United States Patent 11,078,247 (RNA ENCODING A THERAPEUTIC PROTEIN) - sequence listing, part 12

SEQ ID NO: 22996 - RNA, 2403 nt, Artificial Sequence
  SART1__Homo_sapiens__NP_005137
augggcagcagcaagaagcacagaggcgagaaggaggccgccggcaccaccgccgccgccggcaccggcggcgccaccgagcagccccccagacacagagagcacaagaagcacaagcacagaagcggcggcagcggcggcagcggcggcgagagaagaaagagaagcagagagagaggcggcgagagaggcagcggcagaagaggcgccgaggccgaggccagaagcagcacccacggcagagagagaagccaggccgagcccagcgagagaagagugaagagagagaagagagacgacggcuacgaggccgccgccagcagcaagaccagcagcggcgacgccagcagccugagcaucgaggagaccaacaagcugagagccaagcugggccugaagccccuggaggugaacgccaucaagaaggaggccggcaccaaggaggagcccgugaccgccgacgugaucaaccccauggcccugagacagagagaggagcugagagagaagcuggccgccgccaaggagaagagacugcugaaccagaagcugggcaagaucaagacccugggcgaggacgaccccuggcuggacgacaccgccgccuggaucgagagaagcagacagcugcagaaggagaaggaccuggccgagaagagagccaagcugcuggaggagauggaccaggaguucggcgugagcacccugguggaggaggaguucggccagagaagacaggaccuguacagcgccagagaccugcagggccugaccguggagcacgccaucgacagcuucagagagggcgagaccaugauccugacccugaaggacaagggcgugcugcaggaggaggaggacgugcuggugaacgugaaccugguggacaaggagagagccgagaagaacguggagcugagaaagaagaagcccgacuaccugcccuacgccgaggacgagagcguggacgaccuggcccagcagaagcccagaagcauccugagcaaguacgacgaggagcuggagggcgagagaccccacagcuucagacuggagcagggcggcaccgccgacggccugagagagagagagcuggaggagaucagagccaagcugagacugcaggcccagagccugagcaccgugggccccagacuggccagcgaguaccugacccccgaggagauggugaccuucaagaagaccaagagaagagugaagaagaucagaaagaaggagaaggaggugguggugagagccgacgaccugcugccccugggcgaccagacccaggacggcgacuucggcagcagacugagaggcagaggcagaagaagagugagcgagguggaggaggagaaggagcccgugccccagccccugcccagcgacgacaccagaguggagaacauggacaucagcgacgaggaggagggcggcgcccccccccccggcagcccccaggugcuggaggaggacgaggccgagcuggagcugcagaagcagcuggagaagggcagaagacugagacagcugcagcagcugcagcagcugagagacagcggcgagaaggugguggagaucgugaagaagcuggagagcagacagagaggcugggaggaggacgaggaccccgagagaaagggcgccaucguguucaacgccaccagcgaguucugcagaacccugggcgagauccccaccuacggccuggccggcaacagagaggagcaggaggagcugauggacuucgagagagacgaggagagaagcgccaacggcggcagcgagagcgacggcgaggagaacaucggcuggagcaccgugaaccuggacgaggagaagcagcagcaggacuucagcgccagcagcaccaccauccuggacgaggagcccaucgugaacagaggccuggccgccgcccugcugcugugccagaacaagggccugcuggagaccaccgugcagaagguggccagagugaaggcccccaacaagagccugcccagcgccguguacugcaucgaggacaagauggccaucgacgacaaguacagcagaagagaggaguacagaggcuucacccaggacuucaaggagaaggacggcuacaagcccgacgugaagaucgaguacguggacgagaccggcagaaagcugacccccaaggaggccuucagacagcugagccacagauuccacggcaagggcagcggcaagaugaagaccgagagaagaaugaagaagcuggacgaggaggcccugcugaagaagaugagcagcagcgacaccccccugggcaccguggcccugcugcaggagaagcagaaggcccagaagacccccuacaucgugcugagcggcagcggcaagagcaugaacgccaacaccaucaccaaguaa

SEQ ID NO: 22997 - RNA, 2892 nt, Artificial Sequence
  SART3__Homo_sapiens__NP_055521
auggccaccgccgccgagaccagcgccagcgagcccgaggccgagagcaaggccggccccaaggccgacggcgaggaggacgaggugaaggccgccagaaccagaagaaaggugcugagcagagccguggccgccgccaccuacaagaccaugggccccgccugggaccagcaggaggagggcgugagcgagagcgacggcgacgaguacgccauggccagcagcgccgagagcagccccggcgaguacgagugggaguacgacgaggaggaggagaagaaccagcuggagaucgagagacuggaggagcagcugagcaucaacguguacgacuacaacugccacguggaccugaucagacugcugagacuggagggcgagcugaccaaggugagaauggccagacagaagaugagcgagaucuucccccugaccgaggagcuguggcuggaguggcugcacgacgagaucagcauggcccaggacggccuggacagagagcacguguacgaccuguucgagaaggccgugaaggacuacaucugccccaacaucuggcuggaguacggccaguacagcgugggcggcaucggccagaagggcggccuggagaaggugagaagcguguucgagagagcccugagcagcgugggccugcacaugaccaagggccuggcccugugggaggccuacagagaguucgagagcgccaucguggaggccgccagacuggagaaggugcacagccuguucagaagacagcuggccaucccccuguacgacauggaggccaccuucgccgaguacgaggaguggagcgaggaccccauccccgagagcgugauccagaacuacaacaaggcccugcagcagcuggagaaguacaagcccuacgaggaggcccugcugcaggccgaggcccccagacuggccgaguaccaggccuacaucgacuucgagaugaagaucggcgaccccgccagaauccagcugaucuucgagagagcccugguggagaacugccuggugcccgaccuguggaucagauacagccaguaccuggacagacagcugaaggugaaggaccuggugcugagcgugcacaacagagccaucagaaacugccccuggaccguggcccuguggagcagauaccugcuggccauggagagacacggcguggaccaccaggugaucagcgugaccuucgagaaggcccugaacgccggcuucauccaggccaccgacuacguggagaucuggcaggccuaccuggacuaccugagaagaagaguggacuucaagcaggacagcagcaaggagcuggaggagcugagagccgccuucaccagagcccuggaguaccugaagcaggagguggaggagagauucaacgagagcggcgaccccagcugcgugaucaugcagaacugggccagaaucgaggccagacugugcaacaacaugcagaaggccagagagcugugggacagcaucaugaccagaggcaacgccaaguacgccaacauguggcuggaguacuacaaccuggagagagcccacggcgacacccagcacugcagaaaggcccugcacagagccgugcagugcaccagcgacuaccccgagcacgugugcgaggugcugcugaccauggagagaaccgagggcagccuggaggacugggacaucgccgugcagaagaccgagaccagacuggccagagugaacgagcagagaaugaaggccgccgagaaggaggccgcccuggugcagcaggaggaggagaaggccgagcagagaaagagagccagagccgagaagaaggcccugaagaagaagaagaagaucagaggccccgagaagagaggcgccgacgaggacgacgagaaggaguggggcgacgacgaggaggagcagcccagcaagagaagaagaguggagaacagcauccccgccgccggcgagacccagaacguggagguggccgccggccccgccggcaagugcgccgccguggacguggagccccccagcaagcagaaggagaaggccgccagccugaagagagacaugcccaaggugcugcacgacagcagcaaggacagcaucaccguguucgugagcaaccugcccuacagcaugcaggagcccgacaccaagcugagaccccuguucgaggccugcggcgagguggugcagaucagacccaucuucagcaacagaggcgacuucagaggcuacugcuacguggaguucaaggaggagaagagcgcccugcaggcccuggagauggacagaaagagcguggagggcagacccauguucgugagccccugcguggacaagagcaagaaccccgacuucaagguguucagauacagcaccagccuggagaagcacaagcuguucaucagcggccugcccuucagcugcaccaaggaggagcuggaggagaucugcaaggcccacggcaccgugaaggaccugagacuggugaccaacagagccggcaagcccaagggccuggccuacguggaguacgagaacgagagccaggccagccaggccgugaugaagauggacggcaugaccaucaaggagaacaucaucaagguggccaucagcaaccccccccagagaaaggugcccgagaagcccgagaccagaaaggcccccggcggccccaugcugcugccccagaccuacggcgccagaggcaagggcagaacccagcugagccugcugcccagagcccugcagagacccagcgccgccgccccccaggccgagaacggccccgccgccgcccccgccguggccgcccccgccgccaccgaggcccccaagaugagcaacgccgacuucgccaagcuguuccugagaaaguaa

SEQ ID NO: 22998 - RNA, 3744 nt, Artificial Sequence
  SASH1__Homo_sapiens__NP_056093
auggaggacgccggcgccgccggccccggccccgagcccgagcccgagcccgagcccgagcccgagcccgcccccgagcccgagcccgagcccaagcccggcgccggcaccagcgaggccuucagcagacuguggaccgacgugaugggcauccuggacggcagccugggcaacaucgacgaccuggcccagcaguacgccgacuacuacaacaccugcuucagcgacgugugcgagagaauggaggagcugagaaagagaagagugagccaggaccuggagguggagaagcccgacgccagccccaccagccugcagcugagaagccagaucgaggagagccugggcuucugcagcgccgugagcacccccgagguggagagaaagaacccccugcacaagagcaacagcgaggacagcagcgugggcaagggcgacuggaagaagaagaacaaguacuucuggcagaacuucagaaagaaccagaagggcaucaugagacagaccagcaagggcgaggacgugggcuacguggccagcgagaucaccaugagcgacgaggagagaauccagcugaugaugauggugaaggagaagaugaucaccaucgaggaggcccuggccagacugaaggaguacgaggcccagcacagacagagcgccgcccuggaccccgccgacuggcccgacggcagcuaccccaccuucgacggcagcagcaacugcaacagcagagagcagagcgacgacgagaccgaggagagcgugaaguucaagagacugcacaagcuggugaacagcaccagaagagugagaaagaagcugaucagaguggaggagaugaagaagcccagcaccgagggcggcgaggagcacguguucgagaacagccccgugcuggacgagagaagcgcccuguacagcggcgugcacaagaagccccuguucuucgacggcagccccgagaagccccccgaggacgacagcgacagccugaccaccagccccagcagcagcagccuggacaccuggggcgccggcagaaagcuggugaagaccuucagcaagggcgagagcagaggccugaucaagccccccaagaagaugggcaccuucuucagcuaccccgaggaggagaaggcccagaaggugagcagaagccugaccgagggcgagaugaagaagggccugggcagccugagccacggcagaaccugcagcuucggcggcuucgaccugaccaacagaagccugcacgugggcagcaacaacagcgaccccaugggcaaggagggcgacuucguguacaaggaggugaucaagagccccaccgccagcagaaucagccugggcaagaaggugaagagcgugaaggagaccaugagaaagagaaugagcaagaaguacagcagcagcgugagcgagcaggacagcggccuggacggcaugcccggcagccccccccccagccagcccgaccccgagcaccuggacaagcccaagcugaaggccggcggcagcguggagagccugagaagcagccugagcggccagagcagcaugagcggccagaccgugagcaccaccgacagcagcaccagcaacagagagagcgugaagagcgaggacggcgacgacgaggagccccccuacagaggccccuucugcggcagagccagagugcacaccgacuucacccccagccccuacgacaccgacagccugaagcugaagaagggcgacaucaucgacaucaucagcaagccccccaugggcaccuggaugggccugcugaacaacaaggugggcaccuucaaguucaucuacguggacgugcugagcgaggacgaggagaagcccaagagacccaccagaagaagaagaaagggcagacccccccagcccaagagcguggaggaccugcuggacagaaucaaccugaaggagcacaugcccaccuuccuguucaacggcuacgaggaccuggacaccuucaagcugcuggaggaggaggaccuggacgagcugaacaucagagaccccgagcacagagccgugcugcugaccgccguggagcugcugcaggaguacgacagcaacagcgaccagagcggcagccaggagaagcugcugguggacagccagggccugagcggcugcagccccagagacagcggcugcuacgagagcagcgagaaccuggagaacggcaagaccagaaaggccagccugcugagcgccaagagcagcaccgagcccagccugaagagcuucagcagaaaccagcugggcaacuaccccacccugccccugaugaagagcggcgacgcccugaagcagggccaggaggagggcagacugggcggcggccuggcccccgacaccagcaagagcugcgacccccccggcgugaccggccugaacaagaacagaagaagccugcccgugagcaucugcagaagcugcgagacccuggagggcccccagaccguggacaccuggcccagaagccacagccuggacgaccugcagguggagcccggcgccgagcaggacgugcccaccgaggugaccgagccccccccccagaucgugcccgaggugccccagaagaccaccgccagcagcaccaaggcccagccccuggagcaggacagcgccguggacaacgcccugcugcugacccagagcaagagauucagcgagccccagaagcugaccaccaagaagcuggagggcagcaucgccgccagcggcagaggccugagccccccccagugccugcccagaaacuacgacgcccagccccccggcgccaagcacggccuggccagaaccccccuggagggccacagaaagggccacgaguucgagggcacccaccacccccugggcaccaaggagggcguggacgccgagcagagaaugcagcccaagauccccagccagcccccccccgugcccgccaagaagagcagagagagacuggccaacggccugcaccccgugcccaugggccccagcggcgcccugcccagccccgacgcccccugccugcccgugaagagaggcagccccgccagccccaccagccccagcgacugcccccccgcccuggcccccagaccccugagcggccaggcccccggcagcccccccagcaccagacccccccccuggcugagcgagcugcccgagaacaccagccugcaggagcacggcgugaagcugggccccgcccugaccagaaaggugagcugcgccagaggcguggaccuggagacccugaccgagaacaagcugcacgccgagggcaucgaccugaccgaggagcccuacagcgacaagcacggcagaugcggcauccccgaggcccuggugcagagauacgccgaggaccuggaccagcccgagagagacguggccgccaacauggaccagaucagagugaagcagcugagaaagcagcacagaauggccauccccagcggcggccugaccgagaucugcagaaagcccgugagccccggcugcaucagcagcgugagcgacuggcugaucagcaucggccugcccauguacgccggcacccugagcaccgccggcuucagcacccugagccaggugcccagccugagccacaccugccugcaggaggccggcaucaccgaggagagacacaucagaaagcugcugagcgccgccagacuguucaagcugccccccggccccgaggccauguaa

SEQ ID NO: 22999 - RNA, 1143 nt, Artificial Sequence
  SASH3__Homo_sapiens__NP_061863
augcugagaagaaagcccagcaacgccagcgagaaggagcccacccagaagaagaagcugagccugcagagaagcagcagcuucaaggacuucgccaagagcaagcccagcagccccguggugagcgagaaggaguucaaccuggacgacaacauccccgaggacgacagcggcgugcccacccccgaggacgccggcaagagcggcaagaagcugggcaagaaguggagagccgugaucagcagaaccaugaacagaaagaugggcaagaugauggugaaggcccugagcgaggagauggccgacacccuggaggagggcagcgccagccccaccagccccgacuacagccuggacagccccggccccgagaagauggcccuggccuucagcgagcaggaggagcacgagcugcccgugcugagcagacaggccagcaccggcagcgagcugugcagccccagccccggcagcggcagcuucggcgaggagccccccgccccccaguacaccggccccuucugcggcagagccagagugcacaccgacuucacccccagccccuacgaccacgacagccugaagcugcagaagggcgacgugauccagaucaucgagaagccccccgugggcaccuggcugggccugcugaacggcaaggugggcagcuucaaguucaucuacguggacgugcugcccgaggaggccgugggccacgccagacccagcagaagacagagcaagggcaagagacccaagcccaagacccugcacgagcugcuggagagaaucggccuggaggagcacaccagcacccugcugcugaacggcuaccagacccuggaggacuucaaggagcugagagagacccaccugaacgagcugaacaucauggacccccagcacagagccaagcugcugaccgccgccgagcugcugcuggacuacgacaccggcagcgaggaggccgaggagggcgccgagagcagccaggagcccguggcccacaccgugagcgagcccaagguggacauccccagagacagcggcugcuucgagggcagcgagagcggcagagacgacgccgagcuggccggcaccgaggagcagcugcagggccugagccuggccggcgcccccuaa

SEQ ID NO: 23000 - RNA, 516 nt, Artificial Sequence
  SAT1__Homo_sapiens__NP_002961
auggccaaguucgugaucagacccgccaccgccgccgacugcagcgacauccugagacugaucaaggagcuggccaaguacgaguacauggaggagcaggugauccugaccgagaaggaccugcuggaggacggcuucggcgagcaccccuucuaccacugccugguggccgaggugcccaaggagcacuggacccccgagggccacagcaucgugggcuucgccauguacuacuucaccuacgaccccuggaucggcaagcugcuguaccuggaggacuucuucgugaugagcgacuacagaggcuucggcaucggcagcgagauccugaagaaccugagccagguggccaugagaugcagaugcagcagcaugcacuuccugguggccgaguggaacgagcccagcaucaacuucuacaagagaagaggcgccagcgaccugagcagcgaggagggcuggagacuguucaagaucgacaaggaguaccugcugaagauggccaccgaggaguaa

SEQ ID NO: 23001 - RNA, 513 nt, Artificial Sequence
  SAT2__Homo_sapiens__NP_597998
auggccagcgugagaaucagagaggccaaggagggcgacugcggcgacauccugagacugaucagagagcuggccgaguucgagaagcugagcgaccaggugaagaucagcgaggaggcccugagagccgacggcuucggcgacaaccccuucuaccacugccugguggccgagauccugcccgcccccggcaagcugcugggccccugcguggugggcuacggcaucuacuacuucaucuacagcaccuggaagggcagaaccaucuaccuggaggacaucuacgugaugcccgaguacagaggccagggcaucggcagcaagaucaucaagaagguggccgagguggcccuggacaagggcugcagccaguucagacuggccgugcuggacuggaaccagagagccauggaccuguacaaggcccugggcgcccaggaccugaccgaggccgagggcuggcacuucuucugcuuccagggcgaggccaccagaaagcuggccggcaaguaa

SEQ ID NO: 23002 - RNA, 2388 nt, Artificial Sequence
  SATB1__Homo_sapiens__NP_001182399
auggaccaccugaacgaggccacccagggcaaggagcacagcgagaugagcaacaacgugagcgaccccaagggcccccccgccaagaucgccagacuggagcagaacggcagcccccugggcagaggcagacugggcagcaccggcgccaagaugcagggcgugccccugaagcacagcggccaccugaugaagaccaaccugagaaagggcaccaugcugcccguguucugcgugguggagcacuacgagaacgccaucgaguacgacugcaaggaggagcacgccgaguucgugcuggugagaaaggacaugcuguucaaccagcugaucgagauggcccugcugagccugggcuacagccacagcagcgccgcccaggccaagggccugauccaggugggcaaguggaaccccgugccccugagcuacgugaccgacgcccccgacgccaccguggccgacaugcugcaggacguguaccacguggugacccugaagauccagcugcacagcugccccaagcuggaggaccugccccccgagcaguggagccacaccaccgugagaaacgcccugaaggaccugcugaaggacaugaaccagagcagccuggccaaggagugcccccugagccagagcaugaucagcagcaucgugaacagcaccuacuacgccaacgugagcgccgccaagugccaggaguucggcagaugguacaagcacuucaagaagaccaaggacaugaugguggagauggacagccugagcgagcugagccagcagggcgccaaccacgugaacuucggccagcagcccgugcccggcaacaccgccgagcagccccccagccccgcccagcugagccacggcagccagcccagcgugagaaccccccugcccaaccugcaccccggccuggugagcacccccaucagcccccagcuggugaaccagcagcuggugauggcccagcugcugaaccagcaguacgccgugaacagacugcuggcccagcagagccugaaccagcaguaccugaaccaccccccccccgugagcagaagcaugaacaagccccuggagcagcaggugagcaccaacaccgaggugagcagcgagaucuaccagugggugagagacgagcugaagagagccggcaucagccaggccguguucgccagaguggccuucaacagaacccagggccugcugagcgagauccugagaaaggaggaggaccccaagaccgccagccagagccugcuggugaaccugagagccaugcagaacuuccugcagcugcccgaggccgagagagacagaaucuaccaggacgagagagagagaagccugaacgccgccagcgccaugggccccgccccccugaucagcaccccccccagcagacccccccaggugaagaccgccaccaucgccaccgagagaaacggcaagcccgagaacaacaccaugaacaucaacgccagcaucuacgacgagauccagcaggagaugaagagagccaaggugagccaggcccuguucgccaagguggccgccaccaagagccagggcuggcugugcgagcugcugagauggaaggaggaccccagccccgagaacagaacccugugggagaaccugagcaugaucagaagauuccugagccugccccagcccgagagagacgccaucuacgagcaggagagcaacgccgugcaccaccacggcgacagacccccccacaucauccacgugcccgccgagcagauccagagccccagccccaccacccugggcaagggcgagagcagaggcguguuccugcccggccugcccacccccgcccccuggcugggcgccgccccccagcagcagcagcagcagcagcagcagcagcagcagcagcagcaggcccccccccccccccagccccagcagcagccccagaccggccccagacugccccccagacagcccaccguggccagccccgccgagagcgacgaggagaacagacagaagaccagacccagaaccaagaucagcguggaggcccugggcauccugcagagcuucauccaggacgugggccuguaccccgacgaggaggccauccagacccugagcgcccagcuggaccugcccaaguacaccaucaucaaguucuuccagaaccagagauacuaccugaagcaccacggcaagcugaaggacaacagcggccuggagguggacguggccgaguacaaggaggaggagcugcugaaggaccuggaggagagcgugcaggacaagaacaccaacacccuguucagcgugaagcuggaggaggagcugagcguggagggcaacaccgacaucaacaccgaccugaaggacuaa

SEQ ID NO: 23003 - RNA, 2028 nt, Artificial Sequence
  SATB2__Homo_sapiens__XP_005246453
augauccccguguucugcgugguggagcagcuggacggcagccuggaguacgacaacagagaggagcacgccgaguucgugcuggugagaaaggacgugcuguucagccagcugguggagaccgcccugcuggcccugggcuacagccacagcagcgccgcccaggcccagggcaucaucaagcugggcagauggaacccccugccccugagcuacgugaccgacgcccccgacgccaccguggccgacaugcugcaggacguguaccacguggugacccugaagauccagcugcagagcugcagcaagcuggaggaccugcccgccgagcaguggaaccacgccaccgugagaaacgcccugaaggagcugcugaaggagaugaaccagagcacccuggccaaggagugcccccugagccagagcaugaucagcagcaucgugaacagcaccuacuacgccaacgugagcgccaccaagugccaggaguucggcagaugguacaagaaguacaagaagaucaagguggagagaguggagagagagaaccugagcgacuacugcgugcugggccagagacccaugcaccugcccaacaugaaccagcuggccagccugggcaagaccaacgagcagagcccccacagccagauccaccacagcacccccaucagaaaccaggugcccgcccugcagcccaucaugagccccggccugcugagcccccagcugagcccccagcuggugagacagcagaucgccauggcccaccugaucaaccagcagaucgccgugagcagacugcuggcccaccagcacccccaggccaucaaccagcaguuccugaaccacccccccauccccagagccgugaagcccgagcccaccaacagcagcguggaggugagccccgacaucuaccagcaggugagagacgagcugaagagagccagcgugagccaggccguguucgccagaguggccuucaacagaacccagggccugcugagcgagauccugagaaaggaggaggaccccagaaccgccagccagagccugcuggugaaccugagagccaugcagaacuuccugaaccugcccgagguggagagagacagaaucuaccaggacgagagagagagaagcaugaaccccaacgugagcauggugagcagcgccagcagcagccccagcagcagcagaaccccccaggccaagaccagcacccccaccaccgaccugcccaucaagguggacggcgccaacaucaacaucaccgccgccaucuacgacgagauccagcaggagaugaagagagccaaggugagccaggcccuguucgccaagguggccgccaacaagagccagggcuggcugugcgagcugcugagauggaaggagaaccccagccccgagaacagaacccugugggagaaccugugcaccaucagaagauuccugaaccugccccagcacgagagagacgugaucuacgaggaggagagcagacaccaccacagcgagagaaugcagcacguggugcagcugccccccgagcccgugcaggugcugcacagacagcagagccagcccgccaaggagagcagcccccccagagaggaggccccccccccccccccccccaccgaggacagcugcgccaagaagcccagaagcagaaccaagaucagccuggaggcccugggcauccugcagagcuucauccacgacgugggccuguaccccgaccaggaggccauccacacccugagcgcccagcuggaccugcccaagcacaccaucaucaaguucuuccagaaccagagauaccacgugaagcaccacggcaagcugaaggagcaccugggcagcgccguggacguggccgaguacaaggacgaggagcugcugaccgagagcgaggagaacgacagcgaggagggcagcgaggagauguacaagguggaggccgaggaggagaacgccgacaagagcaaggccgcccccgccgagaucgaccagagauaa

SEQ ID NO: 23004 - RNA, 1899 nt, Artificial Sequence
  SATL1__Homo_sapiens__NP_001012998
augaaccagagcggcaccaaccagagcagccugagcgacagcaaccaggccggcaucaaccagcccagcaccaacagccugggcaugaaccagauggacaugaaccagggcagcgccagccuguacgagaugaaccagguggacaugaagcagcccagcaugagccaggccggcaugagacagagcggcaccaaccugcccgacaucaaccagcccgacaugaagcagcccgacaccuggcagcugggcagaagccagcccggcaugcugcagcaggagcugagccagcuggugcugagcaaggccggcaucagccagcccgaccccagccagcccggccccagccagagcggccccagccagagcagaaugagacagaucggcaccaaccagagcggcaugagccagcccgugaugcagcagcuggacagccagagcggcggcagccagcccagcaugagacaggugggcaccagccagcugggcaccagccagaucggcaugagccagcccggcaccuggcagaccggccugagccagcccgugcugagacagcccaacaugagcccccccggcauguggcagcccggcgugcagcagcccggcaucagccagcaggugcccagccaccccgacaugagccagcccggcaugagccagcaggugcccagccagcccggcaucagacagcccgacaccagccagagcugcaagaaccagaccgacaugagccagcccgacgccaaccagagcagccugagcgacagcaaccagaccggcaucauccagcccagccccagccugcugggcaugaaccagauggacaugaaccaguggagcgccagccuguacgagaugaaccagguggacaugaagcagcccagcaugagccaggccggcaugagacagagcggcaccaaccugcccgacaucaaccagcccggcaugaagcagcccggcaccuggcagcugggcagaagccagcccggcauguggccccagagccugagcgagcuggugcugagcgaggccagcaucagccagcccggccccccccagagagcccccagccagagcggccccagacagagcagcaccagccaggccggcaccaaccagagcggcaucagccagcccgugauguggcagcuggacaugagacagagcggcggcagccagcccagcaugagacaggugggcaccagccagagcggcaccagccagaucggcaugagccagcccggcaccuggcagaccggccugagccagcccgugcccagacagcccaacaagagcccccccggcauguggcagagaggcauguggcagcccggcaugagccagcaggugcccagccagcugggcaugagacagcccggcaccagccagagcagcaagaaccagaccggcaugagccaccccggcagaggccagcccggcaucugggagcccggccccagccagcccggccugagccagcaggaccugaaccagcuggugcugagccagcccggccugagccagcccggcagaagccagcccagcgugagccagaugggcaugagacagaccagcauggacuacuuccagaucagacacgccgaggccggcgacugccccgagauccugagacugaucaaggagcuggccgccugcgagaacaugcuggacgccauggagcugaccgccgccgaccugcugagagacggcuucggcgacaacccccuguucuacugccugaucgccgaggugaacgaccagcagaagcccagcggcaagcugaccgugggcuucgccauguacuacuucaccuacgacagcuggaccggcaaggugcuguaccuggaggacuucuacgugacccaggccuaccaggacagccaccacaacagcauguaa

SEQ ID NO: 23005 - RNA, 1152 nt, Artificial Sequence
  SAV1__Homo_sapiens__NP_068590
augcugagcagaaagaagaccaagaacgaggugagcaagcccgccgaggugcagggcaaguacgugaagaaggagaccagcccccugcugagaaaccugaugcccagcuucaucagacacggccccaccauccccagaagaaccgacaucugccugcccgacagcagccccaacgccuucagcaccagcggcgacguggugagcagaaaccagagcuuccugagaacccccauccagagaaccccccacgagaucaugagaagagagagcaacagacugagcgcccccagcuaccuggccagaagccuggccgacgugcccagagaguacggcagcagccagagcuucgugaccgaggugagcuucgccguggagaacggcgacagcggcagcagauacuacuacagcgacaacuucuucgacggccagagaaagagaccccugggcgacagagcccacgaggacuacagauacuacgaguacaaccacgaccuguuccagagaaugccccagaaccagggcagacacgccagcggcaucggcagaguggccgccaccagccugggcaaccugaccaaccacggcagcgaggaccugccccugccccccggcuggagcguggacuggaccaugagaggcagaaaguacuacaucgaccacaacaccaacaccacccacuggagccacccccuggagagagagggccugccccccggcugggagagaguggagagcagcgaguucggcaccuacuacguggaccacaccaacaagaaggcccaguacagacaccccugcgcccccagcgugcccagauacgaccagcccccccccgugaccuaccagccccagcagaccgagagaaaccagagccugcuggugcccgccaaccccuaccacaccgccgagauccccgacuggcugcagguguacgccagagcccccgugaaguacgaccacauccugaagugggagcuguuccagcuggccgaccuggacaccuaccagggcaugcugaagcugcuguucaugaaggagcuggagcagaucgugaagauguacgaggccuacagacaggcccugcugaccgagcuggagaacagaaagcagagacagcagugguacgcccagcagcacggcaagaacuucuaa

SEQ ID NO: 23006 - RNA, 753 nt, Artificial Sequence
  SBDS__Homo_sapiens__NP_057122
augagcaucuucacccccaccaaccagaucagacugaccaacguggccguggugagaaugaagagagccggcaagagauucgagaucgccugcuacaagaacaagguggugggcuggagaagcggcguggagaaggaccuggacgaggugcugcagacccacagcguguucgugaacgugagcaagggccagguggccaagaaggaggaccugaucagcgccuucggcaccgacgaccagaccgagaucugcaagcagauccugaccaagggcgaggugcaggugagcgacaaggagagacacacccagcuggagcagauguucagagacaucgccaccaucguggccgacaagugcgugaaccccgagaccaagagacccuacaccgugauccugaucgagagagccaugaaggacauccacuacagcgugaagaccaacaagagcaccaagcagcaggcccuggaggugaucaagcagcugaaggagaagaugaagaucgagagagcccacaugagacugagauucauccugcccgugaacgagggcaagaagcugaaggagaagcugaagccccugaucaaggugaucgagagcgaggacuacggccagcagcuggagaucgugugccugaucgaccccggcugcuucagagagaucgacgagcugaucaagaaggagaccaagggcaagggcagccuggaggugcugaaccugaaggacguggaggagggcgacgagaaguucgaguaa

SEQ ID NO: 23007 - RNA, 5682 nt, Artificial Sequence
  SBF1__Homo_sapiens__NP_002963
auggccagacuggccgacuacuucgugcugguggccuucggcccccaccccagaggcagcggcgagggccagggccagauccugcagagauuccccgagaaggacugggaggacaaccccuucccccagggcaucgagcuguucugccagcccagcggcuggcagcugugccccgagagaaacccccccaccuucuucguggccgugcugaccgacaucaacagcgagagacacuacugcgccugccugaccuucugggagcccgccgagcccagccaggagaccaccagaguggaggacgccaccgagagagaggaggagggcgacgagggcggccagacccaccugagccccaccgcccccgcccccagcgcccagcuguucgcccccaagacccuggugcuggugagcagacuggaccacaccgagguguucagaaacagccugggccugaucuacgccauccacguggagggccugaacgugugccuggagaacgugaucggcaaccugcugaccugcaccgugccccuggccggcggcagccagagaaccaucagccugggcgccggcgacagacaggugauccagaccccccuggccgacagccugcccgugagcagaugcagcguggcccugcuguucagacagcugggcaucaccaacgugcugagccuguucugcgccgcccugaccgagcacaaggugcuguuccugagcagaagcuaccagagacuggccgacgccugcagaggccugcuggcccugcuguucccccugagauacagcuucaccuacgugcccauccugcccgcccagcugcuggaggugcugagcacccccacccccuucaucaucggcgugaacgccgccuuccaggccgagacccaggagcugcuggacgugaucguggccgaccuggacggcggcaccgugaccauccccgagugcgugcacauccccccccugcccgagccccugcagagccagacccacagcgugcugagcauggugcuggaccccgagcuggagcuggccgaccuggccuuccccccccccaccaccagcaccagcagccugaagaugcaggacaaggagcugagagccguguuccugagacuguucgcccagcugcugcagggcuacagauggugccugcacguggugagaauccaccccgagcccgugaucagauuccacaaggccgccuuccugggccagagaggccugguggaggacgacuuccugaugaaggugcuggagggcauggccuucgccggcuucgugagcgagagaggcgugcccuacagacccaccgaccuguucgacgagcugguggcccacgagguggccagaaugagagccgacgagaaccacccccagagagugcugagacacgugcaggagcuggccgagcagcuguacaagaacgagaaccccuaccccgccguggccaugcacaaggugcagagacccggcgagagcagccaccugagaagagugcccagacccuuccccagacuggacgagggcaccgugcaguggaucguggaccaggccgccgccaagaugcagggcgccccccccgccgugaaggccgagagaagaaccaccgugcccagcggcccccccaugaccgccauccuggagagaugcagcggccugcacgugaacagcgccagaagacuggagguggugagaaacugcaucagcuacguguucgagggcaagaugcuggaggccaagaagcugcugcccgccgugcugagagcccugaagggcagagccgccagaagaugccuggcccaggagcugcaccugcacgugcagcagaacagagccgugcuggaccaccagcaguucgacuucguggugagaaugaugaacugcugccugcaggacugcaccagccuggacgagcacggcaucgccgccgcccugcugccccuggugaccgccuucugcagaaagcugagccccggcgugacccaguucgccuacagcugcgugcaggagcacgugguguggagcaccccccaguucugggaggccauguucuacggcgacgugcagacccacaucagagcccuguaccuggagcccaccgaggaccuggcccccgcccaggaggugggcgaggcccccagccaggaggacgagagaagcgcccuggacguggccagcgagcagagaagacuguggcccacccugagcagagagaagcagcaggagcuggugcagaaggaggagagcaccguguucagccaggccauccacuacgccaacagaaugagcuaccugcugcugccccuggacagcagcaagagcagacugcugagagagagagccggccugggcgaccuggagagcgccagcaacagccuggugaccaacagcauggccggcagcguggccgagagcuacgacaccgagagcggcuucgaggacgccgagaccugcgacguggccggcgccguggugagauucaucaacagauucguggacaaggugugcaccgagagcggcgugaccagcgaccaccugaagggccugcacgugauggugcccgacaucgugcagaugcacaucgagacccuggaggccgugcagagagagagcagaagacugccccccauccagaagcccaagcugcugagacccagacugcugcccggcgaggagugcgugcuggacggccugagaguguaccugcugcccgacggcagagaggagggcgccggcggcagcgccggcggccccgcccugcugcccgccgagggcgccguguuccugaccaccuacagagugaucuucaccggcaugcccaccgacccccuggugggcgagcaggugguggugagaagcuuccccguggccgcccugaccaaggagaagagaaucagcgugcagacccccguggaccagcugcugcaggacggccugcagcugagaagcugcaccuuccagcugcugaagauggccuucgacgaggaggugggcagcgacagcgccgagcuguucagaaagcagcugcacaagcugagauacccccccgacaucagagccaccuucgccuucacccugggcagcgcccacacccccggcagaccccccagagugaccaaggacaagggccccagccugagaacccugagcagaaaccuggugaagaacgccaagaagaccaucggcagacagcacgugaccagaaagaaguacaacccccccagcugggagcacagaggccagcccccccccgaggaccaggaggacgagaucagcgugagcgaggagcuggagcccagcacccugacccccagcagcgcccugaagcccagcgacagaaugaccaugagcagccugguggagagagccugcugcagagacuaccagagacugggccugggcacccugagcagcagccugagcagagccaagagcgagcccuucagaaucagccccgugaacagaauguacgccaucugcagaagcuaccccggccugcugaucgugccccagagcgugcaggacaacgcccugcagagagugagcagaugcuacagacagaacagauuccccguggugugcuggagaagcggcagaagcaaggccgugcugcugagaagcggcggccugcacggcaagggcguggugggccuguucaaggcccagaacgcccccagccccggccagagccaggccgacagcagcagccuggagcaggagaaguaccugcaggccguggugagcagcaugcccagauacgccgacgccagcggcagaaacacccugagcggcuucagcagcgcccacaugggcagccacgugcccagccccagagccagagugaccacccugagcaaccccauggccgccagcgccagcagaagaaccgcccccagaggcaaguggggcagcgugagaaccagcggcagaagcagcggccugggcaccgacgugggcagcagacuggccggcagagacgcccuggcccccccccaggccaacggcggcccccccgaccccggcuuccugagaccccagagagccgcccuguacauccugggcgacaaggcccagcugaagggcgugagaagcgacccccugcagcagugggagcuggugcccaucgagguguucgaggccagacaggugaaggccagcuucaagaagcugcugaaggccugcgugcccggcugccccgccgccgagcccagccccgccagcuuccugagaagccuggaggacagcgaguggcugauccagauccacaagcugcugcaggugagcgugcuggugguggagcugcuggacagcggcagcagcgugcuggugggccuggaggacggcugggacaucaccacccagguggugagccuggugcagcugcugagcgaccccuucuacagaacccuggagggcuucagacugcugguggagaaggaguggcugagcuucggccacagauucagccacagaggcgcccacacccuggccggccagagcagcggcuucacccccguguuccugcaguuccuggacugcgugcaccaggugcaccugcaguuccccauggaguucgaguucagccaguucuaccugaaguuccugggcuaccaccacgugagcagaagauucagaaccuuccugcuggacagcgacuacgagagaaucgagcugggccugcuguacgaggagaagggcgagagaagaggccaggugcccugcagaagcgugugggaguacguggacagacugagcaagagaacccccguguuccacaacuacauguacgcccccgaggacgccgaggugcugagacccuacagcaacgugagcaaccugaaggugugggacuucuacaccgaggagacccuggccgagggcccccccuacgacugggagcuggcccagggcccccccgagccccccgaggaggagagaagcgacggcggcgccccccagagcagaagaagagugguguggcccugcuacgacagcugccccagagcccagcccgacgccaucagcagacugcuggaggagcugcagagacuggagaccgagcugggccagcccgccgagagauggaaggacaccugggacagagugaaggccgcccagagacuggagggcagacccgacggcagaggcacccccagcagccugcuggugagcaccgccccccaccacagaagaagccugggcguguaccugcaggagggccccgugggcagcacccugagccugagccuggacagcgaccagagcagcggcagcaccaccagcggcagcagacaggccgccagaagaagcaccagcacccuguacagccaguuccagaccgccgagagcgagaacagaagcuacgagggcacccuguacaagaagggcgccuucaugaagcccuggaaggccagaugguucgugcuggacaagaccaagcaccagcugagauacuacgaccacagaguggacaccgagugcaagggcgugaucgaccuggccgagguggaggccguggcccccggcacccccaccaugggcgcccccaagaccguggacgagaaggccuucuucgacgugaagaccaccagaagaguguacaacuucugcgcccaggacgugcccagcgcccagcaguggguggacagaauccagagcugccugagcgacgccuaa

SEQ ID NO: 23008 - RNA, 5550 nt, Artificial Sequence
  SBF2__Homo_sapiens__NP_112224
auggccagacuggccgacuacuucaucguggugggcuacgaccacgagaagcccggcagcggcgagggccugggcaagaucauccagagauucccccagaaggacugggacgacacccccuucccccagggcaucgagcuguucugccagcccggcggcuggcagcugagcagagagagaaagcagcccaccuucuucgugguggugcugaccgacaucgacagcgacagacacuacugcagcugccugaccuucuacgaggccgagaucaaccugcagggcaccaagaaggaggagaucgagggcgaggccaaggugagcggccugauccagcccgccgagguguucgcccccaagagccuggugcuggugagcagacuguacuaccccgagaucuucagagccugccugggccugaucuacaccguguacguggacagccugaacgugagccuggagagccugaucgccaaccugugcgccugccuggugcccgccgccggcggcagccagaagcuguucagccugggcgccggcgacagacagcugauccagaccccccugcacgacagccugcccaucaccggcaccagcguggcccugcuguuccagcagcugggcauccagaacgugcugagccuguucugcgccgugcugaccgagaacaaggugcuguuccacagcgccagcuuccagagacugagcgacgccugcagagcccuggagagccugauguucccccugaaguacagcuaccccuacauccccauccugcccgcccagcugcuggaggugcugagcagccccacccccuucaucaucggcgugcacagcguguucaagaccgacgugcacgagcugcuggacgugaucaucgccgaccuggacggcggcaccaucaagauccccgagugcauccaccugagcagccugcccgagccccugcugcaccagacccagagcgcccugagccugauccugcaccccgaccuggagguggccgaccacgccuuccccccccccagaaccgcccugagccacagcaagaugcuggacaaggaggugagagccguguuccugagacuguucgcccagcuguuccagggcuacagaagcugccugcagcugaucagaauccacgccgagcccgugauccacuuccacaagaccgccuuccugggccagagaggccugguggagaacgacuuccugaccaaggugcugagcggcauggccuucgccggcuucgugagcgagagaggcccccccuacagaagcugcgaccuguucgacgagcugguggccuucgagguggagagaaucaagguggaggagaacaaccccgugaagaugaucaagcacgugagagagcuggccgagcagcuguucaagaacgagaaccccaacccccacauggccuuccagaaggugcccagacccaccgagggcagccaccugagagugcacauccugcccuuccccgagaucaacgaggccagagugcaggagcugauccaggagaacguggccaagaaccagaacgccccccccgccaccagaaucgagaagaagugcguggugcccgccggcccccccguggugagcaucauggacaaggugaccaccguguucaacagcgcccagagacuggagguggugagaaacugcaucagcuucaucuucgagaacaagauccuggagaccgagaagacccugcccgccgcccugagagcccugaagggcaaggccgccagacagugccugaccgacgagcugggccugcacgugcagcagaacagagccauccuggaccaccagcaguucgacuacaucaucagaaugaugaacugcacccugcaggacugcagcagccuggaggaguacaacaucgccgccgcccugcugccccugaccagcgccuucuacagaaagcuggcccccggcgugagccaguucgccuacaccugcgugcaggaccaccccaucuggaccaaccagcaguucugggagaccaccuucuacaacgccgugcaggagcaggugagaagccuguaccugagcgccaaggaggacaaccacgccccccaccugaagcagaaggacaagcugcccgacgaccacuaccaggagaagaccgccauggaccuggccgccgagcagcugagacuguggcccacccugagcaagagcacccagcaggagcuggugcagcacgaggagagcaccguguucagccaggccauccacuucgccaaccugauggugaaccugcuggugccccuggacaccagcaagaacaagcugcugagaaccagcgcccccggcgacugggagagcggcagcaacagcaucgugaccaacagcaucgccggcagcguggccgagagcuacgacaccgagagcggcuucgaggacagcgagaacaccgacaucgccaacagcguggugagauucaucaccagauucaucgacaaggugugcaccgagagcggcgugacccaggaccacaucaagagccugcacugcaugauccccggcaucguggccaugcacaucgagacccuggaggccgugcacagagagagcagaagacugccccccauccagaagcccaagauccugagacccgcccugcugcccggcgaggagaucgugugcgagggccugagagugcugcuggaccccgacggcagagaggaggccaccggcggccugcugggcggcccccagcugcugcccgccgagggcgcccuguuccugaccaccuacagaauccuguucagaggcaccccccacgaccagcuggugggcgagcagaccguggugagaagcuuccccaucgccagcaucaccaaggagaagaagaucaccaugcagaaccagcugcagcagaacaugcaggagggccugcagaucaccagcgccagcuuccagcugaucaagguggccuucgacgaggaggugagccccgaggugguggagaucuucaagaagcagcugaugaaguucagauacccccagagcaucuucagcaccuucgccuucgccgccggccagaccaccccccagaucauccugcccaagcagaaggagaagaacaccagcuucagaaccuucagcaagaccaucgugaagggcgccaagagagccggcaagaugaccaucggcagacaguaccugcugaagaagaagaccggcaccaucguggaggagagagugaacagacccggcuggaacgaggacgacgacgugagcgugagcgacgagagcgagcugcccaccagcaccacccugaaggccagcgagaagagcaccauggagcagcugguggagaaggccugcuucagagacuaccagagacugggccugggcaccaucagcggcagcagcagcagaagcagacccgaguacuucagaaucaccgccagcaacagaauguacagccugugcagaagcuaccccggccugcugguggugccccaggccgugcaggacagcagccugcccagaguggccagaugcuacagacacaacagacugcccguggugugcuggaagaacagcagaagcggcacccugcugcugagaagcggcggcuuccacggcaagggcguggugggccuguucaagagccagaacagcccccaggccgcccccaccagcagccuggagagcagcagcagcaucgagcaggagaaguaccugcaggcccugcugaacgccgugagcgugcaccagaagcugagaggcaacagcacccugaccgugagacccgccuucgcccugagccccggcgugugggccagccugagaagcagcaccagacugaucagcagccccaccagcuucaucgacgugggcgccagacuggccggcaaggaccacagcgccagcuucagcaacagcagcuaccugcagaaccagcugcugaagagacaggccgcccuguacaucuucggcgagaagagccagcugagaaacuucaagguggaguucgcccugaacugcgaguucgugcccguggaguuccacgagaucagacaggugaaggccagcuucaagaagcugaugagagccugcauccccagcaccauccccaccgacagcgaggugaccuuccugaaggcccugggcgacagcgagugguucccccagcugcacagaaucaugcagcuggccgugguggugagcgaggugcuggagaacggcagcagcgugcuggugugccuggaggagggcugggacaucaccgcccaggugaccagccuggugcagcugcugagcgaccccuucuacagaacccuggagggcuuccagaugcugguggagaaggaguggcugagcuucggccacaaguucagccagagaagcagccugacccugaacugccagggcagcggcuucgcccccguguuccugcaguuccuggacugcgugcaccaggugcacaaccaguaccccaccgaguucgaguucaaccuguacuaccugaaguuccuggccuuccacuacgugagcaacagauucaagaccuuccugcuggacagcgacuacgagagacuggagcacggcacccuguucgacgacaagggcgagaagcacgccaagaagggcgugugcaucugggagugcaucgacagaaugcacaagagaagccccaucuucuucaacuaccuguacagcccccuggagaucgaggcccugaagcccaacgugaacgugagcagccugaagaagugggacuacuacaucgaggagacccugagcaccggccccagcuacgacuggaugaugcugacccccaagcacuuccccagcgaggacagcgaccuggccggcgaggccggccccagaagccagagaagaaccguguggcccugcuacgacgacgugagcugcacccagcccgacgcccugaccagccuguucagcgagaucgagaagcuggagcacaagcugaaccaggcccccgagaaguggcagcagcugugggagagagugaccguggaccugaaggaggagcccagaaccgacagaagccagagacaccugagcagaagccccggcaucgugagcaccaaccugcccagcuaccagaagagaagccugcugcaccugcccgacagcagcaugggcgaggagcagaacagcagcaucagccccagcaacggcguggagagaagagccgccacccuguacagccaguacaccagcaagaacgacgagaacagaagcuucgagggcacccuguacaagagaggcgcccugcugaagggcuggaagcccagaugguucgugcuggacgugaccaagcaccagcugagauacuacgacagcggcgaggacaccagcugcaagggccacaucgaccuggccgagguggagauggugauccccgccggccccagcaugggcgcccccaagcacaccagcgacaaggccuucuucgaccugaagaccagcaagagaguguacaacuucugcgcccaggacggccagagcgcccagcaguggauggacaagauccagagcugcaucagcgacgccuaa

SEQ ID NO: 23009 - RNA, 4182 nt, Artificial Sequence
  SBNO1__Homo_sapiens__NP_001161328
augguggagcccggccaggaccugcugcuggccgcccugagcgagagcggcaucagccccaacgaccuguucgacaucgacggcggcgacgccggccuggccacccccaugcccacccccagcgugcagcagagcgugccccugagcgcccuggagcugggccuggagaccgaggccgccgugcccgugaagcaggagcccgagaccgugcccacccccgcccugcugaacgugagacagcagccccccagcaccaccaccuucgugcugaaccagaucaaccaccugcccccccugggcagcaccaucgugaugaccaagaccccccccgugaccaccaacagacagaccaucacccugaccaaguucauccagaccaccgccagcaccagacccagcgugagcgcccccaccgugagaaacgccaugaccagcgcccccagcaaggaccaggugcagcugaaggaccugcugaagaacaacagccugaacgagcugaugaagcugaagccccccgccaacaucgcccagcccguggccaccgccgccaccgacgugagcaacggcaccgugaagaaggagagcagcaacaaggagggcgccagaauguggaucaacgacaugaagaugagaagcuucagccccaccaugaaggugcccguggugaaggaggacgacgagcccgaggaggaggacgaggaggagaugggccacgccgagaccuacgccgaguacaugcccaucaagcugaagaucggccugagacaccccgacgccgugguggagaccagcagccugagcagcgugaccccccccgacgugugguacaagaccagcaucagcgaggagaccaucgacaacggcuggcugagcgcccugcagcuggaggccaucaccuacgccgcccagcagcacgagaccuuccugcccaacggcgacagagccggcuuccugaucggcgacggcgccggcgugggcaagggcagaaccaucgccggcaucaucuacgagaacuaccugcugagcagaaagagagcccugugguucagcgugagcaacgaccugaaguacgacgccgagagagaccugagagacaucggcgccaagaacauccuggugcacagccugaacaaguucaaguacggcaagaucagcagcaagcacaacggcagcgugaagaagggcgugaucuucgccaccuacagcagccugaucggcgagagccagagcggcggcaaguacaagaccagacugaagcagcugcugcacuggugcggcgacgacuucgacggcgugaucguguucgacgagugccacaaggccaagaaccugugccccgugggcagcagcaagcccaccaagaccggccuggccgugcuggagcugcagaacaagcugcccaaggccagagugguguacgccagcgccaccggcgccagcgagcccagaaacauggccuacaugaacagacugggcaucuggggcgagggcacccccuucagagaguucagcgacuucauccaggccguggagagaagaggcgugggcgccauggagaucguggccauggacaugaagcugagaggcauguacaucgccagacagcugagcuucaccggcgugaccuucaagaucgaggaggugcugcugagccagagcuacgugaagauguacaacaaggccgugaagcugugggugaucgccagagagagauuccagcaggccgccgaccugaucgacgccgagcagagaaugaagaagagcauguggggccaguucuggagcgcccaccagagauucuucaaguaccugugcaucgccagcaaggugaagagaguggugcagcuggccagagaggagaucaagaacggcaagugcguggugaucggccugcagagcaccggcgaggccagaacccuggaggcccuggaggagggcggcggcgagcugaacgacuucgugagcaccgccaagggcgugcugcagagccugaucgagaagcacuuccccgcccccgacagaaagaagcuguacagccugcugggcaucgaccugaccgcccccagcaacaacagcagccccagagacagccccugcaaggagaacaagaucaagaagagaaagggcgaggagaucaccagagaggccaagaaggccagaaaggugggcggccugaccggcagcagcagcgacgacagcggcagcgagagcgacgccagcgacaacgaggagagcgacuacgagagcagcaagaacaugagcagcggcgacgacgacgacuucaaccccuuccuggacgagagcaacgaggacgacgagaacgaccccuggcugaucagaaaggaccacaagaagaacaaggagaagaagaagaagaagagcaucgaccccgacagcauccagagcgcccugcuggccagcggccugggcagcaagagacccagcuucagcagcacccccgugaucagccccgcccccaacagcacccccgccaacagcaacaccaacagcaacagcagccugaucaccagccaggacgccguggagagagcccagcagaugaagaaggaccugcuggacaagcuggagaagcuggccgaggaccugccccccaacacccuggacgagcugaucgacgagcugggcggccccgagaacguggccgagaugaccggcagaaagggcagaguggugagcaacgacgacggcagcaucagcuacgagagcagaagcgagcuggacgugcccguggagauccugaacaucaccgagaagcagagauucauggacggcgacaagaacaucgccaucaucagcgaggccgccagcagcggcaucagccugcaggccgacagaagagccaagaaccagagaagaagagugcacaugacccuggagcugcccuggagcgccgacagagccauccagcaguucggcagaacccacagaagcaaccaggugaccgcccccgaguacguguuccugaucagcgagcuggccggcgagcagagauucgccagcaucguggccaagagacuggagagccugggcgcccugacccacggcgacagaagagccaccgagagcagagaccugagcagauucaacuucgacaacaaguacggcagaaacgcccuggagaucgugaugaagagcaucgugaaccuggacagccccauggugagccccccccccgacuaccccggcgaguucuucaaggacgugagacagggccugaucggcgugggccugaucaacguggaggacagaagcggcauccugacccuggacaaggacuacaacaacaucggcaaguuccugaacagaauccugggcauggaggugcaccagcagaacgcccuguuccaguacuucgccgacacccugaccgccguggugcagaacgccaagaagaacggcagauacgacaugggcauccuggaccugggcagcggcgacgagaaggugagaaagagcgacgugaagaaguuccugacccccggcuacagcaccagcggccacguggagcuguacaccaucagcguggagagaggcaugagcugggaggaggccaccaagaucugggccgagcugaccggccccgacgacggcuucuaccugagccugcagaucagaaacaacaagaagaccgccauccuggugaaggaggugaaccccaagaagaagcuguuccugguguacagacccaacaccggcaagcagcugaagcuggagaucuacgccgaccugaagaagaaguacaagaagguggugagcgacgacgcccugaugcacuggcuggaccaguacaacagcagcgccgacaccugcacccacgccuacuggagaggcaacugcaagaaggccagccugggccuggugugcgagaucggccugagaugcagaaccuacuacgugcugugcggcagcgugcugagcguguggaccaagguggagggcgugcuggccagcgugagcggcaccaacgugaagaugcagaucgugagacugagaaccgaggacggccagagaaucgugggccugaucauccccgccaacugcgugagcccccuggugaaccugcugagcaccagcgaccagagccagcagcuggccgugcagcagaagcagcuguggcagcagcaccacccccagagcaucaccaaccugagcaacgccuaa

SEQ ID NO: 23010 - RNA, 3930 nt, Artificial Sequence
  SBNO2__Homo_sapiens__NP_001093592
augagagagccccugcccggcagcgccagcuggggcacccccggcccccccagcgccggcaccaugagccagcugcagcuguggcugcaguucgaggcccugaacaaggacagcagcuacuucgaggacuucagcaacaucagcaucuucagcagcagcguggacagccugagcgacaucguggacacccccgacuuccugcccgccgacagccugaaccaggugagcaccaucugggacgacaaccccgcccccagcacccacgacaagcuguuccagcugagcagacccuucgccggcuucgaggacuuccugcccagccacagcaccccccugcuggugagcuaccaggagcagagcgugcagagccagcccgaggaggaggacgaggccgaggaggaggaggccgaggagcugggccacaccgagaccuacgccgacuacgugcccagcaagagcaagaucggcaagcagcaccccgacagagugguggagaccagcacccugagcagcgugcccccccccgacaucaccuacacccuggcccugcccagcgacagcggcgcccugagcgcccugcagcuggaggccaucaccuacgccugccagcagcacgaggugcugcugcccagcggccagagagccggcuuccugaucggcgacggcgccggcgugggcaagggcagaaccguggccggcgugauccuggagaaccaccugagaggcagaaagaaggcccugugguucagcgugagcaacgaccugaaguacgacgccgagagagaccugagagacaucgaggccaccggcaucgccgugcacgcccugagcaagaucaaguacggcgacaccaccaccagcgagggcgugcuguucgccaccuacagcgcccugaucggcgagagccaggccggcggccagcacagaaccagacugagacagauccuggacuggugcggcgaggccuucgagggcgugaucguguucgacgagugccacaaggccaagaacgccggcagcaccaagaugggcaaggccgugcuggaccugcagaacaagcugccccuggccagagugguguacgccagcgccaccggcgccagcgagcccagaaacaugaucuacaugagcagacugggcaucuggggcgagggcacccccuucagaaacuucgaggaguuccugcacgccaucgagaagagaggcgugggcgccauggagaucguggccauggacaugaaggugagcggcauguacaucgccagacagcugagcuucagcggcgugaccuucagaaucgaggagaucccccuggcccccgccuucgagugcguguacaacagagccgcccugcugugggccgaggcccugaacguguuccagcaggccgccgacuggaucggccuggagagcagaaagagccuguggggccaguucuggagcgcccaccagagauucuucaaguaccugugcaucgccgccaaggugagaagacugguggagcuggccagagaggagcuggccagagacaagugcguggugaucggccugcagagcaccggcgaggccagaaccagagaggugcugggcgagaacgacggccaccugaacugcuucgugagcgccgccgagggcguguuccugagccugauccagaagcacuuccccagcaccaagagaaagagagacagaggcgccggcagcaagagaaagagaagacccagaggcagaggcgccaaggcccccagacuggccugcgagaccgccggcgugaucagaaucagcgacgacagcagcaccgagagcgaccccggccuggacagcgacuucaacagcagccccgagagccugguggacgacgacguggugaucguggacgccgugggccugcccagcgacgacagaggcccccugugccugcugcagagagacccccacggccccggcgugcuggagagaguggagagacugaagcaggaccugcuggacaaggugagaagacugggcagagagcugcccgugaacacccuggacgagcugaucgaccagcugggcggcccccagagaguggccgagaugaccggcagaaagggcagaguggugagcagacccgacggcaccguggccuucgagagcagagccgagcagggccugagcaucgaccacgugaaccugagagagaagcagagauucaugagcggcgagaagcugguggccaucaucagcgaggccagcagcagcggcgugagccugcaggccgacagaagagugcagaaccagagaagaagagugcacaugacccuggagcugcccuggagcgccgacagagccauccagcaguucggcagaacccacagaagcaaccaggugagcgcccccgaguacguguuccugaucagcgagcuggccggcgagagaagauucgccagcaucguggccaagagacuggagagccugggcgcccugacccacggcgacagaagagccaccgagagcagagaccugagcaaguacaacuucgagaacaaguacggcaccagagcccugcacugcgugcugaccaccauccugagccagaccgagaacaaggugcccgugccccagggcuaccccggcggcgugcccaccuucuucagagacaugaagcagggccugcugagcgugggcaucggcggcagagagagcagaaacggcugccuggacguggagaaggacugcagcaucaccaaguuccugaacagaauccugggccuggaggugcacaagcagaacgcccuguuccaguacuucagcgacaccuucgaccaccugaucgagauggacaagagagagggcaaguacgacaugggcauccuggaccuggcccccggcaucgaggagaucuacgaggagagccagcagguguuccuggcccccggccacccccaggacggccaggugguguucuacaagaucagcguggacagaggccugaagugggaggacgccuucgccaagagccuggcccugaccggccccuacgacggcuucuaccugagcuacaaggugagaggcaacaagcccagcugccugcuggccgagcagaacagaggccaguucuucaccguguacaagcccaacaucggcagacagagccagcuggaggcccuggacagccugagaagaaaguuccacagagugaccgccgaggaggccaaggagcccugggagagcggcuacgcccugagccugacccacugcagccacagcgccuggaacagacacugcagacuggcccaggagggcaaggacugccugcagggccugagacugagacaccacuacaugcugugcggcgcccugcugagaguguggggcagaaucgccgccgugauggccgacgugagcagcagcagcuaccugcagaucgugagacugaagaccaaggacagaaagaagcaggugggcaucaagauccccgagggcugcgugagaagagugcugcaggagcugagacugauggacgccgacgugaagagaagacaggcccccgcccugggcugccccgccccccccgcccccagaccccuggcccugcccugcggccccggcgaggugcuggaccugaccuacagcccccccgccgaggccuuccccccccccccccacuucagcuuccccgccccccugagccuggacgccggccccggcguggugccccugggcacccccgacgcccaggccgaccccgccgcccuggcccaccagggcugcgacaucaacuucaaggaggugcuggaggacaugcugagaagccugcacgccggcccccccagcgagggcgcccugggcgagggcgccggcgccggcggcgccgccggcggcggccccgagagacagagcgugauccaguucagcccccccuuccccggcgcccaggccccccuguaa

SEQ ID NO: 23011 - RNA, 1773 nt, Artificial Sequence
  SBSN__Homo_sapiens__NP_001159506
augcaccuggccagacuggugggcagcugcagccugcugcugcugcugggcgcccugagcggcugggccgccagcgacgaccccaucgagaaggugaucgagggcaucaacagaggccugagcaacgccgagagagaggugggcaaggcccuggacggcaucaacagcggcaucacccacgccggcagagagguggagaagguguucaacggccugagcaacaugggcagccacaccggcaaggagcuggacaagggcgugcagggccugaaccacggcauggacaagguggcccacgagaucaaccacggcaucggccaggccggcaaggaggccgagaagcugggccacggcgugaacaacgccgccggccaggugggcaaggaggccgacaagcugauccaccacggcgugcaccacggcgccaaccaggccggcagcgaggccggcaaguucggccagggcguggacaacgccgccggccaggccggcaacgaggccggcagauucggccagggcgugcaccacgccgccggccaggccggcaacgaggccggcagauucggccagggcgugcaccacgccgccggccaggccggcaacgaggccggcagauucggccagggcgcccaccacggccugagcgagggcuggaaggagaccgagaaguucggccagggcauccaccacgccgccggccaggugggcaaggaggccgagaaguucggccagggcgcccaccacgccgccggccaggccggcaacgaggccggcagauucggccagggcgugcaccacggccugagcgagggcuggaaggagaccgagaaguucggccagggcgugcaccacaccgccggccaggugggcaaggaggccgagaaguucggccagggcgcccaccacgccgccggccaggccggcaacgaggccggcagauucggccagggcgcccaccacgccgccggccaggccggcaacgaggccggcagauucggccagggcgugcaccacggccugagcgagggcuggaaggagaccgagaaguucggccagggcgugcaccacgccgccagccaguucggcaaggagaccgagaagcugggccacggcgugcaccacggcgugaacgaggccuggaaggaggccgagaaguucggccagggcgugcaccacgccgccagccaggugggcaaggaggaggacagaguggugcagggccugcaccacggcgugagccaggccggcagagaggccggccaguucggccacgacauccaccacaccgccggccaggccggcaaggagggcgacaucgccgugcacggcgugcagcccggcgugcacgaggccggcaaggaggccggccaguucggccagggcgugcaccacacccuggagcaggccggcaaggaggccgacaaggccgugcagggcuuccacaccggcgugcaccaggccggcaaggaggccgagaagcugggccagggcgugaaccacgccgccgaccaggccggcaaggagguggagaagcugggccagggcgcccaccacgccgccggccaggccggcaaggagcugcagaacgcccacaacggcgugaaccaggccagcaaggaggccaaccagcugcugaacggcaaccaccagagcggcagcagcagccaccagggcggcgccaccaccaccccccuggccagcggcgccagcgugaacacccccuucaucaaccugcccgcccuguggagaagcguggccaacaucaugcccuaa

SEQ ID NO: 23012 - RNA, 900 nt, Artificial Sequence
  SC5D__Homo_sapiens__NP_008849
auggaccuggugcugagaguggccgacuacuacuucuucacccccuacguguaccccgccaccuggcccgaggacgacaucuucagacaggccaucagccugcugaucgugaccaacgugggcgccuacauccuguacuucuucugcgccacccugagcuacuacuucguguucgaccacgcccugaugaagcacccccaguuccugaagaaccaggugagaagagagaucaaguucaccgugcaggcccugcccuggaucagcauccugaccguggcccuguuccugcuggagaucagaggcuacagcaagcugcacgacgaccugggcgaguuccccuacggccuguucgagcugguggugagcaucaucagcuuccuguucuucaccgacauguucaucuacuggauccacagaggccugcaccacagacugguguacaagagacugcacaagccccaccacaucuggaagauccccacccccuucgccagccacgccuuccaccccaucgacggcuuccugcagagccugcccuaccacaucuaccccuucaucuucccccugcacaaggugguguaccugagccuguacauccuggugaacaucuggaccaucagcauccacgacggcgacuucagagugccccagauccugcagcccuucaucaacggcagcgcccaccacaccgaccaccacauguucuucgacuacaacuacggccaguacuucacccugugggacagaaucggcggcagcuucaagaaccccagcagcuucgagggcaagggcccccugagcuacgugaaggagaugaccgagggcaagagaagcagccacagcggcaacggcugcaagaacgagaagcuguucaacggcgaguucaccaagaccgaguaa

SEQ ID NO: 23013 - RNA, 4392 nt, Artificial Sequence
  SCAF11__Homo_sapiens__NP_004710
augaagaagaagaccgugugcacccugaacaugggcgacaagaaguacgaggacauggagggcgaggagaacggcgacaacaccaucagcaccggccugcuguacagcgaggccgacagaugccccaucugccugaacugccugcuggagaaggaggugggcuuccccgagagcugcaaccacguguucugcaugaccugcauccugaagugggccgagacccuggccagcugccccaucgacagaaagcccuuccaggccguguucaaguucagcgcccuggagggcuacgugaaggugcaggugaagaagcagcugagagagaccaaggacaagaagaacgagaacagcuucgagaagcaggugagcugccacgagaacagcaagagcugcaucagaagaaaggccaucgugagagaggaccugcugagcgccaaggugugcgaccugaaguggauccacagaaacagccuguacagcgagaccggcggcaagaagaacgccgccaucaagaucaacaagccccagagaagcaacuggagcaccaaccagugcuucagaaacuucuucagcaacauguucagcagcgugagccacagcggcgagagcagcuucaccuacagagccuacugcaccgaguucaucgaggccagcgagaucagcgcccugaucagacagaagagacacgagcuggagcugagcugguuccccgacacccugcccggcaucggcagaaucggcuucauccccuggaacguggagaccgaggugcugccccugaucagcagcgugcugcccagaaccaucuuccccaccagcaccaucagcuucgagcacuucggcaccagcugcaagggcuacgcccuggcccacacccaggagggcgaggagaagaagcagaccagcggcaccagcaacaccagaggcagcagaagaaagcccgccaugaccacccccaccagaagaagcaccagaaacaccagagccgagaccgccagccagagccagagaagccccaucagcgacaacagcggcugcgacgcccccggcaacagcaaccccagccugagcgugcccagcagcgccgagagcgagaagcagaccagacaggcccccaagagaaagagcgugagaagaggcagaaagcccccccugcugaagaagaagcugagaagcagcguggccgcccccgagaagagcagcagcaacgacagcguggacgaggagaccgccgagagcgacaccagccccgugcuggagaaggagcaccagcccgacguggacagcagcaacaucugcaccgugcagacccacguggagaaccagagcgccaacugccugaagagcugcaacgagcagaucgaggagagcgagaagcacaccgccaacuacgacaccgaggagagagugggcagcagcagcagcgagagcugcgcccaggaccugcccgugcuggugggcgaggagggcgaggugaagaagcuggagaacaccggcaucgaggccaacgugcugugccuggagagcgagaucagcgagaacauccuggagaagggcggcgacccccuggagaagcaggaccagaucagcggccugagccagagcgaggugaagaccgacgugugcaccgugcaccugcccaacgacuuccccaccugccugaccagcgagagcaagguguaccagcccgugagcugcccccugagcgaccugagcgagaacguggagagcguggugaacgaggagaagaucaccgagagcagccugguggagaucaccgagcacaaggacuucacccugaagaccgaggagcugaucgagagccccaagcuggagagcagcgagggcgagaucauccagaccguggacagacagagcgugaagagccccgaggugcagcugcugggccacguggagaccgaggacguggagaucaucgccaccugcgacaccuucggcaacgaggacuucaacaacauccaggacagcgagaacaaccugcugaagaacaaccugcugaacaccaagcuggagaagagccuggaggagaagaacgagagccugaccgagcaccccagaagcaccgagcugcccaagacccacaucgagcagauccagaagcacuucagcgaggacaacaacgagaugauccccauggagugcgacagcuucugcagcgaccagaacgagagcgagguggagcccagcgugaacgccgaccugaagcagaugaacgagaacagcgugacccacugcagcgagaacaacaugcccagcagcgaccuggccgacgagaagguggagaccgugagccagcccagcgagagccccaaggacaccaucgacaagaccaagaagcccagaaccagaagaagcagauuccacagccccagcaccaccuggagccccaacaaggacaccccccaggagaagaagagaccccagagccccagccccagaagagagaccggcaaggagagcagaaagagccagagccccagccccaagaacgagagcgccagaggcagaaagaagagcagaagccagagccccaagaaggacaucgccagagagagaagacagagccagagcagaagccccaagagagacaccaccagagagagcagaagaagcgagagccugagccccagaagagagaccagcagagagaacaagagaagccagcccagagugaaggacagcagccccggcgagaagagcagaagccagagcagagagagagagagcgacagagacggccagagaagagagagagagagaagaaccagaaaguggagcagaagcagaagccacagcagaagccccagcagaugcagaaccaagagcaagagcagcagcuucggcagaaucgacagagacagcuacagccccagauggaagggcagaugggccaacgacggcuggagaugccccagaggcaacgacagauacagaaagaacgaccccgagaagcagaacgagaacaccagaaaggagaagaacgacauccaccuggacgccgacgaccccaacagcgccgacaagcacagaaacgacugccccaacuggaucaccgagaagaucaacagcggccccgaccccagaaccagaaaccccgagaagcugaaggagagccacugggaggagaacagaaacgagaacagcggcaacagcuggaacaagaacuucggcagcggcugggugagcaacagaggcagaggcagaggcaacagaggcagaggcaccuacagaagcagcuucgccuacaaggaccagaacgagaacagauggcagaacagaaagccccugagcggcaacagcaacagcagcggcagcgagagcuucaaguucguggagcagcagagcuacaagagaaagagcgagcaggaguucagcuucgacacccccgccgacagaagcggcuggaccagcgccagcagcugggccgugagaaagacccugcccgccgacgugcagaacuacuacagcagaagaggcagaaacagcagcggcccccagagcggcuggaugaagcaggaggaggagaccagcggccaggacagcagccugaaggaccagaccaaccagcagguggacggcagccagcugcccaucaacaugaugcagccccagaugaacgugaugcagcagcagaugaacgcccagcaccagcccaugaacaucuuccccuaccccgugggcgugcacgccccccugaugaacauccagagaaaccccuucaacauccacccccagcugccccugcaccugcacaccggcgugccccugaugcagguggccacccccaccagcgugagccagggccugcccccccccccccccccccccccccccagccagcaggugaacuacaucgccagccagcccgacggcaagcagcugcagggcauccccagcagcagccacgugagcaacaacaugagcacccccgugcugcccgcccccaccgccgcccccggcaacaccggcauggugcagggccccagcagcggcaacaccagcagcagcagccacagcaaggccagcaacgccgccgugaagcuggccgagagcaaggugagcguggccguggaggccagcgccgacagcagcaagaccgacaagaagcugcagauccaggagaaggccgcccaggaggugaagcuggccaucaagcccuucuaccagaacaaggacaucaccaaggaggaguacaaggagaucgugagaaaggccguggacaaggugugccacagcaagagcggcgaggugaacagcaccaagguggccaaccuggugaaggccuacguggacaaguacaaguacagcagaaagggcagccagaagaagacccuggaggagcccgugagcaccgagaagaacaucggcuaa

SEQ ID NO: 23014 - RNA, 3939 nt, Artificial Sequence
  SCAF1__Homo_sapiens__NP_067051
auggaggaggaggacgagagcagaggcaagaccgaggagagcggcgaggacagaggcgacggcccccccgacagagaccccacccugagccccagcgccuucauccugagagccauccagcaggccgugggcagcagccugcagggcgaccugcccaacgacaaggacggcagcagaugccacggccugagauggagaagaugcagaagccccagaagcgagcccagaagccaggagagcggcggcaccgacaccgccaccgugcuggacauggccaccgacagcuuccuggccggccuggugagcgugcuggacccccccgacaccugggugcccagcagacuggaccugagacccggcgagagcgaggacaugcuggagcugguggccgaggugagaaucggcgacagagaccccaucccccugcccgugcccagccugcugcccagacugagagccuggagaaccggcaagaccgugagcccccagagcaacagcagcagacccaccugcgccagacaccugacccugggcaccggcgacggcggccccgcccccccccccgcccccagcagcgccagcagcagccccagccccagccccagcagcagcagccccagcccccccccccccccccccccccccgccccccccgccccccccgcccccagauucgacaucuacgaccccuuccaccccaccgacgaggccuacagccccccccccgcccccgagcagaaguacgaccccuucgagcccaccggcagcaaccccagcagcagcgccggcacccccagccccgaggaggaggaggaggaggaggaggaggaggaggaggaggaggaggacgaggaggaggaggagggccugagccagagcaucagcagaaucagcgagacccuggccggcaucuacgacgacaacagccugagccaggacuuccccggcgacgagagccccagacccgacgcccagcccacccagcccacccccgcccccggcacccccccccagguggacagcaccagagccgacggcgccaugagaagaagaguguucguggugggcaccgaggccgaggccugcagagagggcaaggugagcguggagguggugaccgccggcggcgccgcccugccccccccccugcugccccccggcgacagcgagaucgaggagggcgagaucgugcagcccgaggaggagcccagacuggcccugagccuguucagacccggcggcagagccgccagacccacccccgccgccagcgccacccccaccgcccagccccugccccagccccccgcccccagagcccccgagggcgacgacuuccugagccugcacgccgagagcgacggcgagggcgcccugcagguggaccugggcgagcccgcccccgccccccccgccgccgacagcagauggggcggccuggaccugagaagaaagauccugacccagagaagagagagauacagacagagaagccccagccccgcccccgcccccgcccccgccgccgccgccggcccccccaccagaaagaagagcagaagagagagaaagagaagcggcgaggccaaggaggccgccagcagcagcagcggcacccagcccgccccccccgcccccgccagccccugggacagcaagaagcacagaagcagagacagaaagcccggcagccacgccagcagcagcgccagaagaagaagcagaagcagaagcagaagcagaagcaccagaagaagaagcagaagcaccgacagaagaagaggcggcagcagaagaagcagaagcagagagaagagaagaagaagaagaagaagcgccagccccccccccgccaccagcagcagcagcagcagcagaagagagagacacagaggcaagcacagagacggcggcggcagcaagaagaagaagaagagaagcagaagcagaggcgagaagagaagcggcgacggcagcgagaaggcccccgcccccgcccccccccccagcggcagcaccagcugcggcgacagagacagcagaagaagaggcgccgugccccccagcauccaggaccugaccgaccacgaccuguucgccaucaagagaaccaucaccgugggcagacuggacaagagcgaccccagaggccccagccccgcccccgccagcagccccaagagagaggugcuguacgacagcgagggccugagcggcgaggagagaggcggcaagagcagccagaaggacagaagaagaagcggcgccgccagcagcagcagcagcagcagagagaagggcagcagaagaaaggcccuggacggcggcgacagagacagagacagagacagagacagagacagagacagaagcagcaagaaggccagaccccccaaggagagcgcccccagcagcggccccccccccaagccccccgugagcagcggcagcggcagcagcagcagcagcagcagcugcagcagcagaaaggugaagcugcagagcaagguggccgugcugaucagagagggcgugagcagcaccacccccgccaaggacgccgccagcgccggccugggcagcaucggcgugaaguucagcagagacagagagagcagaagccccuuccugaagcccgacgagagagcccccaccgagauggccaaggccgcccccggcagcaccaagcccaagaagaccaaggugaaggccaaggccggcgccaagaagaccaagggcaccaagggcaagaccaagcccagcaagaccagaaagaaggugagaagcggcggcggcagcggcggcagcggcggccaggugagccugaagaagagcaaggccgacagcugcagccaggccgccggcaccaagggcgccgaggagaccagcuggagcggcgaggagagagccgccaaggugcccagcacccccccccccaaggccgccccccccccccccgcccugacccccgacagccagaccguggacagcagcugcaagacccccgaggugagcuuccugcccgaggaggccaccgaggaggccggcgugagaggcggcgccgaggaggaggaggaggaggaggaggaggaggaggaggaggaggaggaggaggagcagcagcccgccaccaccaccgccaccagcaccgccgccgccgcccccagcaccgcccccagcgccggcagcaccgccggcgacagcggcgccgaggacggccccgccagcagagugagccagcugcccacccugcccccccccaugcccuggaaccugcccgccggcguggacugcaccaccagcggcgugcuggcccugaccgcccugcuguucaagauggaggaggccaaccuggccagcagagccaaggcccaggagcugauccaggccaccaaccagauccugagccacagaaagccccccagcagccugggcaugacccccgcccccgugcccaccagccugggccugccccccggccccagcagcuaccugcugcccggcagccugccccugggcggcugcggcagcaccccccccacccccaccggccuggccgccaccagcgacaagagagagggcagcagcagcagcgagggcagaggcgacaccgacaaguaccugaagaagcugcacacccaggagagagccguggaggaggugaagcuggccaucaagcccuacuaccagaagaaggacaucaccaaggaggaguacaaggacauccugagaaaggccgugcacaagaucugccacagcaagagcggcgagaucaaccccgugaaggugagcaaccuggugagagccuacgugcagagauacagauacuucagaaagcacggcagaaagcccggcgacccccccggcccccccagaccccccaaggagcccggcccccccgacaagggcggccccggccugccccugcccccccuguaa

SEQ ID NO: 23015 - RNA, 3399 nt, Artificial Sequence
  SCAF4__Homo_sapiens__NP_001138916
auggacgccgugaacgccuucaaccaggagcuguucagccugauggacaugaagccccccaucagcagagccaagaugauccugaucaccaaggccgccaucaaggccaucaagugcaagcccgaguacaaggugcccggccuguacgugaucgacagcaucgugagacagagcagacaccaguucggcaccgacaaggacguguucggccccagauucagcaagaacaucaccgccaccuuccaguaccuguaccugugccccagcgaggacaagagcaagaucgugagagugcugaaccuguggcagaagaacggcguguucaagaucgagaucauccagccccugcuggacauggccgccggcaccagcaacgccgcccccguggccgagaacgugaccaacaacgagggcagcccccccccccccgugaaggugagcagcgagccccccacccaggccacccccaacagcgugcccgccgugccccagcugcccagcagcgacgccuucgccgccguggcccagcuguuccagaccacccagggccagcagcugcagcagauccugcagaccuuccagcagccccccaagccccagagccccgcccuggacaacgccgugauggcccaggugcaggccaucaccgcccagcugaagaccacccccacccagcccagcgagcagaaggccgccuuccccccccccgagcagaagaccgccuucgacaagaagcugcuggacagauucgacuacgacgacgagcccgaggccguggaggagagcaagaaggaggacaccaccgccgugaccaccaccgcccccgccgccgccgugccccccgcccccaccgccaccgugcccgccgccgccgcccccgccgccgccagccccccccccccccaggcccccuucggcuuccccggcgacggcaugcagcagcccgccuacacccagcaccagaacauggaccaguuccagcccagaaugaugggcauccagcaggaccccaugcaccaccaggugccccugccccccaacggccagaugcccggcuucggccugcugcccaccccccccuucccccccauggcccagcccgugaucccccccaccccccccgugcagcagcccuuccaggccagcuuccaggcccagaacgagccccugacccagaagccccaccagcaggagauggagguggagcagcccugcauccaggaggugaagagacacaugagcgacaacagaaagagcagaagcagaagcgccagcagaagccccaagagaagaagaagcagaagcggcagcagaagcagaagaagcagacacagaagaagcagaagcagaagcagagacagaagaagacacagccccagaagcagaagccaggagagaagagacagagagaaggagagagagagaagacagaagggccugccccaggugaagcccgagaccgccagcgugugcagcaccacccugugggugggccagcuggacaagagaaccacccagcaggacguggccagccugcuggaggaguucggccccaucgagagcaucaacaugaucccccccagaggcugcgccuacaucgugauggugcacagacaggacgccuacagagcccugcagaagcugagcagaggcaacuacaaggugaaccagaagagcaucaagaucgccugggcccugaacaagggcaucaaggccgacuacaagcaguacugggacguggagcugggcgugaccuacauccccugggacaaggugaagcccgaggagcuggagagcuucugcgagggcggcaugcuggacagcgacacccugaaccccgacuggaagggcauccccaagaagcccgagaacgagguggcccagaacggcggcgccgagaccagccacaccgagcccgugagccccauccccaagccccugcccgugcccgugccccccauccccgugcccgcccccaucaccgugccccccccccaggugcccccccaccagcccggcccccccguggugggcgcccugcagccccccgccuucacccccccccugggcauccccccccccggcuucggccccggcgugccccccccccccccccccccccccuuccugagacccggcuucaaccccaugcaccugccccccggcuuccugccccccggcccccccccccccaucaccccccccgugagcaucccccccccccacaccccccccaucagcauccccaacagcaccaucgccggcaucaacgaggacaccaccaaggaccugagcaucggcaaccccauccccaccguggugagcggcgccagaggcaacgccgagagcggcgacagcgugaagauguacggcagcgccgugccccccgccgcccccaccaaccugcccaccccccccgugacccagcccgugagccugcugggcacccagggcguggcccccggccccgugaucggccugcaggcccccagcaccggccugcugggcgccagacccggccugaucccccugcagagaccccccggcaugccccccccccaccugcagagauucccccugaugccccccagacccaugcccccccacaugaugcacagaggccccccccccggccccggcggcuucgccaugccccccccccacggcaugaagggccccuuccccccccacggccccuucgugagacccggcggcaugcccggccugggcggccccggccccggccccggcggccccgaggacagagacggcagacagcagcccccccagcagccccagcagcagccccagccccaggccccccagcagccccagcagcagcagcagcagcagcccccccccagccagcagcccccccccacccagcagcagccccagcaguucagaaacgacaacagacagcaguucaacagcggcagagaccaggagagauucggcagaagaagcuucggcaacagaguggagaacgacagagagagauacggcaacagaaacgacgacagagacaacagcaacagagacagaagagaguggggcagaagaagccccgacagagacagacacagagaccuggaggagagaaacagaagaagcagcggccacagagacagagagagagacagcagagacagagagagcagaagagagaaggaggaggccagaggcaaggagaagcccgaggugaccgacagagccggcggcaacaagaccguggagccccccaucagccaggugggcaacguggacaccgccagcgagcuggagaagggcgugagcgaggccgccgugcugaagcccagcgaggagcugcccgccgaggccaccagcagcguggagcccgagaaggacagcggcagcgccgccgaggcccccagauaa

SEQ ID NO: 23016 - RNA, 4014 nt, Artificial Sequence
  SCAF8__Homo_sapiens__NP_001273118
augccccagccccugcugcccgcccugcccccccugagcagccccagcggcgccggcagcugcggccccagcggcggcgagugcagcggcagaagacuguucagaagaagagccagaggccugagaagcgacaacauggaggccgugaagaccuucaacagcgaggacugcgccagcacccccgccugcaccgacugcuucagcagcagcauggacaccagaagcauccuguacagccugaacgacuacaagccccccaucagcaaggccaagaugacccagaucaccaaggccgccaucaaggccaucaaguucuacaagcacguggugcagagcguggagaaguucauccagaagugcaagcccgaguacaaggugcccggccuguacgugaucgacagcaucgugagacagagcagacaccaguucggccaggagaaggacguguucgcccccagauucagcaacaacaucaucagcaccuuccagaaccuguacagaugccccggcgacgacaagagcaagaucgugagagugcugaaccuguggcagaagaacaacguguucaagagcgagaucauccagccccugcuggacauggccgccggcauccccccccccguggugacccccgugcuggccagcaccaccaccgccaugagcaacacccccggcacccccgugacccccgugacccccgccaacguggugcagggccugcccgaccccugggugagccagaucaccaacaccgacacccuggccgccguggcccagauccugcagagcccccagggccagcagcugcagcagcugauccagacccugcagauccagcagcagaagccccagcccagcauccugcaggcccuggacgccggccugguggugcagcugcaggcccugaccgcccagcugaccgccgccgccgccgccgccaacacccugaccccccuggagcagggcgugagcuucaacaagaagcugauggacagauucgacuucggcgaggacagcgagcacagcgaggagcccaagaaggagauccccgccagccagcugagccacgugagcgagagcgugaacaacagcaucuuccaccagaucgccgagcagcugcagcagcagaaccuggagcaccugagacagcagcugcuggagcagcagcagccccagaaggccaccccccaggacagccaggagggcaccuucggcagcgagcacagcgccagccccagccagggcagcagccagcagcacuuccuggagcccgaggugaaccuggacgacagcaucgacauccagcagcaggacauggacaucgacgagggccaggacggcguggaggaggagguguucgagcaggaggccaagaagguggccgugagaagcagaagcagaacccacagcagaagcagaagcagaagccccagaaagagaagaagcagaagcagaagcggcagcagaaagagaaagcacagaaagagaagcagaagcagaagcagagagagaaagagaaagagcagcagaagcuacagcagcgagagaagagccagagagagagagaaggagagacagaagaagggccugccccccaucagaagcaagacccugagcgugugcagcaccacccugugggugggccagguggacaagaaggccacccagcaggaccugaccaaccuguucgaggaguucggccagaucgagagcaucaacaugaucccccccagaggcugcgccuacgugugcauggugcacagacaggacgccuucagagcccugcagaagcugagcagcggcagcuacaagaucggcagcaaggugaucaagaucgccugggcccugaacaagggcgugaagaccgaguacaagcaguucugggacguggaccugggcgugaccuacauccccugggagaaggugaagguggacgaccuggagggcuucgccgagggcggcaugaucgaccaggagaccgugaacaccgagugggagaccgugaagagcagcgagcccgugaaggagaccgugcagaccacccagagccccacccccguggagaaggagaccguggugaccacccaggccgagguguuccccccccccguggccaugcugcagauccccguggcccccgccgugcccaccgugagccuggugccccccgccuuccccgugagcaugcccgugcccccccccggcuucagccccaucccccccccccccuuccugagagccagcuucaaccccagccagcccccccccggcuucaugcccccccccgugcccccccccguggugcccccccccaccaucccccccguggugcccaccagccuggugcagcccagccugagcaugacccccgagaccgugaaggacgugggcuucggcagccuggugauccccggcggcagcguggccagcaaccuggccaccagcgcccugcccgccggcaacguguucaacgcccccaccaagcaggccgagcccgaggagaaggugccccaccugaucgaccaccagaucagcagcggcgagaacaccagaagcgugauccccaacgacaucagcagcaacgccgccauccugggcggccagccccccaacgugaccagcaacagcggcauccugggcgugcagagacccaacgugagcagcaacagcgagauccugggcgugagacccagcaacgugagcagcagcagcggcaucaucgccgcccagccccccaacauccugaacaacagcggcauccugggcauccagccccccagcgugagcaacagcagcggccugcugggcgugcugccccccaacauccccaacaacagcggccuggugggcgugcagccccccaacgugcccaacacccccggccugcugggcacccagccccccgccggcccccagaaccugcccccccugagcauccccaaccagagaaugcccaccaugcccaugcuggacaucagacccggccugaucccccaggcccccggccccagauucccccugauccagcccggcauccccccccagagaggcauccccccccccagcgugcuggacagcgcccugcaccccccccccagaggccccuucccccccggcgacaucuucagccagcccgagagacccuuccuggcccccggcagacagagcguggacaacgugaccaaccccgagaagagaaucccccugggcaacgacaacauccagcaggagggcgacagagacuacagauucccccccaucgagaccagagagagcaucagcagacccccccccguggacgugagagacguggugggcagacccaucgaccccagagagggccccggcagacccccccuggacggcagagaccacuucggcagaccccccguggacaucagagagaaccuggugagacccggcaucgaccaccugggcagaagagaccacuucggcuucaaccccgagaagcccuggggccacagaggcgacuucgacgagagagagcacagagugcugcccguguacggcggccccaagggccugcacgaggagagaggcagauucagaagcggcaacuacagauucgaccccagaagcggccccuggaacagaggcuucggccaggaggugcacagagacuucgacgacagaagaagacccugggagagacagagagacagagacgacagagacuucgacuucugcagagagaugaacggcaacagacugggcagagacagaauccagaacaccugggugccccccccccacgccagaguguucgacuacuucgagggcgccaccagccagagaaagggcgacaacgugccccaggugaacggcgagaacaccgagagacacgcccagcccccccccauccccgugcagaacgaccccgagcuguacgagaagcugaccagcagcaacgagaucaacaaggagaagagcgacaccguggccgacaucgagagcgagcccgugguggagagcaccgagaccgagggcaccuaa

SEQ ID NO: 23017 - RNA, 1821 nt, Artificial Sequence
  SCAI__Homo_sapiens__NP_001138349
auggugagaggcgccagacagccccagcagcccagaagcagacuggcccccagacugaccggcaccguggagaagccccccagaaagagaagaagcagaaccgaguucgcccugaaggagaucaugagcagcggcggcgccgaggacgacaucccccagggcgagagaaagaccgugaccgacuucugcuaccugcuggacaagagcaagcagcuguucaacggccugagagaccugccccaguacggccagaagcaguggcagagcuacuucggcagaaccuucgacguguacaccaagcuguggaaguuccagcagcagcacagacaggugcuggacaacagauacggccugaagagauggcagaucggcgagaucgccagcaagaucggccagcuguacuaccacuacuaccugagaaccagcgagaccagcuaccugaacgaggccuucagcuucuacagcgccaucagacagagaagcuacuacagccaggugaacaaggaggacagacccgagcugguggugaagaagcugagauacuacgccagauucaucguggugugccugcugcugaacaagauggacguggugaaggaccuggugaaggagcugagcgacgagaucgaggacuacacccacagauucaacaccgaggaccagguggaguggaaccuggugcugcaggagguggccgccuucaucgaggccgaccccgugauggugcugaacgacgacaacaccaucgugaucaccagcaacagacuggccgagaccggcgccccccugcuggagcagggcaugaucgugggccagcugagccuggccgacgcccugaucaucggcaacugcaacaaccaggugaaguucagcgagcugaccguggacauguucagaaugcugcaggcccuggagagagagcccaugaaccuggccagccagaugaacaagcccggcaugcaggagagcgccgacaagcccaccagaagagagaacccccacaaguaccugcuguacaagcccaccuucagccagcuguacaccuuccuggccgccagcuucaaggagcugcccgccaacagcgugcugcugaucuaccugagcgccaccggcguguuccccaccggcagaagcgacagcgagggccccuacgacuucggcggcgugcugaccaacagcaacagagacaucaucaacggcgacgccauccacaagagaaaccagagccacaaggagaugcacugccugcaccccggcgaccuguaccccuucaccagaaagccccuguucaucaucguggacagcagcaacagcguggccuacaagaacuucaccaaccuguucggccagccccuggugugccugcugagccccaccgccuaccccaaggcccugcaggaccagagccagagaggcagccuguucacccuguuccugaacaacccccugauggccuuccuguucgugagcggccugagcagcaugagaagaggccugugggagaagugccaggaguaccugagaaagaucaacagagacaucgcccagcugcugacccacagcagaagcaucgaccaggccuuccugcaguucuucggcgacgaguuccugagacugcugcugaccagauucaucuucugcagcgccaccaugagaaugcacaagaucuucagagagaccagaaacuaccccgagagcuacccccagcugcccagagacgagaccguggagaacccccaccugcagaagcacauccuggagcuggccagcauccuggacgugagaaacguguucuucgagaacaccaucgacgacuacuaa

SEQ ID NO: 23018 - RNA, 990 nt, Artificial Sequence
  SCAMP2__Homo_sapiens__NP_005688
augagcgccuucgacaccaaccccuucgccgaccccguggacgugaaccccuuccaggaccccagcgugacccagcugaccaacgccccccagggcggccuggccgaguucaaccccuucagcgagaccaacgccgccaccaccgugcccgugacccagcugcccggcagcagccagcccgccgugcugcagcccagcguggagcccacccagcccaccccccaggccguggugagcgccgcccaggccggccugcugagacagcaggaggagcuggacagaaaggccgccgagcuggagagaaaggagagagagcugcagaacaccguggccaaccugcacgugagacagaacaacuggcccccccugcccagcuggugccccgugaagcccugcuucuaccaggacuucagcaccgagauccccgccgacuaccagagaaucugcaagaugcuguacuaccuguggaugcugcacagcgugacccuguuccugaaccugcuggccugccuggccugguucagcggcaacagcagcaagggcguggacuucggccugagcauccugugguuccugaucuucacccccugcgccuuccugugcugguacagacccaucuacaaggccuucagaagcgacaacagcuucagcuucuucguguucuucuucguguucuucugccagaucggcaucuacaucauccagcuggugggcauccccggccugggcgacagcggcuggaucgccgcccugagcacccuggacaaccacagccuggccaucagcgugaucaugauggugguggccggcuucuucacccugugcgccgugcugagcguguuccugcugcagagagugcacagccuguacagaagaaccggcgccagcuuccagcaggcccaggaggaguucagccagggcaucuucagcagcagaaccuuccacagagccgccagcagcgccgcccagggcgccuuccagggcaacuaa

SEQ ID NO: 23019 - RNA, 762 nt, Artificial Sequence
  SCAMP5__Homo_sapiens__XP_006720483
auggaguucagaaccaagagaugcggccaggccaccggccccgccggcaacaucauggccgagaaggugaacaacuuccccccccugcccaaguucaucccccugaagcccugcuucuaccaggacuucgaggccgacauccccccccagcacgugagcaugaccaagagacuguacuaccuguggaugcugaacagcgugacccuggccgugaaccuggugggcugccuggccuggcugaucggcggcggcggcgccaccaacuucggccuggccuuccuguggcugauccuguucacccccugcagcuacgugugcugguucagacccaucuacaaggccuucaagaccgacagcagcuucagcuucauggccuucuucuucaccuucauggcccagcuggugaucagcaucauccaggccgugggcauccccggcuggggcgugugcggcuggaucgccaccaucagcuucuucggcaccaacaucggcagcgccguggugaugcugauccccaccgugauguucaccgugauggccguguucagcuucaucgcccugagcauggugcacaaguucuacagaggcagcggcggcagcuucagcaaggcccaggaggaguggaccaccggcgccuggaagaacccccacgugcagcaggccgcccagaacgccgccaugggcgccgcccagggcgccaugaaccagccccagacccaguacagcgccacccccaacuacaccuacagcaacgagauguaa

SEQ ID NO: 23020 - RNA, 3465 nt, Artificial Sequence
  SCAPER__Homo_sapiens__NP_001139395
augaagaccaaguacaucuucugcaacaucaccgagagaaaggacgccgagggcugggagaccgugcagagaggcagacccaucagaagcagaagcaccgccgugaugcccaaggugagccuggccaccgaggccaccagaagcaaggacgacagcgacaaggagaacgugugccugcugcccgacgagagcauccagaagggccaguucgugggcgacggcaccagcaacaccaucgagagccaccccaaggacagccugcacagcugcgaccacccccuggccgagaagacccaguucaccgugagcacccuggacgacgugaagaacagcggcagcaucagagacaacuacgugagaaccagcgagaucagcgccgugcacaucgacaccgagugcgugagcgugaugcugcaggccggcacccccccccugcaggugaacgaggagaaguuccccgccgagaaggccagaaucgagaacgagauggaccccagcgacaucagcaacagcauggccgaggugcuggccaagaaggaggagcuggccgacagacuggagaaggccaacgaggaggccaucgccagcgccaucgccgaggaggagcagcugaccagagagaucgaggccgaggagaacaacgacaucaacaucgagaccgacaacgacagcgacuucagcgccagcaugggcagcggcagcgugagcuucugcggcaugagcauggacuggaacgacgugcuggccgacuacgaggccagagagagcuggagacagaacaccagcuggggcgacaucguggaggaggagcccgccagaccccccggccacggcauccacaugcacgagaagcugagcagccccagcagaaagagaaccaucgccgagagcaagaagaagcacgaggagaagcagaugaaggcccagcagcugagagagaagcugagagaggagaagacccugaagcugcagaagcugcuggagagagagaaggacgugagaaaguggaaggaggagcugcuggaccagagaagaagaaugauggaggagaagcugcugcacgccgaguucaagagagaggugcagcugcaggccaucgugaagaaggcccaggaggaggaggccaaggugaacgagaucgccuucaucaacacccuggaggcccagaacaagagacacgacgugcugagcaagcugaaggaguacgagcagagacugaacgagcugcaggaggagagacagagaagacaggaggagaagcaggccagagacgaggccgugcaggagagaaagagagcccuggaggccgagagacaggccagaguggaggagcugcugaugaagagaaaggagcaggaggccagaaucgagcagcagagacaggagaaggagaaggccagagaggacgccgccagagagagagccagagacagagaggagagacuggccgcccugaccgccgcccagcaggaggccauggaggagcugcagaagaagauccagcugaagcacgacgagagcaucagaagacacauggagcagaucgagcagagaaaggagaaggccgccgagcugagcagcggcagacacgccaacaccgacuacgcccccaagcugacccccuacgagagaaagaagcagugcagccugugcaacgugcugaucagcagcgagguguaccuguucagccacgugaagggcagaaagcaccagcaggccgugagagagaacaccagcauccagggcagagagcugagcgacgaggagguggagcaccugagccugaagaaguacaucaucgacaucgugguggagagcaccgcccccgccgaggcccugaaggacggcgaggagagacagaagaacaagaagaaggccaagaagaucaaggccagaaugaacuucagagccaaggaguacgagagccugauggagaccaagaacagcggcagcgacagccccuacaaggccaagcugcagagacuggccaaggaccugcugaagcaggugcaggugcaggacagcggcagcugggccaacaacaaggugagcgcccuggacagaacccugggcgagaucaccagaauccuggagaaggagaacguggccgaccagaucgccuuccaggccgccggcggccugaccgcccuggagcacauccugcaggccguggugcccgccaccaacgugaacaccgugcugagaaucccccccaagagccugugcaacgccaucaacguguacaaccugaccugcaacaacugcagcgagaacugcagcgacgugcuguucagcaacaagaucaccuuccugauggaccugcugauccaccagcugaccguguacgugcccgacgagaacaacaccauccugggcagaaacaccaacaagcagguguucgagggccugaccaccggccugcugaaggugagcgccguggugcugggcugccugaucgccaacagacccgacggcaacugccagcccgccacccccaagauccccacccaggagaugaagaacaagcccagccagggcgaccccuucaacaacagagugcaggaccugaucagcuacguggugaacaugggccugaucgacaagcugugcgccugcuuccugagcgugcagggccccguggacgagaaccccaagauggccaucuuccugcagcacgccgccggccugcugcacgccaugugcacccugugcuucgccgugaccggcagaagcuacagcaucuucgacaacaacagacaggaccccaccggccugaccgccgcccugcaggccaccgaccuggccggcgugcugcacaugcuguacugcgugcuguuccacggcaccauccuggaccccagcaccgccagccccaaggagaacuacacccagaacaccauccagguggccauccagagccugagauucuucaacagcuucgccgcccugcaccugcccgccuuccagagcaucgugggcgccgagggccugagccuggccuucagacacauggccagcagccugcugggccacugcagccaggugagcugcgagagccugcugcacgaggugaucgugugcgugggcuacuucaccgugaaccaccccgacaaccaggugaucgugcagagcggcagacaccccaccgugcugcagaagcugugccagcugcccuuccaguacuucagcgaccccagacugaucaaggugcuguuccccagccugaucgccgccugcuacaacaaccaccagaacaagaucauccuggagcaggagaugagcugcgugcugcuggccaccuucauccaggaccuggcccagacccccggccaggccgagaaccagcccuaccagcccaagggcaagugccugggcagccaggacuaccuggagcuggccaacagauucccccagcaggccugggaggaggccagacaguucuuccugaagaaggagaagaaguaa

SEQ ID NO: 23021 - RNA, 3840 nt, Artificial Sequence
  SCAP__Homo_sapiens__NP_036367
augacccugaccgagagacugagagagaagaucagcagagccuucuacaaccacggccugcugugcgccagcuaccccauccccaucauccuguucaccggcuucugcauccuggccugcugcuacccccugcugaagcugccccugcccggcaccggccccguggaguucaccacccccgugaaggacuacagccccccccccguggacagcgacagaaagcagggcgagcccaccgagcagcccgagugguacgugggcgcccccguggccuacgugcagcagaucuucgugaagagcagcguguuccccuggcacaagaaccugcuggccguggacguguucagaagcccccugagcagagccuuccagcugguggaggagaucagaaaccacgugcugagagacagcagcggcaucagaagccuggaggagcugugccugcaggugaccgaccugcugcccggccugagaaagcugagaaaccugcugcccgagcacggcugccugcugcugagccccggcaacuucuggcagaacgacugggagagauuccacgccgaccccgacaucaucggcaccauccaccagcacgagcccaagacccugcagaccagcgccacccugaaggaccugcuguucggcgugcccggcaaguacagcggcgugagccuguacaccagaaagagaauggugagcuacaccaucacccugguguuccagcacuaccacgccaaguuccugggcagccugagagccagacugaugcugcugcaccccagccccaacugcagccugagagccgagagccuggugcacgugcacuucaaggaggagaucggcguggccgagcugaucccccuggugaccaccuacaucauccuguucgccuacaucuacuucagcaccagaaagaucgacauggugaagagcaaguggggccuggcccuggccgccguggugaccgugcugagcagccugcugaugagcgugggccugugcacccuguucggccugacccccacccugaacggcggcgagaucuuccccuaccuggugguggugaucggccuggagaacgugcuggugcugaccaagagcguggugagcacccccguggaccuggaggugaagcugagaaucgcccagggccugagcagcgagagcuggagcaucaugaagaacauggccaccgagcugggcaucauccugaucggcuacuucacccuggugcccgccauccaggaguucugccuguucgccguggugggccuggugagcgacuucuuccugcagaugcuguucuucaccaccgugcugagcaucgacaucagaagaauggagcuggccgaccugaacaagagacugccccccgaggccugccugcccagcgccaagcccgugggccagcccaccagauacgagagacagcuggccgugagacccagcaccccccacaccaucacccugcagcccagcagcuucagaaaccugagacugcccaagagacugagagugguguacuuccuggccagaaccagacuggcccagagacugaucauggccggcaccgugguguggaucggcauccugguguacaccgaccccgccggccugagaaacuaccuggccgcccaggugaccgagcagagcccccugggcgagggcgcccuggcccccaugcccgugcccagcggcaugcugccccccagccaccccgaccccgccuucagcaucuucccccccgacgcccccaagcugcccgagaaccagaccagccccggcgagagccccgagagaggcggccccgccgagguggugcacgacagccccgugcccgaggugaccuggggccccgaggacgaggagcuguggagaaagcugagcuucagacacuggcccacccuguucagcuacuacaacaucacccuggccaagagauacaucagccugcugcccgugauccccgugacccugagacugaaccccagagaggcccuggagggcagacacccccaggacggcagaagcgccuggcccccccccggccccauccccgccggccacugggaggccggccccaagggccccggcggcgugcaggcccacggcgacgugacccuguacaagguggccgcccugggccuggccaccggcaucgugcuggugcugcugcugcugugccuguacagagugcugugccccagaaacuacggccagcugggcggcggccccggcagaagaagaagaggcgagcugcccugcgacgacuacggcuacgccccccccgagaccgagaucgugccccuggugcugagaggccaccugauggacaucgagugccuggccagcgacggcaugcugcuggugagcugcugccuggccggccacgugugcgugugggacgcccagaccggcgacugccugaccagaauccccagacccggcagacagagaagagacagcggcgugggcagcggccuggaggcccaggagagcugggagagacugagcgacggcggcaaggccggccccgaggagcccggcgacagccccccccugagacacagacccagaggcccccccccccccagccuguucggcgaccagcccgaccugaccugccugaucgacaccaacuucagcgcccagcccagaagcagccagcccacccagcccgagcccagacacagagccgugugcggcagaagcagagacagccccggcuacgacuucagcugccuggugcagagaguguaccaggaggagggccuggccgccgugugcacccccgcccugagaccccccagccccggccccgugcugagccaggcccccgaggacgagggcggcagccccgagaagggcagccccagccuggccugggcccccagcgccgagggcagcaucuggagccuggagcugcagggcaaccugaucguggugggcagaagcagcggcagacuggaggugugggacgccaucgagggcgugcugugcugcagcagcgaggaggugagcagcggcaucaccgcccugguguuccuggacaagagaaucguggccgccagacugaacggcagccuggacuucuucagccuggagacccacaccgcccugagcccccugcaguucagaggcacccccggcagaggcagcagccccgccagccccguguacagcagcagcgacaccguggccugccaccugacccacaccgugcccugcgcccaccagaagcccaucaccgcccugaaggccgccgccggcagacuggugaccggcagccaggaccacacccugagaguguucagacuggaggacagcugcugccuguucacccugcagggccacagcggcgccaucaccaccguguacaucgaccagaccauggugcuggccagcggcggccaggacggcgccaucugccugugggacgugcugaccggcagcagagugagccacguguucgcccacagaggcgacgugaccagccugaccugcaccaccagcugcgugaucagcagcggccuggacgaccugaucagcaucugggacagaagcaccggcaucaaguucuacagcauccagcaggaccugggcugcggcgccagccugggcgugaucagcgacaaccugcuggugaccggcggccagggcugcgugagcuucugggaccugaacuacggcgaccugcugcagaccguguaccugggcaagaacagcgaggcccagcccgccagacagauccuggugcuggacaacgccgccaucgugugcaacuucggcagcgagcugagccugguguacgugcccagcgugcuggagaagcuggacuaa

SEQ ID NO: 23022 - RNA, 1821 nt, Artificial Sequence
  SCARA3__Homo_sapiens__NP_057324
augaaggugagaagcgccggcggcgacggcgacgcccugugcgugaccgaggaggaccuggccggcgacgacgaggacaugcccaccuuccccugcacccagaagggcagacccggccccagaugcagcagaugccagaagaaccugagccugcacaccagcgugagaauccuguaccuguuccuggcccugcugcugguggccguggccgugcuggccagccugguguucagaaagguggacagccugagcgaggacaucagccugacccagagcaucuacgacaagaagcuggugcugaugcagaagaaccugcagggccuggaccccaaggcccugaacaacugcagcuucugccacgaggccggccagcugggccccgagaucagaaagcugcaggaggagcuggagggcauccagaagcugcugcuggcccaggaggugcagcuggaccagacccugcaggcccaggaggugcugagcaccaccagcagacagaucagccaggagaugggcagcugcagcuucagcauccaccaggugaaccagagccugggccuguuccuggcccaggugagaggcuggcaggccaccaccgccggccuggaccugagccugaaggaccugacccaggagugcuacgacgugaaggccgccgugcaccagaucaacuucaccgugggccagaccagcgaguggauccacggcauccagagaaagaccgacgaggagacccugacccugcagaagaucgugaccgacuggcagaacuacaccagacuguucagcggccugagaaccaccagcaccaagaccggcgaggccgugaagaacauccaggccacccugggcgccagcagccagagaaucagccagaacagcgagagcaugcacgaccuggugcugcaggugaugggccugcagcugcagcuggacaacaucagcagcuuccuggacgaccacgaggagaacaugcacgaccugcaguaccacacccacuacgcccagaacagaaccguggagagauucgagagccuggagggcagaauggccagccacgagaucgagaucggcaccaucuucaccaacaucaacgccaccgacaaccacgugcacagcaugcugaaguaccuggacgacgugagacugagcugcacccugggcuuccacacccacgccgaggagcuguacuaccugaacaagagcgugagcaucaugcugggcaccaccgaccugcugagagagagauucagccugcugagcgccagacuggaccugaacgugagaaaccugagcaugaucguggaggagaugaaggccguggacacccagcacggcgagauccugagaaacgugaccauccugagaggcgcccccggcccccccggccccagaggcuucaagggcgacaugggcgugaagggccccgugggcggcagaggccccaagggcgaccccggcagccugggcccccugggcccccagggcccccagggccagcccggcgaggccggccccgugggcgagagaggccccgugggccccagaggcuuccccggccugaagggcagcaagggcagcuucggcaccggcggccccagaggccagcccggccccaagggcgacaucggcccccccggccccgagggcccccccggcagccccggccccagcggcccccagggcaagcccggcaucgccggcaagaccggcagccccggccagagaggcgccaugggccccaagggcgagcccggcauccagggcccccccggccugcccggcccccccggcccccccggcagccagagcuucuacuaa

SEQ ID NO: 23023 - RNA, 1488 nt, Artificial Sequence
  SCARA5__Homo_sapiens__NP_776194
auggagaacaaggccauguaccugcacaccgugagcgacugcgacaccagcagcaucugcgaggacagcuucgacggcagaagccugagcaagcugaaccugugcgaggacggccccugccacaagagaagagccagcaucugcugcacccagcugggcagccugagcgcccugaagcacgccgugcugggccuguaccugcugguguuccugauccuggugggcaucuucauccuggccgugagcagacccagaagcagccccgacgaccugaaggcccugaccagaaacgugaacagacugaacgagagcuucagagaccugcagcugagacugcugcaggccccccugcaggccgaccugaccgagcagguguggaaggugcaggacgcccugcagaaccagagcgacagccugcuggcccuggccggcgccgugcagagacuggagggcgcccuguggggccugcaggcccaggccgugcagaccgagcaggccguggcccugcugagagacagaaccggccagcagagcgacaccgcccagcuggagcuguaccagcugcagguggagagcaacagcagccagcugcugcugagaagacacgccggccugcuggacggccuggccagaagagugggcauccugggcgaggagcuggccgacgugggcggcgugcugagaggccugaaccacagccugagcuacgacguggcccugcacagaaccagacugcaggaccugagagugcuggugagcaacgccagcgaggacaccagaagacugagacuggcccacgugggcauggagcugcagcugaagcaggagcuggccaugcugaacgccgugaccgaggaccugagacugaaggacugggagcacagcaucgcccugagaaacaucagccuggccaagggcccccccggccccaagggcgaccagggcgacgagggcaaggagggcagacccggcauccccggccugcccggccugagaggccugcccggcgagagaggcacccccggccugcccggccccaagggcgacgacggcaagcugggcgccaccggccccaugggcaugagaggcuucaagggcgacagaggccccaagggcgagaagggcgagaagggcgacagagccggcgacgccagcggcguggaggcccccaugaugaucagacuggugaacggcagcggcccccacgagggcagaguggagguguaccacgacagaagauggggcaccgugugcgacgacggcugggacaagaaggacggcgacguggugugcagaaugcugggcuucagaggcguggaggagguguacagaaccgccagauucggccagggcaccggcagaaucuggauggacgacguggccugcaagggcaccgaggagaccaucuucagaugcagcuucagcaaguggggcgugaccaacugcggccacgccgaggacgccagcgugaccugcaacagacacuaa

SEQ ID NO: 23024 - RNA, 1521 nt, Artificial Sequence
  SCARB1__Homo_sapiens__NP_001076428
augggcugcagcgccaaggccagaugggccgccggcgcccugggcguggccggccugcugugcgccgugcugggcgccgugaugaucgugauggugcccagccugaucaagcagcaggugcugaagaacgugagaaucgaccccagcagccugagcuucaacauguggaaggagauccccauccccuucuaccugagcguguacuucuucgacgugaugaaccccagcgagauccugaagggcgagaagccccaggugagagagagaggccccuacguguacagagaguucagacacaagagcaacaucaccuucaacaacaacgacaccgugagcuuccuggaguacagaaccuuccaguuccagcccagcaagagccacggcagcgagagcgacuacaucgugaugcccaacauccuggugcugggcgccgccgugaugauggagaacaagcccaugacccugaagcugaucaugacccuggccuucaccacccugggcgagagagccuucaugaacagaaccgugggcgagaucauguggggcuacaaggacccccuggugaaccugaucaacaaguacuuccccggcauguuccccuucaaggacaaguucggccuguucgccgagcugaacaacagcgacagcggccuguucaccguguucaccggcgugcagaacaucagcagaauccaccugguggacaaguggaacggccugagcaagguggacuucuggcacagcgaccagugcaacaugaucaacggcaccagcggccagauguggccccccuucaugacccccgagagcagccuggaguucuacagccccgaggccugcagaagcaugaagcugauguacaaggagagcggcguguucgagggcauccccaccuacagauucguggcccccaagacccuguucgccaacggcagcaucuacccccccaacgagggcuucugccccugccuggagagcggcauccagaacgugagcaccugcagauucagcgccccccuguuccugagccacccccacuuccugaacgccgaccccgugcuggccgaggccgugaccggccugcaccccaaccaggaggcccacagccuguuccuggacauccaccccgugaccggcauccccaugaacugcagcgugaagcugcagcugagccuguacaugaagagcguggccggcaucggccagaccggcaagaucgagcccguggugcugccccugcugugguucgccgagagcggcgccauggagggcgagacccugcacaccuucuacacccagcuggugcugaugcccaaggugaugcacuacgcccaguacgugcugcuggcccugggcugcgugcugcugcuggugcccgugaucugccagaucagaagccagggccccgaggacaccgugagccagcccggccuggccgccggccccgacagaccccccagccccuacaccccccugcugcccgacagccccagcggccagccccccagccccaccgccuaa

SEQ ID NO: 23025 - RNA, 1008 nt, Artificial Sequence
  SCARB2__Homo_sapiens__NP_001191184
augggcagaugcugcuucuacaccgccggcacccugagccugcugcugcuggugaccagcgugacccugcugguggccagaguguuccagaaggccguggaccagagcaucgagaagaagaucgugcugagaaacggcaccgaggccuucgacagcugggagaagcccccccugcccguguacacccaguucuacuucuucaacgugaccaaccccgaggagauccugagaggcgagacccccagaguggaggaggugggccccuacaccuacagaagccuggacugguggaucaccgacaagugcaacaugaucaacggcaccgacggcgacagcuuccacccccugaucaccaaggacgaggugcuguacguguuccccagcgacuucugcagaagcguguacaucaccuucagcgacuacgagagcgugcagggccugcccgccuucagauacaaggugcccgccgagauccuggccaacaccagcgacaacgccggcuucugcauccccgagggcaacugccugggcagcggcgugcugaacgugagcaucugcaagaacggcgcccccaucaucaugagcuucccccacuucuaccaggccgacgagagauucgugagcgccaucgagggcaugcaccccaaccaggaggaccacgagaccuucguggacaucaacccccugaccggcaucauccugaaggccgccaagagauuccagaucaacaucuacgugaagaagcuggacgacuucguggagaccggcgacaucagaaccaugguguuccccgugauguaccugaacgagagcgugcacaucgacaaggagaccgccagcagacugaagagcaugaucaacaccacccugaucaucaccaacauccccuacaucaucauggcccugggcguguucuucggccugguguucaccuggcuggccugcaagggccagggcagcauggacgagggcaccgccgacgagagagccccccugaucagaaccuaa

SEQ ID NO: 23026 - RNA, 2616 nt, Artificial Sequence
  SCARF2__Homo_sapiens__NP_699165
auggagggcgccggccccagaggcgccggccccgccagaagaagaggcgccggcggcccccccagcccccugcugcccagccugcugcugcugcugcugcuguggaugcugcccgacaccguggccccccaggagcugaaccccagaggcagaaacgugugcagagcccccggcagccaggugcccaccugcugcgccggcuggagacagcagggcgacgagugcggcaucgccgugugcgagggcaacagcaccugcagcgagaacgaggugugcgugagacccggcgagugcagaugcagacacggcuacuucggcgccaacugcgacaccaagugccccagacaguucuggggccccgacugcaaggagcugugcagcugccacccccacggccagugcgaggacgugaccggccagugcaccugccacgccagaagauggggcgccagaugcgagcacgccugccagugccagcacggcaccugccaccccagaagcggcgccugcagaugcgagcccggcugguggggcgcccagugcgccagcgccugcuacugcagcgccaccagcagaugcgacccccagaccggcgccugccugugccacgccggcugguggggcagaagcugcaacaaccagugcgccugcaacagcagccccugcgagcagcagagcggcagaugccagugcagagagagaaccuucggcgccagaugcgacagauacugccagugcuucagaggcagaugccaccccguggacggcaccugcgccugcgagcccggcuacagaggcaaguacugcagagagcccugccccgccggcuucuacggccugggcugcagaagaagaugcggccagugcaagggccagcagcccugcaccguggccgagggcagaugccugaccugcgagcccggcuggaacggcaccaagugcgaccagcccugcgccaccggcuucuacggcgagggcugcagccacagaugcccccccugcagagacggccacgccugcaaccacgugaccggcaagugcaccagaugcaacgccggcuggaucggcgacagaugcgagaccaagugcagcaacggcaccuacggcgaggacugcgccuucgugugcgccgacugcggcagcggccacugcgacuuccagagcggcagaugccugugcagccccggcgugcacggcccccacugcaacgugaccugcccccccggccugcacggcgccgacugcgcccaggccugcagcugccacgaggacaccugcgaccccgugaccggcgccugccaccuggagaccaaccagagaaagggcgugaugggcgccggcgcccugcuggugcugcuggugugccugcugcugagccugcugggcugcugcugcgccugcagaggcaaggaccccaccagaagacccagacccagaagagagcugagccugggcagaaagaaggccccccacagacugugcggcagauucagcagaaucagcaugaagcugcccagaaucccccugagaagacagaagcugcccaagguggugguggcccaccacgaccuggacaacacccugaacugcagcuuccuggagccccccagcggccuggagcagcccagccccagcuggagcagcagagccagcuucagcagcuucgacaccaccgacgagggccccguguacugcgugccccacgaggaggcccccgccgagagcagagaccccgaggugcccaccgugcccgccgaggcccccgcccccagccccgugccccugaccacccccgccagcgccgaggaggccaucccccugcccgccagcagcgacagcgagagaagcgccagcagcguggagggccccggcggcgcccuguacgccagaguggccagaagagaggccagacccgccagagccagaggcgagaucggcggccugagccugagccccagccccgagagaagaaagccccccccccccgaccccgccaccaagcccaaggugagcuggauccacggcaagcacagcgccgccgccgccggcagagcccccagcccccccccccccggcagcgaggccgcccccagccccagcaagagaaagagaacccccagcgacaagagcgcccacaccguggagcacggcagccccagaaccagagaccccacccccagaccccccggccugcccgaggaggccaccgcccuggccgcccccagcccccccagagccagagccagaggcagaggccccggccugcuggagcccaccgacgccggcggcccccccagaagcgcccccgaggccgccagcaugcuggccgccgagcugagaggcaagaccagaagccugggcagagccgagguggcccugggcgcccagggccccagagagaagcccgcccccccccagaaggccaagagaagcgugccccccgccagccccgccagagccccccccgccaccgagacccccggccccgagaaggccgccaccgaccugcccgcccccgagacccccagaaagaagacccccauccagaagccccccagaaagaagagcagagaggccgccggcgagcugggcagagccggcgcccccacccuguaa

SEQ ID NO: 23027 - RNA, 1290 nt, Artificial Sequence
  SCCPDH__Homo_sapiens__NP_057086
auggccaccgagcagagacccuuccaccuggugguguucggcgccagcggcuucaccggccaguucgugaccgaggagguggccagagagcagguggaccccgagagaagcagcagacugcccugggccguggccggcagaagcagagagaagcugcagagagugcuggagaaggccgcccugaagcugggcagacccacccugagcagcgaggugggcaucaucaucugcgacaucgccaaccccgccagccuggacgagauggccaagcaggccaccguggugcugaacugcgugggccccuacagauucuacggcgagcccgugaucaaggccugcaucgagaacggcgccagcugcaucgacaucagcggcgagccccaguuccuggagcugaugcagcugaaguaccacgagaaggccgccgacaagggcguguacaucaucggcagcagcggcuucgacagcauccccgccgaccugggcgugaucuacaccagaaacaagaugaacggcacccugaccgccguggagagcuuccugaccauccacagcggccccgagggccugagcauccacgacggcaccuggaagagcgccaucuacggcuucggcgaccagagcaaccugagaaagcugagaaacgugagcaaccugaagcccgugccccugaucggccccaagcugaagagaagauggcccaucagcuacugcagagagcugaagggcuacagcauccccuucaugggcagcgacgugagcguggugagaagaacccagagauaccuguacgagaaccuggaggagagccccgugcaguacgccgccuacgugaccgugggcggcaucaccagcgugaucaagcugauguucgccggccuguucuuccuguucuucgugagauucggcaucggcagacagcugcugaucaaguuccccugguucuucagcuucggcuacuucagcaagcagggccccacccagaagcagaucgacgccgccagcuucacccugaccuucuucggccagggcuacagccagggcaccggcaccgacaagaacaagcccaacaucaagaucugcacccaggugaagggccccgaggccggcuacguggccacccccaucgccauggugcaggccgccaugacccugcugagcgacgccagccaccugcccaaggccggcggcguguucacccccggcgccgccuucagcaagaccaagcugaucgacagacugaacaagcacggcaucgaguucagcgugaucagcagcagcgagguguaa

SEQ ID NO: 23028 - RNA, 993 nt, Artificial Sequence
  SCD5__Homo_sapiens__NP_001032671
augcccggccccgccaccgacgccggcaagauccccuucugcgacgccaaggaggagaucagagccggccuggagagcagcgagggcggcggcggccccgagagacccggcgccagaggccagagacagaacaucguguggagaaacguggugcugaugagccugcugcaccugggcgccguguacagccuggugcugauccccaaggccaagccccugacccugcugugggccuacuucugcuuccugcuggccgcccugggcgugaccgccggcgcccacagacuguggagccacagaagcuacagagccaagcugccccugagaaucuuccuggccguggccaacagcauggccuuccagaacgacaucuucgaguggagcagagaccacagagcccaccacaaguacagcgagaccgacgccgacccccacaacgccagaagaggcuucuucuucagccacaucggcuggcuguucgugagaaagcacagagacgugaucgagaagggcagaaagcuggacgugaccgaccugcuggccgaccccguggugagaauccagagaaaguacuacaagaucagcguggugcugaugugcuucguggugcccacccuggugcccugguacaucuggggcgagagccuguggaacagcuacuuccuggccagcauccugagauacaccaucagccugaacaucagcuggcuggugaacagcgccgcccacauguacggcaacagacccuacgacaagcacaucagccccagacagaacccccugguggcccugggcgccaucggcgagggcuuccacaacuaccaccacaccuuccccuucgacuacagcgccagcgaguucggccugaacuucaaccccaccaccugguucaucgacuucaugugcuggcugggccuggccaccgacagaaagagagccaccaagcccaugaucgaggccagaaaggccagaaccggcgacagcagcgccuaa

SEQ ID NO: 23029 - RNA, 1080 nt, Artificial Sequence
  SCD__Homo_sapiens__NP_005054
augcccgcccaccugcugcaggacgacaucagcagcagcuacaccaccaccaccaccaucaccgccccccccagcagagugcugcagaacggcggcgacaagcuggagaccaugccccuguaccuggaggacgacaucagacccgacaucaaggacgacaucuacgaccccaccuacaaggacaaggagggccccagccccaagguggaguacguguggagaaacaucauccugaugagccugcugcaccugggcgcccuguacggcaucacccugauccccaccugcaaguucuacaccuggcuguggggcguguucuacuacuucgugagcgcccugggcaucaccgccggcgcccacagacuguggagccacagaagcuacaaggccagacugccccugagacuguuccugaucaucgccaacaccauggccuuccagaacgacguguacgagugggccagagaccacagagcccaccacaaguucagcgagacccacgccgacccccacaacagcagaagaggcuucuucuucagccacgugggcuggcugcuggugagaaagcaccccgccgugaaggagaagggcagcacccuggaccugagcgaccuggaggccgagaagcuggugauguuccagagaagauacuacaagcccggccugcugaugaugugcuucauccugcccacccuggugcccugguacuucuggggcgagaccuuccagaacagcguguucguggccaccuuccugagauacgccguggugcugaacgccaccuggcuggugaacagcgccgcccaccuguucggcuacagacccuacgacaagaacaucagccccagagagaacauccuggugagccugggcgccgugggcgagggcuuccacaacuaccaccacagcuuccccuacgacuacagcgccagcgaguacagauggcacaucaacuucaccaccuucuucaucgacugcauggccgcccugggccuggccuacgacagaaagaaggugagcaaggccgccauccuggccagaaucaagagaaccggcgacggcaacuacaagagcggcuaa

SEQ ID NO: 23030 - RNA, 1653 nt, Artificial Sequence
  SCFD1__Homo_sapiens__NP_001244305
augcccaccgaggagaacaucgacagaaugugccaggaccugagaaaccagcuguacgagagcuacuaccugaacuucaucagcgccaucagcagaagcaagcuggaggacaucgccaacgccgcccuggccgccagcgccgugacccagguggccaagguguucgaccaguaccugaacuucaucacccuggaggacgacauguucgugcugugcaaccagaacaaggagcuggugagcuacagagccaucaacagacccgacaucaccgacaccgagauggagaccgugauggacaccaucguggacagccuguucugcuucuucgugacccugggcgccgugcccaucaucagaugcagcagaggcaccgccgccgagaugguggccgugaagcuggacaagaagcugagagagaaccugagagacgccagaaacagccuguucaccggcgacacccugggcgccggccaguucagcuuccagagaccccugcuggugcugguggacagaaacaucgaccuggccaccccccugcaccacaccuggaccuaccaggcccuggugcacgacgugcuggacuuccaccugaacagagugaaccuggaggagagcagcggcguggagaacagccccgccggcgccagacccaagagaaagaacaagaagagcuacgaccugacccccguggacaaguucuggcagaagcacaagggcagccccuuccccgagguggccgagagcgugcagcaggagcuggagagcuacagagcccaggaggacgaggugaagagacugaagagcaucaugggccuggagggcgaggacgagggcgccaucagcaugcugagcgacaacaccgccaagcugaccagcgccgugagcagccugcccgagcugcuggagaagaagagacugaucgaccugcacaccaacguggccaccgccgugcuggagcacaucaaggccagaaagcuggacguguacuucgaguacgaggagaagaucaugagcaagaccacccuggacaagagccugcuggacaucaucagcgaccccgacgccggcacccccgaggacaagaugagacuguuccugaucuacuacaucagcacccagcaggcccccagcgaggccgaccuggagcaguacaagaaggcccugaccgacgccggcugcaaccugaacccccugcaguacaucaagcaguggaaggccuucaccaagauggccagcgcccccgccagcuacggcagcaccaccaccaagcccaugggccugcugagcagagugaugaacaccggcagccaguucgugauggagggcgugaagaaccuggugcugaagcagcagaaccugcccgugaccagaauccuggacaaccugauggagaugaagagcaaccccgagaccgacgacuacagauacuucgaccccaagaugcugagaggcaacgacagcagcgugcccagaaacaagaaccccuuccaggaggccaucguguucguggugggcggcggcaacuacaucgaguaccagaaccugguggacuacaucaagggcaagcagggcaagcacauccuguacggcugcagcgagcuguucaacgccacccaguucaucaagcagcugagccagcugggccagaaguaa

SEQ ID NO: 23031 - RNA, 2055 nt, Artificial Sequence
  SCFD2__Homo_sapiens__NP_689753
augagcgccagcggcgugcugagcuucacccagcagggcugggagcaggugcuggccaaggugaagagagccgugguguaccuggacgccgccugcgccgagagccugcacuggggcugcggcagcaccagacugcuggaggccgugggcggccccgacugccaccugagagaguucgagcccgacgccaucggcggcggcgccaagcagcccaaggccguguucgugcugagcugccugcugaagggcagaaccguggagauccugagagacaucaucugcagaagccacuuccaguacugcgugguggugaccaccgugagccacgccgugcaccugaccgccaaccacgugcccgccgccgccgccgccgagauggagggccagcagcccguguucgagcagcuggaggagaagcugugcgaguggaugggcaacaugaacuacaccgccgagguguuccacgugccccugcugcuggcccccguggccccccacuucgcccugacccccgccuucgccagccuguucccccugcugccccaggacgugcaccugcugaacagcgccagacccgacaagagaaagcugggcagccugggcgacguggacagcaccacccugacccccgagcugcugcugcagaucagaugccuggugagcggccugagcagccugugcgagcaccugggcgugagagaggagugcuucgccgugggcagccugagccaggugaucgccgccgaccuggccaacuacgcccccgccaagaacagaaagaagaccgccgccggcagagccagcgugguguucguggacagaacccuggaccugaccggcgccgugggccaccacggcgacaaccugguggagaagaucaucagcgcccugccccagcugcccggccacaccaacgacgugauggugaacaugaucgcccugaccgcccugcacaccgaggaggagaacuacaacgugguggcccccggcugccugagccagagcagcgacaccaccgccaaggcccugugggaggcccugcugaacaccaagcacaaggaggccgugauggaggugagaagacaccugguggaggccgccagcagagagaaccugcccaucaagaugagcaugggcagagugacccccggccagcugaugagcuacauccagcuguucaagaacaaccugaaggcccugaugaaccacugcggccugcugcagcugggccuggccaccgcccagacccugaagcacccccagaccgccaagugggacaacuuccuggccuucgagagacugcugcugcagagcaucggcgagagcgccaugagcguggugcugaaccagcugcugcccaugaucaagcccgugacccagagaaccaacgaggacuacagccccgaggagcugcugauccugcugaucuacaucuacagcgugaccggcgagcugaccguggacaaggaccugugcgaggccgaggagaaggugaagaaggcccuggcccagguguucugcgaggagagcggccugagcccccugcugcagaagaucaccgacugggacagcagcaucaaccugaccuuccacaagagcaagaucgccguggacgagcuguucaccagccugagagacaucgccggcgccagaagccugcugaagcaguucaagagcguguacgugcccggcaaccacacccaccaggccagcuacaagccccugcugaagcaggugguggaggagaucuuccaccccgagagacccgacagcguggacaucgagcacaugagcagcggccugaccgaccugcugaagaccggcuucagcauguucaugaaggugagcagaccccaccccagcgacuacccccugcugauccuguucguggugggcggcgugaccgugagcgaggugaagauggugaaggaccugguggccagccugaagcccggcacccaggugaucgugcugagcaccagacugcugaagccccugaacauccccgagcugcuguucgccaccgacagacugcaccccgaccugggcuucuaa

SEQ ID NO: 23032 - RNA, 1854 nt, Artificial Sequence
  SCG2__Homo_sapiens__NP_003460
auggccgaggccaagacccacuggcugggcgccgcccugagccugaucccccugaucuuccugaucagcggcgccgaggccgccagcuuccagagaaaccagcugcugcagaaggagcccgaccugagacuggagaacgugcagaaguuccccagccccgagaugaucagagcccuggaguacaucgagaaccugagacagcaggcccacaaggaggagagcagccccgacuacaaccccuaccagggcgugagcgugccccugcagcagaaggagaacggcgacgagagccaccugcccgagagagacagccugagcgaggaggacuggaugagaaucauccuggaggcccugagacaggccgagaacgagccccagagcgcccccaaggagaacaagcccuacgcccugaacagcgagaagaacuuccccauggacaugagcgacgacuacgagacccagcaguggcccgagagaaagcugaagcacaugcaguucccccccauguacgaggagaacagcagagacaaccccuucaagagaaccaacgagaucguggaggagcaguacaccccccagagccuggccacccuggagagcguguuccaggagcugggcaagcugaccggccccaacaaccagaagagagagagaauggacgaggagcagaagcuguacaccgacgacgaggacgacaucuacaaggccaacaacaucgccuacgaggacguggugggcggcgaggacuggaaccccguggaggagaagaucgagagccagacccaggaggaggugagagacagcaaggagaacaucgagaagaacgagcagaucaacgacgagaugaagagaagcggccagcugggcauccaggaggaggaccugagaaaggagagcaaggaccagcugagcgacgacgugagcaaggugaucgccuaccugaagagacuggugaacgccgccggcagcggcagacugcagaacggccagaacggcgagagagccaccagacuguucgagaagccccuggacagccagagcaucuaccagcugaucgagaucagcagaaaccugcagaucccccccgaggaccugaucgagaugcugaagaccggcgagaagcccaacggcagcguggagcccgagagagagcuggaccugcccguggaccuggacgacaucagcgaggccgaccuggaccaccccgaccuguuccagaacagaaugcugagcaagagcggcuaccccaagacccccggcagagccggcaccgaggcccugcccgacggccugagcguggaggacauccugaaccugcugggcauggagagcgccgccaaccagaagaccagcuacuuccccaaccccuacaaccaggagaaggugcugcccagacugcccuacggcgccggcagaagcagaagcaaccagcugcccaaggccgccuggaucccccacguggagaacagacagauggccuacgagaaccugaacgacaaggaccaggagcugggcgaguaccuggccagaaugcuggugaaguaccccgagaucaucaacagcaaccaggugaagagagugcccggccagggcagcagcgaggacgaccugcaggaggaggagcagaucgagcaggccaucaaggagcaccugaaccagggcagcagccaggagaccgacaagcuggcccccgugagcaagagauuccccgugggcccccccaagaacgacgacacccccaacagacaguacugggacgaggaccugcugaugaaggugcuggaguaccugaaccaggagaaggccgagaagggcagagagcacaucgccaagagagccauggagaacauguaa

SEQ ID NO: 23033 - RNA, 711 nt, Artificial Sequence
  SCG3__Homo_sapiens__NP_001158729
auggccgccauccaggacggccuggccaagggcgagaacgacgagaccgugagcaacacccugacccugaccaacggccuggagagaagaaccaagaccuacagcgaggacaacuucgaggagcugcaguacuuccccaacuucuacgcccugcugaagagcaucgacagcgagaaggaggccaaggagaaggagacccugaucaccaucaugaagacccugaucgacuucgugaagaugauggugaaguacggcaccaucagccccgaggagggcgugagcuaccuggagaaccuggacgagaugaucgcccugcagaccaagaacaagcuggagaagaacgccaccgacaacaucagcaagcuguuccccgcccccagcgagaagagccacgaggagaccgacagcaccaaggaggaggccgccaagauggagaaggaguacggcagccugaaggacagcaccaaggacgacaacagcaaccccggcggcaagaccgacgagcccaagggcaagaccgaggccuaccuggaggccaucagaaagaacaucgaguggcugaagaagcacgacaagaagggcaacaaggaggacuacgaccugagcaagaugagagacuucaucaacaagcaggccgacgccuacguggagaagggcauccuggacaaggaggaggccgaggccaucaagagaaucuacagcagccuguaa

SEQ ID NO: 23034 - RNA, 639 nt, Artificial Sequence
  SCG5__Homo_sapiens__NP_001138229
auggugagcagaauggugagcaccaugcugagcggccugcuguucuggcuggccagcggcuggacccccgccuucgccuacagccccagaacccccgacagagugagcgaggccgacauccagagacugcugcacggcgugauggagcagcugggcaucgccagacccagaguggaguaccccgcccaccaggccaugaaccuggugggcccccagagcaucgagggcggcgcccacgagggccugcagcaccugggccccuucggcaacauccccaacaucguggccgagcugaccggcgacaacauccccaaggacuucagcgaggaccagggcuaccccgacccccccaaccccugccccgugggcaagaccgccgacgacggcugccuggagaacacccccgacaccgccgaguucagcagagaguuccagcugcaccagcaccuguucgaccccgagcacgacuaccccggccugggcaaguggaacaagaagcugcuguacgagaagaugaagggcggcgagagaagaaagagaagaagcgugaaccccuaccugcagggccagagacuggacaacgugguggccaagaagagcgugccccacuucagcgacgaggacaaggaccccgaguaa

SEQ ID NO: 23035 - RNA, 276 nt, Artificial Sequence
  SCGB1A1__Homo_sapiens__NP_003348
augaagcuggccgugacccugacccuggugacccuggcccugugcugcagcagcgccagcgccgagaucugccccagcuuccagagagugaucgagacccugcugauggacacccccagcagcuacgaggccgccauggagcuguucagccccgaccaggacaugagagaggccggcgcccagcugaagaagcugguggacacccugccccagaagcccagagagagcaucaucaagcugauggagaagaucgcccagagcagccugugcaacuaa

SEQ ID NO: 23036 - RNA, 273 nt, Artificial Sequence
  SCGB1D1__Homo_sapiens__NP_006543
augagacugagcgugugccugcugcugcugacccuggcccugugcugcuacagagccaacgccguggugugccaggcccugggcagcgagaucaccggcuuccugcuggccggcaagcccguguucaaguuccagcuggccaaguucaaggccccccuggaggccguggccgccaagauggaggugaagaagugcguggacaccauggccuacgagaagagagugcugaucaccaagacccugggcaagaucgccgagaagugcgacagauaa

SEQ ID NO: 23037 - RNA, 273 nt, Artificial Sequence
  SCGB1D2__Homo_sapiens__NP_006542
augaagcugagcgugugccugcugcuggugacccuggcccugugcugcuaccaggccaacgccgaguucugccccgcccuggugagcgagcugcuggacuucuucuucaucagcgagccccuguucaagcugagccuggccaaguucgacgccccccccgaggccguggccgccaagcugggcgugaagagaugcaccgaccagaugagccugcagaagagaagccugaucgccgaggugcuggugaagauccugaagaagugcagcguguaa

SEQ ID NO: 23038 - RNA, 288 nt, Artificial Sequence
  SCGB2A1__Homo_sapiens__NP_002398
augaagcugcugauggugcugaugcuggccgcccugcugcugcacugcuacgccgacagcggcugcaagcugcuggaggacaugguggagaagaccaucaacagcgacaucagcauccccgaguacaaggagcugcugcaggaguucaucgacagcgacgccgccgccgaggccaugggcaaguucaagcagugcuuccugaaccagagccacagaacccugaagaacuucggccugaugaugcacaccguguacgacagcaucuggugcaacaugaagagcaacuaa

SEQ ID NO: 23039 - RNA, 282 nt, Artificial Sequence
  SCGB2A2__Homo_sapiens__NP_002402
augaagcugcugauggugcugaugcuggccgcccugagccagcacugcuacgccggcagcggcugcccccugcuggagaacgugaucagcaagaccaucaacccccaggugagcaagaccgaguacaaggagcugcugcaggaguucaucgacgacaacgccaccaccaacgccaucgacgagcugaaggagugcuuccugaaccagaccgacgagacccugagcaacguggagguguucaugcagcugaucuacgacagcagccugugcgaccuguucuaa

SEQ ID NO: 23040 - RNA, 291 nt, Artificial Sequence
  SCGB2B2__Homo_sapiens__NP_001020762
augagagugaccagcgccaccugcgcccugcugcuggcccugaucugcagcgugcagcugggcgacgccugccuggacaucgacaagcugcuggccaacgugguguucgacgugagccaggaccugcugaaggaggagcuggccagauacaaccccagcccccugaccgaggagagcuuccugaacgugcagcagugcuucgccaacgugagcgugaccgagagauucgcccacagcguggugaucaagaagauccugcagagcaacgacugcaucgaggccgccuucuaa

SEQ ID NO: 23041 - RNA, 315 nt, Artificial Sequence
  SCGB3A1__Homo_sapiens__NP_443095
augaagcuggccgcccugcugggccugugcguggcccugagcugcagcagcgccgccgccuuccuggugggcagcgccaagcccguggcccagcccguggccgcccuggagagcgccgccgaggccggcgccggcacccuggccaacccccugggcacccugaacccccugaagcugcugcugagcagccugggcauccccgugaaccaccugaucgagggcagccagaagugcguggccgagcugggcccccaggccgugggcgccgugaaggcccugaaggcccugcugggcgcccugaccguguucggcuaa

SEQ ID NO: 23042 - RNA, 282 nt, Artificial Sequence
  SCGB3A2__Homo_sapiens__NP_473364
augaagcuggugaccaucuuccugcuggugaccaucagccugugcagcuacagcgccaccgccuuccugaucaacaaggugccccugcccguggacaagcuggccccccugccccuggacaacauccugcccuucauggacccccugaagcugcugcugaagacccugggcaucagcguggagcaccugguggagggccugagaaagugcgugaacgagcugggccccgaggccagcgaggccgugaagaagcugcuggaggcccugagccaccugguguaa

SEQ ID NO: 23043 - RNA, 831 nt, Artificial Sequence
  SCGN__Homo_sapiens__NP_008929
auggacagcagcagagagcccacccugggcagacuggacgccgccggcuucuggcagguguggcagagauucgacgccgacgagaagggcuacaucgaggagaaggagcuggacgccuucuuccugcacaugcugaugaagcugggcaccgacgacaccgugaugaaggccaaccugcacaaggugaagcagcaguucaugaccacccaggacgccagcaaggacggcagaaucagaaugaaggagcuggccggcauguuccugagcgaggacgagaacuuccugcugcuguucagaagagagaacccccuggacagcagcguggaguucaugcagaucuggagaaaguacgacgccgacagcagcggcuucaucagcgccgccgagcugagaaacuuccugagagaccuguuccugcaccacaagaaggccaucagcgaggccaagcuggaggaguacaccggcaccaugaugaagaucuucgacagaaacaaggacggcagacuggaccugaacgaccuggccagaauccuggcccugcaggagaacuuccugcugcaguucaagauggacgccugcagcaccgaggagagaaagagagacuucgagaagaucuucgccuacuacgacgugagcaagaccggcgcccuggagggccccgagguggacggcuucgugaaggacaugauggagcuggugcagcccagcaucagcggcguggaccuggacaaguucagagagauccugcugagacacugcgacgugaacaaggacggcaagauccagaagagcgagcuggcccugugccugggccugaagaucaaccccuaa

SEQ ID NO: 23044 - RNA, 1425 nt, Artificial Sequence
  SCHIP1__Homo_sapiens__NP_001184036
auggagagaagcggccagagagugaccaccugggacugcgaccagggcaagcacagcgacagcgacuacagagaggacggcauggaccugggcagcgacgccggcagcagcagcagcagcagcagagccagcagccagagcaacagcaccaaggugacccccugcagcgagugcaagagcagcagcagccccggcggcagccuggaccuggugagcgcccuggaggacuacgaggagcccuuccccguguaccagaagaaggugaucgacgagugggcccccgaggaggacggcgaggaggaggaggaggaggacgagagagaccagagaggcuacagagacgacagaagccccgccagagagcccggcgacgugagcgccagaaccagaagcggcggcggcggcggcagaagcgccaccaccgccaugcccccccccgugcccaacggcaaccugcaccagcacgacccccaggaccugagacacaacggcaacguggugguggccggcagacccagcugcagcagaggccccagaagagccauccagaagccccagcccgccggcggcagaagaagcggcagaggccccgccgccggcggccugugccugcagccccccgacggcggcaccugcgugcccgaggagccccccgugccccccauggacugggaggcccuggagaagcaccuggccggccugcaguucagagagcaggaggcccagaagaacgagagagagagcaucagacagaagcuggcccugggcagcuucuucgacgacggccccggcaucuacaccagcugcagcaagagcggcaagcccagccugagcagcagacugcagagcggcaugaaccugcagaucugcuucgugaacgacagcggcagcgacaaggacagcgacgccgacgacagcaagaccgagaccagccuggacaccccccugagccccaugagcaagcagagcagcagcuacagcgacagagacaccaccgaggaggagagcgagagccuggacgacauggacuuccugaccagacagaagaagcugcaggccgaggccaagauggcccuggccauggccaagcccauggccaagaugcagguggagguggagaagcagaacagaaagaagagccccguggccgaccugcugccccacaugccccacaucagcgagugccugaugaagagaagccugaagcccaccgaccugagagacaugaccaucggccagcugcaggugaucgugaacgaccugcacagccagaucgagagccugaacgaggagcuggugcagcugcugcugaucagagacgagcugcacaccgagcaggacgccaugcugguggacaucgaggaccugaccagacacgccgagagccagcagaagcacauggccgagaagaugcccgccaaguaa

SEQ ID NO: 23045 - RNA, 2148 nt, Artificial Sequence
  SCIN__Homo_sapiens__NP_001106177
auggccagagagcuguaccacgaggaguucgccagagccggcaagcaggccggccugcagguguggagaaucgagaagcuggagcuggugcccgugccccagagcgcccacggcgacuucuacgugggcgacgccuaccuggugcugcacaccgccaagaccagcagaggcuucaccuaccaccugcacuucuggcugggcaaggagugcagccaggacgagagcaccgccgccgccaucuucaccgugcagauggacgacuaccugggcggcaagcccgugcagaacagagagcugcagggcuacgagagcaacgacuucgugagcuacuucaagggcggccugaaguacaaggccggcggcguggccagcggccugaaccacgugcugaccaacgaccugaccgccaagagacugcugcacgugaagggcagaagaguggugagagccaccgaggugccccugagcugggacagcuucaacaagggcgacugcuucaucaucgaccugggcaccgagaucuaccaguggugcggcagcagcugcaacaaguacgagagacugaaggccaaccagguggccaccggcaucagauacaacgagagaaagggcagaagcgagcugaucgugguggaggagggcagcgagcccagcgagcugaucaaggugcugggcgagaagcccgagcugcccgacggcggcgacgacgacgacaucaucgccgacaucagcaacagaaagauggccaagcuguacauggugagcgacgccagcggcagcaugagagugaccgugguggccgaggagaaccccuucagcauggccaugcugcugagcgaggagugcuucauccuggaccacggcgccgccaagcagaucuucguguggaagggcaaggacgccaacccccaggagagaaaggccgccaugaagaccgccgaggaguuccugcagcagaugaacuacagcaagaacacccagauccaggugcugcccgagggcggcgagacccccaucuucaagcaguucuucaaggacuggagagacaaggaccagagcgacggcuucggcaagguguacgugaccgagaagguggcccagaucaagcagauccccuucgacgccagcaagcugcacagcagcccccagauggccgcccagcacaacaugguggacgacggcagcggcaagguggagaucuggagaguggagaacaacggcagaauccagguggaccagaacagcuacggcgaguucuacggcggcgacugcuacaucauccuguacaccuaccccagaggccagaucaucuacaccuggcagggcgccaacgccaccagagacgagcugaccaccagcgccuuccugaccgugcagcuggacagaagccugggcggccaggccgugcagaucagagugagccagggcaaggagcccgugcaccugcugagccuguucaaggacaagccccugaucaucuacaagaacggcaccagcaagaagggcggccaggcccccgccccccccaccagacuguuccaggugagaagaaaccuggccagcaucaccagaaucguggagguggacguggacgccaacagccugaacagcaacgacguguucgugcugaagcugccccagaacagcggcuacaucugggugggcaagggcgccagccaggaggaggagaagggcgccgaguacguggccagcgugcugaagugcaagacccugagaauccaggagggcgaggagcccgaggaguucuggaacagccugggcggcaagaaggacuaccagaccagcccccugcuggagacccaggccgaggaccacccccccagacuguacggcugcagcaacaagaccggcagauucgugaucgaggagauccccggcgaguucacccaggacgaccuggccgaggacgacgugaugcugcuggacgccugggagcagaucuucaucuggaucggcaaggacgccaacgagguggagaagaaggagagccugaagagcgccaagauguaccuggagaccgaccccagcggcagagacaagagaacccccaucgugaucaucaagcagggccacgagccccccaccuucaccggcugguuccugggcugggacagcagcaagugguaa

SEQ ID NO: 23046 - RNA, 240 nt, Artificial Sequence
  SCLT1__Homo_sapiens__NP_001287826
auggccgccgagaucgacuuccugagagagcagaacagaagacugaacgaggacuucagaagauaccagauggagagcuucagcaaguacagcagcgugcagaaggccgugugccagggcgagggcgacgacaccuucgagaaccugguguucgaccagagcuuccuggccccccuggugaccgaguacgacaagcaccugggcgagcugaacggccagcugaaguacuaccaggccuaa

SEQ ID NO: 23047 - RNA, 1362 nt, Artificial Sequence
  SCLY__Homo_sapiens__NP_057594
augcccggcagcagcggcgccggcauggaggccgccguggcccccggcagagacgcccccgcccccgccgccagccagcccagcggcugcggcaagcacaacagccccgagagaaagguguacauggacuacaacgccaccaccccccuggagcccgaggugauccaggccaugaccaaggccaugugggaggccuggggcaaccccagcagccccuacagcgccggcagaaaggccaaggacaucaucaacgccgccagagagagccuggccaagaugaucggcggcaagccccaggacaucaucuucaccagcggcggcaccgagagcaacaaccuggugauccacagcguggugaagcacuuccacgccaaccagaccagcaagggccacaccggcggccaccacagccccgugaagggcgccaagccccacuucaucaccagcagcguggagcacgacagcaucagacugccccuggagcaccugguggaggagcagguggccgccgugaccuucgugcccgugagcaaggugagcggccaggccgagguggacgacauccuggccgccgugagacccaccaccagacuggugaccaucaugcuggccaacaacgagaccggcaucgugaugcccgugcccgagaucagccagagaaucaaggcccugaaccaggagagaguggccgccggccugccccccauccuggugcacaccgacgccgcccaggcccugggcaagcagagaguggacguggaggaccugggcguggacuuccugaccaucgugggccacaaguucuacggccccagaaucggcgcccuguacaucagaggccugggcgaguucaccccccuguaccccaugcuguucggcggcggccaggagagaaacuucagacccggcaccgagaacacccccaugaucgccggccugggcaaggccgccgagcuggugacccagaacugcgaggccuacgaggcccacaugagagacgugagagacuaccuggaggagagacuggaggccgaguucggccagaagagaauccaccugaacagccaguuccccggcacccagagacugcccaacaccugcaacuucagcaucagaggccccagacugcagggccacguggugcuggcccagugcagagugcugauggccagcgugggcgccgccugccacagcgaccacggcgaccagcccagccccgugcugcugagcuacggcgugcccuucgacguggccagaaacgcccugagacugagcgugggcagaagcaccaccagagccgagguggaccugguggugcaggaccugaagcaggccguggcccagcuggaggaccaggccuaa

SEQ ID NO: 23048 - RNA, 2103 nt, Artificial Sequence
  SCML2__Homo_sapiens__NP_006080
augggccagaccgugaacgaggacagcauggacgugaagaaggagaaccaggagaagaccccccagagcagcaccagcagcgugcagagagacgacuuccacugggaggaguaccugaaggagaccggcagcaucagcgcccccagcgagugcuucagacagagccagaucccccccgugaacgacuucaaggugggcaugaagcuggaggccagagaccccagaaacgccaccagcgugugcaucgccaccgugaucggcaucaccggcgccagacugagacugagacuggacggcagcgacaacagaaacgacuucuggagacugguggacagccccgacauccagcccgugggcaccugcgagaaggagggcgaccugcugcagcccccccugggcuaccagaugaacaccagcagcuggcccauguuccugcugaagacccugaacggcagcgagauggccagcgccacccuguucaagaaggagccccccaagcccccccugaacaacuucaaggugggcaugaagcuggaggccaucgacaagaagaaccccuaccugaucugccccgccaccaucggcgacgugaagggcgacgaggugcacaucaccuucgacggcuggagcggcgccuucgacuacuggugcaaguacgacagcagagacaucuuccccgccggcuggugcagacugaccggcgacgugcugcagccccccggcaccagcgugcccaucgugaagaacaucgccaagaccgagagcagccccagcgaggccagccagcacagcaugcagagcccccagaagaccacccugauccugcccacccagcaggugagaagaagcagcagaaucaagccccccggccccaccgccgugcccaagagaagcagcagcgugaagaacaucacccccagaaagaagggccccaacagcggcaagaaggagaagccccugcccgugaucugcagcaccagcgccgccagccugaagagccugaccagagacagaggcaugcuguacaaggacguggccagcggccccugcaagaucgugaugagcaccgugugcguguacgugaacaagcacggcaacuucggcccccaccuggaccccaagagaauccagcagcugcccgaccacuucggccccggccccgugaacguggugcugagaagaaucgugcaggccugcguggacugcgcccuggagaccaagaccguguucggcuaccugaagcccgacaacagaggcggcgaggugaucaccgccagcuucgacggcgagacccacagcauccagcugccccccgugaacagcgccagcuucgcccugagauuccuggagaacuucugccacagccugcagugcgacaaccugcugagcagccagcccuucagcagcagcagaggccacacccacagcagcgccgagcacgacaagaaccagagcgccaaggaggacgugaccgagagacagagcaccaagagaagcccccagcagaccgugcccuacguggugccccugagccccaagcugcccaagaccaaggaguacgccagcgagggcgagccccuguucgccggcggcagcgccauccccaaggaggagaaccugagcgaggacagcaagagcagcagccugaacagcggcaacuaccugaaccccgccugcagaaaccccauguacauccacaccagcgugagccaggacuucagcagaagcgugcccggcaccaccagcagcccccuggugggcgacaucagccccaagagcagcccccacgaggugaaguuccagaugcagagaaagagcgaggcccccagcuacaucgccgugcccgaccccagcgugcugaagcagggcuucagcaaggaccccagcaccuggagcguggacgaggugauccaguucaugaagcacaccgacccccagaucagcggcccccuggccgaccuguucagacagcacgagaucgacggcaaggcccuguuccugcugaagagcgacgugaugaugaaguacaugggccugaagcugggccccgcccugaagcugugcuacuacaucgagaagcugaaggagggcaaguacagcuaa

SEQ ID NO: 23049 - RNA, 1245 nt, Artificial Sequence
  SCML4__Homo_sapiens__NP_932347
augcagagccagagaauccccggcagaaagagaggcagacccagccugcacagcacccccaugaagauggccgugcacaaccuguacagcgccagcgccggcagccugcccgccgugaagauccccaagaagagaggcagaaagcccggcuacaagaucaagagcagagugcugaugaccccccuggcccugagcccccccagaagcacccccgagcccgaccugagcagcaucccccaggacgccgccaccgugcccagccuggccgccccccaggcccugaccgugugccuguacaucaacaagcaggccaacgccggccccuaccuggagagaaagaaggugcagcagcugcccgagcacuucggccccgagagacccagcgccgugcugcagcaggccgugcaggccugcaucgacugcgcccaccagcagaagcugguguucagccuggugaagcagggcuacggcggcgagauggugagcgugagcgccagcuucgacggcaagcagcaccugagaagccugcccguggugaacagcaucggcuacgugcugagauuccuggccaagcugugcagaagccugcugugcgacgaccuguucagccaccagcccuuccccagaggcugcagcgccagcgagaaggugcaggagaaggaggagggcagaauggagagcgugaagaccgugaccaccgaggaguaccuggugaaccccgugggcaugaacagauacagcguggacaccagcgccagcaccuucaaccacagaggcagccugcaccccagcagcagccuguacugcaagagacagaacagcggcgacagccaccugggcggcggccccgccgccaccgccggcggccccagaaccagccccaugagcagcggcggccccagcgcccccggccugagaccccccgccagcagccccaagagaaacaccaccagccuggagggcaacagaugcgccagcagccccagccaggacgcccaggacgccagaagacccagaagcagaaaccccagcgccuggaccguggaggacguggugugguucgugaaggacgccgacccccaggcccugggcccccacguggagcuguucagaaagcacgagaucgacggcaacgcccugcugcugcugaagagcgacauggugaugaaguaccugggccugaagcugggccccgcccugaagcugugcuaccacaucgacaagcugaagcaggccaaguucuaa

SEQ ID NO: 23050 - RNA, 5871 nt, Artificial Sequence
  SCN10A__Homo_sapiens__NP_006505
auggaguuccccaucggcagccuggagaccaacaacuucagaagauucacccccgagagccugguggagaucgagaagcagaucgccgccaagcagggcaccaagaaggccagagagaagcacagagagcagaaggaccaggaggagaagcccagaccccagcuggaccugaaggccugcaaccagcugcccaaguucuacggcgagcugcccgccgagcugaucggcgagccccuggaggaccuggaccccuucuacagcacccacagaaccuucauggugcugaacaagggcagaaccaucagcagauucagcgccaccagagcccuguggcuguucagccccuucaaccugaucagaagaaccgccaucaaggugagcgugcacagcugguucagccuguucaucaccgugaccauccuggugaacugcgugugcaugaccagaaccgaccugcccgagaagaucgaguacguguucaccgugaucuacaccuucgaggcccugaucaagauccuggccagaggcuucugccugaacgaguucaccuaccugagagaccccuggaacuggcuggacuucagcgugaucacccuggccuacgugggcaccgccaucgaccugagaggcaucagcggccugagaaccuucagagugcugagagcccugaagaccgugagcgugauccccggccugaaggugaucgugggcgcccugauccacagcgugaagaagcuggccgacgugaccauccugaccaucuucugccugagcguguucgcccuggugggccugcagcuguucaagggcaaccugaagaacaagugcgugaagaacgacauggccgugaacgagaccaccaacuacagcagccacagaaagcccgacaucuacaucaacaagagaggcaccagcgacccccugcugugcggcaacggcagcgacagcggccacugccccgacggcuacaucugccugaagaccagcgacaaccccgacuucaacuacaccagcuucgacagcuucgccugggccuuccugagccuguucagacugaugacccaggacagcugggagagacuguaccagcagacccugagaaccagcggcaagaucuacaugaucuucuucgugcuggugaucuuccugggcagcuucuaccuggugaaccugauccuggccguggugaccauggccuacgaggagcagaaccaggccaccaccgacgagaucgaggccaaggagaagaaguuccaggaggcccuggagaugcugagaaaggagcaggaggugcuggccgcccugggcaucgacaccaccagccugcacagccacaacggcagcccccugaccagcaagaacgccagcgagagaagacacagaaucaagcccagagugagcgagggcagcaccgaggacaacaagagccccagaagcgaccccuacaaccagagaagaaugagcuuccugggccuggccagcggcaagagaagagccagccacggcagcguguuccacuucagaagccccggcagagacaucagccugcccgagggcgugaccgacgacggcguguuccccggcgaccacgagagccacagaggcagccugcugcugggcggcggcgccggccagcagggcccccugcccagaagcccccugccccagcccagcaaccccgacagcagacacggcgaggacgagcaccagcccccccccaccagcgagcuggcccccggcgccguggacgugagcgccuucgacgccggccagaagaagaccuuccugagcgccgaguaccuggacgagcccuucagagcccagagagccaugagcguggugagcaucaucaccagcgugcuggaggagcuggaggagagcgagcagaagugcccccccugccugaccagccugagccagaaguaccugaucugggacugcugccccaugugggugaagcugaagaccauccuguucggccuggugaccgaccccuucgccgagcugaccaucacccugugcaucguggugaacaccaucuucauggccauggagcaccacggcaugagccccaccuucgaggccaugcugcagaucggcaacaucguguucaccaucuucuucaccgccgagaugguguucaagaucaucgccuucgaccccuacuacuacuuccagaagaaguggaacaucuucgacugcaucaucgugaccgugagccugcuggagcugggcguggccaagaagggcagccugagcgugcugagaagcuucagacugcugagaguguucaagcuggccaagagcuggcccacccugaacacccugaucaagaucaucggcaacagcgugggcgcccugggcaaccugaccaucauccuggccaucaucguguucguguucgcccuggugggcaagcagcugcugggcgagaacuacagaaacaacagaaagaacaucagcgccccccacgaggacuggcccagauggcacaugcacgacuucuuccacagcuuccugaucguguucagaauccugugcggcgaguggaucgagaacaugugggccugcauggaggugggccagaagagcaucugccugauccuguuccugaccgugauggugcugggcaaccugguggugcugaaccuguucaucgcccugcugcugaacagcuucagcgccgacaaccugaccgcccccgaggacgacggcgaggugaacaaccugcagguggcccuggccagaauccagguguucggccacagaaccaagcaggcccugugcagcuucuucagcagaagcugccccuucccccagcccaaggccgagcccgagcugguggugaagcugccccugagcagcagcaaggccgagaaccacaucgccgccaacaccgccagaggcagcagcggcggccugcaggcccccagaggccccagagacgagcacagcgacuucaucgccaaccccaccgugugggugagcgugcccaucgccgagggcgagagcgaccuggacgaccuggaggacgacggcggcgaggacgcccagagcuuccagcaggaggugauccccaagggccagcaggagcagcugcagcagguggagagaugcggcgaccaccugacccccagaagccccggcaccggcaccagcagcgaggaccuggcccccagccugggcgagaccuggaaggacgagagcgugccccaggugcccgccgagggcguggacgacaccagcagcagcgagggcagcaccguggacugccuggaccccgaggagauccugagaaagauccccgagcuggccgacgaccuggaggagcccgacgacugcuucaccgagggcugcaucagacacugccccugcugcaagcuggacaccaccaagagccccugggacgugggcuggcaggugagaaagaccugcuacagaaucguggagcacagcugguucgagagcuucaucaucuucaugauccugcugagcagcggcagccuggccuucgaggacuacuaccuggaccagaagcccaccgugaaggcccugcuggaguacaccgacagaguguucaccuucaucuucguguucgagaugcugcugaaguggguggccuacggcuucaagaaguacuucaccaacgccuggugcuggcuggacuuccugaucgugaacaucagccugaucagccugaccgccaagauccuggaguacagcgagguggcccccaucaaggcccugagaacccugagagcccugagaccccugagagcccugagcagauucgagggcaugagaguggugguggacgcccuggugggcgccauccccagcaucaugaacgugcugcuggugugccugaucuucuggcugaucuucagcaucaugggcgugaaccuguucgccggcaaguucuggagaugcaucaacuacaccgacggcgaguucagccuggugccccugagcaucgugaacaacaagagcgacugcaagauccagaacagcaccggcagcuucuucugggugaacgugaaggugaacuucgacaacguggccaugggcuaccuggcccugcugcagguggccaccuucaagggcuggauggacaucauguacgccgccguggacagcagagaggugaacaugcagcccaagugggaggacaacguguacauguaccuguacuucgugaucuucaucaucuucggcggcuucuucacccugaaccuguucgugggcgugaucaucgacaacuucaaccagcagaagaagaagcugggcggccaggacaucuucaugaccgaggagcagaagaaguacuacaacgccaugaagaagcugggcagcaagaagccccagaagcccauccccagaccccugaacaaguuccagggcuucguguucgacaucgugaccagacaggccuucgacaucaccaucauggugcugaucugccugaacaugaucaccaugaugguggagaccgacgaccagagcgaggagaagaccaagauccugggcaagaucaaccaguucuucguggccguguucaccggcgagugcgugaugaagauguucgcccugagacaguacuacuucaccaacggcuggaacguguucgacuucaucgugguggugcugagcaucgccagccugaucuucagcgccauccugaagagccugcagagcuacuucagccccacccuguucagagugaucagacuggccagaaucggcagaauccugagacugaucagagccgccaagggcaucagaacccugcuguucgcccugaugaugagccugcccgcccuguucaacaucggccugcugcuguuccuggugauguucaucuacagcaucuucggcaugagcagcuucccccacgugagaugggaggccggcaucgacgacauguucaacuuccagaccuucgccaacagcaugcugugccuguuccagaucaccaccagcgccggcugggacggccugcugagccccauccugaacaccggcccccccuacugcgaccccaaccugcccaacagcaacggcaccagaggcgacugcggcagccccgccgugggcaucaucuucuucaccaccuacaucaucaucagcuuccugaucguggugaacauguacaucgccgugauccuggagaacuucaacguggccaccgaggagagcaccgagccccugagcgaggacgacuucgacauguucuacgagaccugggagaaguucgaccccgaggccacccaguucaucaccuucagcgcccugagcgacuucgccgacacccugagcggcccccugagaauccccaagcccaacagaaacauccugauccagauggaccugccccuggugcccggcgacaagauccacugccuggacauccuguucgccuucaccaagaacgugcugggcgagagcggcgagcuggacagccugaaggccaacauggaggagaaguucauggccaccaaccugagcaagagcagcuacgagcccaucgccaccacccugagauggaagcaggaggacaucagcgccaccgugauccagaaggccuacagaagcuacgugcugcacagaagcauggcccugagcaacacccccugcgugcccagagccgaggaggaggccgccagccugcccgacgagggcuucguggccuucaccgccaacgagaacugcgugcugcccgacaagagcgagaccgccagcgccaccagcuucccccccagcuacgagagcgugaccagaggccugagcgacagagugaacaugagaaccagcagcagcauccagaacgaggacgaggccaccagcauggagcugaucgcccccggccccuaa

SEQ ID NO: 23051 - RNA, 5376 nt, Artificial Sequence
  SCN11A__Homo_sapiens__XP_011531622
auggacgacagaugcuaccccgugaucuuccccgacgagagaaacuucagacccuucaccagcgacagccuggccgccaucgagaagagaaucgccauccagaaggagaagaagaagagcaaggaccagaccggcgaggugccccagcccagaccccagcuggaccugaaggccagcagaaagcugcccaagcuguacggcgacauccccagagagcugaucggcaagccccuggaggaccuggaccccuucuacagaaaccacaagaccuucauggugcugaacagaaagagaaccaucuacagauucagcgccaagcacgcccuguucaucuucggccccuucaacagcaucagaagccuggccaucagagugagcgugcacagccuguucagcauguucaucaucggcaccgugaucaucaacugcguguucauggccaccggccccgccaagaacagcaacagcaacaacaccgacaucgccgagugcguguucaccggcaucuacaucuucgaggcccugaucaagauccuggccagaggcuucauccuggacgaguucagcuuccugagagaccccuggaacuggcuggacagcaucgugaucggcaucgccaucgugagcuacauccccggcaucaccaucaagcugcugccccugagaaccuucagaguguucagagcccugaaggccaucagcguggugagcagacugaaggugaucgugggcgcccugcugagaagcgugaagaagcuggugaacgugaucauccugaccuucuucugccugagcaucuucgcccuggugggccagcagcuguucaugggcagccugaaccugaagugcaucagcagagacugcaagaacaucagcaaccccgaggccuacgaccacugcuucgagaagaaggagaacagccccgaguucaagaugugcggcaucuggaugggcaacagcgccugcagcauccaguacgagugcaagcacaccaagaucaaccccgacuacaacuacaccaacuucgacaacuucggcuggagcuuccuggccauguucagacugaugacccaggacagcugggagaagcuguaccagcagacccugagaaccaccggccuguacagcguguucuucuucaucguggugaucuuccugggcagcuucuaccugaucaaccugacccuggccguggugaccauggccuacgaggagcagaacaagaacguggccgccgagaucgaggccaaggagaagauguuccaggaggcccagcagcugcugaaggaggagaaggaggcccugguggccaugggcaucgacagaagcagccugaccagccuggagaccagcuacuucacccccaagaagagaaagcuguucggcaacaagaagagaaagagcuucuuccugagagagagcggcaaggaccagccccccggcagcgacagcgacgaggacugccagaagaagccccagcugcuggagcagaccaagagacugagccagaaccugagccuggaccacuucgacgagcacggcgacccccugcagagacagagagcccugagcgccgugagcauccugaccaucaccaugaaggagcaggagaagagccaggagcccugccugcccugcggcgagaaccuggccagcaaguaccugguguggaacugcugcccccaguggcugugcgugaagaaggugcugagaaccgugaugaccgaccccuucaccgagcuggccaucaccaucugcaucaucaucaacaccguguuccuggccauggagcaccacaagauggaggccagcuucgagaagaugcugaacaucggcaaccugguguucaccagcaucuucaucgccgagaugugccugaagaucaucgcccuggaccccuaccacuacuucagaagaggcuggaacaucuucgacagcaucguggcccugcugagcuucgccgacgugaugaacugcgugcugcagaagagaagcuggcccuuccugagaagcuucagagugcugagaguguucaagcuggccaagagcuggcccacccugaacacccugaucaagaucaucggcaacagcgugggcgcccugggcagccugaccguggugcuggugaucgugaucuucaucuucagcguggugggcaugcagcuguucggcagaagcuucaacagccagaagagccccaagcugugcaaccccaccggccccaccgugagcugccugagacacuggcacaugggcgacuucuggcacagcuuccuggugguguucagaauccugugcggcgaguggaucgagaacaugugggagugcaugcaggaggccaacgccagcagcagccugugcgugaucguguucauccugaucaccgugaucggcaagcugguggugcugaaccuguucaucgcccugcugcugaacagcuucagcaacgaggagagaaacggcaaccuggagggcgaggccagaaagaccaaggugcagcuggcccuggacagauucagaagagccuucugcuucgugagacacacccuggagcacuucugccacaaguggugcagaaagcagaaccugccccagcagaaggagguggccggcggcugcgccgcccagagcaaggacaucaucccccuggugauggagaugaagagaggcagcgagacccaggaggagcugggcauccugaccagcgugcccaagacccugggcgugagacacgacuggaccuggcuggccccccuggccgaggaggaggacgacguggaguucagcggcgaggacaacgcccagagaaucacccagcccgagcccgagcagcaggccuacgagcugcaccaggagaacaagaagcccaccagccagagagugcagagcguggagaucgacauguucagcgaggacgagccccaccugaccauccaggaccccagaaagaagagcgacgugaccagcauccugagcgagugcagcaccaucgaccugcaggacggcuucggcuggcugcccgagauggugcccaagaagcagcccgagagaugccugcccaagggcuucggcugcugcuuccccugcugcagcguggacaagagaaagccccccugggugaucugguggaaccugagaaagaccugcuaccagaucgugaagcacagcugguucgagagcuucaucaucuucgugauccugcugagcagcggcgcccugaucuucgaggacgugcaccuggagaaccagcccaagauccaggagcugcugaacugcaccgacaucaucuucacccacaucuucauccuggagauggugcugaaguggguggccuucggcuucggcaaguacuucaccagcgccuggugcugccuggacuucaucaucgugaucgugagcgugaccacccugaucaaccugauggagcugaagagcuucagaacccugagagcccugagaccccugagagcccugagccaguucgagggcaugaaggugguggugaacgcccugaucggcgccauccccgccauccugaacgugcugcuggugugccugaucuucuggcugguguucugcauccugggcguguacuucuucagcggcaaguucggcaagugcaucaacggcaccgacagcgugaucaacuacaccaucaucaccaacaagagccagugcgagagcggcaacuucagcuggaucaaccagaaggugaacuucgacaacgugggcaacgccuaccuggcccugcugcagguggccaccuucaagggcuggauggacaucaucuacgccgccguggacagcaccgagaaggagcagcagcccgaguucgagagcaacagccugggcuacaucuacuucgugguguucaucaucuucggcagcuucuucacccugaaccuguucaucggcgugaucaucgacaacuucaaccagcagcagaagaagcugggcggccaggacaucuucaugaccgaggagcagaagaaguacuacaacgccaugaagaagcugggcagcaagaagccccagaagcccauccccagaccccugaacaagugccagggccugguguucgacaucgugaccagccagaucuucgacaucaucaucaucagccugaucauccugaacaugaucagcaugauggccgagagcuacaaccagcccaaggccaugaagagcauccuggaccaccugaacuggguguucguggugaucuucacccuggagugccugaucaagaucuucgcccugagacaguacuacuucaccaacggcuggaaccuguucgacugcgugguggugcugcugagcaucgugagcaccaugaucagcacccuggagaaccaggagcacauccccuucccccccacccuguucagaaucgugagacuggccagaaucggcagaauccugagacuggugagagccgccagaggcaucagaacccugcuguucgcccugaugaugagccugcccagccuguucaacaucggccugcugcuguuccugaucauguucaucuacgccauccugggcaugaacugguucagcaaggugaaccccgagagcggcaucgacgacaucuucaacuucaagaccuucgccagcagcaugcugugccuguuccagaucagcaccagcgccggcugggacagccugcugagccccaugcugagaagcaaggagagcugcaacagcagcagcgagaacugccaccugcccggcaucgccaccagcuacuucgugagcuacaucaucaucagcuuccugaucguggugaacauguacaucgccgugauccuggagaacuucaacaccgccaccgaggagagcgaggacccccugggcgaggacgacuucgacaucuucuacgaggugugggagaaguucgaccccgaggccacccaguucaucaaguacagcgcccugagcgacuucgccgacgcccugcccgagccccugagaguggccaagcccaacaaguaccaguuccuggugauggaccugcccauggugagcgaggacagacugcacugcauggacauccuguucgccuucaccgccagagugcugggcggcagcgacggccuggacagcaugaaggccaugauggaggagaaguucauggaggccaacccccugaagaagcuguacgagcccaucgugaccaccaccaagagaaaggaggaggagagaggcgccgccaucauccagaaggccuucagaaaguacaugaugaaggugaccaagggcgaccagggcgaccagaacgaccuggagaacggcccccacagcccccugcagacccugugcaacggcgaccugagcagcuucggcguggccaagggcaaggugcacugcgacuaa

SEQ ID NO: 23052 - RNA, 6030 nt, Artificial Sequence
  SCN1A__Homo_sapiens__NP_001159435
auggagcagaccgugcuggugccccccggccccgacagcuucaacuucuucaccagagagagccuggccgccaucgagagaagaaucgccgaggagaaggccaagaaccccaagcccgacaagaaggacgacgacgagaacggccccaagcccaacagcgaccuggaggccggcaagaaccugcccuucaucuacggcgacaucccccccgagauggugagcgagccccuggaggaccuggaccccuacuacaucaacaagaagaccuucaucgugcugaacaagggcaaggccaucuucagauucagcgccaccagcgcccuguacauccugacccccuucaacccccugagaaagaucgccaucaagauccuggugcacagccuguucagcaugcugaucaugugcaccauccugaccaacugcguguucaugaccaugagcaacccccccgacuggaccaagaacguggaguacaccuucaccggcaucuacaccuucgagagccugaucaagaucaucgccagaggcuucugccuggaggacuucaccuuccugagagaccccuggaacuggcuggacuucaccgugaucaccuucgccuacgugaccgaguucguggaccugggcaacgugagcgcccugagaaccuucagagugcugagagcccugaagaccaucagcgugauccccggccugaagaccaucgugggcgcccugauccagagcgugaagaagcugagcgacgugaugauccugaccguguucugccugagcguguucgcccugaucggccugcagcuguucaugggcaaccugagaaacaagugcauccaguggccccccaccaacgccagccuggaggagcacagcaucgagaagaacaucaccgugaacuacaacggcacccugaucaacgagaccguguucgaguucgacuggaagagcuacauccaggacagcagauaccacuacuuccuggagggcuuccuggacgcccugcugugcggcaacagcagcgacgccggccagugccccgagggcuacaugugcgugaaggccggcagaaaccccaacuacggcuacaccagcuucgacaccuucagcugggccuuccugagccuguucagacugaugacccaggacuucugggagaaccuguaccagcugacccugagagccgccggcaagaccuacaugaucuucuucgugcuggugaucuuccugggcagcuucuaccugaucaaccugauccuggccgugguggccauggccuacgaggagcagaaccaggccacccuggaggaggccgagcagaaggaggccgaguuccagcagaugaucgagcagcugaagaagcagcaggaggccgcccagcaggccgccaccgccaccgccagcgagcacagcagagagcccagcgccgccggcagacugagcgacagcagcagcgaggccagcaagcugagcagcaagagcgccaaggagagaagaaacagaagaaagaagagaaagcagaaggagcagagcggcggcgaggagaaggacgaggacgaguuccagaagagcgagagcgaggacagcaucagaagaaagggcuucagauucagcaucgagggcaacagacugaccuacgagaagagauacagcagcccccaccagagccugcugagcaucagaggcagccuguucagccccagaagaaacagcagaaccagccuguucagcuucagaggcagagccaaggacgugggcagcgagaacgacuucgccgacgacgagcacagcaccuucgaggacaacgagagcagaagagacagccuguucgugcccagaagacacggcgagagaagaaacagcaaccugagccagaccagcagaagcagcagaaugcuggccguguuccccgccaacggcaagaugcacagcaccguggacugcaacggcguggugagccuggugggcggccccagcgugcccaccagccccgugggccagcugcugcccgaggugaucaucgacaagcccgccaccgacgacaacggcaccaccaccgagaccgagaugagaaagagaagaagcagcagcuuccacgugagcauggacuuccuggaggaccccagccagagacagagagccaugagcaucgccagcauccugaccaacaccguggaggagcuggaggagagcagacagaagugcccccccugcugguacaaguucagcaacaucuuccugaucugggacugcagccccuacuggcugaaggugaagcacguggugaaccugguggugauggaccccuucguggaccuggccaucaccaucugcaucgugcugaacacccuguucauggccauggagcacuaccccaugaccgaccacuucaacaacgugcugaccgugggcaaccugguguucaccggcaucuucaccgccgagauguuccugaagaucaucgccauggaccccuacuacuacuuccaggagggcuggaacaucuucgacggcuucaucgugacccugagccugguggagcugggccuggccaacguggagggccugagcgugcugagaagcuucagacugcugagaguguucaagcuggccaagagcuggcccacccugaacaugcugaucaagaucaucggcaacagcgugggcgcccugggcaaccugacccuggugcuggccaucaucguguucaucuucgccguggugggcaugcagcuguucggcaagagcuacaaggacugcgugugcaagaucgccagcgacugccagcugcccagauggcacaugaacgacuucuuccacagcuuccugaucguguucagagugcugugcggcgaguggaucgagaccaugugggacugcauggagguggccggccaggccaugugccugaccguguucaugauggugauggugaucggcaaccugguggugcugaaccuguuccuggcccugcugcugagcagcuucagcgccgacaaccuggccgccaccgacgacgacaacgagaugaacaaccugcagaucgccguggacagaaugcacaagggcguggccuacgugaagagaaagaucuacgaguucauccagcagagcuucaucagaaagcagaagauccuggacgagaucaagccccuggacgaccugaacaacaagaaggacagcugcaugagcaaccacaccgccgagaucggcaaggaccuggacuaccugaaggacgugaacggcaccaccagcggcaucggcaccggcagcagcguggagaaguacaucaucgacgagagcgacuacaugagcuucaucaacaaccccagccugaccgugaccgugcccaucgccgugggcgagagcgacuucgagaaccugaacaccgaggacuucagcagcgagagcgaccuggaggagagcaaggagaagcugaacgagagcagcagcagcagcgagggcagcaccguggacaucggcgcccccguggaggagcagcccgugguggagcccgaggagacccuggagcccgaggccugcuucaccgagggcugcgugcagagauucaagugcugccagaucaacguggaggagggcagaggcaagcagugguggaaccugagaagaaccugcuucagaaucguggagcacaacugguucgagaccuucaucguguucaugauccugcugagcagcggcgcccuggccuucgaggacaucuacaucgaccagagaaagaccaucaagaccaugcuggaguacgccgacaagguguucaccuacaucuucauccuggagaugcugcugaaguggguggccuacggcuaccagaccuacuucaccaacgccuggugcuggcuggacuuccugaucguggacgugagccuggugagccugaccgccaacgcccugggcuacagcgagcugggcgccaucaagagccugagaacccugagagcccugagaccccugagagcccugagcagauucgagggcaugagagugguggugaacgcccugcugggcgccauccccagcaucaugaacgugcugcuggugugccugaucuucuggcugaucuucagcaucaugggcgugaaccuguucgccggcaaguucuaccacugcaucaacaccaccaccggcgacagauucgacaucgaggacgugaacaaccacaccgacugccugaagcugaucgagagaaacgagaccgccagauggaagaacgugaaggugaacuucgacaacgugggcuucggcuaccugagccugcugcagguggccaccuucaagggcuggauggacaucauguacgccgccguggacagcagaaacguggagcugcagcccaaguacgaggagagccuguacauguaccuguacuucgugaucuucaucaucuucggcagcuucuucacccugaaccuguucaucggcgugaucaucgacaacuucaaccagcagaagaagaaguucggcggccaggacaucuucaugaccgaggagcagaagaaguacuacaacgccaugaagaagcugggcagcaagaagccccagaagcccauccccagacccggcaacaaguuccagggcaugguguucgacuucgugaccagacagguguucgacaucagcaucaugauccugaucugccugaacauggugaccaugaugguggagaccgacgaccagagcgaguacgugaccaccauccugagcagaaucaaccugguguucaucgugcuguucaccggcgagugcgugcugaagcugaucagccugagacacuacuacuucaccaucggcuggaacaucuucgacuucgugguggugauccugagcaucgugggcauguuccuggccgagcugaucgagaaguacuucgugagccccacccuguucagagugaucagacuggccagaaucggcagaauccugagacugaucaagggcgccaagggcaucagaacccugcuguucgcccugaugaugagccugcccgcccuguucaacaucggccugcugcuguuccuggugauguucaucuacgccaucuucggcaugagcaacuucgccuacgugaagagagaggugggcaucgacgacauguucaacuucgagaccuucggcaacagcaugaucugccuguuccagaucaccaccagcgccggcugggacggccugcuggcccccauccugaacagcaagccccccgacugcgaccccaacaaggugaaccccggcagcagcgugaagggcgacugcggcaaccccagcgugggcaucuucuucuucgugagcuacaucaucaucagcuuccuggugguggugaacauguacaucgccgugauccuggagaacuucagcguggccaccgaggagagcgccgagccccugagcgaggacgacuucgagauguucuacgaggugugggagaaguucgaccccgacgccacccaguucauggaguucgagaagcugagccaguucgccgccgcccuggagcccccccugaaccugccccagcccaacaagcugcagcugaucgccauggaccugcccauggugagcggcgacagaauccacugccuggacauccuguucgccuucaccaagagagugcugggcgagagcggcgagauggacgcccugagaauccagauggaggagagauucauggccagcaaccccagcaaggugagcuaccagcccaucaccaccacccugaagagaaagcaggaggaggugagcgccgugaucauccagagagccuacagaagacaccugcugaagagaaccgugaagcaggccagcuucaccuacaacaagaacaagaucaagggcggcgccaaccugcugaucaaggaggacaugaucaucgacagaaucaacgagaacagcaucaccgagaagaccgaccugaccaugagcaccgccgccugcccccccagcuacgacagagugaccaagcccaucguggagaagcacgagcaggagggcaaggacgagaaggccaagggcaaguaa

SEQ ID NO: 23053 - RNA, 657 nt, Artificial Sequence
  SCN1B__Homo_sapiens__NP_001028
augggcagacugcuggcccugguggugggcgccgcccuggugagcagcgccugcggcggcugcguggagguggacagcgagaccgaggccguguacggcaugaccuucaagauccugugcaucagcugcaagagaagaagcgagaccaacgccgagaccuucaccgaguggaccuucagacagaagggcaccgaggaguucgugaagauccugagauacgagaacgaggugcugcagcuggaggaggacgagagauucgagggcagagugguguggaacggcagcagaggcaccaaggaccugcaggaccugagcaucuucaucaccaacgugaccuacaaccacagcggcgacuacgagugccacguguacagacugcuguucuucgagaacuacgagcacaacaccagcguggugaagaagauccacaucgaggugguggacaaggccaacagagacauggccagcaucgugagcgagaucaugauguacgugcugaucguggugcugaccaucuggcugguggccgagaugaucuacugcuacaagaagaucgccgccgccaccgagaccgccgcccaggagaacgccagcgaguaccuggccaucaccagcgagagcaaggagaacugcaccggcgugcagguggccgaguaa

SEQ ID NO: 23054 - RNA, 6018 nt, Artificial Sequence
  SCN2A__Homo_sapiens__XP_005246807
auggcccagagcgugcuggugccccccggccccgacagcuucagauucuucaccagagagagccuggccgccaucgagcagagaaucgccgaggagaaggccaagagacccaagcaggagagaaaggacgaggacgacgagaacggccccaagcccaacagcgaccuggaggccggcaagagccugcccuucaucuacggcgacaucccccccgagauggugagcgugccccuggaggaccuggaccccuacuacaucaacaagaagaccuucaucgugcugaacaagggcaaggccaucagcagauucagcgccacccccgcccuguacauccugacccccuucaaccccaucagaaagcuggccaucaagauccuggugcacagccuguucaacaugcugaucaugugcaccauccugaccaacugcguguucaugaccaugagcaacccccccgacuggaccaagaacguggaguacaccuucaccggcaucuacaccuucgagagccugaucaagauccuggccagaggcuucugccuggaggacuucaccuuccugagagaccccuggaacuggcuggacuucaccgugaucaccuucgccuacgugaccgaguucguggaccugggcaacgugagcgcccugagaaccuucagagugcugagagcccugaagaccaucagcgugauccccggccugaagaccaucgugggcgcccugauccagagcgugaagaagcugagcgacgugaugauccugaccguguucugccugagcguguucgcccugaucggccugcagcuguucaugggcaaccugagaaacaagugccugcaguggccccccgacaacagcagcuucgagaucaacaucaccagcuucuucaacaacagccuggacggcaacggcaccaccuucaacagaaccgugagcaucuucaacugggacgaguacaucgaggacaagagccacuucuacuuccuggagggccagaacgacgcccugcugugcggcaacagcagcgacgccggccagugccccgagggcuacaucugcgugaaggccggcagaaaccccaacuacggcuacaccagcuucgacaccuucagcugggccuuccugagccuguucagacugaugacccaggacuucugggagaaccuguaccagcugacccugagagccgccggcaagaccuacaugaucuucuucgugcuggugaucuuccugggcagcuucuaccugaucaaccugauccuggccgugguggccauggccuacgaggagcagaaccaggccacccuggaggaggccgagcagaaggaggccgaguuccagcagaugcuggagcagcugaagaagcagcaggaggaggcccaggccgccgccgccgccgccagcgccgagagcagagacuucagcggcgccggcggcaucggcguguucagcgagagcagcagcguggccagcaagcugagcagcaagagcgagaaggagcugaagaacagaagaaagaagaagaagcagaaggagcagagcggcgaggaggagaagaacgacagagugagaaagagcgagagcgaggacagcaucagaagaaagggcuucagauucagccuggagggcagcagacugaccuacgagaagagauucagcagcccccaccagagccugcugagcaucagaggcagccuguucagccccagaagaaacagcagagccagccuguucagcuucagaggcagagccaaggacaucggcagcgagaacgacuucgccgacgacgagcacagcaccuucgaggacaacgacagcagaagagacagccuguucgugccccacagacacggcgagagaagacacagcaacgugagccaggccagcagagccagcagagugcugcccauccugcccaugaacggcaagaugcacagcgccguggacugcaacggcguggugagccuggugggcggccccagcacccugaccagcgccggccagcugcugcccgagggcaccaccaccgagaccgagaucagaaagagaagaagcagcagcuaccacgugagcauggaccugcuggaggaccccaccagcagacagagagccaugagcaucgccagcauccugaccaacaccauggaggagcuggaggagagcagacagaagugcccccccugcugguacaaguucgccaacaugugccugaucugggacugcugcaagcccuggcugaaggugaagcaccuggugaaccugguggugauggaccccuucguggaccuggccaucaccaucugcaucgugcugaacacccuguucauggccauggagcacuaccccaugaccgagcaguucagcagcgugcugagcgugggcaaccugguguucaccggcaucuucaccgccgagauguuccugaagaucaucgccauggaccccuacuacuacuuccaggagggcuggaacaucuucgacggcuucaucgugagccugagccugauggagcugggccuggccaacguggagggccugagcgugcugagaagcuucagacugcugagaguguucaagcuggccaagagcuggcccacccugaacaugcugaucaagaucaucggcaacagcgugggcgcccugggcaaccugacccuggugcuggccaucaucguguucaucuucgccguggugggcaugcagcuguucggcaagagcuacaaggagugcgugugcaagaucagcaacgacugcgagcugcccagauggcacaugcacgacuucuuccacagcuuccugaucguguucagagugcugugcggcgaguggaucgagaccaugugggacugcauggagguggccggccagaccaugugccugaccguguucaugauggugauggugaucggcaaccugguggugcugaaccuguuccuggcccugcugcugagcagcuucagcagcgacaaccuggccgccaccgacgacgacaacgagaugaacaaccugcagaucgccgugggcagaaugcagaagggcaucgacuucgugaagagaaagaucagagaguucauccagaaggccuucgugagaaagcagaaggcccuggacgagaucaagccccuggaggaccugaacaacaagaaggacagcugcaucagcaaccacaccaccaucgagaucggcaaggaccugaacuaccugaaggacggcaacggcaccaccagcggcaucggcagcagcguggagaaguacgugguggacgagagcgacuacaugagcuucaucaacaaccccagccugaccgugaccgugcccaucgccgugggcgagagcgacuucgagaaccugaacaccgaggaguucagcagcgagagcgacauggaggagagcaaggagaagcugaacgccaccagcagcagcgagggcagcaccguggacaucggcgcccccgccgagggcgagcagcccgagguggagcccgaggagagccuggagcccgaggccugcuucaccgaggacugcgugagaaaguucaagugcugccagaucagcaucgaggagggcaagggcaagcugugguggaaccugagaaagaccugcuacaagaucguggagcacaacugguucgagaccuucaucguguucaugauccugcugagcagcggcgcccuggccuucgaggacaucuacaucgagcagagaaagaccaucaagaccaugcuggaguacgccgacaagguguucaccuacaucuucauccuggagaugcugcugaaguggguggccuacggcuuccagguguacuucaccaacgccuggugcuggcuggacuuccugaucguggacgugagccuggugagccugaccgccaacgcccugggcuacagcgagcugggcgccaucaagagccugagaacccugagagcccugagaccccugagagcccugagcagauucgagggcaugagagugguggugaacgcccugcugggcgccauccccagcaucaugaacgugcugcuggugugccugaucuucuggcugaucuucagcaucaugggcgugaaccuguucgccggcaaguucuaccacugcaucaacuacaccaccggcgagauguucgacgugagcguggugaacaacuacagcgagugcaaggcccugaucgagagcaaccagaccgccagauggaagaacgugaaggugaacuucgacaacgugggccugggcuaccugagccugcugcagguggccaccuucaagggcuggauggacaucauguacgccgccguggacagcagaaacguggagcugcagcccaaguacgaggacaaccuguacauguaccuguacuucgugaucuucaucaucuucggcagcuucuucacccugaaccuguucaucggcgugaucaucgacaacuucaaccagcagaagaagaaguucggcggccaggacaucuucaugaccgaggagcagaagaaguacuacaacgccaugaagaagcugggcagcaagaagccccagaagcccauccccagacccgccaacaaguuccagggcaugguguucgacuucgugaccaagcagguguucgacaucagcaucaugauccugaucugccugaacauggugaccaugaugguggagaccgacgaccagagccaggagaugaccaacauccuguacuggaucaaccugguguucaucgugcuguucaccggcgagugcgugcugaagcugaucagccugagauacuacuacuucaccaucggcuggaacaucuucgacuucgugguggugauccugagcaucgugggcauguuccuggccgagcugaucgagaaguacuucgugagccccacccuguucagagugaucagacuggccagaaucggcagaauccugagacugaucaagggcgccaagggcaucagaacccugcuguucgcccugaugaugagccugcccgcccuguucaacaucggccugcugcuguuccuggugauguucaucuacgccaucuucggcaugagcaacuucgccuacgugaagagagaggugggcaucgacgacauguucaacuucgagaccuucggcaacagcaugaucugccuguuccagaucaccaccagcgccggcugggacggccugcuggcccccauccugaacagcggcccccccgacugcgaccccgacaaggaccaccccggcagcagcgugaagggcgacugcggcaaccccagcgugggcaucuucuucuucgugagcuacaucaucaucagcuuccuggugguggugaacauguacaucgccgugauccuggagaacuucagcguggccaccgaggagagcgccgagccccugagcgaggacgacuucgagauguucuacgaggugugggagaaguucgaccccgacgccacccaguucaucgaguucgccaagcugagcgacuucgccgacgcccuggaccccccccugcugaucgccaagcccaacaaggugcagcugaucgccauggaccugcccauggugagcggcgacagaauccacugccuggacauccuguucgccuucaccaagagagugcugggcgagagcggcgagauggacgcccugagaauccagauggaggagagauucauggccagcaaccccagcaaggugagcuacgagcccaucaccaccacccugaagagaaagcaggaggaggugagcgccaucaucauccagagagccuacagaagauaccugcugaagcagaaggugaagaaggugagcagcaucuacaagaaggacaagggcaaggagugcgacggcacccccaucaaggaggacacccugaucgacaagcugaacgagaacagcacccccgagaagaccgacaugacccccagcaccaccagcccccccagcuacgacagcgugaccaagcccgagaaggagaaguucgagaaggacaagagcgagaaggaggacaagggcaaggacaucagagagagcaagaaguaa

SEQ ID NO: 23055 - RNA, 648 nt, Artificial Sequence
  SCN2B__Homo_sapiens__NP_004579
augcacagagacgccuggcugcccagacccgccuucagccugaccggccugagccuguucuucagccuggugccccccggcagaagcauggaggugaccgugcccgccacccugaacgugcugaacggcagcgacgccagacugcccugcaccuucaacagcugcuacaccgugaaccacaagcaguucagccugaacuggaccuaccaggagugcaacaacugcagcgaggagauguuccugcaguucagaaugaagaucaucaaccugaagcuggagagauuccaggacagaguggaguucagcggcaaccccagcaaguacgacgugagcgugaugcugagaaacgugcagcccgaggacgagggcaucuacaacugcuacaucaugaacccccccgacagacacagaggccacggcaagauccaccugcaggugcugauggaggagccccccgagagagacagcaccguggccgugaucgugggcgccagcgugggcggcuuccuggccguggugauccuggugcugaugguggugaagugcgugagaagaaagaaggagcagaagcugagcaccgacgaccugaagaccgaggaggagggcaagaccgacggcgagggcaaccccgacgacggcgccaaguaa

SEQ ID NO: 23056 - RNA, 5856 nt, Artificial Sequence
  SCN3A__Homo_sapiens__NP_001075145
auggcccaggcccugcuggugccccccggccccgagagcuucagacuguucaccagagagagccuggccgccaucgagaagagagccgccgaggagaaggccaagaagcccaagaaggagcaggacaacgacgacgagaacaagcccaagcccaacagcgaccuggaggccggcaagaaccugcccuucaucuacggcgacaucccccccgagauggugagcgagccccuggaggaccuggaccccuacuacaucaacaagaagaccuucaucgugaugaacaagggcaaggccaucuucagauucagcgccaccagcgcccuguacauccugaccccccugaaccccgugagaaagaucgccaucaagauccuggugcacagccuguucagcaugcugaucaugugcaccauccugaccaacugcguguucaugacccugagcaacccccccgacuggaccaagaacguggaguacaccuucaccggcaucuacaccuucgagagccugaucaagauccuggccagaggcuucugccuggaggacuucaccuuccugagagaccccuggaacuggcuggacuucagcgugaucgugauggccuacgugaccgaguucguggaccugggcaacgugagcgcccugagaaccuucagagugcugagagcccugaagaccaucagcgugauccccggccugaagaccaucgugggcgcccugauccagagcgugaagaagcugagcgacgugaugauccugaccguguucugccugagcguguucgcccugaucggccugcagcuguucaugggcaaccugagaaacaagugccugcaguggccccccagcgacagcgccuucgagaccaacaccaccagcuacuucaacggcaccauggacagcaacggcaccuucgugaacgugaccaugagcaccuucaacuggaaggacuacaucggcgacgacagccacuucuacgugcuggacggccagaaggacccccugcugugcggcaacggcagcgacgccggccagugccccgagggcuacaucugcgugaaggccggcagaaaccccaacuacggcuacaccagcuucgacaccuucagcugggccuuccugagccuguucagacugaugacccaggacuacugggagaaccuguaccagcugacccugagagccgccggcaagaccuacaugaucuucuucgugcuggugaucuuccugggcagcuucuaccuggugaaccugauccuggccgugguggccauggccuacgaggagcagaaccaggccacccuggaggaggccgagcagaaggaggccgaguuccagcagaugcuggagcagcugaagaagcagcaggaggaggcccaggccguggccgccgccagcgccgccagcagagacuucagcggcaucggcggccugggcgagcugcuggagagcagcagcgaggccagcaagcugagcagcaagagcgccaaggaguggagaaacagaagaaagaagagaagacagagagagcaccuggagggcaacaacaagggcgagagagacagcuuccccaagagcgagagcgaggacagcgugaagagaagcagcuuccuguucagcauggacggcaacagacugaccagcgacaagaaguucugcagcccccaccagagccugcugagcaucagaggcagccuguucagccccagaagaaacagcaagaccagcaucuucagcuucagaggcagagccaaggacgugggcagcgagaacgacuucgccgacgacgagcacagcaccuucgaggacagcgagagcagaagagacagccuguucgugccccacagacacggcgagagaagaaacagcaacggcaccaccaccgagaccgaggugagaaagagaagacugagcagcuaccagaucagcauggagaugcuggaggacagcagcggcagacagagagccgugagcaucgccagcauccugaccaacaccauggaggagcuggaggagagcagacagaagugcccccccugcugguacagauucgccaacguguuccugaucugggacugcugcgacgccuggcugaaggugaagcaccuggugaaccugaucgugauggaccccuucguggaccuggccaucaccaucugcaucgugcugaacacccuguucauggccauggagcacuaccccaugaccgagcaguucagcagcgugcugaccgugggcaaccugguguucaccggcaucuucaccgccgagauggugcugaagaucaucgccauggaccccuacuacuacuuccaggagggcuggaacaucuucgacggcaucaucgugagccugagccugauggagcugggccugagcaacguggagggccugagcgugcugagaagcuucagacugcugagaguguucaagcuggccaagagcuggcccacccugaacaugcugaucaagaucaucggcaacagcgugggcgcccugggcaaccugacccuggugcuggccaucaucguguucaucuucgccguggugggcaugcagcuguucggcaagagcuacaaggagugcgugugcaagaucaacgacgacugcacccugcccagauggcacaugaacgacuucuuccacagcuuccugaucguguucagagugcugugcggcgaguggaucgagaccaugugggacugcauggagguggccggccagaccaugugccugaucguguucaugcuggugauggugaucggcaaccugguggugcugaaccuguuccuggcccugcugcugagcagcuucagcagcgacaaccuggccgccaccgacgacgacaacgagaugaacaaccugcagaucgccgugggcagaaugcagaagggcaucgacuacgugaagaacaagaugagagagugcuuccagaaggccuucuucagaaagcccaaggugaucgagauccacgagggcaacaagaucgacagcugcaugagcaacaacaccggcaucgagaucagcaaggagcugaacuaccugagagacggcaacggcaccaccagcggcgugggcaccggcagcagcguggagaaguacgugaucgacgagaacgacuacaugagcuucaucaacaaccccagccugaccgugaccgugcccaucgccgugggcgagagcgacuucgagaaccugaacaccgaggaguucagcagcgagagcgagcuggaggagagcaaggagaagcugaacgccaccagcagcagcgagggcagcaccguggacguggugcugcccagagagggcgagcaggccgagaccgagcccgaggaggaccugaagcccgaggccugcuucaccgagggcugcaucaagaaguuccccuucugccaggugagcaccgaggagggcaagggcaagaucugguggaaccugagaaagaccugcuacagcaucguggagcacaacugguucgagaccuucaucguguucaugauccugcugagcagcggcgcccuggccuucgaggacaucuacaucgagcagagaaagaccaucaagaccaugcuggaguacgccgacaagguguucaccuacaucuucauccuggagaugcugcugaaguggguggccuacggcuuccagaccuacuucaccaacgccuggugcuggcuggacuuccugaucguggacgugagccuggugagccugguggccaacgcccugggcuacagcgagcugggcgccaucaagagccugagaacccugagagcccugagaccccugagagcccugagcagauucgagggcaugagagugguggugaacgcccuggugggcgccauccccagcaucaugaacgugcugcuggugugccugaucuucuggcugaucuucagcaucaugggcgugaaccuguucgccggcaaguucuaccacugcgugaacaugaccaccggcaacauguucgacaucagcgacgugaacaaccugagcgacugccaggcccugggcaagcaggccagauggaagaacgugaaggugaacuucgacaacgugggcgccggcuaccuggcccugcugcagguggccaccuucaagggcuggauggacaucauguacgccgccguggacagcagagacgugaagcugcagcccguguacgaggagaaccuguacauguaccuguacuucgugaucuucaucaucuucggcagcuucuucacccugaaccuguucaucggcgugaucaucgacaacuucaaccagcagaagaagaaguucggcggccaggacaucuucaugaccgaggagcagaagaaguacuacaacgccaugaagaagcugggcagcaagaagccccagaagcccauccccagacccgccaacaaguuccagggcaugguguucgacuucgugaccagacagguguucgacaucagcaucaugauccugaucugccugaacauggugaccaugaugguggagaccgacgaccagggcaaguacaugacccuggugcugagcagaaucaaccugguguucaucgugcuguucaccggcgaguucgugcugaagcuggugagccugagacacuacuacuucaccaucggcuggaacaucuucgacuucgugguggugauccugagcaucgugggcauguuccuggccgagaugaucgagaaguacuucgugagccccacccuguucagagugaucagacuggccagaaucggcagaauccugagacugaucaagggcgccaagggcaucagaacccugcuguucgcccugaugaugagccugcccgcccuguucaacaucggccugcugcuguuccuggugauguucaucuacgccaucuucggcaugagcaacuucgccuacgugaagaaggaggccggcaucgacgacauguucaacuucgagaccuucggcaacagcaugaucugccuguuccagaucaccaccagcgccggcugggacggccugcuggcccccauccugaacagcgccccccccgacugcgaccccgacaccauccaccccggcagcagcgugaagggcgacugcggcaaccccagcgugggcaucuucuucuucgugagcuacaucaucaucagcuuccuggugguggugaacauguacaucgccgugauccuggagaacuucagcguggccaccgaggagagcgccgagccccugagcgaggacgacuucgagauguucuacgaggugugggagaaguucgaccccgacgccacccaguucaucgaguucagcaagcugagcgacuucgccgccgcccuggaccccccccugcugaucgccaagcccaacaaggugcagcugaucgccauggaccugcccauggugagcggcgacagaauccacugccuggacauccuguucgccuucaccaagagagugcugggcgagagcggcgagauggacgcccugagaauccagauggaggacagauucauggccagcaaccccagcaaggugagcuacgagcccaucaccaccacccugaagagaaagcaggaggaggugagcgccgccaucauccagagaaacuucagaugcuaccugcugaagcagagacugaagaacaucagcagcaacuacaacaaggaggccaucaagggcagaaucgaccugcccaucaagcaggacaugaucaucgacaagcugaacggcaacagcacccccgagaagaccgacggcagcagcagcaccaccagcccccccagcuacgacagcgugaccaagcccgacaaggagaaguucgagaaggacaagcccgagaaggagagcaagggcaaggaggugagagagaaccagaaguaa

SEQ ID NO: 23057 - RNA, 648 nt, Artificial Sequence
  SCN3B__Homo_sapiens__XP_011541199
augcccgccuucaacagacuguucccccuggccagccuggugcugaucuacugggugagcgugugcuuccccgugugcguggaggugcccagcgagaccgaggccgugcagggcaaccccaugaagcugagaugcaucagcugcaugaagagagaggagguggaggccaccaccgugguggagugguucuacagacccgagggcggcaaggacuuccugaucuacgaguacagaaacggccaccaggagguggagagccccuuccagggcagacugcaguggaacggcagcaaggaccugcaggacgugagcaucaccgugcugaacgugacccugaacgacagcggccuguacaccugcaacgugagcagagaguucgaguucgaggcccacagacccuucgugaagaccaccagacugaucccccugagagugaccgaggaggccggcgaggacuucaccagcguggugagcgagaucaugauguacauccugcugguguuccugacccuguggcugcugaucgagaugaucuacugcuacagaaaggugagcaaggccgaggaggccgcccaggagaacgccagcgacuaccuggccauccccagcgagaacaaggagaacagcgccgugcccguggaggaguaa

SEQ ID NO: 23058 - RNA, 5511 nt, Artificial Sequence
  SCN4A__Homo_sapiens__NP_000325
auggccagacccagccugugcacccuggugccccugggccccgagugccugagacccuucaccagagagagccuggccgccaucgagcagagagccguggaggaggaggccagacugcagagaaacaagcagauggagaucgaggagcccgagagaaagcccagaagcgaccuggaggccggcaagaaccugcccaugaucuacggcgaccccccccccgaggugaucggcaucccccuggaggaccuggaccccuacuacagcaacaagaagaccuucaucgugcugaacaagggcaaggccaucuucagauucagcgccacccccgcccuguaccugcugagccccuucagcguggugagaagaggcgccaucaaggugcugauccacgcccuguucagcauguucaucaugaucaccauccugaccaacugcguguucaugaccaugagcgaccccccccccuggagcaagaacguggaguacaccuucaccggcaucuacaccuucgagagccugaucaagauccuggccagaggcuucugcguggacgacuucaccuuccugagagaccccuggaacuggcuggacuucagcgugaucaugauggccuaccugaccgaguucguggaccugggcaacaucagcgcccugagaaccuucagagugcugagagcccugaagaccaucaccgugauccccggccugaagaccaucgugggcgcccugauccagagcgugaagaagcugagcgacgugaugauccugaccguguucugccugagcguguucgcccuggugggccugcagcuguucaugggcaaccugagacagaagugcgugagauggcccccccccuucaacgacaccaacaccaccugguacagcaacgacaccugguacggcaacgacaccugguacggcaacgagaugugguacggcaacgacagcugguacgccaacgacaccuggaacagccacgccagcugggccaccaacgacaccuucgacugggacgccuacaucagcgacgagggcaacuucuacuuccuggagggcagcaacgacgcccugcugugcggcaacagcagcgacgccggccacugccccgagggcuacgagugcaucaagaccggcagaaaccccaacuacggcuacaccagcuacgacaccuucagcugggccuuccuggcccuguucagacugaugacccaggacuacugggagaaccuguuccagcugacccugagagccgccggcaagaccuacaugaucuucuucguggugaucaucuuccugggcagcuucuaccugaucaaccugauccuggccgugguggccauggccuacgccgagcagaacgaggccacccuggccgaggacaaggagaaggaggaggaguuccagcagaugcuggagaaguucaagaagcaccaggaggagcuggagaaggccaaggccgcccaggcccuggagggcggcgaggccgacggcgaccccgcccacggcaaggacugcaacggcagccuggacaccagccagggcgagaagggcgcccccagacagagcagcagcggcgacagcggcaucagcgacgccauggaggagcuggaggaggcccaccagaagugcccccccuggugguacaagugcgcccacaaggugcugaucuggaacugcugcgcccccuggcugaaguucaagaacaucauccaccugaucgugauggaccccuucguggaccugggcaucaccaucugcaucgugcugaacacccuguucauggccauggagcacuaccccaugaccgagcacuucgacaacgugcugaccgugggcaaccugguguucaccggcaucuucaccgccgagauggugcugaagcugaucgccauggaccccuacgaguacuuccagcagggcuggaacaucuucgacagcaucaucgugacccugagccugguggagcugggccuggccaacgugcagggccugagcgugcugagaagcuucagacugcugagaguguucaagcuggccaagagcuggcccacccugaacaugcugaucaagaucaucggcaacagcgugggcgcccugggcaaccugacccuggugcuggccaucaucguguucaucuucgccguggugggcaugcagcuguucggcaagagcuacaaggagugcgugugcaagaucgcccuggacugcaaccugcccagauggcacaugcacgacuucuuccacagcuuccugaucguguucagaauccugugcggcgaguggaucgagaccaugugggacugcauggagguggccggccaggccaugugccugaccguguuccugauggugauggugaucggcaaccugguggugcugaaccuguuccuggcccugcugcugagcagcuucagcgccgacagccuggccgccagcgacgaggacggcgagaugaacaaccugcagaucgccaucggcagaaucaagcugggcaucggcuucgccaaggccuuccugcugggccugcugcacggcaagauccugagccccaaggacaucaugcugagccugggcgaggccgacggcgccggcgaggccggcgaggccggcgagaccgcccccgaggacgagaagaaggagccccccgaggaggaccugaagaaggacaaccacauccugaaccacaugggccuggccgacggcccccccagcagccuggagcuggaccaccugaacuucaucaacaaccccuaccugaccauccaggugcccaucgccagcgaggagagcgaccuggagaugcccaccgaggaggagaccgacaccuucagcgagcccgaggacagcaagaagcccccccagccccuguacgacggcaacagcagcgugugcagcaccgccgacuacaagccccccgaggaggaccccgaggagcaggccgaggagaaccccgagggcgagcagcccgaggagugcuucaccgaggccugcgugcagagauggcccugccuguacguggacaucagccagggcagaggcaagaagugguggacccugagaagagccugcuucaagaucguggagcacaacugguucgagaccuucaucguguucaugauccugcugagcagcggcgcccuggccuucgaggacaucuacaucgagcagagaagagugaucagaaccauccuggaguacgccgacaagguguucaccuacaucuucaucauggagaugcugcugaaguggguggccuacggcuucaagguguacuucaccaacgccuggugcuggcuggacuuccugaucguggacgugagcaucaucagccugguggccaacuggcugggcuacagcgagcugggccccaucaagagccugagaacccugagagcccugagaccccugagagcccugagcagauucgagggcaugagagugguggugaacgcccugcugggcgccauccccagcaucaugaacgugcugcuggugugccugaucuucuggcugaucuucagcaucaugggcgugaaccuguucgccggcaaguucuacuacugcaucaacaccaccaccagcgagagauucgacaucagcgaggugaacaacaagagcgagugcgagagccugaugcacaccggccaggugagauggcugaacgugaaggugaacuacgacaacgugggccugggcuaccugagccugcugcagguggccaccuucaagggcuggauggacaucauguacgccgccguggacagcagagagaaggaggagcagccccaguacgaggugaaccuguacauguaccuguacuucgugaucuucaucaucuucggcagcuucuucacccugaaccuguucaucggcgugaucaucgacaacuucaaccagcagaagaagaagcugggcggcaaggacaucuucaugaccgaggagcagaagaaguacuacaacgccaugaagaagcugggcagcaagaagccccagaagcccauccccagaccccagaacaagauccagggcaugguguacgaccuggugaccaagcaggccuucgacaucaccaucaugauccugaucugccugaacauggugaccaugaugguggagaccgacaaccagagccagcugaagguggacauccuguacaacaucaacaugaucuucaucaucaucuucaccggcgagugcgugcugaagaugcuggcccugagacaguacuacuucaccgugggcuggaacaucuucgacuucgugguggugauccugagcaucgugggccuggcccugagcgaccugauccagaaguacuucgugagccccacccuguucagagugaucagacuggccagaaucggcagagugcugagacugaucagaggcgccaagggcaucagaacccugcuguucgcccugaugaugagccugcccgcccuguucaacaucggccugcugcuguuccuggugauguucaucuacagcaucuucggcaugagcaacuucgccuacgugaagaaggagagcggcaucgacgacauguucaacuucgagaccuucggcaacagcaucaucugccuguucgagaucaccaccagcgccggcugggacggccugcugaaccccauccugaacagcggcccccccgacugcgaccccaaccuggagaaccccggcaccagcgugaagggcgacugcggcaaccccagcaucggcaucugcuucuucugcagcuacaucaucaucagcuuccugaucguggugaacauguacaucgccaucauccuggagaacuucaacguggccaccgaggagagcagcgagccccugggcgaggacgacuucgagauguucuacgagaccugggagaaguucgaccccgacgccacccaguucaucgccuacagcagacugagcgacuucguggacacccugcaggagccccugagaaucgccaagcccaacaagaucaagcugaucacccuggaccugcccauggugcccggcgacaagauccacugccuggacauccuguucgcccugaccaaggaggugcugggcgacagcggcgagauggacgcccugaagcagaccauggaggagaaguucauggccgccaaccccagcaaggugagcuacgagcccaucaccaccacccugaagagaaagcacgaggaggugugcgccaucaagauccagagagccuacagaagacaccugcugcagagaagcaugaagcaggccagcuacauguacagacacagccacgacggcagcggcgacgacgcccccgagaaggagggccugcuggccaacaccaugagcaagauguacggccacgagaacggcaacagcagcagccccagccccgaggagaagggcgaggccggcgacgccggccccaccaugggccugaugcccaucagccccagcgacaccgccuggccccccgcccccccccccggccagaccgugagacccggcgugaaggagagccugguguaa

SEQ ID NO: 23059 - RNA, 285 nt, Artificial Sequence
  SCN4B__Homo_sapiens__NP_001135820
augcccggcgccggcgacggcggcaaggcccccgccagauggcugggcaccggccugcugguggaggagguggacaacaccgugacccugaucauccuggccguggugggcggcgugaucggccugcugauccugauccugcugaucaagaagcugaucaucuucauccugaagaagaccagagagaagaagaaggagugccuggugagcagcagcggcaacgacaacaccgagaacggccugcccggcagcaaggccgaggagaagccccccagcaagguguaa

SEQ ID NO: 23060 - RNA, 6048 nt, Artificial Sequence
  SCN5A__Homo_sapiens__NP_000326
auggccaacuuccugcugcccagaggcaccagcagcuucagaagauucaccagagagagccuggccgccaucgagaagagaauggccgagaagcaggccagaggcagcaccacccugcaggagagcagagagggccugcccgaggaggaggcccccagaccccagcuggaccugcaggccagcaagaagcugcccgaccuguacggcaaccccccccaggagcugaucggcgagccccuggaggaccuggaccccuucuacagcacccagaagaccuucaucgugcugaacaagggcaagaccaucuucagauucagcgccaccaacgcccuguacgugcugagccccuuccaccccaucagaagagccgccgugaagauccuggugcacagccuguucaacaugcugaucaugugcaccauccugaccaacugcguguucauggcccagcacgaccccccccccuggaccaaguacguggaguacaccuucaccgccaucuacaccuucgagagccuggugaagauccuggccagaggcuucugccugcacgccuucaccuuccugagagaccccuggaacuggcuggacuucagcgugaucaucauggccuacaccaccgaguucguggaccugggcaacgugagcgcccugagaaccuucagagugcugagagcccugaagaccaucagcgugaucagcggccugaagaccaucgugggcgcccugauccagagcgugaagaagcuggccgacgugauggugcugaccguguucugccugagcguguucgcccugaucggccugcagcuguucaugggcaaccugagacacaagugcgugagaaacuucaccgcccugaacggcaccaacggcagcguggaggccgacggccuggugugggagagccuggaccuguaccugagcgaccccgagaacuaccugcugaagaacggcaccagcgacgugcugcugugcggcaacagcagcgacgccggcaccugccccgagggcuacagaugccugaaggccggcgagaaccccgaccacggcuacaccagcuucgacagcuucgccugggccuuccuggcccuguucagacugaugacccaggacugcugggagagacuguaccagcagacccugagaagcgccggcaagaucuacaugaucuucuucaugcuggugaucuuccugggcagcuucuaccuggugaaccugauccuggccgugguggccauggccuacgaggagcagaaccaggccaccaucgccgagaccgaggagaaggagaagagauuccaggaggccauggagaugcugaagaaggagcacgaggcccugaccaucagaggcguggacaccgugagcagaagcagccuggagaugagcccccuggcccccgugaacagccacgagagaagaagcaagagaagaaagagaaugagcagcggcaccgaggagugcggcgaggacagacugcccaagagcgacagcgaggacggccccagagccaugaaccaccugagccugaccagaggccugagcagaaccagcaugaagcccagaagcagcagaggcagcaucuucaccuucagaagaagagaccugggcagcgaggccgacuucgccgacgacgagaacagcaccgccggcgagagcgagagccaccacaccagccugcuggugcccuggccccugagaagaaccagcgcccagggccagcccagccccggcaccagcgcccccggccacgcccugcacggcaagaagaacagcaccguggacugcaacggcguggugagccugcugggcgccggcgaccccgaggccaccagccccggcagccaccugcugagacccgugaugcuggagcacccccccgacaccaccacccccagcgaggagcccggcggcccccagaugcugaccagccaggcccccugcguggacggcuucgaggagcccggcgccagacagagagcccugagcgccgugagcgugcugaccagcgcccuggaggagcuggaggagagcagacacaagugcccccccugcuggaacagacuggcccagagauaccugaucugggagugcugcccccuguggaugagcaucaagcagggcgugaagcugguggugauggaccccuucaccgaccugaccaucaccaugugcaucgugcugaacacccuguucauggcccuggagcacuacaacaugaccagcgaguucgaggagaugcugcaggugggcaaccugguguucaccggcaucuucaccgccgagaugaccuucaagaucaucgcccuggaccccuacuacuacuuccagcagggcuggaacaucuucgacagcaucaucgugauccugagccugauggagcugggccugagcagaaugagcaaccugagcgugcugagaagcuucagacugcugagaguguucaagcuggccaagagcuggcccacccugaacacccugaucaagaucaucggcaacagcgugggcgcccugggcaaccugacccuggugcuggccaucaucguguucaucuucgccguggugggcaugcagcuguucggcaagaacuacagcgagcugagagacagcgacagcggccugcugcccagauggcacaugauggacuucuuccacgccuuccugaucaucuucagaauccugugcggcgaguggaucgagaccaugugggacugcauggaggugagcggccagagccugugccugcugguguuccugcuggugauggugaucggcaaccugguggugcugaaccuguuccuggcccugcugcugagcagcuucagcgccgacaaccugaccgcccccgacgaggacagagagaugaacaaccugcagcuggcccuggccagaauccagagaggccugagauucgugaagagaaccaccugggacuucugcugcggccugcugagacagagaccccagaagcccgccgcccuggccgcccagggccagcugcccagcugcaucgccacccccuacagcccccccccccccgagaccgagaaggugccccccaccagaaaggagaccagauucgaggagggcgagcagcccggccagggcacccccggcgaccccgagcccgugugcgugcccaucgccguggccgagagcgacaccgacgaccaggaggaggacgaggagaacagccugggcaccgaggaggagagcagcaagcaggagagccagcccgugagcggcggccccgaggccccccccgacagcagaaccuggagccaggugagcgccaccgccagcagcgaggccgaggccagcgccagccaggccgacuggagacagcaguggaaggccgagccccaggcccccggcugcggcgagacccccgaggacagcugcagcgagggcagcaccgccgacaugaccaacaccgccgagcugcuggagcagauccccgaccugggccaggacgugaaggaccccgaggacugcuucaccgagggcugcgugagaagaugccccugcugcgccguggacaccacccaggcccccggcaaggugugguggagacugagaaagaccugcuaccacaucguggagcacagcugguucgagaccuucaucaucuucaugauccugcugagcagcggcgcccuggccuucgaggacaucuaccuggaggagagaaagaccaucaaggugcugcuggaguacgccgacaagauguucaccuacguguucgugcuggagaugcugcugaaguggguggccuacggcuucaagaaguacuucaccaacgccuggugcuggcuggacuuccugaucguggacgugagccuggugagccugguggccaacacccugggcuucgccgagaugggccccaucaagagccugagaacccugagagcccugagaccccugagagcccugagcagauucgagggcaugagagugguggugaacgcccuggugggcgccauccccagcaucaugaacgugcugcuggugugccugaucuucuggcugaucuucagcaucaugggcgugaaccuguucgccggcaaguucggcagaugcaucaaccagaccgagggcgaccugccccugaacuacaccaucgugaacaacaagagccagugcgagagccugaaccugaccggcgagcuguacuggaccaaggugaaggugaacuucgacaacgugggcgccggcuaccuggcccugcugcagguggccaccuucaagggcuggauggacaucauguacgccgccguggacagcagaggcuacgaggagcagccccagugggaguacaaccuguacauguacaucuacuucgugaucuucaucaucuucggcagcuucuucacccugaaccuguucaucggcgugaucaucgacaacuucaaccagcagaagaagaagcugggcggccaggacaucuucaugaccgaggagcagaagaaguacuacaacgccaugaagaagcugggcagcaagaagccccagaagcccauccccagaccccugaacaaguaccagggcuucaucuucgacaucgugaccaagcaggccuucgacgugaccaucauguuccugaucugccugaacauggugaccaugaugguggagaccgacgaccagagccccgagaagaucaacauccuggccaagaucaaccugcuguucguggccaucuucaccggcgagugcaucgugaagcuggccgcccugagacacuacuacuucaccaacagcuggaacaucuucgacuucgugguggugauccugagcaucgugggcaccgugcugagcgacaucauccagaaguacuucuucagccccacccuguucagagugaucagacuggccagaaucggcagaauccugagacugaucagaggcgccaagggcaucagaacccugcuguucgcccugaugaugagccugcccgcccuguucaacaucggccugcugcuguuccuggugauguucaucuacagcaucuucggcauggccaacuucgccuacgugaagugggaggccggcaucgacgacauguucaacuuccagaccuucgccaacagcaugcugugccuguuccagaucaccaccagcgccggcugggacggccugcugagccccauccugaacaccggcccccccuacugcgaccccacccugcccaacagcaacggcagcagaggcgacugcggcagccccgccgugggcauccuguucuucaccaccuacaucaucaucagcuuccugaucguggugaacauguacaucgccaucauccuggagaacuucagcguggccaccgaggagagcaccgagccccugagcgaggacgacuucgacauguucuacgagaucugggagaaguucgaccccgaggccacccaguucaucgaguacagcgugcugagcgacuucgccgacgcccugagcgagccccugagaaucgccaagcccaaccagaucagccugaucaacauggaccugcccauggugagcggcgacagaauccacugcauggacauccuguucgccuucaccaagagagugcugggcgagagcggcgagauggacgcccugaagauccagauggaggagaaguucauggccgccaaccccagcaagaucagcuacgagcccaucaccaccacccugagaagaaagcacgaggaggugagcgccauggugauccagagagccuucagaagacaccugcugcagagaagccugaagcacgccagcuuccuguucagacagcaggccggcagcggccugagcgaggaggacgcccccgagagagagggccugaucgccuacgugaugagcgagaacuucagcagaccccugggcccccccagcagcagcagcaucagcagcaccagcuucccccccagcuacgacagcgugaccagagccaccagcgacaaccugcaggugagaggcagcgacuacagccacagcgaggaccuggccgacuucccccccagccccgacagagacagagagagcaucguguaa

SEQ ID NO: 23061 - RNA, 5049 nt, Artificial Sequence
  SCN7A__Homo_sapiens__NP_002967
augcuggccagccccgagcccaagggccuggugcccuucaccaaggagagcuucgagcugaucaagcagcacaucgccaagacccacaacgaggaccacgaggaggaggaccugaagcccacccccgaccuggaggugggcaagaagcugcccuucaucuacggcaaccugagccagggcauggugagcgagccccuggaggacguggaccccuacuacuacaagaagaagaacaccuucaucgugcugaacaagaacagaaccaucuucagauucaacgccgccagcauccugugcacccugagccccuucaacugcaucagaagaaccaccaucaaggugcuggugcaccccuucuuccagcuguucauccugaucagcgugcugaucgacugcguguucaugagccugaccaaccugcccaaguggagacccgugcuggagaacacccugcugggcaucuacaccuucgagauccuggugaagcuguucgccagaggcgugugggccggcagcuucagcuuccugggcgaccccuggaacuggcuggacuucagcgugaccguguucgaggugaucaucagauacagcccccuggacuucauccccacccugcagaccgccagaacccugagaauccugaagaucaucccccugaaccagggccugaagagccuggugggcgugcugauccacugccugaagcagcugaucggcgugaucauccugacccuguucuuccugagcaucuucagccugaucggcaugggccuguucaugggcaaccugaagcacaagugcuucagauggccccaggagaacgagaacgagacccugcacaacagaaccggcaaccccuacuacaucagagagaccgagaacuucuacuaccuggagggcgagagauacgcccugcugugcggcaacagaaccgacgccggccagugccccgagggcuacgugugcgugaaggccggcaucaaccccgaccagggcuucaccaacuucgacagcuucggcugggcccuguucgcccuguucagacugauggcccaggacuaccccgaggugcuguaccaccagauccuguacgccagcggcaagguguacaugaucuucuucgugguggugagcuuccuguucagcuucuacauggccagccuguuccugggcauccuggccauggccuacgaggaggagaagcagagagugggcgagaucagcaagaagaucgagcccaaguuccagcagaccggcaaggagcugcaggagggcaacgagaccgacgaggccaagaccauccagaucgagaugaagaagagaagccccaucagcaccgacaccagccuggacgugcuggaggacgccacccugagacacaaggaggagcuggagaagagcaagaagaucugcccccuguacugguacaaguucgccaagaccuuccugaucuggaacugcagccccugcuggcugaagcugaaggaguucgugcacagaaucaucauggcccccuucaccgaccuguuccugaucaucugcaucauccugaacgugugcuuccugacccuggagcacuaccccaugagcaagcagaccaacacccugcugaacaucggcaaccugguguucaucggcaucuucaccgccgagaugaucuucaagaucaucgccaugcaccccuacggcuacuuccaggugggcuggaacaucuucgacagcaugaucguguuccacggccugaucgagcugugccuggccaacguggccggcauggcccugcugagacuguucagaaugcugagaaucuucaagcugggcaaguacuggcccaccuuccagauccugauguggagccugagcaacagcuggguggcccugaaggaccuggugcugcugcuguucaccuucaucuucuucagcgccgccuucggcaugaagcuguucggcaagaacuacgaggaguucgugugccacaucgacaaggacugccagcugcccagauggcacaugcacgacuucuuccacagcuuccugaacguguucagaauccugugcggcgaguggguggagacccugugggacugcauggagguggccggccagagcuggugcauccccuucuaccugauggugauccugaucggcaaccugcuggugcuguaccuguuccuggcccuggugagcagcuucagcagcugcaaggacgugaccgccgaggagaacaacgaggccaagaaccugcagcuggccguggccagaaucaagaagggcaucaacuacgugcugcugaagauccugugcaagacccagaacgugcccaaggacaccauggaccacgugaacgagguguacgugaaggaggacaucagcgaccacacccugagcgagcugagcaacacccaggacuuccugaaggacaaggagaagagcagcggcaccgagaagaacgccaccgagaacgagagccagagccugauccccagccccagcgugagcgagaccgugcccaucgccagcggcgagagcgacaucgagaaccuggacaacaaggagauccagagcaagagcggcgacggcggcagcaaggagaagaucaagcagagcagcagcagcgagugcagcaccguggacaucgccaucagcgaggaggaggagauguucuacggcggcgagagaagcaagcaccugaagaacggcugcagaagaggcagcagccugggccagaucagcggcgccagcaagaagggcaagaucuggcagaacaucagaaagaccugcugcaagaucguggagaacaacugguucaagugcuucaucggccuggugacccugcugagcaccggcacccuggccuucgaggacaucuacauggaccagagaaagaccaucaagauccugcuggaguacgccgacaugaucuucaccuacaucuucauccuggagaugcugcugaaguggauggccuacggcuucaaggccuacuucagcaacggcugguacagacuggacuucgugguggugaucguguucugccugagccugaucggcaagaccagagaggagcugaagccccugaucagcaugaaguuccugagaccccugagagugcugagccaguucgagagaaugaaggugguggugagagcccugaucaagaccacccugcccacccugaacguguuccuggugugccugaugaucuggcugaucuucagcaucaugggcguggaccuguucgccggcagauucuacgagugcaucgaccccaccagcggcgagagauuccccagcagcgaggugaugaacaagagcagaugcgagagccugcuguucaacgagagcaugcugugggagaacgccaagaugaacuucgacaacgugggcaacggcuuccugagccugcugcagguggccaccuucaacggcuggaucaccaucaugaacagcgccaucgacagcguggccgugaacauccagccccacuucgaggugaacaucuacauguacugcuacuucaucaacuucaucaucuucggcguguuccugccccugagcaugcugaucaccgugaucaucgacaacuucaacaagcacaagaucaagcugggcggcagcaacaucuucaucaccgugaagcagagaaagcaguacagaagacugaagaagcugauguacgaggacagccagagacccgugcccagaccccugaacaagcugcagggcuucaucuucgacguggugaccagccaggccuucaacgugaucgugauggugcugaucugcuuccaggccaucgccaugaugaucgacaccgacgugcagagccugcagaugagcaucgcccuguacuggaucaacagcaucuucgugaugcuguacaccauggagugcauccugaagcugaucgccuucagaugcuucuacuucaccaucgccuggaacaucuucgacuucaugguggugaucuucagcaucaccggccugugccugcccaugaccgugggcagcuaccuggugccccccagccuggugcagcugauccugcugagcagaaucauccacaugcugagacugggcaagggccccaagguguuccacaaccugaugcugccccugaugcugagccugcccgcccugcugaacaucauccugcugaucuuccuggugauguucaucuacgccguguucggcauguacaacuucgccuacgugaagaaggaggccggcaucaacgacgugagcaacuucgagaccuucggcaacagcaugcugugccuguuccagguggccaucuucgccggcugggacggcaugcuggacgccaucuucaacagcaaguggagcgacugcgaccccgacaagaucaaccccggcacccaggugagaggcgacugcggcaaccccagcgugggcaucuucuacuucgugagcuacauccugaucagcuggcugaucaucgugaacauguacaucgugguggugauggaguuccugaacaucgccagcaagaagaagaacaagacccugagcgaggacgacuucagaaaguucuuccagguguggaagagauucgaccccgacagaacccaguacaucgacagcagcaagcugagcgacuucgccgccgcccuggaccccccccuguucauggccaagcccaacaagggccagcugaucgcccuggaccugcccauggccgugggcgacagaauccacugccuggacauccugcuggccuucaccaagagagugaugggccaggacgugagaauggagaagguggugagcgagaucgagagcggcuuccugcuggccaaccccuucaagaucaccugcgagcccaucaccaccacccugaagagaaagcaggaggccgugagcgccaccaucauccagagagccuacaagaacuacagacugagaagaaacgacaagaacaccagcgacauccacaugaucgacggcgacagagacgugcacgccaccaaggagggcgccuacuucgacaaggccaaggagaagagccccauccagagccagaucuaa

SEQ ID NO: 23062 - RNA, 5820 nt, Artificial Sequence
  SCN8A__Homo_sapiens__NP_001171455
auggccgccagacugcuggccccccccggccccgacagcuucaagcccuucacccccgagagccuggccaacaucgagagaagaaucgccgagagcaagcugaagaagccccccaaggccgacggcagccacagagaggacgacgaggacagcaagcccaagcccaacagcgaccuggaggccggcaagagccugcccuucaucuacggcgacaucccccagggccugguggccgugccccuggaggacuucgaccccuacuaccugacccagaagaccuucguggugcugaacagaggcaagacccuguucagauucagcgccacccccgcccuguacauccugagccccuucaaccugaucagaagaaucgccaucaagauccugauccacagcguguucagcaugaucaucaugugcaccauccugaccaacugcguguucaugaccuucagcaacccccccgacuggagcaagaacguggaguacaccuucaccggcaucuacaccuucgagagccuggugaagaucaucgccagaggcuucugcaucgacggcuucaccuuccugagagaccccuggaacuggcuggacuucagcgugaucaugauggccuacaucaccgaguucgugaaccugggcaacgugagcgcccugagaaccuucagagugcugagagcccugaagaccaucagcgugauccccggccugaagaccaucgugggcgcccugauccagagcgugaagaagcugagcgacgugaugauccugaccguguucugccugagcguguucgcccugaucggccugcagcuguucaugggcaaccugagaaacaagugcgugguguggcccaucaacuucaacgagagcuaccuggagaacggcaccaagggcuucgacugggaggaguacaucaacaacaagaccaacuucuacaccgugcccggcaugcuggagccccugcugugcggcaacagcagcgacgccggccagugccccgagggcuaccagugcaugaaggccggcagaaaccccaacuacggcuacaccagcuucgacaccuucagcugggccuuccuggcccuguucagacugaugacccaggacuacugggagaaccuguaccagcugacccugagagccgccggcaagaccuacaugaucuucuucgugcuggugaucuucgugggcagcuucuaccuggugaaccugauccuggccgugguggccauggccuacgaggagcagaaccaggccacccuggaggaggccgagcagaaggaggccgaguucaaggccaugcuggagcagcugaagaagcagcaggaggaggcccaggccgccgccauggccaccagcgccggcaccgugagcgaggacgccaucgaggaggagggcgaggagggcggcggcagccccagaagcagcagcgagaucagcaagcugagcagcaagagcgccaaggagagaagaaacagaagaaagaagagaaagcagaaggagcugagcgagggcgaggagaagggcgaccccgagaagguguucaagagcgagagcgaggacggcaugagaagaaaggccuucagacugcccgacaacagaaucggcagaaaguucagcaucaugaaccagagccugcugagcauccccggcagccccuuccugagcagacacaacagcaagagcagcaucuucagcuucagaggccccggcagauucagagaccccggcagcgagaacgaguucgccgacgacgagcacagcaccguggaggagagcgagggcagaagagacagccuguucauccccaucagagccagagagagaagaagcagcuacagcggcuacagcggcuacagccagggcagcagaagcagcagaaucuuccccagccugagaagaagcgugaagagaaacagcaccguggacugcaacggcguggugagccugaucggcggccccggcagccacaucggcggcagacugcugcccgaggccaccaccgagguggagaucaagaagaagggccccggcagccugcuggugagcauggaccagcuggccagcuacggcagaaaggacagaaucaacagcaucaugagcguggugaccaacacccugguggaggagcuggaggagagccagagaaagugcccccccugcugguacaaguucgccaacaccuuccugaucugggagugccaccccuacuggaucaagcugaaggagaucgugaaccugaucgugauggaccccuucguggaccuggccaucaccaucugcaucgugcugaacacccuguucauggccauggagcaccaccccaugaccccccaguucgagcacgugcuggccgugggcaaccugguguucaccggcaucuucaccgccgagauguuccugaagcugaucgccauggaccccuacuacuacuuccaggagggcuggaacaucuucgacggcuucaucgugagccugagccugauggagcugagccuggccgacguggagggccugagcgugcugagaagcuucagacugcugagaguguucaagcuggccaagagcuggcccacccugaacaugcugaucaagaucaucggcaacagcgugggcgcccugggcaaccugacccuggugcuggccaucaucguguucaucuucgccguggugggcaugcagcuguucggcaagagcuacaaggagugcgugugcaagaucaaccaggacugcgagcugcccagauggcacaugcacgacuucuuccacagcuuccugaucguguucagagugcugugcggcgaguggaucgagaccaugugggacugcauggagguggccggccaggccaugugccugaucguguucaugauggugauggugaucggcaaccugguggugcugaaccuguuccuggcccugcugcugagcagcuucagcgccgacaaccuggccgccaccgacgacgacggcgagaugaacaaccugcagaucagcgugaucagaaucaagaagggcguggccuggaccaagcugaaggugcacgccuucaugcaggcccacuucaagcagagagaggccgacgaggugaagccccuggacgagcuguacgagaagaaggccaacugcaucgccaaccacaccggcgccgacauccacagaaacggcgacuuccagaagaacggcaacggcaccaccagcggcaucggcagcagcguggagaaguacaucaucgacgaggaccacaugagcuucaucaacaaccccaaccugaccgugagagugcccaucgccgugggcgagagcgacuucgagaaccugaacaccgaggacgugagcagcgagagcgaccccgagggcagcaaggacaagcuggacgacaccagcagcagcgagggcagcaccaucgacaucaagcccgagguggaggaggugcccguggagcagcccgaggaguaccuggaccccgacgccugcuucaccgagggcugcgugcagagauucaagugcugccaggugaacaucgaggagggccugggcaagagcugguggauccugagaaagaccugcuuccugaucguggagcacaacugguucgagaccuucaucaucuucaugauccugcugagcagcggcgcccuggccuucgaggacaucuacaucgagcagagaaagaccaucagaaccauccuggaguacgccgacaagguguucaccuacaucuucauccuggagaugcugcugaaguggaccgccuacggcuucgugaaguucuucaccaacgccuggugcuggcuggacuuccugaucguggccgugguggugaacgcccuggugggcgccauccccagcaucaugaacgugcugcuggugugccugaucuucuggcugaucuucagcaucaugggcgugaaccuguucgccggcaaguaccacuacugcuucaacgagaccagcgagaucagauucgagaucgaggacgugaacaacaagaccgagugcgagaagcugauggagggcaacaacaccgagaucagauggaagaacgugaagaucaacuucgacaacgugggcgccggcuaccuggcccugcugcagguggccaccuucaagggcuggauggacaucauguacgccgccguggacagcagaaagcccgacgagcagcccaaguacgaggacaacaucuacauguacaucuacuucgugaucuucaucaucuucggcagcuucuucacccugaaccuguucaucggcgugaucaucgacaacuucaaccagcagaagaagaaguucggcggccaggacaucuucaugaccgaggagcagaagaaguacuacaacgccaugaagaagcugggcagcaagaagccccagaagcccauccccagaccccugaacaagauccagggcaucguguucgacuucgugacccagcaggccuucgacaucgugaucaugaugcugaucugccugaacauggugaccaugaugguggagaccgacacccagagcaagcagauggagaacauccuguacuggaucaaccugguguucgugaucuucuucaccugcgagugcgugcugaagauguucgcccugagacacuacuacuucaccaucggcuggaacaucuucgacuucgugguggugauccugagcaucgugggcauguuccuggccgacaucaucgagaaguacuucgugagccccacccuguucagagugaucagacuggccagaaucggcagaauccugagacugaucaagggcgccaagggcaucagaacccugcuguucgcccugaugaugagccugcccgcccuguucaacaucggccugcugcuguuccuggugauguucaucuucagcaucuucggcaugagcaacuucgccuacgugaagcacgaggccggcaucgacgacauguucaacuucgagaccuucggcaacagcaugaucugccuguuccagaucaccaccagcgccggcugggacggccugcugcugcccauccugaacagaccccccgacugcagccuggacaaggagcaccccggcagcggcuucaagggcgacugcggcaaccccagcgugggcaucuucuucuucgugagcuacaucaucaucagcuuccugaucguggugaacauguacaucgccaucauccuggagaacuucagcguggccaccgaggagagcgccgacccccugagcgaggacgacuucgagaccuucuacgagaucugggagaaguucgaccccgacgccacccaguucaucgaguacugcaagcuggccgacuucgccgacgcccuggagcacccccugagagugcccaagcccaacaccaucgagcugaucgccauggaccugcccauggugagcggcgacagaauccacugccuggacauccuguucgccuucaccaagagagugcugggcgacagcggcgagcuggacauccugagacagcagauggaggagagauucguggccagcaaccccagcaaggugagcuacgagcccaucaccaccacccugagaagaaagcaggaggaggugagcgccguggugcugcagagagccuacagaggccaccuggccagaagaggcuucaucugcaagaagaccaccagcaacaagcuggagaacggcggcacccacagagagaagaaggagagcacccccagcaccgccagccugcccagcuacgacagcgugaccaagcccgagaaggagaagcagcagagagccgaggagggcagaagagagagagccaagagacagaaggaggugagagagagcaagugcuaa

SEQ ID NO: 23063 - RNA, 5934 nt, Artificial Sequence
  SCN9A__Homo_sapiens__NP_002968
auggccaugcugcccccccccggcccccagagcuucgugcacuucaccaagcagagccuggcccugaucgagcagagaaucgccgagagaaagagcaaggagcccaaggaggagaagaaggacgacgacgaggaggcccccaagcccagcagcgaccuggaggccggcaagcagcugcccuucaucuacggcgacaucccccccggcauggugagcgagccccuggaggaccuggaccccuacuacgccgacaagaagaccuucaucgugcugaacaagggcaagaccaucuucagauucaacgccacccccgcccuguacaugcugagccccuucagcccccugagaagaaucagcaucaagauccuggugcacagccuguucagcaugcugaucaugugcaccauccugaccaacugcaucuucaugaccaugaacaacccccccgacuggaccaagaacguggaguacaccuucaccggcaucuacaccuucgagagccuggugaagauccuggccagaggcuucugcgugggcgaguucaccuuccugagagaccccuggaacuggcuggacuucguggugaucguguucgccuaccugaccgaguucgugaaccugggcaacgugagcgcccugagaaccuucagagugcugagagcccugaagaccaucagcgugauccccggccugaagaccaucgugggcgcccugauccagagcgugaagaagcugagcgacgugaugauccugaccguguucugccugagcguguucgcccugaucggccugcagcuguucaugggcaaccugaagcacaagugcuucagaaacagccuggagaacaacgagacccuggagagcaucaugaacacccuggagagcgaggaggacuucagaaaguacuucuacuaccuggagggcagcaaggacgcccugcugugcggcuucagcaccgacagcggccagugccccgagggcuacaccugcgugaagaucggcagaaaccccgacuacggcuacaccagcuucgacaccuucagcugggccuuccuggcccuguucagacugaugacccaggacuacugggagaaccuguaccagcagacccugagagccgccggcaagaccuacaugaucuucuucgugguggugaucuuccugggcagcuucuaccugaucaaccugauccuggccgugguggccauggccuacgaggagcagaaccaggccaacaucgaggaggccaagcagaaggagcuggaguuccagcagaugcuggacagacugaagaaggagcaggaggaggccgaggccaucgccgccgccgccgccgaguacaccagcaucagaagaagcagaaucaugggccugagcgagagcagcagcgagaccagcaagcugagcagcaagagcgccaaggagagaagaaacagaagaaagaagaagaaccagaagaagcugagcagcggcgaggagaagggcgacgccgagaagcugagcaagagcgagagcgaggacagcaucagaagaaagagcuuccaccugggcguggagggccacagaagagcccacgagaagagacugagcacccccaaccagagcccccugagcaucagaggcagccuguucagcgccagaagaagcagcagaaccagccuguucagcuucaagggcagaggcagagacaucggcagcgagaccgaguucgccgacgacgagcacagcaucuucggcgacaacgagagcagaagaggcagccuguucgugccccacagaccccaggagagaagaagcagcaacaucagccaggccagcagaagcccccccaugcugcccgugaacggcaagaugcacagcgccguggacugcaacggcguggugagccugguggacggcagaagcgcccugaugcugcccaacggccagcugcugcccgagggcaccaccaaccagauccacaagaagagaagaugcagcagcuaccugcugagcgaggacaugcugaacgaccccaaccugagacagagagccaugagcagagccagcauccugaccaacaccguggaggagcuggaggagagcagacagaagugcccccccuggugguacagauucgcccacaaguuccugaucuggaacugcagccccuacuggaucaaguucaagaagugcaucuacuucaucgugauggaccccuucguggaccuggccaucaccaucugcaucgugcugaacacccuguucauggccauggagcaccaccccaugaccgaggaguucaagaacgugcuggccaucggcaaccugguguucaccggcaucuucgccgccgagauggugcugaagcugaucgccauggaccccuacgaguacuuccaggugggcuggaacaucuucgacagccugaucgugacccugagccugguggagcuguuccuggccgacguggagggccugagcgugcugagaagcuucagacugcugagaguguucaagcuggccaagagcuggcccacccugaacaugcugaucaagaucaucggcaacagcgugggcgcccugggcaaccugacccuggugcuggccaucaucguguucaucuucgccguggugggcaugcagcuguucggcaagagcuacaaggagugcgugugcaagaucaacgacgacugcacccugcccagauggcacaugaacgacuucuuccacagcuuccugaucguguucagagugcugugcggcgaguggaucgagaccaugugggacugcauggagguggccggccaggccaugugccugaucguguacaugauggugauggugaucggcaaccugguggugcugaaccuguuccuggcccugcugcugagcagcuucagcagcgacaaccugaccgccaucgaggaggaccccgacgccaacaaccugcagaucgccgugaccagaaucaagaagggcaucaacuacgugaagcagacccugagagaguucauccugaaggccuucagcaagaagcccaagaucagcagagagaucagacaggccgaggaccugaacaccaagaaggagaacuacaucagcaaccacacccuggccgagaugagcaagggccacaacuuccugaaggagaaggacaagaucagcggcuucggcagcagcguggacaagcaccugauggaggacagcgacggccagagcuucauccacaaccccagccugaccgugaccgugcccaucgcccccggcgagagcgaccuggagaacaugaacgccgaggagcugagcagcgacagcgacagcgaguacagcaaggugagacugaacagaagcagcagcagcgagugcagcaccguggacaacccccugcccggcgagggcgaggaggccgaggccgagcccaugaacagcgacgagcccgaggccugcuucaccgacggcugcgugagaagauucagcugcugccaggugaacaucgagagcggcaagggcaagaucugguggaacaucagaaagaccugcuacaagaucguggagcacagcugguucgagagcuucaucgugcugaugauccugcugagcagcggcgcccuggccuucgaggacaucuacaucgagagaaagaagaccaucaagaucauccuggaguacgccgacaagaucuucaccuacaucuucauccuggagaugcugcugaaguggaucgccuacggcuacaagaccuacuucaccaacgccuggugcuggcuggacuuccugaucguggacgugagccuggugacccugguggccaacacccugggcuacagcgaccugggccccaucaagagccugagaacccugagagcccugagaccccugagagcccugagcagauucgagggcaugagagugguggugaacgcccugaucggcgccauccccagcaucaugaacgugcugcuggugugccugaucuucuggcugaucuucagcaucaugggcgugaaccuguucgccggcaaguucuacgagugcaucaacaccaccgacggcagcagauuccccgccagccaggugcccaacagaagcgagugcuucgcccugaugaacgugagccagaacgugagauggaagaaccugaaggugaacuucgacaacgugggccugggcuaccugagccugcugcagguggccaccuucaagggcuggaccaucaucauguacgccgccguggacagcgugaacguggacaagcagcccaaguacgaguacagccuguacauguacaucuacuucgugguguucaucaucuucggcagcuucuucacccugaaccuguucaucggcgugaucaucgacaacuucaaccagcagaagaagaagcugggcggccaggacaucuucaugaccgaggagcagaagaaguacuacaacgccaugaagaagcugggcagcaagaagccccagaagcccauccccagacccggcaacaagauccagggcugcaucuucgaccuggugaccaaccaggccuucgacaucagcaucauggugcugaucugccugaacauggugaccaugaugguggagaaggagggccagagccagcacaugaccgaggugcuguacuggaucaacgugguguucaucauccuguucaccggcgagugcgugcugaagcugaucagccugagacacuacuacuucaccgugggcuggaacaucuucgacuucgugguggugaucaucagcaucgugggcauguuccuggccgaccugaucgagaccuacuucgugagccccacccuguucagagugaucagacuggccagaaucggcagaauccugagacuggugaagggcgccaagggcaucagaacccugcuguucgcccugaugaugagccugcccgcccuguucaacaucggccugcugcuguuccuggugauguucaucuacgccaucuucggcaugagcaacuucgccuacgugaagaaggaggacggcaucaacgacauguucaacuucgagaccuucggcaacagcaugaucugccuguuccagaucaccaccagcgccggcugggacggccugcuggcccccauccugaacagcaagccccccgacugcgaccccaagaaggugcaccccggcagcagcguggagggcgacugcggcaaccccagcgugggcaucuucuacuucgugagcuacaucaucaucagcuuccuggugguggugaacauguacaucgccgugauccuggagaacuucagcguggccaccgaggagagcaccgagccccugagcgaggacgacuucgagauguucuacgaggugugggagaaguucgaccccgacgccacccaguucaucgaguucagcaagcugagcgacuucgccgccgcccuggaccccccccugcugaucgccaagcccaacaaggugcagcugaucgccauggaccugcccauggugagcggcgacagaauccacugccuggacauccuguucgccuucaccaagagagugcugggcgagagcggcgagauggacagccugagaagccagauggaggagagauucaugagcgccaaccccagcaaggugagcuacgagcccaucaccaccacccugaagagaaagcaggaggacgugagcgccaccgugauccagagagccuacagaagauacagacugagacagaacgugaagaacaucagcagcaucuacaucaaggacggcgacagagacgacgaccugcugaacaagaaggacauggccuucgacaacgugaacgagaacagcagccccgagaagaccgacgccaccagcagcaccaccagcccccccagcuacgacagcgugaccaagcccgacaaggagaaguacgagcaggacagaaccgagaaggaggacaagggcaaggacagcaaggagagcaagaaguaa

SEQ ID NO: 23064 - RNA, 588 nt, Artificial Sequence
  SCNM1__Homo_sapiens__NP_001191785
augcugagagacggcagauucgccugcgccaucugcccccacagacccgugcuggacacccuggccaugcugaccgcccacagagccggcaagaagcaccugagcagccugcagcuguucuacggcaagaagcagcccggcaaggagagaaagcagaaccccaagcaccagaacgagcugagaagagaggagaccaaggccgaggccccccugcugacccagaccagacugaucacccagagcgcccugcacagagccccccacuacaacagcugcugcagaagaaaguacagacccgaggcccccggccccagcgugagccugagccccaugccccccagcgaggugaagcugcagagcggcaagaucagcagagagcccgagcccgccgccggcccccaggccgaggagagcgccaccgugagcgcccccgcccccaugagccccaccagaagaagagcccuggaccacuaccugacccugagaagcagcggcuggauccccgacggcagaggcagaugggugaaggacgagaacguggaguucgacagcgacgaggaggagccccccgaccugccccuggacuaa

SEQ ID NO: 23065 - RNA, 2010 nt, Artificial Sequence
  SCNN1A__Homo_sapiens__NP_001029
auggagggcaacaagcuggaggagcaggacagcagccccccccagagcacccccggccugaugaagggcaacaagagagaggagcagggccugggccccgagcccgccgccccccagcagcccaccgccgaggaggaggcccugaucgaguuccacagaagcuacagagagcuguucgaguucuucugcaacaacaccaccauccacggcgccaucagacuggugugcagccagcacaacagaaugaagaccgccuucugggccgugcuguggcugugcaccuucggcaugauguacuggcaguucggccugcuguucggcgaguacuucagcuaccccgugagccugaacaucaaccugaacagcgacaagcugguguuccccgccgugaccaucugcacccugaaccccuacagauaccccgagaucaaggaggagcuggaggagcuggacagaaucaccgagcagacccuguucgaccuguacaaguacagcagcuucaccacccugguggccggcagcagaagcagaagagaccugagaggcacccugccccacccccugcagagacugagagugcccccccccccccacggcgccagaagagccagaagcguggccagcagccugagagacaacaacccccagguggacuggaaggacuggaagaucggcuuccagcugugcaaccagaacaagagcgacugcuucuaccagaccuacagcagcggcguggacgccgugagagagugguacagauuccacuacaucaacauccugagcagacugcccgagacccugcccagccuggaggaggacacccugggcaacuucaucuucgccugcagauucaaccaggugagcugcaaccaggccaacuacagccacuuccaccaccccauguacggcaacugcuacaccuucaacgacaagaacaacagcaaccuguggaugagcagcaugcccggcaucaacaacggccugagccugaugcugagagccgagcagaacgacuucaucccccugcugagcaccgugaccggcgccagagugauggugcacggccaggacgagcccgccuucauggacgacggcggcuucaaccugagacccggcguggagaccagcaucagcaugagaaaggagacccuggacagacugggcggcgacuacggcgacugcaccaagaacggcagcgacgugcccguggagaaccuguaccccagcaaguacacccagcaggugugcauccacagcugcuuccaggagagcaugaucaaggagugcggcugcgccuacaucuucuaccccagaccccagaacguggaguacugcgacuacagaaagcacagcagcuggggcuacugcuacuacaagcugcagguggacuucagcagcgaccaccugggcugcuucaccaagugcagaaagcccugcagcgugaccagcuaccagcugagcgccggcuacagcagauggcccagcgugaccagccaggaguggguguuccagaugcugagcagacagaacaacuacaccgugaacaacaagagaaacggcguggccaaggugaacaucuucuucaaggagcugaacuacaagaccaacagcgagagccccagcgugaccauggugacccugcugagcaaccugggcagccaguggagccugugguucggcagcagcgugcugagcgugguggagauggccgagcugguguucgaccugcuggugaucauguuccugaugcugcugagaagauucagaagcagauacuggagccccggcagaggcggcagaggcgcccaggagguggccagcacccuggccagcagcccccccagccacuucugcccccaccccaugagccugagccugagccagcccggccccgcccccagccccgcccugaccgcccccccccccgccuacgccacccugggccccagacccagccccggcggcagcgccggcgccagcagcagcaccugcccccugggcggccccuaa

SEQ ID NO: 23066 - RNA, 1923 nt, Artificial Sequence
  SCNN1B__Homo_sapiens__NP_000327
augcacgugaagaaguaccugcugaagggccugcacagacugcagaagggccccggcuacaccuacaaggagcugcuggugugguacugcgacaacaccaacacccacggccccaagagaaucaucugcgagggccccaagaagaaggccaugugguuccugcugacccugcuguucgccgcccuggugugcuggcaguggggcaucuucaucagaaccuaccugagcugggaggugagcgugagccugagcgugggcuucaagaccauggacuuccccgccgugaccaucugcaacgccagccccuucaaguacagcaagaucaagcaccugcugaaggaccuggacgagcugauggaggccgugcuggagagaauccuggcccccgagcugagccacgccaacgccaccagaaaccugaacuucagcaucuggaaccacaccccccuggugcugaucgacgagagaaacccccaccaccccauggugcuggaccuguucggcgacaaccacaacggccugaccagcagcagcgccagcgagaagaucugcaacgcccacggcugcaagauggccaugagacugugcagccugaacagaacccagugcaccuucagaaacuucaccagcgccacccaggcccugaccgagugguacauccugcaggccaccaacaucuucgcccaggugccccagcaggagcugguggagaugagcuaccccggcgagcagaugauccuggccugccuguucggcgccgagcccugcaacuacagaaacuucaccagcaucuucuacccccacuacggcaacugcuacaucuucaacuggggcaugaccgagaaggcccugcccagcgccaaccccggcaccgaguucggccugaagcugauccuggacaucggccaggaggacuacgugcccuuccuggccagcaccgccggcgugagacugaugcugcacgagcagagaagcuaccccuucaucagagacgagggcaucuacgccaugagcggcaccgagaccagcaucggcgugcugguggacaagcugcagagaaugggcgagcccuacagccccugcaccgugaacggcagcgaggugcccgugcagaacuucuacagcgacuacaacaccaccuacagcauccaggccugccugagaagcugcuuccaggaccacaugaucagaaacugcaacugcggccacuaccuguacccccugcccagaggcgagaaguacugcaacaacagagacuuccccgacugggcccacugcuacagcgaccugcagaugagcguggcccagagagagaccugcaucggcaugugcaaggagagcugcaacgacacccaguacaagaugaccaucagcauggccgacuggcccagcgaggccagcgaggacuggaucuuccacgugcugagccaggagagagaccagagcaccaacaucacccugagcagaaagggcaucgugaagcugaacaucuacuuccaggaguucaacuacagaaccaucgaggagagcgccgccaacaacaucguguggcugcugagcaaccugggcggccaguucggcuucuggaugggcggcagcgugcugugccugaucgaguucggcgagaucaucaucgacuucguguggaucaccaucaucaagcugguggcccuggccaagagccugagacagagaagagcccaggccagcuacgccggccccccccccaccguggccgagcugguggaggcccacaccaacuucggcuuccagcccgacaccgcccccagaagccccaacaccggccccuaccccagcgagcaggcccugcccauccccggcacccccccccccaacuacgacagccugagacugcagccccuggacgugaucgagagcgacagcgagggcgacgccaucuaa

SEQ ID NO: 23067 - RNA, 2688 nt, Artificial Sequence
  SCNN1D__Homo_sapiens__XP_011540201
augcccggcgccugccaccugcagggcagcgccgugaccgaggacaacaccgcccccagccugcccguggccagacccccccagagacccaaggaggugagcagccagcccugcagcgugaacggcgccuggcccagcuuccugggcgagagcagaggcaugggccccaagggcgccagagacgccugccccagccugcugagcuucagacugaccuggagcuggugcagcgaccacagaacccccaccugcagagagcugggcagcccccaccccacccccugcaccggccccgccagaggcuggcccagaagaggcggcggccccugcggcuucaccagcgccggccacgugcugugcggcuacccccugugccugcugagcggccccauccagggcugcggcaccggcgccgcccacgcccagagcugccccgacguggugggcgagaagccccaggccugcgccgugagcggcggccccgccgccgaccuguggggccugugcgacaucagcaagccccccgccgccagccuggagagacaccccagccccaucuggcacagcagaaagagcgcccagagaggcagacacagauggcagcugcugcccagcagagccggcagacaggaggccagaggcagcauccugcugcagagcugccagcugcccccccaguggcugagcaccgaggccuggaccggcgaguggaagcagccccacggcggcgcccugaccagcagaagccccggccccguggccccccagagacccugccaccugaagggcuggcagcacagacccacccagcacaacgccgccugcaagcagggccaggccgccgcccagaccccccccagacccggcccccccagcgcccccccccccccccccaaggagggccaccaggagggccugguggagcugcccgccagcuucagagagcugcugaccuucuucugcaccaacgccaccauccacggcgccaucagacuggugugcagcagaggcaacagacugaagaccaccagcuggggccugcugagccugggcgcccugguggcccugugcuggcagcugggccugcuguucgagagacacuggcacagacccgugcugauggccgugagcgugcacagcgagagaaagcugcugccccuggugacccugugcgacggcaaccccagaagacccagccccgugcugagacaccuggagcugcuggacgaguucgccagagagaacaucgacagccuguacaacgugaaccugagcaagggcagagccgcccugagcgccaccgugcccagacacgagccccccuuccaccuggacagagagaucagacugcagagacugagccacagcggcagcagagugagagugggcuucagacugugcaacagcaccggcggcgacugcuucuacagaggcuacaccagcggcguggccgccgugcaggacugguaccacuuccacuacguggacauccuggcccugcugcccgccgccugggaggacagccacggcagccaggacggccacuucgugcugagcugcagcuacgacggccuggacugccaggccagacaguucagaaccuuccaccaccccaccuacggcagcugcuacaccguggacggcguguggaccgcccagagacccggcaucacccacggcgugggccuggugcugagaguggagcagcagccccaccugccccugcugagcacccuggccggcaucagagugauggugcacggcagaaaccacacccccuuccugggccaccacagcuucagcgugagacccggcaccgaggccaccaucagcaucagagaggacgaggugcacagacugggcagccccuacggccacugcaccgccggcggcgagggcguggagguggagcugcugcacaacaccagcuacaccagacaggccugccuggugagcugcuuccagcagcugaugguggagaccugcagcugcggcuacuaccugcacccccugcccgccggcgccgaguacugcagcagcgccagacaccccgccuggggccacugcuucuacagacuguaccaggaccuggagacccacagacugcccugcaccagcagaugccccagacccugcagagagagcgccuucaagcugagcaccggcaccagcagauggcccagcgccaagagcgccggcuggacccuggccacccugggcgagcagggccugccccaccagagccacagacagagaagcagccuggccaagaucaacaucguguaccaggagcugaacuacagaagcguggaggaggcccccguguacagcgugccccagcugcugagcgccaugggcagccugugcagccugugguucggcgccagcgugcugagccugcuggagcugcuggagcugcugcuggacgccagcgcccugacccuggugcugggcggcagaagacugagaagagccugguucagcuggcccagagccagccccgccagcggcgccagcagcaucaagcccgaggccagccagaugcccccccccgccggcggcaccagcgacgaccccgagcccagcggcccccaccugcccagagugaugcugcccggcgugcuggccggcgugagcgccgaggagagcugggccggcccccagccccuggagacccuggacaccuaa

SEQ ID NO: 23068 - RNA, 1950 nt, Artificial Sequence
  SCNN1G__Homo_sapiens__NP_001030
auggcccccggcgagaagaucaaggccaagaucaagaagaaccugcccgugaccggcccccaggcccccaccaucaaggagcugaugagaugguacugccugaacaccaacacccacggcugcagaagaaucguggugagcagaggcagacugagaagacugcuguggaucggcuucacccugaccgccguggcccugauccuguggcagugcgcccugcugguguucagcuucuacaccgugagcgugagcaucaaggugcacuucagaaagcuggacuuccccgccgugaccaucugcaacaucaaccccuacaaguacagcaccgugagacaccugcuggccgaccuggagcaggagaccagagaggcccugaagagccuguacggcuuccccgagagcagaaagagaagagaggccgagagcuggaacagcgugagcgagggcaagcagcccagauucagccacagaaucccccugcugaucuucgaccaggacgagaagggcaaggccagagacuucuucaccggcagaaagagaaaggugggcggcagcaucauccacaaggccagcaacgugaugcacaucgagagcaagcagguggugggcuuccagcugugcagcaacgacaccagcgacugcgccaccuacaccuucagcagcggcaucaacgccauccaggagugguacaagcugcacuacaugaacaucauggcccaggugccccuggagaagaagaucaacaugagcuacagcgccgaggagcugcuggugaccugcuucuucgacggcgugagcugcgacgccagaaacuucacccuguuccaccaccccaugcacggcaacugcuacaccuucaacaacagagagaacgagaccauccugagcaccagcaugggcggcagcgaguacggccugcaggugauccuguacaucaacgaggaggaguacaaccccuuccuggugagcagcaccggcgccaaggugaucauccacagacaggacgaguaccccuucguggaggacgugggcaccgagaucgagaccgccauggugaccagcaucggcaugcaccugaccgagagcuucaagcugagcgagcccuacagccagugcaccgaggacggcagcgacgugcccaucagaaacaucuacaacgccgccuacagccugcagaucugccugcacagcugcuuccagaccaagaugguggagaagugcggcugcgcccaguacagccagccccugccccccgccgccaacuacugcaacuaccagcagcaccccaacuggauguacugcuacuaccagcugcacagagccuucgugcaggaggagcugggcugccagagcgugugcaaggaggccugcagcuucaaggaguggacccugaccaccagccuggcccaguggcccagcguggugagcgagaaguggcugcugcccgugcugaccugggaccagggcagacaggugaacaagaagcugaacaagaccgaccuggccaagcugcugaucuucuacaaggaccugaaccagagaagcaucauggagagccccgccaacagcaucgagaugcugcugagcaacuucggcggccagcugggccuguggaugagcugcagcguggugugcgugaucgagaucaucgagguguucuucaucgacuucuucagcaucaucgccagaagacaguggcagaaggccaaggaguggugggccuggaagcaggccccccccugccccgaggcccccagaagcccccagggccaggacaaccccgcccuggacaucgacgacgaccugcccaccuucaacagcgcccugcaccugccccccgcccugggcacccaggugcccggcacccccccccccaaguacaacacccugagacuggagagagccuucagcaaccagcugaccgacacccagaugcuggacgagcuguaa

SEQ ID NO: 23069 - RNA, 906 nt, Artificial Sequence
  SCO1__Homo_sapiens__NP_004580
auggccaugcuggugcuggugcccggcagagugaugagaccccugggcggccagcuguggagauuccugcccagaggccuggaguucuggggccccgccgagggcaccgccagagugcugcugagacaguucugcgccagacaggccgaggccuggagagccagcggcagacccggcuacugccugggcaccagaccccugagcaccgccagaccccccccccccuggagccagaagggccccggcgacagcaccagacccagcaagcccggccccgugagcuggaagagccuggccaucaccuucgccaucggcggcgcccugcuggccggcaugaagcacgugaagaaggagaaggccgagaagcuggagaaggagagacagagacacaucggcaagccccugcugggcggccccuucagccugaccacccacaccggcgagagaaagaccgacaaggacuaccugggccaguggcugcugaucuacuucggcuucacccacugccccgacgugugccccgaggagcuggagaagaugauccaggugguggacgagaucgacagcaucaccacccugcccgaccugaccccccuguucaucagcaucgaccccgagagagacaccaaggaggccaucgccaacuacgugaaggaguucagccccaagcuggugggccugaccggcaccagagaggagguggaccagguggccagagccuacagaguguacuacagccccggccccaaggacgaggacgaggacuacaucguggaccacaccaucaucauguaccugaucggccccgacggcgaguuccuggacuacuucggccagaacaagagaaagggcgagaucgccgccagcaucgccacccacaugagacccuacagaaagaagagcuaa

SEQ ID NO: 23070 - RNA, 801 nt, Artificial Sequence
  SCO2__Homo_sapiens__NP_001162582
augcugcugcugaccagaagccccaccgccuggcacagacugagccagcugaagcccagagugcugcccggcacccugggcggccaggcccugcaccugagaagcuggcugcugagcagacagggccccgccgagaccggcggccagggccagccccagggccccggccugagaaccagacugcugaucaccggccuguucggcgccggccugggcggcgccuggcuggcccugagagccgagaaggagagacugcagcagcagaagagaaccgaggcccugagacaggccgccgugggccagggcgacuuccaccugcuggaccacagaggcagagccagaugcaaggccgacuucagaggccagugggugcugauguacuucggcuucacccacugccccgacaucugccccgacgagcuggagaagcuggugcagguggugagacagcuggaggccgagcccggccugccccccgugcagcccguguucaucaccguggaccccgagagagacgacguggaggccauggccagauacgugcaggacuuccaccccagacugcugggccugaccggcagcaccaagcagguggcccaggccagccacagcuacagaguguacuacaacgccggccccaaggacgaggaccaggacuacaucguggaccacagcaucgccaucuaccugcugaaccccgacggccuguucaccgacuacuacggcagaagcagaagcgccgagcagaucagcgacagcgugagaagacacauggccgccuucagaagcgugcugagcuaa

SEQ ID NO: 23071 - RNA, 471 nt, Artificial Sequence
  SCP2D1__Homo_sapiens__NP_848578
auguggaagagaagcgaccaccagcccaagaucaaggccgaggacggcccccuggugggccaguucgaggugcugggcagcgugcccgagcccgccaugccccacccccuggagcugagcgaguucgagagcuuccccguguuccaggacaucagacugcacaucagagaggugggcgcccagcuggugaagaaggugaacgccguguuccagcuggacaucaccaagaacggcaagaccauccugagauggaccaucgaccugaagaacggcagcggcgacauguaccccggccccgccagacugcccgccgacaccguguucaccauccccgagagcguguucauggagcuggugcugggcaagaugaacccccagaaggccuuccuggccggcaaguucaaggugagcggcaaggugcugcugagcuggaagcuggagagaguguucaaggacugggccaaguucuaa

SEQ ID NO: 23072 - RNA, 1359 nt, Artificial Sequence
  SCPEP1__Homo_sapiens__NP_067639
auggagcuggcccugagaagaagccccgugcccagauggcugcugcugcugccccugcugcugggccugaacgccggcgccgugaucgacuggcccaccgaggagggcaaggaggugugggacuacgugaccgugagaaaggacgccuacauguucugguggcuguacuacgccaccaacagcugcaagaacuucagcgagcugccccuggugauguggcugcagggcggccccggcggcagcagcaccggcuucggcaacuucgaggagaucggcccccuggacagcgaccugaagcccagaaagaccaccuggcugcaggccgccagccugcuguucguggacaaccccgugggcaccggcuucagcuacgugaacggcagcggcgccuacgccaaggaccuggccaugguggccagcgacaugauggugcugcugaagaccuucuucagcugccacaaggaguuccagaccgugcccuucuacaucuucagcgagagcuacggcggcaagauggccgccggcaucggccuggagcuguacaaggccauccagagaggcaccaucaagugcaacuucgccggcguggcccugggcgacagcuggaucagccccguggacagcgugcugagcuggggccccuaccuguacagcaugagccugcuggaggacaagggccuggccgaggugagcaagguggccgagcaggugcugaacgccgugaacaagggccuguacagagaggccaccgagcuguggggcaaggccgagaugaucaucgagcagaacaccgacggcgugaacuucuacaacauccugaccaagagcacccccaccagcaccauggagagcagccuggaguucacccagagccaccuggugugccugugccagagacacgugagacaccugcagagagacgcccugagccagcugaugaacggccccaucagaaagaagcugaagaucauccccgaggaccagagcuggggcggccaggccaccaacguguucgugaacauggaggaggacuucaugaagcccgugaucagcaucguggacgagcugcuggaggccggcaucaacgugaccguguacaacggccagcuggaccugaucguggacaccaugggccaggaggccugggugagaaagcugaaguggcccgagcugcccaaguucagccagcugaaguggaaggcccuguacagcgaccccaagagccuggagaccagcgccuucgugaagagcuacaagaaccuggccuucuacuggauccugaaggccggccacauggugcccagcgaccagggcgacauggcccugaagaugaugagacuggugacccagcaggaguaa

SEQ ID NO: 23073 - RNA, 4893 nt, Artificial Sequence
  SCRIB__Homo_sapiens__NP_056171
augcugaagugcaucccccuguggagaugcaacagacacguggagagcguggacaagagacacugcagccugcaggccgugcccgaggagaucuacagauacagcagaagccuggaggagcugcugcuggacgccaaccagcugagagagcugcccaagcccuucuucagacugcugaaccugagaaagcugggccugagcgacaacgagauccagagacugccccccgagguggccaacuucaugcagcugguggagcuggacgugagcagaaacgacauccccgagauccccgagagcaucaaguucugcaaggcccuggagaucgccgacuucagcggcaacccccugagcagacugcccgacggcuucacccagcugagaagccuggcccaccuggcccugaacgacgugagccugcaggcccugcccggcgacgugggcaaccuggccaaccuggugacccuggagcugagagagaaccugcugaagagccugcccgccagccugagcuuccuggugaagcuggagcagcuggaccugggcggcaacgaccuggaggugcugcccgacacccugggcgcccugcccaaccugagagagcuguggcuggacagaaaccagcugagcgcccugccccccgagcugggcaaccugagaagacuggugugccuggacgugagcgagaacagacuggaggagcugcccgccgagcugggcggccuggugcugcugaccgaccugcugcugagccagaaccugcugagaagacugcccgacggcaucggccagcugaagcagcugagcauccugaagguggaccagaacagacugugcgaggugaccgaggccaucggcgacugcgagaaccugagcgagcugauccugaccgagaaccugcugauggcccugcccagaagccugggcaagcugaccaagcugaccaaccugaacguggacagaaaccaccuggaggcccugccccccgagaucggcggcugcguggcccugagcgugcugagccugagagacaacagacuggccgugcugccccccgagcuggcccacaccaccgagcugcacgugcuggacguggccggcaacagacugcagagccugcccuucgcccugacccaccugaaccugaaggcccuguggcuggccgagaaccaggcccagcccaugcugagauuccagaccgaggacgacgccagaaccggcgagaaggugcugaccugcuaccugcugccccagcagcccccccccagccuggaggacgccggccagcagggcagccugagcgagaccuggagcgacgccccccccagcagagugagcgugauccaguuccuggaggcccccaucggcgacgaggacgccgaggaggccgccgccgagaagagaggccugcagagaagagccaccccccaccccagcgagcugaaggugaugaagagaagcaucgagggcagaagaagcgaggccugccccugccagcccgacagcggcagcccccugcccgccgaggaggagaagagacugagcgccgagagcggccugagcgaggacagcagacccagcgccagcaccgugagcgaggccgagcccgagggccccagcgccgaggcccagggcggcagccagcaggaggccaccaccgccggcggcgaggaggacgccgaggaggacuaccaggagcccaccgugcacuucgccgaggacgcccugcugcccggcgacgacagagagaucgaggagggccagcccgaggcccccuggacccugcccggcggcagacagagacugaucagaaaggacaccccccacuacaagaagcacuucaagaucagcaagcugccccagcccgaggccgugguggcccugcugcagggcaugcagcccgacggcgagggccccguggcccccggcggcuggcacaacggcccccacgcccccugggcccccagagcccagaaggaggaggaggaggaggaggagggcagcccccaggaggaggaggaggaggaggaggaggagaacagagccgaggaggaggaggccagcaccgaggaggaggacaaggagggcgccguggugagcgcccccagcgugaagggcgugagcuucgaccaggccaacaaccugcugaucgagcccgccagaaucgaggaggaggagcugacccugaccauccugagacagaccggcggccugggcaucagcaucgccggcggcaagggcagcacccccuacaagggcgacgacgagggcaucuucaucagcagagugagcgaggagggccccgccgccagagccggcgugagagugggcgacaagcugcuggaggugaacggcguggcccugcagggcgccgagcaccacgaggccguggaggcccugagaggcgccggcaccgccgugcagaugagaguguggagagagagaaugguggagcccgagaacgccgugaccaucaccccccugagacccgaggacgacuacagccccagagagagaagaggcggcggccugagacugccccugcugccccccgagagccccggcccccugagacagagacacguggccugccuggccagaagcgagagaggccugggcuucagcaucgccggcggcaagggcagcacccccuacagagccggcgacgccggcaucuucgugagcagaaucgccgagggcggcgccgcccacagagccggcacccugcaggugggcgacagagugcugagcaucaacggcguggacgugaccgaggccagacacgaccacgccgugagccugcugaccgccgccagccccaccaucgcccugcugcuggagagagaggccggcggcccccugccccccagcccccugccccacagcagcccccccaccgccgccguggccaccaccagcaucaccaccgccacccccggcgugcccggccugcccagccuggcccccagccugcuggccgccgcccuggagggccccuaccccguggaggagaucagacugcccagagccggcggcccccugggccugagcaucgugggcggcagcgaccacagcagccaccccuucggcgugcaggagcccggcguguucaucagcaaggugcugcccagaggccuggccgccagaagcggccugagagugggcgacagaauccuggccgugaacggccaggacgugagagacgccacccaccaggaggccgugagcgcccugcugagacccugccuggagcugagccugcuggugagaagagaccccgccccccccggccugagagagcugugcauccagaaggcccccggcgagagacugggcaucagcaucagaggcggcgccagaggccacgccggcaaccccagagaccccaccgacgagggcaucuucaucagcaaggugagccccaccggcgccgccggcagagacggcagacugagagugggccugagacugcuggaggugaaccagcagagccugcugggccugacccacggcgaggccgugcagcugcugagaagcgugggcgacacccugaccgugcuggugugcgacggcuucgaggccagcaccgacgccgcccuggaggugagccccggcgugaucgccaaccccuucgccgccggcaucggccacagaaacagccuggagagcaucagcagcaucgacagagagcugagccccgagggccccggcaaggagaaggagcugcccggccagacccugcacuggggccccgaggccaccgaggccgccggcagaggccugcagccccugaagcuggacuacagagcccuggccgccgugcccagcgccggcagcgugcagagagugcccagcggcgccgccggcggcaagauggccgagagccccugcagccccagcggccagcagccccccagcccccccagccccgacgagcugcccgccaacgugaagcaggccuacagagccuucgccgccgugcccaccagccacccccccgaggacgcccccgcccagccccccacccccggccccgccgccagccccgagcagcugagcuucagagagagacagaaguacuucgagcuggaggugagagugccccaggccgagggcccccccaagagagugagccuggugggcgccgacgaccugagaaagaugcaggaggaggaggccagaaagcugcagcagaagagagcccagaugcugagagaggccgccgaggccggcgccgaggccagacuggcccuggacggcgagacccugggcgaggaggagcaggaggacgagcagccccccugggccagccccagccccaccagcagacagagccccgccagcccccccccccugggcggcggcgcccccgugagaaccgccaaggccgagagaagacaccaggagagacugagagugcagagccccgagccccccgcccccgagagagcccugagccccgccgagcugagagcccuggaggccgagaagagagcccuguggagagccgccagaaugaagagccuggagcaggacgcccugagagcccagauggugcugagcagaagccaggagggcagaggcaccagaggcccccuggagagacuggccgaggcccccagccccgcccccacccccagccccacccccguggaggaccugggcccccagaccagcaccagccccggcagacugagccccgacuucgccgaggagcugagaagccuggagcccagccccagccccggcccccaggaggaggacggcgagguggcccuggugcugcugggcagacccagccccggcgccgugggccccgaggacguggcccugugcagcagcagaagacccgugagacccggcagaagaggccugggccccgugcccagcuaa

SEQ ID NO: 23074 - RNA, 1305 nt, Artificial Sequence
  SCRN1__Homo_sapiens__NP_001138986
auggugcaggacggcaccuucaagaccagagacagcaccuggaccugcgagagcaccagaauggccgccgccccccccagcuacugcuucguggccuucccccccagagccaaggacggccuggugguguucggcaagaacagcgccagacccagagacgaggugcaggaggugguguacuucagcgccgccgaccacgagcccgagagcaagguggagugcaccuacaucagcaucgaccaggugcccagaaccuacgccaucaugaucagcagacccgccuggcuguggggcgccgagaugggcgccaacgagcacggcgugugcaucgccaacgaggccaucaacaccagagagcccgccgccgagaucgaggcccugcugggcauggaccuggugagacugggccuggagagaggcgagaccgccaaggaggcccuggacgugaucgugagccugcuggaggagcacggccagggcggcaacuacuucgaggacgccaacagcugccacagcuuccagagcgccuaccugaucguggacagagacgaggccugggugcuggagaccaucggcaaguacugggccgccgagaaggugaccgagggcgugagaugcaucugcagccagcugagccugaccaccaagauggacgccgagcaccccgagcugagaagcuacgcccagagccagggcugguggaccggcgagggcgaguucaacuucagcgagguguucagccccguggaggaccaccuggacugcggcgccggcaaggacagccuggagaagcaggaggagagcaucaccgugcagaccaugaugaacacccugagagacaaggccagcggcgugugcaucgacagcgaguucuuccugaccaccgccagcggcgugagcgugcugccccagaacagaagcagccccugcauccacuacuucaccggcacccccgaccccagcagaagcaucuucaagcccuucaucuucguggacgacgugaagcuggugcccaagacccagagccccugcuucggcgacgacgaccccgccaagaaggagcccagauuccaggagaagcccgacagaagacacgagcuguacaaggcccacgagugggccagagccaucaucgagagcgaccaggagcagggcagaaagcugagaagcaccaugcuggagcuggagaagcagggccuggaggccauggaggagauccugaccagcagcgagccccuggaccccgccgaggugggcgaccuguucuacgacugcguggacaccgagaucaaguucuucaaguaa

SEQ ID NO: 23075 - RNA, 366 nt, Artificial Sequence
  SCT__Homo_sapiens__XP_011518583
auggcccccagaccccugcugcugcugcugcugcugcugggcggcagcgccgccagacccgccccccccagagccagaagacacagcgacggcaccuucaccagcgagcugagcagacugagagagggcgccagacugcagagacugcugcagggccuggugggcaagagaagcgagcaggacgccgagaacagcauggccuggaccagacugagcgccggccugcugugccccagcggcagcaacaugcccauccugcaggccuggaugccccuggacggcaccuggagccccuggcugccccccggccccauggugagcgagcccgccggcgccgccgccgagggcacccugagacccagauaa

SEQ ID NO: 23076 - RNA, 1323 nt, Artificial Sequence
  SCTR__Homo_sapiens__NP_002971
augagaccccaccugagccccccccugcagcagcugcugcugcccgugcugcuggccugcgccgcccacagcaccggcgcccugcccagacugugcgacgugcugcaggugcugugggaggagcaggaccagugccugcaggagcugagcagagagcagaccggcgaccugggcaccgagcagcccgugcccggcugcgagggcaugugggacaacaucagcugcuggcccagcagcgugcccggcagaaugguggagguggagugccccagauuccugagaaugcugaccagcagaaacggcagccuguucagaaacugcacccaggacggcuggagcgagaccuuccccagacccaaccuggccugcggcgugaacgugaacgacagcagcaacgagaagagacacagcuaccugcugaagcugaaggugauguacaccgugggcuacagcagcagccuggugaugcugcugguggcccugggcauccugugcgccuucagaagacugcacugcaccagaaacuacauccacaugcaccuguucgugagcuucauccugagagcccugagcaacuucaucaaggacgccgugcuguucagcagcgacgacgugaccuacugcgacgcccacagagccggcugcaagcuggugauggugcuguuccaguacugcaucauggccaacuacagcuggcugcugguggagggccuguaccugcacacccugcuggccaucagcuucuucagcgagagaaaguaccugcagggcuucguggccuucggcuggggcagccccgccaucuucguggcccugugggccaucgccagacacuuccuggaggacgugggcugcugggacaucaacgccaacgccagcaucugguggaucaucagaggccccgugauccugagcauccugaucaacuucauccuguucaucaacauccugagaauccugaugagaaagcugagaacccaggagaccagaggcaacgaggugagccacuacaagagacuggccagaagcacccugcugcugaucccccuguucggcauccacuacaucguguucgccuucagccccgaggacgccauggagauccagcuguucuucgagcuggcccugggcagcuuccagggccuggugguggccgugcuguacugcuuccugaacggcgaggugcagcuggaggugcagaagaaguggcagcaguggcaccugagagaguucccccugcaccccguggccagcuucagcaacagcaccaaggccagccaccuggagcagagccagggcaccugcagaaccagcaucaucuaa

SEQ ID NO: 23077 - RNA, 2967 nt, Artificial Sequence
  SCUBE1__Homo_sapiens__NP_766638
augggcgccgccgccgugagauggcaccugugcgugcugcuggcccugggcaccagaggcagacuggccggcggcagcggccugcccggcagcguggacguggacgagugcagcgagggcaccgacgacugccacaucgacgccaucugccagaacacccccaagagcuacaagugccugugcaagcccggcuacaagggcgagggcaagcagugcgaggacaucgacgagugcgagaacgacuacuacaacggcggcugcgugcacgagugcaucaacauccccggcaacuacagaugcaccugcuucgacggcuucaugcuggcccacgacggccacaacugccuggacguggacgagugccaggacaacaacggcggcugccagcagaucugcgugaacgccaugggcagcuacgagugccagugccacagcggcuucuuccugagcgacaaccagcacaccugcauccacagaagcaacgagggcaugaacugcaugaacaaggaccacggcugcgcccacaucugcagagagacccccaagggcggcguggccugcgacugcagacccggcuucgaccuggcccagaaccagaaggacugcacccugaccugcaacuacggcaacggcggcugccagcacagcugcgaggacaccgacaccggccccaccugcggcugccaccagaaguacgcccugcacagcgacggcagaaccugcaucgagaccugcgccgugaacaacggcggcugcgacagaaccugcaaggacaccgccaccggcgugagaugcagcugccccgugggcuucacccugcagcccgacggcaagaccugcaaggacaucaacgagugccuggugaacaacggcggcugcgaccacuucugcagaaacaccgugggcagcuucgagugcggcugcagaaagggcuacaagcugcugaccgacgagagaaccugccaggacaucgacgagugcagcuucgagagaaccugcgaccacaucugcaucaacagccccggcagcuuccagugccugugccacagaggcuacauccuguacggcaccacccacugcggcgacguggacgagugcagcaugagcaacggcagcugcgaccagggcugcgugaacaccaagggcagcuacgagugcgugugcccccccggcagaagacugcacuggaacggcaaggacugcguggagaccggcaagugccugagcagagccaagaccagccccagagcccagcugagcugcagcaaggccggcggcguggagagcugcuuccugagcugccccgcccacacccuguucgugcccgacagcgagaacagcuacgugcugagcugcggcgugcccggcccccagggcaaggcccugcagaagagaaacggcaccagcagcggccugggccccagcugcagcgacgcccccaccacccccaucaagcagaaggccagauucaagaucagagacgccaagugccaccugagaccccacagccaggccagagccaaggagaccgccagacagccccugcuggaccacugccacgugaccuucgugacccugaagugcgacagcagcaagaagagaagaagaggcagaaagagccccagcaaggaggugagccacaucaccgccgaguucgagaucgagaccaagauggaggaggccagcgacaccugcgaggccgacugccugagaaagagagccgagcagagccugcaggccgccaucaagacccugagaaagagcaucggcagacagcaguucuacgugcaggugagcggcaccgaguacgagguggcccagagacccgccaaggcccuggagggccagggcgccugcggcgccggccaggugcugcaggacagcaagugcguggccugcggccccggcacccacuucggcggcgagcugggccagugcgugagcugcaugcccggcaccuaccaggacauggagggccagcugagcugcacccccugccccagcagcgacggccugggccugcccggcgccagaaacgugagcgagugcggcggccagugcagccccggcuucuucagcgccgacggcuucaagcccugccaggccugccccgugggcaccuaccagcccgagcccggcagaaccggcugcuuccccugcggcggcggccugcugaccaagcacgagggcaccaccagcuuccaggacugcgaggccaaggugcacugcagccccggccaccacuacaacaccaccacccacagaugcaucagaugccccgugggcaccuaccagcccgaguucggccagaaccacugcaucaccugccccggcaacaccagcaccgacuucgacggcagcaccaacgugacccacugcaagaaccagcacugcggcggcgagcugggcgacuacaccggcuacaucgagagccccaacuaccccggcgacuaccccgccaacgccgagugcguguggcacaucgcccccccccccaagagaagaauccugaucguggugcccgagaucuuccugcccaucgaggacgagugcggcgacgugcuggugaugagaaagagcgccagccccaccagcaucaccaccuacgagaccugccagaccuacgagagacccaucgccuucaccagcagaagcagaaagcuguggauccaguucaagagcaacgagggcaacagcggcaagggcuuccaggugcccuacgugaccuacgacgaggacuaccagcagcugaucgaggacaucgugagagacggcagacuguacgccagcgagaaccaccaggagauccugaaggacaagaagcugaucaaggcccuguucgacgugcuggcccacccccagaacuacuucaaguacaccgcccaggagagcaaggagauguuccccagaagcuucaucaagcugcugagaagcaaggugagcagauuccugagacccuacaaguaa

SEQ ID NO: 23078 - RNA, 2424 nt, Artificial Sequence
  SCUBE2__Homo_sapiens__NP_001164161
augggcguggccggcagaaacagacccggcgccgccugggccgugcugcugcugcugcugcugcugcccccccugcugcugcuggccggcgccgugccccccggcagaggcagagccgccggcccccaggaggacguggacgagugcgcccagggccuggacgacugccacgccgacgcccugugccagaacacccccaccagcuacaagugcagcugcaagcccggcuaccagggcgagggcagacagugcgaggacaucgacgagugcggcaacgagcugaacggcggcugcgugcacgacugccugaacauccccggcaacuacagaugcaccugcuucgacggcuucaugcuggcccacgacggccacaacugccuggacguggacgagugccuggagaacaacggcggcugccagcacaccugcgugaacgugaugggcagcuacgagugcugcugcaaggagggcuucuuccugagcgacaaccagcacaccugcauccacagaagcgaggagggccugagcugcaugaacaaggaccacggcugcagccacaucugcaaggaggcccccagaggcagcguggccugcgagugcagacccggcuucgagcuggccaagaaccagagagacugcauccugaccugcaaccacggcaacggcggcugccagcacagcugcgacgacaccgccgacggccccgagugcagcugccacccccaguacaagaugcacaccgacggcagaagcugccuggagagagaggacaccgugcuggaggugaccgagagcaacaccaccagcgugguggacggcgacaagagagugaagagaagacugcugauggagaccugcgccgugaacaacggcggcugcgacagaaccugcaaggacaccagcaccggcgugcacugcagcugccccgugggcuucacccugcagcuggacggcaagaccugcaaggacaucgacgagugccagaccagaaacggcggcugcgaccacuucugcaagaacaucgugggcagcuucgacugcggcugcaagaagggcuucaagcugcugaccgacgagaagagcugccaggacguggacgagugcagccuggacagaaccugcgaccacagcugcaucaaccaccccggcaccuucgccugcgccugcaacagaggcuacacccuguacggcuucacccacugcggcgacaccaacgagugcagcaucaacaacggcggcugccagcaggugugcgugaacaccgugggcagcuacgagugccagugccaccccggcuacaagcugcacuggaacaagaaggacugcguggccagcugcgaccugagcugcaucgugaagagaaccgagaagagacugagaaaggccaucagaacccugagaaaggccgugcacagagagcaguuccaccugcagcugagcggcaugaaccuggacguggccaagaagccccccagaaccagcgagagacaggccgagagcugcggcgugggccagggccacgccgagaaccagugcgugagcugcagagccggcaccuacuacgacggcgccagagagagaugcauccugugccccaacggcaccuuccagaacgaggagggccagaugaccugcgagcccugccccagacccggcaacagcggcgcccugaagacccccgaggccuggaacaugagcgagugcggcggccugugccagcccggcgaguacagcgccgacggcuucgcccccugccagcugugcgcccugggcaccuuccagcccgaggccggcagaaccagcugcuuccccugcggcggcggccuggccaccaagcaccagggcgccaccagcuuccaggacugcgagaccagagugcagugcagccccggccacuucuacaacaccaccacccacagaugcaucagaugccccgugggcaccuaccagcccgaguucggcaagaacaacugcgugagcugccccggcaacaccaccaccgacuucgacggcagcaccaacaucacccagugcaagaccagcagcaacagcgugaccaccuacgagaccugccagaccuacgagagacccaucgccuucaccagcagaagcaagaagcuguggauccaguucaagagcaacgagggcaacagcgccagaggcuuccaggugcccuacgugaccuacgacgaggacuaccaggagcugaucgaggacaucgugagagacggcagacuguacgccagcgagaaccaccaggagauccugaaggacaagaagcugaucaaggcccuguucgacgugcuggcccacccccagaacuacuucaaguacaccgcccaggagagcagagagauguuccccagaagcuucaucagacugcugagaagcaaggugagcagauuccugagacccuacaaguaa

SEQ ID NO: 23079 - RNA, 2982 nt, Artificial Sequence
  SCUBE3__Homo_sapiens__NP_689966
augggcagcggcagagugcccggccugugccugcuggugcugcuggugcacgccagagccgcccaguacagcaaggccgcccaggacguggacgagugcguggagggcaccgacaacugccacaucgacgccaucugccagaacacccccagaagcuacaagugcaucugcaagagcggcuacaccggcgacggcaagcacugcaaggacguggacgagugcgagagagaggacaacgccggcugcgugcacgacugcgugaacauccccggcaacuacagaugcaccugcuacgacggcuuccaccuggcccacgacggccacaacugccuggacguggacgagugcgccgagggcaacggcggcugccagcagagcugcgugaacaugaugggcagcuacgagugccacugcagagagggcuucuuccugagcgacaaccagcacaccugcauccagagacccgaggagggcaugaacugcaugaacaagaaccacggcugcgcccacaucugcagagagacccccaagggcggcaucgccugcgagugcagacccggcuucgagcugaccaagaaccagagagacugcaagcugaccugcaacuacggcaacggcggcugccagcacaccugcgacgacaccgagcagggccccagaugcggcugccacaucaaguucgugcugcacaccgacggcaagaccugcaucgagaccugcgccgugaacaacggcggcugcgacagcaagugccacgacgccgccaccggcgugcacugcaccugccccgugggcuucaugcugcagcccgacagaaagaccugcaaggacaucgacgagugcagacugaacaacggcggcugcgaccacaucugcagaaacaccgugggcagcuucgagugcagcugcaagaagggcuacaagcugcugaucaacgagagaaacugccaggacaucgacgagugcagcuucgacagaaccugcgaccacaucugcgugaacacccccggcagcuuccagugccugugccacagaggcuaccugcuguacggcaucacccacugcggcgacguggacgagugcagcaucaacagaggcggcugcagauucggcugcaucaacacccccggcagcuaccagugcaccugccccgccggccagggcagacugcacuggaacggcaaggacugcaccgagccccugaagugccagggcagccccggcgccagcaaggccaugcugagcugcaacagaagcggcaagaaggacaccugcgcccugaccugccccagcagagccagauuccugcccgagagcgagaacggcuucaccgugagcugcggcacccccagccccagagccgcccccgccagagccggccacaacggcaacagcaccaacagcaaccacugccacgaggccgccgugcugagcaucaagcagagagccagcuucaagaucaaggacgccaagugcagacugcaccugagaaacaagggcaagaccgaggaggccggcagaaucaccggccccggcggcgcccccugcagcgagugccaggugaccuucauccaccugaagugcgacagcagcagaaagggcaagggcagaagagccagaaccccccccggcaaggaggugaccagacugacccuggagcuggaggccgaggugagagccgaggagaccaccgccagcugcggccugcccugccugagacagagaauggagagaagacugaagggcagccugaagaugcugagaaagagcaucaaccaggacagauuccugcugagacuggccggccuggacuacgagcuggcccacaagcccggccugguggccggcgagagagccgagcccauggagagcugcagacccggccagcacagagccggcaccaagugcgugagcugcccccagggcaccuacuaccacggccagaccgagcagugcgugcccugccccgccggcaccuuccaggagagagagggccagcugagcugcgaccugugccccggcagcgacgcccacggcccccugggcgccaccaacgugaccaccugcgccggccagugcccccccggccagcacagcguggacggcuucaagcccugccagcccugccccagaggcaccuaccagcccgaggccggcagaacccugugcuuccccugcggcggcggccugaccaccaagcacgagggcgccaucagcuuccaggacugcgacaccaaggugcagugcagccccggccacuacuacaacaccagcauccacagaugcaucagaugcgccaugggcagcuaccagcccgacuucagacagaacuucugcagcagaugccccggcaacaccagcaccgacuucgacggcagcaccagcguggcccagugcaagaacagacagugcggcggcgagcugggcgaguucaccggcuacaucgagagccccaacuaccccggcaacuaccccgccggcguggagugcaucuggaacaucaaccccccccccaagagaaagauccugaucguggugcccgagaucuuccugcccagcgaggacgagugcggcgacgugcuggugaugagaaagaacagcagccccagcagcaucaccaccuacgagaccugccagaccuacgagagacccaucgccuucaccgccagaagcagaaagcuguggaucaacuucaagaccagcgaggccaacagcgccagaggcuuccagauccccuacgugaccuacgacgaggacuacgagcagcugguggaggacaucgugagagacggcagacuguacgccagcgagaaccaccaggagauccugaaggacaagaagcugaucaaggccuucuucgaggugcuggcccacccccagaacuacuucaaguacaccgagaagcacaaggagaugcugcccaagagcuucaucaagcugcugagaagcaaggugagcagcuuccugagacccuacaaguaa

SEQ ID NO: 23080 - RNA, 2376 nt, Artificial Sequence
  SCYL1__Homo_sapiens__NP_001041683
augugguucuucgccagagaccccgugagagacuuccccuucgagcugauccccgagccccccgagggcggccugcccggccccugggcccugcacagaggcagaaagaaggccaccggcagccccgugagcaucuucguguacgacgugaagcccggcgccgaggagcagacccagguggccaaggccgccuucaagagauucaagacccugagacaccccaacauccuggccuacaucgacggccuggagaccgagaagugccugcacguggugaccgaggccgugaccccccugggcaucuaccugaaggccagaguggaggccggcggccugaaggagcuggagaucagcuggggccugcaccagaucgugaaggcccugagcuuccuggugaacgacugcagccugauccacaacaacgugugcauggccgccguguucguggacagagccggcgaguggaagcugggcggccuggacuacauguacagcgcccagggcaacggcggcggcccccccagaaagggcauccccgagcuggagcaguacgacccccccgagcuggccgacagcagcggcagaguggugagagagaaguggagcgccgacauguggagacugggcugccugaucugggagguguucaacggcccccugcccagagccgccgcccugagaaaccccggcaagauccccaagacccuggugccccacuacugcgagcuggugggcgccaaccccaaggugagacccaaccccgccagauuccugcagaacugcagagcccccggcggcuucaugagcaacagauucguggagaccaaccuguuccuggaggagauccagaucaaggagcccgccgagaagcagaaguucuuccaggagcugagcaagagccuggacgccuuccccgaggacuucugcagacacaaggugcugccccagcugcugaccgccuucgaguucggcaacgccggcgccguggugcugaccccccuguucaaggugggcaaguuccugagcgccgaggaguaccagcagaagaucauccccgugguggugaagauguucagcagcaccgacagagccaugagaaucagacugcugcagcagauggagcaguucauccaguaccuggacgagcccaccgugaacacccagaucuucccccacguggugcacggcuuccuggacaccaaccccgccaucagagagcagaccgugaagagcaugcugcugcuggcccccaagcugaacgaggccaaccugaacguggagcugaugaagcacuucgccagacugcaggccaaggacgagcagggccccaucagaugcaacaccaccgugugccugggcaagaucggcagcuaccugagcgccagcaccagacacagagugcugaccagcgccuucagcagagccaccagagaccccuucgcccccagcagaguggccggcgugcugggcuucgccgccacccacaaccuguacagcaugaacgacugcgcccagaagauccugcccgugcugugcggccugaccguggaccccgagaagagcgugagagaccaggccuucaaggccaucagaagcuuccugagcaagcuggagagcgugagcgaggaccccacccagcuggaggagguggagaaggacgugcacgccgccagcagccccggcaugggcggcgccgccgccagcugggccggcugggccgugaccggcgugagcagccugaccagcaagcugaucagaagccaccccaccaccgcccccaccgagaccaacaucccccagagacccacccccgagggccacugggagacccaggaggaggacaaggacaccgccgaggacagcagcaccgccgacagaugggacgacgaggacuggggcagccuggagcaggaggccgagagcgugcuggcccagcaggacgacuggagcaccggcggccaggugagcagagccagccaggugagcaacagcgaccacaagagcagcaagagccccgagagcgacuggagcagcugggaggccgagggcagcugggagcagggcuggcaggagcccagcagccaggagcccccccccgacggcaccagacuggccagcgaguacaacuggggcggccccgagagcagcgacaagggcgaccccuucgccacccugagcgccagacccagcacccagcccagacccgacagcuggggcgaggacaacugggagggccuggagaccgacagcagacaggugaaggccgagcuggccagaaagaagagagaggagagaagaagagagauggaggccaagagagccgagagaaagguggccaagggccccaugaagcugggcgccagaaagcuggacuaa

SEQ ID NO: 23081 - RNA, 2067 nt, Artificial Sequence
  SCYL3__Homo_sapiens__NP_065156
augggcagcgagaacagcgcccugaagagcuacacccugagagagccccccuucacccugcccagcggccuggccguguaccccgccgugcugcaggacggcaaguucgccagcguguucguguacaagagagagaacgaggacaaggugaacaaggccgccaagcaccugaagacccugagacaccccugccugcugagauuccugagcugcaccguggaggccgacggcauccaccuggugaccgagagagugcagccccuggagguggcccuggagacccugagcagcgccgaggugugcgccggcaucuacgacauccugcuggcccugaucuuccugcacgacagaggccaccugacccacaacaacgugugccugagcagcguguucgugagcgaggacggccacuggaagcugggcggcauggagaccgugugcaaggugagccaggccacccccgaguuccugagaagcauccagagcaucagagaccccgccagcaucccccccgaggagaugagccccgaguucaccacccugcccgagugccacggccacgccagagacgccuucagcuucggcacccugguggagagccugcugaccauccugaacgagcaggugagcgccgacgugcugagcagcuuccagcagacccugcacagcacccugcugaaccccauccccaagugcagacccgcccugugcacccugcugagccacgacuucuucagaaacgacuuccuggagguggugaacuuccugaagagccugacccugaagagcgaggaggagaagaccgaguucuucaaguuccugcuggacagagugagcugccugagcgaggagcugaucgccagcagacuggugccccugcugcugaaccagcugguguucgccgagcccguggccgugaagagcuuccugcccuaccugcugggccccaagaaggaccacgcccagggcgagacccccugccugcugagccccgcccuguuccagagcagagugauccccgugcugcugcagcuguucgaggugcacgaggagcacgugagaauggugcugcugagccacaucgaggccuacguggagcacuucacccaggagcagcugaagaaggugauccugccccaggugcugcugggccugagagacaccagcgacagcaucguggccaucacccugcacagccuggccgugcuggugagccugcugggccccgaggugguggugggcggcgagagaaccaagaucuucaagagaaccgcccccagcuucaccaagaacaccgaccugagccuggagggcgaccccuucagccagcccaucaaguuccccaucaacggccugagcgacgugaagaacaccagcgaggacagcgagaacuuccccagcagcagcaagaagagcgaggaguggcccgacuggagcgagcccgaggagcccgagaaccagaccgugaacauccagaucuggcccagagagcccugcgacgacgugaagagccagugcaccacccuggacguggaggagagcagcugggacgacugcgagcccagcagccuggacaccaaggugaaccccggcggcggcaucaccgccaccaagcccgugaccagcggcgagcagaagcccauccccgcccugcugagccugaccgaggagagcaugcccuggaagagcagccugccccagaagaucagccuggugcagagaggcgacgacgccgaccagaucgagccccccaaggugagcagccaggagagaccccugaaggugcccagcgagcugggccugggcgaggaguucaccauccaggugaagaagaagcccgugaaggaccccgagauggacugguucgccgacaugauccccgagaucaagcccagcgccgccuuccugauccugcccgagcugagaaccgagauggugcccaagaaggacgacgugagccccgugaugcaguucagcagcaaguucgccgccgccgagaucaccgagggcgaggccgagggcugggaggaggagggcgagcugaacugggaggacaacaacugguaa

SEQ ID NO: 23082 - RNA, 933 nt, Artificial Sequence
  SDC1__Homo_sapiens__NP_001006947
augagaagagccgcccuguggcuguggcugugcgcccuggcccugagccugcagcccgcccugccccagaucguggccaccaaccugccccccgaggaccaggacggcagcggcgacgacagcgacaacuucagcggcagcggcgccggcgcccugcaggacaucacccugagccagcagacccccagcaccuggaaggacacccagcugcugaccgccauccccaccagccccgagcccaccggccuggaggccaccgccgccagcaccagcacccugcccgccggcgagggccccaaggagggcgaggccguggugcugcccgagguggagcccggccugaccgccagagagcaggaggccacccccagacccagagagaccacccagcugcccaccacccaccaggccagcaccaccaccgccaccaccgcccaggagcccgccaccagccacccccacagagacaugcagcccggccaccacgagaccagcacccccgccggccccagccaggccgaccugcacaccccccacaccgaggacggcggccccagcgccaccgagagagccgccgaggacggcgccagcagccagcugcccgccgccgagggcagcggcgagcaggacuucaccuucgagaccagcggcgagaacaccgccgugguggccguggagcccgacagaagaaaccagagccccguggaccagggcgccaccggcgccagccagggccugcuggacagaaaggaggugcugggcggcgugaucgccggcggccuggugggccugaucuucgccgugugccuggugggcuucaugcuguacagaaugaagaagaaggacgagggcagcuacagccuggaggagcccaagcaggccaacggcggcgccuaccagaagcccaccaagcaggaggaguucuacgccuaa

SEQ ID NO: 23083 - RNA, 606 nt, Artificial Sequence
  SDC2__Homo_sapiens__NP_002989
augagaagagccuggauccugcugacccugggccugguggccugcgugagcgccgagagcagagccgagcugaccagcgacaaggacauguaccuggacaacagcagcaucgaggaggccagcggcguguaccccaucgacgacgacgacuacgccagcgccagcggcagcggcgccgacgaggacguggagagccccgagcugaccaccagcagaccccugcccaagauccugcugaccagcgccgcccccaagguggagaccaccacccugaacauccagaacaagauccccgcccagaccaagagccccgaggagaccgacaaggagaaggugcaccugagcgacagcgagagaaagauggaccccgccgaggaggacaccaacguguacaccgagaagcacagcgacagccuguucaagagaaccgaggugcuggccgccgugaucgccggcggcgugaucggcuuccuguucgccaucuuccugauccugcugcugguguacagaaugagaaagaaggacgagggcagcuacgaccugggcgagagaaagcccagcagcgccgccuaccagaaggcccccaccaaggaguucuacgccuaa

SEQ ID NO: 23084 - RNA, 1332 nt, Artificial Sequence
  SDC3__Homo_sapiens__XP_011540764
augcccacccagaugcuguucccccugcacggccuguuccuguacagcagcgugaacagcuacaccagcagcaagacccagcacagaugccugcugcugugggagagcaacaacgaccccagcuaccagccccccagcaccgcccagagauggagaagcgagaacuucgagagacccguggaccuggagggcagcggcgacgacgacagcuuccccgacgacgagcuggacgaccuguacagcggcagcggcagcggcuacuucgagcaggagagcggcaucgagaccgccaugagauucagccccgacguggcccuggccgugagcaccacccccgccgugcugcccaccaccaacauccagcccgugggcacccccuucgaggagcugcccagcgagagacccacccuggagcccgccaccagcccccugguggugaccgaggugcccgaggagcccagccagagagccaccaccgugagcaccaccauggccaccaccgccgccaccagcaccggcgaccccaccguggccaccgugcccgccaccguggccaccgccacccccagcacccccgccgccccccccuucaccgccaccaccgccgugaucagaaccaccggcgugagaagacugcugccccugccccugaccaccguggccaccgccagagccaccacccccgaggcccccagcccccccaccaccgccgccgugcuggacaccgaggcccccacccccagacuggugagcaccgccaccagcagacccagagcccugcccagacccgccaccacccaggagcccgacauccccgagagaagcacccugccccugggcaccaccgcccccggccccaccgagguggcccagacccccacccccgagaccuuccugaccaccaucagagacgagcccgaggugcccgugagcggcggccccagcggcgacuucgagcugcccgaggaggagaccacccagcccgacaccgccaacgaggugguggccgugggcggcgccgccgccaaggccagcagcccccccggcacccugcccaagggcgccagacccggccccggccugcuggacaacgccaucgacagcggcagcagcgccgcccagcugccccagaagagcauccuggagagaaaggaggugcugguggccgugaucgugggcggcguggugggcgcccuguucgccgccuuccuggugacccugcugaucuacagaaugaagaagaaggacgagggcagcuacacccuggaggagcccaagcaggccagcgugaccuaccagaagcccgacaagcaggaggaguucuacgccuaa

SEQ ID NO: 23085 - RNA, 597 nt, Artificial Sequence
  SDC4__Homo_sapiens__NP_002990
auggcccccgccagacuguucgcccugcugcuguucuucgugggcggcguggccgagagcaucagagagaccgaggugaucgacccccaggaccugcuggagggcagauacuucagcggcgcccugcccgacgacgaggacguggugggccccggccaggagagcgacgacuucgagcugagcggcagcggcgaccuggacgaccuggaggacagcaugaucggccccgagguggugcacccccuggugccccuggacaaccacauccccgagagagccggcagcggcagccaggugcccaccgagcccaagaagcuggaggagaacgaggugauccccaagagaaucagccccguggaggagagcgaggacgugagcaacaaggugagcaugagcagcaccgugcagggcagcaacaucuucgagagaaccgaggugcuggccgcccugaucgugggcggcaucgugggcauccuguucgccguguuccugauccugcugcugauguacagaaugaagaagaaggacgagggcagcuacgaccugggcaagaagcccaucuacaagaaggcccccaccaacgaguucuacgccuaa

SEQ ID NO: 23086 - RNA, 879 nt, Artificial Sequence
  SDCBP2__Homo_sapiens__NP_001186713
augagcagccuguaccccagccuggaggaccugaagguggaccaggccauccaggcccaggugagagccagccccaagaugcccgcccugcccgugcaggccaccgccaucagccccccccccgugcuguaccccaaccuggccgagcuggagaacuacaugggccugagccugagcagccaggaggugcaggagagccugcugcagauccccgagggcgacagcaccgccgugagcggccccggccccggccagaugguggcccccgugaccggcuacagccugggcgugagaagagccgagaucaagcccggcgugagagagauccaccugugcaaggacgagagaggcaagaccggccugagacugagaaagguggaccagggccuguucgugcagcuggugcaggccaacacccccgccagccuggugggccugagauucggcgaccagcugcugcagaucgacggcagagacugcgccggcuggagcagccacaaggcccaccagguggugaagaaggccagcggcgacaagaucguggugguggugagagacagacccuuccagagaaccgugaccaugcacaaggacagcaugggccacgugggcuucgugaucaagaagggcaagaucgugagccuggugaagggcagcagcgccgccagaaacggccugcugaccaaccacuacgugugcgagguggacggccagaacgugaucggccugaaggacaagaagaucauggagauccuggccaccgccggcaacguggugacccugaccaucauccccagcgugaucuacgagcacauggugaagaagcugccccccgugcugcugcaccacaccauggaccacagcauccccgacgccuaa

SEQ ID NO: 23087 - RNA, 879 nt, Artificial Sequence
  SDCBP__Homo_sapiens__NP_001007069
augagccuguaccccagccuggaggaccugaaggcccagaccgccuucagcgccaaccccgccaaccccgccauccugagcgaggccagcgcccccaucccccacgacggcaaccuguaccccagacuguaccccgagcugagccaguacaugggccugagccugaacgaggaggagaucagagccaacguggccguggugagcggcgccccccugcagggccagcugguggccagacccagcagcaucaacuacaugguggcccccgugaccggcaacgacgugggcaucagaagagccgagaucaagcagggcaucagagaggugauccugugcaaggaccaggacggcaagaucggccugagacugaagagcaucgacaacggcaucuucgugcagcuggugcaggccaacagccccgccagccuggugggccugagauucggcgaccaggugcugcagaucaacggcgagaacugcgccggcuggagcagcgacaaggcccacaaggugcugaagcaggccuucggcgagaagaucaccaugaccaucagagacagacccuucgagagaaccaucaccaugcacaaggacagcaccggccacgugggcuucaucuucaagaacggcaagaucaccagcaucgugaaggacagcagcgccgccagaaacggccugcugaccgagcacaacaucugcgagaucaacggccagaacgugaucggccugaaggacagccagaucgccgacauccugagcaccagcggcaccguggugaccaucaccaucaugcccgccuucaucuucgagcacaucaucaagagaauggcccccagcaucaugaagagccugauggaccacaccauccccgagguguaa

SEQ ID NO: 23088 - RNA, 1308 nt, Artificial Sequence
  SDCCAG3__Homo_sapiens__NP_001034796
augagcggcuaccagagaagacccggcgccaccccccugagcagagccagaagccuggccauccccgacgcccccgccuucuacgagagaagaagcugccugccccagcugaacugcgagagaccccacggcagagaccuggacagccccuucuucggcaucagacccgccuucaugugcuacgugcccagccccgugcuggccagcgugggcgacaccgacuucggcuacggcaagggcaagugcagcaagcagagccccagcggcgcccacggcacccacuucggcgacgacagauucgaggaccuggaggaggccaaccccuucagcuucagagaguuccugaagaccaagaaccugggccugagcaaggaggaccccgccagcagaaucuacgccaaggaggccagcagacacagccugggccuggaccacaacagcccccccagccagaccggcggcuacggccuggaguaccagcagcccuucuucgaggaccccaccggcgccggcgaccugcuggacgaggaggaggacgaggacaccggcuggagcggcgccuaccugcccagcgccaucgagcagacccaccccgagagagugcccgccggcaccagccccugcagcaccuaccugagcuucuucagcacccccagcgagcuggccggccccgagagccugcccagcugggcccugagcgacaccgacagcagagugagccccgccagccccgccggcagccccagcgccgacuucgccgugcacggcgagagccugggcgacagacaccugagaacccugcagaucagcuacgacgcccugaaggacgagaacagcaagcugagaagaaagcugaacgaggugcagagcuucagcgaggcccagaccgagauggugagaacccuggagagaaagcuggaggccaagaugaucaaggaggagagcgacuaccacgaccuggagagcguggugcagcagguggagcagaaccuggagcugaugaccaagagagccgugaaggccgagaaccacguggugaagcugaagcaggagaucagccugcugcaggcccaggugagcaacuuccagagagagaacgaggcccugagaugcggccagggcgccagccugaccguggugaagcagaacgccgacguggcccugcagaaccugagaguggugaugaacagcgcccaggccagcaucaagcagcuggugagcggcgccgagacccugaaccugguggccgagauccugaagagcaucgacagaaucagcgaggugaaggacgaggaggaggacagcuaa

SEQ ID NO: 23089 - RNA, 2142 nt, Artificial Sequence
  SDCCAG8__Homo_sapiens__NP_006633
auggccaagagccccgagaacagcacccuggaggagauccugggccaguaccagagaagccugagagagcacgccagcagaagcauccaccagcugaccugcgcccugaaggagggcgacgugaccaucggcgaggacgcccccaaccugagcuucagcaccagcgugggcaacgaggacgccagaaccgccuggcccgagcugcagcagagccacgccgugaaccagcugaaggaccugcugagacagcaggccgacaaggagagcgaggugagccccagcagaagaagaaagaugagcccccugagaagccuggagcacgaggagaccaacaugcccaccaugcacgaccuggugcacaccaucaacgaccagagccaguacauccaccaccuggaggccgaggugaaguucugcaaggaggagcugagcggcaugaagaacaagauccaggugguggugcuggagaacgagggccugcagcagcagcugaagagccagagacaggaggagacccugagagagcagacccugcuggacgccagcggcaacaugcacaacagcuggaucaccaccggcgaggacagcggcgugggcgagaccagcaagagacccuucagccacgacaacgccgacuucggcaaggccgccagcgccggcgagcagcuggagcuggagaagcugaagcugaccuacgaggagaagugcgagaucgaggagagccagcugaaguuccugagaaacgaccuggccgaguaccagagaaccugcgaggaccugaaggagcagcugaagcacaaggaguuccugcuggccgccaacaccugcaacagagugggcggccugugccugaagugcgcccagcacgaggccgugcugagccagacccacaccaacgugcacaugcagaccaucgagagacuggugaaggagagagacgaccugaugagcgcccuggugagcgugagaagcagccuggccgacacccagcagagagaggccagcgccuacgagcaggugaagcaggugcugcagaucagcgaggaggccaacuucgagaagaccaaggcccugauccagugcgaccagcugagaaaggagcuggagagacaggccgagagacuggagaaggagcuggccagccagcaggagaagagagccaucgagaaggacaugaugaagaaggagaucaccaaggagagagaguacaugggcagcaagaugcugauccugagccagaacaucgcccagcuggaggcccagguggagaaggugaccaaggagaagaucagcgccaucaaccagcuggaggagauccagagccagcuggccagcagagagauggacgugaccaaggugugcggcgagaugagauaccagcugaacaagaccaacauggagaaggacgaggccgagaaggagcacagagaguucagagccaagaccaacagagaccuggagaucaaggaccaggagaucgagaagcugagaaucgagcuggacgagagcaagcagcaccuggagcaggagcagcagaaggccgcccuggccagagaggagugccugagacugaccgagcugcugggcgagagcgagcaccagcugcaccugaccagacaggagaaggacagcauccagcagagcuucagcaaggaggccaaggcccaggcccugcaggcccagcagagagagcaggagcugacccagaagauccagcagauggaggcccagcacgacaagaccgagaacgagcaguaccugcugcugaccagccagaacaccuuccugaccaagcugaaggaggagugcugcacccuggccaagaagcuggagcagaucagccagaagaccagaagcgagaucgcccagcugagccaggagaagagauacaccuacgacaagcugggcaagcugcagagaagaaacgaggagcuggaggagcagugcgugcagcacggcagagugcacgagaccaugaagcagagacugagacagcuggacaagcacagccaggccaccgcccagcagcuggugcagcugcugagcaagcagaaccagcugcugcuggagagacagagccugagcgaggagguggacagacugagaacccagcugcccagcaugccccagagcgacugcuaa

SEQ ID NO: 23090 - RNA, 636 nt, Artificial Sequence
  SDF2__Homo_sapiens__NP_008854
auggccguggugccccugcugcugcugggcggccuguggagcgccgugggcgccagcagccugggcguggugaccugcggcagcguggugaagcugcugaacaccagacacaacgugagacugcacagccacgacgugagauacggcagcggcagcggccagcagagcgugaccggcgugaccagcguggacgacagcaacagcuacuggagaaucagaggcaagagcgccaccgugugcgagagaggcacccccaucaagugcggccagcccaucagacugacccacgugaacaccggcagaaaccugcacagccaccacuucaccagcccccugagcggcaaccaggaggugagcgccuucggcgaggagggcgagggcgacuaccuggacgacuggaccgugcugugcaacggccccuacugggugagagacggcgaggugagauucaagcacagcagcaccgaggugcugcugagcgugaccggcgagcaguacggcagacccaucagcggccagaaggaggugcacggcauggcccagcccagccagaacaacuacuggaaggccauggagggcaucuucaugaagcccagcgagcugcugaaggccgaggcccaccacgccgagcuguaa

SEQ ID NO: 23091 - RNA, 666 nt, Artificial Sequence
  SDF2L1__Homo_sapiens__NP_071327
auguggagcgccggcagaggcggcgccgccuggcccgugcugcugggccugcugcuggcccugcuggugcccggcggcggcgccgccaagaccggcgccgagcuggugaccugcggcagcgugcugaagcugcugaacacccaccacagagugagacugcacagccacgacaucaaguacggcagcggcagcggccagcagagcgugaccggcguggaggccagcgacgacgccaacagcuacuggagaaucagaggcggcagcgagggcggcugccccagaggcagccccgugagaugcggccaggccgugagacugacccacgugcugaccggcaagaaccugcacacccaccacuuccccagcccccugagcaacaaccaggaggugagcgccuucggcgaggacggcgagggcgacgaccuggaccuguggaccgugagaugcagcggccagcacugggagagagaggccgccgugagauuccagcacgugggcaccagcguguuccugagcgugaccggcgagcaguacggcagccccaucagaggccagcacgaggugcacggcaugcccagcgccaacacccacaacaccuggaaggccauggagggcaucuucaucaagcccagcguggagcccagcgccggccacgacgagcuguaa

SEQ ID NO: 23092 - RNA, 609 nt, Artificial Sequence
  SDF4__Homo_sapiens__XP_011539858
augguguggcccuggguggccauggccagcagauggggcccccugaucggccuggcccccugcugccuguggcugcugggcgccgugcugcugauggacgccagcgccagacccgccaaccacagcagcaccagagagagaguggccaacagagaggagaacgagauccugccccccgaccaccugaacggcgugaagcuggagauggacggccaccugaacagaggcuuccaccaggagguguuccugggcaaggaccugggcggcuucgacgaggacgccgagcccagaagaagcagaagaaagcugauggugaucuucagcaagguggacgugaacaccgacagaaagaucagcgccaaggagaugcagagauggaucauggagaagaccgccgagcacuuccaggaggccauggaggagagcaagacccacuucagagccguggaccccgacggcgacggccacgugagcugggacgaguacaaggugaaguuccuggccagcaagggccacagcgagaaggagguggccgacgccaucagacugaacgaggagcugaagguggacgaggagagacacggcccccccggccccagagcccuguaa

SEQ ID NO: 23093 - RNA, 348 nt, Artificial Sequence
  SDHAF1__Homo_sapiens__NP_001036096
augagcagacacagcagacugcagagacaggugcugagccuguacagagaccugcugagagccggcagaggcaagcccggcgccgaggccagagugagagccgaguucagacagcacgccggccugcccagaagcgacgugcugagaaucgaguaccuguacagaagaggcagaagacagcugcagcugcugagaagcggccacgccaccgccaugggcgccuucgugagacccagagcccccaccggcgagcccggcggcgugggcagccagcccgacgacggcgacagccccagaaacccccacgacagcaccggcgcccccgagaccagacccgacggcagauaa

SEQ ID NO: 23094 - RNA, 501 nt, Artificial Sequence
  SDHAF2__Homo_sapiens__NP_060311
auggccgugagcaccguguucagcaccagcagccugaugcuggcccugagcagacacagccugcugagcccccugcugagcgugaccagcuucagaagauucuacagaggcgacagccccaccgacagccagaaggacaugaucgagaucccccugccccccuggcaggagagaaccgacgagagcaucgagaccaagagagccagacugcuguacgagagcagaaagagaggcaugcuggagaacugcauccugcugagccuguucgccaaggagcaccugcagcacaugaccgagaagcagcugaaccuguacgacagacugaucaacgagcccagcaacgacugggacaucuacuacugggccaccgaggccaagcccgcccccgagaucuucgagaacgaggugauggcccugcugagagacuucgccaagaacaagaacaaggagcagagacugagagcccccgaccuggaguaccuguucgagaagcccagauaa

SEQ ID NO: 23095 - RNA, 327 nt, Artificial Sequence
  SDHAF4__Homo_sapiens__NP_660310
augacccccagcagacugcccuggcugcugagcugggugagcgccaccgccuggagagccgccagaagcccccugcugugccacagccugagaaagaccagcagcagccagggcggcaagagcgagcuggugaagcagagccugaagaagcccaagcugcccgagggcagauucgacgcccccgaggacagccaccuggagaaggagccccuggagaaguuccccgacgacgugaaccccgugaccaaggagaagggcggccccagaggccccgagcccaccagauacggcgacugggagagaaagggcagaugcaucgacuucuaa

SEQ ID NO: 23096 - RNA, 1851 nt, Artificial Sequence
  SDHA__Homo_sapiens__NP_001281261
augagcggcgugagaggccugagcagacugcugagcgccagaagacuggcccuggccaaggccuggcccaccgugcugcagaccggcaccagaggcuuccacuucaccguggacggcaacaagagagccagcgccaaggugagcgacagcaucagcgcccaguaccccgugguggaccacgaguucgacgccgugguggugggcgccggcggcgccggccugagagccgccuucggccugagcgaggccggcuucaacaccgccugcgugaccaagcuguuccccaccagaagccacaccguggccgcccagcuggagaacuacggcaugcccuucagcagaaccgaggacggcaagaucuaccagagagccuucggcggccagagccugaaguucggcaagggcggccaggcccacagaugcugcugcguggccgacagaaccggccacagccugcugcacacccuguacggcagaagccugagauacgacaccagcuacuucguggaguacuucgcccuggaccugcugauggagaacggcgagugcagaggcgugaucgcccugugcaucgaggacggcagcauccacagaaucagagccaagaacaccgugguggccaccggcggcuacggcagaaccuacuucagcugcaccagcgcccacaccagcaccggcgacggcaccgccaugaucaccagagccggccugcccugccaggaccuggaguucgugcaguuccaccccaccggcaucuacggcgccggcugccugaucaccgagggcugcagaggcgagggcggcauccugaucaacagccagggcgagagauucauggagagauacgcccccguggccaaggaccuggccagcagagacguggugagcagaagcaugacccuggagaucagagagggcagaggcugcggccccgagaaggaccacguguaccugcagcugcaccaccugccccccgagcagcuggccaccagacugcccggcaucagcgagaccgccaugaucuucgccggcguggacgugaccaaggagcccauccccgugcugcccaccgugcacuacaacaugggcggcauccccaccaacuacaagggccaggugcugagacacgugaacggccaggaccagaucgugcccggccuguacgccugcggcgaggccgccugcgccagcgugcacggcgccaacagacugggcgccaacagccugcuggaccuggugguguucggcagagccugcgcccugagcaucgaggagagcugcagacccggcgacaaggugccccccaucaagcccaacgccggcgaggagagcgugaugaaccuggacaagcugagauucgccgacggcagcaucagaaccagcgagcugagacugagcaugcagaagagcaugcagaaccacgccgccguguucagagugggcagcgugcugcaggagggcugcggcaagaucagcaagcuguacggcgaccugaagcaccugaagaccuucgacagaggcaugguguggaacaccgaccugguggagacccuggagcugcagaaccugaugcugugcgcccugcagaccaucuacggcgccgaggccagaaaggagagcagaggcgcccacgccagagaggacuacaaggugagaaucgacgaguacgacuacagcaagcccauccagggccagcagaagaagcccuucgaggagcacuggagaaagcacacccugagcuacguggacgugggcaccggcaaggugacccuggaguacagacccgugaucgacaagacccugaacgaggccgacugcgccaccgugccccccgccaucagaagcuacuaa

SEQ ID NO: 23097 - RNA, 453 nt, Artificial Sequence
  SDHC__Homo_sapiens__NP_001030588
auggccgcccugcugcugagacacgugggcagacacugccugagagcccacuucagcccccagcugugcaucagaaacgccgugccccugggcaccaccgccaaggaggagauggagagauucuggaacaagaacaucggcagcaacagaccccugagcccccacaucaccaucuacagcuggagccugcccauggccaugagcaucugccacagaggcaccggcaucgcccugagcgccgacgugggccccagaaagagacccgaggacagccccgccauccccguguggagcggcugccccggcagcuacugcguggugcuguacggcgccggcagccacgugaagaagggcggcagccagcaccaccugcccacccacuacuacauccaccccagcuucugccugagcuuccugagccccgccugggagaaguucagccuguucguguaa

SEQ ID NO: 23098 - RNA, 480 nt, Artificial Sequence
  SDHD__Homo_sapiens__NP_002993
auggccgugcuguggagacugagcgccgugugcggcgcccugggcggcagagcccugcugcugagaacccccguggugagacccgcccacaucagcgccuuccugcaggacagacccauccccgaguggugcggcgugcagcacauccaccugagccccagccaccacagcggcagcaaggccgccagccugcacuggaccagcgagagaguggugagcgugcugcugcugggccugcugcccgccgccuaccugaaccccugcagcgccauggacuacagccuggccgccgcccugacccugcacggccacuggggccugggccagguggugaccgacuacgugcacggcgacgcccugcagaaggccgccaaggccggccugcuggcccugagcgcccugaccuucgccggccugugcuacuucaacuaccacgacgugggcaucugcaaggccguggccaugcuguggaagcuguaa

SEQ ID NO: 23099 - RNA, 6642 nt, Artificial Sequence
  SDK1__Homo_sapiens__NP_689957
auggccagaggcgccagacccagcgccgccggcggcggcggcggcggcgccgagccccccgagagagccggccccggcagacccagaggcagcccccccggcagagccagacccagccuggcccccagacccggccccgagcccagcagacccagagccgcccccgagaccagcggcggcgacaccgccggcgccggcagaugcggcggcagaagagccgccaagcugggccccggcagaagaggcuggugggcccugcuggcccugcagcugcaccugcugagagcccuggcccaggacgacguggcccccuacuucaagaccgagcccggccugccccagauccaccuggagggcaacagacuggugcugaccugccuggccgagggcagcuggccccuggaguucaaguggaugagagacgacagcgagcugaccaccuacagcagcgaguacaaguacaucauccccagccugcagaagcuggacgccggcuucuacagaugcguggugagaaacagaaugggcgcccugcugcagagaaagagcgaggugcagguggccuacaugggcagcuucauggacaccgaccagagaaagaccgugagccagggcagagccgccauccugaaccugcugcccaucaccagcuaccccagaccccaggugaccugguucagagagggccacaagaucauccccagcaacagaaucgccaucacccuggagaaccagcuggugauccuggccaccaccaccagcgacgccggcgccuacuacgugcaggccgugaacgagaagaacggcgagaacaagaccagccccuucauccaccugagcaucgccagagacgugggcacccccgagaccauggcccccaccaucguggugccccccggcaacagaagcgugguggccggcagcagcgagaccacccuggagugcaucgccagcgccagacccguggaggaccugagcgugaccuggaagagaaacggcgugagaaucaccagcggccugcacagcuucggcagaagacugaccaucagcaaccccaccagcgccgacaccggccccuacgugugcgaggccgcccugcccggcagcgccuucgagcccgccagagccaccgccuuccuguucaucaucgagccccccuacuucaccgccgagcccgagagcagaaucagcgccgagguggaggagaccguggacaucggcugccaggccaugggcgugccccugcccacccugcagugguacaaggacgccaucagcaucagcagacugcagaaccccagauacaaggugcuggccagcggcggccugagaauccagaagcugagacccgaggacagcggcaucuuccagugcuucgccagcaacgagggcggcgagauccagacccacaccuaccuggacgugaccaacaucgcccccguguucacccagagacccguggacaccaccgugaccgacggcaugaccgccauccugagaugcgaggugagcggcgcccccaagcccgccaucaccuggaagagagagaaccacauccuggccagcggcagcgugagaauccccagauucaugcugcuggagagcggcggccugcagaucgcccccguguucauccaggacgccggcaacuacaccugcuacgccgccaacaccgagggcagccugaacgccagcgccacccugaccguguggaacagaaccagcaucgugcacccccccgaggaccacguggugaucaagggcaccaccgccacccugcacugcggcgccacccacgaccccagagugagccugagauacguguggaagaaggacaacguggcccugacccccagcagcaccagcagaaucgugguggagaaggacggcagccugcugaucagccagaccuggagcggcgacaucggcgacuacagcugcgagaucgugagcgagggcggcaacgacagcagaauggccagacuggaggugaucgagcugccccacagcccccagaaccugcuggugagccccaacagcagccacagccacgccguggugcugagcugggugagacccuucgacggcaacagccccauccuguacuacaucguggagcugagcgagaacaacagccccuggaaggugcaccugagcaacgugggccccgagaugaccggcgugaccgugagcggccugacccccgccagaaccuaccaguucagagugugcgccgugaacgaggugggcagaggccaguacagcgccgagaccagcagacugaugcugcccgaggagccccccagcgccccccccaagaacaucguggccagcggcagaaccaaccagagcaucauggugcaguggcagcccccccccgagaccgagcacaacggcgugcugagaggcuacauccugagauacagacuggccggccugcccggcgaguaccagcagagaaacaucaccagccccgaggugaacuacugccuggugaccgaccugaucaucuggacccaguacgagauccagguggccgccuacaacggcgccggccugggcguguucagcagagccgugaccgaguacacccugcagggcgugcccaccgcccccccccagaacgugcagaccgaggccgugaacagcaccaccauccaguuccuguggaacccccccccccagcaguucaucaacggcaucaaccagggcuacaagcugcuggccuggcccgccgacgcccccgaggccgugaccguggugaccaucgcccccgacuuccacggcgugcaccacggccacaucaccaaccugaagaaguucaccgccuacuucaccagcgugcugugcuucaccacccccggcgacggcccccccagcaccccccagcugguguggacccaggaggacaagcccggcgccgugggccaccugagcuucaccgagauccuggacaccagccugaaggugagcuggcaggagccccuggagaagaacggcaucaucaccggcuaccagaucagcugggagguguacggcagaaacgacagcagacugacccacacccugaacagcaccacccacgaguacaagauccagggccugagcagccugaccaccuacaccaucgacguggccgccgugaccgccgugggcaccggccuggugaccagcagcaccaucagcagcggcgugccccccgaccugcccggcgcccccagcaaccuggugaucagcaacaucagccccagaagcgccacccugcaguucagacccggcuacgacggcaagaccagcaucagcagauggaucguggagggccaggugggcgccaucggcgacgaggaggagugggugacccuguacgaggaggagaacgagcccgacgcccagaugcuggagauccccaaccugacccccuacacccacuacagauucagaaugaagcaggugaacaucgugggccccagccccuacagccccagcagcagagugauccagacccugcaggccccccccgacguggcccccaccagcgugaccgugagaaccgccagcgagaccagccugagacugagaugggugccccugcccgacagccaguacaacggcaaccccgagagcgugggcuacagaaucaaguacuggagaagcgaccugcagagcagcgccguggcccagguggugagcgacagacuggagagagaguucaccaucgaggagcuggaggaguggauggaguacgagcugcagaugcaggccuucaacgccgugggcgccggccccuggagcgagguggugagaggcagaaccagagagagcgugcccagcgccgcccccgagaacgugagcgccgaggccgugagcagcacccagauccugcugaccuggaccagcgugcccgagcaggaccagaacggccugauccugggcuacaagauccuguucagagccaaggaccuggaccccgagcccagaagccacaucgugagaggcaaccacacccagagcgcccugcuggccggccugagaaaguucgugcuguacgagcugcaggugcuggccuucaccagaaucggcaacggcgugcccagcaccccccugauccuggagagaaccaaggacgacgcccccggcccccccgugagacugguguuccccgaggugagacugaccagcgugagaaucguguggcagccccccgaggagcccaacggcaucauccugggcuaccagaucgccuacagacuggccagcagcagcccccacaccuucaccaccguggaggugggcgccaccgugagacaguucaccgccaccgaccuggcccccgagagcgccuacaucuucagacugagcgccaagaccagacagggcuggggcgagccccuggaggccaccgugaucaccaccgagaagagagagagacccgccccccccagagagcugcuggugccccaggccgaggugaccgccagaagccugagacugcagugggugcccggcagcgacggcgccagccccaucagauacuucaccaugcaggugagagagcugcccagaggcgaguggcagaccuacagcagcagcaucagccacgaggccaccgccugcgugguggacagacugagacccuucaccagcuacaagcugagacugaaggccaccaacgacaucggcgacagcgacuucagcagcgagaccgaggccgugaccacccugcaggacgugcccggcgagccccccggcagcgugagcgccaccccccacaccaccagcagcgugcugauccaguggcagccccccagagacgagagccugaacggccugcugcagggcuacagaaucuacuacagagagcuggaguacgaggccggcagcggcaccgaggccaagacccugaagaaccccaucgcccugcacgccgagcugaccgcccagagcagcuucaagaccgugaacagcagcagcaccagcaccaugugcgagcugacccaccugaagaaguacagaagauacgaggugaucaugaccgccuacaacaucaucggcgagagccccgccagcgcccccguggagguguucgugggcgaggccgcccccgccauggccccccagaacgugcaggugaccccccugaccgccagccagcuggaggugaccugggacccccccccccccgagagccagaacggcaacauccagggcuacaagaucuacuacugggaggccgacagccagaacgagaccgagaagaugaaggugcuguuccugcccgagcccguggugagacugaagaaccugaccagccacaccaaguaccuggugagcaucagcgccuucaacgccgccggcgacggccccaagagcgacccccagcagggcagaacccaccaggccgcccccggcgcccccagcuuccuggccuucagcgagaucaccagcaccacccugaacgugagcuggggcgagcccgccgccgccaacggcauccugcagggcuacagagugguguacgagccccuggcccccgugcagggcgugagcaagguggugaccguggaggugagaggcaacuggcagagauggcugaaggugagagaccugaccaagggcgugaccuacuucuucagagugcaggccagaaccaucaccuacggccccgagcugcaggccaacaucaccgccggccccgccgagggcagccccggcagccccagagacgugcuggugaccaagagcgccagcgagcugacccugcaguggaccgagggccacagcggcgacacccccaccaccggcuacgugaucgaggccagacccagcgacgagggccugugggacauguucgugaaggacauccccagaagcgccaccagcuacacccugagccuggacaagcugagacagggcgugaccuacgaguucagagugguggccgugaacgaggccggcuacggcgagcccagcaaccccagcaccgccgugagcgcccagguggaggcccccuucuacgaggaguggugguuccugcuggugauggcccugagcagccugaucgugauccugcuggugguguucgcccuggugcugcacggccagaacaagaaguacaagaacugcagcaccggcaagggcaucagcaccauggaggagagcgugacccuggacaacggcggcuucgccgcccuggagcugagcagcagacaccugaacgugaagagcaccuucagcaagaagaacggcaccagaagcccccccagacccagccccggcggccugcacuacagcgacgaggacaucugcaacaaguacaacggcgccgugcugaccgagagcgugagccugaaggagaagagcgccgacgccagcgagagcgaggccaccgacagcgacuacgaggacgcccugcccaagcacagcuucgugaaccacuacaugagcgaccccaccuacuacaacagcuggaagagaagagcccagggcagagcccccgccccccacagauacgaggccguggccggcagcgaggccggcgcccagcugcaccccgugaucaccacccagagcgccggcggcguguacacccccgccggccccggcgccagaaccccccugaccggcuucagcagcuucguguaa

SEQ ID NO: 23100 - RNA, 6519 nt, Artificial Sequence
  SDK2__Homo_sapiens__NP_001138424
auguggggccugcugaucuggacccugcuggcccugcaccagaucagagccgccagagcccaggacgacgugagccccuacuucaagaccgagcccgugagaacccaggugcaccuggagggcaacagacuggugcugaccugcauggccgagggcagcuggccccuggaguucaaguggcugcacaacaacagagagcugaccaaguucagccuggaguacagauacaugaucaccagccuggacagaacccacgccggcuucuacagaugcaucgugagaaacagaaugggcgcccugcugcagagacagaccgaggugcagguggccuacaugggcagcuucgaggagggcgagaagcaccagagcgugagccacggcgaggccgccgugaucagagcccccagaaucgccagcuucccccagccccaggugaccugguucagagacggcagaaagaucccccccagcagcagaaucgccaucacccuggagaacacccuggugauccugagcaccguggcccccgacgccggcagauacuacgugcaggccgugaacgacaagaacggcgacaacaagaccagccagcccaucacccugaccguggagaacgugggcggccccgccgaccccaucgcccccaccaucaucaucccccccaagaacaccagcgugguggccggcaccagcgaggugacccuggagugcguggccaacgccagaccccugaucaagcugcacaucaucuggaagaaggacggcgugcugcugagcggcggcaucagcgaccacaacagaagacugaccauccccaaccccaccggcagcgacgccggcuacuacgagugcgaggccgugcugagaagcagcagcgugcccagcguggugagaggcgccuaccugagcgugcuggagcccccccaguucgugaaggagcccgagagacacaucaccgccgagauggagaaggugguggacauccccugccaggccaagggcgugcccccccccagcaucaccugguacaaggacgccgccgugguggagguggagaagcugaccagauucagacagagaaacgacggcggccugcagaucagcggccuggugcccgacgacaccggcauguuccagugcuucgccagaaacgccgccggcgaggugcagaccagcaccuaccuggccgugaccagcaucgcccccaacaucaccagaggcccccuggacagcaccgugaucgacggcaugagcguggugcuggccugcgagaccagcggcgcccccagacccgccaucaccuggcagaagggcgagagaauccuggccagcggcagcgugcagcugcccagauucaccccccuggagagcggcagccugcugaucagccccacccacaucagcgacgccggcaccuacaccugccuggccaccaacagcagaggcguggacgaggccagcgccgaccugguggugugggccagaaccagaaucaccaagcccccccaggaccagagcgugaucaagggcacccaggccagcauggugugcggcgugacccacgaccccagagugaccaucagauacaucugggagaaggacggcgccacccugggcaccgagagccaccccagaaucagacuggacagaaacggcagccugcacaucagccagaccuggagcggcgacaucggcaccuacaccugcagagugaucagcgccggcggcaacgacagcagaagcgcccaccugagagugagacagcugccccacgcccccgagcaccccguggccacccugagcaccguggagagaagagccaucaaccugaccuggaccaagcccuucgacggcaacagcccccugaucagauacauccuggagaugagcgagaacaacgcccccuggaccgugcugcuggccagcguggaccccaaggccaccagcgugaccgugaagggccuggugcccgccagaagcuaccaguucagacugugcgccgugaacgacgugggcaagggccaguucagcaaggacaccgagagagugagccugcccgaggagccccccaccgcccccccccagaacgugaucgccagcggcagaaccaaccagagcaucaugauccaguggcagcccccccccgagagccaccagaacggcauccugaagggcuacaucaucagauacugccuggccggccugcccgugggcuaccaguucaagaacaucaccgacgccgacgugaacaaccugcugcuggaggaccugaucaucuggaccaacuacgagaucgagguggccgccuacaacagcgccggccugggcguguacagcagcaaggugaccgaguggacccugcagggcgugcccaccgugccccccggcaacgugcacgccgaggccaccaacagcaccaccaucagauucaccuggaacgcccccagcccccaguucaucaacggcaucaaccagggcuacaagcugaucgccugggagcccgagcaggaggaggaggugaccauggugaccgccagacccaacuuccaggacagcauccacgugggcuucgugagcggccugaagaaguucaccgaguacuucaccagcgugcugugcuucaccacccccggcgacggccccagaagcaccccccagcuggugagaacccacgaggacgugcccggccccgugggccaccugagcuucagcgagauccuggacaccagccugaaggugagcuggcaggagcccggcgagaagaacggcauccugaccggcuacagaaucagcugggaggaguacaacagaaccaacaccagagugacccacuaccugcccaacgugacccuggaguacagagugaccggccugaccgcccugaccaccuacaccaucgagguggccgccaugaccagcaagggccagggccaggugagcgccagcaccaucagcagcggcgugccccccgagcugcccggcccccccaccaaccugggcaucagcaacaucggccccagaagcgugacccugcaguucagacccggcuacgacggcaagaccagcaucagcagauggcugguggaggcccaggugggcguggugggcgagggcgaggaguggcugcugauccaccagcugagcaacgagcccgacgccagaagcauggaggugcccgaccugaaccccuucaccugcuacagcuucagaaugagacaggugaacaucgugggcaccagcccccccagccagcccagcagaaagauccagacccugcaggccccccccgacauggcccccgccaacgugagccugagaaccgccagcgagaccagccuguggcugagauggaugccccugcccgagauggaguacaacggcaaccccgagagcgugggcuacaagaucaaguacagcagaagcgacggccacggcaagacccugagccacguggugcaggacagaguggagagagacuacaccaucgaggaccuggaggaguggaccgaguacagagugcaggugcaggccuucaacgccaucggcagcggccccuggagccagaccguggugggcagaaccagagagagcgugcccagcagcggccccaccaacgugagcgcccuggccaccaccagcagcagcaugcuggugagauggagcgaggugcccgaggccgacagaaacggccuggugcugggcuacaaggugauguacaaggagaaggacagcgacacccagcccagauucuggcugguggagggcaacagcagcagaagcgcccagcugaccggccugggcaaguacgugcuguacgaggugcaggugcuggccuucaccagaaucggcgacggcagccccagccacccccccauccuggagagaacccuggacgacgugcccggcccccccaugggcauccuguuccccgaggugagaaccaccagcgugagacugaucuggcagccccccgccgcccccaacggcaucauccuggccuaccagaucacccacagacugaacaccaccaccgccaacaccgccaccguggaggugcuggcccccagcgccagacaguacaccgccaccggccugaagcccgagagcguguaccuguucagaaucaccgcccagaccagaaagggcuggggcgaggccgccgaggcccugguggugaccaccgagaagagagacagaccccagccccccagcagacccauggugcagcaggaggacgugagagccagaagcgugcugcugagcugggagcccggcagcgacggccugagccccgugagauacuacaccauccagaccagagagcugcccagcggcagaugggcccugcacagcgccagcgugagccacaacgccagcagcuucaucguggacagacugaagcccuucaccagcuacaaguucagagugaaggccaccaacgacaucggcgacagcgaguucagcgaggagagcgagagccugaccacccugcaggccgcccccgacgaggcccccaccauccugagcgugaccccccacaccaccaccagcgugcugaucagauggcagccccccgccgaggacaagaucaacggcauccugcugggcuucagaaucagauacagagagcugcuguacgagggccugagaggcuucacccugagaggcaucaacaaccccggcgccaccugggccgagcugaccagcauguacagcaugagaaaccugagcagacccagccugacccaguacgagcuggacaaccugaacaagcacagaagauacgagaucagaaugagcguguacaacgccgugggcgagggccccagcagccccccccaggagguguucgugggcgaggccgugcccaccgccgcccccagaaacgugguggugcacggcgccaccgccacccagcuggacgugaccugggagccccccccccuggacagccagaacggcgacauccagggcuacaagaucuacuucugggaggcccagagaggcaaccugaccgagagagugaagacccuguuccuggccgagaacagcgugaagcugaagaaccugaccggcuacaccgccuacauggugagcguggccgccuucaacgccgccggcgacggccccagaagcacccccacccagggccagacccagcaggccgcccccagcgcccccagcagcgugaaguucagcgagcugaccaccaccagcgugaacgugagcugggaggccccccaguuccccaacggcauccuggagggcuacagacugguguacgagcccugcagccccguggacggcgugagcaagaucgugaccguggacgugaagggcaacagcccccuguggcugaaggugaaggaccuggccgagggcgugaccuacagauucagaaucagagccaagaccuucaccuacggccccgagaucgaggccaacgugaccaccggccccggcgagggcgcccccggcccccccggcgugcccaucaucgugagauacagcagcgccaucgccauccacuggagcagcggcgaccccggcaagggccccaucaccagauacgugaucgaggccagacccagcgacgagggccugugggacauccugaucaaggacauccccaaggaggugagcagcuacaccuucagcauggacauccugaagcccggcgugagcuacgacuucagagugaucgccgugaacgacuacggcuucggcacccccagcagccccagccagagcgugcccgcccagaaggccaaccccuucuacgaggaguggugguuccugguggugaucgcccuggugggccugaucuucauccugcugcugguguucgugcugaucaucagaggccagagcaagaaguacgccaagaagaccgacagcggcaacagcgccaagagcggcgcccugggccacagcgagaugaugagccuggacgagagcagcuuccccgcccuggagcugaacaacagaagacugagcgugaagaacagcuucugcagaaagaacggccuguacaccagaagcccccccagacccagccccggcagccugcacuacagcgacgaggacgugaccaaguacaacgaccugauccccgccgagagcagcagccugaccgagaagcccagcgagaucagcgacagccagggcagcgacagcgaguacgagguggacagcaaccaccagaaggcccacagcuucgugaaccacuacaucagcgaccccaccuacuacaacagcuggagaagacagcagaagggcaucagcagagcccaggccuacagcuacaccgagagcgacagcggcgagcccgaccacaccaccgugaccaacagcaccagcacccagcagggcagccuguucagacccaaggccagcagaacccccaccccccagaacccccccaacccccccagccagcagagcacccuguacagaccccccagcagccuggcccccggcagcagagcccccaucgccggcuucagcagcuucguguaa

SEQ ID NO: 23101 - RNA, 1278 nt, Artificial Sequence
  SDPR__Homo_sapiens__NP_004648
augggcgaggacgccgcccaggccgagaaguuccagcaccccggcagcgacaugagacaggagaagcccagcagccccagccccaugcccagcagcacccccagccccagccugaaccugggcaacaccgaggaggccaucagagacaacagccaggugaacgccgugaccgugcugacccugcuggacaagcuggugaacaugcuggacgccgugcaggagaaccagcacaagauggagcagagacagaucagccuggagggcagcgugaagggcauccagaacgaccugaccaagcugagcaaguaccaggccagcaccagcaacaccgugagcaagcugcuggagaagagcagaaaggugagcgcccacaccagagccgugaaggagagaauggacagacagugcgcccaggugaagagacuggagaacaaccacgcccagcugcugagaagaaaccacuucaaggugcugaucuuccaggaggagaacgagauccccgccagcguguucgugaagcagcccgugagcggcgccguggagggcaaggaggagcugcccgacgagaacaagagccuggaggagacccugcacaccguggaccugagcagcgacgacgaccugccccacgacgaggaggcccuggaggacagcgccgaggagaagguggaggagagcagagccgagaagaucaagagaagcagccugaagaagguggacagccugaagaaggccuucagcagacagaacaucgagaagaagaugaacaagcugggcaccaagaucgugagcguggagagaagagagaagaucaagaagagccugaccagcaaccaccagaagaucagcagcggcaagagcagccccuucaaggugagcccccugaccuucggcagaaagaaggugagagagggcgagagccacgccgagaacgagaccaagagcgaggaccugcccagcagcgagcagaugcccaacgaccaggaggaggagagcuucgccgagggccacagcgaggccagccuggccagcgcccugguggagggcgagaucgccgaggaggccgccgagaaggccaccagcagaggcagcaacagcggcauggacagcaacaucgaccugaccaucguggaggacgaggaggaggagagcguggcccuggagcaggcccagaaggugagauacgagggcagcuacgcccugaccagcgaggaggccgagagaagcgacggcgaccccgugcagcccgccgugcugcaggugcaccagaccagcuaa

SEQ ID NO: 23102 - RNA, 1182 nt, Artificial Sequence
  SDR42E1__Homo_sapiens__XP_011521772
auggaccccaagagaagccagaaggagagcgugcugaucaccggcggcagcggcuacuucggcuucagacugggcugcgcccugaaccagaacggcgugcacgugauccuguucgacaucagcagccccgcccagaccauccccgagggcaucaaguucauccagggcgacaucagacaccugagcgacguggagaaggccuuccaggacgccgacgugaccugcguguuccacaucgccagcuacggcaugagcggcagagagcagcugaacagaaaccugaucaaggaggugaacgugagaggcaccgacaacauccugcaggugugccagagaagaagagugcccagacugguguacaccagcaccuucaacgugaucuucggcggccaggugaucagaaacggcgacgagagccugcccuaccugccccugcaccugcaccccgaccacuacagcagaaccaagagcaucgccgagcagaaggugcuggaggccaacgccaccccccuggacagaggcgacggcgugcugagaaccugcgcccugagacccgccggcaucuacggccccggcgagcagagacaccugcccagaaucgugagcuacaucgagaagggccuguucaaguucguguacggcgaccccagaagccugguggaguucgugcacguggacaaccuggugcaggcccacauccuggccagcgaggcccugagagccgacaagggccacaucgccagcggccagcccuacuucaucagcgacggcagacccgugaacaacuucgaguucuucagaccccugguggagggccugggcuacaccuuccccagcaccagacugccccugacccugguguacugcuucgccuuccugaccgagauggugcacuucauccugggcagacuguacaacuuccagcccuuccugaccagaaccgagguguacaagaccggcgugacccacuacuucagccuggagaaggccaagaaggagcugggcuacaaggcccagcccuucgaccugcaggaggccguggagugguucaaggcccacggccacggcagaagcagcggcagcagagacagcgagugcuucgugugggacggccugcugguguuccugcugaucaucgccgugcugauguggcugcccagcagcgugauccugagccuguaa

SEQ ID NO: 23103 - RNA, 942 nt, Artificial Sequence
  SDR9C7__Homo_sapiens__NP_683695
auggccgcccugaccgaccugagcuucauguacagaugguucaagaacugcaaccuggugggcaaccugagcgagaaguacguguucaucaccggcugcgacagcggcuucggcaaccugcuggccaagcagcugguggacagaggcaugcaggugcuggccgccugcuucaccgaggagggcagccagaagcugcagagagacaccagcuacagacugcagaccacccugcuggacgugaccaagagcgagagcaucaaggccgccgcccagugggugagagacaaggugggcgagcagggccugugggcccuggugaacaacgccggcgugggccugcccagcggccccaacgaguggcugaccaaggacgacuucgugaaggugaucaacgugaaccuggugggccugaucgaggugacccugcacaugcugcccauggugaagagagccagaggcagaguggugaacaugagcagcagcggcggcagaguggccgugaucggcggcggcuacugcgugagcaaguucggcguggaggccuucagcgacagcaucagaagagagcuguacuacuucggcgugaaggugugcaucaucgagcccggcaacuacagaaccgccauccugggcaaggagaaccuggagagcagaaugagaaagcugugggagagacugccccaggagaccagagacagcuacggcgaggacuacuucagaaucuacaccgacaagcugaagaacaucaugcagguggccgagcccagagugagagacgugaucaacagcauggagcacgccaucgugagcagaagccccagaaucagauacaaccccggccuggacgccaagcugcuguacaucccccuggccaagcugcccacccccgugaccgacuucauccugagcagauaccugcccagacccgccgacagcguguaa

SEQ ID NO: 23104 - RNA, 987 nt, Artificial Sequence
  SDS__Homo_sapiens__NP_006834
augaugagcggcgagccccugcacgugaagacccccaucagagacagcauggcccugagcaagauggccggcaccagcguguaccugaagauggacagcgcccagcccagcggcagcuucaagaucagaggcaucggccacuucugcaagagaugggccaagcagggcugcgcccacuucgugugcagcagcgccggcaacgccggcauggccgccgccuacgccgccagacagcugggcgugcccgccaccaucguggugcccagcaccacccccgcccugaccaucgagagacugaagaacgagggcgccaccgugaagguggugggcgagcugcuggacgaggccuucgagcuggccaaggcccuggccaagaacaaccccggcuggguguacaucccccccuucgacgacccccugaucugggagggccacgccagcaucgugaaggagcugaaggagacccugugggagaagcccggcgccaucgcccugagcgugggcggcggcggccugcugugcggcguggugcagggccugcaggaggugggcuggggcgacgugcccgugaucgccauggagaccuucggcgcccacagcuuccacgccgccaccaccgccggcaagcuggugagccugcccaagaucaccagcguggccaaggcccugggcgugaagaccgugggcgcccaggcccugaagcuguuccaggagcaccccaucuucagcgaggugaucagcgaccaggaggccguggccgccaucgagaaguucguggacgacgagaagauccugguggagcccgccugcggcgccgcccuggccgccguguacagccacgugauccagaagcugcagcuggagggcaaccugagaaccccccugcccagccugguggugaucgugugcggcggcagcaacaucagccuggcccagcugagagcccugaaggagcagcugggcaugaccaacagacugcccaaguaa

SEQ ID NO: 23105 - RNA, 462 nt, Artificial Sequence
  SEC11A__Homo_sapiens__NP_001258847
augaucgugagcagcgcccugaugaucuggaagggccugauggugaucaccggcagcgagagccccaucgugguggugcugagcggcagcauggagcccgccuuccacagaggcgaccugcuguuccugaccaacagaguggaggaccccaucagagugggcgagaucgugguguucagaaucgagggcagagagauccccaucgugcacagagugcugaagauccacgagaagcagaacggccacaucaaguuccugaccaagggcgacaacaacgccguggacgacagaggccuguacaagcagggccagcacuggcuggagaagaaggacguggugggcagagccagaggcuucgugcccuacaucggcaucgugaccauccugaugaacgacuaccccaaguucaaguacgccgugcuguuccugcugggccuguucgugcuggugcacagagaguaa

SEQ ID NO: 23106 - RNA, 579 nt, Artificial Sequence
  SEC11C__Homo_sapiens__NP_150596
auggugagagccggcgccgugggcgcccaccugcccgccagcggccuggacaucuucggcgaccugaagaagaugaacaagagacagcuguacuaccaggugcugaacuucgccaugaucgugagcagcgcccugaugaucuggaagggccugaucgugcugaccggcagcgagagccccaucgugguggugcugagcggcagcauggagcccgccuuccacagaggcgaccugcuguuccugaccaacuucagagaggaccccaucagagccggcgagaucgugguguucaagguggagggcagagacauccccaucgugcacagagugaucaaggugcacgagaaggacaacggcgacaucaaguuccugaccaagggcgacaacaacgagguggacgacagaggccuguacaaggagggccagaacuggcuggagaagaaggacguggugggcagagccagaggcuuccugcccuacgugggcauggugaccaucaucaugaacgacuaccccaaguucaaguacgcccugcuggccgugaugggcgccuacgugcugcugaagagagagagcuaa

SEQ ID NO: 23107 - RNA, 1107 nt, Artificial Sequence
  SEC13__Homo_sapiens__NP_001129498
augagagagcccgugcugaccuggugcgugccccuggagcugcugugcagccacccccugccccugagcgccuuccugaagagccaggugaagcuguacaccuacagagccugcgccggcaaggacgagaugggcaagauggugagcgugaucaacaccguggacaccagccacgaggacaugauccacgacgcccagauggacuacuacggcaccagacuggccaccugcagcagcgacagaagcgugaagaucuucgacgugagaaacggcggccagauccugaucgccgaccugagaggccacgagggccccguguggcagguggccugggcccaccccauguacggcaacauccuggccagcugcagcuacgacagaaaggugaucaucuggagagaggagaacggcaccugggagaagagccacgagcacgccggccacgacagcagcgugaacagcgugugcugggccccccacgacuacggccugauccuggccugcggcagcagcgacggcgccaucagccugcugaccuacaccggcgagggccagugggaggugaagaagaucaacaacgcccacaccaucggcugcaacgccgugagcugggcccccgccguggugcccggcagccugaucgaccaccccagcggccagaagcccaacuacaucaagagauucgccagcggcggcugcgacaaccugaucaagcuguggaaggaggaggaggacggccaguggaaggaggagcagaagcuggaggcccacagcgacugggugagagacguggccugggcccccagcaucggccugcccaccagcaccaucgccagcugcagccaggacggcagaguguucaucuggaccugcgacgacgccagcagcaacaccuggagccccaagcugcugcacaaguucaacgacgugguguggcacgugagcuggagcaucaccgccaacauccuggccgugagcggcggcgacaacaaggugacccuguggaaggagagcguggacggccagugggugugcaucagcgacgugaacaagggccagggcagcgugagcgccagcgugaccgagggccagcagaacgagcaguaa

SEQ ID NO: 23108 - RNA, 2148 nt, Artificial Sequence
  SEC14L1__Homo_sapiens__NP_001137470
auggugcagaaguaccagagccccgugagaguguacaaguaccccuucgagcugaucauggccgccuacgagagaagauuccccaccugcccccugauccccauguucgugggcagcgacaccgugaacgaguucaagagcgaggacggcgccauccacgugaucgagagaagaugcaagcuggacguggacgcccccagacugcugaagaagaucgccggcguggacuacguguacuucgugcagaagaacagccugaacagcagagagagaacccugcacaucgaggccuacaacgagaccuucagcaacagagugaucaucaacgagcacugcugcuacaccgugcaccccgagaacgaggacuggaccugcuucgagcagagcgccagccuggacaucaagagcuucuucggcuucgagagcaccguggagaagaucgccaugaagcaguacaccagcaacaucaagaagggcaaggagaucaucgaguacuaccugagacagcuggaggaggagggcaucaccuucgugcccagauggagcccccccagcaucacccccagcagcgagaccagcagcagcagcagcaagaagcaggccgccagcauggccguggugauccccgaggccgcccugaaggagggccugagcggcgacgcccugagcagccccagcgcccccgagcccguggugggcacccccgacgacaagcuggacgccgacuacaucaagagauaccugggcgaccugaccccccugcaggagagcugccugaucagacugagacaguggcugcaggagacccacaagggcaagauccccaaggacgagcacauccugagauuccugagagccagagacuucaacaucgacaaggccagagagaucaugugccagagccugaccuggagaaagcagcaccagguggacuacauccuggagaccuggacccccccccaggugcugcaggacuacuacgccggcggcuggcaccaccacgacaaggacggcagaccccuguacgugcugagacugggccagauggacaccaagggccuggugagagcccugggcgaggaggcccugcugagauacgugcugagcaucaacgaggagggccugagaagaugcgaggagaacaccaagguguucggcagacccaucagcagcuggaccugccugguggaccuggagggccugaacaugagacaccuguggagacccggcgugaaggcccugcugagaaucaucgaggugguggaggccaacuaccccgagacccugggcagacugcugauccugagagcccccagaguguuccccgugcuguggacccuggugagccccuucaucgacgacaacaccagaagaaaguuccugaucuacgccggcaacgacuaccagggccccggcggccugcuggacuacaucgacaaggagaucauccccgacuuccugagcggcgagugcaugugcgaggugcccgagggcggccuggugcccaagagccuguacagaaccgccgaggagcuggagaacgaggaccugaagcuguggaccgagaccaucuaccagagcgccagcguguucaagggcgccccccacgagauccugauccagaucguggacgccagcagcgugaucaccugggacuucgacgugugcaagggcgacaucguguucaacaucuaccacagcaagagaagcccccagccccccaagaaggacagccugggcgcccacagcaucaccagccccggcggcaacaacgugcagcugaucgacaagguguggcagcugggcagagacuacagcaugguggagagcccccugaucugcaaggagggcgagagcgugcagggcagccacgugaccagauggcccggcuucuacauccugcaguggaaguuccacagcaugcccgccugcgccgccagcagccugcccagaguggacgacgugcuggccagccugcaggugagcagccacaagugcaaggugauguacuacaccgaggugaucggcagcgaggacuucagaggcagcaugaccagccuggagagcagccacagcggcuucagccagcugagcgccgccaccaccagcagcagccagagccacagcagcagcaugaucagcagauaa

SEQ ID NO: 23109 - RNA, 963 nt, Artificial Sequence
  SEC14L2__Homo_sapiens__NP_001191133
augagcggcagagugggcgaccugagccccagacagaaggaggcccuggccaaguucagagagaacgugcaggacgugcugcccgcccugcccaaccccgacgacuacuuccugcugagauggcugagagccagaagcuucgaccugcagaagagcgaggccaugcugagaaagcugggcagaaagguggagaccaucaccaucaucuacgacugcgagggccugggccugaagcaccuguggaagcccgccguggaggccuacggcgaguuccugugcauguucgaggagaacuaccccgagacccugaagagacuguucguggugaaggcccccaagcuguuccccguggccuacaaccugaucaagcccuuccugagcgaggacaccagaaagaagaucauggugcugggcgccaacuggaaggaggugcugcugaagcacaucagccccgaccaggugcccguggaguacggcggcaccaugaccgaccccgacggcaaccccaagugcaagagcaagaucaacuacggcggcgacauccccagaaaguacuacgugagagaccaggugaagcagcaguacgagcacagcgugcagaucagcagaggcagcagccaccagguggaguacgagauccuguuccccggcugcgugcugagauggcaguucaugagcgacggcgccgacgugggcuucggcaucuuccugaagaccaagaugggcgagagacagagagccggcgagaugaccgaggugcugcccaaccagagauacaacagccaccuggugcccgaggacggcacccugaccugcagcgaccccggcaucuacgugcugagauucgacaacaccuacagcuucauccacgccaagaaggugaacuucaccguggaggugcugcugcccgacaaggccagcgaggagaagaugaagcagcugggcgccggcacccccaaguaa

SEQ ID NO: 23110 - RNA, 972 nt, Artificial Sequence
  SEC14L3__Homo_sapiens__NP_001244307
auggugauccagaaguacaugcccggcggccugugcggcuacgacagagacggcugccccgugugguacgacaucaucggcccccuggaccccaagggccugcuguucagcgugaccaagcaggaccugcugaagaccaagaugagagacugcgagagaauccugcacgagugcgaccugcagaccgagagacugggcaagaagaucgagaccaucgugaugaucuucgacugcgagggccugggccugaagcacuucuggaagccccugguggagguguaccaggaguucuucggccugcuggaggagaacuaccccgagacccugaaguucaugcugaucgugaaggccaccaagcuguuccccgugggcuacaaccugaugaagcccuuccugagcgaggacaccagaagaaagaucaucgugcugggcaacaacuggaaggagggccugcugaagcugaucagccccgaggagcugcccgcccaguucggcggcacccugaccgaccccgacggcaaccccaagugccugaccaagaucaacuacggcggcgagauccccaagagcauguacgugagagaccaggugaagacccaguacgagcacagcgugcagaucaacagaggcagcagccaccagguggaguacgagauccuguuccccggcugcgugcugagauggcaguucagcagcgacggcgccgacaucggcuucggcguguuccugaagaccaagaugggcgagagacagagagccggcgagaugaccgacgugcugcccagccagagauacaacgcccacauggugcccgaggacggcaaccugaccugcagcgaggccggcguguacgugcugagauucgacaacaccuacagcuucgugcacgccaagaaggugagcuucaccguggaggugcugcugcccgacgagggcaugcagaaguacgacaaggagcugacccccguguaa

SEQ ID NO: 23111 - RNA, 3183 nt, Artificial Sequence
  SEC16B__Homo_sapiens__NP_149118
auggagcugugggccccccagagacugccccagaccagaggcaaggccaccgcccccagcaaggaccccgacagaggcuucagaagagacggccaccacagacccgugccccacagcuggcacaacggcgagagauuccaccaguggcaggacaacagaggcagcccccagccccagcaggagcccagagccgaccaccagcagcagccccacuacgccagcagacccggcgacuggcaccagcccgugagcggcguggacuacuacgagggcggcuacagaaaccagcuguacagcagacccggcuacgagaacagcuaccagagcuaccagagccccaccaugagagaggaguacgccuacggcagcuacuacuaccacggccacccccaguggcugcaggaggagagagugcccagacagagaagccccuacaucuggcacgaggacuacagagagcagaaguaccuggacgagcaccacuacgagaaccagcacagccccuucggcaccaacagcgagacccacuuccagagcaacagcagaaaccccugcaaggacagccccgccagcaacagcggccaggaguggcccggcgagcuguuccccggcagccugcuggccgaggcccagaagaacaagcccagccuggccagcgagagcaaccugcugcagcagagagagagcggccugagcagcagcagcuacgagcugagccaguacaucagagacgcccccgagagagacgacccccccgccagcgccgccuggagccccgugcaggccgacgugagcagcgccggccccaaggcccccaugaaguucuacaucccccacgugcccgugagcuucggccccggcggccagcuggugcacgugggccccagcagccccaccgacggccaggccgcccugguggagcugcacagcauggaggugauccugaacgacagcgaggagcaggaggagaugagaagcuucagcggcccccugaucagagaggacgugcacaagguggacaucaugaccuucugccagcagaaggccgcccagagcugcaagagcgagacccugggcagcagagacagcgcccugcuguggcagcugcuggugcugcugugcagacagaacggcagcauggugggcagcgacaucgccgagcugcugaugcaggacugcaagaagcuggagaaguacaagagacagccccccguggccaaccugaucaaccugaccgacgaggacuggcccgugcugagcagcggcacccccaaccugcugaccggcgagaucccccccagcguggagacccccgcccagaucguggagaaguucaccagacugcuguacuacggcagaaagaaggaggcccuggagugggccaugaagaaccaccuguggggccacgcccuguuccugagcagcaagauggacccccagaccuacagcugggugaugagcggcuucaccagcacccuggcccugaacgacccccugcagacccuguuccagcugaugagcggcagaaucccccaggccgccaccugcugcggcgagaagcaguggggcgacuggagaccccaccuggccgugauccugagcaaccaggccggcgaccccgagcuguaccagagagccaucguggccaucggcgacacccuggccggcaagggccugguggaggccgcccacuucugcuaccugauggcccacgugcccuucggccacuacaccgugaagaccgaccaccuggugcugcugggcagcagccacagccaggaguuccugaaguucgccaccaccgaggccauccagagaaccgagaucuucgaguacugccagaugcugggcagacccaagagcuucauccccagcuuccagguguacaagcugcuguacgccagcagacuggccgacuacggccuggugagccaggcccugcacuacugcgaggccaucggcgccgccgugcugagccagggcgagagcagccaccccgugcugcugguggagcugaucaagcuggccgagaagcugaagcugagcgacccccuggugcuggagagaagaagcggcgacagagaccuggagcccgacuggcuggcccagcugagaagacagcuggagcagaagguggccggcgacaucggcgacccccaccccaccagaagcgacaucagcggcgccggcggcaccaccaccgagaacaccuucuaccaggacuucagcggcugccagggcuacagcgaggcccccggcuacagaagcgcccuguggcugacccccgagcagaccugccugcugcagcccagcccccagcagcccuucccccugcagcccggcagcuaccccgccggcggcggcgccggccagaccggcacccccagacccuucuacagcgugcccgagacccaccugcccggcaccggcagcagcguggccgugaccgaggccaccggcggcaccgugugggaggagaugcugcagacccaccugggccccggcgagaacaccgugagccaggagaccagccagccccccgacggccaggaggugaucagcaagccccagaccccccuggccgccagacccagaagcaucagcgagagcagcgccagcagcgccaaggaggacgagaaggagagcagcgacgaggccgacaagaacagccccagaaacaccgcccagagaggcaagcugggcgacggcaaggagcacaccaagagcagcggcuucggcugguucagcugguucagaagcaagcccaccaagaacgccagccccgccggcgacgaggacagcagcgacagccccgacagcgaggagacccccagagccagcagcccccaccaggccggccugggccugagccugacccccagccccgagagccccccccugcccgacgugagcgccuucagcagaggcagaggcggcggcgagggcagaggcagcgccagcagcggcggcgccgccgccggcgccggcgugggcggccugagcggccccgagagcgugagcuucgagcugugcagcaaccccggcgugcugcugcccccccccgcccugaagggcgccgugccccuguacaaccccagccaggugccccagcugcccaccgccaccagccugaacagacccaacagacuggcccagagaagauaccccacccagcccugcuaa

SEQ ID NO: 23112 - RNA, 2298 nt, Artificial Sequence
  SEC23A__Homo_sapiens__NP_006355
augaccaccuaccuggaguucauccagcagaacgaggagagagacggcgugagauucagcuggaacguguggcccagcagcagacuggaggccaccagaaugguggugcccguggccgcccuguucaccccccugaaggagagacccgaccugccccccauccaguacgagcccgugcugugcagcagaaccaccugcagagccgugcugaacccccugugccagguggacuacagagccaagcugugggccugcaacuucugcuaccagagaaaccaguucccccccagcuacgccggcaucagcgagcugaaccagcccgccgagcugcugccccaguucagcagcaucgaguacguggugcugagaggcccccagaugccccugaucuuccuguacgugguggacaccugcauggaggacgaggaccugcaggcccugaaggagagcaugcagaugagccugagccugcugccccccaccgcccuggugggccugaucaccuucggcagaauggugcaggugcacgagcugggcugcgagggcaucagcaagagcuacguguucagaggcaccaaggaccugagcgccaagcagcugcaggagaugcugggccugagcaaggugccccugacccaggccaccagaggcccccaggugcagcagcccccccccagcaacagauuccugcagcccgugcagaagaucgacaugaaccugaccgaccugcugggcgagcugcagagagaccccuggcccgugccccagggcaagagaccccugagaagcagcggcguggcccugagcaucgccgugggccugcuggagugcaccuuccccaacaccggcgccagaaucaugauguucaucggcggccccgccacccagggccccggcaugguggugggcgacgagcugaagacccccaucagaagcuggcacgacaucgacaaggacaacgccaaguacgugaagaagggcaccaagcacuucgaggcccuggccaacagagccgccaccaccggccacgugaucgacaucuacgccugcgcccuggaccagaccggccugcuggagaugaagugcugccccaaccugaccggcggcuacauggugaugggcgacagcuucaacaccagccuguucaagcagaccuuccagagaguguucaccaaggacaugcacggccaguucaagaugggcuucggcggcacccuggagaucaagaccagcagagagaucaagaucagcggcgccaucggccccugcgugagccugaacagcaagggccccugcgugagcgagaacgagaucggcaccggcggcaccugccaguggaagaucugcggccugagccccaccaccacccuggccaucuacuucgagguggugaaccagcacaacgcccccaucccccagggcggcagaggcgccauccaguucgugacccaguaccagcacagcagcggccagagaagaaucagagugaccaccaucgccagaaacugggccgacgcccagacccagauccagaacaucgccgccagcuucgaccaggaggccgccgccauccugauggccagacuggccaucuacagagccgagaccgaggagggccccgacgugcugagauggcuggacagacagcugaucagacugugccagaaguucggcgaguaccacaaggacgaccccagcagcuucagauucagcgagaccuucagccuguacccccaguucauguuccaccugagaagaagcagcuuccugcagguguucaacaacagccccgacgagagcagcuacuacagacaccacuucaugagacaggaccugacccagagccugaucaugauccagcccauccuguacgccuacagcuucagcggcccccccgagcccgugcugcuggacagcagcagcauccuggccgacagaauccugcugauggacaccuucuuccagauccugaucuaccacggcgagaccaucgcccaguggagaaagagcggcuaccaggacaugcccgaguacgagaacuucagacaccugcugcaggcccccguggacgacgcccaggagauccugcacagcagauuccccaugcccagauacaucgacaccgagcacggcggcagccaggccagauuccugcugagcaaggugaaccccagccagacccacaacaacauguacgccuggggccaggagagcggcgcccccauccugaccgacgacgugagccugcagguguucauggaccaccugaagaagcuggccgugagcagcgccgccuaa

SEQ ID NO: 23113 - RNA, 2250 nt, Artificial Sequence
  SEC23B__Homo_sapiens__NP_001166217
auggccaccuaccuggaguucauccagcagaacgaggagagagacggcgugagauucagcuggaacguguggcccagcagcagacuggaggccaccagaaugguggugccccuggccugccugcugaccccccugaaggagagacccgaccugccccccgugcaguacgagcccgugcugugcagcagacccaccugcaaggccgugcugaacccccugugccagguggacuacagagccaagcugugggccugcaacuucugcuuccagagaaaccaguucccccccgccuacggcggcaucagcgaggugaaccagcccgccgagcugaugccccaguucagcaccaucgaguacgugauccaggaggacgaccugcaggcccugaaggagagccugcagaugagccugagccugcugccccccgacgcccuggugggccugaucaccuucggcagaauggugcaggugcacgagcugagcugcgagggcaucagcaagagcuacguguucagaggcaccaaggaccugaccgccaagcagauccaggacaugcugggccugaccaagcccgccaugcccaugcagcaggccagacccgcccagccccaggagcaccccuucgccagcagcagauuccugcagcccgugcacaagaucgacaugaaccugaccgaccugcugggcgagcugcagagagaccccuggcccgugacccagggcaagagaccccugagaagcaccggcguggcccugagcaucgccgugggccugcuggagggcaccuuccccaacaccggcgccagaaucaugcuguucaccggcggcccccccacccagggccccggcaugguggugggcgacgagcugaagauccccaucagaagcuggcacgacaucgagaaggacaacgccagauucaugaagaaggccaccaagcacuacgagaugcuggccaacagaaccgccgccaacggccacugcaucgacaucuacgccugcgcccuggaccagaccggccugcuggagaugaagugcugcgccaaccugaccggcggcuacauggugaugggcgacagcuucaacaccagccuguucaagcagaccuuccagagaaucuucaccaaggacuucaacggcgacuucagaauggccuucggcgccacccuggacgugaagaccagcagagagcugaagaucgccggcgccaucggccccugcgugagccugaacgugaagggccccugcgugagcgagaacgagcugggcgugggcggcaccagccaguggaagaucugcggccuggaccccaccagcacccugggcaucuacuucgagguggugaaccagcacaacacccccaucccccagggcggcagaggcgccauccaguucgugacccacuaccagcacagcagcacccagagaagaaucagagugaccaccaucgccagaaacugggccgacgugcagagccagcugagacacaucgaggccgccuucgaccaggaggccgccgccgugcugauggccagacugggcguguucagagccgagagcgaggagggccccgacgugcugagauggcuggacagacagcugaucagacugugccagaaguucggccaguacaacaaggaggaccccaccagcuucagacugagcgacagcuucagccuguacccccaguucauguuccaccugagaagaagccccuuccugcagguguucaacaacagccccgacgagagcagcuacuacagacaccacuucgccagacaggaccugacccagagccugaucaugauccagcccauccuguacagcuacagcuuccacggcccccccgagcccgugcugcuggacagcagcagcauccuggccgacagaauccugcugauggacaccuucuuccagaucgugaucuaccugggcgagaccaucgcccaguggagaaaggccggcuaccaggacaugcccgaguacgagaacuucaagcaccugcugcaggccccccuggacgacgcccaggagauccugcaggccagauuccccaugcccagauacaucaacaccgagcacggcggcagccaggccagauuccugcugagcaaggugaaccccagccagacccacaacaaccuguacgccuggggccaggagaccggcgcccccauccugaccgacgacgugagccugcagguguucauggaccaccugaagaagcuggccgugagcagcgccugcuaa

SEQ ID NO: 23114 - RNA, 3003 nt, Artificial Sequence
  SEC23IP__Homo_sapiens__NP_009121
auggccgagagaaagcccaacggcggcagcggcggcgccagcaccagcagcagcggcaccaaccugcuguucagcagcagcgccaccgaguucagcuucaacgugcccuucauccccgugacccaggccagcgccagccccgccagccugcugcugcccggcgaggacagcaccgacgugggcgaggaggacagcuuccugggccagaccagcauccacaccagcgccccccagaccuucagcuacuucagccaggugagcagcagcagcgaccccuucggcaacaucggccagagcccccugaccaccgccgccaccagcgugggccagagcggcuuccccaagccccugaccgcccugcccuucaccaccggcagccaggacgugagcaacgccuucagccccagcaucagcaaggcccagcccggcgccccccccagcagccugaugggcaucaacagcuaccugcccagccagcccagcagccugccccccagcuacuucggcaaccagccccagggcaucccccagcccggcuacaaccccuacagacacacccccggcagcagcagagccaaccccuacaucgcccccccccagcugcagcagugccagacccccggcccccccgcccaccccccccccagcggcccccccgugcagauguaccagaugccccccggcagccugccccccgugcccagcagcgugcagagccccgcccagcagcaggugcccgccagacccggcgcccccagcgugcaggugcccagccccuuccugcugcagaaccaguacgagcccgugcagccccacugguucuacugcaaggagguggaguacaagcagcuguggaugcccuucagcguguucgacagccugaaccuggaggagaucuacaacagcgugcagcccgaccccgagagcguggugcugggcaccgacggcggcagauacgacguguaccuguacgacagaaucagaaaggccgccuacugggaggaggagcccgccgaggugagaagaugcaccugguucuacaagggcgacaccgacagcagauucauccccuacaccgaggaguucagcgagaagcuggaggccgaguacaagaaggccgugaccaccaaccaguggcacagaagacuggaguuccccagcggcgagaccaucgugaugcacaaccccaaggugaucgugcaguuccagcccagcagcgugcccgacgaguggggcaccacccaggacggccagaccagacccagaguggugaagagaggcaucgacgacaaccuggacgagauccccgacggcgagaugccccagguggaccaccugguguucguggugcacggcaucggccccgugugcgaccugagauucagaagcaucaucgagugcguggacgacuucagaguggugagccugaagcugcugagaacccacuucaagaagagccuggacgacggcaaggugagcagaguggaguuccugcccgugcacuggcacagcagccugggcggcgacgccaccggcguggacagaaacaucaagaagaucacccugcccagcaucggcagauucagacacuucaccaacgagacccugcuggacauccuguucuacaacagccccaccuacugccagaccaucguggagaaggugggcauggagaucaaccaccugcacgcccuguucaugagcagaaaccccgacuucaagggcggcgugagcguggccggccacagccugggcagccugauccuguucgacauccugagcaaccagaaggaccugaaccugagcaagugccccggcccccuggccguggccaacggcguggugaagcagcugcacuuccaggagaagcagaugcccgaggagcccaagcugacccuggacgagagcuacgaccuggugguggagaacaaggaggugcugacccugcaggagacccuggaggcccugagccugagcgaguacuucagcaccuucgagaaggagaagaucgacauggagagccugcugaugugcaccguggacgaccugaaggagaugggcaucccccugggccccagaaagaagaucgccaacuucguggagcacaaggccgccaagcugaagaaggccgccagcgagaagaaggccguggccgccaccagcaccaagggccaggagcagagcgcccagaagaccaaggacauggccagccugcccagcgagagcaacgagcccaagagaaagcugcccgugggcgccugcgugagcagcgugugcgugaacuacgagagcuucgaggugggcgccggccaggugagcguggccuacaacagccuggacuucgagcccgagaucuucuucgcccugggcagccccaucgccauguuccugaccaucagaggcguggacagaaucgacgagaacuacagccugcccaccugcaagggcuucuucaacaucuaccacccccuggaccccguggccuacagacuggagcccaugaucgugcccgaccuggaccugaaggccgugcugaucccccaccacaagggcagaaagagacugcaccuggagcugaaggagagccugagcagaaugggcagcgaccugaagcagggcuucaucagcagccugaagagcgccuggcagacccugaacgaguucgccagagcccacaccagcagcacccagcugcaggaggagcuggagaagguggccaaccagaucaaggaggaggaggagaagcaggugguggaggccgagaaggugguggagagccccgacuucagcaaggacgaggacuaccugggcaaggugggcaugcugaacggcggcagaagaaucgacuacgugcugcaggagaagcccaucgagagcuucaacgaguaccuguucgcccugcagagccaccugugcuacugggagagcgaggacaccgcccugcugcugcugaaggagaucuacagaaccaugaacaucagccccgagcagccccagcacuaa

SEQ ID NO: 23115 - RNA, 1842 nt, Artificial Sequence
  SEC24A__Homo_sapiens__NP_001239160
augagccagcccggcauccccgccagcggcggcgcccccgccagccugcaggcccagaacggcgccgcccuggccagcggcagccccuacaccaacggccccgugcagaacgcccugcugagcagccaggagagcgugagccagggcuacaacuuccagcugcccggcagcuacccccaccccauccccgccaagacccugaaccccgugagcggccagagcaacuacggcggcagccagggcagcggccagacccugaacagaccccccguggccagcaaccccgugacccccagccugcacagcggccccgcccccagaaugccccugcccgccagccagaaccccgccaccacccccaugcccagcagcagcuuccugcccgaggccaaccugccccccccccugaacuggcaguacaacuaccccagcaccgccagccagaccaaccacugccccagagccagcagccagcccaccgugagcggcaacaccagccugaccaccaaccaccaguacgugagcagcggcuaccccagccugcagaacagcuucaucaagagcggccccagcgugcccccccuggugaaccccccccugcccaccaccuuccagcccggcgccccccacggccccccccccgccggcggccccccccccgugagagcccugaccccccugaccagcagcuacagagacgugccccagccccuguucaacagcgccgugaaccaggagggcaucaccagcaacaccaacaacggcagcaugguggugcacagcagcuacgacgagaucgagggcggcggccugcuggccaccccccagcugaccaacaagaaccccaagaugagcagaagcgugggcuacagcuaccccagccugccccccggcuaccagaacaccaccccccccggcgccaccggcgugccccccagcagccugaacuaccccagcggcccccaggccuucacccagaccccccugggcgccaaccaccugaccaccagcaugagcggccugagccugcagcccgagggccugagaguggugaaccugcugcaggagagaaacaugcugcccagcaccccccugaagccccccgugcccaaccugcacgaggacauccagaagcugaacugcaaccccgagcuguucagaugcacccugaccagcaucccccagacccaggcccugcugaacaaggccaagcugccccugggccugcugcugcaccccuucaaggaccuggugcagcugcccguggugaccagcagcaccaucgugagaugcagaagcugcagaaccuacaucaaccccuucgugagcuuccuggaccagagaagauggaagugcaaccugugcuacagagugaacgacgugcccgaggaguuccuguacaacccccugaccagaguguacggcgagccccacagaagacccgaggugcagaacgccaccaucgaguucauggcccccagcgaguacaugcugagacccccccagccccccguguaccuguucguguucgacgugagccacaacgccguggagaccggcuaccugaacagcgugugccagagccugcuggacaaccuggaccugcugcccggcaacaccagaaccaagaucggcuucaucaccuucgacagcaccauccacuucuacggccugcaggagagccugagccagccccagaugcugaucgugagcgacaucgaggacguguucauccccaugcccgagaaccugcuggugaaccugaacgagagcaaggagagcgugaucggcgugagcagcgaggagacccugaucaccugccuggagaucgccaugagauaa

SEQ ID NO: 23116 - RNA, 3702 nt, Artificial Sequence
  SEC24B__Homo_sapiens__NP_001036199
augagcgcccccgccggcagcagccaccccgccgccagcgccagaaucccccccaaguucggcggcgccgccgugagcggcgccgccgcccccgccggccccggcgccggccccgccccccaccagcagaacggccccgcccagaaccagaugcaggugcccagcggcuacggccugcaccaccagaacuacaucgcccccagcggccacuacagccagggccccggcaagaugaccagccugccccuggacacccagugcggcgacuacuacagcgcccuguacaccgugcccacccagaacgugacccccaacaccgugaaccagcagcccggcgcccagcagcuguacagcagaggcccccccgccccccacaucgugggcagcacccugggcagcuuccagggcgccgccagcagcgccagccaccugcacaccagcgccagccagcccuacagcagcuucgugaaccacuacaacagccccgccauguacagcgccagcagcagcguggccagccagggcuuccccagcaccugcggccacuacgccaugagcaccgugagcaacgccgccuaccccagcgugagcuaccccagccugcccgccggcgacaccuacggccagauguucaccagccagaacgcccccaccgugagacccgugaaggacaacagcuucagcggccagaacaccgccaucagccaccccagcccccugcccccccugcccagccagcagcaccaccagcagcagagccugagcggcuacagcacccugaccuggagcagccccggccugcccagcacccaggacaaccugaucagaaaccacaccggcagccuggccguggccaacaacaaccccaccaucaccguggccgacagccugagcugccccgugaugcagaacgugcagccccccaagagcagccccguggugagcaccgugcugagcggcagcagcggcagcagcagcaccagaaccccccccaccgccaaccaccccguggagcccgugaccagcgugacccagcccagcgagcugcugcagcagaagggcguggacagcagcagcaccaccagcagcgccagccccaugcccaacagcuacgacgcccuggagggcggcagcuaccccgacaugcugagcagcagcgccagcagccccgcccccgaccccgcccccgagcccgaccccgccagcgcccccgcccccgccagcgcccccgcccccguggugccccagcccagcaagauggccaagcccuucggcuacggcuaccccacccugcagcccggcuaccagaacgccaccgccccccugaucagcggcgugcagcccagcaaccccguguacagcggcuuccagcaguacccccagcaguaccccggcgugaaccagcugagcagcagcaucggcggccugagccugcagagcagcccccagcccgagagccugagacccgugaaccugacccaggagagaaacauccugcccaugacccccgugugggcccccgugcccaaccugaacgccgaccugaagaagcugaacugcagccccgacagcuucagaugcacccugaccaacaucccccagacccaggcccugcugaacaaggccaagcugccccugggccugcugcugcaccccuucagagaccugacccagcugcccgugaucaccagcaacaccaucgugagaugcagaagcugcagaaccuacaucaaccccuucgugagcuucaucgaccagagaagauggaagugcaaccugugcuacagagugaacgacgugcccgaggaguucauguacaacccccugaccagaagcuacggcgagccccacaagagacccgaggugcagaacagcaccguggaguucaucgccagcagcgacuacaugcugagacccccccagcccgccguguaccuguucgugcuggacgugagccacaacgccguggaggccggcuaccugaccauccugugccagagccugcuggagaaccuggacaagcugcccggcgacagcagaaccagaaucggcuucaugaccuucgacagcaccauccacuucuacaaccugcaggagggccugagccagccccagaugcugaucgugagcgacaucgacgacguguuccugcccacccccgacagccugcuggugaaccuguacgagagcaaggagcugaucaaggaccugcugaacgcccugcccaacauguucaccaacaccagagagacccacagcgcccugggccccgcccugcaggccgccuucaagcugaugagccccaccggcggcagagugagcguguuccagacccagcugcccagccugggcgccggccugcugcagagcagagaggaccccaaccagagaagcagcaccaagguggugcagcaccugggccccgccaccgacuucuacaagaagcuggcccuggacugcagcggccagcagaccgccguggaccuguuccugcugagcagccaguacagcgaccuggccagccuggccugcaugagcaaguacagcgccggcugcaucuacuacuaccccagcuuccacuacacccacaaccccagccaggccgagaagcugcagaaggaccugaagagauaccugaccagaaagaucggcuucgaggccgugaugagaaucagaugcaccaagggccugagcaugcacaccuuccacggcaacuucuucgugagaagcaccgaccugcugagccuggccaacaucaaccccgacgccggcuucgccgugcagcugagcaucgaggagagccugaccgacaccagccuggugugcuuccagaccgcccugcuguacaccagcagcaagggcgagagaagaaucagagugcacacccugugccugcccguggugagcagccuggccgacguguacgccggcguggacgugcaggccgccaucugccugcuggccaacauggccguggacagaagcgugagcagcagccugagcgacgccagagacgcccuggugaacgccgugguggacagccugagcgccuacggcagcaccgugagcaaccugcagcacagcgcccugauggcccccagcagccugaagcuguucccccuguacgugcuggcccugcugaagcagaaggccuucagaaccggcaccagcaccagacuggacgacagaguguacgccaugugccagaucaagagccagccccuggugcaccugaugaagaugauccaccccaaccuguacagaaucgacagacugaccgacgagggcgccgugcacgugaacgacagaaucgugccccagcccccccugcagaagcugagcgccgagaagcugaccagagagggcgccuuccugauggacugcggcagcguguucuacaucugggugggcaagggcugcgacaacaacuucaucgaggacgugcugggcuacaccaacuucgccagcaucccccagaagaugacccaccugcccgagcuggacacccugagcagcgagagagccagaagcuucaucaccuggcugagagacagcagaccccugagccccauccugcacaucgugaaggacgagagccccgccaaggccgaguucuuccagcaccugaucgaggacagaaccgaggccgccuucagcuacuacgaguuccugcugcacgugcagcagcagaucugcaaguaa

SEQ ID NO: 23117 - RNA, 3285 nt, Artificial Sequence
  SEC24C__Homo_sapiens__NP_940999
augaacgugaaccagagcgugccccccgugccccccuucggccagccccagcccaucuaccccggcuaccaccagagcagcuacggcggccagagcggcagcaccgcccccgccauccccuacggcgccuacaacggccccgugcccggcuaccagcagacccccccccagggcaugagcagagccccccccagcagcggcgccccccccgccagcaccgcccaggcccccugcggccaggccgccuacggccaguucggccagggcgacgugcagaacggccccagcagcaccgugcagaugcagagacugcccggcagccagcccuucggcagcccccuggcccccgugggcaaccagccccccgugcugcagcccuacggccccccccccaccagcgcccagguggccacccagcugagcggcaugcagaucagcggcgccguggcccccgccccccccagcagcggccugggcuucggcccccccaccagccuggccagcgccagcggcagcuuccccaacagcggccuguacggcagcuacccccagggccaggcccccccccugagccaggcccagggccaccccggcauccagaccccccagagaagcgcccccagccaggccagcagcuucaccccccccgccagcggcggccccagacugcccagcaugaccggcccccugcugcccggccagagcuucggcggccccagcgugagccagcccaaccacgugagcagccccccccaggcccugccccccggcacccagaugaccggcccccugggcccccugccccccaugcacagcccccagcagcccggcuaccagccccagcagaacggcagcuucggccccgccagaggcccccagagcaacuacggcggccccuaccccgccgcccccaccuucggcagccagcccggccccccccagccccugccccccaagagacuggaccccgacgccauccccagccccauccaggugaucgaggacgacagaaacaacagaggcaccgagcccuucgugaccggcgugagaggccaggugcccccccuggugaccaccaacuuccuggugaaggaccagggcaacgccagccccagauacaucagaugcaccagcuacaacauccccugcaccagcgacauggccaagcaggcccaggugccccuggccgccgugaucaagccccuggccagacugccccccgaggaggccagccccuacgugguggaccacggcgagagcggcccccugagaugcaacagaugcaaggccuacaugugccccuucaugcaguucaucgagggcggcagaagauuccagugcugcuucugcagcugcaucaacgacgugcccccccaguacuuccagcaccuggaccacaccggcaagagaguggacgccuacgacagacccgagcugagccugggcagcuacgaguuccuggccaccguggacuacugcaagaacaacaaguuccccagcccccccgccuucaucuucaugaucgacgugagcuacaacgccaucagaaccggccuggugagacugcugugcgaggagcugaagagccugcuggacuuccugcccagagagggcggcgccgaggagagcgccaucagagugggcuucgugaccuacaacaaggugcugcacuucuacaacgugaagagcagccuggcccagccccagaugaugguggugagcgacguggccgacauguucgugccccugcuggacggcuuccuggugaacgugaacgagagcagagccgugaucaccagccugcuggaccagauccccgagauguucgccgacaccagagagaccgagaccguguucgugcccgugauccaggccggcauggaggcccugaaggccgccgagugcgccggcaagcuguuccuguuccacaccagccugcccaucgccgaggcccccggcaagcugaagaacagagacgacagaaagcugaucaacaccgacaaggagaagacccuguuccagccccagaccggcgccuaccagacccuggccaaggagugcguggcccagggcugcugcguggaccuguuccuguuccccaaccaguacguggacguggccacccugagcguggugccccagcugaccggcggcagcguguacaaguacgccagcuuccagguggagaacgaccaggagagauuccugagcgaccugagaagagacgugcagaagguggugggcuucgacgccgugaugagagugagaaccagcaccggcaucagagccguggacuucuucggcgccuucuacaugagcaacaccaccgacguggagcuggccggccuggacggcgacaagaccgugaccguggaguucaagcacgacgacagacugaacgaggagagcggcgcccugcugcagugcgcccugcuguacaccagcugcgccggccagagaagacugagaauccacaaccuggcccugaacugcugcacccagcuggccgaccuguacagaaacugcgagaccgacacccugaucaacuacauggccaaguucgccuacagaggcgugcugaacagccccgugaaggccgugagagacacccugaucacccagugcgcccagauccuggccugcuacagaaagaacugcgccagccccagcagcgccggccagcugauccugcccgagugcaugaagcugcugcccguguaccugaacugcgugcugaagagcgacgugcugcagcccggcgccgaggugaccaccgacgacagagccuacgugagacagcuggugaccagcauggacgugaccgagaccaacguguucuucuaccccagacugcugccccugaccaagagccccguggagagcaccaccgagccccccgccgugagagccagcgaggagagacugagcaacggcgacaucuaccugcuggagaacggccugaaccuguuccugugggugggcgccagcgugcagcagggcguggugcagagccuguucagcgugagcagcuucagccagaucaccagcggccugagcgugcugcccgugcuggacaacccccugagcaagaaggugagaggccugaucgacagccugagagcccagagaagcagauacaugaagcugaccguggugaagcaggaggacaagauggagaugcuguucaagcacuuccugguggaggacaagagccugagcggcggcgccagcuacguggacuuccugugccacaugcacaaggagaucagacagcugcugagcuaa

SEQ ID NO: 23118 - RNA, 3321 nt, Artificial Sequence
  SEC31A__Homo_sapiens__NP_001070674
augaagcugaaggagguggacagaaccgccaugcaggccuggagccccgcccagaaccaccccaucuaccuggccaccggcaccagcgcccagcagcuggacgccaccuucagcaccaacgccagccuggagaucuucgagcuggaccugagcgaccccagccuggacaugaagagcugcgccaccuucagcagcagccacagauaccacaagcugaucuggggccccuacaagauggacagcaagggcgacgugagcggcgugcugaucgccggcggcgagaacggcaacaucauccuguacgaccccagcaagaucaucgccggcgacaaggagguggugaucgcccagaacgacaagcacaccggccccgugagagcccuggacgugaacaucuuccagaccaaccugguggccagcggcgccaacgagagcgagaucuacaucugggaccugaacaacuucgccacccccaugacccccggcgccaagacccagccccccgaggacaucagcugcaucgccuggaacagacaggugcagcacauccuggccagcgccagccccagcggcagagccaccgugugggaccugagaaagaacgagcccaucaucaaggugagcgaccacagcaacagaaugcacugcagcggccuggccuggcaccccgacguggccacccagauggugcuggccagcgaggacgacagacugcccgugauccagaugugggaccugagauucgccagcagcccccugagagugcuggagaaccacgccagaggcauccuggccaucgccuggagcauggccgaccccgagcugcugcugagcugcggcaaggacgccaagauccugugcagcaaccccaacaccggcgaggugcuguacgagcugcccaccaacacccaguggugcuucgacauccaguggugccccagaaaccccgccgugcugagcgccgccagcuucgacggcagaaucagcguguacagcaucaugggcggcagcaccgacggccugagacagaagcagguggacaagcugagcagcagcuucggcaaccuggaccccuucggcaccggccagccccugcccccccugcagaucccccagcagaccgcccagcacagcaucgugcugccccugaagaagccccccaaguggaucagaagacccgugggcgccagcuucagcuucggcggcaagcuggugaccuucgagaacgugagaaugcccagccaccagggcgccgagcagcagcagcagcagcaccacguguucaucagccagguggugaccgagaaggaguuccugagcagaagcgaccagcugcagcaggccgugcagagccagggcuucaucaacuacugccagaagaagaucgacgccagccagaccgaguucgagaagaacguguggagcuuccugaaggugaacuucgaggacgacagcagaggcaaguaccuggagcugcugggcuacagaaaggaggaccugggcaagaagaucgcccuggcccugaacaagguggacggcgccaacguggcccugaaggacagcgaccagguggcccagagcgacggcgaggagagccccgccgccgaggagcagcugcugggcgagcacaucaaggaggagaaggaggagagcgaguuccugcccagcagcggcggcaccuucaacaucagcgugagcggcgacaucgacggccugaucacccaggcccugcugaccggcaacuucgagagcgccguggaccugugccugcacgacaacagaauggccgacgccaucauccuggccaucgccggcggccaggagcugcuggccagaacccagaagaaguacuucgccaagagccagagcaagaucaccagacugaucaccgccguggugaugaagaacuggaaggagaucguggagagcugcgaccugaagaacuggagagaggcccuggccgccgugcugaccuacgccaagcccgacgaguucagcgcccugugcgaccugcugggcaccagacuggagaacgagggcgacagccugcugcagacccaggccugccugugcuacaucugcgccggcaacguggagaagcugguggccugcuggaccaaggcccaggacggcagccacccccugagccugcaggaccugaucgagaagguggugauccugagaaaggccgugcagcugacccaggccauggacaccagcaccgugggcgugcugcuggccgccaagaugagccaguacgccaaccugcuggccgcccagggcagcaucgccgccgcccuggccuuccugcccgacaacaccaaccagcccaacaucaugcagcugagagacagacugugcagagcccagggcgagcccguggccggccacgagagccccaagauccccuacgagaagcagcagcugcccaagggcagacccggccccguggccggccaccaccagaugcccagagugcagacccagcaguacuacccccacggcgagaacccccccccccccggcuucaucaugcacggcaacgugaaccccaacgccgccggccagcugcccaccagccccggccacaugcacacccaggugccccccuacccccagccccagagaccccagaacggcuggaacgacccccccgcccugaacagagugcccaagaagaagaagaugcccgagaacuucaugccccccgugcccaucaccagccccaucaugaacccccugggcgacccccagagccagaugcugcagcagcagcccagcgcccccgugccccugagcagccagagcagcuucccccagccccaccugcccggcggccagcccuuccacggcgugcagcagccccugggccagaccggcaugccccccagcuucagcaagcccaacaucgagggcgcccccggcgcccccaucggcaacaccuuccagcacgugcagagccugcccaccaagaagaucaccaagaagcccauccccgacgagcaccugauccugaagaccaccuucgaggaccugauccagagaugccugagcagcgccaccgacccccagaccaagagaaagcuggacgacgccagcaagagacuggaguuccuguacgacaagcugagagagcagacccugagccccaccaucaccagcggccugcacaacaucgccagaagcaucgagaccagaaacuacagcgagggccugaccaugcacacccacaucgugagcaccagcaacuucagcgagaccagcgccuucaugcccgugcugaagguggugcugacccaggccaacaagcugggcguguaa

SEQ ID NO: 23119 - RNA, 1431 nt, Artificial Sequence
  SEC61A1__Homo_sapiens__NP_037468
auggccaucaaguuccuggaggugaucaagcccuucugcgugauccugcccgagauccagaagcccgagagaaagauccaguucaaggagaaggugcuguggaccgccaucacccuguucaucuuccuggugugcugccagaucccccuguucggcaucaugagcagcgacagcgccgaccccuucuacuggaugagagugauccuggccagcaacagaggcacccugauggagcugggcaucagccccaucgugaccagcggccugaucaugcagcugcuggccggcgccaagaucaucgaggugggcgacacccccaaggacagagcccuguucaacggcgcccagaagcuguucggcaugaucaucaccaucggccagagcaucguguacgugaugaccggcauguacggcgaccccagcgagaugggcgccggcaucugccugcugaucaccauccagcuguucguggccggccugaucgugcugcugcuggacgagcugcugcagaagggcuacggccugggcagcggcaucagccuguucaucgccaccaacaucugcgagaccaucguguggaaggccuucagccccaccaccgugaacaccggcagaggcauggaguucgagggcgccaucaucgcccuguuccaccugcuggccaccagaaccgacaaggugagagcccugagagaggccuucuacagacagaaccugcccaaccugaugaaccugaucgccaccaucuucguguucgccguggugaucuacuuccagggcuucagaguggaccugcccaucaagagcgccagauacagaggccaguacaacaccuaccccaucaagcuguucuacaccagcaacauccccaucauccugcagagcgcccuggugagcaaccuguacgugaucagccagaugcugagcgccagauucagcggcaaccugcuggugagccugcugggcaccuggagcgacaccagcagcggcggccccgccagagccuaccccgugggcggccugugcuacuaccugagcccccccgagagcuucggcagcgugcuggaggaccccgugcacgccgugguguacaucguguucaugcugggcagcugcgccuucuucagcaagaccuggaucgaggugagcggcagcagcgccaaggacguggccaagcagcugaaggagcagcagauggugaugagaggccacagagagaccagcauggugcacgagcugaacagauacauccccaccgccgccgccuucggcggccugugcaucggcgcccugagcgugcuggccgacuuccugggcgccaucggcagcggcaccggcauccugcuggccgugaccaucaucuaccaguacuucgagaucuucgugaaggagcagagcgaggugggcagcaugggcgcccugcuguucuaa

SEQ ID NO: 23120 - RNA, 207 nt, Artificial Sequence
  SEC61G__Homo_sapiens__NP_055117
auggaccaggugaugcaguucguggagcccagcagacaguucgugaaggacagcaucagacuggugaagagaugcaccaagcccgacagaaaggaguuccagaagaucgccauggccaccgccaucggcuucgccaucaugggcuucaucggcuucuucgugaagcugauccacauccccaucaacaacaucaucgugggcggcuaa

SEQ ID NO: 23121 - RNA, 1200 nt, Artificial Sequence
  SEC62__Homo_sapiens__NP_003253
auggccgagagaagaagacacaagaagagaauccaggaggugggcgagcccagcaaggaggagaaggccguggccaaguaccugagauucaacugccccaccaagagcaccaacaugaugggccacagaguggacuacuucaucgccagcaaggccguggacugccugcuggacagcaagugggccaaggccaagaagggcgaggaggcccuguucaccaccagagagagcgugguggacuacugcaacagacugcugaagaagcaguucuuccacagagcccugaaggugaugaagaugaaguacgacaaggacaucaagaaggagaaggacaagggcaaggccgagagcggcaaggaggaggacaagaagagcaagaaggagaacaucaaggacgagaagaccaagaaggagaaggagaagaagaaggacggcgagaaggaggagagcaagaaggaggagacccccggcacccccaagaagaaggagaccaagaagaaguucaagcuggagccccacgacgaccagguguuccuggacggcaacgagguguacguguggaucuacgaccccgugcacuucaagaccuucgugaugggccugauccuggugaucgccgugaucgccgccacccuguucccccuguggcccgccgagaugagagugggcguguacuaccugagcgugggcgccggcugcuucguggccagcauccugcugcuggccguggccagaugcauccuguuccugaucaucuggcugaucaccggcggcagacaccacuucugguuccugcccaaccugaccgccgacgugggcuucaucgacagcuucagaccccuguacacccacgaguacaagggccccaaggccgaccugaagaaggacgagaagagcgagaccaagaagcagcagaagagcgacagcgaggagaagagcgacagcgagaagaaggaggacgaggagggcaaggugggccccggcaaccacggcaccgagggcagcggcggcgagagacacagcgacaccgacagcgacagaagagaggacgacagaagccagcacagcagcggcaacggcaacgacuucgagaugaucaccaaggaggagcuggagcagcagaccgacggcgacugcgaggaggacgaggaggaggagaacgacggcgagacccccaagagcagccacgagaagagcuaa

SEQ ID NO: 23122 - RNA, 2283 nt, Artificial Sequence
  SEC63__Homo_sapiens__NP_009145
auggccggccagcaguuccaguacgacgacagcggcaacaccuucuucuacuuccugaccagcuucgugggccugaucgugauccccgccaccuacuaccuguggcccagagaccagaacgccgagcagaucagacugaagaacaucagaaagguguacggcagaugcaugugguacagacugagacugcugaagccccagcccaacaucauccccaccgugaagaagaucgugcugcuggccggcugggcccuguuccuguuccuggccuacaaggugagcaagaccgacagagaguaccaggaguacaaccccuacgaggugcugaaccuggaccccggcgccaccguggccgagaucaagaagcaguacagacugcugagccugaaguaccaccccgacaagggcggcgacgaggugauguucaugagaaucgccaaggccuacgccgcccugaccgacgaggagagcagaaagaacugggaggaguucggcaaccccgacggcccccaggccaccagcuucggcaucgcccugcccgccuggaucguggaccagaagaacagcauccuggugcugcugguguacggccuggccuucauggugauccugcccgugguggugggcagcuggugguacagaagcaucagauacagcggcgaccagauccugaucagaaccacccagaucuacaccuacuucguguacaagaccagaaacauggacaugaagagacugaucauggugcuggccggcgccagcgaguucgacccccaguacaacaaggacgccaccagcagacccaccgacaacauccugaucccccagcugaucagagagaucggcagcaucaaccugaagaagaacgagcccccccugaccugccccuacagccugaaggccagagugcugcugcugagccaccuggccagaaugaagauccccgagacccuggaggaggaccagcaguucaugcugaagaagugccccgcccugcugcaggagauggugaacgugaucugccagcugaucgugauggccagaaacagagaggagagagaguucagagcccccacccuggccagccuggagaacugcaugaagcugagccagauggccgugcagggccugcagcaguucaagagcccccugcugcagcugccccacaucgaggaggacaaccugagaagagugagcaaccacaagaaguacaagaucaagaccauccaggaccuggugagccugaaggagagcgacagacacacccugcugcacuuccuggaggacgagaaguacgaggaggugauggccgugcugggcagcuuccccuacgugaccauggacaucaagagccaggugcuggacgacgaggacagcaacaacaucaccgugggcagccuggugaccgugcuggugaagcugaccagacagaccauggccgagguguucgagaaggagcagagcaucugcgccgccgaggagcagcccgccgaggacggccagggcgagaccaacaagaacagaaccaagggcggcuggcagcagaagagcaagggccccaagaagaccgccaagagcaagaagaagaagccccugaagaagaagcccacccccgugcugcugccccagagcaagcagcagaagcagaagcaggccaacggcguggugggcaacgaggccgccgugaaggaggacgaggaggaggugagcgacaagggcagcgacagcgaggaggaggagaccaacagagacagccagagcgagaaggacgacggcagcgacagagacagcgacagagagcaggacgagaagcagaacaaggacgacgaggccgaguggcaggagcugcagcagagcauccagagaaaggagagagcccugcuggagaccaagagcaagaucacccaccccguguacagccuguacuuccccgaggagaagcaggaguggugguggcuguacaucgccgacagaaaggagcagacccugaucagcaugcccuaccacgugugcacccugaaggacaccgaggagguggagcugaaguuccccgcccccggcaagcccggcaacuaccaguacaccguguuccugagaagcgacagcuacaugggccuggaccagaucaagccccugaagcuggaggugcacgaggccaagcccgugcccgagaaccacccccagugggacaccgccaucgagggcgacgaggaccaggaggacagcgagggcuucgaggacagcuucgaggaggaggaggaggaggaggaggacgacgacuaa

SEQ ID NO: 23123 - RNA, 2565 nt, Artificial Sequence
  SECISBP2__Homo_sapiens__NP_076982
auggccagcgagggccccagagagcccgagagcgagggcaucaagcugagcgccgacgugaagcccuucgugcccagauucgccggccugaacguggccuggcuggagagcagcgaggccugcguguuccccagcagcgccgccaccuacuaccccuucgugcaggagccccccgugaccgagcagaagaucuacaccgaggacauggccuucggcgccagcaccuuccccccccaguaccugagcagcgagaucacccugcaccccuacgccuacagccccuacacccuggacagcacccagaacguguacagcgugcccggcagccaguaccuguacaaccagcccagcugcuacagaggcuuccagaccgugaagcacagaaacgagaacaccugcccccugccccaggagaugaaggcccuguucaagaagaagaccuacgacgagaagaagaccuacgaccagcagaaguucgacagcgagagagccgacggcaccaucagcagcgagaucaagagcgccagaggcagccaccaccugagcaucuacgccgagaacagccugaagagcgacggcuaccacaagagaaccgacagaaagagcagaaucaucgccaagaacgugagcaccagcaagcccgaguucgaguucaccacccuggacuuccccgagcugcagggcgccgagaacaacaugagcgagauccagaagcagcccaaguggggccccgugcacagcgugagcaccgacaucagccugcugagagagguggugaagcccgccgccgugcugagcaagggcgagaucguggugaagaacaaccccaacgagagcgugaccgccaacgccgccaccaacagccccagcugcaccagagagcugagcuggacccccaugggcuacguggugagacagacccugagcaccgagcugagcgccgcccccaagaacgugaccagcaugaucaaccugaagaccaucgccagcagcgccgaccccaagaacgugagcauccccagcagcgaggcccugagcagcgaccccagcuacaacaaggagaagcacaucauccaccccacccagaagagcaaggccagccagggcagcgaccuggagcagaacgaggccagcagaaagaacaagaagaagaaggagaagagcaccagcaaguacgaggugcugaccgugcaggagccccccagaaucgaggacgccgaggaguuccccaaccuggccguggccagcgagagaagagacagaaucgagacccccaaguuccagagcaagcagcagccccaggacaacuucaagaacaacgugaagaagagccagcugcccgugcagcuggaccugggcggcaugcugaccgcccuggagaagaagcagcacagccagcacgccaagcagagcagcaagcccgugguggugagcgugggcgccgugcccgugcugagcaaggagugcgccagcggcgagagaggcagaagaaugagccagaugaagaccccccacaacccccuggacagcagcgccccccugaugaagaagggcaagcagagagagauccccaaggccaagaagcccaccagccugaagaagaucauccugaaggagagacaggagagaaagcagagacugcaggagaacgccgugagccccgccuucaccagcgacgacacccaggacggcgagagcggcggcgacgaccaguuccccgagcaggccgagcugagcggccccgagggcauggacgagcugaucagcacccccagcguggaggacaagagcgaggagccccccggcaccgagcugcagagagacaccgaggccagccaccuggcccccaaccacaccaccuuccccaagauccacagcagaagauucagagacuacugcagccagaugcugagcaaggagguggacgccugcgugaccgaccugcugaaggagcuggugagauuccaggacagaauguaccagaaggaccccgugaaggccaagaccaagagaagacuggugcugggccugagagaggugcugaagcaccugaagcugaagaagcugaagugcgugaucaucagccccaacugcgagaagauccagagcaagggcggccuggacgacacccugcacaccaucaucgacuacgccugcgagcagaacauccccuucguguucgcccugaacagaaaggcccugggcagaagccugaacaaggccgugcccgugagcguggugggcaucuucagcuacgacggcgcccaggaccaguuccacaagaugguggagcugaccguggccgccagacaggccuacaagaccaugcuggagaacgugcagcaggagcuggugggcgagcccagaccccaggccccccccagccugcccacccagggccccagcugccccgccgaggacggcccccccgcccugaaggagaaggaggagccccacuacaucgagaucuggaagaagcaccuggaggccuacagcggcugcacccuggagcuggaggagagccuggaggccagcaccagccagaugaugaaccugaaccuguaa

SEQ ID NO: 23124 - RNA, 3306 nt, Artificial Sequence
  SECISBP2L__Homo_sapiens__NP_001180418
auggacagagcccccaccgagcagaacgugaagcugagcgccgagguggagcccuucaucccccagaagaagagccccgacaccuucaugauccccauggcccugcccaacgacaacggcagcgugagcggcguggagcccacccccauccccagcuaccugaucaccugcuaccccuucgugcaggagaaccagagcaacagacaguucccccuguacaacaacgacaucagauggcagcagcccaaccccaaccccaccggccccuacuucgccuaccccaucaucagcgcccagccccccgugagcaccgaguacaccuacuaccagcugaugcccgcccccugcgcccaggugaugggcuucuaccaccccuuccccacccccuacagcaacaccuuccaggccgccaacaccgugaacgccaucaccaccgagugcaccgagagacccagccagcugggccagguguucccccugagcagccacagaagcagaaacagcaacagaggcagcguggugcccaagcagcagcugcugcagcagcacaucaagagcaagagaccccuggugaagaacguggccacccagaaggagaccaacgccgccggccccgacagcagaagcaagaucgugcugcugguggacgccagccagcagaccgacuuccccagcgacaucgccaacaagagccugagcgagaccaccgccaccaugcuguggaagagcaagggcagaagaagaagagccagccaccccaccgccgagagcagcagcgagcagggcgccagcgaggccgacaucgacagcgacagcggcuacugcagccccaagcacagcaacaaccagcccgccgccggcgcccugagaaaccccgacagcggcaccaugaaccacguggagagcagcaugugcgccggcggcgugaacuggagcaacgugaccugccaggccacccagaagaagcccuggauggagaagaaccagaccuucagcagaggcggcagacagaccgagcagagaaacaacagccaggugggcuucagaugcagaggccacagcaccagcagcgagagaagacagaaccugcagaagagacccgacaacaagcaccugagcagcagccagagccacagaagcgaccccaacagcgagagccuguacuucgaggacgaggacggcuuccaggagcugaacgagaacggcaacgccaaggacgagaacauccagcagaagcugagcagcaaggugcuggacgaccugcccgagaacagccccaucaacaucgugcagacccccauccccaucaccaccagcgugcccaagagagccaagagccagaagaagaaggcccuggccgccgcccuggccaccgcccaggaguacagcgagaucagcauggagcagaagaagcugcaggaggcccugagcaaggccgccggcaagaagaacaagacccccgugcagcuggaccugggcgacaugcuggccgcccuggagaagcagcagcaggccaugaaggccagacagaucaccaacaccagaccccugagcuacaccguggugaccgccgccagcuuccacaccaaggacagcaccaacagaaagccccugaccaagagccagcccugccugaccagcuucaacagcguggacaucgccagcagcaaggccaagaagggcaaggagaaggagaucgccaagcugaagagacccaccgcccugaagaaggugauccugaaggagagagaggagaagaagggcagacugaccguggaccacaaccugcugggcagcgaggagcccaccgagaugcaccuggacuucaucgacgaccugccccaggagaucgugagccaggaggacaccggccugagcaugcccagcgacaccagccugagccccgccagccagaacagccccuacugcaugacccccgugagccagggcagccccgccagcagcggcaucggcagccccauggccagcagcaccaucaccaagauccacagcaagagauucagagaguacugcaaccaggugcugugcaaggagaucgacgagugcgugacccugcugcugcaggagcuggugagcuuccaggagagaaucuaccagaaggaccccgugagagccaaggccagaagaagacuggugaugggccugagagaggugaccaagcacaugaagcugaacaagaucaagugcgugaucaucagccccaacugcgagaagauccagagcaagggcggccuggacgaggcccuguacaacgugaucgccauggccagagagcaggagauccccuucguguucgcccugggcagaaaggcccugggcagaugcgugaacaagcuggugcccgugagcguggugggcaucuucaacuacuucggcgccgagagccuguucaacaagcugguggagcugaccgaggaggccagaaaggccuacaaggacaugguggccgccauggagcaggagcaggccgaggaggcccugaagaacgugaagaaggugccccaccacaugggccacagcagaaaccccagcgccgccagcgccaucagcuucugcagcgugaucagcgagcccaucagcgaggugaacgagaaggaguacgagaccaacuggagaaacaugguggagaccagcgacggccuggaggccagcgagaacgagaaggaggugagcugcaagcacagcaccagcgagaagcccagcaagcugcccuucgacaccccccccaucggcaagcagcccagccugguggccaccggcagcaccaccagcgccaccagcgccggcaagagcaccgccagcgacaaggaggaggugaagcccgacgaccuggagugggccagccagcagagcaccgagaccggcagccuggacggcagcugcagagaccugcugaacagcagcaucaccagcaccaccagcacccuggugcccggcaugcuggaggaggaggaggacgaggacgaggaggaggaggaggacuacacccacgagcccaucagcguggaggugcagcugaacagcagaaucgagagcugggugagcgagacccagagaaccauggagacccugcagcugggcaagacccugaacggcagcgaggaggacaacguggagcagagcggcgaggaggaggccgaggcccccgaggugcuggagcccggcauggacagcgaggccuggaccgccgaccagcaggccagccccggccagcagaagagcagcaacugcagcagccugaacaaggagcacagcgacagcaacuacaccacccagaccaccuaa

SEQ ID NO: 23125 - RNA, 747 nt, Artificial Sequence
  SECTM1__Homo_sapiens__NP_002995
augcagaccugcccccuggccuuccccggccacgugagccaggcccugggcacccugcuguuccuggccgccagccugagcgcccagaacgagggcugggacagccccaucugcaccgagggcguggugagcgugagcuggggcgagaacaccgugaugagcugcaacaucagcaacgccuucagccacgugaacaucaagcugagagcccacggccaggagagcgccaucuucaacgagguggcccccggcuacuucagcagagacggcuggcagcugcaggugcagggcggcguggcccagcuggugaucaagggcgccagagacagccacgccggccuguacauguggcaccuggugggccaccagagaaacaacagacaggugacccuggaggugagcggcgccgagccccagagcgcccccgacaccggcuucuggcccgugcccgccguggugaccgccguguucauccugcugguggcccuggugauguucgccugguacagaugcagaugcagccagcagagaagagagaagaaguucuuccugcuggagccccagaugaagguggccgcccugagagccggcgcccagcagggccugagcagagccagcgccgagcuguggacccccgacagcgagcccacccccagaccccuggcccugguguucaagcccagcccccugggcgcccuggagcugcugagcccccagccccuguuccccuacgccgccgaccccuaa

SEQ ID NO: 23126 - RNA, 906 nt, Artificial Sequence
  SEL1L__Homo_sapiens__NP_001231913
augagagugagaaucggccugacccugcugcugugcgccgugcugcugagccuggccagcgccagcagcgacgaggagggcagccaggacgagagccuggacagcaagaccacccugaccagcgacgagagcgugaaggaccacaccaccgccggcagagugguggccggccagaucuuccuggacagcgaggagagcgagcuggagagcagcauccaggaggaggaggacagccugaagagccaggagggcgagagcgugaccgaggacaucagcuuccuggagagccccaaccccgagaacaaggacuacgaggagcccaagaaggugagaaagcccgcccugaccgccaucgagggcaccgcccacggcgagcccugccacuuccccuuccuguuccuggacaaggaguacgacgagugcaccagcgacggcagagaggacggcagacuguggugcgccaccaccuacgacuacaaggccgacgagaaguggggcuucugcgagaccgaggaggaggccgccaagagaagacagaugcaggaggccgagaugauguaccagaccggcaugaagauccugaacggcagcaacaagaagagccagaagagagaggccuacagauaccugcagaaggccgccagcaugaaccacaccaaggcccuggagagagugagcuacgcccugcuguucggcgacuaccugccccagaacauccaggccgccagagagauguucgagaagcugaccgaggagggcagccccaagggccagaccgcccugggcuuccuguacgccagcggccugggcgugaacagcagccaggccaaggcccugguguacuacaccuucggcgcccugggcggcaaccugaucgcccacauggugcuggugagcagacuguaa

SEQ ID NO: 23127 - RNA, 1833 nt, Artificial Sequence
  SELE__Homo_sapiens__NP_000441
augaucgccagccaguuccugagcgcccugacccuggugcugcugaucaaggagagcggcgccuggagcuacaacaccagcaccgaggccaugaccuacgacgaggccagcgccuacugccagcagagauacacccaccugguggccauccagaacaaggaggagaucgaguaccugaacagcauccugagcuacagccccagcuacuacuggaucggcaucagaaaggugaacaacgugugggugugggugggcacccagaagccccugaccgaggaggccaagaacugggcccccggcgagcccaacaacagacagaaggacgaggacugcguggagaucuacaucaagagagagaaggacgugggcauguggaacgacgagagaugcagcaagaagaagcuggcccugugcuacaccgccgccugcaccaacaccagcugcagcggccacggcgagugcguggagaccaucaacaacuacaccugcaagugcgaccccggcuucagcggccugaagugcgagcagaucgugaacugcaccgcccuggagagccccgagcacggcagccuggugugcagccacccccugggcaacuucagcuacaacagcagcugcagcaucagcugcgacagaggcuaccugcccagcagcauggagaccaugcagugcaugagcagcggcgaguggagcgcccccauccccgccugcaacgugguggagugcgacgccgugaccaaccccgccaacggcuucguggagugcuuccagaaccccggcagcuuccccuggaacaccaccugcaccuucgacugcgaggagggcuucgagcugaugggcgcccagagccugcagugcaccagcagcggcaacugggacaacgagaagcccaccugcaaggccgugaccugcagagccgugagacagccccagaacggcagcgugagaugcagccacagccccgccggcgaguucaccuucaagagcagcugcaacuucaccugcgaggagggcuucaugcugcagggccccgcccagguggagugcaccacccagggccaguggacccagcagauccccgugugcgaggccuuccagugcaccgcccugagcaaccccgagagaggcuacaugaacugccugcccagcgccagcggcagcuucagauacggcagcagcugcgaguucagcugcgagcagggcuucgugcugaagggcagcaagagacugcagugcggccccaccggcgagugggacaacgagaagcccaccugcgaggccgugagaugcgacgccgugcaccagccccccaagggccuggugagaugcgcccacagccccaucggcgaguucaccuacaagagcagcugcgccuucagcugcgaggagggcuucgagcugcacggcagcacccagcuggagugcaccagccagggccaguggaccgaggaggugcccagcugccagguggugaagugcagcagccuggccgugcccggcaagaucaacaugagcugcagcggcgagcccguguucggcaccgugugcaaguucgccugccccgagggcuggacccugaacggcagcgccgccagaaccugcggcgccaccggccacuggagcggccugcugcccaccugcgaggcccccaccgagagcaacaucccccugguggccggccugagcgccgccggccugagccugcugacccuggcccccuuccugcuguggcugagaaagugccugagaaaggccaagaaguucgugcccgccagcagcugccagagccuggagagcgacggcagcuaccagaagcccagcuacauccuguaa

SEQ ID NO: 23128 - RNA, 1233 nt, Artificial Sequence
  SELENBP1__Homo_sapiens__NP_001245217
auggccaccaagugcggcaacugcggccccggcuacagcaccccccuggaggccaugaagggccccagagaggagaucguguaccugcccugcaucuacagaaacaccggcaccgaggcccccgacuaccuggccaccguggacguggaccccaagagcccccaguacugccaggugaucgagcccaaggacauccacgccaagugcgagcuggccuuccugcacaccagccacugccuggccagcggcgaggugaugaucagcagccugggcgacgugaagggcaacggcaagggcggcuucgugcugcuggacggcgagaccuucgaggugaagggcaccugggagagacccggcggcgccgccccccugggcuacgacuucugguaccagcccagacacaacgugaugaucagcaccgagugggccgcccccaacgugcugagagacggcuucaaccccgccgacguggaggccggccuguacggcagccaccuguacgugugggacuggcagagacacgagaucgugcagacccugagccugaaggacggccugaucccccuggagaucagauuccugcacaaccccgacgccgcccagggcuucgugggcugcgcccugagcagcaccauccagagauucuacaagaacgagggcggcaccuggagcguggagaaggugauccaggugccccccaagaaggugaagggcuggcugcugcccgagaugcccggccugaucaccgacauccugcugagccuggacgacagauuccuguacuucagcaacuggcugcacggcgaccugagacaguacgacaucagcgacccccagagacccagacugaccggccagcuguuccugggcggcagcaucgugaagggcggccccgugcaggugcuggaggacgaggagcugaagagccagcccgagccccugguggugaagggcaagagaguggccggcggcccccagaugauccagcugagccuggacggcaagagacuguacaucaccaccagccuguacagcgccugggacaagcaguucuaccccgaccugaucagagagggcagcgugaugcugcagguggacguggacaccgugaagggcggccugaagcugaaccccaacuuccugguggacuucggcaaggagccccugggccccgcccuggcccacgagcugagauaccccggcggcgacugcagcagcgacaucuggaucuaa

SEQ ID NO: 23129 - RNA, 1158 nt, Artificial Sequence
  SELL__Homo_sapiens__NP_000646
augggcugcagaagaaccagagagggccccagcaaggccaugaucuuccccuggaagugccagagcacccagagagaccuguggaacaucuucaagcuguggggcuggaccaugcugugcugcgacuuccuggcccaccacggcaccgacugcuggaccuaccacuacagcgagaagcccaugaacuggcagagagccagaagauucugcagagacaacuacaccgaccugguggccauccagaacaaggccgagaucgaguaccuggagaagacccugcccuucagcagaagcuacuacuggaucggcaucagaaagaucggcggcaucuggaccugggugggcaccaacaagagccugaccgaggaggccgagaacuggggcgacggcgagcccaacaacaagaagaacaaggaggacugcguggagaucuacaucaagagaaacaaggacgccggcaaguggaacgacgacgccugccacaagcugaaggccgcccugugcuacaccgccagcugccagcccuggagcugcagcggccacggcgagugcguggagaucaucaacaacuacaccugcaacugcgacgugggcuacuacggcccccagugccaguucgugauccagugcgagccccuggaggcccccgagcugggcaccauggacugcacccacccccugggcaacuucagcuucagcagccagugcgccuucagcugcagcgagggcaccaaccugaccggcaucgaggagaccaccugcggccccuucggcaacuggagcagccccgagcccaccugccaggugauccagugcgagccccugagcgcccccgaccugggcaucaugaacugcagccacccccuggccagcuucagcuucaccagcgccugcaccuucaucugcagcgagggcaccgagcugaucggcaagaagaagaccaucugcgagagcagcggcaucuggagcaaccccagccccaucugccagaagcuggacaagagcuucagcaugaucaaggagggcgacuacaacccccuguucauccccguggccgugauggugaccgccuucagcggccuggccuucaucaucuggcuggccagaagacugaagaagggcaagaagagcaagagaagcaugaacgaccccuacuaa

SEQ ID NO: 23130 - RNA, 2493 nt, Artificial Sequence
  SELP__Homo_sapiens__NP_002996
auggccaacugccagaucgccauccuguaccagagauuccagagagugguguucggcaucagccagcugcugugcuucagcgcccugaucagcgagcugaccaaccagaaggagguggccgccuggaccuaccacuacagcaccaaggccuacagcuggaacaucagcagaaaguacugccagaacagauacaccgaccugguggccauccagaacaagaacgagaucgacuaccugaacaaggugcugcccuacuacagcagcuacuacuggaucggcaucagaaagaacaacaagaccuggaccugggugggcaccaagaaggcccugaccaacgaggccgagaacugggccgacaacgagcccaacaacaagagaaacaacgaggacugcguggagaucuacaucaagagccccagcgcccccggcaaguggaacgacgagcacugccugaagaagaagcacgcccugugcuacaccgccagcugccaggacaugagcugcagcaagcagggcgagugccuggagaccaucggcaacuacaccugcagcugcuaccccggcuucuacggccccgagugcgaguacgugagagagugcggcgagcuggagcugccccagcacgugcugaugaacugcagccacccccugggcaacuucagcuucaacagccagugcagcuuccacugcaccgacggcuaccaggugaacggccccagcaagcuggagugccuggccagcggcaucuggaccaacaagcccccccagugccuggccgcccagugccccccccugaagauccccgagagaggcaacaugaccugccugcacagcgccaaggccuuccagcaccagagcagcugcagcuucagcugcgaggagggcuucgcccuggugggccccgagguggugcagugcaccgccagcggcguguggaccgcccccgcccccgugugcaaggccgugcagugccagcaccuggaggcccccagcgagggcaccauggacugcgugcacccccugaccgccuucgccuacggcagcagcugcaaguucgagugccagcccggcuacagagugagaggccuggacaugcugagaugcaucgacagcggccacuggagcgccccccugcccaccugcgaggccaucagcugcgagccccuggagagccccgugcacggcagcauggacugcagccccagccugagagccuuccaguacgacaccaacugcagcuucagaugcgccgagggcuucaugcugagaggcgccgacaucgugagaugcgacaaccugggccaguggaccgcccccgcccccgugugccaggcccugcagugccaggaccugcccgugcccaacgaggccagagugaacugcagccaccccuucggcgccuucagauaccagagcgugugcagcuucaccugcaacgagggccugcugcuggugggcgccagcgugcugcagugccuggccaccggcaacuggaacagcgugccccccgagugccaggccauccccugcaccccccugcugagcccccagaacggcaccaugaccugcgugcagccccugggcagcagcagcuacaagagcaccugccaguucaucugcgacgagggcuacagccugagcggccccgagagacuggacugcaccagaagcggcagauggaccgacagcccccccaugugcgaggccaucaagugccccgagcuguucgcccccgagcagggcagccuggacugcagcgacaccagaggcgaguucaacgugggcagcaccugccacuucagcugcgacaacggcuucaagcuggagggccccaacaacguggagugcaccaccagcggcagauggagcgccaccccccccaccugcaagggcaucgccagccugcccacccccggcgugcagugccccgcccugaccacccccggccagggcaccauguacugcagacaccaccccggcaccuucggcuucaacaccaccugcuacuucggcugcaacgccggcuucacccugaucggcgacagcacccugagcugcagacccagcggccaguggaccgccgugacccccgccugcagagccgugaagugcagcgagcugcacgugaacaagcccaucgccaugaacugcagcaaccuguggggcaacuucagcuacggcagcaucugcagcuuccacugccuggagggccagcugcugaacggcagcgcccagaccgccugccaggagaacggccacuggagcaccaccgugcccaccugccaggccggcccccugaccauccaggaggcccugaccuacuucggcggcgccguggccagcaccaucggccugaucaugggcggcacccugcuggcccugcugagaaagagauucagacagaaggacgacggcaagugcccccugaacccccacagccaccugggcaccuacggcguguucaccaacgccgccuucgaccccagccccuaa

SEQ ID NO: 23131 - RNA, 1287 nt, Artificial Sequence
  SELPLG__Homo_sapiens__NP_001193538
auggccgugggcgccagcggccuggagggcgacaagauggccggcgccaugccccugcagcugcugcugcugcugauccugcugggccccggcaacagccugcagcugugggacaccugggccgacgaggccgagaaggcccugggcccccugcuggccagagacagaagacaggccaccgaguacgaguaccuggacuacgacuuccugcccgagaccgagccccccgagaugcugagaaacagcaccgacaccaccccccugaccggccccggcacccccgagagcaccaccguggagcccgccgccagaagaagcaccggccuggacgccggcggcgccgugaccgagcugaccaccgagcuggccaacaugggcaaccugagcaccgacagcgccgccauggagauccagaccacccagcccgccgccaccgaggcccagaccacccagcccgugcccaccgaggcccagaccaccccccuggccgccaccgaggcccagaccaccagacugaccgccaccgaggcccagaccaccccccuggccgccaccgaggcccagaccaccccccccgccgccaccgaggcccagaccacccagcccaccggccuggaggcccagaccaccgcccccgccgccauggaggcccagaccaccgcccccgccgccauggaggcccagaccaccccccccgccgccauggaggcccagaccacccagaccaccgccauggaggcccagaccaccgcccccgaggccaccgaggcccagaccacccagcccaccgccaccgaggcccagaccaccccccuggccgccauggaggcccugagcaccgagcccagcgccaccgaggcccugagcauggagcccaccaccaagagaggccuguucauccccuucagcgugagcagcgugacccacaagggcauccccauggccgccagcaaccugagcgugaacuaccccgugggcgcccccgaccacaucagcgugaagcagugccugcuggccauccugauccuggcccugguggccaccaucuucuucgugugcaccguggugcuggccgugagacugagcagaaagggccacauguaccccgugagaaacuacagccccaccgagauggugugcaucagcagccugcugcccgacggcggcgagggccccagcgccaccgccaacggcggccugagcaaggccaagagccccggccugacccccgagcccagagaggacagagagggcgacgaccugacccugcacagcuuccugcccuaa

SEQ ID NO: 23132 - RNA, 2316 nt, Artificial Sequence
  SEMA3A__Homo_sapiens__XP_006715902
augggcuggcugaccagaaucgugugccuguucuggggcgugcugcugaccgccagagccaacuaccagaacggcaagaacaacgugcccagacugaagcugagcuacaaggagaugcuggagagcaacaacgugaucaccuucaacggccuggccaacagcagcagcuaccacaccuuccugcuggacgaggagagaagcagacuguacgugggcgccaaggaccacaucuucagcuucgaccuggugaacaucaaggacuuccagaagaucguguggcccgugagcuacaccagaagagacgagugcaagugggccggcaaggacauccugaaggagugcgccaacuucaucaaggugcugaaggccuacaaccagacccaccuguacgccugcggcaccggcgccuuccaccccaucugcaccuacaucgagaucggccaccaccccgaggacaacaucuucaagcuggagaacagccacuucgagaacggcagaggcaagagccccuacgaccccaagcugcugaccgccagccugcugaucgacggcgagcuguacagcggcaccgccgccgacuucaugggcagagacuucgccaucuucagaacccugggccaccaccaccccaucagaaccgagcagcacgacagcagauggcugaacgaccccaaguucaucagcgcccaccugaucagcgagagcgacaaccccgaggacgacaagguguacuucuucuucagagagaacgccaucgacggcgagcacagcggcaaggccacccacgccagaaucggccagaucugcaagaacgacuucggcggccacagaagccuggugaacaaguggaccaccuuccugaaggccagacugaucugcagcgugcccggccccaacggcaucgacacccacuucgacgagcugcaggacguguuccugaugaacuucaaggaccccaagaaccccgugguguacggcguguucaccaccagcagcaacaucuucaagggcagcgccgugugcauguacagcaugagcgacgugagaagaguguuccugggccccuacgcccacagagacggccccaacuaccagugggugcccuaccagggcagagugcccuaccccagacccggcaccugccccagcaagaccuucggcggcuucgacagcaccaaggaccugcccgacgacgugaucaccuucgccagaagccaccccgccauguacaaccccguguuccccaugaacaacagacccaucgugaucaagaccgacgugaacuaccaguucacccagaucgugguggacagaguggacgccgaggacggccaguacgacgugauguucaucggcaccgacgugggcaccgugcugaagguggugagcauccccaaggagaccugguacgaccuggaggaggugcugcuggaggagaugaccguguucagagagcccaccgccaucagcgccauggagcugagcaccaagcagcagcagcuguacaucggcagcaccgccggcguggcccagcugccccugcacagaugcgacaucuacggcaaggccugcgccgagugcugccuggccagagaccccuacugcgccugggacggcagcgccugcagcagauacuuccccaccgccaagagaagaaccagaagacaggacaucagaaacggcgacccccugacccacugcagcgaccugcaccacgacaaccaccacggccacagccccgaggagagaaucaucuacggcguggagaacagcagcaccuuccuggagugcagccccaagagccagagagcccugguguacuggcaguuccagagaagaaacgaggagagaaaggaggagaucagaguggacgaccacaucaucagaaccgaccagggccugcugcugagaagccugcagcagaaggacagcggcaacuaccugugccacgccguggagcacggcuucauccagacccugcugaaggugacccuggaggugaucgacaccgagcaccuggaggagcugcugcacaaggacgacgacggcgacggcagcaagaccaaggagaugagcaacagcaugacccccagccagaaggugugguacagagacuucaugcagcugaucaaccaccccaaccugaacaccauggacgaguucugcgagcagguguggaagagagacagaaagcagagaagacagagacccggccacacccccggcaacagcaacaaguggaagcaccugcaggagaacaagaagggcagaaacagaagaacccacgaguucgagagagcccccagaagcguguaa

SEQ ID NO: 23133 - RNA, 2250 nt, Artificial Sequence
  SEMA3B__Homo_sapiens__NP_001276989
augggcagagccggcgccgccgccgugauccccggccuggcccugcugugggccgugggccugggcagcgccgcccccagcccccccagacugagacugagcuuccaggagcugcaggccuggcacggccugcagaccuucagccuggagagaaccugcugcuaccaggcccugcugguggacgaggagagaggcagacuguucgugggcgccgagaaccacguggccagccugaaccuggacaacaucagcaagagagccaagaagcuggccuggcccgcccccguggaguggagagaggagugcaacugggccggcaaggacaucggcaccgagugcaugaacuucgugaagcugcugcacgccuacaacagaacccaccugcuggccugcggcaccggcgccuuccaccccaccugcgccuucguggaggugggccacagagccgaggagcccgugcugagacuggaccccggcagaaucgaggacggcaagggcaagagccccuacgaccccagacacagagccgccagcgugcuggugggcgaggagcuguacagcggcguggccgccgaccugaugggcagagacuucaccaucuucagaagccugggccagagacccagccugagaaccgagccccacgacagcagauggcugaacgagcccaaguucgugaagguguucuggauccccgagagcgagaaccccgacgacgacaagaucuacuucuucuucagagagaccgccguggaggccgcccccgcccugggcagacugagcgugagcagagugggccagaucugcagaaacgacgugggcggccagagaagccuggugaacaaguggaccaccuuccugaaggccagacuggugugcagcgugcccggcguggagggcgacacccacuucgaccagcugcaggacguguuccugcugagcagcagagaccacagaaccccccugcuguacgccguguucagcaccagcagcagcaucuuccagggcagcgccgugugcguguacagcaugaacgacgugagaagagccuuccugggccccuucgcccacaaggagggccccaugcaccagugggugagcuaccagggcagagugcccuaccccagacccggcaugugccccagcaagaccuucggcaccuucagcagcaccaaggacuuccccgacgacgugauccaguucgccagaaaccacccccugauguacaacagcgugcugcccaccggcggcagaccccuguuccugcaggugggcgccaacuacaccuucacccagaucgccgccgacagaguggccgccgccgacggccacuacgacgugcuguucaucggcaccgacgugggcaccgugcugaaggugaucagcgugcccaagggcagcagacccagcgccgagggccugcugcuggaggagcugcacguguucgaggacagcgccgccgugaccagcaugcagaucagcagcaagagacaccagcuguacguggccagcagaagcgccguggcccagaucgcccugcacagaugcgccgcccacggcagagugugcaccgagugcugccuggccagagaccccuacugcgccugggacggcguggccugcaccagauuccagcccagcgccaagagaagauucagaagacaggacgugagaaacggcgaccccagcacccugugcagcggcgacagcagcagacccgcccugcuggagcacaagguguucggcguggagggcagcagcgccuuccuggagugcgagcccagaagccugcaggccagaguggaguggaccuuccagagagccggcgugaccgcccacacccaggugcuggccgaggagagaaccgagagaaccgccagaggccugcugcugagaagacugagaagaagagacagcggcguguaccugugcgccgccguggagcagggcuucacccagccccugagaagacugagccugcacgugcugagcgccacccaggccgagagacuggccagagccgaggaggccgcccccgccgccccccccggccccaagcugugguacagagacuuccugcagcugguggagcccggcggcggcggcagcgccaacagccugagaaugugcagaccccagcccgcccugcagagccugccccuggagagcagaagaaagggcagaaacagaagaacccacgcccccgagcccagagccgagagaggccccagaagcgccacccacugguaa

SEQ ID NO: 23134 - RNA, 2256 nt, Artificial Sequence
  SEMA3C__Homo_sapiens__NP_006370
auggccuucagaaccaucugcgugcuggugggcguguucaucugcagcaucugcgugaagggcagcagccagccccaggccagaguguaccugaccuucgacgagcugagagagaccaagaccagcgaguacuucagccugagccaccacccccuggacuacagaauccugcugauggacgaggaccaggacagaaucuacgugggcagcaaggaccacauccugagccugaacaucaacaacaucagccaggaggcccugagcguguucuggcccgccagcaccaucaagguggaggagugcaagauggccggcaaggaccccacccacggcugcggcaacuucgugagagugauccagaccuucaacagaacccaccuguacgugugcggcagcggcgccuucagccccgugugcaccuaccugaacagaggcagaagaagcgaggaccagguguucaugaucgacagcaagugcgagagcggcaagggcagaugcagcuucaaccccaacgugaacaccgugagcgugaugaucaacgaggagcuguucagcggcauguacaucgacuucaugggcaccgacgccgccaucuucagaagccugaccaagagaaacgccgugagaaccgaccagcacaacagcaaguggcugagcgagcccauguucguggacgcccacgugauccccgacggcaccgaccccaacgacgccaagguguacuucuucuucaaggagaagcugaccgacaacaacagaagcaccaagcagauccacagcaugaucgccagaaucugccccaacgacaccggcggccugagaagccuggugaacaaguggaccaccuuccugaaggccagacuggugugcagcgugaccgacgaggacggccccgagacccacuucgacgagcuggaggacguguuccugcuggagaccgacaaccccagaaccacccugguguacggcaucuucaccaccagcagcagcguguucaagggcagcgccgugugcguguaccaccugagcgacauccagaccguguucaacggccccuucgcccacaaggagggccccaaccaccagcugaucagcuaccagggcagaauccccuaccccagacccggcaccugccccggcggcgccuucacccccaacaugagaaccaccaaggaguuccccgacgacguggugaccuucaucagaaaccacccccugauguacaacagcaucuaccccauccacaagagaccccugaucgugagaaucggcaccgacuacaaguacaccaagaucgccguggacagagugaacgccgccgacggcagauaccacgugcuguuccugggcaccgacagaggcaccgugcagaaggugguggugcugcccaccaacaacagcgugagcggcgagcugauccuggaggagcuggagguguucaagaaccacgcccccaucaccaccaugaagaucagcagcaagaagcagcagcuguacgugagcagcaacgagggcgugagccaggugagccugcacagaugccacaucuacggcaccgccugcgccgacugcugccuggccagagaccccuacugcgccugggacggccacagcugcagcagauucuaccccaccggcaagagaagaagcagaagacaggacgugagacacggcaacccccugacccagugcagaggcuucaaccugaaggccuacagaaacgccgccgagaucgugcaguacggcgugaagaacaacaccaccuuccuggagugcgcccccaagagcccccaggccagcaucaaguggcugcugcagaaggacaaggacagaagaaaggaggugaagcugaacgagagaaucaucgccaccagccagggccugcugaucagaagcgugcagggcagcgaccagggccuguaccacugcaucgccaccgagaacagcuucaagcagaccaucgccaagaucaacuucaaggugcuggacagcgagaugguggccguggugaccgacaaguggagccccuggaccugggccagcagcgugagagcccugcccuuccaccccaaggacaucaugggcgccuucagccacagcgagaugcagaugaucaaccaguacugcaaggacaccagacagcagcaccagcagggcgacgagagccagaagaugagaggcgacuacggcaagcugaaggcccugaucaacagcagaaagagcagaaacagaagaaaccagcugcccgagagcuaa

SEQ ID NO: 23135 - RNA, 2334 nt, Artificial Sequence
  SEMA3D__Homo_sapiens__NP_689967
augaacgccaacaaggacgagagacugaaggccagaagccaggacuuccaccuguuccccgcccugaugaugcugagcaugaccaugcuguuccugcccgugaccggcacccugaagcagaacauccccagacugaagcugaccuacaaggaccugcugcugagcaacagcugcauccccuuccugggcagcagcgagggccuggacuuccagacccugcugcuggacgaggagagaggcagacugcugcugggcgccaaggaccacaucuuccugcugagccugguggaccugaacaagaacuucaagaagaucuacuggcccgccgccaaggagagaguggagcugugcaagcuggccggcaaggacgccaacaccgagugcgccaacuucaucagagugcugcagcccuacaacaagacccacaucuacgugugcggcaccggcgccuuccaccccaucugcggcuacaucgaccugggcguguacaaggaggacaucaucuucaagcuggacacccacaaccuggagagcggcagacugaagugccccuucgacccccagcagcccuucgccagcgugaugaccgacgaguaccuguacagcggcaccgccagcgacuuccugggcaaggacaccgccuucaccagaagccugggccccacccacgaccaccacuacaucagaaccgacaucagcgagcacuacuggcugaacggcgccaaguucaucggcaccuucuucauccccgacaccuacaaccccgacgacgacaagaucuacuucuucuucagagagagcagccaggagggcagcaccagcgacaagaccauccugagcagagugggcagagugugcaagaacgacgugggcggccagagaagccugaucaacaaguggaccaccuuccugaaggccagacugaucugcagcauccccggcagcgacggcgccgacaccuacuucgacgagcugcaggacaucuaccugcugcccaccagagacgagagaaaccccgugguguacggcguguucaccaccaccagcagcaucuucaagggcagcgccgugugcguguacagcauggccgacaucagagccguguucaacggccccuacgcccacaaggagagcgccgaccacagaugggugcaguacgacggcagaauccccuaccccagacccggcaccugccccagcaagaccuacgacccccugaucaagagcaccagagacuuccccgacgacgugaucagcuucaucaagagacacagcgugauguacaagagcguguaccccguggccggcggccccaccuucaagagaaucaacguggacuacagacugacccagaucgugguggaccacgugaucgccgaggacggccaguacgacgugauguuccugggcaccgacaucggcaccgugcugaagguggugagcaucagcaaggagaaguggaacauggaggagguggugcuggaggagcugcagaucuucaagcacagcagcaucauccugaacauggagcugagccugaagcagcagcagcuguacaucggcagcagagacggccuggugcagcugagccugcacagaugcgacaccuacggcaaggccugcgccgacugcugccuggccagagaccccuacugcgccugggacggcaacgccugcagcagauacgcccccaccagcaagagaagagccagaagacaggacgugaaguacggcgaccccaucacccagugcugggacaucgaggacagcaucagccacgagaccgccgacgagaaggugaucuucggcaucgaguucaacagcaccuuccuggagugcauccccaagagccagcaggccaccaucaagugguacauccagagaagcggcgacgagcacagagaggagcugaagcccgacgagagaaucaucaagaccgaguacggccugcugaucagaagccugcagaagaaggacagcggcauguacuacugcaaggcccaggagcacaccuucauccacaccaucgugaagcugacccugaacgugaucgagaacgagcagauggagaacacccagagagccgagcacgaggagggcaaggugaaggaccugcuggccgagagcagacugagauacaaggacuacauccagauccugagcagccccaacuucagccuggaccaguacugcgagcagauguggcacagagagaagagaagacagagaaacaagggcggccccaaguggaagcacaugcaggagaugaagaagaagagaaacagaagacaccacagagaccuggacgagcugcccagagccguggccaccuaa

SEQ ID NO: 23136 - RNA, 2148 nt, Artificial Sequence
  SEMA3E__Homo_sapiens__NP_001171600
augcugcuggacgaguaccaggagagacuguucgugggcggcagagaccugguguacagccugagccuggagagaaucagcgacggcuacaaggagauccacuggcccagcaccgcccugaagauggaggagugcaucaugaagggcaaggacgccggcgagugcgccaacuacgugagagugcugcaccacuacaacagaacccaccugcugaccugcggcaccggcgccuucgaccccgugugcgccuucaucagagugggcuaccaccuggaggacccccuguuccaccuggagagccccagaagcgagagaggcagaggcagaugccccuucgaccccagcagcagcuucaucagcacccugaucggcagcgagcuguucgccggccuguacagcgacuacuggagcagagacgccgccaucuucagaagcaugggcagacuggcccacaucagaaccgagcacgacgacgagagacugcugaaggagcccaaguucgugggcagcuacaugauccccgacaacgaggacagagacgacaacaagguguacuucuucuucaccgagaaggcccuggaggccgagaacaacgcccacgccaucuacaccagagugggcagacugugcgugaacgacgugggcggccagagaauccuggugaacaaguggagcaccuuccugaaggccagacuggugugcagcgugcccggcaugaacggcaucgacaccuacuucgacgagcuggaggacguguuccugcugcccaccagagaccacaagaaccccgugaucuucggccuguucaacaccaccagcaacaucuucagaggccacgccaucugcguguaccacaugagcagcaucagagccgccuucaacggccccuacgcccacaaggagggccccgaguaccacuggagcguguacgagggcaaggugcccuaccccagacccggcagcugcgccagcaaggugaacggcggcagauacggcaccaccaaggacuaccccgacgacgccaucagauucgccagaagccacccccugauguaccaggccaucaagcccgcccacaagaagcccauccuggugaagaccgacggcaaguacaaccugaagcagaucgccguggacagaguggaggccgaggacggccaguacgacgugcuguucaucggcaccgacaacggcaucgugcugaaggugaucaccaucuacaaccaggagauggagagcauggaggaggugauccuggaggagcugcagaucuucaaggaccccgugcccaucaucagcauggagaucagcagcaagagacagcagcuguacaucggcagcgccagcgccguggcccaggugagauuccaccacugcgacauguacggcagcgccugcgccgacugcugccuggccagagaccccuacugcgccugggacggcaucagcugcagcagauacuaccccaccggcacccacgccaagagaagauucagaagacaggacgugagacacggcaacgccgcccagcagugcuucggccagcaguucgugggcgacgcccuggacaagaccgaggagcaccuggccuacggcaucgagaacaacagcacccugcuggagugcacccccagaagccugcaggccaaggugaucugguucgugcagaagggcagagagaccagaaaggaggaggugaagaccgacgacagaguggugaagauggaccugggccugcuguuccugagacugcacaagagcgacgccggcaccuacuucugccagaccguggagcacagcuucgugcacaccgugagaaagaucacccuggaggugguggaggaggagaagguggaggacauguucaacaaggacgacgaggaggacagacaccacagaaugcccugccccgcccagagcagcaucagccagggcgccaagcccugguacaaggaguuccugcagcugaucggcuacagcaacuuccagagaguggaggaguacugcgagaagguguggugcaccgacagaaagagaaagaagcugaagaugagccccagcaaguggaaguacgccaacccccaggagaagaagcugagaagcaagcccgagcacuacagacugcccagacacacccuggacagcuaa

SEQ ID NO: 23137 - RNA, 2358 nt, Artificial Sequence
  SEMA3F__Homo_sapiens__NP_004177
augcugguggccggccugcugcugugggccagccugcugaccggcgccuggcccagcuuccccacccaggaccaccugcccgccacccccagagugagacugagcuucaaggagcugaaggccaccggcaccgcccacuucuucaacuuccugcugaacaccaccgacuacagaauccugcugaaggacgaggaccacgacagaauguacgugggcagcaaggacuacgugcugagccuggaccugcacgacaucaacagagagccccugaucauccacugggccgccagcccccagagaaucgaggagugcgugcugagcggcaaggacgugaacggcgagugcggcaacuucgugagacugauccagcccuggaacagaacccaccuguacgugugcggcaccggcgccuacaaccccaugugcaccuacgugaacagaggcagaagagcccaggccacccccuggacccagacccaggccgugagaggcagaggcagcagagccaccgacggcgcccugagacccaugcccaccgcccccagacaggacuacaucuucuaccuggagcccgagagacuggagagcggcaagggcaagugccccuacgaccccaagcuggacaccgccagcgcccugaucaacgaggagcuguacgccggcguguacaucgacuucaugggcaccgacgccgccaucuucagaacccugggcaagcagaccgccaugagaaccgaccaguacaacagcagauggcugaacgaccccagcuucauccacgccgagcugauccccgacagcgccgagagaaacgacgacaagcuguacuucuucuucagagagagaagcgccgaggccccccagagccccgccguguacgccagaaucggcagaaucugccugaacgacgacggcggccacugcugccuggugaacaaguggagcaccuuccugaaggccagacuggugugcagcgugcccggcgaggacggcaucgagacccacuucgacgagcugcaggacguguucgugcagcagacccaggacgugagaaaccccgugaucuacgccguguucaccagcagcggcagcguguucagaggcagcgccgugugcguguacagcauggccgacaucagaaugguguucaacggccccuucgcccacaaggagggccccaacuaccaguggaugcccuucagcggcaagaugcccuaccccagacccggcaccugccccggcggcaccuucacccccagcaugaagagcaccaaggacuaccccgacgaggugaucaacuucaugagaagccacccccugauguaccaggccguguacccccugcagagaagaccccugguggugagaaccggcgcccccuacagacugaccaccaucgccguggaccagguggacgccgccgacggcagauacgaggugcuguuccugggcaccgacagaggcaccgugcagaaggugaucgugcugcccaaggacgaccaggagcuggaggagcugaugcuggaggagguggagguguucaaggaccccgcccccgugaagaccaugaccaucagcagcaagagacagcagcuguacguggccagcgccgugggcgugacccaccugagccugcacagaugccaggccuacggcgccgccugcgccgacugcugccuggccagagaccccuacugcgccugggacggccaggccugcagcagauacaccgccagcagcaagagaagaagcagaagacaggacgugagacacggcaaccccaucagacagugcagaggcuucaacagcaacgccaacaagaacgccguggagagcgugcaguacggcguggccggcagcgccgccuuccuggagugccagcccagaagcccccaggccaccgugaaguggcuguuccagagagaccccggcgacagaagaagagagaucagagccgaggacagauuccugagaaccgagcagggccugcugcugagagcccugcagcugagcgacagaggccuguacagcugcaccgccaccgagaacaacuucaagcacguggugaccagagugcagcugcacgugcugggcagagacgccgugcacgccgcccuguuccccccccugagcaugagcgccccccccccccccggcgccggcccccccaccccccccuaccaggagcuggcccagcugcuggcccagcccgaggugggccugauccaccaguacugccagggcuacuggagacacgugccccccagccccagagaggcccccggcgcccccagaagccccgagccccaggaccagaagaagcccagaaacagaagacaccacccccccgacaccuaa

SEQ ID NO: 23138 - RNA, 2349 nt, Artificial Sequence
  SEMA3G__Homo_sapiens__NP_064548
auggcccccagcgccugggccaucugcuggcugcugggcggccugcugcugcacggcggcagcagcggccccagccccggccccagcgugcccagacugagacugagcuacagagaccugcugagcgccaacagaagcgccaucuuccugggcccccagggcagccugaaccugcaggccauguaccuggacgaguacagagacagacuguuccugggcggccuggacgcccuguacagccugagacuggaccaggccuggcccgaccccagagaggugcuguggcccccccagcccggccagagagaggagugcgugagaaagggcagagacccccugaccgagugcgccaacuucgugagagugcugcagccccacaacagaacccaccugcuggccugcggcaccggcgccuuccagcccaccugcgcccugaucaccgugggccacagaggcgagcacgugcugcaccuggagcccggcagcguggagagcggcagaggcagaugcccccacgagcccagcagacccuucgccagcaccuucaucgacggcgagcuguacaccggccugaccgccgacuuccugggcagagaggccaugaucuucagaagcggcggccccagacccgcccugagaagcgacagcgaccagagccugcugcacgaccccagauucgugauggccgccagaauccccgagaacagcgaccaggacaacgacaagguguacuucuucuucagcgagaccgugcccagccccgacggcggcagcaaccacgugaccgugagcagagugggcagagugugcgugaacgacgccggcggccagagagugcuggugaacaaguggagcaccuuccugaaggccagacuggugugcagcgugcccggccccggcggcgccgagacccacuucgaccagcuggaggacguguuccugcuguggcccaaggccggcaagagccuggagguguacgcccuguucagcaccgugagcgccguguuccagggcuucgccgugugcguguaccacauggccgacaucugggagguguucaacggccccuucgcccacagagacggcccccagcaccaguggggccccuacggcggcaaggugcccuuccccagacccggcgugugccccagcaagaugaccgcccagcccggcagacccuucggcagcaccaaggacuaccccgacgaggugcugcaguucgccagagcccacccccugauguucuggcccgugagacccagacacggcagacccgugcuggugaagacccaccuggcccagcagcugcaccagaucgugguggacagaguggaggccgaggacggcaccuacgacgugaucuuccugggcaccgacagcggcagcgugcugaaggugaucgcccugcaggccggcggcagcgccgagcccgaggagguggugcuggaggagcugcagguguucaaggugcccacccccaucaccgagauggagaucagcgugaagagacagaugcuguacgugggcagcagacugggcguggcccagcugagacugcaccagugcgagaccuacggcaccgccugcgccgagugcugccuggccagagaccccuacugcgccugggacggcgccagcugcacccacuacagacccagccugggcaagagaagauucagaagacaggacaucagacacggcaaccccgcccugcagugccugggccagagccaggaggaggaggccgugggccugguggccgccaccaugguguacggcaccgagcacaacagcaccuuccuggagugccugcccaagagcccccaggccgccgugagauggcugcugcagagacccggcgacgagggccccgaccaggugaagaccgacgagagagugcugcacaccgagagaggccugcuguucagaagacugagcagauucgacgccggcaccuacaccugcaccacccuggagcacggcuucagccagaccguggugagacuggcccugguggugaucguggccagccagcuggacaaccuguucccccccgagcccaagcccgaggagccccccgccagaggcggccuggccagcaccccccccaaggccugguacaaggacauccugcagcugaucggcuucgccaaccugcccagaguggacgaguacugcgagagaguguggugcagaggcaccaccgagugcagcggcugcuucagaagcagaagcagaggcaagcaggccagaggcaagagcugggccggccuggagcugggcaagaagaugaagagcagagugcacgccgagcacaacagaacccccagagagguggaggccaccuaa

SEQ ID NO: 23139 - RNA, 1890 nt, Artificial Sequence
  SEMA4A__Homo_sapiens__NP_001180231
augauccccuggcccgccagcgacagaaagaagagcgagugcgccuucaagaagaagagcaacgaggagcugcaggacagcuaccugcugcccaucagcgaggacaaggugauggagggcaagggccagagccccuucgaccccgcccacaagcacaccgccgugcugguggacggcaugcuguacagcggcaccaugaacaacuuccugggcagcgagcccauccugaugagaacccugggcagccagcccgugcugaagaccgacaacuuccugagauggcugcaccacgacgccagcuucguggccgccauccccagcacccaggugguguacuucuucuucgaggagaccgccagcgaguucgacuucuucgagagacugcacaccagcagaguggccagagugugcaagaacgacgugggcggcgagaagcugcugcagaagaaguggaccaccuuccugaaggcccagcugcugugcacccagcccggccagcugcccuucaacgugaucagacacgccgugcugcugcccgccgacagccccaccgccccccacaucuacgccguguucaccagccaguggcaggugggcggcaccagaagcagcgccgugugcgccuucagccugcuggacaucgagagaguguucaagggcaaguacaaggagcugaacaaggagaccagcagauggaccaccuacagaggccccgagaccaaccccagacccggcagcugcagcgugggccccagcagcgacaaggcccugaccuucaugaaggaccacuuccugauggacgagcagguggugggcaccccccugcuggugaagagcggcguggaguacaccagacuggccguggagaccgcccagggccuggacggccacagccaccuggugauguaccugggcaccaccaccggcagccugcacaaggccguggugagcggcgacagcagcgcccaccugguggaggagauccagcuguuccccgaccccgagcccgugagaaaccugcagcuggcccccacccagggcgccguguucgugggcuucagcggcggcguguggagagugcccagagccaacugcagcguguacgagagcugcguggacugcgugcuggccagagacccccacugcgccugggaccccgagagcagaaccugcugccugcugagcgcccccaaccugaacagcuggaagcaggacauggagagaggcaaccccgagugggccugcgccagcggccccaugagcagaagccugagaccccagagcagaccccagaucaucaaggaggugcuggccgugcccaacagcauccuggagcugcccugcccccaccugagcgcccuggccagcuacuacuggagccacggccccgccgccgugcccgaggccagcagcaccguguacaacggcagccugcugcugaucgugcaggacggcgugggcggccuguaccagugcugggccaccgagaacggcuucagcuaccccgugaucagcuacuggguggacagccaggaccagacccuggcccuggaccccgagcuggccggcauccccagagagcacgugaaggugccccugaccagagugagcggcggcgccgcccuggccgcccagcagagcuacuggccccacuucgugaccgugaccgugcuguucgcccuggugcugagcggcgcccugaucauccugguggccagcccccugagagcccugagagccagaggcaaggugcagggcugcgagacccugagacccggcgagaaggccccccugagcagagagcagcaccugcagagccccaaggagugcagaaccagcgccagcgacguggacgccgacaacaacugccugggcaccgagguggccuaa

SEQ ID NO: 23140 - RNA, 2514 nt, Artificial Sequence
  SEMA4B__Homo_sapiens__NP_064595
augcugagaaccgccaugggccugagaagcuggcuggccgcccccuggggcgcccugccccccagacccccccugcugcugcugcugcugcugcugcugcugcugcagccccccccccccaccugggcccugagccccagaaucagccugccccugggcagcgaggagagacccuuccugagauucgaggccgagcacaucagcaacuacaccgcccugcugcugagcagagacggcagaacccuguacgugggcgccagagaggcccuguucgcccugagcagcaaccugagcuuccugcccggcggcgaguaccaggagcugcuguggggcgccgacgccgagaagaagcagcagugcagcuucaagggcaaggacccccagagagacugccagaacuacaucaagauccugcugccccugagcggcagccaccuguucaccugcggcaccgccgccuucagccccaugugcaccuacaucaacauggagaacuucacccuggccagagacgagaagggcaacgugcugcuggaggacggcaagggcagaugccccuucgaccccaacuucaagagcaccgcccuggugguggacggcgagcuguacaccggcaccgugagcagcuuccagggcaacgaccccgccaucagcagaagccagagccugagacccaccaagaccgagagcagccugaacuggcugcaggaccccgccuucguggccagcgccuacauccccgagagccugggcagccugcagggcgacgacgacaagaucuacuucuucuucagcgagaccggccaggaguucgaguucuucgagaacaccaucgugagcagaaucgccagaaucugcaagggcgacgagggcggcgagagagugcugcagcagagauggaccagcuuccugaaggcccagcugcugugcagcagacccgacgacggcuuccccuucaacgugcugcaggacguguucacccugagccccagcccccaggacuggagagacacccuguucuacggcguguucaccagccaguggcacagaggcaccaccgagggcagcgccgugugcguguucaccaugaaggacgugcagagaguguucagcggccuguacaaggaggugaacagagagacccagcagugguacaccgugacccaccccgugcccacccccagacccggcgccugcaucaccaacagcgccagagagagaaagaucaacagcagccugcagcugcccgacagagugcugaacuuccugaaggaccacuuccugauggacggccaggugagaagcagaaugcugcugcugcagccccaggccagauaccagagaguggccgugcacagagugcccggccugcaccacaccuacgacgugcuguuccugggcaccggcgacggcagacugcacaaggccgugagcgugggccccagagugcacaucaucgaggagcugcagaucuucagcagcggccagcccgugcagaaccugcugcuggacacccacagaggccugcuguacgccgccagccacagcggcguggugcaggugcccauggccaacugcagccuguacagaagcugcggcgacugccugcuggccagagaccccuacugcgccuggagcggcagcagcugcaagcacgugagccuguaccagccccagcuggccaccagacccuggauccaggacaucgagggcgccagcgccaaggaccugugcagcgccagcagcguggugagccccagcuucgugcccaccggcgagaagcccugcgagcaggugcaguuccagcccaacaccgugaacacccuggccugcccccugcugagcaaccuggccaccagacuguggcugagaaacggcgcccccgugaacgccagcgccagcugccacgugcugcccaccggcgaccugcugcuggugggcacccagcagcugggcgaguuccagugcuggagccuggaggagggcuuccagcagcugguggccagcuacugccccgaggugguggaggacggcguggccgaccagaccgacgagggcggcagcgugcccgugaucaucagcaccagcagagugagcgcccccgccggcggcaaggccagcuggggcgccgacagaagcuacuggaaggaguuccuggugaugugcacccuguucgugcuggccgugcugcugcccgugcuguuccugcuguacagacacagaaacagcaugaagguguuccugaagcagggcgagugcgccagcgugcaccccaagaccugccccguggugcugccccccgagaccagaccccugaacggccugggcccccccagcaccccccuggaccacagaggcuaccagagccugagcgacagcccccccggcagcagaguguucaccgagagcgagaagagaccccugagcauccaggacagcuucguggaggugagccccgugugccccagacccagagugagacugggcagcgagaucagagacagcgugguguaa

SEQ ID NO: 23141 - RNA, 2589 nt, Artificial Sequence
  SEMA4D__Homo_sapiens__XP_005251711
augagaaugugcacccccaucagaggccugcugauggcccuggccgugauguucggcaccgccauggccuucgcccccauccccagaaucaccugggagcacagagaggugcaccuggugcaguuccacgagcccgacaucuacaacuacagcgcccugcugcugagcgaggacaaggacacccuguacaucggcgccagagaggccguguucgccgugaacgcccugaacaucagcgagaagcagcacgagguguacuggaaggugagcgaggacaagaaggccaagugcgccgagaagggcaagagcaagcagaccgagugccugaacuacaucagagugcugcagccccugagcgccaccagccuguacgugugcggcaccaacgccuuccagcccgccugcgaccaccugaaccugaccagcuucaaguuccugggcaagaacgaggacggcaagggcagaugccccuucgaccccgcccacagcuacaccagcgugaugguggacggcgagcuguacagcggcaccagcuacaacuuccugggcagcgagcccaucaucagcagaaacagcagccacagcccccugagaaccgaguacgccauccccuggcugaacgagcccagcuucguguucgccgacgugaucagaaagagccccgacagccccgacggcgaggacgacagaguguacuucuucuucaccgaggugagcguggaguacgaguucguguucagagugcugauccccagaaucgccagagugugcaagggcgaccagggcggccugagaacccugcagaagaaguggaccagcuuccugaaggccagacugaucugcagcagacccgacagcggccugguguucaacgugcugagagacguguucgugcugagaagccccggccugaaggugcccguguucuacgcccuguucaccccccagcugaacaacgugggccugagcgccgugugcgccuacaaccugagcaccgccgaggagguguucagccacggcaaguacaugcagagcaccaccguggagcagagccacaccaagugggugagauacaacggccccgugcccaagcccagacccggcgccugcaucgacagcgaggccagagccgccaacuacaccagcagccugaaccugcccgacaagacccugcaguucgugaaggaccacccccugauggacgacagcgugacccccaucgacaacagacccagacugaucaagaaggacgugaacuacacccagaucgugguggacagaacccaggcccuggacggcaccguguacgacgugauguucgugagcaccgacagaggcgcccugcacaaggccaucagccuggagcacgccgugcacaucaucgaggagacccagcuguuccaggacuucgagcccgugcagacccugcugcugagcagcaagaagggcaacagauucguguacgccggcagcaacagcggcguggugcaggccccccuggccuucugcggcaagcacggcaccugcgaggacugcgugcuggccagagaccccuacugcgccuggagcccccccaccgccaccugcguggcccugcaccagaccgagagccccagcagaggccugauccaggagaugagcggcgacgccagcgugugccccgacaagagcaagggcagcuacagacagcacuucuucaagcacggcggcaccgccgagcugaagugcagccagaagagcaaccuggccagaguguucuggaaguuccagaacggcgugcugaaggccgagagccccaaguacggccugaugggcagaaagaaccugcugaucuucaaccugagcgagggcgacagcggcguguaccagugccugagcgaggagagagugaagaacaagaccguguuccaggugguggccaagcacgugcuggaggugaagguggugcccaagcccgugguggcccccacccugagcguggugcagaccgagggcagcagaaucgccaccaaggugcugguggccagcacccagggcagcagcccccccacccccgccgugcaggccaccagcagcggcgccaucacccugccccccaagcccgcccccaccggcaccagcugcgagcccaagaucgugaucaacaccgugccccagcugcacagcgagaagaccauguaccugaagagcagcgacaacagacugcugaugagccuguuccuguucuucuucgugcuguuccugugccuguucuucuacaacugcuacaagggcuaccugcccagacagugccugaaguucagaagcgcccugcugaucggcaagaagaagcccaagagcgacuucugcgacagagagcagagccugaaggagacccugguggagcccggcagcuucagccagcagaacggcgagcaccccaagcccgcccuggacaccggcuacgagaccgagcaggacaccaucaccagcaaggugcccaccgacagagaggacagccagagaaucgacgaccugagcgccagagacaagcccuucgacgugaagugcgagcugaaguucgccgacagcgacgccgacggcgacuaa

SEQ ID NO: 23142 - RNA, 1848 nt, Artificial Sequence
  SEMA4F__Homo_sapiens__NP_001258590
augcccgccagcgccgccagacccagacccggccccggccagcccaccgccagccccuucccccugcugcugcuggccgugcugagcggccccgugagcggcagagugcccagaagcgugcccagaaccagccugcccaucagcgaggccgacagcugccugaccagauucgccgugccccacaccuacaacuacagcgugcugcugguggaccccgccagccacacccuguacgugggcgccagagacaccaucuucgcccugagccugcccuucagcggcgagagacccagaagaaucgacuggauggugcccgaggcccacagacagaacugcagaaagaagggcaagaaggagggcgaccugggcggcagaaagacccugcagcagagauggaccaccuuccugaaggccgaccugcugugccccggccccgagcacggcagagccagcagcgugcugcaggacguggccgugcugagacccgagcugggcgccggcacccccaucuucuacggcaucuucagcagccagugggagggcgccaccaucagcgccgugugcgccuucagaccccaggacaucagaaccgugcugaacggccccuucagagagcugaagcacgacugcaacagaggccugcccgugguggacaacgacgugccccagcccagacccggcgagugcaucaccaacaacaugaagcugagacacuucggcagcagccugagccugcccgacagagugcugaccuucaucagagaccacccccugauggacagacccguguuccccgccgacggccacccccugcuggugaccaccgacaccgccuaccugagagugguggcccacagagugaccagccugagcggcaaggaguacgacgugcuguaccugggcaccgaggacggccaccugcacagagccgugagaaucggcgcccagcugagcgugcuggaggaccuggcccuguuccccgagccccagcccguggagaacaugaagcuguaccacagcuggcugcuggugggcagcagaaccgaggugacccaggugaacaccaccaacugcggcagacugcagagcugcagcgagugcauccuggcccaggaccccgugugcgccuggagcuucagacuggacgagugcguggcccacgccggcgagcacagaggccuggugcaggacaucgagagcgccgacgugagcagccugugccccaaggagcccggcgagagacccgugguguucgaggugcccguggccaccgccgcccacguggugcugcccugcagccccagcagcgccugggccagcugcguguggcaccagcccagcggcgugaccgcccugacccccagaagagacggccuggaggugguggugacccccggcgccaugggcgccuacgccugcgagugccaggagggcggcgccgcccacgugguggccgccuacagccugguguggggcagccagagagacgcccccagcagagcccacaccgugggcgccggccuggccggcuucuuccugggcauccuggccgccagccugacccugauccugaucggcagaagacagcagagaagaagacagagagagcugcuggccagagacaaggugggccuggaccugggcgccccccccagcggcaccaccagcuacagccaggacccccccagccccagccccgaggacgagagacugccccuggcccuggccaagagaggcagcggcuucggcggcuucagcccccccuuccugcuggaccccugccccagccccgcccacaucagacugaccggcgccccccuggccaccugcgacgagaccagcaucuaa

SEQ ID NO: 23143 - RNA, 2109 nt, Artificial Sequence
  SEMA4G__Homo_sapiens__NP_001190173
auguggggcagacuguggccccugcugcugagcauccugaccgccaccgccgugcccggccccagccugagaagacccagcagagagcuggacgccacccccagaaugaccauccccuacgaggagcugagcggcaccagacacuucaagggccaggcccagaacuacagcacccugcugcuggaggaggccagcgccagacugcuggugggcgccagaggcgcccuguucagccugagcgccaacgacaucggcgacggcgcccacaaggagauccacugggaggccagccccgagaugcagagcaagugccaccagaagggcaagaacaaccagaccgagugcuucaaccacgugagauuccugcagagacugaacagcacccaccuguacgccugcggcacccacgccuuccagccccugugcgccgccaucgacgccgaggccuucacccugcccaccagcuucgaggagggcaaggagaagugccccuacgaccccgccagaggcuucaccggccugaucaucgacggcggccuguacaccgccaccagauacgaguucagaagcauccccgacaucagaagaagcagacacccccacagccugagaaccgaggagacccccaugcacuggcugaacgacgccgaguucguguucagcgugcuggugagagagagcaaggccagcgccgugggcgacgacgacaagguguacuacuucuucaccgagagagccaccgaggagggcagcggcagcuucacccagagcagaagcagccacagaguggccagaguggccagagugugcaagggcgaccugggcggcaagaagauccugcagaagaaguggaccagcuuccugaaggccagacugaucugccacaucccccuguacgagacccugagaggcgugugcagccuggacgccgagaccagcagcagaacccacuucuacgccgccuucacccugagcacccaguggaagacccuggaggccagcgccaucugcagauacgaccuggccgagauccaggccguguucgccggccccuacauggaguaccaggacggcagcagaagauggggcagauacgagggcggcgugcccgagcccagacccggcagcugcaucaccgacagccugagaagccagggcuacaacagcagccaggaccugcccagccuggugcuggacuucgugaagcugcacccccugauggccagacccguggugcccaccagaggcagaccccugcugcugaagagaaacaucagauacacccaccugaccggcacccccgugaccacccccgccggccccaccuacgaccugcuguuccugggcaccgccgacggcuggauccacaaggccguggugcugggcagcggcaugcacaucaucgaggagacccagguguucagagagagccagagcguggagaaccuggugaucagccugcugcagcacagccuguacgugggcgcccccagcggcgugauccagcugccccugagcagcugcagcagauacagaagcugcuacgacugcauccuggccagagaccccuacugcggcugggaccccggcacccacgccugcgccgccgccaccaccaucgccaacagaagccagggcagcagaaccgcccugauccaggacaucgagagaggcaacagaggcugcgagagcagcagagacaccggcagagcccugcaggugcacaugggcagcaugagcccccccagcgccuggcccugcgugcuggacggccccgagaccagacaggaccugugccagccccccaagcccugcgugcacagccacgcccacauggaggagugccugagcgccggccugcagugcccccacccccaccugcugcuggugcacagcugcuucauccccgccagcggccugggcgugcccagccagcugccccaccccaucuggagcagcagccccgcccccugcggcgaccuguucgugaagagccugggcaccggccagcccggcgaggugagacugcaccacagccccccccugcccagcugcguggcccuggugaaccagcccccccacagccccuggagcuucagcagaguguaa

SEQ ID NO: 23144 - RNA, 3225 nt, Artificial Sequence
  SEMA5A__Homo_sapiens__NP_003957
augaagggcaccugcgugaucgccuggcuguucagcagccugggccuguggagacuggcccaccccgaggcccagggcaccacccagugccagagaaccgagcaccccgugaucagcuacaaggagaucggccccuggcugagagaguucagagccaagaacgccguggacuucagccagcugaccuucgaccccggccagaaggagcugguggugggcgccagaaacuaccuguucagacugcagcuggaggaccugagccugauccaggccguggagugggagugcgacgaggccaccaagaaggccugcuacagcaagggcaagagcaaggaggagugccagaacuacaucagagugcugcuggugggcggcgacagacuguucaccugcggcaccaacgccuucacccccgugugcaccaacagaagccugagcaaccugaccgagauccacgaccagaucagcggcauggccagaugccccuacagcccccagcacaacagcaccgcccugcugaccgccggcggcgagcuguacgccgccaccgccauggacuuccccggcagagaccccgccaucuacagaagccugggcauccugcccccccugagaaccgcccaguacaacagcaaguggcugaacgagcccaacuucgugagcagcuacgacaucggcaacuucaccuacuucuucuucagagagaacgccguggagcacgacugcggcaagaccguguucagcagagccgccagagugugcaagaacgacaucggcggcagauuccugcuggaggacaccuggaccaccuucaugaaggccagacugaacugcagcagacccggcgaggugcccuucuacuacaacgagcugcagagcaccuucuuccugcccgagcuggaccugaucuacggcaucuucaccaccaacgugaacagcaucgccgccagcgccgugugcguguucaaccugagcgccaucgcccaggccuucagcggccccuucaaguaccaggagaacagcagaagcgccuggcugcccuaccccaaccccaacccccacuuccagugcggcaccguggaccagggccuguacgugaaccugaccgagagaaaccugcaggacgcccagaaguucauccugaugcacgagguggugcagcccgugaccaccgugcccagcuucauggaggacaacagcagauucagccacguggccguggacguggugcagggcagagaggcccuggugcacaucaucuaccuggccaccgacuacggcaccaucaagaaggugagagugccccugaaccagaccagcagcagcugccugcuggaggagaucgagcuguuccccgagagaagaagagagcccaucagaagccugcagauccugcacagccagagcgugcuguucgugggccugagagagcacguggugaagaucccccugaagagaugccaguucuacagaaccagaagcaccugcaucggcgcccaggaccccuacugcggcugggacguggugaugaagaagugcaccagccuggaggagagccugagcaugacccagugggagcagagcaucagcgccugccccaccagaaaccugaccguggacggccacuucggcguguggagccccuggacccccugcacccacaccgacggcagcgccgugggcagcugccugugcagaaccagaagcugcgacagccccgccccccagugcggcggcuggcagugcgagggccccggcauggagaucgccaacugcagcagaaacggcggcuggacccccuggaccagcuggagccccugcagcaccaccugcggcaucggcuuccaggugagacagagaagcugcagcaaccccacccccagacacggcggcagagugugcgugggccagaacagagaggagagauacugcaacgagcaccugcugugccccccccacauguucuggaccggcuggggccccugggagagaugcaccgcccagugcggcggcggcauccaggccagaagaagaaucugcgagaacggccccgacugcgccggcugcaacguggaguaccagagcugcaacaccaaccccugccccgagcugaagaagaccacccccuggacccccuggacccccgugaacaucagcgacaacggcggccacuacgagcagagauucagauacaccugcaaggccagacuggccgaccccaaccugcuggaggugggcagacagagaaucgagaugagauacugcagcagcgacggcaccagcggcugcagcaccgacggccugagcggcgacuuccugagagccggcagauacagcgcccacaccgugaacggcgccuggagcgccuggaccagcuggagccagugcagcagagacugcagcagaggcaucagaaacagaaagagagugugcaacaaccccgagcccaaguacggcggcaugcccugccugggccccagccuggaguaccaggagugcaacauccugcccugccccguggacggcguguggagcugcuggagccccuggaccaagugcagcgccaccugcggcggcggccacuacaugagaaccagaagcugcagcaaccccgcccccgccuacggcggcgacaucugccugggccugcacaccgaggaggcccugugcaacacccagcccugccccgagagcuggagcgaguggagcgacuggagcgagugcgaggccagcggcgugcaggugagagccagacagugcauccugcuguuccccaugggcagccagugcagcggcaacaccaccgagagcagacccugcguguucgacagcaacuucauccccgaggugagcguggccagaagcagcagcguggaggagaagagaugcggcgaguucaacauguuccacaugaucgccgugggccugagcagcagcauccugggcugccugcugacccugcugguguacaccuacugccagagauaccagcagcagagccacgacgccaccgugauccaccccgugagccccgccccccugaacaccagcaucaccaaccacaucaacaagcuggacaaguacgacagcguggaggccaucaaggccuucaacaagaacaaccugauccuggaggagagaaacaaguacuucaacccccaccugaccggcaagaccuacagcaacgccuacuucaccgaccugaacaacuacgacgaguacuaa

SEQ ID NO: 23145 - RNA, 3456 nt, Artificial Sequence
  SEMA5B__Homo_sapiens__NP_001026872
augcccugcggcuucagccccagccccguggcccaccaccuggugcccggcccccccgacacccccgcccagcagcugagaugcggcuggaccgugggcggcuggcugcugagccuggugagaggccugcugcccugccugccccccggcgccagaaccgccgagggccccaucauggugcuggccggcccccuggccgugagccugcugcugcccagccugacccugcuggugagccaccugagcagcagccaggacgugagcagcgagcccagcagcgagcagcagcugugcgcccugagcaagcaccccaccguggccuucgaggaccugcagcccugggugagcaacuucaccuaccccggcgccagagacuucagccagcuggcccuggaccccagcggcaaccagcugaucgugggcgccagaaacuaccuguucagacugagccuggccaacgugagccugcugcaggccaccgagugggccagcagcgaggacaccagaagaagcugccagagcaagggcaagaccgaggaggagugccagaacuacgugagagugcugaucguggccggcagaaagguguucaugugcggcaccaacgccuucagccccaugugcaccagcagacaggugggcaaccugagcagaaccaucgagaagaucaacggcguggccagaugccccuacgaccccagacacaacagcaccgccgugaucagcagccagggcgagcuguacgccgccaccgugaucgacuucagcggcagagaccccgccaucuacagaagccugggcagcggccccccccugagaaccgcccaguacaacagcaaguggcugaacgagcccaacuucguggccgccuacgacaucggccuguucgccuacuucuuccugagagagaacgccguggagcacgacugcggcagaaccguguacagcagaguggccagagugugcaagaacgacgugggcggcagauuccugcuggaggacaccuggaccaccuucaugaaggccagacugaacugcagcagacccggcgaggugcccuucuacuacaacgagcugcagagcgccuuccaccugcccgagcaggaccugaucuacggcguguucaccaccaacgugaacagcaucgccgccagcgccgugugcgccuucaaccugagcgccaucagccaggccuucaacggccccuucagauaccaggagaaccccagagccgccuggcugcccaucgccaaccccauccccaacuuccagugcggcacccugcccgagaccggccccaacgagaaccugaccgagagaagccugcaggacgcccagagacuguuccugaugagcgaggccgugcagcccgugacccccgagcccugcgugacccaggacagcgugagauucagccaccuggugguggaccuggugcaggccaaggacacccuguaccacgugcuguacaucggcaccgagagcggcaccauccugaaggcccugagcaccgccagcagaagccugcacggcugcuaccuggaggagcugcacgugcugccccccggcagaagagagccccugagaagccugagaauccugcacagcgccagagcccuguucgugggccugagagacggcgugcugagagugccccuggagagaugcgccgccuacagaagccagggcgccugccugggcgccagagaccccuacugcggcugggacggcaagcagcagagaugcagcacccuggaggacagcagcaacaugagccuguggacccagaacaucaccgccugccccgugagaaacgugaccagagacggcggcuucggccccuggagccccuggcagcccugcgagcaccuggacggcgacaacagcggcagcugccugugcagagccagaagcugcgacagccccagacccagaugcggcggccuggacugccugggccccgccauccacaucgccaacugcagcagaaacggcgccuggacccccuggagcagcugggcccugugcagcaccagcugcggcaucggcuuccaggugagacagagaagcugcagcaaccccgcccccagacacggcggcagaaucugcgugggcaagagcagagaggagagauucugcaacgagaacacccccugccccgugcccaucuucugggccagcuggggcagcuggagcaagugcagcagcaacugcggcggcggcaugcagagcagaagaagagccugcgagaacggcaacagcugccugggcugcggcguggaguucaagaccugcaaccccgagggcugccccgaggugagaagaaacacccccuggacccccuggcugcccgugaacgugacccagggcggcgccagacaggagcagagauucagauucaccugcagagccccccuggccgacccccacggccugcaguucggcagaagaagaaccgagaccagaaccugccccgccgacggcagcggcagcugcgacaccgacgcccugguggaggugcugcugagaagcggcagcaccagcccccacaccgugagcggcggcugggccgccuggggccccuggagcagcugcagcagagacugcgagcugggcuucagagugagaaagagaaccugcaccaaccccgagcccagaaacggcggccugcccugcgugggcgacgccgccgaguaccaggacugcaacccccaggccugccccgugagaggcgccuggagcugcuggaccagcuggagccccugcagcgccagcugcggcggcggccacuaccagagaaccagaagcugcaccagccccgcccccagccccggcgaggacaucugccugggccugcacaccgaggaggcccugugcgccacccaggccugccccgagggcuggagccccuggagcgaguggagcaagugcaccgacgacggcgcccagagcagaagcagacacugcgaggagcugcugcccggcagcagcgccugcgccggcaacagcagccagagcagacccugccccuacagcgagauccccgugauccugcccgccagcagcauggaggaggccaccgacugcgccggcuucaaccugauccaccugguggccaccggcaucagcugcuuccugggcagcggccugcugacccuggccguguaccugagcugccagcacugccagagacagagccaggagagcacccuggugcaccccgccacccccaaccaccugcacuacaagggcggcggcacccccaagaacgagaaguacacccccauggaguucaagacccugaacaagaacaaccugauccccgacgacagagccaacuucuacccccugcagcagaccaacguguacaccaccaccuacuaccccagcccccugaacaagcacagcuucagacccgaggccagccccggccagagaugcuuccccaacagcuaa

SEQ ID NO: 23146 - RNA, 3144 nt, Artificial Sequence
  SEMA6A__Homo_sapiens__NP_001287709
augagaagcgaggcccugcugcuguacuucacccugcugcacuucgccggcgccggcuuccccgaggacagcgagcccaucagcaucagccacggcaacuacaccaagcaguaccccguguucgugggccacaagcccggcagaaacaccacccagagacacagacuggacauccagaugaucaugaucaugaacggcacccuguacaucgccgccagagaccacaucuacaccguggacaucgacaccagccacaccgaggagaucuacugcagcaagaagcugaccuggaagagcagacaggccgacguggacaccugcagaaugaagggcaagcacaaggacgagugccacaacuucaucaaggugcugcugaagaagaacgacgacgcccuguucgugugcggcaccaacgccuucaaccccagcugcagaaacuacaagauggacacccuggagcccuucggcgacgaguucagcggcauggccagaugccccuacgacgccaagcacgccaacguggcccuguucgccgacggcaagcuguacagcgccaccgugaccgacuuccuggccaucgacgccgugaucuacagaagccugggcgagagccccacccugagaaccgugaagcacgacagcaaguggcugaaggagcccuacuucgugcaggccguggacuacggcgacuacaucuacuucuucuucagagagaucgccguggaguacaacaccaugggcaaggugguguuccccagaguggcccaggugugcaagaacgacaugggcggcagccagagagugcuggagaagcaguggaccagcuuccugaaggccagacugaacugcagcgugcccggcgacagccacuucuacuucaacauccugcaggccgugaccgacgugaucagaaucaacggcagagacguggugcuggccaccuucagcacccccuacaacagcauccccggcagcgccgugugcgccuacgacaugcuggacaucgccagcguguucaccggcagauucaaggagcagaagagccccgacagcaccuggacccccgugcccgacgagagagugcccaagcccagacccggcugcugcgccggcagcagcagccuggagagauacgccaccagcaacgaguuccccgacgacacccugaacuucaucaagacccacccccugauggacgaggccgugcccagcaucuucaacagacccugguuccugagaaccauggugagauacagacugaccaagaucgccguggacaccgccgccggccccuaccagaaccacaccgugguguuccugggcagcgagaagggcaucauccugaaguuccuggccagaaucggcaacagcggcuuccugaacgacagccuguuccuggaggagaugagcguguacaacagcgagaagugcagcuacgacggcguggaggacaagagaaucaugggcaugcagcuggacagagccagcagcagccuguacguggccuucagcaccugcgugaucaaggugccccugggcagaugcgagagacacggcaagugcaagaagaccugcaucgccagcagagaccccuacugcggcuggaucaaggagggcggcgccugcagccaccugagccccaacagcagacugaccuucgagcaggacaucgagagaggcaacaccgacggccugggcgacugccacaacagcuucguggcccugaacgacaucagcaccccccugcccgacaacgagaugagcuacaacaccguguacggccacagcagcagccugcugcccagcaccaccaccagcgacagcaccgcccaggagggcuacgagagcagaggcggcaugcuggacuggaagcaccugcuggacagccccgacagcaccgacccccugggcgccgugagcagccacaaccaccaggacaagaagggcgugaucagagagagcuaccugaagggccacgaccagcuggugcccgugacccugcuggccaucgccgugauccuggccuucgugaugggcgccguguucagcggcaucaccguguacugcgugugcgaccacagaagaaaggacguggccguggugcagagaaaggagaaggagcugacccacagcagaagaggcagcaugagcagcgugaccaagcugagcggccuguucggcgacacccagagcaaggaccccaagcccgaggccauccugaccccccugaugcacaacggcaagcuggccacccccggcaacaccgccaagaugcugaucaaggccgaccagcaccaccuggaccugaccgcccugcccacccccgagagcacccccacccugcagcagaagagaaagcccagcagaggcagcagagagugggagagaaaccagaaccugaucaacgccugcaccaaggacaugccccccaugggcagccccgugauccccaccgaccugccccugagagccagccccagccacauccccagcgugguggugcugcccaucacccagcagggcuaccagcacgaguacguggaccagcccaagaugagcgagguggcccagauggcccuggaggaccaggccgccacccuggaguacaagaccaucaaggagcaccugagcagcaagagccccaaccacggcgugaaccugguggagaaccuggacagccugccccccaaggugccccagagagaggccagccugggcccccccggcgccagccugagccagaccggccugagcaagagacuggagaugcaccacagcagcagcuacggcguggacuacaagagaagcuaccccaccaacagccugaccagaagccaccaggccaccacccugaagagaaacaacaccaacagcagcaacagcagccaccugagcagaaaccagagcuucggcagaggcgacaaccccccccccgccccccagagaguggacagcauccaggugcacagcagccagcccagcggccaggccgugaccgugagcagacagcccagccugaacgccuacaacagccugaccagaagcggccugaagagaacccccagccugaagcccgacgugccccccaagcccagcuucgccccccugagcaccagcaugaagcccaacgacgccugcaccuaa

SEQ ID NO: 23147 - RNA, 2667 nt, Artificial Sequence
  SEMA6B__Homo_sapiens__NP_115484
augcagacccccagagccagcccccccagacccgcccugcugcugcugcugcugcugcugggcggcgcccacggccuguuccccgaggagccccccccccugagcguggcccccagagacuaccugaaccacuaccccguguucgugggcagcggccccggcagacugacccccgccgagggcgccgacgaccugaacauccagagagugcugagagugaacagaacccuguucaucggcgacagagacaaccuguacagaguggagcuggagccccccaccagcaccgagcugagauaccagagaaagcugaccuggagaagcaaccccagcgacaucaacgugugcagaaugaagggcaagcaggagggcgagugcagaaacuucgugaaggugcugcugcugagagacgagagcacccuguucgugugcggcagcaacgccuucaaccccgugugcgccaacuacagcaucgacacccugcagcccgugggcgacaacaucagcggcauggccagaugccccuacgaccccaagcacgccaacguggcccuguucagcgacggcaugcuguucaccgccaccgugaccgacuuccuggccaucgacgccgugaucuacagaagccugggcgacagacccacccugagaaccgugaagcacgacagcaagugguucaaggagcccuacuucgugcacgccguggaguggggcagccacguguacuucuucuucagagagaucgccauggaguucaacuaccuggagaaggugguggugagcagaguggccagagugugcaagaacgacgugggcggcagccccagagugcuggagaagcaguggaccagcuuccugaaggccagacugaacugcagcgugcccggcgacagccacuucuacuucaacgugcugcaggccgugaccggcguggugagccugggcggcagacccguggugcuggccguguucagcacccccagcaacagcauccccggcagcgccgugugcgccuucgaccugacccagguggccgccguguucgagggcagauucagagagcagaagagccccgagagcaucuggacccccgugcccgaggaccaggugcccagacccagacccggcugcugcgccgcccccggcaugcaguacaacgccagcagcgcccugcccgacgacauccugaacuucgugaagacccacccccugauggacgaggccgugcccagccugggccacgcccccuggauccugagaacccugaugagacaccagcugaccagaguggccguggacgugggcgccggccccuggggcaaccagaccgugguguuccugggcagcgaggccggcaccgugcugaaguuccuggugagacccaacgccagcaccagcggcaccagcggccugagcguguuccuggaggaguucgagaccuacagacccgacagaugcggcagacccggcggcggcgagaccggccagagacugcugagccuggagcuggacgccgccagcggcggccugcuggccgccuuccccagaugcguggugagagugcccguggccagaugccagcaguacagcggcugcaugaagaacugcaucggcagccaggaccccuacugcggcugggcccccgacggcagcugcaucuuccugagccccggcaccagagccgccuucgagcaggacgugagcggcgccagcaccagcggccugggcgacugcaccggccugcugagagccagccugagcgaggacagagccggccuggugagcgugaaccugcuggugaccagcagcguggccgccuucguggugggcgccguggugagcggcuucagcgugggcugguucgugggccugagagagagaagagagcuggccagaagaaaggacaaggaggccauccuggcccacggcgccggcgaggccgugcugagcgugagcagacugggcgagagaagagcccagggccccggcggcagaggcggcggcggcggcggcggcgccggcgugccccccgaggcccugcuggccccccugaugcagaacggcugggccaaggccacccugcugcagggcggcccccacgaccuggacagcggccugcugcccacccccgagcagaccccccugccccagaagagacugcccaccccccacccccacccccacgcccugggccccagagccugggaccacggccacccccugcugcccgccagcgccagcagcagccugcugcugcuggcccccgccagagcccccgagcagccccccgcccccggcgagcccacccccgacggcagacuguacgccgccagacccggcagagccagccacggcgacuucccccugaccccccacgccagccccgacagaagaagaguggugagcgcccccaccggcccccuggaccccgccagcgccgccgacggccugcccagacccuggagccccccccccaccggcagccugagaagaccccugggcccccacgccccccccgccgccacccugagaagaacccacaccuucaacagcggcgaggccagacccggcgacagacacagaggcugccacgccagacccggcaccgaccuggcccaccugcugcccuacggcggcgccgacagaaccgccccccccgugcccuaa

SEQ ID NO: 23148 - RNA, 3036 nt, Artificial Sequence
  SEMA6D__Homo_sapiens__NP_001185928
augagaguguuccugcugugcgccuacauccugcugcugauggugagccagcugagagccgugagcuuccccgaggacgacgagccccugaacaccguggacuaccacuacagcagacaguaccccguguucagaggcagacccagcggcaacgagagccagcacagacuggacuuccagcugaugcugaagaucagagacacccuguacaucgccggcagagaccagguguacaccgugaaccugaacgagaugcccaagaccgaggugauccccaacaagaagcugaccuggagaagcagacagcaggacagagagaacugcgccaugaagggcaagcacaaggacgagugccacaacuucaucaagguguucgugcccagaaacgacgagaugguguucgugugcggcaccaacgccuucaaccccaugugcagauacuacagacugagcacccuggaguacgacggcgaggagaucagcggccuggccagaugccccuucgacgccagacagaccaacguggcccuguucgccgacggcaagcuguacagcgccaccguggccgacuuccuggccagcgacgccgugaucuacagaagcaugggcgacggcagcgcccugagaaccaucaaguacgacagcaaguggaucaaggagccccacuuccugcacgccaucgaguacggcaacuacguguacuucuucuucagagagaucgccguggagcacaacaaccugggcaaggccguguacagcagaguggccagaaucugcaagaacgacaugggcggcagccagagagugcuggagaagcacuggaccagcuuccugaaggccagacugaacugcagcgugcccggcgacagcuucuucuacuucgacgugcugcagagcaucaccgacaucauccagaucaacggcauccccaccguggugggcguguucaccacccagcugaacagcauccccggcagcgccgugugcgccuucagcauggacgacaucgagaagguguucaagggcagauucaaggagcagaagacccccgacagcguguggaccgccgugcccgaggacaaggugcccaagcccagacccggcugcugcgccaagcacggccuggccgaggccuacaagaccagcaucgacuuccccgacgagacccugagcuucaucaagagccacccccugauggacagcgccgugccccccaucgccgacgagcccugguucaccaagaccagagugagauacagacugaccgccaucagcguggaccacagcgccggccccuaccagaacuacaccgugaucuucgugggcagcgaggccggcauggugcugaaggugcuggccaagaccagccccuucagccugaacgacagcgugcugcuggaggagaucgaggccuacaaccacgccaagugcagcgccgagaacgaggaggacaagaaggugaucagccugcagcuggacaaggaccaccacgcccuguacguggccuucagcagcugcaucaucagaaucccccugagcagaugcgagagauacggcagcugcaagaagagcugcaucgccagcagagaccccuacugcggcuggcugagccagggcagcugcggcagagugacccccggcaugcugcugcugaccgaggacuucuucgccuuccacaaccacagcgccgagggcuacgagcaggacaccgaguucggcaacaccgcccaccugggcgacugccacggcgugagaugggaggugcagagcggcgagagcaaccagauggugcacaugaacgugcugaucaccugcguguucgccgccuucgugcugggcgccuucaucgccggcguggccguguacugcuacagagacauguucgugagaaagaacagaaagauccacaaggacgccgagagcgcccagagcugcaccgacagcagcggcagcuucgccaagcugaacggccuguucgacagccccgugaaggaguaccagcagaacaucgacagccccaagcuguacagcaaccugcugaccagcagaaaggagcugccccccaacggcgacaccaagagcauggugauggaccacagaggccagccccccgagcuggccgcccugcccacccccgagagcacccccgugcugcaccagaagacccugcaggccaugaagagccacagcgagaaggcccacggccacggcgccagcagaaaggagaccccccaguucuuccccagcagcccccccccccacagcccccugagccacggccacauccccagcgccaucgugcugcccaacgccacccacgacuacaacaccagcuucagcaacagcaacgcccacaaggccgagaagaagcugcagaacaucgaccacccccugaccaagagcagcagcaagagagaccacagaagaagcguggacagcagaaacacccugaacgaccugcugaagcaccugaacgaccccaacagcaaccccaaggccaucaugggcgacauccagauggcccaccagaaccugaugcuggaccccaugggcagcaugagcgaggugccccccaaggugcccaacagagaggccagccuguacagcccccccagcacccugcccagaaacagccccaccaagagaguggacgugcccaccacccccggcgugcccaugaccagccuggagagacagagaggcuaccacaagaacagcagccagagacacagcaucagcgccaugcccaagaaccugaacagccccaacggcgugcugcugagcagacagcccagcaugaacagaggcggcuacaugcccacccccaccggcgccaagguggacuacauccagggcacccccgugagcgugcaccugcagcccagccugagcagacagagcagcuacaccagcaacggcacccugcccagaaccggccugaagagaacccccagccugaagcccgacgugccccccaagcccagcuucgugccccagacccccagcgugagaccccugaacaaguacaccuacuaa

SEQ ID NO: 23149 - RNA, 1959 nt, Artificial Sequence
  SEMA7A__Homo_sapiens__NP_001139501
augaccccccccccccccggcagagccgcccccagcgcccccagagccagagugcccggcccccccgccagacugggccugccccugagacugagacugcugcugcugcugugggccgccgccgccagcgcccagggccaccugagaagcggccccagaaucuucgccguguggaagggccacgugggccaggacagaguggacuucggccagaccgagccccacaccgugcuguuccacgagcccggcagcagcagcgugugggugggcggcagaggcaagguguaccuguucgacuuccccgagggcaagaacgccagcgugagaaccgacugcgagaacuacaucacccugcuggagagaagaagcgagggccugcuggccugcggcaccaacgccagacaccccagcugcuggaaccuggugaacggcaccguggugccccugggcgagaugagaggcuacgcccccuucagccccgacgagaacagccuggugcuguucgagggcgacgagguguacagcaccaucagaaagcaggaguacaacggcaagauccccagauucagaagaaucagaggcgagagcgagcuguacaccagcgacaccgugaugcagaacccccaguucaucaaggccaccaucgugcaccaggaccaggccuacgacgacaagaucuacuacuucuucagagaggacaaccccgacaagaaccccgaggccccccugaacgugagcagaguggcccagcugugcagaggcgaccagggcggcgagagcagccugagcgugagcaaguggaacaccuuccugaaggccaugcuggugugcagcgacgccgccaccaacaagaacuucaacagacugcaggacguguuccugcugcccgaccccagcggccaguggagagacaccagaguguacggcguguucagcaaccccuggaacuacagcgccgugugcguguacagccugggcgacaucgacaagguguucagaaccagcagccugaagggcuaccacagcagccugcccaaccccagacccggcaagugccugcccgaccagcagcccauccccaccgagaccuuccagguggccgacagacaccccgagguggcccagagaguggagcccaugggcccccugaagaccccccuguuccacagcaaguaccacuaccagaagguggccgugcacagaaugcaggccagccacggcgagaccuuccacgugcuguaccugaccaccgacagaggcaccauccacaaggugguggagcccggcgagcaggagcacagcuucgccuucaacaucauggagauccagcccuucagaagagccgccgccauccagaccaugagccuggacgccgagagaagaaagcuguacgugagcagccagugggaggugagccaggugccccuggaccugugcgagguguacggcggcggcugccacggcugccugaugagcagagaccccuacugcggcugggaccagggcagaugcaucagcaucuacagcagcgagagaagcgugcugcagagcaucaaccccgccgagccccacaaggagugccccaaccccaagcccgacaaggccccccugcagaaggugagccuggcccccaacagcagauacuaccugagcugccccauggagagcagacacgccaccuacagcuggagacacaaggagaacguggagcagagcugcgagcccggccaccagagccccaacugcauccuguucaucgagaaccugaccgcccagcaguacggccacuacuucugcgaggcccaggagggcagcuacuucagagaggcccagcacuggcagcugcugcccgaggacggcaucauggccgagcaccugcugggccacgccugcgcccuggccgccagccuguggcugggcgugcugcccacccugacccugggccugcuggugcacuaa

SEQ ID NO: 23150 - RNA, 1389 nt, Artificial Sequence
  SEMG1__Homo_sapiens__NP_002998
augaagcccaacaucaucuucgugcugagccugcugcugauccuggagaagcaggccgccgugaugggccagaagggcggcagcaagggcagacugcccagcgaguucagccaguucccccacggccagaagggccagcacuacagcggccagaagggcaagcagcagaccgagagcaagggcagcuucagcauccaguacaccuaccacguggacgccaacgaccacgaccagagcagaaagagccagcaguacgaccugaacgcccugcacaagaccaccaagagccagagacaccugggcggcagccagcagcugcugcacaacaagcaggagggcagagaccacgacaagagcaagggccacuuccacagaguggugauccaccacaagggcggcaaggcccacagaggcacccagaaccccagccaggaccagggcaacagccccagcggcaagggcaucagcagccaguacagcaacaccgaggagagacugugggugcacggccugagcaaggagcagaccagcgugagcggcgcccagaagggcagaaagcagggcggcagccagagcagcuacgugcugcagaccgaggagcugguggccaacaagcagcagagagagaccaagaacagccaccagaacaagggccacuaccagaacgugguggaggugagagaggagcacagcagcaaggugcagaccagccugugccccgcccaccaggacaagcugcagcacggcagcaaggacaucuucagcacccaggacgagcugcugguguacaacaagaaccagcaccagaccaagaaccugaaccaggaccagcagcacggcagaaaggccaacaagaucagcuaccagagcagcagcaccgaggagagaagacugcacuacggcgagaacggcgugcagaaggacgugagccagagcagcaucuacagccagaccgaggagaaggcccagggcaagagccagaagcagaucaccauccccagccaggagcaggagcacagccagaaggccaacaagaucagcuaccagagcagcagcaccgaggagagaagacugcacuacggcgagaacggcgugcagaaggacgugagccagagaagcaucuacagccagaccgagaagcugguggccggcaagagccagauccaggcccccaaccccaagcaggagcccuggcacggcgagaacgccaagggcgagagcggccagagcaccaacagagagcaggaccugcugagccacgagcagaagggcagacaccagcacggcagccacggcggccuggacaucgugaucaucgagcaggaggacgacagcgacagacaccuggcccagcaccugaacaacgacagaaacccccuguucaccuaa

SEQ ID NO: 23151 - RNA, 1749 nt, Artificial Sequence
  SEMG2__Homo_sapiens__NP_002999
augaagagcaucauccuguucgugcugagccugcugcugauccuggagaagcaggccgccgugaugggccagaagggcggcagcaagggccagcugcccagcggcagcagccaguucccccacggccagaagggccagcacuacuucggccagaaggaccagcagcacaccaagagcaagggcagcuucagcauccagcacaccuaccacguggacaucaacgaccacgacuggaccagaaagagccagcaguacgaccugaacgcccugcacaaggccaccaagagcaagcagcaccugggcggcagccagcagcugcugaacuacaagcaggagggcagagaccacgacaagagcaagggccacuuccacaugaucgugauccaccacaagggcggccaggcccaccacggcacccagaaccccagccaggaccagggcaacagccccagcggcaagggccugagcagccagugcagcaacaccgagaagagacugugggugcacggccugagcaaggagcaggccagcgccagcggcgcccagaagggcagaacccagggcggcagccagagcagcuacgugcugcagaccgaggagcugguggugaacaagcagcagagagagaccaagaacagccaccagaacaagggccacuaccagaacgugguggacgugagagaggagcacagcagcaagcugcagaccagccugcaccccgcccaccaggacagacugcagcacggccccaaggacaucuucaccacccaggacgagcugcugguguacaacaagaaccagcaccagaccaagaaccugagccaggaccaggagcacggcagaaaggcccacaagaucagcuaccccagcagcagaaccgaggagagacagcugcaccacggcgagaagagcgugcagaaggacgugagcaagggcagcaucagcauccagaccgaggagaagauccacggcaagagccagaaccaggugaccauccacagccaggaccaggagcacggccacaaggagaacaagaucagcuaccagagcagcagcaccgaggagagacaccugaacugcggcgagaagggcauccagaagggcgugagcaagggcagcaucagcauccagaccgaggagcagauccacggcaagagccagaaccaggugagaauccccagccaggcccaggaguacggccacaaggagaacaagaucagcuaccagagcagcagcaccgaggagagaagacugaacagcggcgagaaggacgugcagaagggcgugagcaagggcagcaucagcauccagaccgaggagaagauccacggcaagagccagaaccaggugaccauccccagccaggaccaggagcacggccacaaggagaacaagaugagcuaccagagcagcagcaccgaggagagaagacugaacuacggcggcaagagcacccagaaggacgugagccagagcagcaucagcuuccagaucgagaagcugguggagggcaagagccagauccagacccccaaccccaaccaggaccaguggagcggccagaacgccaagggcaagagcggccagagcgccgacagcaagcaggaccugcugagccacgagcagaagggcagauacaagcaggagagcagcgagagccacaacaucgugaucaccgagcacgagguggcccaggacgaccaccugacccagcaguacaacgaggacagaaaccccaucagcaccuaa

SEQ ID NO: 23152 - RNA, 1935 nt, Artificial Sequence
  SENP1__Homo_sapiens__NP_001254524
auggacgacaucgccgacagaaugagaauggacgccggcgaggugacccuggugaaccacaacagcguguucaagacccaccugcugccccagaccggcuuccccgaggaccagcugagccugagcgaccagcagauccugagcagcagacagggccaccuggacagaagcuucaccugcagcaccagaagcgccgccuacaaccccagcuacuacagcgacaaccccagcagcgacagcuuccugggcagcggcgaccugagaaccuucggccagagcgccaacggccaguggagaaacagcacccccagcagcagcagcagccugcagaagagcagaaacagcagaagccuguaccuggagaccagaaagaccagcagcggccugagcaacagcuucgccggcaagagcaaccaccacugccacgugagcgccuacgagaagagcuuccccaucaagcccgugcccagccccagcuggagcggcagcugcagaagaagccugcugagccccaagaagacccagagaagacacgugagcaccgccgaggagaccgugcaggaggaggagagagagaucuacagacagcugcugcagauggugaccggcaagcaguucaccaucgccaagcccaccacccacuucccccugcaccugagcagaugccugagcagcagcaagaacacccugaaggacagccuguucaagaacggcaacagcugcgccagccagaucaucggcagcgacaccagcagcagcggcagcgccagcauccugaccaaccaggagcagcugagccacagcguguacagccugagcagcuacacccccgacguggccuucggcagcaaggacagcggcacccugcaccacccccaccaccaccacagcgugccccaccagcccgacaaccuggccgccagcaacacccagagcgagggcagcgacagcgugauccugcugaaggugaaggacagccagacccccacccccagcagcaccuucuuccaggccgagcuguggaucaaggagcugaccagcguguacgacagcagagccagagagagacugagacagaucgaggagcagaaggcccuggcccugcagcugcagaaccagagacugcaggagagagagcacagcgugcacgacagcguggagcugcaccugagagugccccuggagaaggagauccccgugaccguggugcaggagacccagaagaagggccacaagcugaccgacagcgaggacgaguuccccgagaucaccgaggagauggagaaggagaucaagaacguguucagaaacggcaaccaggacgaggugcugagcgaggccuucagacugaccaucaccagaaaggacauccagacccugaaccaccugaacuggcugaacgacgagaucaucaacuucuacaugaacaugcugauggagagaagcaaggagaagggccugcccagcgugcacgccuucaacaccuucuucuucaccaagcugaagaccgccggcuaccaggccgugaagagauggaccaagaagguggacguguucagcguggacauccugcuggugcccauccaccugggcgugcacuggugccuggccgugguggacuucagaaagaagaacaucaccuacuacgacagcaugggcggcaucaacaacgaggccugcagaauccugcugcaguaccugaagcaggagagcaucgacaagaagagaaaggaguucgacaccaacggcuggcagcuguucagcaagaagagccaggagaucccccagcagaugaacggcagcgacugcggcauguucgccugcaaguacgccgacugcaucaccaaggacagacccaucaacuucacccagcagcacaugcccuacuucagaaagagaauggugugggagauccugcacagaaagcugcuguaa

SEQ ID NO: 23153 - RNA, 1770 nt, Artificial Sequence
  SENP2__Homo_sapiens__NP_067640
auguacagauggcuggugagaauccugggcaccaucuucagauucugcgacagaagcgugccccccgccagagcccugcugaagagaagaagaagcgacagcacccuguucagcaccguggacaccgacgagauccccgccaagagacccagacuggacugcuucauccaccaggugaagaacagccuguacaacgccgccagccuguucggcuuccccuuccagcugaccaccaagcccauggugaccagcgccugcaacggcaccagaaacguggcccccagcggcgagguguucagcaacagcagcagcugcgagcugaccggcagcggcagcuggaacaacaugcugaagcugggcaacaagagccccaacggcaucagcgacuaccccaagaucagagugaccgugaccagagaccagcccagaagagugcugcccagcuucggcuucacccugaacagcgagggcugcaacagaagacccggcggcagaagacacagcaagggcaaccccgagagcagccugauguggaagccccaggagcaggccgugaccgagaugaucagcgaggagagcggcaagggccugagaagaccccacugcaccguggaggagggcgugcagaaggaggagagagagaaguacagaaagcugcuggagagacugaaggagagcggccacggcaacagcgugugccccgugaccagcaacuaccacagcagccagagaagccagauggacacccugaagaccaagggcuggggcgaggagcagaaccacggcgugaagaccacccaguucgugcccaagcaguacagacugguggagaccagaggcccccugugcagccugagaagcgagaagagaugcagcaagggcaagaucaccgacaccgagaccauggugggcaucagauucgagaacgagagcagaagaggcuaccagcuggagcccgaccugagcgaggaggugagcgccagacugagacugggcagcggcagcaacggccugcugagaagaaaggugagcaucaucgagaccaaggagaagaacugcagcggcaaggagagagacagaagaaccgacgaccugcuggagcugaccgaggacauggagaaggagaucagcaacgcccugggccacggcccccaggacgagauccugagcagcgccuucaagcugagaaucaccagaggcgacauccagacccugaagaacuaccacuggcugaacgacgaggugaucaacuucuacaugaaccugcugguggagagaaacaagaagcagggcuaccccgcccugcacguguucagcaccuucuucuaccccaagcugaagagcggcggcuaccaggccgugaagagauggaccaagggcgugaaccuguucgagcaggagaucauccuggugcccauccacagaaaggugcacuggagccugguggugaucgaccugagaaagaagugccugaaguaccuggacagcaugggccagaagggccacagaaucugcgagauccugcugcaguaccugcaggacgagagcaagaccaagagaaacagcgaccugaaccugcuggaguggacccaccacagcaugaagccccacgagaucccccagcagcugaacggcagcgacugcggcauguucaccugcaaguacgccgacuacaucagcagagacaagcccaucaccuucacccagcaccagaugccccuguucagaaagaagauggugugggagauccugcaccagcagcugcuguaa

SEQ ID NO: 23154 - RNA, 1725 nt, Artificial Sequence
  SENP3__Homo_sapiens__NP_056485
augaaggagaccauccagggcaccggcagcuggggccccgagccccccggccccggcaucccccccgccuacagcagccccagaagagagagacugagauggccccccccccccaagcccagacugaagagcggcggcggcuucggccccgaccccggcagcggcaccaccgugcccgccagaagacugcccgugcccagacccagcuucgacgccagcgccagcgaggaggaggaggaggaggaggaggaggaggacgaggacgaggaggaggagguggccgccuggagacugccccccagauggagccagcugggcaccagccagagacccagacccagcagacccacccacagaaagaccugcagccagagaagaagaagagccaugagagccuucagaaugcugcuguacagcaagagcaccagccugaccuuccacuggaagcuguggggcagacacagaggcagaagaagaggccuggcccaccccaagaaccaccugagcccccagcagggcggcgccaccccccaggugcccagccccugcugcagauucgacagccccagaggcccccccccccccagacugggccugcugggcgcccugauggccgaggacggcgugagaggcagcccccccgugcccagcggcccccccauggaggaggacggccugagauggacccccaagagcccccuggaccccgacagcggccugcugagcugcacccugcccaacggcuucggcggccagagcggccccgagggcgagagaagccuggccccccccgacgccagcauccugaucagcaacgugugcagcaucggcgaccacguggcccaggagcuguuccagggcagcgaccugggcauggccgaggaggccgagagacccggcgagaaggccggccagcacagcccccugagagaggagcacgugaccugcgugcagagcauccuggacgaguuccugcagaccuacggcagccugaucccccugagcaccgacgaggugguggagaagcuggaggacaucuuccagcaggaguucagcacccccagcagaaagggccuggugcugcagcugauccagagcuaccagagaaugcccggcaacgccauggugagaggcuucagaguggccuacaagagacacgugcugaccauggacgaccugggcacccuguacggccagaacuggcugaacgaccaggugaugaacauguacggcgaccuggugauggacaccgugcccgagaaggugcacuucuucaacagcuucuucuacgacaagcugagaaccaagggcuacgacggcgugaagagauggaccaagaacguggacaucuucaacaaggagcugcugcugauccccauccaccuggaggugcacuggagccugaucagcguggacgugagaagaagaaccaucaccuacuucgacagccagagaacccugaacagaagaugccccaagcacaucgccaaguaccugcaggccgaggccgugaagaaggacagacuggacuuccaccagggcuggaagggcuacuucaagaugaacguggccagacagaacaacgacagcgacugcggcgccuucgugcugcaguacugcaagcaccuggcccugagccagcccuucagcuucacccagcaggacaugcccaagcugagaagacagaucuacaaggagcugugccacugcaagcugaccguguaa

SEQ ID NO: 23155 - RNA, 2268 nt, Artificial Sequence
  SENP5__Homo_sapiens__NP_689912
augaagaagcagagaaagauccuguggagaaagggcauccaccuggccuucagcgagaaguggaacaccggcuucggcggcuucaagaaguucuacuuccaccagcaccugugcauccugaaggccaagcugggcagacccgugaccuggaacagacagcugagacacuuccagggcagaaagaaggcccugcagauccagaagaccuggaucaaggacgagccccugugcgccaagaccaaguucaacguggccacccagaacgugagcacccugagcagcaaggugaagagaaaggacgccaagcacuucaucagcagcagcaagacccugcugagacugcaggccgagaagcugcugagcagcgccaagaacagcgaccacgaguacugcagagagaagaaccugcugaaggccgugaccgacuuccccagcaacagcgcccugggccaggccaacggccacagacccagaaccgacccccagcccagcgacuuccccaugaaguucaacggcgagagccagagccccggcgagagcggcaccaucguggugacccugaacaaccacaagagaaagggcuucugcuacggcugcugccagggccccgagcaccacagaaacggcggcccccugauccccaagaaguuccagcugaaccagcacagaagaaucaagcugagcccccugaugauguacgagaagcugagcaugaucagauucagauacagaauccugagaagccagcacuucagaaccaagagcaaggugugcaagcugagaaaggcccagagaagcugggugcagaaggugaccggcgaccaccaggagaccagaagagagaacggcgagggcggcagcugcagccccuuccccagccccgagcccaaggaccccagcugcagacaccagcccuacuuccccgacauggacagcagcgccguggugaagggcaccaacagccacgugcccgacugccacaccaagggcagcagcuuccugggcaaggagcugagccuggacgaggccuuccccgaccagcagaacggcagcgccaccaacgccugggaccagagcagcugcagcagccccaagugggagugcaccgagcugauccacgacaucccccugcccgagcacagaagcaacaccauguucaucagcgagaccgagagagagaucaugacccugggccaggagaaccagaccagcagcgugagcgacgacagagugaagcugagcgugagcggcgccgacaccagcgugagcagcguggacggccccgugagccagaaggccgugcagaacgagaacagcuaccagauggaggaggacggcagccugaagcagagcauccugagcagcgagcugcuggaccaccccuacugcaagagcccccuggaggccccccuggugugcagcggccugaagcuggagaaccaggugggcggcggcaagaacagccagaaggccagccccguggacgacgagcagcugagcgugugccugagcggcuuccuggacgaggugaugaagaaguacggcagccuggugccccugagcgagaaggaggugcugggcagacugaaggacguguucaacgaggacuucagcaacagaaagcccuucaucaacagagagaucaccaacuacagagccagacaccagaagugcaacuucagaaucuucuacaacaagcacaugcuggacauggacgaccuggccacccuggacggccagaacuggcugaacgaccaggugaucaacauguacggcgagcugaucauggacgccgugcccgacaaggugcacuucuucaacagcuucuuccacagacagcuggugaccaagggcuacaacggcgugaagagauggaccaagaagguggaccuguucaagaagagccugcugcugauccccauccaccuggaggugcacuggagccugaucaccgugacccugagcaacagaaucaucagcuucuacgacagccagggcauccacuucaaguucugcguggagaacaucagaaaguaccugcugaccgaggccagagagaagaacagacccgaguuccugcagggcuggcagaccgccgugaccaagugcaucccccagcagaagaacgacagcgacugcggcguguucgugcugcaguacugcaagugccuggcccuggagcagcccuuccaguucagccaggaggacaugcccagagugagaaagagaaucuacaaggagcugugcgagugcagacugauggacuaa

SEQ ID NO: 23156 - RNA, 3318 nt, Artificial Sequence
  SENP6__Homo_sapiens__NP_001093879
auggccgccggcaagagcggcggcagcgccggcgagaucaccuuccuggaggcccuggccagaagcgagagcaagagagacggcggcuucaagaacaacuggagcuucgaccacgaggaggagagcgagggcgacaccgacaaggacggcaccaaccugcugagcguggacgaggacgaggacagcgagaccagcaagggcaagaagcugaacagaagaagcgagaucguggccaacagcagcggcgaguucauccugaagaccuacgugagaagaaacaagagcgagagcuucaagacccugaagggcaaccccaucggccugaacaugcugagcaacaacaagaagcugagcgagaacacccagaacaccagccugugcagcggcaccguggugcacggcagaagauuccaccacgcccacgcccagauccccguggugaagaccgccgcccagagaaaggaguaccccccccacgugcagaagguggagaucaaccccgugagacugagcagacugcagggcguggagagaaucaugaagaagaccgaggagagcgagagccagguggagcccgagaucaagagaaaggugcagcagaagagacacugcagcaccuaccagcccacccccccccugagccccgccagcaagaagugccugacccaccuggaggaccugcagagaaacugcagacaggccaucacccugaacgagagcaccggcccccugcugagaaccagcauccaccagaacagcggcggccagaagagccagaacaccggccugaccaccaagaaguucuacggcaacaacguggagaaggugcccaucgacaucaucgugaacugcgacgacagcaagcacaccuaccugcagaccaacggcaaggugauccugcccggcgccaagauccccaagaucaccaaccugaaggagagaaagaccagccugagcgaccugaacgaccccaucauccugagcagcgacgacgacgacgacaacgacagaaccaacagaagagagagcaucagcccccagcccgccgacagcgccugcagcagccccgcccccagcaccggcaagguggaggccgcccugaacgagaacaccugcagagccgagagagagcugagaagcauccccgaggacagcgagcugaacaccgugacccugcccagaaaggccagaaugaaggaccaguucggcaacagcaucaucaacaccccccugaagagaagaaagguguucagccaggagccccccgacgcccuggcccugagcugccagagcagcuucgacagcgugauccugaacugcagaagcaucagagugggcacccuguucagacugcugaucgagcccgugaucuucugccuggacuucaucaagauccagcuggacgagcccgaccacgaccccguggagaucauccugaacaccagcgaccugaccaagugcgaguggugcaacgugagaaagcugcccgugguguuccugcaggccauccccgccguguaccagaagcugagcauccagcugcagaugaacaaggaggacaagguguggaacgacugcaagggcgugaacaagcugaccaaccuggaggagcaguacaucauccugaucuuccagaacggccuggacccccccgccaacaugguguucgagagcaucaucaacgagaucggcaucaagaacaacaucagcaacuucuucgccaagauccccuucgaggaggccaacggcagacugguggccugcaccagaaccuacgaggagagcaucaagggcagcugcggccagaaggagaacaagaucaagaccgugagcuucgagagcaagauccagcugagaagcaagcaggaguuccaguucuucgacgaggaggaggagaccggcgagaaccacaccaucuucaucggccccguggagaagcugaucguguacccccccccccccgccaagggcggcaucagcgugaccaacgaggaccugcacugccugaacgagggcgaguuccugaacgacgugaucaucgacuucuaccugaaguaccuggugcuggagaagcugaagaaggaggacgccgacagaauccacaucuucagcagcuucuucuacaagagacugaaccagagagagagaagaaaccacgagaccaccaaccugagcauccagcagaagagacacggcagagugaagaccuggaccagacacguggacaucuucgagaaggacuucaucuucgugccccugaacgaggccgcccacugguuccuggccguggugugcuuccccggccuggagaagcccaaguacgagcccaacccccacuaccacgagaacgccgugauccagaagugcagcaccguggaggacagcugcaucagcagcagcgccagcgagauggagagcugcagccagaacagcagcgccaagcccgugaucaagaagaugcugaacaagaagcacugcaucgccgugaucgacagcaaccccggccaggaggagagcgaccccagauacaagagaaacaucugcagcgugaaguacagcgugaagaagaucaaccacaccgccagcgagaacgaggaguucaacaagggcgagagcaccagccagaagguggccgacagaaccaagagcgagaacggccugcagaacgagagccugagcagcacccaccacaccgacggccugagcaagaucagacugaacuacagcgacgagagccccgaggccggcaagaugcuggaggacgagcugguggacuucagcgaggaccaggacaaccaggacgacagcagcgacgacggcuuccuggccgacgacaacugcagcagcgagaucggccaguggcaccugaagcccaccaucugcaagcagcccugcauccugcugauggacagccugagaggccccagcagaagcaacguggugaagauccugagagaguaccuggagguggagugggaggugaagaagggcagcaagagaagcuucagcaaggacgugaugaagggcagcaaccccaaggugccccagcagaacaacuucagcgacugcggcguguacgugcugcaguacguggagagcuucuucgagaaccccauccugagcuucgagcugcccaugaaccuggccaacugguuccccccccccagaaugagaaccaagagagaggagaucagaaacaucauccugaagcugcaggaggaccagagcaaggagaagagaaagcacaaggacaccuacagcaccgaggccccccugggcgagggcaccgagcaguacgugaacagcaucagcgacuaa

SEQ ID NO: 23157 - RNA, 639 nt, Artificial Sequence
  SENP8__Homo_sapiens__NP_001165580
auggaccccguggugcugagcuacauggacagccugcugagacagagcgacgugagccugcuggacccccccagcuggcugaacgaccacaucaucggcuucgccuucgaguacuucgccaacagccaguuccacgacugcagcgaccacgugagcuucaucagccccgaggugacccaguucaucaagugcaccagcaaccccgccgagaucgccauguuccuggagccccuggaccugcccaacaagagagugguguuccuggccaucaacgacaacagcaaccaggccgccggcggcacccacuggagccugcugguguaccugcaggacaagaacagcuucuuccacuacgacagccacagcagaagcaacagcgugcacgccaagcagguggccgagaagcuggaggccuuccugggcagaaagggcgacaagcuggccuucguggaggagaaggcccccgcccagcagaacagcuacgacugcggcauguacgugaucugcaacaccgaggcccugugccagaacuucuucagacagcagaccgagagccugcugcagcugcugacccccgccuacaucaccaagaagagaggcgaguggaaggaccugaucaccacccuggccaagaaguaa

SEQ ID NO: 23158 - RNA, 978 nt, Artificial Sequence
  SEPHS1__Homo_sapiens__NP_001182531
auggacaccugcgugaucccccugagacacggcggccugagccuggugcagaccaccgacuacaucuaccccaucguggacgaccccuacaugaugggcagaaucgccugcgccaacgugcugagcgaccuguacgccaugggcgugaccgagugcgacaacaugcugaugcugcugggcgugagcaacaagaugaccgacagagagagagacaaggugaugccccugaucauccagggcuucaaggacgccgccgaggaggccggcaccagcgugaccggcggccagaccgugcugaaccccuggaucgugcugggcggcguggccaccaccgugugccagcccaacgaguucaucaugcccgacaacgccgugcccggcgacgugcuggugcugaccaagccccugggcacccagguggccguggccgugcaccaguggcuggacauccccgagaaguggaacaagaucaagcugguggugacccaggaggacguggagcuggccuaccaggaggccaugaugaacauggccagacugaacagaaccgccgccggccugaugcacaccuucaacgcccacgccgccaccgacaucaccggcuucggcauccugggccacgcccagaaccuggccaagcagcagagaaacgaggugagcuucgugauccacaaccugcccgugcuggccaagauggccgccgugagcaaggccugcggcaacauguucggccugaugcacggcaccugccccgagaccagcggcggccugcugaucugccugcccagagagcaggccgccagauucugcgccgagaucaagagccccaaguacggcgagggccaccaggccuggaucaucggcaucguggagaagggcaacagaaccgccagaaucaucgacaagcccagaaucaucgagguggccccccagguggccacccagaacgugaaccccacccccggcgccaccagcuaa

SEQ ID NO: 23159 - RNA, 1506 nt, Artificial Sequence
  SEPSECS__Homo_sapiens__NP_058651
augaacagagagagcuucgccgccggcgagagacuggugagccccgccuacgugagacagggcugcgaggccagaagaagccacgagcaccugaucagacugcugcuggagaagggcaagugccccgagaacggcugggacgagagcacccuggagcuguuccugcacgagcuggccaucauggacagcaacaacuuccugggcaacugcggcgugggcgagagagagggcagaguggccagcgcccugguggccagaagacacuacagauucauccacggcaucggcagaagcggcgacaucagcgccgugcagcccaaggccgccggcagcagccugcugaacaagaucaccaacagccuggugcuggacaucaucaagcuggccggcgugcacaccguggccaacugcuucguggugcccauggccaccggcaugagccugacccugugcuuccugacccugagacacaagagacccaaggccaaguacaucaucuggcccagaaucgaccagaagagcugcuucaagagcaugaucaccgccggcuucgagcccguggugaucgagaacgugcuggagggcgacgagcugagaaccgaccugaaggccguggaggccaaggugcaggagcugggccccgacugcauccugugcauccacagcaccaccagcugcuucgcccccagagugcccgacagacuggaggagcuggccgugaucugcgccaacuacgacaucccccacaucgugaacaacgccuacggcgugcagagcagcaagugcaugcaccugauccagcagggcgccagagugggcagaaucgacgccuucgugcagagccuggacaagaacuucauggugcccgugggcggcgccaucaucgccggcuucaacgacagcuucauccaggagaucagcaagauguaccccggcagagccagcgccagccccagccuggacgugcugaucacccugcugagccugggcagcaacggcuacaagaagcugcugaaggagagaaaggagauguucagcuaccugagcaaccagaucaagaagcugagcgaggccuacaacgagagacugcugcacaccccccacaaccccaucagccuggccaugacccugaagacccuggacgagcacagagacaaggccgugacccagcugggcagcaugcuguucaccagacaggugagcggcgccagaguggugccccugggcagcaugcagaccgugagcggcuacaccuucagaggcuucaugagccacaccaacaacuaccccugcgccuaccugaacgccgccagcgccaucggcaugaagaugcaggacguggaccuguucaucaagagacuggacagaugccugaaggccgugagaaaggagagaagcaaggagagcgacgacaacuacgacaagaccgaggacguggacaucgaggagauggcccugaagcuggacaacgugcugcuggacaccuaccaggacgccagcagcuaa

SEQ ID NO: 23160 - RNA, 1965 nt, Artificial Sequence
  SERAC1__Homo_sapiens__NP_116250
augagccuggccgccuacugcgugaucugcugcagaagaaucggcaccagcaccagcccccccaagagcggcacccacuggagagacaucagaaacaucaucaaguucaccggcagccugauccugggcggcagccuguuccugaccuacgaggugcuggcccugaagaaggccgugacccuggacacccaggugguggagagagagaagaugaagagcuacaucuacgugcacaccgugagccuggacaagggcgagaaccacggcaucgccuggcaggccagaaaggagcugcacaaggccgugagaaaggugcuggccaccagcgccaagauccugagaaaccccuucgccgaccccuucagcaccguggacaucgaggaccacgagugcgccguguggcugcugcugagaaagagcaagagcgacgacaagaccaccagacuggaggccgugagagagaugagcgagacccaccacuggcacgacuaccaguacagaaucaucgcccaggccugcgaccccaagacccugaucggccuggccagaagcgaggagagcgaccugagauucuuccugcugccccccccccugcccagccugaaggaggacagcagcaccgaggaggagcugagacagcugcuggccagccugccccagaccgagcuggacgagugcauccaguacuucaccagccuggcccugagcgagagcagccagagccuggccgcccagaagggcggccuguggugcuucggcggcaacggccugcccuacgccgagagcuucggcgaggugcccagcgccaccguggagauguucugccuggaggccaucgugaagcacagcgagaucagcacccacugcgacaagaucgaggccaacggcggccugcagcugcugcagagacuguacagacugcacaaggacugccccaaggugcagagaaacaucaugagagugaucggcaacauggcccugaacgagcaccugcacagcagcaucgugagaagcggcugggugagcaucauggccgaggccaugaagagcccccacaucauggagagcagccacgccgccagaauccuggccaaccuggacagagagaccgugcaggagaaguaccaggacggcguguacgugcugcacccccaguacagaaccagccagcccaucaaggccgacgugcuguucauccacggccugaugggcgccgccuucaagaccuggagacagcaggacagcgagcaggccgugaucgagaagcccauggaggacgaggacagauacaccaccugcuggcccaagaccuggcuggccaaggacugccccgcccugagaaucaucagcguggaguacgacaccagccugagcgacuggagagccagaugccccauggagagaaagagcaucgccuucagaagcaacgagcugcugagaaagcugagagccgccggcgugggcgacagacccgugguguggaucagccacagcaugggcggccugcuggugaagaagaugcugcuggaggccagcaccaagcccgagaugagcaccgugaucaacaacaccagaggcaucaucuucuacagcgugccccaccacggcagcagacuggccgaguacagcgugaacaucagauaccugcuguuccccagccuggaggugaaggagcugagcaaggacagccccgcccugaagacccugcaggacgacuuccuggaguucgccaaggacaagaacuuccaggugcugaacuucguggagacccugcccaccuacaucggcagcaugaucaagcugcacguggugcccguggagagcgccgaccugggcaucggcgaccugauccccguggacgugaaccaccugaacaucugcaagcccaagaagaaggacgccuuccuguaccagagaacccugcaguucaucagagaggcccuggccaaggaccuggagaacuaa

SEQ ID NO: 23161 - RNA, 333 nt, Artificial Sequence
  SERF1A__Homo_sapiens__NP_068802
auggccagaggcaaccagagagagcuggccagacagaagaacaugaagaagacccaggagaucagcaagggcaagagaaaggaggacagccugaccgccagccagagaaagcagagcagcggcggccagaagagcgagagcaagaugagcgccggcccccaccugccccugaaggcccccagagagaaccccugcuucccccugcccgccgccggcggcagcagauacuaccuggccuacggcagcaucacccccaucagcgccuucguguucgugguguucuucagcguguucuuccccagcuucuacgaggacuucugcugcuggaucuaa

SEQ ID NO: 23162 - RNA, 1377 nt, Artificial Sequence
  SERGEF__Homo_sapiens__NP_036271
auggagagagagcccagcgccagcgaggccgcccccgccgccgccgcccuguucgccuggggcgccaacagcuacggccagcugggccugggccacaaggaggacgugcugcugccccagcagcugaacgacuucugcaagcccagaagcgugagaagaaucaccggcggcggcggccacagcgccguggugaccgacggcggcgaccuguucgugugcggccugaacaaggacggccagcugggccugggccacaccgaggacauccccuacuucacccccugcaagagccuguucggcugccccauccagcagguggccugcggcugggacuucaccaucaugcugaccgagaacggccaggugcugagcugcggcagcaacagcuucggccagcugggcgugccccacggccccagaagaugcguggugccccaggccaucgagcugcacaaggagaagguggugugcaucgccgccggccugagacacgccguggccgccaccgccagcggcaucguguuccaguggggcaccggccuggccagcugcggcagaagacugugccccggccagacccugccccuguucuucaccgccaaggagcccagcagagugaccggccuggagaacagcaaggccaugugcgugcuggccggcagcgaccacagcgccagccugaccgacgccggcgagguguacguguggggcagcaacaagcacggccagcuggccaacgaggccgccuuccugcccgugccccagaagaucgaggcccacugcuuccagaacgagaaggugaccgccaucuggagcggcuggacccaccugguggcccagaccgagaccggcaagauguucaccuggggcagagccgacuacggccagcugggcagaaagcuggagaccuacgagggcuggaagcuggagaagcaggacagcuuccugcccugcagcagaccccccaacagcaugcccagcagcccccacugccugaccggcgccaccgaggugagcugcggcagcgagcacaaccuggccaucaucggcggcgugugcuacagcuggggcuggaacgagcacggcaugugcggcgacggcaccgaggccaacgugugggcccccaagcccgugcaggcccugcugagcagcagcggccugcuggugggcugcggcgccggccacagccuggcccugugccagcugcccgcccaccccgcccuggugcaggaccccaaggugaccuaccugagccccgacgccaucgaggacaccgagagccagaaggccauggacaaggagagaaacuggaaggagagacagagcgagaccagcacccagagccagagcgacuggagcagaaacggcggccuguaa

SEQ ID NO: 23163 - RNA, 1362 nt, Artificial Sequence
  SERINC1__Homo_sapiens__NP_065806
augggcagcgugcugggccugugcagcauggccagcuggauccccugccugugcggcagcgcccccugccugcugugcagaugcugccccagcggcaacaacagcaccgugaccagacugaucuacgcccuguuccugcuggugggcgugugcguggccugcgugaugcugauccccggcauggaggagcagcugaacaagauccccggcuucugcgagaacgagaagggcguggugcccugcaacauccuggugggcuacaaggccguguacagacugugcuucggccuggccauguucuaccugcugcugagccugcugaugaucaaggugaagagcagcagcgaccccagagccgccgugcacaacggcuucugguucuucaaguucgccgccgccaucgccaucaucaucggcgccuucuucauccccgagggcaccuucaccaccgugugguucuacgugggcauggccggcgccuucugcuucauccugauccagcuggugcugcugaucgacuucgcccacagcuggaacgagagcuggguggagaagauggaggagggcaacagcagaugcugguacgccgcccugcugagcgccaccgcccugaacuaccugcugagccugguggccaucgugcuguucuucguguacuacacccaccccgccagcugcagcgagaacaaggccuucaucagcgugaacaugcugcugugcgugggcgccagcgugaugagcauccugcccaagauccaggagagccagcccagaagcggccugcugcagagcagcgugaucaccguguacaccauguaccugaccuggagcgccaugaccaacgagcccgagaccaacugcaaccccagccugcugagcaucaucggcuacaacaccaccagcaccgugcccaaggagggccagagcgugcagugguggcacgcccagggcaucaucggccugauccuguuccugcugugcguguucuacagcagcaucagaaccagcaacaacagccaggugaacaagcugacccugaccagcgacgagagcacccugaucgaggacggcggcgccagaagcgacggcagccuggaggacggcgacgacgugcacagagccguggacaacgagagagacggcgugaccuacagcuacagcuucuuccacuucaugcuguuccuggccagccuguacaucaugaugacccugaccaacugguacagauacgagcccagcagagagaugaagagccaguggaccgccgugugggugaagaucagcagcagcuggaucggcaucgugcuguacguguggacccugguggccccccuggugcugaccaacagagacuucgacuaa

SEQ ID NO: 23164 - RNA, 1422 nt, Artificial Sequence
  SERINC3__Homo_sapiens__NP_006802
augggcgccgugcugggcguguucagccuggccagcugggugcccugccugugcagcggcgccagcugccugcugugcagcugcugccccaacagcaagaacagcaccgugaccagacugaucuacgccuucauccugcugcugagcaccguggugagcuacaucaugcagagaaaggagauggagaccuaccugaagaagauccccggcuucugcgagggcggcuucaagauccacgaggccgacaucaacgccgacaaggacugcgacgugcuggugggcuacaaggccguguacagaaucagcuucgccauggccaucuucuucuucguguucagccugcugauguucaaggugaagaccagcaaggaccugagagccgccgugcacaacggcuucugguucuucaagaucgccgcccugaucggcaucauggugggcagcuucuacauccccggcggcuacuucagcagcgugugguucguggugggcaugaucggcgccgcccuguucauccugauccagcuggugcugcugguggacuucgcccacagcuggaacgagagcugggugaacagaauggaggagggcaaccccagacugugguacgccgcccugcugagcuucaccagcgccuucuacauccugagcaucaucugcgugggccugcuguacaccuacuacaccaagcccgacggcugcaccgagaacaaguucuucaucagcaucaaccugauccugugcgugguggccagcaucaucagcauccaccccaagauccaggagcaccagcccagaagcggccugcugcagagcagccugaucacccuguacaccauguaccugaccuggagcgccaugagcaacgagcccgacagaagcugcaaccccaaccugaugagcuucaucaccagaaucaccgcccccacccuggcccccggcaacagcaccgccguggugcccacccccaccccccccagcaagagcggcagccugcuggacagcgacaacuucaucggccuguucguguucgugcugugccugcuguacagcagcaucagaaccagcaccaacagccagguggacaagcugacccugagcggcagcgacagcgugauccugggcgacaccaccaccagcggcgccagcgacgaggaggacggccagcccagaagagccguggacaacgagaaggagggcgugcaguacagcuacagccuguuccaccugaugcugugccuggccagccuguacaucaugaugacccugaccagcugguacagccccgacgccaaguuccagagcaugaccagcaaguggcccgccgugugggugaagaucagcagcagcugggugugccugcugcuguacguguggacccugguggccccccuggugcugaccagcagagacuucagcuaa

SEQ ID NO: 23165 - RNA, 1263 nt, Artificial Sequence
  SERINC5__Homo_sapiens__NP_001167542
augagcgcccagugcugcgccggccagcuggccugcugcugcggcagcgccggcugcagccugugcugcgacugcugccccagaaucagacagagccugagcaccagauucauguacgcccuguacuucauccuggugguggugcugugcugcaucaugaugagcaccaccguggcccacaagaugaaggagcacauccccuucuucgaggacaugugcaagggcaucaaggccggcgacaccugcgagaagcuggugggcuacagcgccguguacagagugugcuucggcauggccugcuucuucuucaucuucugccugcugacccugaagaucaacaacagcaagagcugcagagcccacauccacaacggcuucugguucuucaagcugcugcugcugggcgccaugugcagcggcgccuucuucauccccgaccaggacaccuuccugaacgccuggagauacgugggcgccgugggcggcuuccuguucaucggcauccagcugcugcugcugguggaguucgcccacaaguggaacaagaacuggaccgccggcaccgccagcaacaagcugugguacgccagccuggcccuggugacccugaucauguacagcaucgccaccggcggccuggugcugauggccguguucuacacccagaaggacagcugcauggagaacaagauccugcugggcgugaacggcggccugugccugcugaucagccugguggccaucagccccugggugcagaacagacagccccacagcggccugcugcagagcggcgugaucagcugcuacgugaccuaccugaccuucagcgcccugagcagcaagcccgccgagguggugcuggacgagcacggcaagaacgugaccaucugcgugcccgacuucggccaggaccuguacagagacgagaaccuggugaccauccugggcaccagccugcugaucggcugcauccuguacagcugccugaccagcaccaccagaagcagcagcgacgcccugcagggcagauacgccgcccccgagcuggagaucgccagaugcugcuucugcuucagccccggcggcgaggacaccgaggagcagcagcccggcaaggagggccccagagugaucuacgacgagaagaagggcaccguguacaucuacagcuacuuccacuucguguucuuccuggccagccuguacgugaugaugaccgugaccaacugguucaagagcgccuuccaccugcugcccuaa

SEQ ID NO: 23166 - RNA, 201 nt, Artificial Sequence
  SERP1__Homo_sapiens__NP_055260
augguggccaagcagagaaucagaauggccaacgagaagcacagcaagaacaucacccagagaggcaacguggccaagaccagcagaaacgcccccgaggagaaggccagcgugggccccuggcugcuggcccuguucaucuucguggugugcggcagcgccaucuuccagaucauccagagcaucagaaugggcauguaa

SEQ ID NO: 23167 - RNA, 198 nt, Artificial Sequence
  SERP2__Homo_sapiens__NP_001010897
augguggccaagcagagaaucagaauggccaacgagaagcacagcaagaacaucacccagagaggcaacguggccaagacccugagaccccaggaggagaaguaccccgugggccccuggcugcuggcccuguucguguucguggugugcggcagcgccaucuuccagaucauccagagcaucagaaugggcauguaa

SEQ ID NO: 23168 - RNA, 1335 nt, Artificial Sequence
  SERPINA10__Homo_sapiens__NP_001094077
augaagguggugcccagccugcugcugagcgugcugcuggcccagguguggcuggugcccggccuggcccccagcccccagagccccgagacccccgccccccagaaccagaccagcagaguggugcaggcccccaaggaggaggaggaggacgagcaggaggccagcgaggagaaggccagcgaggaggagaaggccuggcugauggccagcagacagcagcuggccaaggagaccagcaacuucggcuucagccugcugagaaagaucagcaugagacacgacggcaacaugguguucagccccuucggcaugagccuggccaugaccggccugaugcugggcgccaccggccccaccgagacccagaucaagagaggccugcaccugcaggcccugaagcccaccaagcccggccugcugcccagccuguucaagggccugagagagacccugagcagaaaccuggagcugggccugacccagggcagcuucgccuucauccacaaggacuucgacgugaaggagaccuucuucaaccugagcaagagauacuucgacaccgagugcgugcccaugaacuucagaaacgccagccaggccaagagacugaugaaccacuacaucaacaaggagaccagaggcaagauccccaagcuguucgacgagaucaaccccgagaccaagcugauccugguggacuacauccuguucaagggcaaguggcugacccccuucgaccccguguucaccgagguggacaccuuccaccuggacaaguacaagaccaucaaggugcccaugauguacggcgccggcaaguucgccagcaccuucgacaagaacuucagaugccacgugcugaagcugcccuaccagggcaacgccaccaugcugguggugcugauggagaagaugggcgaccaccuggcccuggaggacuaccugaccaccgaccugguggagaccuggcugagaaacaugaagaccagaaacauggagguguucuuccccaaguucaagcuggaccagaaguacgagaugcacgagcugcugagacagaugggcaucagaagaaucuucagccccuucgccgaccugagcgagcugagcgccaccggcagaaaccugcaggugagcagagugcugcagagaaccgugaucgagguggacgagagaggcaccgaggccguggccggcauccugagcgagaucaccgccuacagcaugccccccgugaucaagguggacagacccuuccacuucaugaucuacgaggagaccagcggcaugcugcuguuccugggcagaguggugaaccccacccugcuguaa

SEQ ID NO: 23169 - RNA, 1269 nt, Artificial Sequence
  SERPINA11__Homo_sapiens__NP_001073920
augggccccgccuggcuguggcugcugggcaccggcauccuggccagcgugcacugccagccccugcuggcccacggcgacaagagccugcagggcccccagccccccagacaccagcugagcgagcccgcccccgccuaccacagaaucacccccaccaucaccaacuucgcccugagacuguacaaggagcuggccgccgacgcccccggcaacaucuucuucagccccgugagcaucagcaccacccuggcccugcugagccugggcgcccaggccaacaccagcgcccugauccuggagggccugggcuucaaccugaccgagacccccgaggccgacauccaccagggcuucagaagccugcugcacacccuggcccugcccagccccaagcuggagcugaaggugggcaacagccuguuccuggacaagagacugaagcccagacagcacuaccuggacagcaucaaggagcuguacggcgccuucgccuucagcgccaacuucaccgacagcgugaccaccggcagacagaucaacgacuaccugagaagacagaccuacggccaggugguggacugccugcccgaguucagccaggacaccuucauggugcuggccaacuacaucuucuucaaggccaaguggaagcaccccuucagcagauaccagacccagaagcaggagagcuucuucguggacgagagaaccagccugcaggugcccaugaugcaccagaaggagaugcacagauuccuguacgaccaggaccuggccugcaccgugcugcagaucgaguacagaggcaacgcccuggcccugcuggugcugcccgaccccggcaagaugaagcagguggaggccgcccugcagccccagacccugagaaaguggggccagcugcugcugcccagccugcuggaccugcaccugcccagauucagcaucagcggcaccuacaaccuggaggacauccugccccagaucggccugaccaacauccugaaccuggaggccgacuucagcggcgugaccggccagcugaacaagaccaucagcaaggugagccacaaggccaugguggacaugagcgagaagggcaccgaggccggcgccgccagcggccugcugagccagccccccagccugaacaccaugagcgacccccacgcccacuucaacagacccuuccugcugcugcugugggaggugaccacccagagccugcuguuccugggcaagguggugaaccccguggccggcuaa

SEQ ID NO: 23170 - RNA, 1245 nt, Artificial Sequence
  SERPINA12__Homo_sapiens__NP_001291390
augaaccccacccugggccuggccaucuuccuggccgugcugcugaccgugaagggccugcugaagcccagcuucagccccagaaacuacaaggcccugagcgaggugcagggcuggaagcagagaauggccgccaaggagcuggccagacagaacauggaccugggcuucaagcugcugaagaagcuggccuucuacaaccccggcagaaacaucuuccugagcccccugagcaucagcaccgccuucagcaugcugugccugggcgcccaggacagcacccuggacgagaucaagcagggcuucaacuucagaaagaugcccgagaaggaccugcacgagggcuuccacuacaucauccacgagcugacccagaagacccaggaccugaagcugagcaucggcaacacccuguucaucgaccagagacugcagccccagagaaaguuccuggaggacgccaagaacuucuacagcgccgagaccauccugaccaacuuccagaaccuggagauggcccagaagcagaucaacgacuucaucagccagaagacccacggcaagaucaacaaccugaucgagaacaucgaccccggcaccgugaugcugcuggccaacuacaucuucuucagagccagauggaagcacgaguucgaccccaacgugaccaaggaggaggacuucuuccuggagaagaacagcagcgugaaggugcccaugauguucagaagcggcaucuaccaggugggcuacgacgacaagcugagcugcaccauccuggagauccccuaccagaagaacaucaccgccaucuucauccugcccgacgagggcaagcugaagcaccuggagaagggccugcagguggacaccuucagcagauggaagacccugcugagcagaagagugguggacgugagcgugcccagacugcacaugaccggcaccuucgaccugaagaagacccugagcuacaucggcgugagcaagaucuucgaggagcacggcgaccugaccaagaucgccccccacagaagccugaaggugggcgaggccgugcacaaggccgagcugaagauggacgagagaggcaccgagggcgccgccggcaccggcgcccagacccugcccauggagaccccccugguggugaagaucgacaagcccuaccugcugcugaucuacagcgagaagauccccagcgugcuguuccugggcaagaucgugaaccccaucggcaaguaa

SEQ ID NO: 23171 - RNA, 1257 nt, Artificial Sequence
  SERPINA1__Homo_sapiens__NP_001121179
augcccagcagcgugagcuggggcauccugcugcuggccggccugugcugccuggugcccgugagccuggccgaggacccccagggcgacgccgcccagaagaccgacaccagccaccacgaccaggaccaccccaccuucaacaagaucacccccaaccuggccgaguucgccuucagccuguacagacagcuggcccaccagagcaacagcaccaacaucuucuucagccccgugagcaucgccaccgccuucgccaugcugagccugggcaccaaggccgacacccacgacgagauccuggagggccugaacuucaaccugaccgagauccccgaggcccagauccacgagggcuuccaggagcugcugagaacccugaaccagcccgacagccagcugcagcugaccaccggcaacggccuguuccugagcgagggccugaagcugguggacaaguuccuggaggacgugaagaagcuguaccacagcgaggccuucaccgugaacuucggcgacaccgaggaggccaagaagcagaucaacgacuacguggagaagggcacccagggcaagaucguggaccuggugaaggagcuggacagagacaccguguucgcccuggugaacuacaucuucuucaagggcaagugggagagacccuucgaggugaaggacaccgaggaggaggacuuccacguggaccaggugaccaccgugaaggugcccaugaugaagagacugggcauguucaacauccagcacugcaagaagcugagcagcugggugcugcugaugaaguaccugggcaacgccaccgccaucuucuuccugcccgacgagggcaagcugcagcaccuggagaacgagcugacccacgacaucaucaccaaguuccuggagaacgaggacagaagaagcgccagccugcaccugcccaagcugagcaucaccggcaccuacgaccugaagagcgugcugggccagcugggcaucaccaagguguucagcaacggcgccgaccugagcggcgugaccgaggaggccccccugaagcugagcaaggccgugcacaaggccgugcugaccaucgacgagaagggcaccgaggccgccggcgccauguuccuggaggccauccccaugagcaucccccccgaggugaaguucaacaagcccuucguguuccugaugaucgagcagaacaccaagagcccccuguucaugggcaagguggugaaccccacccagaaguaa

SEQ ID NO: 23172 - RNA, 1272 nt, Artificial Sequence
  SERPINA3__Homo_sapiens__NP_001076
auggagagaaugcugccccugcuggcccugggccugcuggccgccggcuucugccccgccgugcugugccaccccaacagcccccuggacgaggagaaccugacccaggagaaccaggacagaggcacccacguggaccugggccuggccagcgccaacguggacuucgccuucagccuguacaagcagcuggugcugaaggcccccgacaagaacgugaucuucagcccccugagcaucagcaccgcccuggccuuccugagccugggcgcccacaacaccacccugaccgagauccugaagggccugaaguucaaccugaccgagaccagcgaggccgagauccaccagagcuuccagcaccugcugagaacccugaaccagagcagcgacgagcugcagcugagcaugggcaacgccauguucgugaaggagcagcugagccugcuggacagauucaccgaggacgccaagagacuguacggcagcgaggccuucgccaccgacuuccaggacagcgccgccgccaagaagcugaucaacgacuacgugaagaacggcaccagaggcaagaucaccgaccugaucaaggaccuggacagccagaccaugauggugcuggugaacuacaucuucuucaaggccaagugggagaugcccuucgacccccaggacacccaccagagcagauucuaccugagcaagaagaagugggugauggugcccaugaugagccugcaccaccugaccauccccuacuucagagacgaggagcugagcugcaccgugguggagcugaaguacaccggcaacgccagcgcccuguucauccugcccgaccaggacaagauggaggagguggaggccaugcugcugcccgagacccugaagagauggagagacagccuggaguucagagagaucggcgagcuguaccugcccaaguucagcaucagcagagacuacaaccugaacgacauccugcugcagcugggcaucgaggaggccuucaccagcaaggccgaccugagcggcaucaccggcgccagaaaccuggccgugagccagguggugcacaaggccgugcuggacguguucgaggagggcaccgaggccagcgccgccaccgccgugaagaucacccugcugagcgcccugguggagaccagaaccaucgugagauucaacagacccuuccugaugaucaucgugcccaccgacacccagaacaucuucuucaugagcaaggugaccaaccccaagcaggccuaa

SEQ ID NO: 23173 - RNA, 1395 nt, Artificial Sequence
  SERPINA4__Homo_sapiens__NP_001275961
augcccggcgaccccgagaagcccccccccggcacccacagcugguacagagccgcccugaccgagggccagggccugcuggccgccaaccccggccugagagugcagagaaugcaccugaucgacuaccugcugcugcugcuggugggccugcuggcccugagccacggccagcugcacguggagcacgacggcgagagcugcagcaacagcagccaccagcagauccuggagaccggcgagggcagccccagccugaagaucgcccccgccaacgccgacuucgccuucagauucuacuaccugaucgccagcgagacccccggcaagaacaucuucuucagcccccugagcaucagcgccgccuacgccaugcugagccugggcgccugcagccacagcagaagccagauccuggagggccugggcuucaaccugaccgagcugagcgagagcgacgugcacagaggcuuccagcaccugcugcacacccugaaccugcccggccacggccuggagaccagagugggcagcgcccuguuccugagccacaaccugaaguuccuggccaaguuccugaacgacaccauggccguguacgaggccaagcuguuccacaccaacuucuacgacaccgugggcaccauccagcugaucaacgaccacgugaagaaggagaccagaggcaagaucguggaccuggugagcgagcugaagaaggacgugcugauggugcuggugaacuacaucuacuucaaggcccugugggagaagcccuucaucagcagcagaaccacccccaaggacuucuacguggacgagaacaccaccgugagagugcccaugaugcugcaggaccaggagcaccacugguaccugcacgacagauaccugcccugcagcgugcugagaauggacuacaagggcgacgccaccguguucuucauccugcccaaccagggcaagaugagagagaucgaggaggugcugacccccgagaugcugaugagauggaacaaccugcugagaaagagaaacuucuacaagaagcuggagcugcaccugcccaaguucagcaucagcggcagcuacgugcuggaccagauccugcccagacugggcuucaccgaccuguucagcaagugggccgaccugagcggcaucaccaagcagcagaagcuggaggccagcaagagcuuccacaaggccacccuggacguggacgaggccggcaccgaggccgccgccgccaccagcuucgccaucaaguucuucagcgcccagaccaacagacacauccugagauucaacagacccuuccugguggugaucuucagcaccagcacccagagcgugcuguuccugggcaaggugguggaccccaccaagcccuaa

SEQ ID NO: 23174 - RNA, 1221 nt, Artificial Sequence
  SERPINA5__Homo_sapiens__NP_000615
augcagcuguuccugcugcugugccuggugcugcugagcccccagggcgccagccugcacagacaccaccccagagagaugaagaagagaguggaggaccugcacgugggcgccaccguggcccccagcagcagaagagacuucaccuucgaccuguacagagcccuggccagcgccgcccccagccagagcaucuucuucagccccgugagcaucagcaugagccuggccaugcugagccugggcgccggcagcagcaccaagaugcagauccuggagggccugggccugaaccugcagaagagcagcgagaaggagcugcacagaggcuuccagcagcugcugcaggagcugaaccagcccagagacggcuuccagcugagccugggcaacgcccuguucaccgaccuggugguggaccugcaggacaccuucgugagcgccaugaagacccuguaccuggccgacaccuuccccaccaacuucagagacagcgccggcgccaugaagcagaucaacgacuacguggccaagcagaccaagggcaagaucguggaccugcugaagaaccuggacagcaacgccguggugaucauggugaacuacaucuucuucaaggccaagugggagaccagcuucaaccacaagggcacccaggagcaggacuucuacgugaccagcgagaccguggugagagugcccaugaugagcagagaggaccaguaccacuaccugcuggacagaaaccugagcugcagaguggugggcgugcccuaccagggcaacgccaccgcccuguucauccugcccagcgagggcaagaugcagcagguggagaacggccugagcgagaagacccugagaaaguggcugaagauguucaagaagagacagcuggagcuguaccugcccaaguucagcaucgagggcagcuaccagcuggagaaggugcugcccagccugggcaucagcaacguguucaccagccacgccgaccugagcggcaucagcaaccacagcaacauccaggugagcgagauggugcacaaggccgugguggagguggacgagagcggcaccagagccgccgccgccaccggcaccaucuucaccuucagaagcgccagacugaacagccagagacugguguucaacagacccuuccugauguucaucguggacaacaacauccuguuccugggcaaggugaacagacccuaa

SEQ ID NO: 23175 - RNA, 1218 nt, Artificial Sequence
  SERPINA6__Homo_sapiens__NP_001747
augccccugcugcuguacaccugccugcuguggcugcccaccagcggccuguggaccgugcaggccauggaccccaacgccgccuacgugaacaugagcaaccaccacagaggccuggccagcgccaacguggacuucgccuucagccuguacaagcaccugguggcccugagccccaagaagaacaucuucaucagccccgugagcaucagcauggcccuggccaugcugagccugggcaccugcggccacaccagagcccagcugcugcagggccugggcuucaaccugaccgagagaagcgagaccgagauccaccagggcuuccagcaccugcaccagcuguucgccaagagcgacaccagccuggagaugaccaugggcaacgcccuguuccuggacggcagccuggagcugcuggagagcuucagcgccgacaucaagcacuacuacgagagcgaggugcuggccaugaacuuccaggacugggccaccgccagcagacagaucaacagcuacgugaagaacaagacccagggcaagaucguggaccuguucagcggccuggacagccccgccauccuggugcuggugaacuacaucuucuucaagggcaccuggacccagcccuucgaccuggccagcaccagagaggagaacuucuacguggacgagaccaccguggugaaggugcccaugaugcugcagagcagcaccaucagcuaccugcacgacgccgagcugcccugccagcuggugcagaugaacuacgugggcaacggcaccguguucuucauccugcccgacaagggcaagaugaacaccgugaucgccgcccugagcagagacaccaucaacagauggagcgccggccugaccagcagccagguggaccuguacauccccaaggugaccaucagcggcguguacgaccugggcgacgugcuggaggagaugggcaucgccgaccuguucaccaaccaggccaacuucagcagaaucacccaggacgcccagcugaagagcagcaagguggugcacaaggccgugcugcagcugaacgaggagggcguggacaccgccggcagcaccggcgugacccugaaccugaccagcaagcccaucauccugagauucaaccagcccuucaucaucaugaucuucgaccacuucaccuggagcagccuguuccuggccagagugaugaaccccguguaa

SEQ ID NO: 23176 - RNA, 1248 nt, Artificial Sequence
  SERPINA7__Homo_sapiens__NP_000345
augagccccuuccuguaccuggugcugcuggugcugggccugcacgccaccauccacugcgccagccccgagggcaaggugaccgccugccacagcagccagcccaacgccacccuguacaagaugagcagcaucaacgccgacuucgccuucaaccuguacagaagauucaccguggagacccccgacaagaacaucuucuucagccccgugagcaucagcgccgcccuggugaugcugagcuucggcgccugcugcagcacccagaccgagaucguggagacccugggcuucaaccugaccgacacccccaugguggagauccagcacggcuuccagcaccugaucugcagccugaacuuccccaagaaggagcuggagcugcagaucggcaacgcccuguucaucggcaagcaccugaagccccuggccaaguuccugaacgacgugaagacccuguacgagaccgagguguucagcaccgacuucagcaacaucagcgccgccaagcaggagaucaacagccacguggagaugcagaccaagggcaagguggugggccugauccaggaccugaagcccaacaccaucauggugcuggugaacuacauccacuucaaggcccagugggccaaccccuucgaccccagcaagaccgaggacagcagcagcuuccugaucgacaagaccaccaccgugcaggugcccaugaugcaccagauggagcaguacuaccaccugguggacauggagcugaacugcaccgugcugcagauggacuacagcaagaacgcccuggcccuguucgugcugcccaaggagggccagauggagagcguggaggccgccaugagcagcaagacccugaagaaguggaacagacugcugcagaagggcuggguggaccuguucgugcccaaguucagcaucagcgccaccuacgaccugggcgccacccugcugaagaugggcauccagcacgccuacagcgagaacgccgacuucagcggccugaccgaggacaacggccugaagcugagcaacgccgcccacaaggccgugcugcacaucggcgagaagggcaccgaggccgccgccgugcccgagguggagcugagcgaccagcccgagaacaccuuccugcaccccaucauccagaucgacagaagcuucaugcugcugauccuggagagaagcaccagaagcauccuguuccugggcaagguggugaaccccaccgaggccuaa

SEQ ID NO: 23177 - RNA, 1008 nt, Artificial Sequence
  SERPINA9__Homo_sapiens__NP_001035983
augcagggccagggcagaagaagaggcaccugcaaggacaucuucugcagcaagauggccagcuaccuguacggcgugcuguucgccgugggccugugcgcccccaucuacugcgugagccccgccaacgcccccagcgccuaccccagacccagcagcaccaagagcacccccgccagccagguguacagccugaacaccgacuucgccuucagacuguacagaagacuggugcuggagacccccagccagaacaucuucuucagccccgccagaaucaacagccacgugaagaagaagacccagggcaaggugguggacaucauccagggccuggaccugcugaccgccauggugcuggugaaccacaucuucuucaaggccaagugggagaagcccuuccaccccgaguacaccagaaagaacuuccccuuccuggugggcgagcaggugaccgugcacgugcccaugaugcaccagaaggagcaguucgccuucggcguggacaccgagcugaacugcuucgugcugcagauggacuacaagggcgacgccguggccuucuucgugcugcccagcaagggcaagaugagacagcuggagcaggcccugagcgccagaacccugagaaaguggagccacagccugcagaagagauggaucgagguguucauccccagauucagcaucagcgccagcuacaaccuggagaccauccugcccaagaugggcauccagaacguguucgacaagaacgccgacuucagcggcaucgccaagagagacagccugcaggugagcaaggccacccacaaggccgugcuggacgugagcgaggagggcaccgaggccaccgccgccaccaccaccaaguucaucgugagaagcaaggacggccccagcuacuucaccgugagcuucaacagaaccuuccugaugaugaucaccaacaaggccaccgacggcauccuguuccugggcaagguggagaaccccaccaagagcuaa

SEQ ID NO: 23178 - RNA, 1194 nt, Artificial Sequence
  SERPINB10__Homo_sapiens__NP_005015
auggacagccuggccaccagcaucaaccaguucgcccuggagcugagcaagaagcuggccgagagcgcccagggcaagaacaucuucuucagcagcuggagcaucagcaccagccugaccaucguguaccugggcgccaagggcaccaccgccgcccagauggcccaggugcugcaguucaacagagaccagggcgugaagugcgaccccgagagcgagaagaagagaaagauggaguucaaccugagcaacagcgaggagauccacagcgacuuccagacccugaucagcgagauccugaagcccaacgacgacuaccugcugaagaccgccaacgccaucuacggcgagaagaccuacgccuuccacaacaaguaccuggaggacaugaagaccuacuucggcgccgagccccagcccgugaacuucguggaggccagcgaccagaucagaaaggacaucaacagcuggguggagagacagaccgagggcaagauccagaaccugcugcccgacgacagcguggacagcaccaccagaaugauccuggugaacgcccuguacuucaagggcaucugggagcaccaguuccuggugcagaacaccaccgagaagcccuucagaaucaacgagaccaccagcaagcccgugcagaugauguucaugaagaagaagcugcacaucuuccacaucgagaagcccaaggccgugggccugcagcuguacuacaagagcagagaccugagccugcugauccugcugcccgaggacaucaacggccuggagcagcuggagaaggccaucaccuacgagaagcugaacgaguggaccagcgccgacaugauggagcuguacgaggugcagcugcaccugcccaaguucaagcuggaggacagcuacgaccugaagagcacccugagcagcaugggcaugagcgacgccuucagccagagcaaggccgacuucagcggcaugagcagcgccagaaaccuguuccugagcaacguguuccacaaggccuucguggagaucaacgagcagggcaccgaggccgccgccggcagcggcagcgagaucgacaucagaaucagagugcccagcaucgaguucaacgccaaccaccccuuccuguucuucaucagacacaacaagaccaacaccauccuguucuacggcagacugugcagccccuaa

SEQ ID NO: 23179 - RNA, 1176 nt, Artificial Sequence
  SERPINB13__Homo_sapiens__NP_036529
auggacagccugggcgccgugagcaccagacugggcuucgaccuguucaaggagcugaagaagaccaacgacggcaacaucuucuucagccccgugggcauccugaccgccaucggcauggugcugcugggcaccagaggcgccaccgccagccagcuggaggagguguuccacagcgagaaggagaccaagagcagcagaaucaaggccgaggagaaggaggugaucgagaacaccgaggccgugcaccagcaguuccagaaguuccugaccgagaucagcaagcugaccaacgacuacgagcugaacaucaccaacagacuguucggcgagaagaccuaccuguuccugcagaaguaccuggacuacguggagaaguacuaccacgccagccuggagcccguggacuucgugaacgccgccgacgagagcagaaagaagaucaacagcuggguggagagcaagaccaacgagaagaucaaggaccuguuccccgacggcagcaucagcagcagcaccaagcuggugcuggugaacaugguguacuucaagggccagugggacagagaguucaagaaggagaacaccaaggaggagaaguucuggaugaacaagagcaccagcaagagcgugcagaugaugacccagagccacagcuucagcuucaccuuccuggaggaccugcaggccaagauccugggcauccccuacaagaacaacgaccugagcauguucgugcugcugcccaacgacaucgacggccuggagaagaucaucgacaagaucagccccgagaagcugguggaguggaccagccccggccacauggaggagagaaaggugaaccugcaccugcccagauucgagguggaggacggcuacgaccuggaggccgugcuggccgccaugggcaugggcgacgccuucagcgagcacaaggccgacuacagcggcaugagcagcggcagcggccuguacgcccagaaguuccugcacagcagcuucguggccgugaccgaggagggcaccgaggccgccgccgccaccggcaucggcuucaccgugaccagcgcccccggccacgagaacgugcacugcaaccaccccuuccuguucuucaucagacacaacgagagcaacagcauccuguucuucggcagauucagcagccccuaa

SEQ ID NO: 23180 - RNA, 1140 nt, Artificial Sequence
  SERPINB1__Homo_sapiens__NP_109591
auggagcagcugagcagcgccaacaccagauucgcccuggaccuguuccuggcccugagcgagaacaaccccgccggcaacaucuucaucagccccuucagcaucagcagcgccauggccaugguguuccugggcaccagaggcaacaccgccgcccagcugagcaagaccuuccacuucaacaccguggaggaggugcacagcagauuccagagccugaacgccgacaucaacaagagaggcgccagcuacauccugaagcuggccaacagacuguacggcgagaagaccuacaacuuccugcccgaguuccuggugagcacccagaagaccuacggcgccgaccuggccagcguggacuuccagcacgccagcgaggacgccagaaagaccaucaaccagugggugaagggccagaccgagggcaagauccccgagcugcuggccagcggcaugguggacaacaugaccaagcuggugcuggugaacgccaucuacuucaagggcaacuggaaggacaaguucaugaaggaggccaccaccaacgcccccuucagacugaacaagaaggacagaaagaccgugaagaugauguaccagaagaagaaguucgccuacggcuacaucgaggaccugaagugcagagugcuggagcugcccuaccagggcgaggagcugagcauggugauccugcugcccgacgacaucgaggacgagagcaccggccugaagaagaucgaggagcagcugacccuggagaagcugcacgaguggaccaagcccgagaaccuggacuucaucgaggugaacgugagccugcccagauucaagcuggaggagagcuacacccugaacagcgaccuggccagacugggcgugcaggaccuguucaacagcagcaaggccgaccugagcggcaugagcggcgccagagacaucuucaucagcaagaucgugcacaagagcuucguggaggugaacgaggagggcaccgaggccgccgccgccaccgccggcaucgccaccuucugcaugcugaugcccgaggagaacuucaccgccgaccaccccuuccuguucuucaucagacacaacagcagcggcagcauccuguuccugggcagauucagcagccccuaa

SEQ ID NO: 23181 - RNA, 1248 nt, Artificial Sequence
  SERPINB2__Homo_sapiens__NP_001137290
auggaggaccugugcguggccaacacccuguucgcccugaaccuguucaagcaccuggccaaggccagccccacccagaaccuguuccugagccccuggagcaucagcagcaccauggccaugguguacaugggcagcagaggcagcaccgaggaccagauggccaaggugcugcaguucaacgaggugggcgccaacgccgugacccccaugacccccgagaacuucaccagcugcggcuucaugcagcagauccagaagggcagcuaccccgacgccauccugcaggcccaggccgccgacaagauccacagcagcuucagaagccugagcagcgccaucaacgccagcaccggcaacuaccugcuggagagcgugaacaagcuguucggcgagaagagcgccagcuucagagaggaguacaucagacugugccagaaguacuacagcagcgagccccaggccguggacuuccuggagugcgccgaggaggccagaaagaagaucaacagcugggugaagacccagaccaagggcaagauccccaaccugcugcccgagggcagcguggacggcgacaccagaauggugcuggugaacgccguguacuucaagggcaaguggaagacccccuucgagaagaagcugaacggccuguaccccuucagagugaacagcgcccagagaacccccgugcagaugauguaccugagagagaagcugaacaucggcuacaucgaggaccugaaggcccagauccuggagcugcccuacgccggcgacgugagcauguuccugcugcugcccgacgagaucgccgacgugagcaccggccuggagcugcuggagagcgagaucaccuacgacaagcugaacaaguggaccagcaaggacaagauggccgaggacgagguggagguguacaucccccaguucaagcuggaggagcacuacgagcugagaagcauccugagaagcaugggcauggaggacgccuucaacaagggcagagccaacuucagcggcaugagcgagagaaacgaccuguuccugagcgagguguuccaccaggccaugguggacgugaacgaggagggcaccgaggccgccgccggcaccggcggcgugaugaccggcagaaccggccacggcggcccccaguucguggccgaccaccccuuccuguuccugaucaugcacaagaucaccaacugcauccuguucuucggcagauucagcagccccuaa

SEQ ID NO: 23182 - RNA, 1173 nt, Artificial Sequence
  SERPINB3__Homo_sapiens__NP_008850
augaacagccugagcgaggccaacaccaaguucauguucgaccuguuccagcaguucagaaagagcaaggagaacaacaucuucuacagccccaucagcaucaccagcgcccugggcauggugcugcugggcgccaaggacaacaccgcccagcagaucaagaaggugcugcacuucgaccaggugaccgagaacaccaccggcaaggccgccaccuaccacguggacagaagcggcaacgugcaccaccaguuccagaagcugcugaccgaguucaacaagagcaccgacgccuacgagcugaagaucgccaacaagcuguucggcgagaagaccuaccuguuccugcaggaguaccuggacgccaucaagaaguucuaccagaccagcguggagagcguggacuucgccaacgcccccgaggagagcagaaagaagaucaacagcuggguggagagccagaccaacgagaagaucaagaaccugauccccgagggcaacaucggcagcaacaccacccuggugcuggugaacgccaucuacuucaagggccagugggagaagaaguucaacaaggaggacaccaaggaggagaaguucuggcccaacaagaacaccuacaagagcauccagaugaugagacaguacaccagcuuccacuucgccagccuggaggacgugcaggccaaggugcuggagauccccuacaagggcaaggaccugagcaugaucgugcugcugcccaacgagaucgacggccugcagaagcuggaggagaagcugaccgccgagaagcugauggaguggaccagccugcagaacaugagagagaccagaguggaccugcaccugcccagauucaagguggaggagagcuacgaccugaaggacacccugagaaccaugggcaugguggacaucuucaacggcgacgccgaccugagcggcaugaccggcagcagaggccuggugcugagcggcgugcugcacaaggccuucguggaggugaccgaggagggcgccgaggccgccgccgccaccgccguggugggcuucggcagcagccccaccagcaccaacgaggaguuccacugcaaccaccccuuccuguucuucaucagacagaacaagaccaacagcauccuguucuacggcagauucagcagccccuaa

SEQ ID NO: 23183 - RNA, 1110 nt, Artificial Sequence
  SERPINB4__Homo_sapiens__NP_778206
augaacagccugagcgaggccaacaccaaguucauguucgaccuguuccagcaguucagaaagagcaaggagaacaacaucuucuacagccccaucagcaucaccagcgcccugggcauggugcugcugggcgccaaggacaacaccgcccagcagaucagcaaggugcugcacuucgaccaggugaccgagaacaccaccgagaaggccgccaccuaccacguggacagaagcggcaacgugcaccaccaguuccagaagcugcugaccgaguucaacaagagcaccgacgccuacgagcugaagaucgccaacaagcuguucggcgagaagaccuaccaguuccugcaggaguaccuggacgccaucaagaaguucuaccagaccagcguggagagcaccgacuucgccaacgcccccgaggagagcagaaagaagaucaacagcuggguggagagccagaccaacgagaagaucaagaaccuguuccccgacggcaccaucggcaacgacaccacccuggugcuggugaacgccaucuacuucaagggccagugggagaacaaguucaagaaggagaacaccaaggaggagaaguucuggcccaacaaggacgugcaggccaaggugcuggagauccccuacaagggcaaggaccugagcaugaucgugcugcugcccaacgagaucgacggccugcagaagcuggaggagaagcugaccgccgagaagcugauggaguggaccagccugcagaacaugagagagaccugcguggaccugcaccugcccagauucaagauggaggagagcuacgaccugaaggacacccugagaaccaugggcauggugaacaucuucaacggcgacgccgaccugagcggcaugaccuggagccacggccugagcgugagcaaggugcugcacaaggccuucguggaggugaccgaggagggcguggaggccgccgccgccaccgccgugguggugguggagcugagcagccccagcaccaacgaggaguucugcugcaaccaccccuuccuguucuucaucagacagaacaagaccaacagcauccuguucuacggcagauucagcagccccuaa

SEQ ID NO: 23184 - RNA, 1128 nt, Artificial Sequence
  SERPINB5__Homo_sapiens__NP_002630
auggacgcccugcagcuggccaacagcgccuucgccguggaccuguucaagcagcugugcgagaaggagccccugggcaacgugcuguucagccccaucugccugagcaccagccugagccuggcccaggugggcgccaagggcgacaccgccaacgagaucggccaggugcugcacuucgagaacgugaaggacgugcccuucggcuuccagaccgugaccagcgacgugaacaagcugagcagcuucuacagccugaagcugaucaagagacuguacguggacaagagccugaaccugagcaccgaguucaucagcagcaccaagagacccuacgccaaggagcuggagaccguggacuucaaggacaagcuggaggagaccaagggccagaucaacaacagcaucaaggaccugaccgacggccacuucgagaacauccuggccgacaacagcgugaacgaccagaccaagauccugguggugaacgccgccuacuucgugggcaaguggaugaagaaguucagcgagagcgagaccaaggagugccccuucagagugaacaagaccgacaccaagcccgugcagaugaugaacauggaggccaccuucugcaugggcaacaucgacagcaucaacugcaagaucaucgagcugcccuuccagaacaagcaccugagcauguucauccugcugcccaaggacguggaggacgagagcaccggccuggagaagaucgagaagcagcugaacagcgagagccugagccaguggaccaaccccagcaccauggccaacgccaaggugaagcugagcauccccaaguucaagguggagaagaugaucgaccccaaggccugccuggagaaccugggccugaagcacaucuucagcgaggacaccagcgacuucagcggcaugagcgagaccaagggcguggcccugagcaacgugauccacaaggugugccuggagaucaccgaggacggcggcgacagcaucgaggugcccggcgccagaauccugcagcacaaggacgagcugaacgccgaccaccccuucaucuacaucaucagacacaacaagaccagaaacaucaucuucuucggcaaguucugcagccccuaa

SEQ ID NO: 23185 - RNA, 1143 nt, Artificial Sequence
  SERPINB6__Homo_sapiens__NP_001182220
augagcgccaucauggacgugcuggccgaggccaacggcaccuucgcccugaaccugcugaagacccugggcaaggacaacagcaagaacguguucuucagccccaugagcaugagcugcgcccuggccaugguguacaugggcgccaagggcaacaccgccgcccagauggcccagauccugagcuucaacaagagcggcggcggcggcgacauccaccagggcuuccagagccugcugaccgaggugaacaagaccggcacccaguaccugcugagaauggccaacagacuguucggcgagaagagcugcgacuuccugagcagcuucagagacagcugccagaaguucuaccaggccgagauggaggagcuggacuucaucagcgccguggagaagagcagaaagcacaucaacaccuggguggccgagaagaccgagggcaagaucgccgagcugcugagccccggcagcguggacccccugaccagacuggugcuggugaacgccguguacuucagaggcaacugggacgagcaguucgacaaggagaacaccgaggagagacuguucaaggugagcaagaacgaggagaagcccgugcagaugauguucaagcagagcaccuucaagaagaccuacaucggcgagaucuucacccagauccuggugcugcccuacgugggcaaggagcugaacaugaucaucaugcugcccgacgagaccaccgaccugagaaccguggagaaggagcugaccuacgagaaguucguggaguggaccagacuggacaugauggacgaggaggagguggaggugagccugcccagauucaagcuggaggagagcuacgacauggagagcgugcugagaaaccugggcaugaccgacgccuucgagcugggcaaggccgacuucagcggcaugagccagaccgaccugagccugagcaagguggugcacaagagcuucguggaggugaacgaggagggcaccgaggccgccgccgccaccgccgccaucaugaugaugagaugcgccagauucgugcccagauucugcgccgaccaccccuuccuguucuucauccagcacagcaagaccaacggcauccuguucugcggcagauucagcagccccuaa

SEQ ID NO: 23186 - RNA, 1092 nt, Artificial Sequence
  SERPINB7__Homo_sapiens__NP_001248760
auggccagccuggccgccgccaacgccgaguucugcuucaaccuguucagagagauggacgacaaccagggcaacggcaacguguucuucagcagccugagccuguucgccgcccuggcccuggugagacugggcgcccaggacgacagccugagccagaucgacaagagcggccugcagagccagcugaagagaguguucagcgacaucaacgccagccacaaggacuacgaccugagcaucgugaacggccuguucgccgagaagguguacggcuuccacaaggacuacaucgagugcgccgagaagcuguacgacgccaagguggagagaguggacuucaccaaccaccuggaggacaccagaagaaacaucaacaaguggguggagaacgagacccacggcaagaucaagaacgugaucggcgagggcggcaucagcagcagcgccgugauggugcuggugaacgccguguacuucaagggcaaguggcagagcgccuucaccaagagcgagaccaucaacugccacuucaagagccccaagugcagcggcaaggccguggccaugaugcaccaggagagaaaguucaaccugagcgugaucgaggaccccagcaugaagauccuggagcugagauacaacggcggcaucaacauguacgugcugcugcccgagaacgaccugagcgagaucgagaacaagcugaccuuccagaaccugauggaguggaccaaccccagaagaaugaccagcaaguacguggagguguucuucccccaguucaagaucgagaagaacuacgagaugaagcaguaccugagagcccugggccugaaggacaucuucgacgagagcaaggccgaccugagcggcaucgccagcggcggcagacuguacaucagcagaaugaugcacaagagcuacaucgaggugaccgaggagggcaccgaggccaccgccgccaccggcagcaacaucguggagaagcagcugccccagagcacccuguucagagccgaccaccccuuccuguucgugaucagaaaggacgacaucauccuguucagcggcaaggugagcugccccuaa

SEQ ID NO: 23187 - RNA, 729 nt, Artificial Sequence
  SERPINB8__Homo_sapiens__NP_001027018
auggacgaccugugcgaggccaacggcaccuucgccaucagccuguucaagauccugggcgaggaggacaacagcagaaacguguucuucagccccaugagcaucagcagcgcccuggccaugguguucaugggcgccaagggcagcaccgccgcccagaugagccaggcccugugccuguacaaggacggcgacauccacagaggcuuccagagccugcugagcgaggugaacagaaccggcacccaguaccugcugagaaccgccaacagacuguucggcgagaagaccugcgacuuccugcccgacuucaaggaguacugccagaaguucuaccaggccgagcuggaggagcugagcuucgccgaggacaccgaggagugcagaaagcacaucaacgacuggguggccgagaagaccgagggcaagaucagcgaggugcuggacgccggcaccguggacccccugaccaagcuggugcuggugaacgccaucuacuucaagggcaaguggaacgagcaguucgacagaaaguacaccagaggcaugcuguucaagaccaacgaggagaagaagaccgugcagaugauguucaaggaggccaaguucaagaugggcuacgccgacgaggugcacacccaggugcuggagcugcccuacguggaggaggagcugagcauggugauccugcugcccgacgacaacaccgaccuggccgugaaggaguaa

SEQ ID NO: 23188 - RNA, 1131 nt, Artificial Sequence
  SERPINB9__Homo_sapiens__XP_005249241
auggagacccugagcaacgccagcggcaccuucgccaucagacugcugaagauccugugccaggacaaccccagccacaacguguucugcagccccgugagcaucagcagcgcccuggccauggugcugcugggcgccaagggcaacaccgccacccagauggcccaggcccugagccugaacaccgaggaggacauccacagagccuuccagagccugcugaccgaggugaacaaggccggcacccaguaccugcugagaaccgccaacagacuguucggcgagaagaccugccaguuccugagcaccuucaaggagagcugccugcaguucuaccacgccgagcugaaggagcugagcuucaucagagccgccgaggagagcagaaagcacaucaacaccugggugagcaagaagaccgagggcaagaucgaggagcugcugcccggcagcagcaucgacgccgagaccagacuggugcuggugaacgccaucuacuucaagggcaaguggaacgagcccuucgacgagaccuacaccagagagaugcccuucaagaucaaccaggaggagcagagacccgugcagaugauguaccaggaggccaccuucaagcuggcccacgugggcgaggugagagcccagcugcuggagcugcccuacgccagaaaggagcugagccugcuggugcugcugcccgacgacggcguggagcugagcaccguggagaagagccugaccuucgagaagcugaccgccuggaccaagcccgacugcaugaagagcaccgagguggaggugcugcugcccaaguucaagcugcaggaggacuacgacauggagagcgugcugagacaccugggcaucguggacgccuuccagcagggcaaggccgaccugagcgccaugagcgccgagagagaccugugccugagcaaguucgugcacaagagcuucguggaggugaacgaggagggcaccgaggccgccgccgccagcagcugcuucgugguggccgagugcugcauggagagcggccccagauucugcgccgaccaccccuuccuguucuucaucagacacaacagagccaacagcauccuguucugcggcagauucagcagccccuaa

SEQ ID NO: 23189 - RNA, 1395 nt, Artificial Sequence
  SERPINC1__Homo_sapiens__NP_000479
auguacagcaacgugaucggcaccgugaccagcggcaagagaaagguguaccugcugagccugcugcugaucggcuucugggacugcgugaccugccacggcagccccguggacaucugcaccgccaagcccagagacauccccaugaaccccaugugcaucuacagaagccccgagaagaaggccaccgaggacgagggcagcgagcagaagauccccgaggccaccaacagaagagugugggagcugagcaaggccaacagcagauucgccaccaccuucuaccagcaccuggccgacagcaagaacgacaacgacaacaucuuccugagcccccugagcaucagcaccgccuucgccaugaccaagcugggcgccugcaacgacacccugcagcagcugauggagguguucaaguucgacaccaucagcgagaagaccagcgaccagauccacuucuucuucgccaagcugaacugcagacuguacagaaaggccaacaagagcagcaagcuggugagcgccaacagacuguucggcgacaagagccugaccuucaacgagaccuaccaggacaucagcgagcugguguacggcgccaagcugcagccccuggacuucaaggagaacgccgagcagagcagagccgccaucaacaagugggugagcaacaagaccgagggcagaaucaccgacgugauccccagcgaggccaucaacgagcugaccgugcuggugcuggugaacaccaucuacuucaagggccuguggaagagcaaguucagccccgagaacaccagaaaggagcuguucuacaaggccgacggcgagagcugcagcgccagcaugauguaccaggagggcaaguucagauacagaagaguggccgagggcacccaggugcuggagcugcccuucaagggcgacgacaucaccauggugcugauccugcccaagcccgagaagagccuggccaagguggagaaggagcugacccccgaggugcugcaggaguggcuggacgagcuggaggagaugaugcugguggugcacaugcccagauucagaaucgaggacggcuucagccugaaggagcagcugcaggacaugggccugguggaccuguucagccccgagaagagcaagcugcccggcaucguggccgagggcagagacgaccuguacgugagcgacgccuuccacaaggccuuccuggaggugaacgaggagggcagcgaggccgccgccagcaccgccguggugaucgccggcagaagccugaaccccaacagagugaccuucaaggccaacagacccuuccugguguucaucagagaggugccccugaacaccaucaucuucaugggcagaguggccaaccccugcgugaaguaa

SEQ ID NO: 23190 - RNA, 1500 nt, Artificial Sequence
  SERPIND1__Homo_sapiens__NP_000176
augaagcacagccugaacgcccugcugaucuuccugaucaucaccagcgccuggggcggcagcaagggcccccuggaccagcuggagaagggcggcgagaccgcccagagcgccgacccccagugggagcagcugaacaacaagaaccugagcaugccccugcugcccgccgacuuccacaaggagaacaccgugaccaacgacuggauccccgagggcgaggaggacgacgacuaccuggaccuggagaagaucuucagcgaggacgacgacuacaucgacaucguggacagccugagcgugagccccaccgacagcgacgugagcgccggcaacauccugcagcuguuccacggcaagagcagaauccagagacugaacauccugaacgccaaguucgccuucaaccuguacagagugcugaaggaccaggugaacaccuucgacaacaucuucaucgcccccgugggcaucagcaccgccaugggcaugaucagccugggccugaagggcgagacccacgagcaggugcacagcauccugcacuucaaggacuucgugaacgccagcagcaaguacgagaucaccaccauccacaaccuguucagaaagcugacccacagacuguucagaagaaacuucggcuacacccugagaagcgugaacgaccuguacauccagaagcaguuccccauccugcuggacuucaagaccaaggugagagaguacuacuucgccgaggcccagaucgccgacuucagcgaccccgccuucaucagcaagaccaacaaccacaucaugaagcugaccaagggccugaucaaggacgcccuggagaacaucgaccccgccacccagaugaugauccugaacugcaucuacuucaagggcagcugggugaacaaguuccccguggagaugacccacaaccacaacuucagacugaacgagagagagguggugaaggugagcaugaugcagaccaagggcaacuuccuggccgccaacgaccaggagcuggacugcgacauccugcagcuggaguacgugggcggcaucagcaugcugaucguggugccccacaagaugagcggcaugaagacccuggaggcccagcugacccccagagugguggagagauggcagaagagcaugaccaacagaaccagagaggugcugcugcccaaguucaagcuggagaagaacuacaaccugguggagagccugaagcugaugggcaucagaaugcuguucgacaagaacggcaacauggccggcaucagcgaccagagaaucgccaucgaccuguucaagcaccagggcaccaucaccgugaacgaggagggcacccaggccaccaccgugaccaccgugggcuucaugccccugagcacccaggugagauucaccguggacagacccuuccuguuccugaucuacgagcacagaaccagcugccugcuguucaugggcagaguggccaaccccagcagaagcuaa

SEQ ID NO: 23191 - RNA, 1209 nt, Artificial Sequence
  SERPINE1__Homo_sapiens__NP_000593
augcagaugagccccgcccugaccugccuggugcugggccuggcccugguguucggcgagggcagcgccgugcaccacccccccagcuacguggcccaccuggccagcgacuucggcgugagaguguuccagcagguggcccaggccagcaaggacagaaacgugguguucagccccuacggcguggccagcgugcuggccaugcugcagcugaccaccggcggcgagacccagcagcagauccaggccgccaugggcuucaagaucgacgacaagggcauggcccccgcccugagacaccuguacaaggagcugaugggccccuggaacaaggacgagaucagcaccaccgacgccaucuucgugcagagagaccugaagcuggugcagggcuucaugccccacuucuucagacuguucagaagcaccgugaagcagguggacuucagcgagguggagagagccagauucaucaucaacgacugggugaagacccacaccaagggcaugaucagcaaccugcugggcaagggcgccguggaccagcugaccagacuggugcuggugaacgcccuguacuucaacggccaguggaagacccccuuccccgacagcagcacccacagaagacuguuccacaagagcgacggcagcaccgugagcgugcccaugauggcccagaccaacaaguucaacuacaccgaguucaccacccccgacggccacuacuacgacauccuggagcugcccuaccacggcgacacccugagcauguucaucgccgcccccuacgagaaggaggugccccugagcgcccugaccaacauccugagcgcccagcugaucagccacuggaagggcaacaugaccagacugcccagacugcuggugcugcccaaguucagccuggagaccgagguggaccugagaaagccccuggagaaccugggcaugaccgacauguucagacaguuccaggccgacuucaccagccugagcgaccaggagccccugcacguggcccaggcccugcagaaggugaagaucgaggugaacgagagcggcaccguggccagcagcagcaccgccgugaucgugagcgccagaauggcccccgaggagaucaucauggacagacccuuccuguucguggugagacacaaccccaccggcaccgugcuguucaugggccaggugauggagcccuaa

SEQ ID NO: 23192 - RNA, 1194 nt, Artificial Sequence
  SERPINE2__Homo_sapiens__NP_001130000
augaacuggcaccugccccuguuccugcuggccagcgugacccugcccagcaucugcagccacuucaacccccugagccuggaggagcugggcagcaacaccggcauccagguguucaaccagaucgugaagagcagaccccacgacaacaucgugaucagcccccacggcaucgccagcgugcugggcaugcugcagcugggcgccgacggcagaaccaagaagcagcuggccauggugaugagauacggcgugaacggcgugggcaagauccugaagaagaucaacaaggccaucgugagcaagaagaacaaggacaucgugaccguggccaacgccguguucgugaagaacgccagcgagaucgaggugcccuucgugaccagaaacaaggacguguuccagugcgaggugagaaacgugaacuucgaggaccccgccagcgccugcgacagcaucaacgccugggugaagaacgagaccagagacaugaucgacaaccugcugagccccgaccugaucgacggcgugcugaccagacuggugcuggugaacgccguguacuucaagggccuguggaagagcagauuccagcccgagaacaccaagaagagaaccuucguggccgccgacggcaagagcuaccaggugcccaugcuggcccagcugagcguguucagaugcggcagcaccagcgcccccaacgaccugugguacaacuucaucgagcugcccuaccacggcgagagcaucagcaugcugaucgcccugcccaccgagagcagcaccccccugagcgccaucaucccccacaucagcaccaagaccaucgacagcuggaugagcaucauggugcccaagagagugcaggugauccugcccaaguucaccgccguggcccagaccgaccugaaggagccccugaaggugcugggcaucaccgacauguucgacagcagcaaggccaacuucgccaagaucaccagaagcgagaaccugcacgugagccacauccugcagaaggccaagaucgaggugagcgaggacggcaccaaggccagcgccgccaccaccgccauccugaucgccagaagcagcccccccugguucaucguggacagacccuuccuguucuucaucagacacaaccccaccggcgccgugcuguucaugggccagaucaacaagcccuaa

SEQ ID NO: 23193 - RNA, 1275 nt, Artificial Sequence
  SERPINE3__Homo_sapiens__NP_001094790
augccccccuuccugaucacccuguuccuguuccacagcugcugccugagagccaacggccaccugagagagggcaugacccugcugaagaccgaguucgcccugcaccuguaccagagcguggccgccugcagaaacgagaccaacuucgugaucagccccgccggcgugagccugccccuggagauccugcaguucggcgccgagggcagcaccggccagcagcuggccgacgcccugggcuacaccgugcacgacaagagagugaaggacuuccugcacgccguguacgccacccugcccaccagcagccagggcaccgagauggagcuggccugcagccuguucgugcaggugggcaccccccugagccccugcuucguggagcacgugagcuggugggccaacagcagccuggagcccgccgaccugagcgagcccaacagcaccgccauccagaccagcgagggcgccagcagagagaccgccggcggcggccccagcgagggccccggcggcuggcccugggagcaggugagcgccgccuucgcccagcuggugcuggugagcaccaugagcuuccagggcaccuggagaaagagauucagcagcaccgacacccagauccugcccuucaccugcgccuacggccuggugcugcaggugcccaugaugcaccagaccaccgaggugaacuacggccaguuccaggacaccgccggccaccaggugggcgugcuggagcugcccuaccugggcagcgccgugagccuguuccuggugcugcccagagacaaggacaccccccugagccacaucgagccccaccugaccgccagcaccauccaccuguggaccaccagccugagaagagccagaauggacguguuccugcccagauucagaauccagaaccaguucaaccugaagagcauccugaacagcuggggcgugaccgaccuguucgacccccugaaggccaaccugaagggcaucagcggccaggacggcuucuacgugagcgaggccauccacaaggccaagaucgaggugcuggaggagggcaccaaggccagcggcgccaccgcccugcugcugcugaagagaagcagaauccccaucuucaaggccgacagacccuucaucuacuuccugagagagcccaacaccggcaucaccguguucuucgacagaauccagaucaucuaccagugccugagcagcaacaagggcagcuucgugcacuacccccugaagaacaagcacagcuucuaa

SEQ ID NO: 23194 - RNA, 1257 nt, Artificial Sequence
  SERPINF1__Homo_sapiens__NP_002606
augcaggcccuggugcugcugcugugcaucggcgcccugcugggccacagcagcugccagaaccccgccagcccccccgaggagggcagccccgaccccgacagcaccggcgcccugguggaggaggaggaccccuucuucaaggugcccgugaacaagcuggccgccgccgugagcaacuucggcuacgaccuguacagagugagaagcagcaccagccccaccaccaacgugcugcugagcccccugagcguggccaccgcccugagcgcccugagccugggcgccgagcagagaaccgagagcaucauccacagagcccuguacuacgaccugaucagcagccccgacauccacggcaccuacaaggagcugcuggacaccgugaccgccccccagaagaaccugaagagcgccagcagaaucguguucgagaagaagcugagaaucaagagcagcuucguggccccccuggagaagagcuacggcaccagacccagagugcugaccggcaaccccagacuggaccugcaggagaucaacaacugggugcaggcccagaugaagggcaagcuggccagaagcaccaaggagauccccgacgagaucagcauccugcugcugggcguggcccacuucaagggccagugggugaccaaguucgacagcagaaagaccagccuggaggacuucuaccuggacgaggagagaaccgugagagugcccaugaugagcgaccccaaggccgugcugagauacggccuggacagcgaccugagcugcaagaucgcccagcugccccugaccggcagcaugagcaucaucuucuuccugccccugaaggugacccagaaccugacccugaucgaggagagccugaccagcgaguucauccacgacaucgacagagagcugaagaccgugcaggccgugcugaccgugcccaagcugaagcugagcuacgagggcgaggugaccaagagccugcaggagaugaagcugcagagccuguucgacagccccgacuucagcaagaucaccggcaagcccaucaagcugacccagguggagcacagagccggcuucgaguggaacgaggacggcgccggcaccacccccagccccggccugcagcccgcccaccugaccuucccccuggacuaccaccugaaccagcccuucaucuucgugcugagagacaccgacaccggcgcccugcuguucaucggcaagauccuggaccccagaggccccuaa

SEQ ID NO: 23195 - RNA, 1476 nt, Artificial Sequence
  SERPINF2__Homo_sapiens__NP_001159392
auggcccugcuguggggccugcuggugcugagcuggagcugccugcagggccccugcagcguguucagccccgugagcgccauggagccccugggcagacagcugaccagcggccccaaccaggagcaggugagcccccugacccugcugaagcugggcaaccaggagcccggcggccagaccgcccugaagagcccccccggcgugugcagcagagaccccacccccgagcagacccacagacuggccagagccaugauggccuucaccgccgaccuguucagccugguggcccagaccagcaccugccccaaccugauccugagcccccugagcguggcccuggcccugagccaccuggcccugggcgcccagaaccacacccugcagagacugcagcaggugcugcacgccggcagcggccccugccugccccaccugcugagcagacugugccaggaccugggccccggcgccuucagacuggccgccagaauguaccugcagaagggcuuccccaucaaggaggacuuccuggagcagagcgagcagcuguucggcgccaagcccgugagccugaccggcaagcaggaggacgaccuggccaacaucaaccagugggugaaggaggccaccgagggcaagauccaggaguuccugagcggccugcccgaggacaccgugcugcugcugcugaacgccauccacuuccagggcuucuggagaaacaaguucgaccccagccugacccagagagacagcuuccaccuggacgagcaguucaccgugcccguggagaugaugcaggccagaaccuacccccugagaugguuccugcuggagcagcccgagauccagguggcccacuuccccuucaagaacaacaugagcuucguggugcuggugcccacccacuucgaguggaacgugagccaggugcuggccaaccugagcugggacacccugcaccccccccuggugugggagagacccaccaaggugagacugcccaagcuguaccugaagcaccagauggaccugguggccacccugagccagcugggccugcaggagcuguuccaggcccccgaccugagaggcaucagcgagcagagccugguggugagcggcgugcagcaccagagcacccuggagcugagcgaggugggcguggaggccgccgccgccaccagcaucgccaugagcagaaugagccugagcagcuucagcgugaacagacccuuccuguucuucaucuucgaggacaccaccggccugccccuguucgugggcagcgugagaaaccccaaccccagcgcccccagagagcugaaggagcagcaggacagccccggcaacaaggacuuccugcagagccugaagggcuuccccagaggcgacaagcuguucggccccgaccugaagcuggugccccccauggaggaggacuacccccaguucggcagccccaaguaa

SEQ ID NO: 23196 - RNA, 1503 nt, Artificial Sequence
  SERPING1__Homo_sapiens__NP_000053
auggccagcagacugacccugcugacccugcugcugcugcugcuggccggcgacagagccagcagcaaccccaacgccaccagcagcagcagccaggaccccgagagccugcaggacagaggcgagggcaagguggccaccaccgugaucagcaagaugcuguucguggagcccauccuggaggugagcagccugcccaccaccaacagcaccaccaacagcgccaccaagaucaccgccaacaccaccgacgagcccaccacccagcccaccaccgagcccaccacccagcccaccauccagcccacccagcccaccacccagcugcccaccgacagccccacccagcccaccaccggcagcuucugccccggccccgugacccugugcagcgaccuggagagccacagcaccgaggccgugcugggcgacgcccugguggacuucagccugaagcuguaccacgccuucagcgccaugaagaagguggagaccaacauggccuucagccccuucagcaucgccagccugcugacccaggugcugcugggcgccggcgagaacaccaagaccaaccuggagagcauccugagcuaccccaaggacuucaccugcgugcaccaggcccugaagggcuucaccaccaagggcgugaccagcgugagccagaucuuccacagccccgaccuggccaucagagacaccuucgugaacgccagcagaacccuguacagcagcagccccagagugcugagcaacaacagcgacgccaaccuggagcugaucaacaccuggguggccaagaacaccaacaacaagaucagcagacugcuggacagccugcccagcgacaccagacuggugcugcugaacgccaucuaccugagcgccaaguggaagaccaccuucgaccccaagaagaccagaauggagcccuuccacuucaagaacagcgugaucaaggugcccaugaugaacagcaagaaguaccccguggcccacuucaucgaccagacccugaaggccaaggugggccagcugcagcugagccacaaccugagccuggugauccuggugccccagaaccugaagcacagacuggaggacauggagcaggcccugagccccagcguguucaaggccaucauggagaagcuggagaugagcaaguuccagcccacccugcugacccugcccagaaucaaggugaccaccagccaggacaugcugagcaucauggagaagcuggaguucuucgacuucagcuacgaccugaaccugugcggccugaccgaggaccccgaccugcaggugagcgccaugcagcaccagaccgugcuggagcugaccgagaccggcguggaggccgccgccgccagcgccaucagcguggccagaacccugcugguguucgaggugcagcagcccuuccuguucgugcugugggaccagcagcacaaguuccccguguucaugggcagaguguacgaccccagagccuaa

SEQ ID NO: 23197 - RNA, 1257 nt, Artificial Sequence
  SERPINH1__Homo_sapiens__XP_011543629
augagaagccugcugcugcugagcgccuucugccugcuggaggccgcccuggccgccgaggugaagaagcccgccgccgccgccgcccccggcaccgccgagaagcugagccccaaggccgccacccuggccgagagaagcgccggccuggccuucagccuguaccaggccauggccaaggaccaggccguggagaacauccuggugagccccguggugguggccagcagccugggccuggugagccugggcggcaaggccaccaccgccagccaggccaaggccgugcugagcgccgagcagcugagagacgaggaggugcacgccggccugggcgagcugcugagaagccugagcaacagcaccgccagaaacgugaccuggaagcugggcagcagacuguacggccccagcagcgugagcuucgccgacgacuucgugagaagcagcaagcagcacuacaacugcgagcacagcaagaucaacuucagagacaagagaagcgcccugcagagcaucaacgagugggccgcccagaccaccgacggcaagcugcccgaggugaccaaggacguggagagaaccgacggcgcccugcuggugaacgccauguucuucaagccccacugggacgagaaguuccaccacaagaugguggacaacagaggcuucauggugaccagaagcuacaccgugggcgugaugaugaugcacagaaccggccuguacaacuacuacgacgacgagaaggagaagcugcagaucguggagaugccccuggcccacaagcugagcagccugaucauccugaugccccaccacguggagccccuggagagacuggagaagcugcugaccaaggagcagcugaagaucuggaugggcaagaugcagaagaaggccguggccaucagccugcccaagggcgugguggaggugacccacgaccugcagaagcaccuggccggccugggccugaccgaggccaucgacaagaacaaggccgaccugagcagaaugagcggcaagaaggaccuguaccuggccagcguguuccacgccaccgccuucgagcuggacaccgacggcaaccccuucgaccaggacaucuacggcagagaggagcugagaagccccaagcuguucuacgccgaccaccccuucaucuuccuggugagagacacccagagcggcagccugcuguucaucggcagacuggugagacccaagggcgacaagaugagagacgagcuguaa

SEQ ID NO: 23198 - RNA, 1233 nt, Artificial Sequence
  SERPINI1__Homo_sapiens__NP_005016
auggccuuccugggccuguucagccugcuggugcugcagagcauggccaccggcgccaccuuccccgaggaggccaucgccgaccugagcgugaacauguacaacagacugagagccaccggcgaggacgagaacauccuguucagcccccugagcaucgcccuggccaugggcaugauggagcugggcgcccagggcagcacccagaaggagaucagacacagcaugggcuacgacagccugaagaacggcgaggaguucagcuuccugaaggaguucagcaacauggugaccgccaaggagagccaguacgugaugaagaucgccaacagccuguucgugcagaacggcuuccacgugaacgaggaguuccugcagaugaugaagaaguacuucaacgccgccgugaaccacguggacuucagccagaacguggccguggccaacuacaucaacaaguggguggagaacaacaccaacaaccuggugaaggaccuggugagccccagagacuucgacgccgccaccuaccuggcccugaucaacgccguguacuucaagggcaacuggaagagccaguucagacccgagaacaccagaaccuucagcuucaccaaggacgacgagagcgaggugcagauccccaugauguaccagcagggcgaguucuacuacggcgaguucagcgacggcagcaacgaggccggcggcaucuaccaggugcuggagauccccuacgagggcgacgagaucagcaugaugcuggugcugagcagacaggaggugccccuggccacccuggagccccuggugaaggcccagcugguggaggagugggccaacagcgugaagaagcagaagguggagguguaccugcccagauucaccguggagcaggagaucgaccugaaggacgugcugaaggcccugggcaucaccgagaucuucaucaaggacgccaaccugaccggccugagcgacaacaaggagaucuuccugagcaaggccauccacaagagcuuccuggaggugaacgaggagggcagcgaggccgccgccgugagcggcaugaucgccaucagcagaauggccgugcuguacccccaggugaucguggaccaccccuucuucuuccugaucagaaacagaagaaccggcaccauccuguucaugggcagagugaugcaccccgagaccaugaacaccagcggccacgacuucgaggagcuguaa

SEQ ID NO: 23199 - RNA, 1248 nt, Artificial Sequence
  SERPINI2__Homo_sapiens__NP_001012303
augauccagaaccugaugagagaggugaagauggacaccaucuuccuguggagccugcugcugcuguucuucggcagccaggccagcagaugcagcgcccagaagaacaccgaguucgccguggaccuguaccaggaggugagccugagccacaaggacaacaucaucuucagcccccugggcaucacccuggugcuggagauggugcagcugggcgccaagggcaaggcccagcagcagaucagacagacccugaagcagcaggagaccagcgccggcgaggaguucuucgugcugaagagcuucuucagcgccaucagcgagaagaagcaggaguucaccuucaaccuggccaacgcccuguaccugcaggagggcuucaccgugaaggagcaguaccugcacggcaacaaggaguucuuccagagcgccaucaagcugguggacuuccaggacgccaaggccugcgccgagaugaucagcaccuggguggagagaaagaccgacggcaagaucaaggacauguucagcggcgaggaguucggcccccugaccagacuggugcuggugaacgccaucuacuucaagggcgacuggaagcagaaguucagaaaggaggacacccagcugaucaacuucaccaagaagaacggcagcaccgugaagauccccaugaugaaggcccugcugagaaccaaguacggcuacuucagcgagagcagccugaacuaccaggugcuggagcugagcuacaagggcgacgaguucagccugaucaucauccugcccgccgagggcauggacaucgaggagguggagaagcugaucaccgcccagcagauccugaaguggcugagcgagaugcaggaggaggagguggagaucagccugcccagauucaagguggagcagaagguggacuucaaggacgugcuguacagccugaacaucaccgagaucuucagcggcggcugcgaccugagcggcaucaccgacagcagcgagguguacgugagccaggugacccagaagguguucuucgagaucaacgaggacggcagcgaggccgccaccagcaccggcauccacauccccgugaucaugagccuggcccagagccaguucaucgccaaccaccccuuccuguucaucaugaagcacaaccccaccgagagcauccuguucaugggcagagugaccaaccccgacacccaggagaucaagggcagagaccuggacagccuguaa

SEQ ID NO: 23200 - RNA, 711 nt, Artificial Sequence
  SERTAD1__Homo_sapiens__NP_037508
augcugagcaagggccugaagagaaagagagaggaggaggaggagaaggagccccuggccguggacagcugguggcuggaccccggccacaccgccguggcccaggccccccccgccguggccagcagcagccuguucgaccugagcgugcugaagcugcaccacagccugcagcagagcgagcccgaccugagacaccuggugcugguggugaacacccugagaagaauccaggccagcauggcccccgccgccgcccugccccccgugcccagcccccccgccgcccccagcguggccgacaaccugcuggccagcagcgacgccgcccugagcgccagcauggccagccugcuggaggaccugagccacaucgagggccugagccaggccccccagccccuggccgacgagggcccccccggcagaagcaucggcggcgccgcccccagccugggcgcccuggaccugcugggccccgccaccggcugccugcuggacgacggccuggagggccuguucgaggacaucgacaccagcauguacgacaacgagcugugggcccccgccagcgagggccugaagcccggccccgaggacggccccggcaaggaggaggcccccgagcuggacgaggccgagcuggacuaccugauggacgugcuggugggcacccaggcccuggagagaccccccggccccggcagauaa

SEQ ID NO: 23201 - RNA, 966 nt, Artificial Sequence
  SERTAD2__Homo_sapiens__XP_011531506
augcugcccgugauccaguacaugcugggcaagggcggcaagagaaaguucgacgagcacgaggacggccuggagggcaagaucgugagccccugcgacggccccagcaaggugagcuacacccugcagagacagaccaucuucaacaucagccugaugaagcuguacaaccacagaccccugaccgagcccagccugcagaagaccgugcugaucaacaacaugcugagaagaauccaggaggagcugaagcaggagggcagccugagacccauguucacccccagcagccagcccaccaccgagcccagcgacagcuacagagaggccccccccgccuucagccaccuggccagccccagcagccaccccugcgaccugggcagcaccaccccccuggaggccugccugacccccgccagccugcuggaggacgacgacgacaccuucugcaccagccaggccaugcagcccaccgcccccaccaagcugagcccccccgcccugcugcccgagaaggacagcuucagcagcgcccuggacgagaucgaggagcugugccccaccagcaccagcaccgaggccgccaccgccgccaccgacagcgugaagggcaccagcagcgaggccggcacccagaagcuggacggcccccaggagagcagagccgacgacagcaagcugauggacagccugcccggcaacuucgagaucaccaccagcaccggcuuccugaccgaccugacccuggacgacauccuguucgccgacaucgacaccagcauguacgacuucgaccccugcaccagcagcagcggcaccgccagcaagauggcccccgugagcgccgacgaccugcugaagacccuggcccccuacagcagccagcccgugacccccagccagcccuucaagauggaccugaccgagcuggaccacaucauggaggugcuggugggcagcuaa

SEQ ID NO: 23202 - RNA, 1479 nt, Artificial Sequence
  SESN1__Homo_sapiens__NP_001186862
augagacuggccgccgccgccaacgaggccuacaccgccccccuggccgugagcggccugcugggcugcaagcagugcggcggcggcagagaccaggacgaggagcugggcaucagaauccccagaccccugggccagggccccagcagauucauccccgagaaggagauccugcaggugggcagcgaggacgcccagaugcacgcccuguucgccgacagcuucgccgcccugggcagacuggacaacaucacccuggugaugguguuccacccccaguaccuggagagcuuccugaagacccagcacuaccugcugcagauggacggcccccugccccugcacuacagacacuacaucggcaucauggccgccgccagacaccagugcagcuaccuggugaaccugcacgugaacgacuuccugcacgugggcggcgaccccaaguggcugaacggccuggagaacgccccccagaagcugcagaaccugggcgagcugaacaaggugcuggcccacagacccuggcugaucaccaaggagcacaucgagggccugcugaaggccgaggagcacagcuggagccuggccgagcuggugcacgccguggugcugcugacccacuaccacagccuggccagcuucaccuucggcugcggcaucagccccgagauccacugcgacggcggccacaccuucagaccccccagcgugagcaacuacugcaucugcgacaucaccaacggcaaccacagcguggacgagaugcccgugaacagcgccgagaacgugagcgugagcgacagcuucuucgagguggaggcccugauggagaagaugagacagcugcaggagugcagagacgaggaggaggccagccaggaggagauggccagcagauucgagaucgagaagagagagagcauguucguguucagcagcgacgacgaggaggugacccccgccagagccgugagcagacacuucgaggacaccagcuacggcuacaaggacuucagcagacacggcaugcacgugcccaccuucagagugcaggacuacugcugggaggaccacggcuacagccuggugaacagacuguaccccgacgugggccagcugaucgacgagaaguuccacaucgccuacaaccugaccuacaacaccauggccaugcacaaggacguggacaccagcaugcugagaagagccaucuggaacuacauccacugcauguucggcaucagauacgacgacuacgacuacggcgagaucaaccagcugcuggacagaagcuucaagguguacaucaagaccguggugugcacccccgagaaggugaccaagagaauguacgacagcuucuggagacaguucaagcacagcgagaaggugcacgugaaccugcugcugaucgaggccagaaugcaggccgagcugcuguacgcccugagagccaucaccagauacaugaccuaa

SEQ ID NO: 23203 - RNA, 1062 nt, Artificial Sequence
  SESN3__Homo_sapiens__NP_001258523
augagccugcacacccaguaccuggagagcuuccugagaagccaguucuacaugcugagaauggacggcccccugccccugcccuacagacacuacaucgccaucaugaagcuggugaagaccggcgagaacaacuggagccugcccgagcuggugcacgccguggugcugcuggcccacuaccacgcccuggccagcuucguguucggcagcggcaucaaccccgagagagaccccgagaucagcaacggcuucagacugaucagcgugaacaacuucugcgugugcgaccuggccaacgacaacaacaucgagaacgccagccugagcggcagcaacuucggcaucguggacagccugagcgagcuggaggcccugauggagagaaugaagagacugcaggaggagagagaggacgaggaggccagccaggaggagaugagcaccagauucgagaaggagaagaaggagagccuguucguggugagcggcgacaccuuccacagcuucccccacagcgacuucgaggacgacaugaucaucaccagcgacgugagcagauacaucgaggaccccggcuucggcuacgaggacuucgccagaagaggcgaggagcaccugcccaccuucagagcccaggacuacaccugggagaaccacggcuucagccuggugaacagacuguacagcgacaucggccaccugcuggacgagaaguucagaaugguguacaaccugaccuacaacaccauggccacccacgaggacguggacaccaccaugcugagaagagcccuguucaacuacgugcacugcauguucggcaucagauacgacgacuacgacuacggcgaggugaaccagcugcuggagagaagccugaagguguacaucaagaccgugaccugcuaccccgagagaaccaccaagagaauguacgacagcuacuggagacaguucaagcacagcgagaaggugcacgugaaccugcugcugauggaggccagaaugcaggccgagcugcuguacgcccugagagccaucaccagacaccugaccuaa

SEQ ID NO: 23204 - RNA, 729 nt, Artificial Sequence
  SETBP1__Homo_sapiens__NP_001123582
auggagagcagagagacccugagcagcagcagacagagaggcggcgagagcgacuuccugcccgugagcagcgccaagccccccgccgcccccggcugcgccggcgagccccugcugagcacccccggccccggcaagggcauccccgugggcggcgagagaauggagcccgaggaggaggacgagcugggcagcggcagagacguggacagcaacagcaacgccgacagcgagaaguggguggccggcgacggccuggaggagcaggaguucagcaucaaggaggccaacuucaccgagggcagccugaagcugaagauccagaccaccaagagagccaagaagccccccaagaaccuggagaacuacaucugcccccccgagaucaagaucaccaucaagcagagcggcgaccagaaggugagcagagccggcaagaacagcaaggccaccaaggaggaggagagaagccacagcaagaagaagcugcugaccgccagcgaccuggccgccagcgaccugaagggcuuccagccccagaucaaggacagcagcaaggaggagguguggaagagaagaggcggccagggcauccccuucaagaagcaguuccugagccaggagagagccaugugcuucagcugccccagaaaccccuuccccgccaagcccggcagccugacccugcccuuccacagcgagcccgccgugugggcccaggagguguaa

SEQ ID NO: 23205 - RNA, 5124 nt, Artificial Sequence
  SETD1A__Homo_sapiens__NP_055527
auggaccaggagggcggcggcgacggccagaaggcccccagcuuccaguggagaaacuacaagcugaucguggaccccgcccuggaccccgcccugagaagacccagccagaagguguacagauacgacggcgugcacuucagcgugaacgacagcaaguacauccccguggaggaccugcaggaccccagaugccacgugagaagcaagaacagagacuucagccugcccgugcccaaguucaagcuggacgaguucuacaucggccagaucccccugaaggaggugaccuucgccagacugaacgacaacgugagagagaccuuccugaaggacaugugcagaaaguacggcgagguggaggagguggagauccugcugcaccccagaaccagaaagcaccugggccuggccagagugcuguucaccagcaccagaggcgccaaggagaccgugaagaaccugcaccugaccagcgugaugggcaacaucauccacgcccagcuggacaucaagggccagcagagaaugaaguacuacgagcugaucgugaacggcagcuacaccccccagaccgugcccaccggcggcaaggcccugagcgagaaguuccagggcagcggcgccgccaccgagaccgccgagagcagaagaagaagcagcagcgacaccgccgccuaccccgccggcaccaccgccgugggcacccccggcaacggcacccccugcagccaggacaccagcuucagcagcagcagacaggacacccccagcagcuucggccaguucaccccccagagcagccagggcacccccuacaccagcagaggcagcacccccuacagccaggacagcgccuacagcagcagcaccaccagcaccagcuucaagcccagaagaagcgagaacagcuaccaggacgccuucagcagaagacacuucagcgccagcagcgccagcaccaccgccagcaccgccaucgccgccaccaccgccgccaccgccagcagcagcgccagcagcagcagccugagcagcagcagcagcagcagcagcagcagcagcagcagccaguucagaagcagcgacgccaacuaccccgccuacuacgagagcuggaacagauaccagagacacaccagcuacccccccagaagagccaccagagaggagccccccggcgcccccuucgccgagaacaccgccgagagauucccccccagcuacaccagcuaccugccccccgagcccagcagacccaccgaccaggacuacagaccccccgccagcgaggcccccccccccgagccccccgagcccggcggcggcggcggcggcggcggccccagccccgagagagaggaggugagaaccagccccagacccgccagccccgccagaagcggcagccccgcccccgagaccaccaacgagagcgugcccuucgcccagcacagcagccuggacagcagaaucgagaugcugcugaaggagcagagaagcaaguucagcuuccuggccagcgacaccgaggaggaggaggagaacagcagcauggugcugggcgccagagacaccggcagcgaggugcccagcggcagcggccacggccccugcacccccccccccgcccccgccaacuucgaggacguggcccccaccggcagcggcgagcccggcgccaccagagagagccccaaggccaacggccagaaccaggccagccccugcagcagcggcgacgacauggagaucagcgacgacgacagaggcggcagccccccccccgcccccacccccccccagcagcccccccccccccccccccccccccccccccccccccccuaccuggccagccugccccugggcuaccccccccaccagcccgccuaccugcugccccccagacccgacggcccccccccccccgaguaccccccccccccccccccccccccccacaucuacgacuucgugaacagccuggagcugauggacagacugggcgcccaguggggcggcaugcccaugagcuuccagaugcagacccagaugcugaccagacugcaccagcugagacagggcaagggccugaucgccgccagcgccggcccccccggcggcgccuucggcgaggccuuccugcccuucccccccccccaggaggccgccuacggccugcccuacgcccuguacgcccagggccaggagggcagaggcgccuacagcagagaggccuaccaccugcccaugcccauggccgccgagccccugcccagcagcagcgugagcggcgaggaggccagacugccccccagagaggaggccgagcuggccgagggcaagacccugcccaccgccggcaccgugggcagagugcuggccaugcuggugcaggagaugaagagcaucaugcagagagaccugaacagaaagaugguggagaacguggccuucggcgccuucgaccaguggugggagagcaaggaggagaaggccaagcccuuccagaacgccgccaagcagcaggccaaggaggaggacaaggagaagaccaagcugaaggagcccggccugcugagccugguggacugggccaagagcggcggcaccaccggcaucgaggccuucgccuucggcagcggccugagaggcgcccugagacugcccagcuucaaggugaagagaaaggagcccagcgagaucagcgaggccagcgaggagaagagacccagacccagcacccccgccgaggaggacgaggacgaccccgagcaggagaaggaggccggcgagcccggcagacccggcaccaagccccccaagagagacgaggagagaggcaagacccagggcaagcacagaaagagcuucgcccuggacagcgagggcgaggaggccagccaggagagcagcagcgagaaggacgaggaggacgacgaggaggacgaggaggacgaggacagagaggaggccguggacaccaccaagaaggagaccgaggugagcgacggcgaggacgaggagagcgacagcagcagcaagugcagccuguacgccgacagcgacggcgagaacgacagcaccagcgacagcgagagcagcagcagcagcagcagcagcagcagcagcagcagcagcagcagcagcagcagcagcagcagcagcagcgagagcagcagcgaggacgaggaggaggaggagagacccgccgcccugcccagcgccagccccccccccagagaggugcccgugcccacccccgcccccguggaggugcccgugcccgagagaguggccggcagccccgugaccccccugcccgagcaggaggccagccccgccagacccgccggccccaccgaggagagcccccccagcgccccccugagaccccccgagccccccgccggcccccccgcccccgcccccagacccgacgagagacccagcagccccaucccccugcugcccccccccaagaagagaagaaagaccgugagcuucagcgccaucgagguggugcccgcccccgagcccccccccgccacccccccccaggccaaguuccccggccccgccagcagaaaggcccccagaggcguggagagaaccaucagaaaccugccccuggaccacgccagccuggugaagagcuggcccgaggaggugagcagaggcggcagaagcagagccggcggcagaggcagacugaccgaggaggaggaggccgagcccggcaccgagguggaccuggccgugcuggccgaccuggcccugacccccgccagaagaggccugcccgcccugcccgccguggaggacagcgaggccaccgagaccagcgacgaggccgagagacccagaccccugcugagccacauccugcuggagcacaacuacgcccuggccgugaagcccaccccccccgcccccgcccugagaccccccgagcccgugcccgcccccgccgcccuguucagcagccccgccgacgaggugcuggaggcccccgagguggugguggccgaggccgaggagcccaagccccagcagcugcagcagcagagagaggagggcgaggaggagggcgaggaggagggcgaggaggaggaggaggagagcagcgacagcagcagcagcagcgacggcgagggcgcccugagaagaagaagccugagaagccacgccagaagaagaagaccccccccccccccccccccccccccccccagagccuacgagcccagaagcgaguucgagcagaugaccauccuguacgacaucuggaacagcggccuggacagcgaggacaugagcuaccugagacugaccuacgagagacugcugcagcagaccagcggcgccgacuggcugaacgacacccacugggugcaccacaccaucaccaaccugaccacccccaagagaaagagaagaccccaggacggccccagagagcaccagaccggcagcgccagaagcgagggcuacuaccccaucagcaagaaggagaaggacaaguaccuggacgugugccccgugagcgccagacagcuggagggcguggacacccagggcaccaacagagugcugagcgagagaagaagcgagcagagaagacugcugagcgccaucggcaccagcgccaucauggacagcgaccugcugaagcugaaccagcugaaguucagaaagaagaagcugagauucggcagaagcagaauccacgaguggggccuguucgccauggagcccaucgccgccgacgagauggugaucgaguacgugggccagaacaucagacagaugguggccgacaugagagagaagagauacgugcaggagggcaucggcagcagcuaccuguucagaguggaccacgacaccaucaucgacgccaccaagugcggcaaccuggccagauucaucaaccacugcugcacccccaacugcuacgccaaggugaucaccaucgagagccagaagaagaucgugaucuacagcaagcagcccaucggcguggacgaggagaucaccuacgacuacaaguucccccuggaggacaacaagauccccugccugugcggcaccgagagcugcagaggcagccugaacuaa

SEQ ID NO: 23206 - RNA, 5772 nt, Artificial Sequence
  SETD1B__Homo_sapiens__NP_055863
auggagaacagccaccccccccaccaccaccaccagcagccccccccccagcccggccccagcggcgagagaagaaaccaccacuggagaagcuacaagcugaugaucgaccccgcccugaagaagggccaccacaagcuguacagauacgacggccagcacuucagccuggccaugagcagcaacagacccguggagaucguggaggaccccagaguggugggcaucuggaccaagaacaaggagcuggagcugagcgugcccaaguucaagaucgacgaguucuacgugggccccgugccccccaagcaggugaccuucgccaagcugaacgacaacaucagagagaacuuccugagagacaugugcaagaaguacggcgagguggaggagguggagauccuguacaaccccaagaccaagaagcaccugggcaucgccaaggugguguucgccaccgugagaggcgccaaggacgccgugcagcaccugcacagcaccagcgugaugggcaacaucauccacguggagcuggacaccaagggcgagaccagaaugagauucuacgagcugcuggugaccggcagauacaccccccagacccugcccgugggcgagcuggacgccgugagccccaucgugaacgagacccugcagcugagcgacgcccugaagagacugaaggacggcggccugagcgccggcugcggcagcggcagcagcagcgugacccccaacagcggcggcacccccuucagccaggacaccgccuacagcagcugcagacuggacacccccaacagcuacggccagggcaccccccugacccccagacugggcacccccuucagccaggacagcagcuacagcagcagacagcccacccccagcuaccuguucagccaggaccccgccgugaccuucaaggccagaagacacgagagcaaguucaccgacgccuacaacagaagacacgagcaccacuacgugcacaacagccccgccgugaccgccguggccggcgccaccgccgccuucagaggcagcagcgaccugcccuucggcgccgugggcggcaccggcggcagcagcggcccccccuucaaggcccagccccaggacagcgccaccuucgcccacacccccccccccgcccaggccacccccgcccccggcuucaagagcgccuucagccccuaccagacccccguggcccacuucccccccccccccgaggagcccaccgccaccgccgccuucggcgccagagacagcggcgaguucagaagagcccccgccccccccccccugccccccgccgagccccuggccaaggagaagcccggcaccccccccggcccccccccccccgacaccaacagcauggagcugggcggcagacccaccuucggcuggagccccgagcccugcgacagccccggcacccccacccuggagagcagccccgccggccccgagaagccccacgacagccuggacagcagaaucgagaugcugcugaaggagcagagaaccaagcugcuguuccugagagagcccgacagcgacaccgagcugcagauggagggcagccccaucagcagcagcagcagccagcugagcccccuggcccccuucggcaccaacagccagcccggcuucagaggccccaccccccccagcagcagacccagcagcaccggccuggaggacaucagccccaccccccugcccgacagcgacgaggacgaggagcuggaccugggccugggccccagacccccccccgagcccggcccccccgaccccgccggccugcugagccagaccgccgagguggcccuggaccuggugggcgacagaacccccaccagcgagaagauggacgagggccagcagagcagcggcgaggacauggagaucagcgacgacgagaugcccagcgcccccaucaccagcgccgacugccccaagcccaugguggugacccccggcgccgccgccguggccgcccccagcgugcuggcccccacccugccccugccccccccccccggcuuccccccccugccccccccccccccccccccccccccccagcccggcuuccccaugccccccccccugcccccccccccccccccccccccccccgcccaccccgccgugaccgugcccccccccccccugcccgccccccccggcgugccccccccccccauccugcccccccugccccccuucccccccggccuguuccccgugaugcagguggacaugagccacgugcugggcggccaguggggcggcaugcccaugagcuuccagaugcagacccaggugcugagcagacugaugaccggccagggcgccugccccuacccccccuucauggccgccgccgccgccgccgccagcgccggccugcaguucgugaaccugccccccuacagaggccccuucagccugagcaacagcggccccggcagaggccagcacuggcccccccugcccaaguucgaccccagcgugcccccccccggcuacaugcccagacaggaggacccccacaaggccaccguggacggcgugcugcugguggugcugaaggagcugaaggccaucaugaagagagaccugaacagaaagaugguggaggugguggccuucagagccuucgacgaguggugggacaagaaggagagaauggccaaggccagccugacccccgugaagagcggcgagcacaaggacgaggacagacccaagcccaaggacagaaucgccagcugccugcuggagagcuggggcaagggcgagggccugggcuacgagggccugggccugggcaucggccugagaggcgccaucagacugcccagcuucaaggugaagagaaaggagccccccgacaccaccagcagcggcgaccagaagagacugagacccagcaccagcguggacgaggaggacgaggagagcgagagagagagagacagagacauggccgacacccccugcgagcuggccaagagagaccccaagggcgugggcgugagaagaagacccgccagaccccuggagcuggacagcggcggcgaggaggacgagaaggagagccugagcgaggagcaggagagcaccgaggaggaggaggaggccgaggaggaggaggaggaggaggacgacgacgacgacgacagcgacgacagagacgagagcgagaacgacgacgaggacaccgcccugagcgaggccagcgagaaggacgagggcgacagcgacgaggaggagaccgugagcaucgugaccagcaaggccgaggccaccagcagcagcgagagcagcgagagcagcgaguucgagagcagcagcgagagcagccccagcagcagcgaggacgaggaggaggugguggccagagaggaggaggaggaggaggaggaggaggagaugguggccgaggagagcauggccagcgccggccccgaggacuucgagcaggacggcgaggaggccgcccuggcccccggcgcccccgccguggacagccugggcauggaggaggagguggacaucgagaccgaggccguggcccccgaggagagacccagcaugcuggacgagcccccccugcccgugggcguggaggagcccgccgacagcagagagccccccgaggagcccggccugagccaggagggcgccaugcugcugagccccgagccccccgccaaggagguggaggccagacccccccugagccccgagagagcccccgagcacgaccuggagguggagcccgagccccccaugaugcugccccugccccugcagcccccccugcccccccccagaccccccagaccccccagccccccccccgagcccgagaccaccgacgccagccaccccagcgugccccccgagccccuggccgaggaccaccccccccacacccccggccugugcggcagccuggccaagagccagagcaccgagaccgugcccgccacccccggcggcgagcccccccugagcggcggcagcagcggccugagccugagcagcccccaggugcccggcagccccuucagcuaccccgcccccagccccagccugagcagcggcggccugcccagaacccccggcagagacuucagcuucacccccaccuucagcgagcccagcggcccccugcugcugcccgugugcccccugcccaccggcagaagagacgagagaagcggcccccuggccagccccgugcugcuggagaccggccugccccugccccugccccugccccugccccugccccuggcccugcccgccgugcugagagcccaggccagagcccccaccccccugcccccccugcugcccgccccccuggccagcugccccccccccaugaagagaaagcccggcagacccagaagaagcccccccagcaugcugagccuggacggcccccuggugagaccccccgccggcgccgcccugggcagagagcugcugcugcugcccggccagccccagacccccguguuccccagcacccacgaccccagaaccgugacccuggacuucagaaacgccggcauccccgcccccccccccccccugcccccccagcccccccccccccccccccccccccccguggagcccaccaagcugcccuucaaggagcuggacaaccaguggcccagcgaggccaucccccccggccccagaggcagagacgaggugaccgaggaguacauggagcuggccaagagcagaggccccuggagaagaccccccaagaagagacacgaggaccuggugccccccgccggcagccccgagcugagccccccccagccccuguucagacccagaagcgaguucgaggagaugaccauccuguacgacaucuggaacggcggcaucgacgaggaggacaucagauuccugugcgugaccuacgagagacugcugcagcaggacaacggcauggacuggcugaacgacacccuguggguguaccaccccagcaccagccugagcagcgccaagaagaagaagagagacgacggcaucagagagcacgugaccggcugcgccagaagcgagggcuucuacaccaucgacaagaaggacaagcugagauaccugaacagcagcagagccagcaccgacgagccccccgccgacacccagggcaugagcauccccgcccagccccacgccagcaccagagccggcagcgagagaagaagcgagcagagaagacugcugagcagcuucaccggcagcugcgacagcgaccugcugaaguucaaccagcugaaguucagaaagaagaagcugaaguucugcaagagccacauccacgacuggggccuguucgccauggagcccaucgccgccgacgagauggugaucgaguacgugggccagaacaucagacaggugaucgccgacaugagagagaagagauacgaggacgagggcaucggcagcagcuacauguucagaguggaccacgacaccaucaucgacgccaccaagugcggcaacuucgccagauucaucaaccacagcugcaaccccaacugcuacgccaaggugaucaccguggagagccagaagaagaucgugaucuacagcaagcagcacaucaacgugaacgaggagaucaccuacgacuacaaguuccccaucgaggacgugaagauccccugccugugcggcagcgagaacugcagaggcacccugaacuaa

SEQ ID NO: 23207 - RNA, 7695 nt, Artificial Sequence
  SETD2__Homo_sapiens__NP_054878
augaagcagcugcagccccagcccccccccaagaugggcgacuucuacgaccccgagcaccccacccccgaggaggaggagaacgaggccaagaucgagaacgugcagaagaccggcuucaucaagggccccauguucaagggcguggccagcagcagauuccugcccaagggcaccaagaccaaggugaaccuggaggagcagggcagacagaaggugagcuucagcuucagccugaccaagaagacccugcagaacagauuccugaccgcccugggcaacgagaagcagagcgacacccccaacccccccgccgugccccugcagguggacagcacccccaagaugaagauggagaucggcgacacccugagcaccgccgaggagagcagcccccccaagagcagaguggagcugggcaagauccacuucaagaagcaccugcugcacgugaccagcagaccccugcuggccaccaccaccgccguggccagcccccccacccacgccgccccccugcccgccgugaucgccgagagcaccaccguggacagcccccccagcagccccccccccccccccccccccgcccaggccaccacccugagcagccccgcccccgugaccgagcccguggcccugccccacacccccaucaccgugcugauggccgcccccgugccccugcccguggacguggccgugagaagccugaaggagccccccaucaucaucgugcccgagagccuggaggccgacaccaagcaggacaccaucagcaacagccuggaggagcacgugacccagauccugaacgagcaggccgacaucagcagcaagaaggaggacagccacaucggcaaggacgaggagauccccgacagcagcaagaucagccugagcugcaagaagaccggcagcaagaagaagagcagccagagcgagggcaucuuccugggcagcgagagcgacgaggacagcgugagaaccagcagcagccagagaagccacgaccugaaguucagcgccagcaucgagaaggagagagacuucaagaagagcagcgccccccugaagagcgaggaccugggcaagcccagcagaagcaagaccgacagagacgacaaguacuucagcuacagcaagcuggagagagacaccagauacgugagcagcagaugcagaagcgagagagagagaagaagaagcagaagccacagcagaagcgagagaggcagcagaaccaaccugagcuacagcagaagcgagagaagccacuacuacgacagcgacagaagauaccacagaagcagccccuacagagagagaaccagauacagcagacccuacaccgacaacagagccagagagagcagcgacagcgaggaggaguacaagaagaccuacagcagaagaaccagcagccacagcagcagcuacagagaccugagaaccagcagcuacagcaagagcgacagagacugcaagaccgagaccagcuaccuggagauggagagaagaggcaaguacagcagcaagcuggagagagagagcaagagaaccagcgagaacgaggccaucaagagaugcugcagcccccccaacgagcugggcuucagaagaggcagcagcuacagcaagcacgacagcagcgccagcagauacaagagcacccugagcaagcccauccccaagagcgacaaguucaagaacagcuucugcugcaccgagcugaacgaggagaucaagcagagccacagcuucagccugcagacccccugcagcaagggcagcgagcugagaaugaucaacaagaaccccgagagagagaaggccggcagccccgcccccagcaacagacugaacgacagccccacccugaagaagcuggacgagcugcccaucuucaagagcgaguucaucacccacgacagccacgacagcaucaaggagcuggacagccugagcaaggugaagaacgaccagcugagaagcuucugccccaucgagcugaacaucaacggcagccccggcgccgagagcgaccuggccaccuucugcaccagcaagaccgacgccgugcugaugaccagcgacgacagcgugaccggcagcgagcugagcccccuggugaaggccugcaugcugagcagcaacggcuuccagaacaucagcagaugcaaggagaaggaccuggacgacaccugcaugcugcacaagaagagcgagagccccuucagagagaccgagccccuggugagcccccaccaggacaagcugaugagcaugcccgugaugaccguggacuacagcaagaccguggugaaggagcccguggacaccagagugagcugcugcaagaccaaggacagcgacaucuacugcacccugaacgacagcaaccccagccugugcaacagcgaggccgagaacaucgagcccagcgugaugaagaucagcagcaacagcuucaugaacgugcaccuggagagcaagcccgugaucugcgacagcagaaaccugaccgaccacagcaaguucgccugcgaggaguacaagcagagcaucggcagcaccagcagcgccagcgugaaccacuucgacgaccuguaccagcccaucggcagcagcggcaucgccagcagccugcagagccugccccccggcaucaagguggacagccugacccugcugaagugcggcgagaacaccagccccgugcuggacgccgugcugaagagcaagaagagcagcgaguuccugaagcacgccggcaaggagaccaucguggaggugggcagcgaccugcccgacagcggcaagggcuucgccagcagagagaacagaagaaacaacggccugagcggcaagugccugcaggaggcccaggaggagggcaacagcauccugcccgagagaagaggcagacccgagaucagccuggacgagagaggcgagggcggccacgugcacaccagcgacgacagcgaggugguguucagcagcugcgaccugaaccugaccauggaggacagcgacggcgugaccuacgcccugaagugcgacagcagcggccacgcccccgagaucgugagcaccgugcacgaggacuacagcggcagcagcgagagcagcaacgacgagagcgacagcgaggacaccgacagcgacgacagcagcauccccagaaacagacugcagagcguggugguggugcccaagaacagcacccugcccauggaggagaccagccccugcagcagcagaagcagccagagcuacagacacuacagcgaccacugggaggacgagagacuggagagcagaagacaccuguacgaggagaaguucgagagcaucgccagcaaggccugcccccagaccgacaaguucuuccugcacaagggcaccgagaagaaccccgagaucagcuucacccagagcagcagaaagcagaucgacaacagacugcccgagcugagccacccccagagcgacggcguggacagcaccagccacaccgacgugaagagcgacccccugggccaccccaacagcgaggagaccgugaaggccaagauccccagcagacagcaggaggagcugcccaucuacagcagcgacuucgaggacgugcccaacaagagcuggcagcagaccaccuuccagaacagacccgacagcagacugggcaagaccgagcugagcuucagcagcagcugcgagaucccccacguggacggccugcacagcagcgaggagcugagaaaccugggcugggacuucagccaggagaagcccagcaccaccuaccagcagcccgacagcagcuacggcgccugcggcggccacaaguaccagcagaacgccgagcaguacggcggcaccagagacuacuggcagggcaacggcuacugggaccccagaagcggcagaccccccggcaccggcgugguguacgacagaacccagggccaggugcccgacagccugaccgacgacagagaggaggaggagaacugggaccagcaggacggcagccacuucagcgaccagagcgacaaguuccugcugagccugcagaaggacaagggcagcgugcaggcccccgagaucagcagcaacagcaucaaggacacccuggccgugaacgagaagaaggacuucagcaagaaccuggagaagaacgacaucaaggacagaggcccccugaagaagagaagacaggagaucgagagcgacagcgagagcgacggcgagcugcaggacagaaagaaggugagaguggagguggagcagggcgagaccagcgugccccccggcagcgcccuggugggccccagcugcgugauggacgacuucagagacccccagagauggaaggagugcgccaagcagggcaagaugcccugcuacuucgaccugaucgaggagaacguguaccugaccgagagaaagaagaacaagagccacagagacaucaagagaaugcagugcgagugcaccccccugagcaaggacgagagagcccagggcgagaucgccugcggcgaggacugccugaacagacugcugaugaucgagugcagcagcagaugccccaacggcgacuacugcagcaacagaagauuccagagaaagcagcacgccgacguggaggugauccugaccgagaagaagggcuggggccugagagccgccaaggaccugcccagcaacaccuucgugcuggaguacugcggcgaggugcuggaccacaaggaguucaaggccagagugaaggaguacgccagaaacaagaacauccacuacuacuucauggcccugaagaacgacgagaucaucgacgccacccagaagggcaacugcagcagauucaugaaccacagcugcgagcccaacugcgagacccagaaguggaccgugaacggccagcugagagugggcuucuucaccaccaagcuggugcccagcggcagcgagcugaccuucgacuaccaguuccagagauacggcaaggaggcccagaagugcuucugcggcagcgccaacugcagaggcuaccugggcggcgagaacagagugagcaucagagccgccggcggcaagaugaagaaggagagaagcagaaagaaggacagcguggacggcgagcuggaggcccugauggagaacggcgagggccugagcgacaagaaccaggugcugagccugagcagacugauggugagaaucgagacccuggagcagaagcugaccugccuggagcugauccagaacacccacagccagagcugccugaagagcuuccuggagagacacggccugagccugcuguggaucuggauggccgagcugggcgacggcagagagagcaaccagaagcugcaggaggagaucaucaagacccuggagcaccugcccauccccaccaagaacaugcuggaggagagcaaggugcugcccaucauccagagauggagccagaccaagaccgccgugcccccccugagcgagggcgacggcuacagcagcgagaacaccagcagagcccacaccccccugaacacccccgaccccagcaccaagcugagcaccgaggccgacaccgacacccccaagaagcugauguucagaagacugaagaucaucagcgagaacagcauggacagcgccaucagcgacgccaccagcgagcuggagggcaaggacggcaaggaggaccuggaccagcuggagaacgugcccguggaggaggaggaggagcugcagagccagcagcugcugccccagcagcugcccgagugcaagguggacagcgagaccaacaucgaggccagcaagcugcccaccagcgagcccgaggccgacgccgagaucgagcccaaggagagcaacggcaccaagcuggaggagcccaucaacgaggagacccccagccaggacgaggaggagggcgugagcgacguggagagcgagagaagccaggagcagcccgacaagaccguggacaucagcgaccuggccaccaagcugcuggacagcuggaaggaccugaaggagguguacagaauccccaagaagagccagaccgagaaggagaacaccaccaccgagagaggcagagacgccgugggcuucagagaccagacccccgcccccaagacccccaacagaagcagagagagagaccccgacaagcagacccagaacaaggagaagagaaagagaagaagcagccugagcccccccagcagcgccuacgagagaggcaccaagagacccgacgacagauacgacacccccaccagcaagaagaaggugagaaucaaggacagaaacaagcugagcaccgaggagagaagaaagcuguucgagcaggagguggcccagagagaggcccagaagcagcagcagcagaugcagaaccugggcaugaccagcccccugcccuacgacagccugggcuacaacgccccccaccaccccuucgccggcuacccccccggcuaccccaugcaggccuacguggaccccagcaaccccaacgccggcaaggugcugcugcccacccccagcauggaccccgugugcagccccgcccccuacgaccacgcccagccccuggugggccacagcaccgagccccugagcgcccccccccccgugcccguggugccccacguggccgcccccguggaggugagcagcagccaguacguggcccagagcgacggcguggugcaccaggacagcagcguggccgugcugcccgugcccgcccccggccccgugcagggccagaacuacagcgugugggacagcaaccagcagagcgugagcgugcagcagcaguacagccccgcccagagccaggccaccaucuacuaccagggccagaccugccccaccguguacggcgugaccagccccuacagccagaccaccccccccaucgugcagagcuacgcccagcccagccugcaguacauccagggccagcagaucuucaccgcccacccccagggcgugguggugcagcccgccgccgccgugaccaccaucguggcccccggccagccccagccccugcagcccagcgagaugguggugaccaacaaccugcuggaccugcccccccccagcccccccaagcccaagaccaucgugcugccccccaacuggaagaccgccagagaccccgagggcaagaucuacuacuaccacgugaucaccagacagacccagugggacccccccaccugggagagccccggcgacgacgccagccuggagcacgaggccgagauggaccugggcacccccaccuacgacgagaaccccaugaaggccagcaagaagcccaagaccgccgaggccgacaccagcagcgagcuggccaagaagagcaaggagguguucagaaaggagaugagccaguucaucgugcagugccugaaccccuacagaaagcccgacugcaaggugggcagaaucaccaccaccgaggacuucaagcaccuggccagaaagcugacccacggcgugaugaacaaggagcugaaguacugcaagaaccccgaggaccuggagugcaacgagaacgugaagcacaagaccaaggaguacaucaagaaguacaugcagaaguucggcgccguguacaagcccaaggaggacaccgagcuggaguaa

SEQ ID NO: 23208 - RNA, 1950 nt, Artificial Sequence
  SETD3__Homo_sapiens__XP_011535533
auggagugcagaggccccaccagcagcagaugcgugcugagaagacaccaggccaccggcggcgccgagagagugggcugccugagcaccaacggcaagaaggccgagcugagcaaggaggagagagccgccgcccugcugcccgccagacccgccgugagaaagaugggcaagaagagcagagugaagacccagaagagcggcaccggcgccaccgccaccgugagccccaaggagauccugaaccugaccagcgagcugcugcagaagugcagcagccccgcccccggccccggcaaggagugggaggaguacgugcagaucagaacccugguggagaagaucagaaagaagcagaagggccugagcgugaccuucgacggcaagagagaggacuacuuccccgaccugaugaagugggccagcgagaacggcgccagcguggagggcuucgagauggugaacuucaaggaggagggcuucggccugagagccaccagagacaucaaggccgaggagcuguuccugugggugcccagaaagcugcugaugaccguggagagcgccaagaacagcgugcugggcccccuguacagccaggacagaauccugcaggccaugggcaacaucgcccuggccuuccaccugcugugcgagagagccagccccaacagcuucuggcagcccuacauccagacccugcccagcgaguacgacaccccccuguacuucgaggaggacgaggugagauaccugcagagcacccaggccauccacgacguguucagccaguacaagaacaccgccagacaguacgccuacuucuacaaggugauccagacccacccccacgccaacaagcugccccugaaggacagcuucaccuacgaggacuacagaugggccgugagcagcgugaugaccagacagaaccagauccccaccgaggacggcagcagagugacccuggcccugaucccccugugggacaugugcaaccacaccaacggccugaucaccaccggcuacaaccuggaggacgacagaugcgagugcguggcccugcaggacuucagagccggcgagcagaucuacaucuucuacggcaccagaagcaacgccgaguucgugauccacagcggcuucuucuucgacaacaacagccacgacagagugaagaucaagcugggcgugagcaagagcgacagacuguacgccaugaaggccgaggugcuggccagagccggcauccccaccagcagcguguucgcccugcacuucaccgagccccccaucagcgcccagcugcuggccuuccugagaguguucugcaugaccgaggaggagcugaaggagcaccugcugggcgacagcgccaucgacagaaucuucacccugggcaacagcgaguuccccgugagcugggacaacgaggugaagcuguggaccuuccuggaggacagagccagccugcugcugaagaccuacaagaccaccaucgaggaggacaagagcgugcugaagaaccacgaccugagcgugagagccaagauggccaucaagcugagacugggcgagaaggagauccuggagaaggccgugaagagcgccgccgugaacagagaguacuacagacagcagauggaggagaaggccccccugcccaaguacgaggagagcaaccugggccugcuggagagcagcgugggcgacagcagacugccccuggugcugagaaaccuggaggaggaggccggcgugcaggacgcccugaacaucagagaggccaucagcaaggccaaggccaccgagaacggccuggugaacggcgagaacagcauccccaacggcaccagaagcgagaacgagagccugaaccaggagagcaagagagccguggaggacgccaagggcagcagcagcgacagcaccgccggcgugaaggaguaa

SEQ ID NO: 23209 - RNA, 4329 nt, Artificial Sequence
  SETD5__Homo_sapiens__NP_001073986
augagcaucgccaucccccugggcgugaccaccagcgacaccagcuacagcgacauggccgccggcagcgaccccgagagcguggaggccagccccgccgugaacgagaagagcguguacagcacccacaacuacggcaccacccagagacacggcugcagaggccugcccuacgccaccaucauccccagaagcgaccugaacggccugcccagccccguggaggagagaugcggcgacagccccaacagcgagggcgagaccgugcccaccuggugccccugcggccugagccaggacggcuuccugcugaacugcgacaagugcagaggcaugagcagaggcaaggugaucagacugcacagaagaaagcaggacaacaucagcggcggcgacagcagcgccaccgagagcugggacgaggagcugagccccagcaccgugcuguacaccgccacccagcacacccccaccagcaucacccugaccgugagaagaaccaagcccaagaagagaaagaagagccccgagaagggcagagccgcccccaagaccaagaagaucaagaacagccccagcgaggcccagaaccuggacgagaacaccaccgagggcugggagaacagaaucagacuguggaccgaccaguacgaggaggccuucaccaaccaguacagcgccgacgugcagaacgcccuggagcagcaccugcacagcagcaaggaguucgugggcaagcccaccauccuggacaccaucaacaagaccgagcuggccugcaacaacaccgugaucggcagccagaugcagcugcagcugggcagagugaccagagugcagaagcacagaaagauccugagagccgccagagaccuggcccuggacacccugaucaucgaguacagaggcaaggugaugcugagacagcaguucgaggugaacggccacuucuucaagaagcccuaccccuucgugcuguucuacagcaaguucaacggcguggagaugugcguggacgccagaaccuucggcaacgacgccagauucaucagaagaagcugcacccccaacgccgaggugagacacaugaucgccgacggcaugauccaccugugcaucuacgccgugagcgccaucaccaaggacgccgaggugaccaucgccuucgacuacgaguacagcaacugcaacuacaagguggacugcgccugccacaagggcaacagaaacugccccauccagaagagaaaccccaacgccaccgagcugccccugcugccccccccccccagccugcccaccaucggcgccgagaccagaagaagaaaggccagaagaaaggagcuggagauggagcagcagaacgaggccagcgaggagaacaacgaccagcagagccaggaggugcccgagaaggugaccgugagcagcgaccacgaggagguggacaaccccgaggagaagcccgaggaggagaaggaggaggugaucgacgaccaggagaaccuggcccacagcagaagaaccagagaggacagaaagguggaggccaucaugcacgccuucgagaaccuggagaagagaaagaagagaagagaccagccccuggagcagagcaacagcgacguggagaucaccaccaccaccagcgagacccccgugggcgaggagaccaagaccgaggcccccgagagcgaggugagcaacagcgugagcaacgugaccauccccagcaccccccagagcgugggcgugaacaccagaagaagcagccaggccggcgacaucgccgccgagaagcuggugcccaagcccccccccgccaagcccagcagacccagacccaagagcagaaucagcagauacagaaccagcagcgcccagagacugaagagacagaagcaggccaacgcccagcaggccgagcugagccaggccgcccuggaggagggcggcagcaacagccuggugacccccaccgaggccggcagccuggacagcagcggcgagaacagaccccugaccggcagcgaccccaccguggugagcaucaccggcagccacgugaacagagccgccagcaaguaccccaagaccaagaaguaccuggugaccgaguggcugaacgacaaggccgagaagcaggagugccccguggagugcccccugagaaucaccaccgaccccaccgugcuggccaccacccugaacaugcugcccggccugauccacagcccccugaucugcaccacccccaagcacuacaucagauucggcagccccuucauccccgagagaagaagaagaccccugcugcccgacggcaccuucagcagcugcaagaagagauggaucaagcaggcccuggaggagggcaugacccagaccagcagcgugccccaggagaccagaacccagcaccuguaccagagcaacgagaacagcagcagcagcagcaucugcaaggacaacgccgaccugcugagcccccugaagaaguggaagagcagauaccugauggagcagaacgugaccaagcugcugagaccccugagccccgugaccccccccccccccaacagcggcagcaagagcccccagcuggccacccccggcagcagccaccccggcgaggaggagugcagaaacggcuacagccugauguucagccccgugaccagccugaccaccgccagcagaugcaacaccccccugcaguucgagcugugccacagaaaggaccuggaccuggccaaggugggcuaccuggacagcaacaccaacagcugcgccgacagacccagccugcugaacagcggccacagcgaccuggccccccaccccagccugggccccaccagcgagaccggcuuccccagcagaagcggcgacggccaccagacccuggugagaaacagcgaccaggccuucagaaccgaguucaaccugauguacgccuacagcccccugaacgccaugcccagagccgacggccuguacagaggcagcccccuggugggcgacagaaagccccugcaccuggacggcggcuacugcagccccgccgagggcuucagcagcagauacgagcacggccugaugaaggaccugagcagaggcagccugagccccggcggcgagagagccugcgagggcgugcccagcgccccccagaaccccccccagagaaagaaggugagccugcuggaguacagaaagagaaagcaggaggccaaggagaacagcgccggcggcggcggcgacagcgcccagagcaagagcaagagcgccggcgccggccagggcagcagcaacagcgugagcgacaccggcgcccacggcgugcagggcagcagcgccagaacccccagcagcccccacaagaaguucagccccagccacagcagcaugagccaccuggaggccgugagccccagcgacagcagaggcaccagcagcagccacugcagaccccaggagaacaucagcagcagauggauggugcccaccagcguggagagacugagagagggcggcagcauccccaaggugcugagaagcagcgugagaguggcccagaagggcgagcccagccccaccugggagagcaacaucaccgagaaggacagcgaccccgccgacggcgagggccccgagacccugagcagcgcccugagcaagggcgccaccguguacagccccagcagauacagcuaccagcugcugcagugcgacagccccagaaccgagagccagagccugcugcagcagagcagcagccccuucagaggccaccccacccagagccccggcuacagcuacagaaccaccgcccugagacccggcaacccccccagccacggcagcagcgagagcagccugagcagcaccagcuacagcagccccgcccaccccgugagcaccgacagccuggcccccuucaccggcacccccggcuacuucagcagccagccccacagcggcaacagcaccggcagcaaccugcccagaagaagcugccccagcagcgccgccagccccacccugcagggccccagcgacagccccaccagcgacagcgugagccagagcagcaccggcacccugagcagcaccagcuucccccagaacagcagaagcagccugcccagcgaccugagaaccaucagccugcccagcgccggccagagcgccguguaccaggccagcagagugagcgccgugagcaacagccagcacuacccccacagaggcagcggcggcgugcaccaguacagacugcagccccugcagggcagcggcgugaagacccagaccggccugagcuaa

SEQ ID NO: 23210 - RNA, 1101 nt, Artificial Sequence
  SETD7__Homo_sapiens__NP_085151
auggacagcgacgacgagaugguggaggaggccguggagggccaccuggacgacgacggccugccccacggcuucugcaccgugaccuacagcagcaccgacagauucgagggcaacuucgugcacggcgagaagaacggcagaggcaaguucuucuucuucgacggcagcacccuggagggcuacuacguggacgacgcccugcagggccagggcguguacaccuacgaggacggcggcgugcugcagggcaccuacguggacggcgagcugaacggccccgcccaggaguacgacaccgacggcagacugaucuucaagggccaguacaaggacaacaucagacacggcgugugcuggaucuacuaccccgacggcggcagccuggugggcgaggugaacgaggacggcgagaugaccggcgagaagaucgccuacguguaccccgacgagagaaccgcccuguacggcaaguucaucgacggcgagaugaucgagggcaagcuggccacccugaugagcaccgaggagggcagaccccacuucgagcugaugcccggcaacagcguguaccacuucgacaagagcaccagcagcugcaucagcaccaacgcccugcugcccgaccccuacgagagcgagagaguguacguggccgagagccugaucagcagcgccggcgagggccuguucagcaagguggccgugggccccaacaccgugaugagcuucuacaacggcgugagaaucacccaccaggagguggacagcagagacugggcccugaacggcaacacccugagccuggacgaggagaccgugaucgacgugcccgagcccuacaaccacgugagcaaguacugcgccagccugggccacaaggccaaccacagcuucacccccaacugcaucuacgacauguucgugcaccccagauucggccccaucaagugcaucagaacccugagagccguggaggccgacgaggagcugaccguggccuacggcuacgaccacagcccccccggcaagagcggccccgaggcccccgagugguaccagguggagcugaaggccuuccaggccacccagcagaaguaa

SEQ ID NO: 23211 - RNA, 1059 nt, Artificial Sequence
  SETD8__Homo_sapiens__NP_065115
auggccagaggcagaaagaugagcaagcccagagccguggaggccgccgccgccgccgccgccguggccgccaccgcccccggccccgagaugguggagagaagaggccccggcagacccagaaccgacggcgagaacguguucaccggccagagcaagaucuacagcuacaugagccccaacaagugcagcggcaugagauucccccugcaggaggagaacagcgugacccaccacgaggugaagugccagggcaagccccuggccggcaucuacagaaagagagaggagaagagaaacgccggcaacgccgugagaagcgccaugaagagcgaggagcagaagaucaaggacgccagaaagggcccccuggugcccuuccccaaccagaagagcgaggccgccgagccccccaagaccccccccagcagcugcgacagcaccaacgccgccaucgccaagcaggcccugaagaagcccaucaagggcaagcaggcccccagaaagaaggcccagggcaagacccagcagaacagaaagcugaccgacuucuaccccgugagaagaagcagcagaaagagcaaggccgagcugcagagcgaggagagaaagagaaucgacgagcugaucgagagcggcaaggaggagggcaugaagaucgaccugaucgacggcaagggcagaggcgugaucgccaccaagcaguucagcagaggcgacuucgugguggaguaccacggcgaccugaucgagaucaccgacgccaagaagagagaggcccuguacgcccaggaccccagcaccggcugcuacauguacuacuuccaguaccugagcaagaccuacugcguggacgccaccagagagaccaacagacugggcagacugaucaaccacagcaagugcggcaacugccagaccaagcugcacgacaucgacggcgugccccaccugauccugaucgccagcagagacaucgccgccggcgaggagcugcuguacgacuacggcgacagaagcaaggccagcaucgaggcccaccccuggcugaagcacuaa

SEQ ID NO: 23212 - RNA, 2124 nt, Artificial Sequence
  SETDB2__Homo_sapiens__NP_001153780
augggcgagaagaacggcgacgccaagaccuucuggauggagcuggaggacgacggcaagguggacuucaucuucgagcaggugcagaacgugcugcagagccugaagcagaagaucaaggacggcagcgccaccaacaaggaguacauccaggccaugauccuggugaacgaggccaccaucaucaacagcagcaccagcaucaaggaccccaugcccgugacccagaaggagcaggagaacaagagcaacgccuuccccagcaccagcugcgagaacagcuuccccgaggacugcaccuuccugaccaccgagaacaaggagauccugagccuggaggacaaggugguggacuucagagagaaggacagcagcagcaaccugagcuaccagagccacgacugcagcggcgccugccugaugaagaugccccugaaccugaagggcgagaacccccugcagcugcccaucaagugccacuuccagagaagacacgccaagaccaacagccacagcagcgcccugcacgugagcuacaagacccccugcggcagaagccugagaaacguggaggagguguucagauaccugcuggagaccgagugcaacuuccuguucaccgacaacuucagcuucaacaccuacgugcagcuggccagaaacuaccccaagcagaaggagguggugagcgacguggacaucagcaacggcguggagagcgugcccaucagcuucugcaacgagaucgacagcagaaagcugccccaguucaaguacagaaagaccguguggcccagagccuacaaccugaccaacuucagcagcauguucaccgacagcugcgacugcagcgagggcugcaucgacaucaccaagugcgccugccugcagcugaccgccagaaacgccaagaccagcccccugagcagcgacaagaucaccaccggcuacaaguacaagagacugcagagacagauccccaccggcaucuacgagugcagccugcugugcaagugcaacagacagcugugccagaacagaguggugcagcacggcccccaggugagacugcagguguucaagaccgagcagaagggcuggggcgugagaugccuggacgacaucgacagaggcaccuucgugugcaucuacagcggcagacugcugagcagagccaacaccgagaagagcuacggcaucgacgagaacggcagagacgagaacaccaugaagaacaucuucagcaagaagagaaagcuggagguggccugcagcgacugcgagguggaggugcugccccugggccuggagacccaccccagaaccgccaagaccgagaagugcccccccaaguucagcaacaaccccaaggagcugaccguggagaccaaguacgacaacaucagcagaauccaguaccacagcgugaucagagaccccgagagcaagaccgccaucuuccagcacaacggcaagaagauggaguucgugagcagcgagagcgugacccccgaggacaacgacggcuucaagccccccagagagcaccugaacagcaagaccaagggcgcccagaaggacagcagcagcaaccacguggacgaguucgaggacaaccugcugaucgagagcgacgugaucgacaucaccaaguacagagaggagaccccccccagaagcagaugcaaccaggccaccacccuggacaaccagaacaucaagaaggccaucgaggugcagauccagaagccccaggagggcagaagcaccgccugccagagacagcagguguucugcgacgaggagcugcugagcgagaccaagaacaccagcagcgacagccugaccaaguucaacaagggcaacguguuccugcuggacgccaccaaggagggcaacgugggcagauuccugaaccacagcugcugccccaaccugcuggugcagaacguguucguggagacccacaacagaaacuucccccugguggccuucuucaccaacagauacgugaaggccagaaccgagcugaccugggacuacggcuacgaggccggcaccgugcccgagaaggagaucuucugccagugcggcgugaacaagugcagaaagaagauccuguaa

SEQ ID NO: 23213 - RNA, 807 nt, Artificial Sequence
  SET__Homo_sapiens__NP_001234929
augggcugcagagaccugcugcccagccugaagcccacccugcuggagaaggagcagcaggaggccaucgagcacaucgacgaggugcagaacgagaucgacagacugaacgagcaggccagcgaggagauccugaagguggagcagaaguacaacaagcugagacagcccuucuuccagaagagaagcgagcugaucgccaagauccccaacuucugggugaccaccuucgugaaccacccccaggugagcgcccugcugggcgaggaggacgaggaggcccugcacuaccugaccagaguggaggugaccgaguucgaggacaucaagagcggcuacagaaucgacuucuacuucgacgagaaccccuacuucgagaacaaggugcugagcaaggaguuccaccugaacgagagcggcgaccccagcagcaagagcaccgagaucaaguggaagagcggcaaggaccugaccaagagaagcagccagacccagaacaaggccagcagaaagagacagcacgaggagcccgagagcuucuucaccugguucaccgaccacagcgacgccggcgccgacgagcugggcgaggugaucaaggacgacaucuggcccaacccccugcaguacuaccuggugcccgacauggacgacgaggagggcgagggcgaggaggacgacgacgacgacgaggaggaggagggccuggaggacaucgacgaggagggcgacgaggacgagggcgaggaggacgaggacgacgacgagggcgaggagggcgaggaggacgagggcgaggacgacuaa

SEQ ID NO: 23214 - RNA, 1098 nt, Artificial Sequence
  SETMAR__Homo_sapiens__NP_001263254
auguucgccgaggccgccaagaccaccagacccugcggcauggccgaguucaaggagaagcccgaggcccccaccgagcagcuggacguggccugcggccaggagaaccugcccgugggcgccuggccccccggcgccgcccccgcccccuuccaguacacccccgaccacguggugggccccggcgccgacaucgaccccacccagaucaccuuccccggcugcaucugcgugaagacccccugccugcccggcaccugcagcugccugagacacggcgagaacuacgacgacaacagcugccugagagacaucggcagcggcggcaaguacgccgagcccguguucgagugcaacgugcugugcagaugcagcgaccacugcagaaacagaguggugcagaagggccugcaguuccacuuccagguguucaagacccacaagaagggcuggggccugagaacccuggaguucauccccaagggcagauucgugugcgaguacgccggcgaggugcugggcuucagcgaggugcagagaagaauccaccugcagaccaagagcgacagcaacuacaucaucgccaucagagagcacguguacaacggccaggugauggagaccuucguggaccccaccuacaucggcaacaucggcagauuccugaaccacagcugcgagcccaaccugcugaugauccccgugagaaucgacagcauggugcccaagcuggcccuguucgccgccaaggacaucgugcccgaggaggagcugagcuacgacuacagcggcagauaccugaaccugaccgugagcgaggacaaggagagacuggaccacggcaagcugagaaagcccugcuacugcggcgccaagagcugcaccgccuuccugcccuucgacagcagccuguacugccccguggagaagagcaacaucagcugcggcaacgagaaggagcccagcaugugcggcagcgcccccagcguguuccccagcugcaagagacugacccuggaggugagccuguucagcgacaagcagcuggccccccccuacagcggcagacaguggcuggccagcuucaccagcgccuaa

SEQ ID NO: 23215 - RNA, 8034 nt, Artificial Sequence
  SETX__Homo_sapiens__NP_055861
augagcaccugcugcuggugcacccccggcggcgccagcaccaucgacuuccugaagagauacgccagcaacacccccagcggcgaguuccagaccgccgacgaggaccugugcuacugccuggagugcguggccgaguaccacaaggccagagacgagcugcccuuccugcacgaggugcugugggagcuggagacccugagacugaucaaccacuucgagaagagcaugaaggccgagaucggcgacgacgacgagcuguacaucguggacaacaacggcgagaugccccuguucgacaucaccggccaggacuucgagaacaagcugagagugccccugcuggagauccugaaguaccccuaccugcugcugcacgagagagugaacgagcugugcguggaggcccugugcagaauggagcaggccaacugcagcuuccagguguucgacaagcaccccggcaucuaccuguuccuggugcaccccaacgagauggugagaagaugggccauccugaccgccagaaaccugggcaagguggacagagacgacuacuacgaccugcaggaggugcugcugugccuguucaaggugaucgagcugggccugcuggagagccccgacaucuacaccagcagcgugcuggagaagggcaagcugauccugcugcccagccacauguacgacaccaccaacuacaagagcuacuggcugggcaucugcaugcugcugaccauccuggaggagcaggccauggacagccugcugcugggcagcgacaagcagaacgacuucaugcagagcauccugcacaccauggagagagaggccgacgacgacagcguggaccccuucuggcccgcccugcacugcuucauggugauccuggacagacugggcagcaagguguggggccagcugauggaccccaucguggccuuccagaccaucaucaacaacgccagcuacaacagagagaucagacacaucagaaacagcagcgugagaaccaagcuggagcccgagagcuaccuggacgacauggugaccugcagccagaucguguacaacuacaaccccgagaagaccaagaaggacagcggcuggagaaccgccaucugccccgacuacugccccaacauguacgaggagauggagacccuggccagcgugcugcagagcgacaucggccaggacaugagagugcacaacagcaccuuccugugguucauccccuucgugcagagccugauggaccugaaggaccugggcguggccuacaucgcccagguggugaaccaccuguacagcgaggugaaggaggugcugaaccagaccgacgccgugugcgacaaggugaccgaguucuuccugcugauccuggugagcgugaucgagcugcacagaaacaagaagugccugcaccugcugugggugagcagccagcaguggguggaggccguggugaagugcgccaagcugcccaccaccgccuucaccagaagcagcgagaagagcagcggcaacugcagcaagggcaccgccaugaucagcagccugagccugcacagcaugcccagcaacagcgugcagcuggccuacgugcagcugaucagaagccugcugaaggagggcuaccagcugggccagcagagccugugcaagagauucugggacaagcugaaccuguuccugagaggcaaccugagccugggcuggcagcugaccagccaggagacccacgagcugcagagcugccugaagcagaucaucagaaacaucaaguucaaggccccccccugcaacaccuucguggaccugaccagcgccugcaagaucagccccgccagcuacaacaaggaggagagcgagcagaugggcaagaccagcagaaaggacaugcacugccuggaggccagcagccccaccuucagcaaggagcccaugaaggugcaggacagcgugcugaucaaggccgacaacaccaucgagggcgacaacaacgagcagaacuacaucaaggacgugaagcuggaggaccaccugcuggccggcagcugccugaagcagagcagcaagaacaucuucaccgagagagccgaggaccagaucaagaucagcaccagaaagcagaagagcgugaaggagaucagcagcuacacccccaaggacugcaccagcagaaacggccccgagagaggcugcgacagaggcaucaucgugagcaccagacugcugaccgacagcagcaccgacgcccuggagaaggugagcaccagcaacgaggacuucagccugaaggacgacgcccuggccaagaccagcaagagaaagaccaaggugcagaaggacgagaucugcgccaagcugagccacgugaucaagaagcagcacagaaagagcacccugguggacaacaccaucaaccuggacgagaaccugaccgugagcaacaucgagagcuucuacagcagaaaggacaccggcgugcagaagggcgacggcuucauccacaaccugagccuggaccccagcggcgugcuggacgacaagaacggcgagcagaagagccagaacaacgugcugcccaaggagaagcagcugaagaacgaggagcuggugaucuucagcuuccacgagaacaacugcaagauccaggaguuccacguggacggcaaggagcugauccccuucaccgagaugaccaacgccagcgagaagaagagcagccccuucaaggaccugaugaccgugcccgagagcagagacgaggagaugagcaacagcaccagcgugaucuacagcaaccugaccagagagcaggcccccgacaucagccccaagagcgacacccugaccgacagccagaucgacagagaccugcacaagcugagccugcuggcccaggccagcgugaucaccuuccccagcgacagcccccagaacagcagccagcugcagagaaaggugaaggaggacaagagaugcuucaccgccaaccagaacaacgugggcgacaccagcagaggccaggugaucaucaucagcgacagcgacgacgacgacgacgagagaauccugagccuggagaagcugaccaagcaggacaagaucugccuggagagagagcaccccgagcagcacgugagcaccgugaacagcaaggaggagaagaaccccgugaaggaggagaagaccgagacccuguuccaguucgaggagagcgacagccagugcuucgaguucgagagcagcagcgagguguucagcguguggcaggaccaccccgacgacaacaacagcgugcaggacggcgagaagaagugccuggcccccaucgccaacaccaccaacggccagggcugcaccgacuacgugagcgagguggugaagaagggcgccgagggcaucgaggagcacaccagacccagaagcaucagcguggaggaguucugcgagaucgaggugaagaagcccaagagaaagagaagcgagaagcccauggccgaggaccccgugagacccagcagcagcgugagaaacgagggccagagcgacaccaacaagagagaccuggugggcaacgacuucaagagcaucgacagaagaaccagcacccccaacagcagaauccagagagccaccaccgugagccagaagaagagcagcaagcugugcaccugcaccgagcccaucagaaaggugcccgugagcaagacccccaagaagacccacagcgacgccaagaagggccagaacagaagcagcaacuaccugagcugcagaaccacccccgccaucgugccccccaagaaguucagacagugccccgagcccaccagcaccgccgagaagcugggccugaagaagggccccagaaaggccuacgagcugagccagagaagccuggacuacguggcccagcugagagaccacggcaagaccgugggcgugguggacaccagaaagaagaccaagcugaucagcccccagaaccugagcgugagaaacaacaagaagcugcugaccagccaggagcugcagaugcagagacagaucagacccaagagccagaagaacagaagaagacugagcgacugcgagagcaccgacgugaagagagccggcagccacaccgcccagaacagcgacaucuucgugcccgagagcgacagaagcgacuacaacugcaccggcggcaccgaggugcuggccaacagcaacagaaagcagcugaucaagugcaugcccagcgagcccgagaccaucaaggccaagcacggcagccccgccaccgacgacgccugcccccugaaccagugcgacagcguggugcugaacggcaccgugcccaccaacgaggugaucgugagcaccagcgaggacccccugggcggcggcgaccccaccgccagacacaucgagauggccgcccugaaggagggcgagcccgacagcagcagcgacgccgaggaggacaaccuguuccugacccagaacgaccccgaggacauggaccugugcagccagauggagaacgacaacuacaagcugaucgagcugauccacggcaaggacaccguggagguggaggaggacagcgugagcagaccccagcuggagagccugagcggcaccaagugcaaguacaaggacugccuggagaccaccaagaaccagggcgaguacugccccaagcacagcgaggugaaggccgccgacgaggacguguucagaaagcccggccugcccccccccgccagcaagccccugagacccaccaccaagaucuucagcagcaagagcaccagcagaaucgccggccugagcaagagccuggagaccagcagcgcccugagccccagccugaagaacaagagcaagggcauccagagcauccugaaggugccccagcccgugccccugaucgcccagaagcccgugggcgagaugaagaacagcugcaacgugcugcacccccagagccccaacaacagcaacagacagggcugcaaggugcccuucggcgagagcaaguacuuccccagcagcagccccgugaacauccugcugagcagccagagcgugagcgacaccuucgugaaggaggugcugaaguggaaguacgagauguuccugaacuucggccagugcggcccccccgccagccugugccagagcaucagcagacccgugcccgugagauuccacaacuacggcgacuacuucaacguguucuucccccugauggugcugaacaccuucgagaccguggcccaggaguggcugaacagccccaacagagagaacuucuaccagcugcaggugagaaaguuccccgccgacuacaucaaguacugggaguucgccguguaccuggaggagugcgagcuggccaagcagcuguaccccaaggagaacgaccugguguuccuggcccccgagagaaucaacgaggagaagaaggacaccgagagaaacgacauccaggaccugcacgaguaccacagcggcuacgugcacaaguucagaagaaccagcgugaugagaaacggcaagaccgagugcuaccugagcauccagacccaggagaacuuccccgccaaccugaacgagcuggugaacugcaucgugaucagcagccuggugaccacccagagaaagcugaaggccaugagccugcugggcagcagaaaccagcuggccagagccgugcugaaccccaaccccauggacuucugcaccaaggaccugcugaccaccaccagcgagagaaucaucgccuaccugagagacuucaacgaggaccagaagaaggccaucgagaccgccuacgccauggugaagcacagccccagcguggccaagaucugccugauccacggcccccccggcaccggcaagagcaagaccaucgugggccugcuguacagacugcugaccgagaaccagagaaagggccacagcgacgagaacagcaacgccaagaucaagcagaacagagugcuggugugcgcccccagcaacgccgccguggacgagcugaugaagaagaucauccuggaguucaaggagaagugcaaggacaagaagaacccccugggcaacugcggcgacaucaaccuggugagacugggccccgagaagagcaucaacagcgaggugcugaaguucagccuggacagccaggugaaccacagaaugaagaaggagcugcccagccacgugcaggccaugcacaagagaaaggaguuccuggacuaccagcuggacgagcugagcagacagagagcccugugcagaggcggcagagagauccagagacaggagcuggacgagaacaucagcaaggugagcaaggagagacaggagcuggccagcaagaucaaggaggugcagggcagaccccagaagacccagagcaucaucauccuggagagccacaucaucugcugcacccugagcaccagcggcggccugcugcuggagagcgccuucagaggccagggcggcgugcccuucagcugcgugaucguggacgaggccggccagagcugcgagaucgagacccugaccccccugauccacagaugcaacaagcugauccuggugggcgaccccaagcagcugccccccaccgugaucagcaugaaggcccaggaguacggcuacgaccagagcaugauggccagauucugcagacugcuggaggagaacguggagcacaacaugaucagcagacugcccauccugcagcugaccgugcaguacagaaugcaccccgacaucugccuguuccccagcaacuacguguacaacagaaaccugaagaccaacagacagaccgaggccaucagaugcagcagcgacuggcccuuccagcccuaccugguguucgacgugggcgacggcagcgagagaagagacaacgacagcuacaucaacgugcaggagaucaagcuggugauggagaucaucaagcugaucaaggacaagagaaaggacgugagcuucagaaacaucggcaucaucacccacuacaaggcccagaagaccaugauccagaaggaccuggacaaggaguucgacagaaagggccccgccgagguggacaccguggacgccuuccagggcagacagaaggacugcgugaucgugaccugcgugagagccaacagcauccagggcagcaucggcuuccuggccagccugcagagacugaacgugaccaucaccagagccaaguacagccuguucauccugggccaccugagaacccugauggagaaccagcacuggaaccagcugauccaggacgcccagaagagaggcgccaucaucaagaccugcgacaagaacuacagacacgacgccgugaagauccugaagcugaagcccgugcugcagagaagccugacccacccccccaccaucgcccccgagggcagcagaccccagggcggccugcccagcagcaagcuggacagcggcuucgccaagaccagcguggccgccagccuguaccacacccccagcgacagcaaggagaucacccugaccgugaccagcaaggaccccgagagaccccccgugcacgaccagcugcaggaccccagacugcugaagagaaugggcaucgaggugaagggcggcaucuuccugugggacccccagcccagcagcccccagcaccccggcgccaccccccccaccggcgagcccggcuuccccguggugcaccaggaccugagccacauccagcagcccgccgccgugguggccgcccugagcagccacaagccccccgugagaggcgagccccccgccgccagccccgaggccagcaccugccagagcaagugcgacgaccccgaggaggagcugugccacagaagagaggccagagccuucagcgagggcgagcaggagaagugcggcagcgagacccaccacaccagaagaaacagcagaugggacaagagaacccuggagcaggaggacagcagcagcaagaagagaaagcugcuguaa

SEQ ID NO: 23216 - RNA, 2982 nt, Artificial Sequence
  SEZ6__Homo_sapiens__NP_001092105
augagacccguggcccugcugcugcugcccagccugcuggcccugcuggcccacggccugagccuggaggcccccaccgugggcaagggccaggcccccggcaucgaggagaccgacggcgagcugaccgccgcccccacccccgagcagcccgagagaggcgugcacuucgugaccaccgcccccacccugaagcugcugaaccaccacccccugcuggaggaguuccugcaggagggccuggagaagggcgacgaggagcugagacccgcccugcccuuccagcccgacccccccgcccccuucacccccagcccccugcccagacuggccaaccaggacagcagacccguguucaccagccccacccccgccauggccgccgugcccacccagccccagagcaaggagggccccuggagccccgagagcgagagccccaugcugagaaucaccgccccccugccccccggccccagcauggccgugcccacccugggccccggcgagaucgccagcaccaccccccccagcagagccuggacccccacccaggagggccccggcgacaugggcagacccuggguggccgagguggugagccagggcgccggcaucggcauccagggcaccaucaccagcagcaccgccagcggcgacgacgaggagaccaccaccaccaccaccaucaucaccaccaccaucaccaccgugcagacccccggccccugcagcuggaacuucagcggccccgagggcagccuggacagccccaccgaccugagcagccccaccgacgugggccuggacugcuucuucuacaucagcguguaccccggcuacggcguggagaucaaggugcagaacaucagccugagagagggcgagaccgugaccguggagggccugggcggccccgacccccugccccuggccaaccagagcuuccugcugagaggccaggugaucagaagccccacccaccaggccgcccugagauuccagagccugcccccccccgccggccccggcaccuuccacuuccacuaccaggccuaccugcugagcugccacuuccccagaagacccgccuacggcgacgugaccgugaccagccugcaccccggcggcagcgccagauuccacugcgccaccggcuaccagcugaagggcgccagacaccugaccugccugaacgccacccagcccuucugggacagcaaggagcccgugugcaucgccgccugcggcggcgugaucagaaacgccaccaccggcagaaucgugagccccggcuuccccggcaacuacagcaacaaccugaccugccacuggcugcuggaggcccccgagggccagagacugcaccugcacuucgagaaggugagccuggccgaggacgacgacagacugaucaucagaaacggcgacaacguggaggccccccccguguacgacagcuacgagguggaguaccugcccaucgagggccugcugagcagcggcaagcacuucuucguggagcugagcaccgacagcagcggcgccgccgccggcauggcccugagauacgaggccuuccagcagggccacugcuacgagcccuucgugaaguacggcaacuucagcagcagcacccccaccuaccccgugggcaccaccguggaguucagcugcgaccccggcuacacccuggagcagggcagcaucaucaucgagugcguggacccccacgacccccaguggaacgagaccgagcccgccugcagagccgugugcagcggcgagaucaccgacagcgccggcguggugcugagccccaacuggcccgagcccuacggcagaggccaggacugcaucuggggcgugcacguggaggaggacaagagaaucaugcuggacaucagagugcugagaaucggccccggcgacgugcugaccuucuacgacggcgacgaccugaccgccagagugcugggccaguacagcggccccagaagccacuucaagcuguucaccagcauggccgacgugaccauccaguuccagagcgaccccggcaccagcgugcugggcuaccagcagggcuucgugauccacuucuucgaggugcccagaaacgacaccugccccgagcugcccgagauccccaacggcuggaagagccccagccagcccgagcuggugcacggcaccguggugaccuaccagugcuaccccggcuaccagguggugggcagcagcgugcugaugugccagugggaccugaccuggagcgaggaccugcccagcugccagagagugaccagcugccacgaccccggcgacguggagcacagcagaagacugaucagcagccccaaguuccccgugggcgccaccgugcaguacaucugcgaccagggcuucgugcugaugggcagcagcauccugaccugccacgacagacaggccggcagccccaaguggagcgacagagcccccaagugccugcuggagcagcugaagcccugccacggccugagcgcccccgagaacggcgccagaagccccgagaagcagcugcaccccgccggcgccaccauccacuucagcugcgcccccggcuacgugcugaagggccaggccagcaucaagugcgugcccggccaccccagccacuggagcgaccccccccccaucugcagagccgccagccuggacggcuucuacaacagcagaagccuggacguggccaaggcccccgccgccagcagcacccuggacgccgcccacaucgccgccgccaucuuccugccccugguggccauggugcugcuggugggcggcguguacuucuacuucagcagacugcagggcaagagcagccugcagcugcccagacccagacccagacccuacaacagaaucaccaucgagagcgccuucgacaaccccaccuacgagaccggcgagaccagagaguacgaggugagcaucuaa

SEQ ID NO: 23217 - RNA, 2430 nt, Artificial Sequence
  SEZ6L2__Homo_sapiens__NP_001107572
augggcacccccagagcccagcaccccccccccccccagcugcuguuccugauccugcugagcugccccuggauccagggccugccccugaaggaggaggagauccugcccgagcccggcagcgagacccccaccguggccagcgaggcccuggccgagcugcugcacggcgcccugcugagaagaggccccgagaugggcuaccugcccggcagcgacagagaccccacccuggccaccccccccgccggccagacccuggccgugcccagccugcccagagccaccgagcccggcaccggcccccugaccaccgccgugacccccaacggcgugagaggcgccggccccaccgcccccgagcugcugacccccccccccggcaccaccgccccccccccccccagccccgccagccccggccccccccugggccccgagggcggcgaggaggagaccaccaccaccaucaucaccaccaccaccgugaccaccaccgugaccagccccgccuaccugcugagcugcggcuucccccccagacccgcccacggcgacgugagcgugaccgaccugcaccccggcggcaccgccaccuuccacugcgacagcggcuaccagcugcagggcgaggagacccugaucugccugaacggcaccagacccagcuggaacggcgagacccccagcugcauggccagcugcggcggcaccauccacaacgccacccugggcagaaucgugagccccgagcccggcggcgccgugggccccaaccugaccugcagaugggugaucgaggccgccgagggcagaagacugcaccugcacuucgagagagugagccuggacgaggacaacgacagacugauggugagaagcggcggcagcccccugagccccgugaucuacgacagcgacauggacgacgugcccgagagaggccugaucagcgacgcccagagccuguacguggagcugcugagcgagacccccgccaacccccugcugcugagccugagauucgaggccuucgaggaggacagaugcuucgcccccuuccuggcccacggcaacgugaccaccaccgaccccgaguacagacccggcgcccuggccaccuucagcugccugcccggcuacgcccuggagccccccggcccccccaacgccaucgagugcguggaccccaccgagccccacuggaacgacaccgagcccgccugcaaggccaugugcggcggcgagcugagcgagcccgccggcguggugcugagccccgacuggccccagagcuacagccccggccaggacugcguguggggcgugcacgugcaggaggagaagagaauccugcugcagguggagauccugaacgugagagagggcgacaugcugacccuguucgacggcgacggccccagcgccagagugcuggcccagcugagaggcccccagcccagaagaagacugcugagcagcggccccgaccugacccugcaguuccaggccccccccggcccccccaaccccggccugggccagggcuucgugcugcacuucaaggaggugcccagaaacgacaccugccccgagcugcccccccccgaguggggcuggagaaccgccagccacggcgaccugaucagaggcaccgugcugaccuaccagugcgagcccggcuacgagcugcugggcagcgacauccugaccugccagugggaccugagcuggagcgccgccccccccgccugccagaagaucaugaccugcgccgaccccggcgagaucgccaacggccacagaaccgccagcgacgccggcuuccccgugggcagccacgugcaguacagaugccugcccggcuacagccuggagggcgccgccaugcugaccugcuacagcagagacaccggcacccccaaguggagcgacagagugcccaagugcgcccugaaguacgagcccugccugaaccccggcgugcccgagaacggcuaccagacccuguacaagcaccacuaccaggccggcgagagccugagauucuucugcuacgagggcuucgagcugaucggcgaggugaccaucaccugcgugcccggccaccccagccaguggaccagccagcccccccugugcaagguggccuacgaggagcugcuggacaacagaaagcuggaggugacccagaccaccgaccccagcagacagcuggagggcggcaaccuggcccuggccauccugcugccccugggccuggugaucgugcugggcagcggcguguacaucuacuacaccaagcugcagggcaagagccuguucggcuucagcggcagccacagcuacagccccaucaccguggagagcgacuucagcaacccccuguacgaggccggcgacaccagagaguacgaggugagcaucuaa

SEQ ID NO: 23218 - RNA, 3072 nt, Artificial Sequence
  SEZ6L__Homo_sapiens__NP_001171702
augcccgccgccagaccccccgccgccggccugagaggcaucagccuguuccuggcccugcugcugggcagccccgccgccgcccuggagagagacgcccugcccgagggcgacgccagcccccugggccccuaccugcugcccagcggcgcccccgagagaggcagccccggcaaggagcaccccgaggagagaguggugaccgccccccccagcagcagccagagcgccgaggugcugggcgagcuggugcuggacggcaccgcccccagcgcccaccacgacauccccgcccugagcccccugcugcccgaggaggccagacccaagcacgcccugccccccaagaagaagcugcccagccugaagcaggugaacagcgccagaaagcagcugagacccaaggccaccagcgccgccaccgugcagagagccggcagccagcccgccagccagggccuggaccugcugagcagcagcaccgagaagcccggcccccccggcgaccccgaccccaucguggccagcgaggaggccagcgaggugccccuguggcuggacagaaaggagagcgccgugcccaccacccccgccccccugcagaucagccccuucaccagccagcccuacguggcccacacccugccccagagacccgagcccggcgagcccggccccgacauggcccaggaggccccccaggaggacaccagccccauggcccugauggacaagggcgagaacgagcugaccggcagcgccagcgaggagagccaggagaccaccaccagcaccaucaucaccaccaccgugaucaccaccgagcaggcccccgcccugugcagcgugagcuucagcaaccccgagggcuacaucgacagcagcgacuacccccugcugccccugaacaacuuccuggagugcaccuacaacgugaccguguacaccggcuacggcguggagcugcaggugaagagcgugaaccugagcgacggcgagcugcugagcaucagaggcguggacggccccacccugaccgugcuggccaaccagacccugcugguggagggccaggugaucagaagccccaccaacaccaucagcguguacuucagaaccuuccaggacgacggccugggcaccuuccagcugcacuaccaggccuucaugcugagcugcaacuuccccagaagacccgacagcggcgacgugaccgugauggaccugcacagcggcggcguggcccacuuccacugccaccugggcuacgagcugcagggcgccaagaugcugaccugcaucaacgccagcaagccccacuggagcagccaggagcccaucugcagcgcccccugcggcggcgccgugcacaacgccaccaucggcagagugcugagccccagcuaccccgagaacaccaacggcagccaguucugcaucuggaccaucgaggcccccgagggccagaagcugcaccugcacuucgagagacugcugcugcacgacaaggacagaaugaccgugcacagcggccagaccaacaagagcgcccugcuguacgacagccugcagaccgagagcgugcccuucgagggccugcugagcgagggcaacaccaucagaaucgaguucaccagcgaccaggccagagccgccagcaccuucaacaucagauucgaggccuucgagaagggccacugcuacgagcccuacauccagaacggcaacuucaccaccagcgaccccaccuacaacaucggcaccaucguggaguucaccugcgaccccggccacagccuggagcagggccccgccaucaucgagugcaucaacgugagagaccccuacuggaacgacaccgagccccugugcagagccaugugcggcggcgagcugagcgccguggccggcguggugcugagccccaacuggcccgagcccuacguggagggcgaggacugcaucuggaagauccacgugggcgaggagaagagaaucuuccuggacauccaguuccugaaccugagcaacagcgacauccugaccaucuacgacggcgacgaggugaugccccacauccugggccaguaccugggcaacagcggcccccagaagcuguacagcagcacccccgaccugaccauccaguuccacagcgaccccgccggccugaucuucggcaagggccagggcuucaucaugaacuacaucgaggugagcagaaacgacagcugcagcgaccugcccgagauccagaacggcuggaagaccaccagccacaccgagcuggugagaggcgccagaaucaccuaccagugcgaccccggcuacgacaucgugggcagcgacacccugaccugccagugggaccugagcuggagcagcgacccccccuucugcgagaagaucauguacugcaccgaccccggcgagguggaccacagcaccagacugaucagcgaccccgugcugcuggugggcaccaccauccaguacaccugcaaccccggcuucgugcuggagggcagcagccugcugaccugcuacagcagagagaccggcacccccaucuggaccagcagacugccccacugcgugagcgaggagagccuggccugcgacaaccccggccugcccgagaacggcuaccagauccuguacaagagacuguaccugcccggcgagagccugaccuucaugugcuacgagggcuucgagcugaugggcgaggugaccaucagaugcauccugggccagcccagccacuggaacggcccccugcccgugugcaaggugaaccaggacagcuucgagcacgcccuggaggccgaggccgccgccgagaccagccuggagggcggcaacauggcccuggccaucuucauccccgugcugaucaucagccugcugcugggcggcgccuacaucuacaucaccagaugcagauacuacagcaaccugagacugccccugauguacagccaccccuacagccagaucaccguggagaccgaguucgacaaccccaucuacgagaccggcgagaccagagaguacgaggugagcaucuaa

SEQ ID NO: 23219 - RNA, 2022 nt, Artificial Sequence
  SF1__Homo_sapiens__NP_001171501
auggccaccggcgccaacgccaccccccugggcaagcugggcccccccggccugcccccccugcccggccccaagggcggcuucgagcccggccccccccccgcccccggccccggcgccggccugcuggcccccggcccccccccccccccccccgugggcagcaugggcgcccugaccgccgccuuccccuucgccgcccugcccccccccccccccccccccccccccccccccccccagcagccccccccccccccccccccccccagccccggcgccagcuacccccccccccagcccccccccccccccccccuguaccagagagugagccccccccagcccccccccccccagccccccagaaaggaccagcagcccggccccgccggcggcggcggcgacuuccccagcaagaagagaaagagaagcagauggaaccaggacaccauggagcagaagaccgugauccccggcaugcccaccgugaucccccccggccugaccagagagcaggagagagccuacaucgugcagcugcagaucgaggaccugaccagaaagcugagaaccggcgaccugggcaucccccccaaccccgaggacagaagccccagccccgagcccaucuacaacagcgagggcaagagacugaacaccagagaguucagaaccagaaagaagcuggaggaggagagacacaaccugaucaccgagaugguggcccugaaccccgacuucaagccccccgccgacuacaagccccccgccaccagagugagcgacaaggugaugaucccccaggacgaguaccccgagaucaacuucgugggccugcugaucggccccagaggcaacacccugaagaacaucgagaaggagugcaacgccaagaucaugaucagaggcaagggcagcgugaaggagggcaaggugggcagaaaggacggccagaugcugcccggcgaggacgagccccugcacgcccuggugaccgccaacaccauggagaacgugaagaaggccguggagcagaucagaaacauccugaagcagggcaucgagacccccgaggaccagaacgaccugagaaagaugcagcugagagagcuggccagacugaacggcacccugagagaggacgacaacagaauccugagacccuggcagagcagcgagaccagaagcaucaccaacaccaccgugugcaccaagugcggcggcgccggccacaucgccagcgacugcaaguuccagagacccggcgacccccagagcgcccaggacaaggccagaauggacaaggaguaccugagccugauggccgagcugggcgaggcccccgugcccgccagcgugggcagcaccagcggccccgccaccaccccccuggccagcgcccccagacccgccgcccccgccaacaacccccccccccccagccugaugagcaccacccagagcagaccccccuggaugaacagcggccccagcgagagcagacccuaccacggcaugcacggcggcggccccggcggccccggcggcggcccccacagcuucccccacccccugcccagccugaccggcggccacggcggccaccccaugcagcacaaccccaacggcccccccccccccuggaugcagcccccccccccccccaugaaccagggcccccacccccccggccaccacggccccccccccauggaccaguaccugggcagcacccccgugggcagcggcguguacagacugcaccagggcaagggcaugaugccccccccccccaugggcaugaugcccccccccccccccccccccagcggccagcccccccccccccccagcggcccccugccccccuggcagcagcagcagcagcagcccccccccccccccccccccagcagcagcauggccagcagcaccccccugcccuggcagcagagaagccugcccgccgccgccauggccagagccaugagagugagaaccuucagagcccacugguaa

SEQ ID NO: 23220 - RNA, 2382 nt, Artificial Sequence
  SF3A1__Homo_sapiens__NP_005868
augcccgccggccccgugcaggccgugcccccccccccccccgugcccaccgagcccaagcagcccaccgaggaggaggccagcagcaaggaggacagcgcccccagcaagcccguggugggcaucaucuaccccccccccgaggugagaaacaucguggacaagaccgccagcuucguggccagaaacggccccgaguucgaggccagaaucagacagaacgagaucaacaaccccaaguucaacuuccugaaccccaacgaccccuaccacgccuacuacagacacaaggugagcgaguucaaggagggcaaggcccaggagcccagcgccgccauccccaaggugaugcagcagcagcagcagaccacccagcagcagcugccccagaaggugcaggcccaggugauccaggagaccaucgugcccaaggagcccccccccgaguucgaguucaucgccgacccccccagcaucagcgccuucgaccuggacguggugaagcugaccgcccaguucguggccagaaacggcagacaguuccugacccagcugaugcagaaggagcagagaaacuaccaguucgacuuccugagaccccagcacagccuguucaacuacuucaccaagcugguggagcaguacaccaagauccugaucccccccaagggccuguucagcaagcugaagaaggaggccgagaaccccagagaggugcuggaccaggugugcuacagaguggagugggccaaguuccaggagagagagagaaagaaggaggaggaggagaaggagaaggagagaguggccuacgcccagaucgacuggcacgacuucguggugguggagaccguggacuuccagcccaacgagcagggcaacuuccccccccccaccacccccgaggagcugggcgccagaauccugauccaggagagauacgagaaguucggcgagagcgaggagguggagauggagguggagagcgacgaggaggacgacaagcaggagaaggccgaggagccccccagccagcuggaccaggacacccaggugcaggacauggacgagggcagcgacgacgaggaggagggccagaaggugccccccccccccgagacccccaugccccccccccugccccccacccccgaccaggugaucgugagaaaggacuacgaccccaaggccagcaagccccugccccccgcccccgcccccgacgaguaccuggugagccccaucaccggcgagaagauccccgccagcaagaugcaggagcacaugagaaucggccugcuggaccccagauggcuggagcagagagacagaagcaucagagagaagcagagcgacgacgagguguacgcccccggccuggacaucgagagcagccugaagcagcuggccgagagaagaaccgacaucuucggcguggaggagaccgccaucggcaagaagaucggcgaggaggagauccagaagcccgaggagaaggugaccugggacggccacagcggcagcauggccagaacccagcaggccgcccaggccaacaucacccugcaggagcagaucgaggccauccacaaggccaagggccuggugcccgaggacgacaccaaggagaagaucggccccagcaagcccaacgagaucccccagcagccccccccccccagcagcgccaccaacauccccagcagcgccccccccaucaccagcgugcccagaccccccaccaugcccccccccgugagaaccaccguggugagcgccgugcccgugaugcccagaccccccauggccagcguggugagacugccccccggcagcgugaucgcccccaugccccccaucauccacgcccccagaaucaacguggugcccaugccccccagcgccccccccaucauggcccccagacccccccccaugaucgugcccaccgccuucgugcccgccccccccguggcccccgugcccgcccccgcccccaugccccccgugcacccccccccccccauggaggacgagcccaccagcaagaagcugaagaccgaggacagccugaugcccgaggaggaguuccugagaagaaacaagggccccgugagcaucaaggugcaggugcccaacaugcaggacaagaccgaguggaagcugaacggccaggugcugguguucacccugccccugaccgaccaggugagcgugaucaaggugaagauccacgaggccaccggcaugcccgccggcaagcagaagcugcaguacgagggcaucuucaucaaggacagcaacagccuggccuacuacaacauggccaacggcgccgugauccaccuggcccugaaggagagaggcggcagaaagaaguaa

SEQ ID NO: 23221 - RNA, 435 nt, Artificial Sequence
  SF3B1__Homo_sapiens__NP_001005526
auggccaagaucgccaagacccacgaggacaucgaggcccagaucagagagauccagggcaagaaggccgcccuggacgaggcccagggcgugggccuggacagcaccggcuacuacgaccaggagaucuacggcggcagcgacagcagauucgccggcuacgugaccagcaucgccgccaccgagcuggaggacgacgacgacgacuacagcagcagcaccagccugcugggccagaagaagcccggcuaccacgcccccguggcccugcugaacgacaucccccagagcaccgagcaguacgaccccuucgccgagcacagaccccccaagaucgccgacagagaggacgaguacaagaagcacagaagaaccaugaucaucagccccgagagacuggaccccuucgccgacggcuucuacagcgccgccuaa

SEQ ID NO: 23222 - RNA, 2688 nt, Artificial Sequence
  SF3B2__Homo_sapiens__NP_006833
auggccaccgagcaccccgagccccccaaggccgagcugcagcugccccccccccccccccccggccacuacggcgccugggccgcccaggagcugcaggccaagcuggccgagaucggcgcccccauccagggcaacagagaggagcugguggagagacugcagagcuacaccagacagaccggcaucgugcugaacagacccgugcugagaggcgaggacggcgacaaggccgcccccccccccaugagcgcccagcugcccggcauccccaugcccccccccccccugggccugcccccccugcagccccccccccccccccccccccccccccccggccugggccugggcuuccccauggcccacccccccaaccugggccccccccccccccugagagugggcgagcccguggcccugagcgaggaggagagacugaagcuggcccagcagcaggccgcccugcugaugcagcaggaggagagagccaagcagcagggcgaccacagccugaaggagcacgagcugcuggagcagcagaagagagccgccgugcugcuggagcaggagagacagcaggagaucgccaagaugggcacccccgugcccagacccccccaggacaugggccagaucggcgugagaaccccccugggccccagaguggccgcccccgugggccccgugggccccacccccaccgugcugcccaugggcgcccccgugcccagacccagaggccccccccccccccccggcgacgagaacagagagauggacgaccccagcgugggccccaagaucccccaggcccuggagaagauccugcagcugaaggagagcagacaggaggagaugaacagccagcaggaggaggaggagauggagaccgacgccagaagcagccugggccagagcgccagcgagaccgaggaggacaccgugagcgugagcaagaaggagaagaacagaaagagaagaaacagaaagaagaagaagaagccccagagagugagaggcgugagcagcgagagcagcggcgacagagagaaggacagcaccagaagcagaggcagcgacagccccgccgccgacguggagaucgaguacgugaccgaggagcccgagaucuacgagcccaacuucaucuucuucaagagaaucuucgaggccuucaagcugaccgacgacgugaagaaggagaaggagaaggagcccgagaagcuggacaagcuggagaacagcgccgcccccaagaagaagggcuucgaggaggagcacaaggacagcgacgacgacagcagcgacgacgagcaggagaagaagcccgaggcccccaagcugagcaagaagaagcugagaagaaugaacagauucaccguggccgagcugaagcagcugguggccagacccgacgugguggagaugcacgacgugaccgcccaggaccccaagcugcuggugcaccugaaggccaccagaaacagcgugcccgugcccagacacuggugcuucaagagaaaguaccugcagggcaagagaggcaucgagaagccccccuucgagcugcccgacuucaucaagagaaccggcauccaggagaugagagaggcccugcaggagaaggaggagcagaagaccaugaagagcaagaugagagagaaggugagacccaagaugggcaagaucgacaucgacuaccagaagcugcacgacgccuucuucaaguggcagaccaagcccaagcugaccauccacggcgaccuguacuacgagggcaaggaguucgagaccagacugaaggagaagaagcccggcgaccugagcgacgagcugagaaucagccugggcaugcccgugggccccaacgcccacaaggugcccccccccuggcugaucgccaugcagagauacggccccccccccagcuaccccaaccugaagauccccggccugaacagccccauccccgagagcugcagcuucggcuaccacgccggcggcuggggcaagccccccguggacgagaccggcaagccccuguacggcgacguguucggcaccaacgccgccgaguuccagaccaagaccgaggaggaggagaucgacagaacccccuggggcgagcuggagcccagcgacgaggagagcagcgaggaggaggaggaggaggagagcgacgaggacaagcccgacgagaccggcuucaucacccccgccgacagcggccugaucacccccggcggcuucagcagcgugcccgccggcauggagacccccgagcugaucgagcugagaaagaagaagaucgaggaggccauggacggcagcgagaccccccagcuguucaccgugcugcccgagaagagaaccgccaccgugggcggcgccaugaugggcagcacccacaucuacgacaugagcaccgugaugagcagaaagggccccgcccccgagcugcagggcguggagguggcccuggcccccgaggagcuggagcuggaccccauggccaugacccagaaguacgaggagcacgugagagagcagcaggcccagguggagaaggaggacuucagcgacaugguggccgagcacgccgccaagcagaagcagaagaagagaaaggcccagccccaggacagcagaggcggcagcaagaaguacaaggaguucaaguucuaa

SEQ ID NO: 23223 - RNA, 378 nt, Artificial Sequence
  SF3B6__Homo_sapiens__NP_057131
auggccaugcaggccgccaagagagccaacaucagacugccccccgaggugaacagaauccuguacaucagaaaccugcccuacaagaucaccgccgaggagauguacgacaucuucggcaaguacggccccaucagacagaucagagugggcaacacccccgagaccagaggcaccgccuacgugguguacgaggacaucuucgacgccaagaacgccugcgaccaccugagcggcuucaacgugugcaacagauaccugguggugcuguacuacaacgccaacagagccuuccagaagauggacaccaagaagaaggaggagcagcugaagcugcugaaggagaaguacggcaucaacaccgacccccccaaguaa

SEQ ID NO: 23224 - RNA, 3729 nt, Artificial Sequence
  SFI1__Homo_sapiens__NP_001007468
augaagaaccugcugaccgagaagugcaucagcagccacaacuuccaccagaaggugaucaagcagagaauggagaagaagguggacagcagauacuucaaggacggcgccgugaagaagcccuacagcgccaagacccugagcaacaagaagagcagcgccagcuucggcaucagaagagagcugcccagcaccagccaccuggugcaguacagaggcacccacaccugcaccagacagggcagacugagagagcugagaaucagaugcguggccagaaaguuccuguaccuguggaucagaaugaccuucggcagaguguuccccagcaaggccagauucuacuacgagcagagacugcugagaaagguguucgaggaguggaaggaggagugguggguguuccagcacgaguggaagcugugcgugagagccgacugccacuacagauacuaccuguacaaccugauguuccagaccuggaagaccuacgugagacagcagcaggagaugagaaacaaguacaucagagccgaggugcacgacgccaagcagaagaugagacaggccuggaagagcuggcugaucuacgugguggugagaagaaccaagcugcagaugcagaccaccgcccuggaguucagacagagaaucauccugagagugugguggagcaccuggagacagagacugggccaggugagagugagcagagcccugcacgccagcgcccugaagcacagagcccugagccugcaggugcaggccuggagccaguggagagagcagcugcuguacgugcagaaggagaagcagaagguggugagcgccgugaagcaccaccagcacuggcagaagagaagauuccugaaggccuggcuggaguaccugcaggugagaagagugaagagacagcagaacgagauggccgagagauuccaccacgugaccgugcugcagaucuacuucugcgacuggcagcaggccugggagagaagagagagccuguacgcccaccacgcccagguggagaagcuggccagaaagauggcccugagaagagccuucacccacuggaagcacuacaugcugcugugcgccgaggaggccgcccaguucgagauggccgaggagcaccacagacacagccagcuguacuucugcuucagagcccugaaggacaacgugacccacgcccaccugcagcagaucagaagaaaccuggcccaccagcagcacggcgugacccugcugcacagauucuggaaccuguggagaagccagaucgagcagaagaaggagagagagcugcugccccugcugcacgccgccugggaccacuacagaaucgcccugcugugcaagugcaucgagcuguggcugcaguacacccagaagagaagauacaagcagcugcugcaggccagagccgacggccacuuccagcagagagcccugcccgccgccuuccacaccuggaacagacuguggagauggagacaccaggagaacgugcugagcgccagagccaccagauuccacagagagacccuggagaagcagguguucagccuguggagacagaagauguuccagcacagagagaacagacuggccgagagaauggccauccugcacgccgagagacagcugcuguacagaagcugguucauguggcaccagcaggccgccgccagacaccaggagcaggaguggcagaccguggccugcgcccaccacagacacggcagacugaagaaggccuucugccuguggagagagagcgcccagggccugagaaccgagagaaccggcagagugagagccgccgaguuccacauggcccagcugcugagaugggccuggagccaguggagagagugccuggcccugagaggcgccgagagacagaagcugaugagagccgaccugcaccaccagcacagcgugcugcacagagcccugcaggccugggugaccuaccagggcagagugagaagcauccugagagagguggccgccagagagagccagcacaacagacagcugcugagaggcgcccugagaagauggaaggagaacaccauggccagaguggacgaggccaagaagaccuuccaggccagcacccacuacagaagaaccaucugcagcaaggugcuggugcaguggagagaggccgugagcgugcagauguacuacagacagcaggaggacugcgccaucugggaggcccagaaggugcuggacagaggcugccugagaaccugguuccagagauggugggacugcagcagaagaagcgcccagcagagacugcagcuggagagagccgugcagcaccaccacagacagcugcugcuggagggccuggccagauggaagacccaccaccugcagugcgugagaaagagacugcugcacagacagagcacccagcugcuggcccagagacugagcagaaccugcuucagacaguggagacagcagcuggccgccagaagacaggagcagagagccaccgugagagcccugugguucugggccuucagccugcaggccaaggugugggccaccuggcuggccuucgugcuggagagaagaagaaagaaggccagacugcagugggcccugcaggccuaccagggccagcugcugcaggagggcgccaccagacugcugagauucgccgccagcaugaaggccagcagacagcagcugcaggcccagcagcaggugcaggccgcccacagccugcacagagccgugagaagaugcgccacccuguggaagcagaaggugcugggcagaggcggcaagccccagccccuggccgccaucgcccccagcagaaaggugaccuucgagggcccccugcugaacagaaucgccgccggcgccggcgacggcacccuggagaccaagagaccccaggccagcagaccccugggcgcccugggcagacuggccgccgaggagccccacgcccuggagcugaacaccgcccacagcgccagaaagcagcccagaagaccccacuuccugcuggagcccgcccagagccagagaccccagaagccccaggagcacggccugggcauggcccagcccgccgcccccagccugaccagacccuuccuggccgaggcccccaccgcccuggugccccacagcccccugcccggcgcccugagcagcgcccccggccccaagcagccccccaccgccagcaccggccccgagcugcugcugcugccccugagcagcuucaugcccugcggcgccgccgcccccgccagagugagcgcccagagagccacccccagagacaagccccccgugcccagcagccuggccagcgugcccgacccccaccugcugcugcccggcgacuucagcgccaccagagccggccccggccugagcaccgccggcagccuggaccuggaggccgagcuggaggagauccagcagcagcugcugcacuaccagaccaccaagcagaaccuguggagcugcagaagacaggccagcagccugagaagauggcuggagcugaacagagaggagcccggccccgaggaccaggagguggagcagcaggugcagaaggagcuggagcagguggagaugcagauccagcugcuggccgaggagcugcaggcccagagacagcccaucggcgccugcguggccagaauccaggcccugagacaggcccugugcuaa

SEQ ID NO: 23225 - RNA, 2601 nt, Artificial Sequence
  SFMBT1__Homo_sapiens__NP_057413
augaacggcgagcagcagcuggacgccgacgccggcagcggcauggaggagguggagcugagcugggaggacuaccuggaggagaccggcagcaccgccgugcccuacggcagcuucaagcacguggacaccagacugcagaacggcuucgcccccggcaugaagcuggagguggccgugagaaccgaccccgagaccuacuggguggccaccgugaucaccaccugcgagcagcugcugcugcugagauacgacggcuacggcgaggacagaagagccgacuucuggugcgacaucagaaaggccgaccuguaccccaucggcuggugcgagcagaacaagaagacccuggaggcccccgagggcaucagagacaaggugagcgacugggacgaguuccugagacagacccugaucggcgccugcagcccccccgugccccugcuggagggccugagaaacggcagaaacccccuggaccugaucgcccccggcagcagacuggagugccaggccuuccaggacagccugagcaccuggaucgugaccgugguggagaacaucggcggcagacugaagcugagauacgagggccuggagagcagcgacaacuacgagcacuggcuguacuaccuggaccccuuccugcaccacgugggcugggccgcccagcagggcuacgagcugcagccccccagcgccaucagacaccugaagaacgaggccgaguggcaggagauccuggccaaggugaaggaggaggaggaggagccccugcccagcuaccuguucaaggacaagcaggugaucggcauccacaccuucagcgugaacaugaagcuggaggccguggaccccuggagccccuucggcaucagccccgccaccguggugaagguguucgacgagaaguacuuccugguggagauggacgaccugagacccgagaaccacgccagaagaagcuucgugugccacgccgacagccccggcaucuuccccgugcaguggagccugaagaacggccugcacaucagccccccccccggcuaccccagccaggacuucgacugggccgacuaccugaagcagugcggcgccgaggccgccccccagagaugcuuccccccccugaucagcgagcacgaguucaaggagaacaugaagcuggaggccgugaaccccauccugcccgaggaggugugcguggccaccaucaccgccgugagaggcagcuaccuguggcugcagcuggagggcagcaagaagcccauccccgagugcaucgugagcguggagagcauggacaucuucccccugggcuggugcgagaccaacggccacccccugagcacccccagaagagccagaguguacaagcagagaaagaucgccguggugcagcccgagaagcaggugcccagcagcagaaccgugcacgagggccugagaaaccaggagcugaacagcaccgagagcgugaugaucaacggcaaguacugcugccccaagaucuacuucaaccacagaugcuucagcggccccuaccugaacaagggcagaaucgccgagcugccccagugcgugggccccggcaacugcgugcuggugcugagagaggugcugacccugcugaucaacgccgccuacaagcccagcagagugcugagagagcugcagcuggacaaggacagcguguggcacggcugcggcgaggugcugaaggccaaguacaagggcaagagcuacagagccaccguggagaucgugaagaccgccgacagagugaccgaguucugcagacagaccugcaucaagcuggagugcugccccaaccuguucggccccagaauggugcuggacaagugcagcgagaacugcagcgugcugaccaagaccaaguacacccacuacuacggcaagaagaagaacaagagaaucggcagaccccccggcggccacagcaaccuggccugcgcccugaagaaggccagcaagagaagaaagagaagaaagaacguguucgugcacaagaagaagagaagcagcgccagcguggacaacacccccgccggcagcccccagggcagcggcggcgaggacgaggacgaccccgacgagggcgacgacgacagccugagcgagggcagcaccagcgagcagcaggacgagcugcaggaggagagcgagaugagcgagaagaagagcugcagcagcagccccacccagagcgagaucagcaccagccugccccccgacagacagagaagaaagagagagcugagaaccuucagcuucagcgacgacgagaacaagccccccagccccaaggagaucagaaucgagguggccgagagacugcaccuggacagcaacccccugaaguggagcguggccgacguggugagauucaucagaagcaccgacugcgccccccuggccagaaucuuccuggaccaggagaucgacggccaggcccugcugcugcugacccugcccaccgugcaggagugcauggaccugaagcugggccccgccaucaagcugugccaccacaucgagagaaucaaguucgccuucuacgagcaguucgccaacuaa

SEQ ID NO: 23226 - RNA, 2685 nt, Artificial Sequence
  SFMBT2__Homo_sapiens__NP_001018049
auggagagcacccugagcgccagcaacaugcaggaccccagcagcagcccccuggagaagugccugggcagcgccaacggcaacggcgaccuggacagcgaggagggcagcagccuggaggagaccggcuucaacuggggcgaguaccuggaggagaccggcgccagcgccgccccccacaccagcuucaagcacguggagaucagcauccagagcaacuuccagcccggcaugaagcuggagguggccaacaagaacaaccccgacaccuacuggguggccaccaucaucaccaccugcggccagcugcugcugcugagauacugcggcuacggcgaggacagaagagccgacuucuggugcgacguggugaucgccgaccugcaccccgugggcuggugcacccagaacaacaaggugcugaugccccccgacgccaucaaggagaaguacaccgacuggaccgaguuccugaucagagaccugaccggcagcagaaccgcccccgccaaccugcuggagggcccccugagaggcaagggccccaucgaccugaucaccgugggcagccugaucgagcugcaggacagccagaaccccuuccaguacuggaucgugagcgugaucgagaacgugggcggcagacugagacugagauacgugggccuggaggacaccgagagcuacgaccaguggcuguucuaccuggacuacagacugagacccgugggcuggugccaggagaacaaguacagaauggacccccccagcgagaucuacccccugaagauggccagcgaguggaagugcacccuggagaagagccugaucgacgccgccaaguucccccugcccauggagguguucaaggaccacgccgaccugagaagccacuucuucaccgugggcaugaagcuggagaccgugaacaugugcgagcccuucuacaucagccccgccagcgugaccaagguguucaacaaccacuucuuccaggugaccaucgacgaccugagacccgagcccagcaagcugagcaugcugugccacgccgacagccugggcauccugcccgugcaguggugccugaagaacggcgugagccugaccccccccaagggcuacagcggccaggacuucgacugggccgacuaccacaagcagcacggcgcccaggaggccccccccuucugcuucagaaacaccagcuucagcagaggcuucaccaagaacaugaagcuggaggccgugaaccccagaaaccccggcgagcugugcguggccagcguggugagcgugaagggcagacugauguggcugcaccuggagggccugcagacccccgugcccgaggugaucguggacguggagagcauggacaucuuccccgugggcuggugcgaggccaacagcuacccccugaccgccccccacaagaccgugagccagaagaagagaaagaucgccguggugcagcccgagaagcagcugccccccaccgugcccgugaagaagaucccccacgaccugugccuguucccccaccuggacaccaccggcaccgugaacggcaaguacugcugcccccagcuguucaucaaccacagaugcuucagcggccccuaccugaacaagggcagaaucgccgagcugccccagagcgugggccccggcaagugcgugcuggugcugaaggaggugcugagcaugaucaucaacgccgccuacaagcccggcagagugcugagagagcugcagcugguggaggacccccacuggaacuuccaggaggagacccugaaggccaaguacagaggcaagaccuacagagccguggugaagaucgugagaaccagcgaccagguggccaacuucugcagaagagugugcgccaagcuggagugcugccccaaccuguucagccccgugcugaucagcgagaacugccccgagaacugcagcauccacaccaagaccaaguacaccuacuacuacggcaagagaaagaagaucagcaagccccccaucggcgagagcaaccccgacagcggccaccccaagcccgccagaagaagaaagagaagaaagagcaucuucgugcagaagaagagaagaagcagcgccguggacuucaccgccggcagcggcgaggagagcgaggaggaggacgccgacgccauggacgacgacaccgccagcgaggagaccggcagcgagcugagagacgaccagaccgacaccagcagcgccgaggugcccagcgccagacccagaagagccgugacccugagaagcggcagcgagcccgugagaagacccccccccgagagaaccagaagaggcagaggcgcccccgccgccagcagcgccgaggagggcgagaagugcccccccaccaagcccgagggcaccgaggacaccaagcaggaggaggaggagagacuggugcuggagagcaacccccuggaguggaccgugaccgacguggugagauucaucaagcugaccgacugcgccccccuggccaagaucuuccaggagcaggacaucgacggccaggcccugcugcugcugacccugcccaccgugcaggagugcauggagcugaagcugggccccgccaucaagcugugccaccagaucgagagagugaagguggccuucuacgcccaguacgccaacuaa

SEQ ID NO: 23227 - RNA, 738 nt, Artificial Sequence
  SFR1__Homo_sapiens__NP_001002759
auggccgagggcgagaagaaccaggacuucaccuucaagauggagagccccagcgacagcgccguggugcugcccagcaccccccaggccagcgccaaccccagcagccccuacaccaacagcagcagaaagcagcccaugagcgccacccugagagagagacugagaaagaccagauucagcuucaacagcagcuacaacguggugaagagacugaagguggagagcgaggagaacgaccagaccuucagcgagaagcccgccagcagcaccgaggagaacugccuggaguuccaggagagcuucaagcacaucgacagcgaguucgaggagaacaccaaccugaagaacacccugaagaaccugaacgugugcgagagccagagccuggacagcggcagcugcagcgcccugcagaacgaguucgugagcgagaagcugcccaagcagagacugaacgccgagaaggccaagcuggugaagcaggugcaggagaaggaggaccugcugagaagacugaagcuggugaagauguacagaagcaagaacgaccugagccagcugcagcugcugaucaagaaguggagaagcugcagccagcugcugcuguacgagcugcagagcgccgugagcgaggagaacaagaagcugagccugacccagcugaucgaccacuacggccuggacgacaagcugcugcacuacaacagaagcgaggaggaguucaucgacguguaa

SEQ ID NO: 23228 - RNA, 945 nt, Artificial Sequence
  SFRP1__Homo_sapiens__NP_003003
augggcaucggcagaagcgagggcggcagaagaggcgccgcccugggcgugcugcuggcccugggcgccgcccugcuggccgugggcagcgccagcgaguacgacuacgugagcuuccagagcgacaucggccccuaccagagcggcagauucuacaccaagcccccccagugcguggacauccccgccgaccugagacugugccacaacgugggcuacaagaagauggugcugcccaaccugcuggagcacgagaccauggccgaggugaagcagcaggccagcagcugggugccccugcugaacaagaacugccacgccggcacccagguguuccugugcagccuguucgcccccgugugccuggacagacccaucuaccccugcagauggcugugcgaggccgugagagacagcugcgagcccgugaugcaguucuucggcuucuacuggcccgagaugcugaagugcgacaaguuccccgagggcgacgugugcaucgccaugaccccccccaacgccaccgaggccagcaagccccagggcaccaccgugugcccccccugcgacaacgagcugaagagcgaggccaucaucgagcaccugugcgccagcgaguucgcccugagaaugaagaucaaggaggugaagaaggagaacggcgacaagaagaucgugcccaagaagaagaagccccugaagcugggccccaucaagaagaaggaccugaagaagcuggugcuguaccugaagaacggcgccgacugccccugccaccagcuggacaaccugagccaccacuuccugaucaugggcagaaaggugaagagccaguaccugcugaccgccauccacaagugggacaagaagaacaaggaguucaagaacuucaugaagaagaugaagaaccacgagugccccaccuuccagagcguguucaaguaa

SEQ ID NO: 23229 - RNA, 888 nt, Artificial Sequence
  SFRP2__Homo_sapiens__NP_003004
augcugcagggccccggcagccugcugcugcuguuccuggccagccacugcugccugggcagcgccagaggccuguuccuguucggccagcccgacuucagcuacaagagaagcaacugcaagcccauccccgccaaccugcagcugugccacggcaucgaguaccagaacaugagacugcccaaccugcugggccacgagaccaugaaggaggugcuggagcaggccggcgccuggaucccccuggugaugaagcagugccaccccgacaccaagaaguuccugugcagccuguucgcccccgugugccuggacgaccuggacgagaccauccagcccugccacagccugugcgugcaggugaaggacagaugcgcccccgugaugagcgccuucggcuuccccuggcccgacaugcuggagugcgacagauucccccaggacaacgaccugugcaucccccuggccagcagcgaccaccugcugcccgccaccgaggaggcccccaaggugugcgaggccugcaagaacaagaacgacgacgacaacgacaucauggagacccugugcaagaacgacuucgcccugaagaucaaggugaaggagaucaccuacaucaacagagacaccaagaucauccuggagaccaagagcaagaccaucuacaagcugaacggcgugagcgagagagaccugaagaagagcgugcuguggcugaaggacagccugcagugcaccugcgaggagaugaacgacaucaacgcccccuaccuggugaugggccagaagcagggcggcgagcuggugaucaccagcgugaagagauggcagaagggccagagagaguucaagagaaucagcagaagcaucagaaagcugcagugcuaa

SEQ ID NO: 23230 - RNA, 1041 nt, Artificial Sequence
  SFRP4__Homo_sapiens__NP_003005
auguuccugagcauccugguggcccugugccuguggcugcaccuggcccugggcgugagaggcgcccccugcgaggccgugagaauccccaugugcagacacaugcccuggaacaucaccagaaugcccaaccaccugcaccacagcacccaggagaacgccauccuggccaucgagcaguacgaggagcugguggacgugaacugcagcgccgugcugagauucuuccugugcgccauguacgcccccaucugcacccuggaguuccugcacgaccccaucaagcccugcaagagcgugugccagagagccagagacgacugcgagccccugaugaagauguacaaccacagcuggcccgagagccuggccugcgacgagcugcccguguacgacagaggcgugugcaucagccccgaggccaucgugaccgaccugcccgaggacgugaaguggaucgacaucacccccgacaugauggugcaggagagaccccuggacguggacugcaagagacugagccccgacagaugcaagugcaagaaggugaagcccacccuggccaccuaccugagcaagaacuacagcuacgugauccacgccaagaucaaggccgugcagagaagcggcugcaacgaggugaccaccgugguggacgugaaggagaucuucaagagcagcagccccauccccagaacccaggugccccugaucaccaacagcagcugccagugcccccacauccugccccaccaggacgugcugaucaugugcuacgaguggagaagcagaaugaugcugcuggagaacugccugguggagaaguggagagaccagcugagcaagagaagcauccagugggaggagagacugcaggagcagagaagaaccgugcaggacaagaagaagaccgccggcagaaccagcagaagcaacccccccaagcccaagggcaagccccccgcccccaagcccgccagccccaagaagaacaucaagaccagaagcgcccagaagagaaccaaccccaagagaguguaa

SEQ ID NO: 23231 - RNA, 954 nt, Artificial Sequence
  SFRP5__Homo_sapiens__NP_003006
augagagccgccgccgccggcggcggcgugagaaccgccgcccuggcccugcugcugggcgcccugcacugggcccccgccagaugcgaggaguacgacuacuacggcuggcaggccgagccccugcacggcagaagcuacagcaagcccccccagugccuggacauccccgccgaccugccccugugccacaccgugggcuacaagagaaugagacugcccaaccugcuggagcacgagagccuggccgaggugaagcagcaggccagcagcuggcugccccugcuggccaagagaugccacagcgacacccagguguuccugugcagccuguucgcccccgugugccuggacagacccaucuaccccugcagaagccugugcgaggccgugagagccggcugcgccccccugauggaggccuacggcuuccccuggcccgagaugcugcacugccacaaguucccccuggacaacgaccugugcaucgccgugcaguucggccaccugcccgccaccgccccccccgugaccaagaucugcgcccagugcgagauggagcacagcgccgacggccugauggagcagaugugcagcagcgacuucguggugaagaugagaaucaaggagaucaagaucgagaacggcgacagaaagcugaucggcgcccagaagaagaagaagcugcugaagcccggcccccugaagagaaaggacaccaagagacuggugcugcacaugaagaacggcgccggcugccccugcccccagcuggacagccuggccggcagcuuccuggugaugggcagaaagguggacggccagcugcugcugauggccguguacagaugggacaagaagaacaaggagaugaaguucgccgugaaguucauguucagcuaccccugcagccuguacuaccccuucuucuacggcgccgccgagccccacuaa

SEQ ID NO: 23232 - RNA, 3012 nt, Artificial Sequence
  SFSWAP__Homo_sapiens__NP_001248340
auguacggcgccagcggcggcagagccaagcccgagagaaagagcggcgccaaggaggaggccggccccggcggcgccggcggcggcggcagcagaguggagcugcugguguucggcuacgccugcaagcuguucagagacgacgagagagcccuggcccaggagcagggccagcaccugauccccuggaugggcgaccacaagauccugaucgacagauacgacggcagaggccaccugcacgaccugagcgaguacgacgccgaguacagcaccuggaacagagacuaccagcugagcgaggaggaggccagaaucgaggcccugugcgacgaggagagauaccuggcccugcacaccgaccugcuggaggaggaggccagacaggaggaggaguacaagagacugagcgaggcccuggccgaggacggcagcuacaacgccgugggcuucaccuacggcagcgacuacuacgaccccagcgagcccaccgaggaggaggagcccagcaagcagagagagaagaacgaggccgagaaccuggaggagaacgaggagcccuucguggccccccugggccugagcgugcccagcgacguggagcugccccccaccgccaagaugcacgccaucaucgagagaaccgccagcuucgugugcagacagggcgcccaguucgagaucaugcugaaggccaagcaggccagaaacagccaguucgacuuccugagauucgaccacuaccugaaccccuacuacaaguucauccagaaggccaugaaggagggcagauacaccgugcuggccgagaacaagagcgacgagaagaagaagagcggcgugagcagcgacaacgaggacgacgacgacgaggaggacggcaacuaccugcaccccagccuguucgccagcaagaagugcaacagacuggaggagcugaugaagccccugaaggugguggaccccgaccacccccuggccgcccuggugagaaaggcccaggccgacagcagcacccccaccccccacaacgccgacggcgcccccgugcagcccagccagguggaguacaccgccgacagcaccguggccgccauguacuacagcuacuacaugcugcccgacggcaccuacugccuggccccccccccccccggcaucgacgugaccaccuacuacagcacccugcccgccggcgugaccgugagcaacagccccggcgugaccaccaccgccccccccccccccggcaccaccccccugcccccccccaccaccgccgagaccagcagcggcgccaccagcaccaccaccaccaccagcgcccuggcccccguggccgccaucaucccccccccccccgacgugcagcccgugaucgacaagcuggccgaguacguggccagaaacggccugaaguucgagaccagcgugagagccaagaacgaccagagauucgaguuccugcagcccuggcaccaguacaacgccuacuacgaguucaagaagcaguucuuccugcagaaggagggcggcgacagcaugcaggccgugagcgcccccgaggaggcccccaccgacagcgcccccgagaagcccagcgacgccggcgaggacggcgcccccgaggacgccgccgaggugggcgccagagccggcagcggcggcaagaaggaggccagcagcagcaagaccgugcccgacggcaagcuggugaaggccagcuucgcccccaucagcuucgccaucaaggccaaggagaacgaccugcugccccuggagaagaacagagugaagcuggacgacgacagcgacgacgacgaggagagcaaggagggccaggagagcagcagcagcgccgccaacaccaaccccgccguggccccccccugcguggugguggaggagaagaagccccagcugacccaggaggagcuggaggccaagcaggccaagcagaagcuggaggacagacuggccgccgccgccagagagaagcuggcccaggccagcaaggagagcaaggagaagcagcugcaggccgagagaaagagaaaggccgcccuguuccugcagacccugaagaacccccugcccgaggccgaggccggcaagaucgaggagagccccuucagcguggaggagagcagcaccacccccugcccccugcugaccggcggcagaccccugcccacccuggaggugaagccccccgacagacccagcagcaagagcaaggacccccccagagaggaggagaaggagaagaagaagaagaagcacaagaagagaagcagaaccagaagcagaagccccaaguaccacagcagcagcaagagcagaagcagaagccacagcaaggccaagcacagccugcccagcgccuacagaaccgugagaagaagcagagugaccgccagccccggcacccugagagccgagcccugccagagcagcgccagcgugaccgccgccgccgagcccggcagcuaccaggccgccagcaccaccaccagauucgacagcgccagcagcuucgagggcaagcccggcaagaccagcagaagcagaagcagaagccccagaagaagagcccacagccccgagagaagaagagaggagagaagcgugcccaccgccuacagagugagcagaagccccggcgccagcagaaagagaaccagaagcagaagcccccacgagaagaagaagaagagaagaagcagaagcagaaccaagagcaaggccagaagccagagcgugagccccagcaagcaggccgcccccagacccgccgcccccgccgcccacagcgcccacagcgccagcgugagccccguggagagcagaggcagcagccaggagagaagcagaggcgugagccaggagaaggaggcccagaucagcagcgccaucgugagcagcgugcagagcaagaucacccaggaccugauggccaaggugagagccaugcuggccgccagcaagaaccugcagaccagcgccagcuaa

SEQ ID NO: 23233 - RNA, 483 nt, Artificial Sequence
  SFT2D2__Homo_sapiens__NP_955376
auggacaagcugaagaaggugcugagcggccaggacaccgaggacagaagcggccugagcgaggugguggaggccagcagccugagcuggagcaccagaaucaagggcuucaucgccugcuucgccaucggcauccugugcagccugcugggcaccgugcugcugugggugcccagaaagggccugcaccuguucgccguguucuacaccuucggcaacaucgccagcaucggcagcaccaucuuccugaugggccccgugaagcagcugaagagaauguucgagcccaccagacugaucgccaccaucauggugcugcugugcuucgcccugacccugugcagcgccuucugguggcacaacaagggccuggcccugaucuucugcauccugcagagccuggcccugaccugguacagccugagcuucauccccuucgccagagacgccgugaagaagugcuucgccgugugccuggccuaa

SEQ ID NO: 23234 - RNA, 648 nt, Artificial Sequence
  SFT2D3__Homo_sapiens__NP_116129
auggccgaccugcacagacagcugcaggaguaccuggcccagggcaaggccggcggccccgccgccgccgagccccugcuggccgccgagaaggccgaggagcccggcgacagacccgccgaggaguggcugggcagagccggccugagauggaccugggccagaagccccgccgagagcgccgccgccggccugaccugccugcccagcgugaccagaggccagagacuggccgccggcggcggcugccugcugcuggccgcccugugcuucggccuggccgcccuguacgcccccgugcugcugcugagagccagaaaguucgcccugcuguggagccugggcagcgcccuggcccuggccggcagcgcccugcugagaggcggcgccgccugcggcagacugcugagaugcgaggaggcccccagcagacccgcccugcuguacauggccgcccugggcgccacccuguucgccgcccugggccugagaagcacccugcugaccgugcugggcgccggcgcccagguggccgcccugcuggccgcccuggugggccugcugcccuggggcggcggcaccgcccugagacuggcccugggcagacugggcagaggcgccggccuggccaaggugcugcccguguaa

SEQ ID NO: 23235 - RNA, 237 nt, Artificial Sequence
  SFTA2__Homo_sapiens__NP_995326
augggcagcggccugccccuggugcugcugcugacccugcugggcagcagccacggcaccggccccggcaugacccugcagcugaagcugaaggagagcuuccugaccaacagcagcuacgagagcagcuuccuggagcugcuggagaagcugugccugcugcugcaccugcccagcggcaccagcgugacccugcaccacgccagaagccagcaccacguggugugcaacaccuaa

SEQ ID NO: 23236 - RNA, 285 nt, Artificial Sequence
  SFTA3__Homo_sapiens__NP_001094811
augagagccggcuucagcgacuuccagcugaucagagaccaggugcuguuccugcaggaccaggcccagagacugaccgaguggcugcagcugagcggcuucgagaaccccgugagcgagagcaccacccugugccugagagagagagagaagagaauccccaccugcguggccgugugcgugcccagccccggcaccgugcacaccgcccugcugcaccccaccacccugagccagagcagaagcagcagcgaggccaagaugcugaucauccacaccgccuaa

SEQ ID NO: 23237 - RNA, 645 nt, Artificial Sequence
  SFTPA1__Homo_sapiens__NP_001158117
augagacccugccaggugcccggcgccgccaccggccccagagccauguggcugugcccccuggcccugaaccugauccugauggccgccagcggcgccgugugcgaggugaaggacgugugcgugggcacccccggcauccccggcgagugcggcgagaagggcgagcccggcgagagaggcccccccggccugcccgcccaccuggacgaggagcugcaggccacccugcacgacuucagacaccagauccugcagaccagaggcgcccugagccugcagggcagcaucaugaccgugggcgagaagguguucagcagcaacggccagagcaucaccuucgacgccauccaggaggccugcgccagagccggcggcagaaucgccgugcccagaaaccccgaggagaacgaggccaucgccagcuucgugaagaaguacaacaccuacgccuacgugggccugaccgagggccccagccccggcgacuucagauacagcgacggcacccccgugaacuacaccaacugguacagaggcgagcccgccggcagaggcaaggagcagugcguggagauguacaccgacggccaguggaacgacagaaacugccuguacagcagacugaccaucugcgaguucuaa

SEQ ID NO: 23238 - RNA, 798 nt, Artificial Sequence
  SFTPA2__Homo_sapiens__XP_005270185
augagagacagauggagcgagagcgugagagccgccaccggccccagagccauguggcugugcccccuggcccugacccugauccugauggccgccagcggcgccgccugcgaggugaaggacgugugcgugggcagccccggcauccccggcacccccggcagccacggccugcccggcagagacggcagagacggcgugaagggcgaccccggcccccccggccccaugggcccccccggcgagacccccugcccccccggcaacaacggccugcccggcgcccccggcgugcccggcgagagaggcgagaagggcgaggccggcgagagaggcccccccggccugcccgcccaccuggacgaggagcugcaggccacccugcacgacuucagacaccagauccugcagaccagaggcgcccugagccugcagggcagcaucaugaccgugggcgagaagguguucagcagcaacggccagagcaucaccuucgacgccauccaggaggccugcgccagagccggcggcagaaucgccgugcccagaaaccccgaggagaacgaggccaucgccagcuucgugaagaaguacaacaccuacgccuacgugggccugaccgagggccccagccccggcgacuucagauacagcgacggcacccccgugaacuacaccaacugguacagaggcgagcccgccggcagaggcaaggagcagugcguggagauguacaccgacggccaguggaacgacagaaacugccuguacagcagacugaccaucugcgaguucuaa

SEQ ID NO: 23239 - RNA, 1182 nt, Artificial Sequence
  SFTPB__Homo_sapiens__XP_005264544
augcaccaggccggcuaccccggcugcagaggcgccauggccgagagccaccugcugcaguggcugcugcugcugcugcccacccugugcggccccggcaccgccgccuggaccaccagcagccuggccugcgcccagggccccgaguucuggugccagagccuggagcaggcccugcagugcagagcccugggccacugccugcaggagguguggggccacgugggcgccgacgaccugugccaggagugcgaggacaucgugcacauccugaacaagauggccaaggaggccaucuuccaggacaccaugagaaaguuccuggagcaggagugcaacgugcugccccugaagcugcugaugccccagugcaaccaggugcuggacgacuacuucccccuggugaucgacuacuuccagaaccagaccgacagcaacggcaucugcaugcaccugggccugugcaagagcagacagcccgagcccgagcaggagcccggcaugagcgacccccugcccaagccccugagagacccccugcccgacccccugcuggacaagcuggugcugcccgugcugcccggcgcccugcaggccagacccggcccccacacccaggaccugagcgagcagcaguuccccaucccccugcccuacugcuggcugugcagagcccugaucaagagaauccaggccaugauccccaagggcgcccuggccguggccguggcccaggugugcagaguggugccccugguggccggcggcaucugccagugccuggccgagagauacagcgugauccugcuggacacccugcugggcagaaugcugccccagcuggugugcagacuggugcugagaugcagcauggacgacagcgccggccccagaagccccaccggcgaguggcugcccagagacagcgagugccaccugugcaugagcgugaccacccaggccggcaacagcagcgagcaggccaucccccaggccaugcugcaggccugcgugggcagcuggcuggacagagagaagugcaagcaguucguggagcagcacaccccccagcugcugacccuggugcccagaggcugggacgcccacaccaccugccaggcccugggcgugugcggcaccaugagcagcccccugcagugcauccacagccccgaccuguaa

SEQ ID NO: 23240 - RNA, 576 nt, Artificial Sequence
  SFTPC__Homo_sapiens__NP_001165828
auggacgugggcagcaaggaggugcugauggagagcccccccgacuacagcgccgcccccagaggcagauucggcauccccugcugccccgugcaccugaagagacugcugaucguggugguggugguggugcugaucgugguggugaucgugggcgcccugcugaugggccugcacaugagccagaagcacaccgagauggugcuggagaugagcaucggcgcccccgaggcccagcagagacuggcccugagcgagcaccuggugaccaccgccaccuucagcaucggcagcaccggccuggugguguacgacuaccagcagcugcugaucgccuacaagcccgcccccggcaccugcugcuacaucaugaagaucgcccccgagagcauccccagccuggaggcccugaccagaaaggugcacaacuuccaggccaagcccgccgugcccaccagcaagcugggccaggccgagggcagagacgccggcagcgcccccagcggcggcgaccccgccuuccugggcauggccgugagcacccugugcggcgaggugccccuguacuacaucuaa

SEQ ID NO: 23241 - RNA, 1128 nt, Artificial Sequence
  SFTPD__Homo_sapiens__NP_003010
augcugcuguuccugcugagcgcccuggugcugcugacccagccccugggcuaccuggaggccgagaugaagaccuacagccacagaaccaugcccagcgccugcacccuggugaugugcagcagcguggagagcggccugcccggcagagacggcagagacggcagagagggccccagaggcgagaagggcgaccccggccugcccggcgccgccggccaggccggcaugcccggccaggccggccccgugggccccaagggcgacaacggcagcgugggcgagcccggccccaagggcgacaccggccccagcggcccccccggcccccccggcgugcccggccccgccggcagagagggcccccugggcaagcagggcaacaucggcccccagggcaagcccggccccaagggcgaggccggccccaagggcgaggugggcgcccccggcaugcagggcagcgccggcgccagaggccuggccggccccaagggcgagagaggcgugcccggcgagagaggcgugcccggcaacaccggcgccgccggcagcgccggcgccaugggcccccagggcagccccggcgccagaggcccccccggccugaagggcgacaagggcauccccggcgacaagggcgccaagggcgagagcggccugcccgacguggccagccugagacagcagguggaggcccugcagggccaggugcagcaccugcaggccgccuucagccaguacaagaagguggagcuguuccccaacggccagagcgugggcgagaagaucuucaagaccgccggcuucgugaagcccuucaccgaggcccagcugcugugcacccaggccggcggccagcuggccagccccagaagcgccgccgagaacgccgcccugcagcagcuggugguggccaagaacgaggccgccuuccugagcaugaccgacagcaagaccgagggcaaguucaccuaccccaccggcgagagccugguguacagcaacugggcccccggcgagcccaacgacgacggcggcagcgaggacugcguggagaucuucaccaacggcaaguggaacgacagagccugcggcgagaagagacugguggugugcgaguucuaa

SEQ ID NO: 23242 - RNA, 969 nt, Artificial Sequence
  SFXN1__Homo_sapiens__NP_073591
augagcggcgagcugccccccaacaucaacaucaaggagcccagaugggaccagagcaccuucaucggcagagccaaccacuucuucaccgugaccgaccccagaaacauccugcugaccaacgagcagcuggagagcgccagaaagaucgugcacgacuacagacagggcaucgugccccccggccugaccgagaacgagcuguggagagccaaguacaucuacgacagcgccuuccaccccgacaccggcgagaagaugauccugaucggcagaaugagcgcccaggugcccaugaacaugaccaucaccggcugcaugaugaccuucuacagaaccacccccgccgugcuguucuggcaguggaucaaccagagcuucaacgccguggugaacuacaccaacagaagcggcgacgccccccugaccgugaacgagcugggcaccgccuacgugagcgccaccaccggcgccguggccaccgcccugggccugaacgcccugaccaagcacgugagcccccugaucggcagauucgugcccuucgccgccguggccgccgccaacugcaucaacaucccccugaugagacagagagagcugaaggugggcauccccgugaccgacgagaacggcaacagacugggcgagagcgccaacgccgccaagcaggccaucacccaggugguggugagcagaauccugauggccgcccccggcauggccaucccccccuucaucaugaacacccuggagaagaaggccuuccugaagagauuccccuggaugagcgcccccauccaggugggccuggugggcuucugccugguguucgccaccccccugugcugcgcccuguucccccagaagagcagcaugagcgugaccagccuggaggccgagcugcaggccaagauccaggagagccaccccgagcugagaagaguguacuucaacaagggccuguaa

SEQ ID NO: 23243 - RNA, 969 nt, Artificial Sequence
  SFXN2__Homo_sapiens__NP_849189
auggaggccgaccugagcggcuucaacaucgacgcccccagaugggaccagagaaccuuccugggcagagugaagcacuuccugaacaucaccgaccccagaaccguguucgugagcgagagagagcuggacugggccaaggugaugguggagaagagcagaaugggcguggugccccccggcacccagguggagcagcugcuguacgccaagaagcuguacgacagcgccuuccaccccgacaccggcgagaagaugaacgugaucggcagaaugagcuuccagcugcccggcggcaugaucaucaccggcuucaugcugcaguucuacagaaccaugcccgccgugaucuucuggcagugggugaaccagagcuucaacgcccuggugaacuacaccaacagaaacgccgccagccccaccagcgugagacagauggcccugagcuacuucaccgccaccaccaccgccguggccaccgccgugggcaugaacaugcugaccaagaaggcccccccccuggugggcagaugggugcccuucgccgccguggccgccgccaacugcgugaacauccccaugaugagacagcaggagcugaucaagggcaucugcgugaaggacagaaacgagaacgagaucggccacagcagaagagccgccgccaucggcaucacccagguggugaucagcagaaucaccaugagcgcccccggcaugauccugcugcccgugaucauggagagacuggagaagcugcacuucaugcagaaggugaaggugcugcacgccccccugcaggugaugcugagcggcugcuuccugaucuucauggugcccguggccugcggccuguucccccagaagugcgagcugcccgugagcuaccuggagcccaagcugcaggacaccaucaaggccaaguacggcgagcuggagcccuacguguacuucaacaagggccuguaa

SEQ ID NO: 23244 - RNA, 1014 nt, Artificial Sequence
  SFXN4__Homo_sapiens__NP_998814
augagccuggagcaggaggaggagacccagcccggcagacugcugggcagaagagacgccgugcccgccuucaucgagcccaacgugagauucuggaucaccgagagacagagcuucaucagaagauuccugcaguggaccgagcugcuggaccccaccaacguguucaucagcguggagagcaucgagaacagcagacagcugcugugcaccaacgaggacgugagcagccccgccagcgccgaccagagaauccaggaggccuggaagagaagccuggccaccgugcaccccgacagcagcaaccugauccccaagcuguucagacccgccgccuuccugcccuucauggcccccaccguguuccugagcaugaccccccugaagggcaucaagagcgugauccugccccagguguuccugugcgccuacauggccgccuucaacagcaucaacggcaacagaagcuacaccugcaagccccuggagagaagccugcugauggccggcgccguggccagcagcaccuuccugggcgugaucccccaguucgugcagaugaaguacggccugaccggccccuggaucaagagacugcugcccgugaucuuccuggugcaggccagcggcaugaacguguacaugagcagaagccuggagagcaucaagggcaucgccgugauggacaaggagggcaacgugcugggccacagcagaaucgccggcaccaaggccgugagagagacccuggccagcagaaucgugcuguucggcaccagcgcccugauccccgagguguucaccuacuucuucaagagaacccaguacuucagaaagaaccccggcagccuguggauccugaagcugagcugcaccgugcuggccaugggccugauggugcccuucagcuucagcaucuucccccagaucggccagauccaguacugcagccuggaggagaagauccagagccccaccgaggagaccgagaucuucuaccacagaggcguguaa

SEQ ID NO: 23245 - RNA, 1164 nt, Artificial Sequence
  SGCA__Homo_sapiens__NP_000014
auggccgagacccuguucuggaccccccugcugguggugcugcuggccggccugggcgacaccgaggcccagcagaccacccugcacccccuggugggcagaguguucgugcacacccuggaccacgagaccuuccugagccugcccgagcacguggccgugccccccgccgugcacaucaccuaccacgcccaccugcagggccaccccgaccugcccagauggcugagauacacccagagaagcccccaccaccccggcuuccuguacggcagcgccacccccgaggacagaggccugcaggugaucgaggugaccgccuacaacagagacagcuucgacaccaccagacagagacuggugcuggagaucggcgaccccgagggcccccugcugcccuaccaggccgaguuccuggugagaagccacgacgccgaggaggugcugcccagcacccccgccagcagauuccugagcgcccugggcggccugugggagcccggcgagcugcagcugcugaacgugaccagcgcccuggacagaggcggcagagugccccugcccaucgagggcagaaaggagggcguguacaucaaggugggcagcgccagccccuucagcaccugccugaagaugguggccagccccgacagccacgccagaugcgcccagggccagcccccccugcugagcugcuacgacacccuggccccccacuucagaguggacuggugcaacgugacccugguggacaagagcgugcccgagcccgccgacgaggugcccacccccggcgacggcauccuggagcacgaccccuucuucugcccccccaccgaggcccccgacagagacuuccugguggacgcccuggugacccugcuggugccccugcugguggcccugcugcugacccugcugcuggccuacgugaugugcugcagaagagagggcagacugaagagagaccuggccaccagcgacauccagauggugcaccacugcaccauccacggcaacaccgaggagcugagacagauggccgccagcagagaggugcccagaccccugagcacccugcccauguucaacgugcacaccggcgagagacugccccccagaguggacagcgcccaggugccccugauccuggaccagcacuaa

SEQ ID NO: 23246 - RNA, 957 nt, Artificial Sequence
  SGCB__Homo_sapiens__NP_000223
auggccgccgccgccgccgccgccgccgagcagcagagcagcaacggccccgugaagaagagcaugagagagaaggccguggagagaagaagcgugaacaaggagcacaacagcaacuucaaggccggcuacauccccaucgacgaggacagacugcacaagaccggccugagaggcagaaagggcaaccuggccaucugcgugaucauccugcuguucauccuggccgugaucaaccugaucaucacccuggugaucugggccgugaucagaaucggccccaacggcugcgacagcauggaguuccacgagagcggccugcugagauucaagcaggugagcgacaugggcgugauccacccccuguacaagagcaccgugggcggcagaagaaacgagaaccuggugaucaccggcaacaaccagcccaucguguuccagcagggcaccaccaagcugagcguggagaacaacaagaccagcaucaccagcgacaucggcaugcaguucuucgaccccagaacccagaacauccuguucagcaccgacuacgagacccacgaguuccaccugcccagcggcgugaagagccugaacgugcagaaggccagcaccgagagaaucaccagcaacgccaccagcgaccugaacaucaagguggacggcagagccaucgugagaggcaacgagggcguguucaucaugggcaagaccaucgaguuccacaugggcggcaacauggagcugaaggccgagaacagcaucauccugaacggcagcgugauggugagcaccaccagacugcccagcagcagcagcggcgaccagcugggcagcggcgacugggugagauacaagcugugcaugugcgccgacggcacccuguucaaggugcaggugaccagccagaacaugggcugccagaucagcgacaaccccugcggcaacacccacuaa

SEQ ID NO: 23247 - RNA, 771 nt, Artificial Sequence
  SGCD__Homo_sapiens__NP_758447
augaugccccaggagcaguacacccaccacagaagcaccaugcccggcagcgugggcccccagguguacaaggugggcaucuacggcuggagaaagagaugccuguacuucuucgugcugcugcugaugauccugauccuggugaaccuggccaugaccaucuggauccugaaggugaugaacuucaccaucgacggcaugggcaaccugagaaucaccgagaagggccugaagcuggagggcgacagcgaguuccugcagccccuguacgccaaggagauccagagcagacccggcaacgcccuguacuucaagagcgccagaaacgugaccgugaacauccugaacgaccagaccaaggugcugacccagcugaucaccggccccaaggccguggaggccuacggcaagaaguucgaggugaagaccgugagcggcaagcugcuguucagcgccgacaacaacgaggugguggugggcgccgagagacugagagugcugggcgccgagggcaccguguuccccaagagcaucgagacccccaacgugagagccgaccccuucaaggagcugagacuggagagccccaccagaagccuggugauggaggcccccaagggcguggagaucaacgccgaggccggcaacauggaggccaccugcagaaccgagcugagacuggagagcaaggacggcgaggugagagacgagaaggacagaagcagcaagagcuacagcuucaacagacccacccugcccaucaccggcuaa

SEQ ID NO: 23248 - RNA, 1356 nt, Artificial Sequence
  SGCE__Homo_sapiens__NP_001092870
augcagcugcccagauggugggagcugggcgaccccugcgccuggaccggccagggcagaggcaccagaagaaugagccccgccaccaccggcaccuuccugcugaccguguacagcaucuucagcaaggugcacagcgacagaaacguguaccccagcgccggcgugcuguucgugcacgugcuggagagagaguacuucaagggcgaguucccccccuaccccaagcccggcgagaucagcaacgaccccaucaccuucaacaccaaccugaugggcuaccccgacagacccggcuggcugagauacauccagagaacccccuacagcgacggcgugcuguacggcagccccaccgccgagaacgugggcaagcccaccaucaucgagaucaccgccuacaacagaagaaccuucgagaccgccagacacaaccugaucaucaacaucaugagcgccgaggacuucccccugcccuaccaggccgaguucuucaucaagaacaugaacguggaggagaugcuggccagcgaggugcugggcgacuuccugggcgccgugaagaacguguggcagcccgagagacugaacgccaucaacaucaccagcgcccuggacagaggcggcagagugccccugcccaucaacgaccugaaggagggcguguacgugauggugggcgccgacgugcccuucagcagcugccugagagagguggagaacccccagaaccagcugagaugcagccaggagauggagcccgugaucaccugcgacaagaaguucagaacccaguucuacaucgacuggugcaagaucagccugguggacaagaccaagcaggugagcaccuaccaggaggugaucagaggcgagggcauccugcccgacggcggcgaguacaagccccccagcgacagccugaagagcagagacuacuacaccgacuuccugaucacccuggccgugcccagcgccguggcccuggugcuguuccugauccuggccuacaucaugugcugcagaagagagggcgugauccagcuggugcaccacagcgccauccagaagagcaccaaggagcugagagacaugagcaagaacagagagaucgccuggccccugagcacccugcccguguuccaccccgugaccggcgagaucauccccccccugcacaccgacaacuacgacagcaccaacaugccccugaugcagacccagcagaaccugccccaccagacccagaucccccagcagcagaccaccggcgacuucagacugaccaccuuccagagauucgaggugaacggcauccccgaggagagaaagcugaccgaggccaugaaccuguaa

SEQ ID NO: 23249 - RNA, 876 nt, Artificial Sequence
  SGCG__Homo_sapiens__XP_005266562
auggugagagagcaguacaccaccgccaccgagggcaucugcaucgagagacccgagaaccaguacguguacaagaucggcaucuacggcuggagaaagagaugccuguaccuguucgugcugcugcugcugaucauccugguggugaaccuggcccugaccaucuggauccugaaggugaugugguucagccccgccggcaugggccaccugugcgugaccaaggacggccugagacuggagggcgagagcgaguuccuguucccccuguacgccaaggagauccacagcagaguggacagcagccugcugcugcagagcacccagaacgugaccgugaacgccagaaacagcgagggcgaggugaccggcagacugaaggugggccccaagaugguggaggugcagaaccagcaguuccagaucaacagcaacgacggcaagccccuguucaccguggacgagaaggaggugguggugggcaccgacaagcugagagugaccggccccgagggcgcccuguucgagcacagcguggagaccccccuggugagagccgaccccuuccaggaccugagacuggagagccccaccagaagccugagcauggacgcccccagaggcgugcacauccaggcccacgccggcaagaucgaggcccugagccagauggacauccuguuccacagcagcgacggcaugcuggugcuggacgccgagaccgugugccugcccaagcuggugcagggcaccuggggccccagcggcagcagccagagccuguacgagaucugcgugugccccgacggcaagcuguaccugagcguggccggcgugagcaccaccugccaggagcacaaccacaucugccuguaa

SEQ ID NO: 23250 - RNA, 939 nt, Artificial Sequence
  SGCZ__Homo_sapiens__NP_631906
auggacagaagcaccaaccuggacaucgaggagcugaagaugaccagagagcaguacauccuggccacccagcagaacaaccugcccagaaccgagaacgcccagcuguaccccgugggcaucuacggcuggagaaagagaugccuguacuucuucgugcugcugcugcuggugaccaugaucgugaaccuggccaugaccaucuggauccugaaggugaugaacuucaccguggacggcaugggcaaccugagagugaccaagaagggcaucagacuggagggcaucagcgaguuccugcugccccuguacgugaaggagauccacagcagaaaggacagcccccuggugcugcagagcgacagaaacgugaccgugaacgccagaaaccacaugggccagcugaccggccagcugaccaucggcgccgacgccguggaggcccagugcaagagauucgaggugagagccagcgaggacggcagagugcuguucagcgccgacgaggacgagaucaccaucggcgccgagaagcugaaggugaccggcaccgagggcgccguguucggccacagcguggagaccccccacaucagagccgagcccagccaggaccugagacuggagagccccaccagaagccugaucauggaggcccccagaggcgugcaggugagcgccgccgccggcgacuucaaggccaccugcagaaaggagcugcaccugcagagcaccgagggcgagaucuuccugaacgccgagaccaucaagcugggcaaccugcccaccggcagcuucagcagcagcagccccagcagcagcagcagcagacagaccguguacgagcugugcgugugccccaacggcaagcuguaccugagccccgccggcgugggcagcaccugccagagcagcagcaacaucugccuguggagcuaa

SEQ ID NO: 23251 - RNA, 1830 nt, Artificial Sequence
  SGIP1__Homo_sapiens__XP_011540595
augauggagggccugaagaagagaaccagaaaggccuucggcaucagaaagaaggagaaggacaccgacagcaccggcagccccgacagagacggcaucaagaagagcaacggcgcccccaacggcuucuacgccgagaucgacugggagagauacaacagccccgagcuggacgaggagggcuacagcaucagacccgaggagcccggcagcaccaagggcaagcacuucuacagcagcagcgagagcgaggaggaggaggagagccacaagaaguucaacaucaagaucaagccccugcagagcaaggacauccugaagaacgccgccaccguggacgagcugaaggccagcaucggcaacaucgcccugagccccagccccgugggcgccaucaagagaaaccugagcagcgaggagguggccagacccagaagaagcacccccacccccgagcugaucagcaagaagccccccgacgacaccaccgcccuggccccccuguucggccccccccuggagagcgccuucgacgagcagaagaccgaggugcugcuggaccagcccgagaucuggggcagcggccagcccaucaaccccagcauggagagccccaagcugaccagacccuuccccaccggcaccccccccccccugccccccaagaacgugcccgccaccccccccagaaccggcagcccccugaccaucggccccggcgccagcagccccgccagacccgccaccccccuggugcccugcagaagcaccaccccccccccccccccccccagaccccccagcagacccaagcugccccccggcaagcccggcgugggcgacgugagcagacccuucagcccccccauccacagcagcagccccccccccaucgccccccuggccagagccgagagcaccagcagcaucagcagcaccaacagccugagcgccgccaccacccccaccgugggcagcagcagaggccccagcccccugaccaugggcgcccaggacacccugcccguggccgccgccuucaccgagaccgugaacgccuacuucaagggcgccgaccccagcaagugcaucgugaagaucaccggcgagauggugcugagcuuccccgccggcaucaccagacacuucgccaacaaccccagccccgccgcccugaccuucagagugaucaacuucagcagacuggagcacgugcugcccaacccccagcugcugugcugcgacaacacccagaacgacgccaacaccaaggaguucugggugaacaugcccaaccugaugacccaccugaagaaggugagcgagcagaagccccaggccaccuacuacaacguggacaugcugaaguaccaggugagcgcccagggcauccagagcaccccccugaaccuggccgugaacuggagaugcgagcccagcagcaccgaccugagaaucgacuacaaguacaacaccgacgccaugaccaccgccguggcccugaacaacgugcaguuccuggugcccaucgacggcggcgugaccaagcugcaggccgugcugccccccgccguguggaacgccgagcagcagagaauccuguggaagauccccgacaucagccagaagagcgagaacggcggcgugggcagccugcuggccagauuccagcugagcgagggccccagcaagcccagcccccugguggugcaguucaccagcgagggcagcacccugagcggcugcgacaucgagcuggugggcgccggcuacagauucagccugaucaagaagagauucgccgccggcaaguaccuggccgacaacuaa

SEQ ID NO: 23252 - RNA, 1581 nt, Artificial Sequence
  SGK1__Homo_sapiens__NP_001137148
auggugaacaaggacaugaacggcuuccccgugaagaagugcagcgccuuccaguucuucaagaagagagugagaagauggaucaagagccccauggugagcguggacaagcaccagagccccagccugaaguacaccggcagcagcauggugcacaucccccccggcgagcccgacuucgagagcagccugugccagaccugccugggcgagcacgccuuccagagaggcgugcugccccaggagaacgagagcugcagcugggagacccagagcggcugcgaggugagagagcccugcaaccacgccaacauccugaccaagcccgaccccagaaccuucuggaccaacgacgaccccgccuucaugaagcagagaagaaugggccugaacgacuucauccagaagaucgccaacaacagcuacgccugcaagcaccccgaggugcagagcauccugaagaucagccagccccaggagcccgagcugaugaacgccaaccccagccccccccccagccccagccagcagaucaaccugggccccagcagcaacccccacgccaagcccagcgacuuccacuuccugaaggugaucggcaagggcagcuucggcaaggugcugcuggccagacacaaggccgaggagguguucuacgccgugaaggugcugcagaagaaggccauccugaagaagaaggaggagaagcacaucaugagcgagagaaacgugcugcugaagaacgugaagcaccccuuccuggugggccugcacuucagcuuccagaccgccgacaagcuguacuucgugcuggacuacaucaacggcggcgagcuguucuaccaccugcagagagagagaugcuuccuggagcccagagccagauucuacgccgccgagaucgccagcgcccugggcuaccugcacagccugaacaucguguacagagaccugaagcccgagaacauccugcuggacagccagggccacaucgugcugaccgacuucggccugugcaaggagaacaucgagcacaacagcaccaccagcaccuucugcggcacccccgaguaccuggcccccgaggugcugcacaagcagcccuacgacagaaccguggacugguggugccugggcgccgugcuguacgagaugcuguacggccugccccccuucuacagcagaaacaccgccgagauguacgacaacauccugaacaagccccugcagcugaagcccaacaucaccaacagcgccagacaccugcuggagggccugcugcagaaggacagaaccaagagacugggcgccaaggacgacuucauggagaucaagagccacguguucuucagccugaucaacugggacgaccugaucaacaagaagaucaccccccccuucaaccccaacgugagcggccccaacgaccugagacacuucgaccccgaguucaccgaggagcccgugcccaacagcaucggcaagagccccgacagcgugcuggugaccgccagcgugaaggaggccgccgaggccuuccugggcuucagcuacgccccccccaccgacagcuuccuguaa

SEQ ID NO: 23253 - RNA, 4221 nt, Artificial Sequence
  SGK223__Homo_sapiens__XP_005272427
augcaccagacccugugccugaaccccgagagccugaagaugagcgccugcagcgacuucguggagcacaucuggaagcccggcagcugcaagaacugcuucugccugagaagcgaccaccagcugguggccggccccccccagcccagagccggcagccugccccccccccccagacugccccccagacccgagaacugcagacuggaggacgagggcgugaacagcagccccuacagcaagcccaccaucgccgugaagcccaccaugaugagcagcgaggccagcgacguguggaccgaggccaaccugagcgccgaggugagccaggugaucuggagaagagcccccggcaagcugccccugcccaagcaggaggacgcccccgugguguaccugggcagcuucagaggcgugcagaagcccgccggccccagcaccagccccgacggcaacagcagaugcccccccgccuacaccauggugggccugcacaaccuggagcccagaggcgagagaaacaucgccuuccaccccgugagcuuccccgaggagaaggccgugcacaaggagaagcccagcuuccccuaccaggacagacccagcacccaggagagcuucagacagaagcuggccgccuucgccggcaccaccagcggcugccaccagggccccggcccccugagagagagccugcccagcgaggacgacagcgaccagagaugcagccccagcggcgacagcgagggcggcgaguacugcagcauccuggacugcugccccggcagccccguggccaaggccgccagccagaccgccggcagcagaggcagacacggcggcagagacugcagccccaccugcugggagcagggcaagugcagcggccccgccgagcaggagaagagaggccccagcuuccccaaggagugcugcagccagggccccaccgcccaccccagcugccugggccccaagaagcugagccugaccagcgaggccgccaucagcagcgacggccugagcugcggcagcggcagcggcagcggcagcggcgccagcagccccuucgugccccaccuggagagcgacuacugcagccugaugaaggagcccgcccccgagaagcagcaggaccccggcugccccggcgugacccccagcagaugccugggccugaccggcgagccccagccccccgcccaccccagagaggccacccagcccgagcccaucuacgccgagagcaccaagagaaagaaggccgcccccgugcccagcaagagccaggccaagaucgagcacgccgccgccgcccagggccagggccaggugugcaccggcaacgccugggcccagaaggccgccagcggcuggggcagagacagccccgaccccaccccccaggugagcgccaccaucaccgugauggccgcccaccccgaggaggaccacagaaccaucuaccugagcagccccgacagcgccgugggcgugcaguggcccagaggccccgugagccagaacagcgaggugggcgaggaggagaccagcgccggccagggccugagcagcagagagagccacgcccacagcgccagcgagagcaagcccaaggagagacccgccaucccccccaagcugagcaagagcagccccgugggcagccccgugagccccagcgccggcggcccccccgugagcccccuggccgaccugagcgacggcagcagcggcggcagcagcaucggcccccagccccccagccagggccccgccgaccccgcccccagcugcagaaccaacggcguggccaucagcgaccccagcagaugcccccagcccgccgccagcagcgccagcgagcagagaagacccagauuccaggccggcaccuggagcagacagugcagaaucgaggaggaggaggagguggagcaggagcugcugagccacagcuggggcagagagaccaagaacggccccaccgaccacagcaacagcaccaccuggcacagacugcaccccaccgacggcagcagcggccagaacagcaaggugggcaccggcaugagcaagagcgccagcuucgccuucgaguuccccaaggacagaagcggcaucgagaccuucagcccccccccccccccccccaagagcagacaccugcugaagaugaacaagagcagcagcgaccuggagaaggugagccagggcagcgccgagagccugagccccagcuucagaggcgugcacgugagcuucaccaccggcagcaccgacagccuggccagcgacagcagaaccugcagcgacggcggccccagcagcgagcuggcccacagccccaccaacagcggcaagaagcuguucgcccccgugcccuuccccagcggcagcaccgaggacgugagccccagcggcccccagcagccccccccccugccccagaagaagaucgugagcagagccgccagcagccccgacggcuucuucuggacccagggcagccccaagcccggcaccgccagccccaagcugaaccugagccacagcgagaccaacgugcacgacgagagccacuucagcuacagccugagccccggcaacagacaccaccccguguucagcagcagcgacccccuggagaaggccuucaagggcagcggccacuggcugcccgccgccggccuggccggcaacagaggcggcugcggcagccccggccugcagugcaagggcgcccccagcgccagcagcagccagcugagcgugagcagccaggccagcaccggcagcacccagcugcagcugcacggccugcugagcaacaucagcagcaaggagggcaccuacgccaagcugggcggccuguacacccagagccuggccagacugguggccaagugcgaggaccuguucaugggcggccagaagaaggagcugcacuucaacgagaacaacuggagccuguucaagcugaccugcaacaagcccugcugcgacagcggcgacgccaucuacuacugcgccaccugcagcgaggaccccggcagcaccuacgccgugaagaucugcaaggcccccgagcccaagaccgugagcuacugcagccccagcgugcccgugcacuucaacauccagcaggacugcggccacuucguggccagcgugcccagcagcaugcugagcagccccgacgcccccaaggaccccgugcccgcccugcccacccacccccccgcccaggagcaggacugcgugguggugaucaccagagaggugccccaccagaccgccagcgacuucgugagagacagcgccgccagccaccaggccgagcccgaggccuacgagagaagagugugcuuccugcugcugcagcugugcaacggccuggagcaccugaaggagcacggcaucauccacagagaccugugccuggagaaccugcugcuggugcacugcacccugcaggccggccccggccccgcccccgcccccgcccccgcccccgcccccgccgccgccgccccccccugcagcagcgccgccccccccgccggcggcacccugagccccgccgccggccccgccagccccgagggccccagagagaagcagcugcccagacugaucaucagcaacuuccugaaggccaagcagaagcccggcggcacccccaaccugcagcagaagaagagccaggccagacuggcccccgagaucgugagcgccagccaguacagaaaguucgacgaguuccagaccggcauccugaucuacgagcugcugcaccagcccaaccccuucgaggugagagcccagcugagagagagagacuacagacaggaggaccugcccccccugcccgcccugagccuguacagccccggccugcagcagcuggcccaccugcugcuggaggccgaccccaucaagagaaucagaaucggcgaggccaagagagugcugcagugccugcuguggggccccagaagagagcuggugcagcagcccggcaccagcgaggaggcccugugcggcacccugcacaacuggaucgacaugaagagagcccugaugaugaugaaguucgccgagaaggccguggacagaagaagaggcguggagcuggaggacuggcugugcugccaguaccuggccagcgccgagcccggcgcccugcugcagagccugaagcugcugcagcugcuguaa

SEQ ID NO: 23254 - RNA, 1104 nt, Artificial Sequence
  SGK2__Homo_sapiens__NP_001186193
augaacagcagccccgccggcacccccagcccccagcccagcagagccaacggcaacaucaaccugggccccagcgccaaccccaacgcccagcccaccgacuucgacuuccugaaggugaucggcaagggcaacuacggcaaggugcugcuggccaagagaaagagcgacggcgccuucuacgccgugaaggugcugcagaagaagagcauccugaagaagaaggagcagagccacaucauggccgagagaagcgugcugcugaagaacgugagacaccccuuccuggugggccugagauacagcuuccagacccccgagaagcuguacuucgugcuggacuacgugaacggcggcgagcuguucuuccaccugcagagagagagaagauuccuggagcccagagccagauucuacgccgccgagguggccagcgccaucggcuaccugcacagccugaacaucaucuacagagaccugaagcccgagaacauccugcuggacugccagggccacguggugcugaccgacuucggccugugcaaggagggcguggagcccgaggacaccaccagcaccuucugcggcacccccgaguaccuggcccccgaggugcugagaaaggagcccuacgacagagccguggacugguggugccugggcgccgugcuguacgagaugcugcacggccugccccccuucuacagccaggacgugagccagauguacgagaacauccugcaccagccccugcagauccccggcggcagaaccguggccgccugcgaccugcugcagagccugcugcacaaggaccagagacagagacugggcagcaaggccgacuuccuggagaucaagaaccacguguucuucagccccaucaacugggacgaccuguaccacaagagacugaccccccccuucaaccccaacgugaccggccccgccgaccugaagcacuucgaccccgaguucacccaggaggccgugagcaagagcaucggcugcacccccgacaccguggccagcagcagcggcgccagcagcgccuuccugggcuucagcuacgcccccgaggacgacgacauccuggacugcuaa

SEQ ID NO: 23255 - RNA, 1491 nt, Artificial Sequence
  SGK3__Homo_sapiens__NP_001028750
augcagagagaccacaccauggacuacaaggagagcugccccagcgugagcauccccagcagcgacgagcacagagagaagaagaagagauucaccguguacaaggugcuggugagcgugggcagaagcgagugguucguguucagaagauacgccgaguucgacaagcuguacaacacccugaagaagcaguuccccgccauggcccugaagauccccgccaagagaaucuucggcgacaacuucgaccccgacuucaucaagcagagaagagccggccugaacgaguucauccagaaccuggugagauaccccgagcuguacaaccaccccgacgugagagccuuccugcagauggacagccccaagcaccagagcgaccccagcgaggacgaggacgagagaagcagccagaagcugcacagcaccagccagaacaucaaccugggccccagcggcaacccccacgccaagcccaccgacuucgacuuccugaaggugaucggcaagggcagcuucggcaaggugcugcuggccaagagaaagcuggacggcaaguucuacgccgugaaggugcugcagaagaagaucgugcugaacagaaaggagcagaagcacaucauggccgagagaaacgugcugcugaagaacgugaagcaccccuuccuggugggccugcacuacagcuuccagaccaccgagaagcuguacuucgugcuggacuucgugaacggcggcgagcuguucuuccaccugcagagagagagaagcuuccccgagcacagagccagauucuacgccgccgagaucgccagcgcccugggcuaccugcacagcaucaagaucguguacagagaccugaagcccgagaacauccugcuggacagcgugggccacguggugcugaccgacuucggccugugcaaggagggcaucgccaucagcgacaccaccaccaccuucugcggcacccccgaguaccuggcccccgaggugaucagaaagcagcccuacgacaacaccguggacugguggugccugggcgccgugcuguacgagaugcuguacggccugccccccuucuacugcagagacguggccgagauguacgacaacauccugcacaagccccugagccugagacccggcgugagccugaccgccuggagcauccuggaggagcugcuggagaaggacagacagaacagacugggcgccaaggaggacuuccuggagauccagaaccaccccuucuucgagagccugagcugggccgaccuggugcagaagaagauccccccccccuucaaccccaacguggccggccccgacgacaucagaaacuucgacaccgccuucaccgaggagaccgugcccuacagcgugugcgugagcagcgacuacagcaucgugaacgccagcgugcuggaggccgacgacgccuucgugggcuucagcuacgccccccccagcgaggaccuguuccuguaa

SEQ ID NO: 23256 - RNA, 1242 nt, Artificial Sequence
  SGMS1__Homo_sapiens__XP_011537885
augaaggaggugguguacuggagccccaagaagguggccgacuggcugcuggagaacgccaugcccgaguacugcgagccccuggagcacuucaccggccaggaccugaucaaccugacccaggaggacuucaagaagcccccccugugcagagugagcagcgacaacggccagagacugcuggacaugaucgagacccugaagauggagcaccaccuggaggcccacaagaacggccacgccaacggccaccugaacaucggcguggacauccccacccccgacggcagcuucagcaucaagaucaagcccaacggcaugcccaacggcuacagaaaggagaugaucaagauccccaugcccgagcuggagagaagccaguaccccauggaguggggcaagaccuuccuggccuuccuguacgcccugagcugcuucgugcugaccaccgugaugaucagcguggugcacgagagagugccccccaaggaggugcagcccccccugcccgacaccuucuucgaccacuucaacagagugcagugggccuucagcaucugcgagaucaacggcaugauccuggugggccuguggcugauccaguggcugcugcugaaguacaagagcaucaucagcagaagauucuucugcaucgugggcacccuguaccuguacagaugcaucaccauguacgugaccacccugcccgugcccggcaugcacuucaacugcagccccaagcuguucggcgacugggaggcccagcugagaagaaucaugaagcugaucgccggcggcggccugagcaucaccggcagccacaacaugugcggcgacuaccuguacagcggccacaccgugaugcugacccugaccuaccuguucaucaaggaguacagccccagaagacuguggugguaccacuggaucugcuggcugcugagcguggugggcaucuucugcauccugcuggcccacgaccacuacaccguggacguggugguggccuacuacaucaccaccagacuguucuggugguaccacaccauggccaaccagcaggugcugaaggaggccagccagaugaaccugcuggccagaguguggugguacagacccuuccaguacuucgagaagaacgugcagggcaucgugcccagaagcuaccacuggcccuuccccuggcccguggugcaccugagcagacaggugaaguacagcagacuggugaacgacaccuaa

SEQ ID NO: 23257 - RNA, 1098 nt, Artificial Sequence
  SGMS2__Homo_sapiens__NP_001129730
auggacaucaucgagaccgccaagcuggaggagcaccuggagaaccagcccagcgaccccaccaacaccuacgccagacccgccgagcccguggaggaggagaacaagaacggcaacggcaagcccaagagccugagcagcggccugagaaagggcaccaagaaguaccccgacuacauccagaucgccaugcccaccgagagcagaaacaaguucccccuggagugguggaagaccggcaucgccuucaucuacgccguguucaaccuggugcugaccaccgugaugaucaccguggugcacgagagagugccccccaaggagcugagccccccccugcccgacaaguucuucgacuacaucgacagagugaagugggccuucagcgugagcgagaucaacggcaucauccuggugggccuguggaucacccaguggcuguuccugagauacaagagcaucgugggcagaagauucugcuucaucaucggcacccuguaccuguacagaugcaucaccauguacgugaccacccugcccgugcccggcaugcacuuccagugcgcccccaagcugaacggcgacagccaggccaaggugcagagaauccugagacugaucagcggcggcggccugagcaucaccggcagccacauccugugcggcgacuuccuguucagcggccacaccgugacccugacccugaccuaccuguucaucaaggaguacagccccagacacuucuggugguaccaccugaucugcuggcugcugagcgccgccggcaucaucugcauccugguggcccacgagcacuacaccaucgacgugaucaucgccuacuacaucaccaccagacuguucuggugguaccacagcauggccaacgagaagaaccugaaggugagcagccagaccaacuuccugagcagagccuggugguuccccaucuucuacuucuucgagaagaacgugcagggcagcauccccugcugcuucagcuggccccugagcuggccccccggcugcuucaagagcagcugcaagaaguacagcagagugcagaagaucggcgaggacaacgagaagagcaccuaa

SEQ ID NO: 23258 - RNA, 1584 nt, Artificial Sequence
  SGOL1__Homo_sapiens__NP_001012409
auggccaaggagagaugccugaagaagagcuuccaggacagccuggaggacaucaagaagagaaugaaggagaagagaaacaagaaccuggccgagaucggcaagagaagaagcuucaucgccgcccccugccagaucaucaccaacaccagcacccugcugaagaacuaccaggacaacaacaagaugcuggugcuggcccuggagaacgagaagagcaaggugaaggaggcccaggacaucauccugcagcugagaaaggagugcuacuaccugaccugccagcuguacgcccugaagggcaagcugaccagccagcagaccguggagcccgcccagaaccaggagaucugcagcagcggcauggaccccaacagcgacgacagcagcagaaaccuguucgugaaggaccugccccagaucccccuggaggagaccgagcugcccggccagggcgagagcuuccagaucgaggaccagauccccaccaucccccaggacacccugggcguggacuucgacagcggcgaggccaagagcaccgacaacgugcugcccagaaccgugagcgugagaagcagccugaagaagcacugcaacagcaucugccaguucgacagccuggacgacuucgagaccagccaccuggccggcaagagcuucgaguucgagagagugggcuuccuggacccccuggugaacaugcacauccccgagaacgugcagcacaacgccugccaguggagcaaggaccaggugaaccugagccccaagcugauccagcccggcaccuucaccaagaccaaggaggacauccuggagagcaagagcgagcagaccaagagcaagcagagagacacccaggagagaaagagagaggagaagagaaaggccaacagaagaaagagcaagagaaugagcaaguacaaggagaacaagagcgagaacaagaagaccgugccccagaagaagaugcacaagagcgugagcagcaacgacgccuacaacuucaaccuggaggagggcgugcaccugacccccuucagacagaaggugagcaacgacagcaacagagaggagaacaacgagagcgaggugagccugugcgagagcagcggcagcggcgacgacagcgacgaccuguaccugcccaccugcaaguacauccagaaccccaccagcaacagcgacagacccgugaccagaccccuggccaagagagcccugaaguacaccgacgagaaggagaccgagggcagcaagcccaccaagacccccaccaccaccccccccgagacccagcagagcccccaccugagccugaaggacaucaccaacgugagccuguaccccguggugaagaucagaagacugagccugagccccaagaagaacaaggccagccccgccguggcccugcccaagagaagaugcaccgccagcgugaacuacaaggagcccacccuggccagcaagcugagaagaggcgaccccuucaccgaccugugcuuccugaacagccccaucuucaagcagaagaaggaccugagaagaagcaagaagagcaugaagcagauccaguaa

SEQ ID NO: 23259 - RNA, 1707 nt, Artificial Sequence
  SGPL1__Homo_sapiens__XP_011538619
augcccagcaccgaccugcugaugcugaaggccuucgagcccuaccuggagauccuggagguguacagcaccaaggccaagaacuacgugaacggccacugcaccaaguacgagcccuggcagcugaucgccuggagcgugguguggacccugcugaucguguggggcuacgaguucguguuccagcccgagagccuguggagcagauucaagaagaagugcuucaagcugaccagaaagaugcccaucaucggcagaaagauccaggacaagcugaacaagaccaaggacgacaucagcaagaacaugagcuuccugaagguggacaaggaguacgugaaggcccugcccagccagggccugagcagcagcgccgugcuggagaagcugaaggaguacagcagcauggacgccuucuggcaggagggcagagccagcggcaccguguacagcggcgaggagaagcugaccgagcugcuggugaaggccuacggcgacuucgccuggagcaacccccugcaccccgacaucuuccccggccugagaaagaucgaggccgagaucgugagaaucgccugcagccuguucaacggcggccccgacagcugcggcugcgugaccagcggcggcaccgagagcauccugauggccugcaaggccuacagagaccuggccuucgagaagggcaucaagacccccgagaucguggccccccagagcgcccacgccgccuucaacaaggccgccagcuacuucggcaugaagaucgugagagugccccugaccaagaugauggagguggacgugagagccaugagaagagccaucagcagaaacaccgccaugcuggugugcagcaccccccaguucccccacggcgugaucgaccccgugcccgagguggccaagcuggccgugaaguacaagaucccccugcacguggacgccugccugggcggcuuccugaucguguucauggagaaggccggcuacccccuggagcaccccuucgacuucagagugaagggcgugaccagcaucagcgccgacacccacaaguacggcuacgcccccaagggcagcagccuggugcuguacagcgacaagaaguacagaaacuaccaguucuucguggacaccgacuggcagggcggcaucuacgccagccccaccaucgccggcagcagacccggcggcaucagcgccgccugcugggccgcccugaugcacuucggcgagaacggcuacguggaggccaccaagcagaucaucaagaccgccagauuccugaagagcgagcuggagaacaucaagggcaucuucguguucggcaacccccagcugagcgugaucgcccugggcagcagagacuucgacaucuacagacugagcaaccugaugaccgccaagggcuggaaccugaaccagcugcaguucccccccagcauccacuucugcaucacccugcugcacgccagaaagagaguggccauccaguuccugaaggacaucagagagagcgugacccagaucaugaagaaccccaaggccaagaccaccggcaugggcgccaucuacggcauggcccagaccaccguggacagaaacaugguggccgagcugagcagcguguuccuggacagccuguacagcaccgacaccgugacccagggcagccagaugaacggcagccccaagccccacuaa

SEQ ID NO: 23260 - RNA, 1326 nt, Artificial Sequence
  SGPP1__Homo_sapiens__NP_110418
augagccugagacagagacuggcccagcuggugggcagacugcaggacccccagaagguggccagauuccagagacugugcggcguggaggccccccccagaagaagcgccgacagaagagaggacgagaaggccgaggccccccuggccggcgaccccagacugagaggcagacagcccggcgcccccggcggcccccagccccccggcagcgacagaaaccagugccccgccaagcccgacggcggcggcgcccccaacggcgugagaaacggccuggccgccgagcugggccccgccagccccagaagagccggcgcccugagaagaaacagccugaccggcgaggagggccagcuggccagagugagcaacuggccccuguacugccuguucugcuucggcaccgagcugggcaacgagcuguucuacauccuguucuuccccuucuggaucuggaaccuggacccccuggugggcagaagacugguggugaucugggugcuggugauguaccugggccagugcaccaaggacaucaucagauggcccagacccgccagcccccccguggugaagcuggagguguucuacaacagcgaguacagcaugcccagcacccacgccaugagcggcaccgccauccccaucagcauggugcugcugaccuacggcagauggcaguacccccugaucuacggccugauccugauccccugcuggugcagccuggugugccugagcagaaucuacaugggcaugcacagcauccuggacaucaucgccggcuuccuguacaccauccugauccuggccguguucuaccccuucguggaccugaucgacaacuucaaccagacccacaaguacgcccccuucaucaucaucggccugcaccuggcccugggcaucuucagcuucacccuggacaccuggagcaccagcagaggcgacaccgccgagauccugggcagcggcgccggcaucgccugcggcagccacgugaccuacaacaugggccuggugcuggaccccagccuggacacccugccccuggccggcccccccaucaccgugacccuguucggcaaggccauccugagaauccugaucggcaugguguucgugcugaucaucagagacgugaugaagaagaucaccaucccccuggccugcaagaucuucaacauccccugcgacgacaucagaaaggccagacagcacauggagguggagcugcccuacagauacaucaccuacggcauggugggcuucagcaucaccuucuucgugcccuacaucuucuucuucaucggcaucagcuaa

SEQ ID NO: 23261 - RNA, 1200 nt, Artificial Sequence
  SGPP2__Homo_sapiens__NP_689599
auggccgagcugcugagaagccugcaggacagccagcugguggccagauuccagagaagaugcggccuguuccccgcccccgacgagggccccagagagaacggcgccgaccccaccgagagagccgccagagugcccggcguggagcaccugcccgccgccaacggcaagggcggcgaggcccccgccaacggccugagaagagccgccgcccccgaggccuacgugcagaaguacguggugaagaacuacuucuacuacuaccuguuccaguucagcgccgcccugggccaggagguguucuacaucaccuuccugcccuucacccacuggaacaucgaccccuaccugagcagaagacugaucaucaucugggugcuggugauguacaucggccagguggccaaggacgugcugaaguggcccagacccagcagcccccccguggugaagcuggagaagagacugaucgccgaguacggcaugcccagcacccacgccauggccgccaccgccaucgccuucacccugcugaucagcaccauggacagauaccaguaccccuucgugcugggccuggugauggccgugguguucagcacccuggugugccugagcagacuguacaccggcaugcacaccgugcuggacgugcugggcggcgugcugaucaccgcccugcugaucgugcugaccuaccccgccuggaccuucaucgacugccuggacagcgccagcccccuguuccccgugugcgugaucguggugcccuucuuccugugcuacaacuaccccgugagcgacuacuacagccccaccagagccgacaccaccaccauccuggccgccggcgccggcgugaccaucggcuucuggaucaaccacuucuuccagcuggugagcaagcccgccgagagccugcccgugauccagaacauccccccccugaccaccuacaugcuggugcugggccugaccaaguucgccgugggcaucgugcugauccugcuggugagacagcuggugcagaaccugagccugcaggugcuguacagcugguucaagguggugaccagaaacaaggaggccagaagaagacuggagaucgaggugcccuacaaguucgugaccuacaccagcgugggcaucugcgccaccaccuucgugcccaugcugcacagauuccugggccugcccuaa

SEQ ID NO: 23262 - RNA, 1509 nt, Artificial Sequence
  SGSH__Homo_sapiens__NP_000190
augagcugccccgugcccgccugcugcgcccugcugcuggugcugggccugugcagagccagacccagaaacgcccugcugcugcuggccgacgacggcggcuucgagagcggcgccuacaacaacagcgccaucgccaccccccaccuggacgcccuggccagaagaagccugcuguucagaaacgccuucaccagcgugagcagcugcagccccagcagagccagccugcugaccggccugccccagcaccagaacggcauguacggccugcaccaggacgugcaccacuucaacagcuucgacaaggugagaagccugccccugcugcugagccaggccggcgugagaaccggcaucaucggcaagaagcacgugggccccgagaccguguaccccuucgacuucgccuacaccgaggagaacggcagcgugcugcaggugggcagaaacaucaccagaaucaagcugcuggugagaaaguuccugcagacccaggacgacagacccuucuuccuguacguggccuuccacgacccccacagaugcggccacagccagccccaguacggcaccuucugcgagaaguucggcaacggcgagagcggcaugggcagaauccccgacuggaccccccaggccuacgacccccuggacgugcuggugcccuacuucgugcccaacacccccgccgccagagccgaccuggccgcccaguacaccaccgugggcagaauggaccagggcgugggccuggugcugcaggagcugagagacgccggcgugcugaacgacacccuggugaucuucaccagcgacaacggcauccccuuccccagcggcagaaccaaccuguacuggcccggcaccgccgagccccugcuggugagcagccccgagcaccccaagagauggggccaggugagcgaggccuacgugagccugcuggaccugacccccaccauccuggacugguucagcauccccuaccccagcuacgccaucuucggcagcaagaccauccaccugaccggcagaagccugcugcccgcccuggaggccgagccccugugggccaccguguucggcagccagagccaccacgaggugaccaugagcuaccccaugagaagcgugcagcacagacacuucagacuggugcacaaccugaacuucaagaugcccuuccccaucgaccaggacuucuacgugagccccaccuuccaggaccugcugaacagaaccaccgccggccagcccaccggcugguacaaggaccugagacacuacuacuacagagccagaugggagcuguacgacagaagcagagacccccacgagacccagaaccuggccaccgaccccagauucgcccagcugcuggagaugcugagagaccagcuggccaaguggcagugggagacccacgaccccugggugugcgcccccgacggcgugcuggaggagaagcugagcccccagugccagccccugcacaacgagcuguaa

SEQ ID NO: 23263 - RNA, 3021 nt, Artificial Sequence
  SGSM2__Homo_sapiens__NP_001091979
augggcagcgccgaggacgccgugaaggagaagcugcuguggaacgugaagaaggaggugaagcagaucauggaggaggccgugaccagaaaguucgugcacgaggacagcagccacaucaucgcccugugcggcgccguggaggccugccugcugcaccagcugagaagaagagccgccggcuuccugagaagcgacaagauggccgcccuguucaccaaggugggcaagaccugccccguggccggcgagaucugccacaaggugcaggagcugcagcagcaggccgagggcagaaagcccagcggcgugagccaggaggcccugagaagacagggcagcgccagcggcaaggcccccgcccugagcccccaggcccugaagcacgugugggugagaaccgcccugaucgagaaggugcuggacaagguggugcaguaccuggccgagaacugcagcaaguacuacgagaaggaggcccugcuggccgaccccguguucggccccauccuggccagccugcuggugggccccugcgcccuggaguacaccaagcugaagaccgccgaccacuacuggaccgaccccagcgccgacgagcuggugcagagacacagaaucagaggcccccccaccagacaggacagccccgccaagagacccgcccugggcaucagaaagagacacagcagcggcagcgccagcgaggacagacuggccgccugcgccagagagugcguggagagccugcaccagaacagcagaaccagacugcuguacggcaagaaccacgugcuggugcagcccaaggaggacauggaggccgugcccggcuaccugagccugcaccagagcgccgagagccugacccugaaguggacccccaaccagcugaugaacggcacccugggcgacagcgagcuggagaagagcguguacugggacuacgcccugguggugcccuucagccagguggugugcauccacugccaccagcagaagagcggcggcacccuggugcuggugagccaggacggcauccagagacccccccugcacuucccccagggcggccaccugcugagcuuccugagcugccuggagaacggccugcugcccagaggccagcuggagcccccccuguggacccagcagggcaagggcaagguguuccccaagcugagaaagagaagcagcaucagaagcguggacauggaggagaugggcaccggcagagccaccgacuacguguucagaaucaucuaccccggccacagacacgagcacaacgccggcgacaugaucgagaugcagggcuucggccccagccugcccgccuggcaccuggagccccugugcagccagggcagcagcugccugagcugcagcagcagcagcagcccccacgccacccccagccacugcagcugcauccccgacagacugccccugagacugcugugcgagagcaugaagagacagaucgugagcagagccuucuacggcuggcuggcccacugcagacaccugagcaccgugagaacccaccugagcgcccuggugcaccacagcgugaucccccccgacagaccccccggcgccagcgccggccugaccaaggacguguggagcaaguaccagaaggacaagaagaacuacaaggagcuggagcugcugagacagguguacuacggcggcaucgagcacgagaucagaaaggacguguggcccuuccugcugggccacuacaaguucggcaugagcaagaaggagauggagcagguggacgccgugguggccgccagauaccagcaggugcuggccgaguggaaggccugcgaggugguggugagacagagagagagagaggcccaccccgccaccagaaccaaguucagcagcggcagcagcaucgacagccacgugcagagacugauccacagagacagcaccaucagcaacgacguguucaucagcguggacgaccuggagccccccgagccccaggaccccgaggacagcagacccaagcccgagcaggaggccggccccggcacccccggcaccgccgugguggagcagcagcacagcguggaguucgacagccccgacagcggccugcccagcagcagaaacuacagcguggccagcggcauccagagcagccuggacgagggccagagcgugggcuucgaggaggaggacggcggcggcgaggagggcagcagcggccccggccccgccgcccacacccugagagagccccaggaccccagccaggagaagccccaggccggcgagcuggaggccggcgaggagcuggccgccgugugcgccgccgccuacaccaucgagcugcuggacaccguggcccugaaccugcacagaaucgacaaggacgugcagagaugcgacagaaacuacugguacuucaccccccccaaccuggagagacugagagacgugaugugcagcuacgugugggagcaccuggacgugggcuacgugcagggcaugugcgaccugcuggccccccugcuggugacccuggacaacgaccagcuggccuacagcugcuucagccaccugaugaagagaaugagccagaacuuccccaacggcggcgccauggacacccacuucgccaacaugagaagccugauccagauccuggacagcgagcuguucgagcugaugcaccagaacggcgacuacacccacuucuacuucugcuacagaugguuccugcuggacuucaagagagagcugcuguacgaggacguguucgccgugugggaggugaucugggccgccagacacaucagcagcgagcacuucgugcuguucaucgcccuggcccugguggaggccuacagagagaucaucagagacaacaacauggacuucaccgacaucaucaaguucuucaacgagagagccgagcaccacgacgcccaggagauccugagaaucgccagagaccuggugcacaaggugcagaugcugaucgagaacaaguaa

SEQ ID NO: 23264 - RNA, 2250 nt, Artificial Sequence
  SGSM3__Homo_sapiens__NP_056520
augagcggcagccacacccccgccugcggccccuucagcgcccugacccccagcaucuggccccaggagauccuggccaaguacacccagaaggaggagagcgccgagcagcccgaguucuacuacgacgaguucggcuucagaguguacaaggaggagggcgacgagcccggcagcagccugcuggccaacagcccccugauggaggacgccccccagagacugagauggcaggcccaccuggaguucacccacaaccacgacgugggcgaccugaccugggacaagaucgccgugagccugcccagaagcgagaagcugagaagccuggugcuggccggcaucccccacggcaugagaccccagcuguggaugagacugagcggcgcccugcagaagaagagaaacagcgagcugagcuacagagagaucgugaagaacagcagcaacgacgagaccaucgccgccaagcagaucgagaaggaccugcugagaaccaugcccagcaacgccugcuucgccagcaugggcagcaucggcgugcccagacugagaagagugcugagagcccuggccuggcuguaccccgagaucggcuacugccagggcaccggcaugguggccgccugccugcugcuguuccuggaggaggaggacgccuucuggaugaugagcgccaucaucgaggaccugcugcccgccagcuacuucagcaccacccugcugggcgugcagaccgaccagagagugcugagacaccugaucgugcaguaccugcccagacuggacaagcugcugcaggagcacgacaucgagcugagccugaucacccugcacugguuccugaccgccuucgccagcgugguggacaucaagcugcugcugagaaucugggaccuguucuucuacgagggcagcagagugcuguuccagcugacccugggcaugcugcaccugaaggaggaggagcugauccagagcgagaacagcgccagcaucuucaacacccugagcgacauccccagccagauggaggacgccgagcugcugcugggcguggccaugagacuggccggcagccugaccgacguggccguggagacccagagaagaaagcaccuggccuaccugaucgccgaccagggccagcugcugggcgccggcacccugaccaaccugagccagguggugagaagaagaacccagagaagaaagagcaccaucaccgcccugcuguucggcgaggacgaccuggaggcccugaaggccaagaacaucaagcagaccgagcugguggccgaccugagagaggccauccugagaguggccagacacuuccagugcaccgaccccaagaacugcagcguggagcugacccccgacuacagcauggagagccaccagagagaccacgagaacuacguggccugcagcagaagccacagaagaagagccaaggcccugcuggacuucgagagacacgacgacgacgagcugggcuucagaaagaacgacaucaucaccaucgugagccagaaggacgagcacugcugggugggcgagcugaacggccugagaggcugguuccccgccaaguucguggaggugcuggacgagagaagcaaggaguacagcaucgccggcgacgacagcgugaccgagggcgugaccgaccuggugagaggcacccugugccccgcccugaaggcccuguucgagcacggccugaagaagcccagccugcugggcggcgccugccaccccuggcuguucaucgaggaggccgccggcagagagguggagagagacuucgccagcguguacagcagacuggugcugugcaagaccuucagacuggacgaggacggcaaggugcugacccccgaggagcugcuguacagagccgugcagagcgugaacgugacccacgacgccgugcacgcccagauggacgugaagcugagaagccugaucugcgugggccugaacgagcaggugcugcaccuguggcuggaggugcugugcagcagccugcccaccguggagaagugguaccagcccuggagcuuccugagaagccccggcugggugcagaucaagugcgagcugagagugcugugcugcuucgccuucagccugagccaggacugggagcugcccgccaagagagaggcccagcagccccugaaggagggcgugagagacaugcuggugaagcaccaccuguucagcugggacguggacggcuaa

SEQ ID NO: 23265 - RNA, 942 nt, Artificial Sequence
  SGTA__Homo_sapiens__XP_011526480
auggacaacaagaagagacuggccuacgccaucauccaguuccugcacgaccagcugagacacggcggccugagcagcgacgcccaggagagccuggagguggccauccagugccuggagaccgccuucggcgugaccguggaggacagcgaccuggcccugccccagacccugcccgagaucuucgaggccgccgccaccggcaaggagaugccccaggaccugagaagccccgccagaaccccccccagcgaggaggacagcgccgaggccgagagacugaagaccgagggcaacgagcagaugaagguggagaacuucgaggccgccgugcacuucuacggcaaggccaucgagcugaaccccgccaacgccguguacuucugcaacagagccgccgccuacagcaagcugggcaacuacgccggcgccgugcaggacugcgagagagccaucugcaucgaccccgccuacagcaaggccuacggcagaaugggccuggcccugagcagccugaacaagcacguggaggccguggccuacuacaagaaggcccuggagcuggaccccgacaacgagaccuacaagagcaaccugaagaucgccgagcugaagcugagagaggcccccagccccaccggcggcgugggcagcuucgacaucgccggccugcugaacaaccccggcuucaugagcauggccagcaaccugaugaacaacccccagauccagcagcugaugagcggcaugaucagcggcggcaacaacccccugggcacccccggcaccagccccagccagaacgaccuggccagccugauccaggccggccagcaguucgcccagcagaugcagcagcagaaccccgagcugaucgagcagcugagaagccagaucagaagcagaacccccagcgccagcaacgacgaccagcaggaguaa

SEQ ID NO: 23266 - RNA, 2271 nt, Artificial Sequence
  SH2B1__Homo_sapiens__NP_001139267
augaacggcgcccccagccccgaggacggcgccagccccagcagccccccccugccccccccccccccccccagcuggagagaguucugcgagagccacgccagagccgccgcccuggacuucgccagaagauucagacuguaccuggccagccacccccaguacgccggccccggcgccgaggccgccuucagcagaagauucgccgagcuguuccugcagcacuucgaggccgagguggccagagccagcggcagccugagcccccccauccuggccccccugagccccggcgccgagaucagcccccacgaccugagccuggagagcugcagagugggcggcccccuggccgugcugggccccagcagaagcagcgaggaccuggccggcccccugcccagcagcgugagcagcagcagcaccaccagcagcaagcccaagcugaagaagagauucagccugagaagcgugggcagaagcgugagaggcagcgugagaggcauccugcaguggagaggcaccguggacccccccagcagcgccggcccccuggagaccagcagcggcccccccgugcugggcggcaacagcaacagcaacagcagcggcggcgccggcaccgugggcagaggccuggugagcgacggcaccagccccggcgagagauggacccacagauucgagagacugagacugagcagaggcggcggcgcccugaaggacggcgccggcauggugcagagagaggagcugcugagcuucaugggcgccgaggaggccgcccccgaccccgccggcgugggcagaggcggcggcguggccggcccccccagcggcggcggcggccagccccaguggcagaagugcagacugcugcugagaagcgagggcgagggcggcggcggcagcagacuggaguucuucgugccccccaaggccagcagacccagacugagcauccccugcagcagcaucaccgacgugagaaccaccaccgcccuggagaugcccgacagagagaacaccuucguggugaagguggagggccccagcgaguacaucauggagaccguggacgcccagcacgugaaggccugggugagcgacauccaggagugccugagccccggccccugccccgccaccagccccagacccaugacccugccccuggcccccggcaccagcuuccugaccagagagaacaccgacagccuggagcugagcugccugaaccacagcgagagccugcccagccaggaccugcugcugggccccagcgagagcaacgacagacugagccagggcgccuacggcggccugagcgacagacccagcgccagcaucagccccagcagcgccagcaucgccgccagccacuucgacagcauggagcugcugccccccgagcugccccccagaauccccaucgaggagggcccccccaccggcaccgugcacccccugagcgcccccuaccccccccuggacacccccgagaccgccaccggcagcuuccuguuccagggcgagcccgagggcggcgagggcgaccagccccugagcggcuaccccugguuccacggcaugcugagcagacugaaggccgcccagcuggugcugaccggcggcaccggcagccacggcguguuccuggugagacagagcgagaccagaagaggcgaguacgugcugaccuucaacuuccagggcaaggccaagcaccugagacugagccugaacgaggagggccagugcagagugcagcaccugugguuccagagcaucuucgacaugcuggagcacuucagagugcaccccaucccccuggagagcggcggcagcagcgacguggugcuggugagcuacgugcccagcagccagagacagcaggagcccaccaccagccacgaccccccccagccccccgagccccccagcuggaccgaccccccccagcccggcgccgaggaggccagcagagcccccgagguggccgccgccgccgccgccgccgccaaggagagacaggagaaggagaaggccggcggcggcggcgugcccgaggagcuggugcccgugguggagcuggugcccgugguggagcuggaggaggccaucgcccccggcagcgaggcccagggcgccggcagcggcggcgacgccggcgugccccccauggugcagcugcagcagagcccccugggcggcgacggcgaggagggcggccaccccagagccaucaacaaccaguacagcuucguguaa

SEQ ID NO: 23267 - RNA, 2028 nt, Artificial Sequence
  SH2B2__Homo_sapiens__NP_066189
auggaccccagcuacugccccgcccacggcuuccccagccaggacccccuguggccccugagcagccagcaguggagcagcgcccacuacagcgagcccgccgccggcggcugcgacggcaccgaggccaugaacggcgccggccccggccccgccgccgccgcccccgugcccgugcccgugcccgugcccgacuggagacaguucugcgagcugcacgcccaggccgccgccguggacuucgcccacaaguucugcagauuccugagagacaaccccgccuacgacacccccgacgccggcgccagcuucagcagacacuucgccgccaacuuccuggacguguucggcgaggaggugagaagagugcugguggccggccccaccaccagaggcgccgccgugagcgccgaggccauggagcccgagcuggccgacaccagcgcccugaaggccgcccccuacggccacagcagaagcagcgaggacgugagcacccacgccgccaccaaggccagagugagaaagggcuucagccugagaaacaugagccugugcgugguggacggcgugagagacauguggcacagaagagccagccccgagcccgacgccgccgccgcccccagaaccgccgagcccagagacaaguggaccagaagacugagacugagcagaacccuggccgccaagguggagcugguggacauccagagagagggcgcccugagauucaugguggccgacgacgccgccgccggcagcggcggcagcgcccaguggcagaagugcagacugcugcugagaagagccguggccgaggagagauucagacuggaguucuucgugccccccaaggccagcagacccaaggugagcaucccccugagcgccaucaucgaggugagaaccaccaugccccuggagaugcccgagaaggacaacaccuucgugcugaagguggagaacggcgccgaguacauccuggagaccaucgacagccugcagaagcacagcuggguggccgacauccagggcugcguggaccccggcgacagcgaggaggacaccgagcugagcugcaccagaggcggcugccuggccagcagaguggccagcugcagcugcgagcugcugaccgacgccguggaccugcccagaccccccgagaccaccgccgugggcgccguggugaccgccccccacagcagaggcagagacgccgugagagagagccugauccacgugccccuggagaccuuccugcagacccuggagagccccggcggcagcggcagcgacagcaacaacaccggcgagcagggcgccgagaccgaccccgaggccgagcccgagcuggagcugagcgacuaccccugguuccacggcacccugagcagagugaaggccgcccagcuggugcuggccggcggccccagaaaccacggccuguucgugaucagacagagcgagaccagacccggcgaguacgugcugaccuucaacuuccagggcaaggccaagcaccugagacugagccugaacggccacggccagugccacgugcagcaccugugguuccagagcgugcuggacaugcugagacacuuccacacccaccccaucccccuggagagcggcggcagcgccgacaucacccugagaagcuacgugagagcccaggaccccccccccgagcccggccccaccccccccgccgcccccgccagccccgccugcuggagcgacagccccggccagcacuacuucagcagccuggccgccgccgccugcccccccgccagccccagcgacgccgccggcgccagcagcagcagcgccagcagcagcagcgccgccagcggccccgccccccccagacccguggagggccagcugagcgccagaagcagaagcaacagcgccgagagacugcuggaggccguggccgccaccgccgccgaggagccccccgaggccgcccccggcagagccagagccguggagaaccaguacagcuucuacuaa

SEQ ID NO: 23268 - RNA, 1122 nt, Artificial Sequence
  SH2B3__Homo_sapiens__NP_001278353
augggcuuccccgugcugugcagaggcuggagaagaaccuggcccggcugcgccagcuggcugggcgccccccccccccagaagccccugcugagcccccugcugcugaaccacagaagcagcaagagcagcagacccaagcugcaggccgccugcagcagcauccaggaggugagauggugcaccagacuggagaugcccgacaaccuguacaccuucgugcugaaggugaaggacagaaccgacaucaucuucgaggugggcgacgagcagcagcugaacagcuggauggccgagcugagcgagugcaccggcagaggccuggagagcaccgaggccgagaugcacauccccagcgcccuggagcccagcaccagcagcagccccagaggcagcaccgacagccugaaccagggcgccagccccggcggccugcuggaccccgccugccagaagaccgaccacuuccugagcugcuaccccugguuccacggccccaucagcagagugaaggccgcccagcuggugcagcugcagggccccgacgcccacggcguguuccuggugagacagagcgagaccagaagaggcgaguacgugcugaccuucaacuuccagggcaucgccaagcaccugagacugagccugaccgagagaggccagugcagagugcagcaccugcacuuccccagcgugguggacaugcugcaccacuuccagagaagccccaucccccuggagugcggcgccgccugcgacgugagacugagcagcuacguggugguggugagccagccccccggcagcugcaacaccgugcuguuccccuucagccugccccacugggacagcgagagccugccccacuggggcagcgagcugggccugccccaccugagcagcagcggcugccccagaggccugagccccgagggccugcccggcagaagcagcccccccgagcagaucuuccaccuggugcccagccccgaggagcuggccaacagccugcagcaccuggagcacgagcccgugaacagagccagagacagcgacuacgagauggacagcagcagcagaagccaccugagagccaucgacaaccaguacaccccccuguaa

SEQ ID NO: 23269 - RNA, 378 nt, Artificial Sequence
  SH2D1A__Homo_sapiens__NP_001108409
auggacgccguggccguguaccacggcaagaucagcagagagaccggcgagaagcugcugcuggccaccggccuggacggcagcuaccugcugagagacagcgagagcgugcccggcguguacugccugugcgugcuguaccacggcuacaucuacaccuacagagugagccagaccgagaccggcagcuggagcgccgagaccgcccccggcgugcacaagagauacuucagaaagaucaagaaccugaucagcgccuuccagaagcccgaccagggcaucgugaucccccugcaguaccccguggagaagaagagcagcgccagaagcacccagggcaucagagaggaccccgacgugugccugaaggcccccuaa

SEQ ID NO: 23270 - RNA, 1200 nt, Artificial Sequence
  SH2D2A__Homo_sapiens__NP_001154913
auggaguucccccuggcccagaucugcccccagggcagccacgaggcccccauccccaccuucagcaccuuccagaucaccgacaugaccagaagaagcugccagaaccugggcuacaccgccgccagcccccaggcccccgaggccgccagcaacaccggcaacgccgagagagccgaggaggugcccggcgagggcagccuguuccugcaggccgagaccagagccugguuccagaagacccaggcccacuggcugcugcagcacggcgccgcccccgccugguuccacggcuucaucaccagaagagugagacccccccugagcgugacccacagagaggccgagagacugcuggagcccaagccccagggcugcuaccuggugagauucagcgagagcgccgugaccuucgugcugaccuacagaagcagaaccugcugcagacacuuccugcuggcccagcugagagacggcagacacguggugcugggcgaggacagcgcccacgccagacugcaggaccugcugcugcacuacaccgcccacccccugagccccuacggcgagacccugaccgagccccuggccagacagacccccgagcccgccggccugagccugagaaccgaggagagcaacuucggcagcaagagccaggaccccaacccccaguacagccccaucaucaagcagggccaggcccccgugcccaugcagaaggagggcgccggcgagaaggagcccagccagcugcugagacccaagccccccauccccgccaagccccagcugccccccgagguguacaccauccccgugcccagacacagacccgcccccagacccaagcccagcaaccccaucuacaacgagcccgacgagcccaucgccuucuacgccaugggcagaggcagccccggcgaggcccccagcaacaucuacguggagguggaggacgagggccugcccgccacccugggccaccccgugcugagaaagagcuggagcagacccgugcccggcggccagaacaccggcggcagccagcugcacagcgagaacagcgugaucggccagggccccccccugccccaccagcccccccccgccuggagacacacccugccccacaaccugagcagacaggugcugcaggacagaggccaggccuggcugccccugggccccccccaguaa

SEQ ID NO: 23271 - RNA, 1731 nt, Artificial Sequence
  SH2D3A__Homo_sapiens__NP_005481
augcaggugccccaggacggcgaggaccuggccggccagcccugguaccacggccugcugagcagacagaaggccgaggcccugcugcagcagaacggcgacuuccuggugagagccagcggcagcagaggcggcaaccccgugaucagcugcagauggagaggcagcgcccugcacuucgagguguucagaguggcccugagacccagacccggcagacccaccgcccuguuccagcuggaggacgagcaguuccccagcauccccgcccuggugcacagcuacaugaccggcagaagaccccugagccaggccaccggcgccguggugagcagacccgugaccuggcagggcccccugagaagaagcuucagcgaggacacccugauggacggccccgccagaaucgagccccugagagccagaaaguggagcaacagccagcccgccgaccuggcccacaugggcagaagcagagaggaccccgccggcauggaggccagcaccaugcccaucagcgcccugcccagaaccagcagcgaccccgugcugcugaaggcccccgccccccugggcaccguggccgacagccugagagccagcgacggccagcugcaggccaaggcccccaccaagccccccagaacccccagcuucgagcugcccgacgccagcgagagaccccccaccuacugcgagcuggugcccagagugcccagcgugcagggcaccagccccagccagagcugccccgagcccgaggcccccuggugggaggccgaggaggacgaggaggaggagaacagaugcuucaccagaccccaggccgagaucagcuucugcccccacgacgcccccagcugccugcugggcccccagaacagaccccuggagccccaggugcugcacacccugagaggccuguuccuggagcaccaccccggcagcaccgcccugcaccugcugcugguggacugccaggccaccggccugcugggcgugaccagagaccagagaggcaacaugggcgugagcagcggccuggagcugcugacccugccccacggccaccaccugagacuggagcugcuggagagacaccagacccuggcccuggccggcgcccuggccgugcugggcugcagcggcccccuggaggagagagccgccgcccugagaggccugguggagcuggcccuggcccugagacccggcgccgccggcgaccugcccggccuggccgccgugaugggcgcccugcugaugccccaggugagcagacuggagcacaccuggagacagcugagaagaagccacaccgaggccgcccuggccuucgagcaggagcugaagccccugaugagagcccuggacgagggcgccggccccugcgaccccggcgagguggcccugccccacguggcccccauggugagacugcuggagggcgaggagguggccggcccccuggacgagagcugcgagagacugcugagaacccugcacggcgccagacacauggugagagacgcccccaaguucagaaagguggccgcccagagacugagaggcuucagacccaaccccgagcugagagaggcccugaccaccggcuucgugagaagacugcuguggggcagcagaggcgccggcgcccccagagccgagagauucgagaaguuccagagagugcugggcgugcugagccagagacuggagcccgacagauaa

SEQ ID NO: 23272 - RNA, 2109 nt, Artificial Sequence
  SH2D3C__Homo_sapiens__NP_001136005
augaccgagagaugcagccuguggagcgcccugagcgccgccgccugcugcuucuacagaggcagcuucgugcaggugcaguucagcaaggagaaguacauccuggacagcagccccgagaagcugcacaaggagcuggaggaggagcugaagcugagcagcaccgaccugagaagccacgccugguaccacggcagaauccccagagaggugagcgagacccuggugcagagaaacggcgacuuccugaucagagacagccugaccagccugggcgacuacgugcugaccugcagauggagaaaccaggcccugcacuucaagaucaacaaggugguggugaaggccggcgagagcuacacccacauccaguaccuguucgagcaggagagcuucgaccacgugcccgcccuggugagauaccacgugggcagcagaaaggccgugagcgagcagagcggcgccaucaucuacugccccgugaacagaaccuucccccugagauaccuggaggccagcuacggccugggccagggcagcagcaagcccgccagccccgugagccccagcggccccaagggcagccacaugaagagaagaagcgugaccaugaccgacggccugaccgccgacaaggugaccagaagcgacggcugccccaccagcaccagccugcccagacccagagacagcaucagaagcugcgcccugagcauggaccagauccccgaccugcacagccccaugagccccaucagcgagagccccagcagccccgccuacagcaccgugaccagagugcacgccgcccccgccgcccccagcgccaccgcccugcccgccagccccguggccagaagaagcagcgagccccagcugugccccggcagcgcccccaagacccacggcgagagcgacaagggcccccacaccagccccagccacacccugggcaaggccagccccagccccagccugagcagcuacagcgaccccgacagcggccacuacugccagcugcagccccccgugagaggcagcagagagugggccgccaccgagaccagcagccagcaggccagaagcuacggcgagagacugaaggagcugagcgagaacggcgcccccgagggcgacuggggcaagaccuucaccgugcccaucguggaggugaccagcagcuucaaccccgccaccuuccagagccugcugauccccagagacaacagaccccuggaggugggccugcugagaaaggugaaggagcugcuggccgagguggacgccagaacccuggccagacacgugaccaagguggacugccugguggccagaauccugggcgugaccaaggagaugcagacccugaugggcgugagauggggcauggagcugcugacccugccccacggcagacagcugagacuggaccugcuggagagauuccacaccaugagcaucaugcuggccguggacauccugggcugcaccggcagcgccgaggagagagccgcccugcugcacaagaccauccagcuggccgccgagcugagaggcaccaugggcaacauguucagcuucgccgccgugaugggcgcccuggacauggcccagaucagcagacuggagcagaccugggugacccugagacagagacacaccgagggcgccauccuguacgagaagaagcugaagcccuuccugaagagccugaacgagggcaaggagggccccccccugagcaacaccaccuucccccacgugcugccccugaucacccugcuggagugcgacagcgccccccccgagggccccgagcccuggggcagcaccgagcacggcguggagguggugcuggcccaccuggaggccgccagaaccguggcccaccacggcggccuguaccacaccaacgccgaggugaagcugcagggcuuccaggccagacccgagcugcuggagguguucagcaccgaguuccagaugagacugcuguggggcagccagggcgccagcagcagccaggccagaagauacgagaaguucgacaaggugcugaccgcccugagccacaagcuggagcccgccgugagaagcagcgagcuguaa

SEQ ID NO: 23273 - RNA, 1365 nt, Artificial Sequence
  SH2D4A__Homo_sapiens__NP_001167630
augcugaagcagauccugagcgagauguacaucgaccccgaccugcuggccgagcugagcgaggagcagaagcagauccuguucuucaagaugagagaggagcagaucagaagauggaaggagagagaggccgccauggagagaaaggagagccugcccgugaagcccagacccaagaaggagaacggcaagagcgugcacuggaagcugggcgccgacaaggaggugugggugugggugaugggcgagcaccaccuggacaagcccuacgacgugcugugcaacgagaucaucgccgagagagccagacugaaggccgagcaggaggccgaggagcccagaaagacccacagcgaggaguucaccaacagccugaagaccaagagccaguaccacgaccugcaggcccccgacaaccagcagaccaaggacaucuggaagaagguggccgagaaggaggagcuggagcagggcagcagacccgcccccacccuggaggaggagaagaucagaagccugagcagcagcagcagaaacauccagcagaugcuggccgacagcaucaacagaaugaaggccuacgccuuccaccagaagaaggagagcaugaagaagaagcaggacgaggagaucaaccagaucgaggaggagagaaccaagcagaucugcaagagcuggaaggaggacagcgaguggcaggccagccugagaaagagcaaggccgccgacgagaagagaagaagccuggccaagcaggccagagaggacuacaagagacugagccugggcgcccagaagggcagaggcggcgagagacugcagagcccccugagagugccccagaagcccgagagacccccccugccccccaagccccaguuccugaacagcggcgccuacccccagaagccccugagaaaccagggcguggugagaacccugagcagcagcgcccaggaggacaucaucagaugguucaaggaggagcagcugccccugagagccggcuaccagaagaccagcgacaccaucgcccccugguuccacggcauccugacccugaagaaggccaacgagcugcugcugagcaccggcaugcccggcagcuuccugaucagagugagcgagagaaucaagggcuacgcccugagcuaccugagcgaggacggcugcaagcacuuccugaucgacgccagcgccgacgccuacagcuuccugggcguggaccagcugcagcacgccacccuggccgaccugguggaguaccacaaggaggagcccaucaccagccugggcaaggagcugcugcuguaccccugcggccagcaggaccagcugcccgacuaccuggagcuguucgaguaa

SEQ ID NO: 23274 - RNA, 930 nt, Artificial Sequence
  SH2D4B__Homo_sapiens__NP_001139191
augcugcccgaggacagcggcggcagccccgacgccgccgccagcgacaagcacauccaguggcugcugggcgccgacggcgagguguggguguggaucaugggcgagggccccggcgacaagcccuacgaggagaucagcgaggagcugaucgccgagagagccagacugcaggcccagagagaggccgaggagcuguggagacagaaggaggccgagaucaccaagaaguucagagacgcccuggccaacgagaaggccagaauccuggccgagaaguggaagguggagauggaggacagaaaggccgccaaggugcuggaggagagaauccacgaggaguucaagagaaaggaggaggaggagagaaagagaggcgaggagcagaucagacugcaggaggagcagagagccaaggagcuguacuggacccugaagcaggcccagcugcacugccaggccagcgagaaggaggagagagagugggaggagcagcugagaagaagcaaggccgccgacgaggagagaagcagaagagcccagagagccagagacgaguacagacaccacagccugagagccauccagaagggcaccguggccggccugagcagcauguucagagagcugggccagagccacgagcaggaggccagacuguaccaccaccugcccgaccccggccugccccagccccuggcccugcccgugagcagaaccugggagagaccccugagacccgugagcagagacgugaucgugagaugguucaaggaggagcagcugcccagaagagccggcuucgagagaaacaccaaguucaucgcccccugguuccacggcggcaacuaccacugcuucagaagaagagugaccagcggcacccugagaaccgagggccagcccaccagacugcccagcgugguguaa

SEQ ID NO: 23275 - RNA, 387 nt, Artificial Sequence
  SH3BGR__Homo_sapiens__NP_001001713
augagagagaacgugcccggcgagaagaagccccagaacggcaucccccugcccccccagaucuucaacgaggagcaguacugcggcgacuucgacagcuucuucagcgccaaggaggagaacaucaucuacagcuuccugggccuggcccccccccccgacagcaagggcagcgagaaggccgaggagggcggcgagaccgaggcccagaaggagggcagcgaggacgugggcaaccugcccgaggcccaggagaagaacgaggaggagggcgagaccgccaccgaggagaccgaggagaucgccauggagggcgccgagggcgaggccgaggaggaggaggagaccgccgagggcgaggagcccggcgaggacgaggacagcuaa

SEQ ID NO: 23276 - RNA, 324 nt, Artificial Sequence
  SH3BGRL2__Homo_sapiens__NP_113657
auggugaucagaguguucaucgccagcagcagcggcuucguggccaucaagaagaagcagcaggacguggugagauuccuggaggccaacaagaucgaguucgaggagguggacaucaccaugagcgaggagcagagacaguggauguacaagaacgugccccccgagaagaagcccacccagggcaacccccugcccccccagaucuucaacggcgacagauacugcggcgacuacgacagcuucuucgagagcaaggagagcaacaccguguucagcuuccugggccugaagcccagacuggccagcaaggccgagcccuaa

SEQ ID NO: 23277 - RNA, 345 nt, Artificial Sequence
  SH3BGRL__Homo_sapiens__NP_003013
auggugaucagaguguacaucgccagcagcagcggcagcaccgccaucaagaagaagcagcaggacgugcugggcuuccuggaggccaacaagaucggcuucgaggagaaggacaucgccgccaacgaggagaacagaaaguggaugagagagaacgugcccgagaacagcagacccgccaccggcuacccccugcccccccagaucuucaacgagagccaguacagaggcgacuacgacgccuucuucgaggccagagagaacaacgccguguacgccuuccugggccugaccgccccccccggcagcaaggaggccgaggugcaggccaagcagcaggccuaa

SEQ ID NO: 23278 - RNA, 2106 nt, Artificial Sequence
  SH3BP1__Homo_sapiens__NP_061830
augaugaagagacagcugcacagaaugagacagcuggcccagaccggcagccugggcagaacccccgagaccgccgaguuccugggcgaggaccugcugcagguggagcagagacuggagcccgccaagagagccgcccacaacauccacaagagacugcaggccugccugcagggccagagcggcgccgacauggacaagagagugaagaagcugccccugauggcccugagcaccaccauggccgagagcuucaaggagcuggaccccgacagcagcaugggcaaggcccuggagaugagcugcgccauccagaaccagcuggccagaauccuggccgaguucgagaugacccuggagagagacgugcugcagccccugagcagacugagcgaggaggagcugcccgccauccugaagcacaagaagagccugcagaagcuggugagcgacuggaacacccugaagagcagacugagccaggccaccaagaacagcggcagcagccagggccugggcggcagccccggcagccacagccacaccaccauggccaacaagguggagacccugaaggaggaggaggaggagcugaagagaaagguggagcagugcagagacgaguaccuggccgaccuguaccacuucgugaccaaggaggacagcuacgccaacuacuucaucagacugcuggagauccaggccgacuaccacagaagaagccugagcagccuggacaccgcccuggccgagcugagagagaaccacggccaggccgaccacagccccagcaugaccgccacccacuuccccagaguguacggcgugagccuggccacccaccugcaggagcugggcagagagaucgcccugcccaucgaggccugcgugaugaugcugcugagcgagggcaugaaggaggagggccuguucagacuggccgccggcgccagcgugcugaagagacugaagcagaccauggccagcgacccccacagccuggaggaguucugcagcgacccccacgccguggccggcgcccugaagagcuaccugagagagcugcccgagccccugaugaccuucgaccuguacgacgacuggaugagagccgccagccugaaggagcccggcgccagacugcaggcccugcaggaggugugcagcagacugccccccgagaaccugagcaaccugagauaccugaugaaguuccuggccagacuggccgaggagcaggaggugaacaagaugacccccagcaacaucgccaucgugcugggccccaaccugcuguggccccccgagaaggagggcgaccaggcccagcuggacgccgccagcgugagcagcauccagguggugggcgugguggaggcccugauccagagcgccgacacccuguuccccggcgacaucaacuucaacgugagcggccuguucagcgccgugacccugcaggacaccgugagcgacagacuggccagcgaggagcugcccagcaccgccgugcccacccccgccaccacccccgcccccgcccccgcccccgcccccgcccccgcccccgcccuggccagcgccgccaccaaggagagaaccgagagcgaggugccccccagacccgccagccccaaggugaccagaagcccccccgagaccgccgcccccguggaggacauggccagaagaaccaagagacccgcccccgccagacccaccaugccccccccccaggugagcggcagcagaagcagcccccccgcccccccccugccccccggcagcggcagccccggcaccccccaggcccugcccagaagacuggugggcagcagccugagagcccccaccgugccccccccccugccccccacccccccccagcccgccagaagacagagcagaagaagccccgccagccccagccccgccagccccggccccgccagccccagccccgugagccugagcaaccccgcccagguggaccugggcgccgccaccgccgagggcggcgcccccgaggccaucagcggcgugcccaccccccccgccauccccccccagcccagacccagaagccuggccagcgagaccaacuaa

SEQ ID NO: 23279 - RNA, 1770 nt, Artificial Sequence
  SH3BP2__Homo_sapiens__NP_001139327
auggccagccugggccccagaacccccgcccccagcagaagcagaggcagaagagccaugugcugggugagcaccaucagcuucauggccgccgaggagaugcacuggcccgugcccaugaaggccaucggcgcccagaaccugcugaccaugcccggcggcguggccaaggccggcuaccugcacaagaagggcggcacccagcugcagcugcugaaguggccccugagauucgugaucauccacaagagaugcguguacuacuucaagagcagcaccagcgccagcccccagggcgccuucagccugagcggcuacaacagagugaugagagccgccgaggagaccaccagcaacaacguguuccccuucaagaucauccacaucagcaagaagcacagaaccugguucuucagcgccagcagcgaggaggagagaaagagcuggauggcccugcugagaagagagaucggccacuuccacgagaagaaggaccugccccuggacaccagcgacagcagcagcgacaccgacagcuucuacggcgccguggagagacccguggacaucagccugagccccuaccccaccgacaacgaggacuacgagcacgacgacgaggacgacagcuaccuggagcccgacagccccgagcccggcagacuggaggacgcccugaugcacccccccgccuacccccccccccccgugcccacccccagaaagcccgccuucagcgacaugcccagagcccacagcuucaccagcaagggccccggcccccugcugcccccccccccccccaagcacggccugcccgacgugggccuggccgccgaggacagcaagagagacccccugugccccagaagagccgagcccugccccagagugcccgccacccccagaagaaugagcgaccccccccugagcaccaugcccaccgcccccggccugagaaagccccccugcuucagagagagcgccagccccagccccgagcccuggacccccggccacggcgccugcagcaccagcagcgccgccaucauggccaccgccaccagcagaaacugcgacaagcugaagagcuuccaccugagccccagaggcccccccaccagcgagcccccccccgugcccgccaacaagcccaaguuccugaagaucgccgaggaggacccccccagagaggccgccaugcccggccuguucgugccccccguggcccccagaccccccgcccugaagcugcccgugcccgaggccauggccagacccgccgugcugcccagacccgagaagccccagcugccccaccugcagagaagcccccccgacggccagagcuucagaagcuucagcuucgagaagcccagacagcccagccaggccgacaccggcggcgacgacagcgacgaggacuacgagaaggugccccugcccaacagcguguucgugaacaccaccgagagcugcgagguggagagacuguucaaggccaccagccccagaggcgagccccaggacggccuguacugcaucagaaacagcagcaccaagagcggcaaggugcugguggugugggacgagaccagcaacaaggugagaaacuacagaaucuucgagaaggacagcaaguucuaccuggagggcgaggugcuguucgugagcgugggcagcaugguggagcacuaccacacccacgugcugcccagccaccagagccugcugcugagacaccccuacggcuacaccggccccagauaa

SEQ ID NO: 23280 - RNA, 2892 nt, Artificial Sequence
  SH3BP4__Homo_sapiens__XP_011509196
auggccgcccagagaaucagagccgccaacagcaacggccugcccagaugcaagagcgagggcacccugaucgaccugagcgagggcuucagcgagaccagcuucaacgacaucaaggugcccagccccagcgcccugcugguggacaaccccacccccuucggcaacgccaaggaggugaucgccaucaaggacuacugccccaccaacuucaccacccugaaguucagcaagggcgaccaccuguacgugcuggacaccagcggcggcgaguggugguacgcccacaacaccaccgagaugggcuacauccccagcagcuacgugcagccccugaacuacagaaacagcacccugagcgacagcggcaugaucgacaaccugcccgacagccccgacgagguggccaaggagcuggagcugcugggcggcuggaccgacgacaagaaggugcccggcagaauguacagcaacaaccccuucuggaacggcgugcagaccaaccccuuccugaacggcaacgugcccgugaugcccagccuggacgagcugaaccccaagagcaccguggaccugcugcuguucgacgccggcaccagcagcuucaccgagagcagcagcgccaccaccaacagcaccggcaacaucuucgacgagcugcccgugaccaacggccugcacgccgagccccccgugagaagagacaaccccuucuucagaagcaagagaagcuacagccugagcgagcugagcgugcugcaggccaagagcgacgcccccaccagcagcagcuucuucaccggccugaagagccccgcccccgagcaguuccagagcagagaggacuucagaaccgccuggcugaaccacagaaagcuggccagaagcugccacgaccuggaccugcugggccagagccccggcuggggccagacccaggccguggagaccaacaucgugugcaagcuggacagcagcggcggcgccgugcagcugcccgacaccagcaucagcauccacgugcccgagggccacguggcccccggcgagacccagcagaucagcaugaaggcccugcuggaccccccccuggagcugaacagcgacagaagcugcagcaucagccccgugcuggaggugaagcugagcaaccuggaggugaagaccagcaucauccuggagaugaaggugagcgccgagaucaagaacgaccuguucagcaagagcaccgugggccugcagugccugagaagcgacagcaaggagggccccuacgugagcgugccccugaacugcagcugcggcgacaccgugcaggcccagcugcacaaccuggagcccugcauguacguggccgugguggcccacggccccagcauccuguaccccagcaccgugugggacuucaucaacaagaaggugaccgugggccuguacggccccaagcacauccaccccagcuucaagaccguggugaccaucuucggccacgacugcgcccccaagacccugcuggugagcgaggugaccagacaggcccccaaccccgcccccguggcccugcagcuguggggcaagcaccaguucgugcugagcagaccccaggaccugaaggugugcauguucagcaacaugaccaacuacgaggugaaggccagcgagcaggccaagguggugagaggcuuccagcugaagcugggcaaggugagcagacugaucuuccccaucaccagccagaaccccaacgagcugagcgacuucacccugagagugcaggugaaggacgaccaggaggccauccugacccaguucugcgugcagaccccccagcccccccccaagagcgccaucaagcccagcggccagagaagauuccugaagaagaacgaggugggcaagaucauccugagccccuucgccaccaccaccaaguaccccaccuuccaggacagacccgugagcagccugaaguucggcaagcugcugaagaccguggugagacagaacaagaaccacuaccugcuggaguacaagaagggcgacggcaucgcccugcugagcgaggagagagugagacugagaggccagcuguggaccaaggagugguacaucggcuacuaccagggcagagugggccuggugcacaccaagaacgugcugguggugggcagagccagacccagccugugcagcggccccgagcugagcaccagcgugcugcuggagcagauccugagacccugcaaguuccugaccuacaucuacgccagcgugagaacccugcugauggagaacaucagcagcuggagaagcuucgccgacgcccugggcuacgugaaccugccccugaccuucuucugcagagccgagcuggacagcgagcccgagagaguggccagcgugcuggagaagcugaaggaggacugcaacaacaccgagaacaaggagagaaagagcuuccagaaggagcuggugauggcccugcugaagauggacugccagggccugguggugagacugauccaggacuucgugcugcugaccaccgccguggagguggcccagagauggagagagcuggccgagaagcuggccaaggugagcaagcagcagauggacgccuacgagagcccccacagagacagaaacggcgugguggacagcgaggccauguggaagcccgccuacgacuuccugcugaccuggagccaccagaucggcgacagcuacagagacgugauccaggagcugcaccugggccuggacaagaugaagaaccccaucaccaagagauggaagcaccugaccggcacccugauccuggugaacagccuggacgugcugagagccgccgccuucagccccgccgaccaggacgacuucgugaucuaa

SEQ ID NO: 23281 - RNA, 897 nt, Artificial Sequence
  SH3BP5__Homo_sapiens__NP_001018009
augcugaaccacgccacccagagagugauggaggccgagcagaccaagaccagaagcgagcuggugcacaaggagaccgccgccagauacaacgccgccaugggcagaaugagacagcuggagaagaagcugaagagagccaucaacaagagcaagcccuacuucgagcugaaggccaaguacuacgugcagcuggagcagcugaagaagaccguggacgaccugcaggccaagcugacccuggccaagggcgaguacaagauggcccugaagaaccuggagaugaucagcgacgagauccacgagagaagaagaagcagcgccaugggccccagaggcugcggcgugggcgccgagggcagcagcaccagcguggaggaccugcccggcagcaagcccgagcccgacgccaucagcguggccagcgaggccuucgaggacgacagcugcagcaacuucgugagcgaggacgacagcgagacccagagcgugagcagcuucagcagcggccccaccagccccagcgagaugcccgaccaguuccccgccguggugagacccggcagccuggaccugcccagccccgugagccugagcgaguucggcaugauguuccccgugcugggccccagaagcgagugcagcggcgccagcagccccgagugcgagguggagagaggcgacagagccgagggcgccgagaacaagaccagcgacaaggccaacaacaacagaggccugagcagcagcagcggcagcggcggcagcagcaagagccagagcagcaccagccccgagggccaggcccuggagaacagaaugaagcagcugagccugcagugcagcaagggcagagacggcaucaucgccgacaucaagauggugcagaucggcuaa

SEQ ID NO: 23282 - RNA, 2373 nt, Artificial Sequence
  SH3D19__Homo_sapiens__NP_001009555
augaacaucaugaacaccgagcagagccagaacagcaucgugagcagaaucaagguguucgagggccagaccaacaucgagaccagcggccugcccaagaagcccgagaucacccccagaagccugccccccaagcccaccgugagcagcggcaagcccagcguggcccccaagcccgccgccaacagagccagcggcgagugggacagcggcaccgagaacagacugaaggugaccagcaaggagggccugacccccuaccccccccugcaggaggccggcagcauccccgugaccaagcccgagcugcccaagaagcccaaccccggccugaucagaagcgugaaccccgagauccccggcagaggcccccuggccgagagcagcgacagcggcaagaaggugcccacccccgcccccagaccccugcugcugaagaagagcgugagcagcgagaaccccaccuaccccagcgccccccugaagcccgugaccgugccccccagacuggccggcgccagccaggccaaggccuacaagagccugggcgagggcccccccgccaacccccccgugcccgugcugcagagcaagccccugguggacaucgaccugaucagcuucgacgacgacgugcugcccacccccagcggcaaccuggccgaggagagcgugggcagcgagauggugcuggaccccuuccagcugcccgccaagaccgagcccaucaaggagagagccgugcagcccgcccccaccagaaagcccaccgugaucagaauccccgccaagcccggcaagugccugcacgaggacccccagagcccccccccccugcccgccgagaagcccaucggcaacaccuucagcaccgugagcggcaagcugagcaacguggagagaaccagaaaccuggagagcaaccaccccggccagaccggcggcuucgugagagugccccccagacugccccccagacccgugaacggcaagaccauccccacccagcagccccccaccaaggugccccccgagagaccccccccccccaagcugagcgccaccagaagaagcaacaagaagcugcccuucaacagaagcagcagcgacauggaccugcagaagaagcagagcaaccuggccaccggccugagcaaggccaagagccagguguucaagaaccaggaccccgugcugccccccagacccaagcccggccacccccuguacagcaaguacaugcugagcgugccccacggcaucgccaacgaggacaucgugagccagaaccccggcgagcugagcugcaagagaggcgacgugcuggugaugcugaagcagaccgagaacaacuaccuggagugccagaagggcgaggacaccggcagagugcaccugagccagaugaagaucaucaccccccuggacgagcaccugagaagcagacccaacgaccccagccacgcccagaagcccguggacagcggcgccccccacgccguggugcugcacgacuuccccgccgagcagguggacgaccugaaccugaccagcggcgagaucguguaccugcuggagaagaucgacaccgacugguacagaggcaacugcagaaaccagaucggcaucuuccccgccaacuacgugaaggugaucaucgacauccccgagggcggcaacggcaagagagagugcgugagcagccacugcgugaagggcagcagaugcguggccagauucgaguacaucggcgagcagaaggacgagcugagcuucagcgagggcgagaucaucauccugaaggaguacgugaacgaggagugggccagaggcgaggugagaggcagaaccggcaucuucccccugaacuucguggagcccguggaggacuaccccaccagcggcgccaacgugcugagcaccaaggugccccugaagaccaagaaggaggacagcggcagcaacagccaggugaacagccugcccgccgaguggugcgaggcccugcacagcuucaccgccgagaccagcgacgaccugagcuucaagagaggcgacagaauccagauccuggagagacuggacagcgacuggugcagaggcagacugcaggacagagagggcaucuuccccgccguguucgugagacccugccccgccgaggccaagagcaugcuggccaucgugcccaagggcagaaaggccaaggcccuguacgacuucagaggcgagaacgaggacgagcugagcuucaaggccggcgacaucaucaccgagcuggagagcguggacgacgacuggaugagcggcgagcugaugggcaagagcggcaucuuccccaagaacuacauccaguuccugcagaucagcuaa

SEQ ID NO: 23283 - RNA, 963 nt, Artificial Sequence
  SH3GL1__Homo_sapiens__NP_001186872
augagcguggccggccugaagaagcaguucuacaaggccagccagcuggugagcgagaaggugggcggcgccgagggcaccaagcuggacgacgacuucaaggagauggagaagaagguggacgugaccagcaaggccgugaccgaggugcuggccagaaccaucgaguaccugcagcccaaccccggcgacgcccugcuggacgccggcgagagcaugaagagacuggccgaggugaaggacagccuggacaucgaggugaagcagaacuucaucgacccccugcagaaccugugcgagaaggaccugaaggagauccagcaccaccugaagaagcuggagggcagaagacuggacuucgacuacaagaagaagagacagggcaagauccccgacgaggagcugagacaggcccuggagaaguucgaggagagcaaggagguggccgagaccagcaugcacaaccugcuggagaccgacaucgagcaggugagccagcugagcgcccugguggacgcccagcuggacuaccacagacaggccgugcagauccuggacgagcuggccgagaagcugaagagaagaaugagagaggccagcagcagacccaagagagaguacaagcccaagcccagagagcccuucgaccugggcgagcccgagcagagcaacggcggcuuccccugcaccaccgcccccaagaucgccgccagcagcagcuucagaagcagcgacaagcccaucagaacccccagcagaagcaugcccccccuggaccagcccagcugcaaggcccuguacgacuucgagcccgagaacgacggcgagcugggcuuccacgagggcgacgugaucacccugaccaaccagaucgacgagaacugguacgagggcaugcuggacggccagagcggcuucuucccccugagcuacguggaggugcuggugccccugccccaguaa

SEQ ID NO: 23284 - RNA, 1059 nt, Artificial Sequence
  SH3GL2__Homo_sapiens__NP_003017
augagcguggccggccugaagaagcaguuccacaaggccacccagaaggugagcgagaaggugggcggcgccgagggcaccaagcuggacgacgacuucaaggagauggagagaaagguggacgugaccagcagagccgugauggagaucaugaccaagaccaucgaguaccugcagcccaaccccgccagcagagccaagcugagcaugaucaacaccaugagcaagaucagaggccaggagaagggccccggcuacccccaggccgaggcccugcuggccgaggccaugcugaaguucggcagagagcugggcgacgacugcaacuucggccccgcccugggcgaggugggcgaggccaugagagagcugagcgaggugaaggacagccuggacaucgaggugaagcagaacuucaucgacccccugcagaaccugcacgacaaggaccugagagagauccagcaccaccugaagaagcuggagggcagaagacuggacuucgacuacaagaagaagagacagggcaagauccccgacgaggagcugagacaggcccuggagaaguucgacgagagcaaggagaucgccgagagcagcauguucaaccugcuggagauggacaucgagcaggugagccagcugagcgcccuggugcaggcccagcuggaguaccacaagcaggccgugcagauccugcagcaggugaccgugagacuggaggagagaaucagacaggccagcagccagcccagaagagaguaccagcccaagcccagaaugagccuggaguuccccaccggcgacagcacccagcccaacggcggccugagccacaccggcacccccaagcccagcggcgugcagauggaccagcccugcugcagagcccuguacgacuucgagcccgagaacgagggcgagcugggcuucaaggagggcgacaucaucacccugaccaaccagaucgacgagaacugguacgagggcaugcugcacggccacagcggcuucuuccccaucaacuacguggagauccugguggcccugccccacuaa

SEQ ID NO: 23285 - RNA, 1068 nt, Artificial Sequence
  SH3GL3__Homo_sapiens__NP_001288038
auggacggcaucuucgccggcaucaucugcaaccaggccaacagaugccugaccuggaccagccagcagcuguucagcgagaagaucagcggcgccgagggcaccaagcuggacgacgaguuccuggacauggagagaaagaucgacgugaccaacaaggugguggccgagauccugagcaagaccaccgaguaccugcagcccaaccccgccuacagagccaagcugggcaugcugaacaccgugagcaagaucagaggccaggugaagaccaccggcuacccccagaccgagggccugcugggcgacugcaugcugaaguacggcaaggagcugggcgaggacagcaccuucggcaacgcccugaucgaggugggcgagagcaugaagcugauggccgaggugaaggacagccuggacaucaacgugaagcagaccuucaucgacccccugcagcugcugcaggacaaggaccugaaggagaucggccaccaccugaagaagcuggagggcagaagacuggacuacgacuacaagaagaagagagugggcaagauccccgacgaggaggugagacaggccguggagaaguucgaggagagcaaggagcuggccgagagaagcauguucaacuuccuggagaacgacguggagcaggugagccagcuggccguguucaucgaggccgcccuggacuaccacagacagagcaccgagauccugcaggagcugcagagcaagcugcagaugagaaucagcgccgccagcagcgugcccagaagagaguacaagcccagacccgugaagagaagcagcagcgagcugaacggcgugagcaccaccagcguggugaagaccaccggcagcaacauccccauggaccagcccugcugcagaggccuguacgacuucgagcccgagaaccagggcgagcugggcuucaaggagggcgacaucaucacccugaccaaccagaucgacgagaacugguacgagggcaugauccacggcgagagcggcuucuuccccaucaacuacguggaggugaucgugccccugccccaguaa

SEQ ID NO: 23286 - RNA, 1887 nt, Artificial Sequence
  SH3KBP1__Homo_sapiens__NP_001019837
auggaggugagcgccgccaaggcccccagcgccgccgaccugagcgagaucgagaucaagaaggagaugaagaaggacccccugaccaacaaggcccccgagaagccccugcacgaggugcccagcggcaacagccugcugagcagcgagaccauccugagaaccaacaagagaggcgagagaagaagaagaagaugccagguggccuucagcuaccugccccagaacgacgacgagcuggagcugaaggugggcgacaucaucgagguggugggcgagguggaggagggcuggugggagggcgugcugaacggcaagaccggcauguuccccagcaacuucaucaaggagcugagcggcgagagcgacgagcugggcaucagccaggacgagcagcugagcaagagcagccugagagagaccaccggcagcgagagcgacggcggcgacagcagcagcaccaagagcgagggcgccaacggcaccguggccaccgccgccauccagcccaagaaggugaagggcgugggcuucggcgacaucuucaaggacaagcccaucaagcugagacccagaagcaucgagguggagaacgacuuccugcccguggagaagaccaucggcaagaagcugcccgccaccaccgccacccccgacagcagcaagaccgagauggacagcagaaccaagagcaaggacuacugcaaggugaucuuccccuacgaggcccagaacgacgacgagcugaccaucaaggagggcgacaucgugacccugaucaacaaggacugcaucgacgugggcuggugggagggcgagcugaacggcagaagaggcguguuccccgacaacuucgugaagcugcugccccccgacuucgagaaggagggcaacagacccaagaagccccccccccccagcgcccccgugaucaagcagggcgccggcaccaccgagagaaagcacgagaucaagaagaucccccccgagagacccgagaugcugcccaacagaaccgaggagaaggagagacccgagagagagcccaagcuggaccugcagaagcccagcgugcccgccaucccccccaagaagcccagaccccccaagaccaacagccugagcagacccggcgcccugccccccagaagacccgagagacccgugggcccccugacccacaccagaggcgacagccccaagaucgaccuggccggcagcagccugagcggcauccuggacaaggaccugagcgacagaagcaacgacaucgaccuggagggcuucgacagcguggugagcagcaccgagaagcugagccaccccaccaccagcagacccaaggccaccggcagaagaccccccagccagagccugaccagcagcagccugagcagccccgacaucuucgacagccccagccccgaggaggacaaggaggagcacaucagccuggcccacagaggcguggacgccagcaagaagaccagcaagaccgugaccaucagccaggugagcgacaacaaggccagccugccccccaagcccggcaccauggccgccggcggcggcggccccgccccccugagcagcgccgcccccagcccccugagcagcagccugggcaccgccggccacagagccaacagccccagccuguucggcaccgagggcaagcccaagauggagcccgccgccagcagccaggccgccguggaggagcugagaacccaggugagagagcugagaagcaucaucgagaccaugaaggaccagcagaagagagagaucaagcagcugcugagcgagcuggacgaggagaagaagaucagacugagacugcagauggaggugaacgacaucaagaaggcccugcagagcaaguaa

SEQ ID NO: 23287 - RNA, 3318 nt, Artificial Sequence
  SH3PXD2A__Homo_sapiens__NP_055446
augcuggccuacugcgugcaggacgccaccgugguggacguggagaagagaagaaaccccagcaagcacuacguguacaucaucaacgugaccuggagcgacagcaccagccagaccaucuacagaagauacagcaaguucuucgaccugcagaugcagcugcuggacaaguuccccaucgagggcggccagaaggaccccaagcagagaaucauccccuuccugcccggcaagauccuguucagaagaagccacaucagagacguggccgugaagagacugaagcccaucgacgaguacugcagagcccuggugagacugcccccccacaucagccagugcgacgagguguucagauucuucgaggccagacccgaggacgugaacccccccaaggaggacuacggcagcagcaagagaaagagcguguggcugagcagcugggccgagagccccaagaaggacgugaccggcgccgacgccaccgccgagcccaugauccuggagcaguacgugguggugagcaacuacaagaagcaggagaacagcgagcugagccugcaggccggcgaggugguggacgugaucgagaagaacgagagcggcuggugguucgugagcaccagcgaggagcagggcugggugcccgccaccuaccuggaggcccagaacggcaccagagacgacagcgacaucaacaccagcaagaccggcgaggaggagaaguacgugaccgugcagcccuacaccagccagagcaaggacgagaucggcuucgagaagggcgugaccguggaggugaucagaaagaaccuggagggcuggugguacaucagauaccugggcaaggagggcugggcccccgccagcuaccugaagaaggccaaggacgaccugcccaccagaaagaagaaccuggccggccccguggagaucaucggcaacaucauggagaucagcaaccugcugaacaagaaggccagcggcgacaaggagaccccccccgccgagggcgagggccacgaggcccccaucgccaagaaggagaucagccugcccauccugugcaacgccagcaacggcagcgccgugggcgugcccgacagaaccgugagcagacuggcccagggcagccccgccguggccagaaucgccccccagagagcccagaucagcagccccaaccugagaaccagacccccccccagaagagagagcagccugggcuuccagcugcccaagccccccgagccccccagcguggagguggaguacuacaccaucgccgaguuccagagcugcaucagcgacggcaucagcuucagaggcggccagaaggccgaggugaucgacaagaacagcggcggcuggugguacgugcagaucggcgagaaggagggcugggcccccgccagcuacaucgacaagagaaagaagcccaaccugagcagaagaaccagcacccugaccagacccaaggugcccccccccgccccccccagcaagcccaaggaggccgaggagggccccaccggcgccagcgagagccaggacagccccagaaagcugaaguacgaggagcccgaguacgacauccccgccuucggcuucgacagcgagcccgagcugagcgaggagcccguggaggacagagccagcggcgagagaagacccgcccagccccacagacccagccccgccagcagccugcagagagccagauucaaggugggcgagagcagcgaggacguggcccuggaggaggagaccaucuacgagaacgagggcuucagacccuacgccgaggacacccugagcgccagaggcagcagcggcgacagcgacagccccggcagcagcagccugagccugaccagaaagaacagccccaagagcggcagccccaagagcagcagccugcugaagcugaaggccgagaagaacgcccaggccgagaugggcaagaaccacagcagcgccagcuucagcagcagcaucaccaucaacaccaccugcugcagcagcagcagcagcagcagcagcagccugagcaagaccagcggcgaccugaagcccagaagcgccagcgacgccggcaucagaggcacccccaaggugagagccaagaaggacgccgacgccaacgccggccugaccagcugccccagagccaagcccagcgugagacccaagcccuuccugaacagagccgagagccagagccaggagaagauggacaucagcacccugagaagacagcugagacccaccggccagcugagaggcggccugaagggcagcaagagcgaggacagcgagcugcccccccagaccgccagcgaggcccccagcgagggcagcagaagaagcagcagcgaccugaucacccugcccgccaccaccccccccugccccaccaagaaggagugggagggccccgccaccagcuacaugaccugcagcgccuaccagaaggugcaggacagcgagaucagcuuccccgccggcguggaggugcaggugcuggagaagcaggagagcggcuggugguacgugagauucggcgagcuggagggcugggcccccagccacuaccuggugcuggacgagaacgagcagcccgaccccagcggcaaggagcuggacaccgugcccgccaagggcagacagaacgagggcaagagcgacagccuggagaagaucgagagaagagugcaggcccugaacaccgugaaccagagcaagaaggccaccccccccauccccagcaagccccccggcggcuucggcaagaccagcggcacccccgccgugaagaugagaaacggcgugagacagguggccgugagaccccagagcguguucgugagccccccccccaaggacaacaaccugagcugcgcccugagaagaaacgagagccugaccgccaccgacggccugagaggcgugagaagaaacagcagcuucagcaccgccagaagcgccgccgccgaggccaagggcagacuggccgagagagccgccagccagggcagcgacagcccccugcugcccgcccagagaaacagcauccccgugagccccgugagacccaagcccaucgagaagagccaguucauccacaacaaccugaaggacguguacgugagcaucgccgacuacgagggcgacgaggagaccgccggcuuccaggagggcgugagcauggaggugcuggagagaaaccccaacggcuggugguacugccagauccuggacggcgugaagcccuucaagggcugggugcccagcaacuaccuggagaagaagaacuaa

SEQ ID NO: 23288 - RNA, 2736 nt, Artificial Sequence
  SH3PXD2B__Homo_sapiens__NP_001017995
augccccccagaagaagcaucguggaggugaaggugcuggacgugcagaagagaagagugcccaacaagcacuacguguacaucaucagagugaccuggagcagcggcagcaccgaggccaucuacagaagauacagcaaguucuucgaccugcagaugcagaugcuggacaaguuccccauggagggcggccagaaggaccccaagcagagaaucauccccuuccugcccggcaagauccuguucagaagaagccacaucagagacguggccgugaagagacugauccccaucgacgaguacugcaaggcccugauccagcugccccccuacaucagccagugcgacgaggugcugcaguucuucgagaccagacccgaggaccugaacccccccaaggaggagcacaucggcaagaagaagagcggcggcgaccagaccagcguggaccccauggugcuggagcaguacguggugguggccaacuaccagaagcaggagagcagcgagaucagccugagcgugggccaggugguggacaucaucgagaagaacgagagcggcuggugguucgugagcaccgccgaggagcagggcugggugcccgccaccugccuggagggccaggacggcgugcaggacgaguucagccugcagcccgaggaggaggagaaguacaccgugaucuaccccuacaccgccagagaccaggacgagaugaaccuggagagaggcgccgugguggaggugauccagaagaaccuggagggcugguggaagaucagauaccagggcaaggagggcugggcccccgccagcuaccugaagaagaacagcggcgagccccugccccccaagcccggccccggcagccccagccaccccggcgcccuggaccuggacggcgugagcagacagcagaacgccgugggcagagagaaggagcugcugagcagccagagagacggcagauucgagggcagacccgugcccgacggcgacgccaagcagagaagccccaagaugagacagagacccccccccagaagagacaugaccauccccagaggccugaaccugcccaagccccccauccccccccagguggaggaggaguacuacaccaucgccgaguuccagaccaccauccccgacggcaucagcuuccaggccggccugaagguggaggugaucgagaagaaccugagcggcuggugguacauccagaucgaggacaaggagggcugggcccccgccaccuucaucgacaaguacaagaagaccagcaacgccagcagacccaacuuccuggccccccugccccacgaggugacccagcugagacugggcgaggccgccgcccuggagaacaacaccggcagcgaggccaccggccccagcagaccccugcccgacgccccccacggcgugauggacagcggccugcccuggagcaaggacuggaagggcagcaaggacgugcugagaaaggccagcagcgacaugagcgccagcgccggcuacgaggagaucagcgaccccgacauggaggagaagcccagccugccccccagaaaggagagcaucaucaagagcgagggcgagcugcuggagagagagagagagagacagagaaccgagcagcugagaggccccacccccaagccccccggcgugauccugcccaugaugcccgccaagcacaucccccccgccagagacagcagaagacccgagcccaagcccgacaagagcagacuguuccagcugaagaacgacaugggccuggagugcggccacaaggugcuggccaaggaggugaagaagcccaaccugagacccaucagcaagagcaagaccgaccugcccgaggagaagcccgacgccaccccccagaaccccuuccugaagagcagaccccaggugagacccaagcccgcccccagccccaagaccgagcccccccagggcgaggaccagguggacaucugcaaccugagaagcaagcugagacccgccaagagccaggacaagagccugcuggacggcgagggcccccaggccgugggcggccaggacguggccuucagcagaagcuuccugcccggcgagggccccggcagagcccaggacagaaccggcaagcaggacggccugagccccaaggagaucagcugcagagccccccccagacccgccaagaccaccgaccccgugagcaagagcgugcccgugccccugcaggaggccccccagcagagacccguggugccccccagaagaccccccccccccaagaagaccagcagcagcagcagaccccugcccgaggugagaggcccccagugcgagggccacgagagcagagccgcccccacccccggcagagcccugcuggugccccccaaggccaagcccuuccugagcaacagccugggcggccaggacgacaccagaggcaagggcagccugggccccuggggcaccggcaagaucggcgagaacagagagaaggccgccgccgccagcgugcccaacgccgacggccugaaggacagccuguacguggccguggccgacuucgagggcgacaaggacaccagcagcuuccaggagggcaccguguucgaggugagagagaagaacagcagcggcuggugguucugccaggugcugagcggcgcccccagcugggagggcuggauccccagcaacuaccugagaaagaagcccuaa

SEQ ID NO: 23289 - RNA, 2667 nt, Artificial Sequence
  SH3RF1__Homo_sapiens__NP_065921
auggacgagagcgcccugcuggaccugcuggagugccccgugugccuggagagacuggacgccagcgccaaggugcugcccugccagcacaccuucugcaagagaugccugcugggcaucgugggcagcagaaacgagcugagaugccccgagugcagaacccuggugggcagcggcguggaggagcugcccagcaacauccugcuggugagacugcuggacggcaucaagcagagacccuggaagcccggccccggcggcggcagcggcaccaacugcaccaacgcccugagaagccagagcagcaccguggccaacugcagcagcaaggaccugcagagcagccagggcggccagcagcccagagugcagagcuggagcccccccgugagaggcaucccccagcugcccugcgccaaggcccuguacaacuacgagggcaaggagcccggcgaccugaaguucagcaagggcgacaucaucauccugagaagacagguggacgagaacugguaccacggcgaggugaacggcauccacggcuucuuccccaccaacuucgugcagaucaucaagccccugccccagccccccccccagugcaaggcccuguacgacuucgaggugaaggacaaggaggccgacaaggacugccugcccuucgccaaggacgacgugcugaccgugaucagaagaguggacgagaacugggccgagggcaugcuggccgacaagaucggcaucuuccccaucagcuacguggaguucaacagcgccgccaagcagcugaucgagugggacaagccccccgugcccggcguggacgccggcgagugcagcagcgccgccgcccagagcagcaccgcccccaagcacagcgacaccaagaagaacaccaagaagagacacagcuucaccagccugaccauggccaacaagagcagccaggccagccagaacagacacagcauggagaucagcccccccgugcugaucagcagcagcaaccccaccgccgccgccagaaucagcgagcugagcggccugagcugcagcgcccccagccaggugcacaucagcaccaccggccugaucgugacccccccccccagcagccccgugaccaccggccccagcuucaccuuccccagcgacgugcccuaccaggccgcccugggcacccugaaccccccccugcccccccccccccugcuggccgccaccgugcuggccagcaccccccccggcgccaccgccgccgccgccgccgccggcaugggccccagacccauggccggcagcaccgaccagaucgcccaccugagaccccagaccagacccagcguguacguggccaucuaccccuacacccccagaaaggaggacgagcuggagcugagaaagggcgagauguuccugguguucgagagaugccaggacggcugguucaagggcaccagcaugcacaccagcaagaucggcguguuccccggcaacuacguggcccccgugaccagagccgugaccaacgccagccaggccaaggugcccaugagcaccgccggccagaccagcagaggcgugaccauggugagccccagcaccgccggcggccccgcccagaagcugcagggcaacggcguggccggcagccccagcguggugcccgccgccguggugagcgccgcccacauccagaccagcccccaggccaaggugcugcugcacaugaccggccagaugaccgugaaccaggccagaaacgccgugagaaccguggccgcccacaaccaggagagacccaccgccgccgugacccccauccaggugcagaacgccgccggccugagccccgccagcgugggccugagccaccacagccuggccagcccccagcccgccccccugaugcccggcagcgccacccacaccgccgccaucagcaucagcagagccagcgccccccuggccugcgccgccgccgccccccugaccagccccagcaucaccagcgccagccuggaggccgagcccagcggcagaaucgugaccgugcugcccggccugcccaccagccccgacagcgccagcagcgccugcggcaacagcagcgccaccaagcccgacaaggacagcaagaaggagaagaagggccugcugaagcugcugagcggcgccagcaccaagagaaagcccagagugagcccccccgccagccccacccuggagguggagcugggcagcgccgagcugccccugcagggcgccgugggccccgagcugccccccggcggcggccacggcagagccggcagcugccccguggacggcgacggccccgugaccaccgccguggccggcgccgcccuggcccaggacgccuuccacagaaaggccagcagccuggacagcgccgugcccaucgcccccccccccagacaggccugcagcagccugggccccgugcugaacgagagcagacccguggugugcgagagacacagagugguggugagcuaccccccccagagcgaggccgagcuggagcugaaggagggcgacaucguguucgugcacaagaagagagaggacggcugguucaagggcacccugcagagaaacggcaagaccggccuguuccccggcagcuucguggagaacaucuaa

SEQ ID NO: 23290 - RNA, 2649 nt, Artificial Sequence
  SH3RF3__Homo_sapiens__NP_001092759
augcugcugggcgccagcuggcugugcgccagcaaggccgccgccgccgccgcccagagcgagggcgacgaggacagacccggcgagagaagaagaagaagagccgccgccaccgccgccggcgccggcgaggacauggacgagagcagccugcuggaccugcuggagugcagcgugugccuggagagacuggacaccaccgccaaggugcugcccugccagcacaccuucugcagaagaugccuggagagcaucgugugcagcagacacgagcugagaugccccgagugcagaauccuggugggcugcggcguggacgagcugcccgccaacauccugcuggugagacugcuggacggcaucagacagagacccagagccggcaccagccccggcggcagcccccccgccagacccauccccggccagagcgccgcccccacccuggccggcggcggcggcggcgccgccggcagcacccccggcagccccguguuccugagcgccgccgccggcagcaccgccggcagccugagagagcuggccaccagcagaaccgcccccgccgccaagaaccccugccugcugcccuacggcaaggcccuguacagcuacgagggcaaggagcccggcgaccugaaguucaacaagggcgacaucaucgugcugagaagaaagguggacgagcagugguaccacggcgagcugcacggcacccagggcuuccugcccgccagcuacauccagugcauccagccccugccccacgcccccccccagggcaaggcccuguacgacuucgagaugaaggacaaggaccaggacaaggacugccugaccuucaccaaggacgagauccugaccgugcugagaagaguggacgagaacugggccgagggcaugcugggcgacaagaucggcaucuucccccugcuguacguggagcugaacgacagcgccaagcagcugaucgagauggacaagcccugccccgccgccgccagcagcugcaacgccagccugcccagcgacagcggcgccguggccagcguggcccccagccccacccugagcagcagcggcgccgugagcgccuuccagagaagaguggacggcaagaagaacaccaagaagagacacagcuucaccgcccugagcgugacccacagaagcagccaggccgccagccacagacacagcauggagaucagcgcccccgugcugaucagcagcagcgaccccagagccgccgccagaaucggcgaccuggcccaccugagcugcgccgcccccacccaggacgugagcagcagcgccggcagcacccccaccgccgugcccagagccgccagcgugagcggcgagcagggcaccccccccaaggugcagcugccccugaacguguaccuggcccuguacgccuacaagccccagaagagcgacgagcuggagcugcacaagggcgagauguacagagugcuggagaagugccaggacggcugguucaagggcgccagccugagaaccggcgugagcggcguguuccccggcaacuacgugacccccgugagcagagugcccgccggcggcgccggcccccccagaaacaacguggugggcggcagcccccuggccaagggcaucaccaccaccaugcaccccggcagcggcagccugagcagccuggccaccgccaccagacccgcccugcccaucaccaccccccaggcccacgcccagcaccccaccgccagcccccccaccggcagcugccugagacacagcgcccagcccaccgccagccaggccagaagcaccaucagcaccgccgcccacagcgccgcccaggcccaggacagacccaccgccaccgugagcccccugagaacccagaacagccccagcagacugcccgccaccagccugagaccccacagcguggugagcccccagcacagccaccagccccccgugcagaugugccccagacccgccaucccccugaccagcgccgccagcgccaucaccccccccaacgugagcgccgccaaccugaacggcgaggccggcggcggccccaucggcgugcugagcaccagcagccccaccaacaccggcugcaagcuggacgagaagaagagcgagaagaaggagaagaagagcggccugcugaagcugcuggccggcgccagcaccaagaagaagagcagaagcccccccagcgugagccccacccacgacccccagguggccguggacgcccugcugcagggcgccgugggccccgaggugagcagccugagcauccacggcagagccggcagcugccccaucgagagcgagaugcagggcgccaugggcauggagccccugcacagaaaggccggcagccuggaccugaacuucaccagccccagcagacaggccccccugagcauggccgccaucagacccgagcccaagcugcugcccagagagagauacagagugguggugagcuaccccccccagagcgaggccgagaucgagcugaaggagggcgacaucguguucgugcacaagaagagagaggacggcugguacaagggcacccugcagagaaacggcagaaccggccuguuccccggcagcuucguggagagcuucuaa

SEQ ID NO: 23291 - RNA, 3867 nt, Artificial Sequence
  SH3TC2__Homo_sapiens__NP_078853
augggcggcugcuucugcauccccagagagagaagccugaccagaggccccggcaaggagacccccagcaaggaccccaccgugagcagcgagugcaucgccagcagcgaguacaaggagaagugcuuccugccccagaacaucaaccccgaccugacccugagcuucugcgugaagagcagaagcagaagaugcgugaacggcccccugcaggaggccgccagaagaagacugugggcccuggagaacgaggaccaggaggugagaaugcuguucaaggaccugagcgccagacuggugagcauccagagccagagagcccaguuccugaucaccuucaagaccauggaggagaucuggaaguucagcaccuaccugaaccugggcuacgugagcaugugccuggagcaccugcuguucgaccacaaguacuggcugaacugcauccugguggaggacaccgagauccaggugagcguggacgacaagcaccuggagaccaucuaccugggccugcugauccaggagggccacuucuucugcagagcccugugcagcgugaccccccccgccgagaaggagggcgagugccugacccugugcaagaacgagcugaucagcgugaagauggccgaggccggcagcgagcuggagggcgugagccuggugaccggccagagaggccuggugcuggugagcgcccuggagccccugccccugcccuuccaccagugguuccugaagaacuaccccggcagcugcggccugagcagaaagagagacuggaccggcagcuaccagaucggcagaggcagaugcaaggcccugaccggcuacgagcccggcgagaaggacgagcugaacuucuaccagggcgagagcaucgagaucaucggcuucgugauccccggccugcagugguucaucggcaagagcaccagcagcggccaggugggcuucgugcccaccagaaacaucgaccccgacagcuacagccccaugagcagaaacagcgccuuccugagcgacgaggagagaugcagccugcuggcccugggcagcgacaagcagaccgagugcagcagcuuccugcacacccuggccagaaccgacaucaccagcguguacagacugagcggcuucgagagcauccagaacccccccaacgaccugagcgccagccagcccgagggcuucaaggaggugagacccggcagagccugggaggagcaccaggccgugggcagcagacagagcagcagcagcgaggacagcagccuggaggaggagcugcugagcgccaccagcgacagcuacagacugcccgagcccgacgaccuggacgaccccgagcugcugauggaccugagcaccggccaggaggaggaggccgagaacuucgcccccauccuggccuuccuggaccacgagggcuacgccgaccacuucaagagccuguacgacuucagcuucagcuuccugaccagcagcuucuacagcuucagcgaggaggacgaguucguggccuaccuggaggccagcagaaagugggccaagaagagccacaugaccugggcccacgccagacugugcuuccugcugggcagacugagcaucagaaaggugaagcugagccaggccagaguguacuucgaggaggccauccacauccugaacggcgccuucgaggaccugagccugguggccacccuguacaucaaccuggccgccaucuaccugaagcagagacugagacacaagggcagcgcccugcuggagaaggccggcgcccugcuggccugccugcccgacagagagagcagcgccaagcacgagcuggacgugguggccuacgugcugagacagggcaucguggugggcagcagcccccuggaggccagagccugcuuccuggccaucagacugcugcugagccugggcagacacgaggaggugcugcccuucgccgagagacugcagcugcugagcggccacccccccgccagcgaggccguggccagcgugcugagcuuccuguacgacaagaaguaccugccccaccuggccguggccagcgugcagcagcacggcauccagagcgcccagggcaugagccugcccaucuggcaggugcaccuggugcugcagaacaccaccaagcugcugggcuuccccagccccggcuggggcgaggugagcgcccuggccugccccaugcugagacaggcccuggccgccugcgaggagcuggccgacagaagcacccagagagcccugugccugauccugagcaagguguaccuggagcacagaagccccgacggcgccauccacuaccugagccaggcccuggugcugggccagcugcugggcgagcaggagagcuucgagagcagccugugccuggccugggccuaccugcuggccagccaggccaagaaggcccuggacgugcuggagccccugcugugcagccugaaggagaccgagagccugacccagagaggcgugaucuacaaccugcugggccuggcccugcagggcgagggcagagugaacagagccgccaagagcuaccugagagcccugaacagagcccaggaggugggcgacgugcacaaccaggccguggccauggccaaccugggccaccugagccugaagagcugggcccagcaccccgccagaaacuaccugcugcaggccgugagacuguacugcgagcugcaggccagcaaggagaccgacauggagcuggugcagguguuccuguggcuggcccaggugcuggugagcggccaccagcugacccacggccugcugugcuacgagauggcccugcuguucggccugagacacagacaccugaagagccagcugcaggccaccaagagccugugccacuucuacagcagcgugagccccaaccccgaggccugcaucaccuaccacgagcacuggcuggcccuggcccagcagcugagagacagagagauggagggcagacugcuggagagccugggccagcuguacagaaaccugaacaccgccagaagccugagaagaagccugaccugcaucaaggagagccugagaaucuucaucgaccugggcgagaccgacaaggccgccgaggccuggcugggcgccggcagacugcacuaccugaugcaggaggacgagcugguggagcugugccugcaggccgccauccagaccgcccugaagagcgaggagccccugcuggcccugaagcuguacgaggaggccggcgacguguucuucaacggcaccagacacagacaccacgccguggaguacuacagagccggcgccgugccccuggccagaagacugaaggccgugagaaccgagcugagaaucuucaacaagcugaccgagcugcagaucagccuggagggcuacgagaaggcccuggaguucgccacccuggccgccagacugagcaccgugaccggcgaccagagacaggagcugguggccuuccacagacuggccaccguguacuacagccugcacauguacgagauggccgaggacugcuaccugaagacccugagccugugcccccccuggcugcagagccccaaggaggcccuguacuacgccaagguguacuacagacugggcagacugaccuucugccagcugaaggacgcccacgacgccaccgaguacuuccugcuggcccuggccgccgccgugcugcugggcgacgaggagcugcaggacaccaucagaagcagacuggacaacaucugccagagcccccuguggcacagcagacccagcggcugcagcagcgagagagccagauggcugagcggcggcggccuggcccuguaa

SEQ ID NO: 23292 - RNA, 972 nt, Artificial Sequence
  SH3YL1__Homo_sapiens__NP_001153069
augaacaaccccauccccagcaaccugaagagcgaggccaagaaggccgccaagauccugagagaguucaccgagaucaccagcagaaacggccccgacaagaucauccccgcccacgugaucgccaaggccaagggccuggccauccugagcgugaucaaggccggcuuccuggugaccgccagaggcggcagcggcaucgugguggccagacugcccgacggcaaguggagcgcccccagcgccaucggcaucgccggccugggcggcggcuucgagaucggcaucgaggugagcgaccuggugaucauccugaacuacgacagagccguggaggccuucgccaagggcggcaaccugacccugggcggcaaccugaccguggccgugggcccccugggcagaaaccuggagggcaacguggcccugagaagcagcgccgccguguucaccuacugcaagagcagaggccuguucgccggcgugagccuggagggcagcugccugaucgagagaaaggagaccaacagaaaguucuacugccaggacaucagagccuacgacauccuguucggcgacacccccagacccgcccaggccgaggaccuguacgagauccuggacagcuucaccgagaaguacgagaacgagggccagagaaucaacgccagaaaggccgccagagagcagagaaagagcagcgccaaggagcugccccccaagccccugagcagaccccagcagagcagcgcccccgugcagcugaacagcggcagccagagcaaccugaaccagcccaucgaggugaccgcccuguacagcuucgagggccagcagcccggcgaccugaacuuccaggccggcgacagaaucaccgugaucagcaagaccgacagccacuucgacuggugggagggcaagcugagaggccagaccggcaucuuccccgccaacuacgugaccaugaacuaa

SEQ ID NO: 23293 - RNA, 6486 nt, Artificial Sequence
  SHANK1__Homo_sapiens__XP_006723296
augacccacagccccgccaccagcgaggacgaggagagacacagcgccagcgagugccccgagggcggcagcgagagcgacagcagccccgacggccccggcagaggccccagaggcaccagaggccagggcagcggcgcccccggcagccuggccagcgugagaggccugcagggcagaagcaugagcgugcccgacgacgcccacuucagcaugaugguguucagaaucggcauccccgaccugcaccagaccaagugccugagauucaaccccgacgccaccaucuggaccgccaagcagcaggugcugugcgcccugagcgagagccugcaggacgugcugaacuacggccuguuccagcccgccaccagcggcagagacgccaacuuccuggaggaggagagacugcugagagaguacccccagagcuucgagaagggcgugcccuaccuggaguucagauacaagaccagaguguacaagcagaccaaccuggacgagaagcagcuggccaagcugcacaccaagaccggccugaagaaguuccuggaguacgugcagcugggcaccagcgacaagguggccagacugcuggacaagggccuggaccccaacuaccacgacagcgacagcggcgagaccccccugacccuggccgcccagaccgagggcagcguggaggugaucagaacccugugccugggcggcgcccacaucgacuucagagccagagacggcaugaccgcccugcacaaggccgccugcgccagacacugccuggcccugaccgcccugcuggaccugggcggcagccccaacuacaaggacagaagaggccugaccccccuguuccacaccgccauggugggcggcgaccccagaugcugcgagcugcugcuguucaacagagcccagcugggcaucgccgacgagaacggcuggcaggagauccaccaggccugccagagaggccacagccagcaccuggagcaccugcuguucuacggcgccgagcccggcgcccagaacgccagcggcaacaccgcccugcacaucugcgcccuguacaacaaggagaccugcgccagaauccugcuguacagaggcgccgacaaggacgugaagaacaacaacggccagacccccuuccagguggccgugaucgccggcaacuucgagcugggcgagcugaucagaaaccacagagagcaggacguggugcccuuccaggagagccccaaguacgccgccagaagaagaggcccccccggcaccggccugaccgugccccccgcccugcugagagccaacagcgacaccagcauggcccugcccgacuggaugguguucagcgcccccggcgccgccagcagcggcgcccccggccccaccagcggcagccagggccagagccagcccagcgcccccaccaccaagcugagcagcggcacccugagaagcgccagcagccccagaggcgccagagccagaagccccagcagaggcagacaccccgaggacgccaagagacagcccagaggcagacccagcagcagcggcacccccagagagggccccgccggcggcaccggcggcagcggcggccccggcggcagccugggcagcagaggcagaagaagaaagcuguacagcgccgugcccggcagaagcuucauggccgugaagagcuaccaggcccaggccgagggcgagaucagccugagcaagggcgagaagaucaaggugcugagcaucggcgagggcggcuucugggagggccaggugaagggcagagugggcugguuccccagcgacugccuggaggagguggccaacagaagccaggagagcaagcaggagagcagaagcgacaaggccaagagacuguucagacacuacaccgugggcagcuacgacagcuucgacgcccccagccugauggacggcaucggccccggcagcgacuacaucaucaaggagaagaccgugcugcugcagaagaaggacagcgagggcuucggcuucgugcugagaggcgccaaggcccagacccccaucgaggaguucacccccacccccgccuuccccgcccugcaguaccuggagagcguggacgagggcggcguggccuggagagccggccugagaaugggcgacuuccugaucgaggugaacggccagaacguggugaaggugggccacagacagguggugaacaugaucagacagggcggcaacacccugauggugaagguggugauggugaccagacaccccgacauggacgaggccgugcacaagaaggccccccagcaggccaagagacugcccccccccaccaucagccugagaagcaagagcaugaccagcgagcuggaggagauggaguacgagcagcagcccgcccccgugcccagcauggagaagaagagaaccguguaccagauggcccugaacaagcuggacgagauccuggccgccgcccagcagaccaucagcgccagcgagagccccggccccggcggccuggccagccugggcaagcacagacccaagggcuucuucgccaccgagagcagcuucgacccccaccacagagcccagcccagcuacgagagacccagcuuccugccccccggccccggccugaugcugagacagaagagcaucggcgccgccgaggacgacagacccuaccuggccccccccgccaugaaguucagcagaagccugagcgugcccggcagcgaggacaucccccccccccccaccaccagcccccccgagccccccuacagcaccccccccgugcccagcagcagcggcagacugacccccagccccagaggcggccccuucaaccccggcagcggcggcccccugcccgccagcagccccgccagcuucgacggccccagcccccccgacaccagagugggcagcagagagaagagccuguaccacagcggcccccugccccccgcccaccaccaccccccccaccaccaccaccaccacgccccccccccccagccccaccaccaccacgcccaccccccccacccccccgagauggagaccggcggcagccccgacgaccccccccccagacuggcccugggcccccagcccagccugagaggcuggagaggcggcggccccagccccacccccggcgcccccagccccagccaccacggcagcgccggcggcggcggcggcagcagccagggccccgcccugagauacuuccagcugccccccagagccgccagcgccgccauguacgugcccgccagaagcggcagaggcagaaagggcccccuggugaagcagaccaagguggagggcgagccccagaagggcggcggccugccccccgcccccagccccaccagccccgccagcccccagcccccccccgccguggccgcccccagcgagaagaacagcauccccauccccaccaucaucaucaaggcccccagcaccagcagcagcggcagaagcagccagggcagcagcaccgaggccgagccccccacccagcccgagcccaccggcggcggcggcggcggcggcagcagccccagccccgcccccgccaugagccccgugccccccagccccagccccgugcccacccccgccagccccagcggccccgccacccuggacuucaccagccaguucggcgccgcccuggugggcgccgccagaagagagggcggcuggcagaacgaggccagaagaagaagcacccuguuccugagcaccgacgccggcgacgaggacggcggcgacggcggccugggcaccggcgccgcccccggccccagacugagacacagcaagagcaucgacgagggcauguucagcgccgagcccuaccugagacuggagagcgccggcagcggcgccggcuacggcggcuacggcgccggcagcagagccuacggcggcggcggcggcagcagcgccuucaccagcuuccugccccccagaccccuggugcacccccugaccggcaaggcccuggaccccgccagcccccugggccuggcccuggccgccagagagagagcccugaaggagagcagcgagggcggcggcgccccccagcccccccccagaccccccagccccagauacgaggcccccccccccaccccccaccaccacagcccccacgcccaccacgagcccgugcugagacuguggggcgccagcccccccgaccccgccagaagagagcugggcuacagagccggccugggcagccaggagaagagccugcccgccagcccccccgccgccagaagaagccugcugcacagacugccccccaccgcccccggcgugggcccccugcugcugcagcugggcaccgagccccccgccccccaccccggcgugagcaagcccuggagaagcgccgcccccgaggagcccgagagacugccccugcacgugagauuccuggagaacugccagcccagagcccccgugaccagcggcagaggcccccccagcgaggacggccccggcgugcccccccccagccccagaagaagcgugccccccagccccaccagccccagagccagcgaggagaacggccugccccugcuggugcugcccccccccgcccccagcguggacguggaggacggcgaguuccuguucguggagccccugccccccccccuggaguucagcaacagcuucgagaagcccgagagcccccugacccccggccccccccacccccugcccgacacccccgcccccgccaccccccugccccccgugcccccccccgccguggccgccgccccccccacccuggacagcaccgccagcagccugaccagcuacgacagcgagguggccacccugacccagggcgccagcgccgcccccggcgacccccacccccccggcccccccgcccccgccgcccccgcccccgccgccccccagcccggccccgaccccccccccggcaccgacagcggcaucgaggagguggacagcagaagcagcagcgaccacccccuggagaccaucagcagcgccagcacccugagcagccugagcgccgagggcggcggcagcgccggcggcggcggcggcgccggcgccggcguggccagcggccccgagcugcuggacaccuacguggccuaccuggacggccaggccuucggcggcagcagcacccccggcccccccuaccccccccagcugaugacccccagcaagcugagaggcagagcccugggcgccagcggcggccugagacccggccccagcggcggccugagagaccccgugacccccaccagccccaccgugagcgugaccggcgccggcaccgacggccugcuggcccugagagccugcagcggcccccccaccgccggcguggccggcggccccguggccguggagcccgaggugccccccgugccccugcccaccgccagcagccugcccagaaagcugcugcccugggaggagggccccggcccccccccccccccccugcccggcccccuggcccagccccaggccagcgcccuggccaccgugaaggccagcaucaucagcgagcugagcagcaagcugcagcaguucggcggcagcagcgccgccggcggcgcccugcccugggccagaggcggcagcggcggcggcggcgacagccaccacggcggcgccagcuacgugcccgagagaaccagcagccugcagagacagagacugagcgacgacagccagagcagccugcugagcaagcccgugagcagccuguuccagaacuggcccaagcccccccugcccccccugcccaccggcaccggcgugagccccaccgccgccgccgcccccggcgccaccagccccagcgccagcagcagcagcaccagcaccagacaccugcagggcguggaguucgagaugagacccccccugcugagaagagcccccagccccagccugcugcccgccagcgagcacaaggugagccccgcccccagacccagcagccugcccauccugcccagcggcccccuguaccccggccuguucgacaucagaggcagccccaccggcggcgccggcggcagcgccgaccccuucgcccccguguucgugcccccccaccccggcaucagcggcggccugggcggcgcccugagcggcgccagcagaagccugagccccaccagacugcugagccugccccccgacaagcccuucggcgccaagccccugggcuucuggaccaaguucgacguggccgacuggcuggaguggcugggccuggccgagcacagagcccaguuccuggaccacgagaucgacggcagccaccugcccgcccugaccaaggaggacuacguggaccugggcgugaccagagugggccacagaaugaacaucgacagagcccugaaguucuuccuggagagauaa

SEQ ID NO: 23294 - RNA, 5550 nt, Artificial Sequence
  SHANK2__Homo_sapiens__NP_036441
augcccagaagccccaccagcagcgaggacgagauggcccagagcuucagcgacuacagcgugggcagcgagagcgacagcagcaaggaggagaccaucuacgacaccaucagagccaccgccgagaagcccggcggcgccagaaccgaggagagccagggcaacacccuggugaucagaguggugauccacgaccugcagcagaccaagugcaucagauucaaccccgacgccaccguguggguggccaagcagagaauccugugcacccugacccagagccugaaggacgugcugaacuacggccuguuccagcccgccagcaacggcagagacggcaaguuccuggacgaggagagacugcugagagaguacccccagcccgugggcgagggcgugcccagccuggaguucagauacaagaagagaguguacaagcaggccagccuggacgagaagcagcuggccaagcugcacaccaagaccaaccugaagaagugcauggaccacauccagcacagacugguggagaagaucaccaagaugcuggacagaggccuggaccccaacuuccacgaccccgagaccggcgagaccccccugacccuggccgcccagcuggacgacagcguggaggugaucaaggcccugaagaacggcggcgcccaccuggacuucagagccaaggacggcaugaccgcccugcacaaggccgccagagccagaaaccagguggcccugaagacccugcuggagcugggcgccagccccgacuacaaggacagcuacggccugaccccccuguaccacaccgccaucgugggcggcgaccccuacugcugcgagcugcugcugcacgagcacgccaccgugugcugcaaggacgagaacggcuggcacgagauccaccaggccugcagauacggccacgugcagcaccuggagcaccugcuguucuacggcgccgacaugagcgcccagaacgccagcggcaacaccgcccugcacaucugcgcccuguacaaccaggacagcugcgccagagugcugcuguucagaggcggcaacaaggagcugaagaacuacaacagccagacccccuuccagguggccaucaucgccggcaacuucgagcuggccgaguacaucaagaaccacaaggagaccgacaucgugcccuucagagaggcccccgccuacagcaacagaagaagaagaccccccaacacccuggccgcccccagagugcugcugagaagcaacagcgacaacaaccugaacgccagcgcccccgacugggccgugugcagcaccgccaccagccacagaagccugagcccccagcugcugcagcagaugcccagcaagcccgagggcgccgccaagaccaucggcagcuacgugcccggccccagaagcagaagccccagccugaacagacugggcggcgccggcgaggacggcaagagaccccagccccuguggcacgugggcagccccuucgcccugggcgccaacaaggacagccugagcgccuucgaguaccccggccccaagagaaagcuguacagcgccgugcccggcagacuguucguggccgugaagcccuaccagccccagguggacggcgagaucccccugcacagaggcgacagagugaaggugcugagcaucggcgagggcggcuucugggagggcagcgccagaggccacaucggcugguuccccgccgagugcguggaggaggugcagugcaagcccagagacagccaggccgagaccagagccgacagaagcaagaagcuguucagacacuacaccgugggcagcuacgacagcuucgacaccagcagcgacugcaucaucgaggagaagaccguggugcugcagaagaaggacaacgagggcuucggcuucgugcugagaggcgccaaggccgacacccccaucgaggaguucacccccacccccgccuuccccgcccugcaguaccuggagagcguggacgagggcggcguggccuggcaggccggccugagaaccggcgacuuccugaucgaggugaacaacgagaacguggugaaggugggccacagacagguggugaacaugaucagacagggcggcaaccaccuggugcugaagguggugaccgugaccagaaaccuggaccccgacgacaccgccagaaagaaggccccccccccccccaagagagcccccaccaccgcccugacccugagaagcaagagcaugaccagcgagcuggaggagcugguggacaaggccagcgugagaaagaagaaggacaagcccgaggagaucgugcccgccagcaagcccagcagagccgccgagaacauggccguggagcccagaguggccaccaucaagcagagacccagcagcagaugcuuccccgccggcagcgacaugaacagcguguacgagagacagggcaucgccgugaugacccccaccgugcccggcagccccaaggcccccuuccugggcauccccagaggcaccaugagaagacagaagagcaucgacagcagaaucuuccugagcggcaucaccgaggaggagagacaguuccuggccccccccaugcugaaguucaccagaagccugagcaugcccgacaccagcgaggacauccccccccccccccagagcgugccccccagcccccccccccccagccccaccaccuacaacugccccaagagccccacccccagaguguacggcaccaucaagcccgccuucaaccagaacagcgccgccaaggugagccccgccaccagaagcgacaccguggccaccaugaugagagagaagggcauguacuucagaagagagcuggacagauacagccuggacagcgaggaccuguacagcagaaacgccggcccccaggccaacuucagaaacaagagaggccagaugcccgagaaccccuacagcgaggugggcaagaucgccagcaaggccguguacgugcccgccaagcccgccagaagaaagggcaugcuggugaagcagagcaacguggaggacagccccgagaagaccugcagcauccccauccccaccaucaucgugaaggagcccagcaccagcagcagcggcaagagcagccagggcagcagcauggagaucgacccccaggcccccgagccccccagccagcugagacccgacgagagccugaccgugagcagccccuucgccgccgccaucgccggcgccgugagagacagagagaagagacuggaggccagaagaaacagccccgccuuccugagcaccgaccugggcgacgaggacgugggccugggcccccccgcccccagaaccagacccagcauguuccccgaggagggcgacuucgccgacgaggacagcgccgagcagcugagcagccccaugcccagcgccacccccagagagcccgagaaccacuucgugggcggcgccgaggccagcgcccccggcgaggccggcagaccccugaacagcaccagcaaggcccagggccccgagagcagccccgccgugcccagcgccagcagcggcaccgccggccccggcaacuacgugcacccccugaccggcagacugcuggaccccagcagcccccuggcccuggcccugagcgccagagacagagccaugaaggagagccagcagggccccaagggcgaggcccccaaggccgaccugaacaagccccuguacaucgacaccaagaugagacccagccuggacgccggcuuccccaccgugaccagacagaacaccagaggcccccugagaagacaggagaccgagaacaaguacgagaccgaccugggcagagacagaaagggcgacgacaagaagaacaugcugaucgacaucauggacaccagccagcagaagagcgccggccugcugauggugcacaccguggacgccaccaagcuggacaacgcccugcaggaggaggacgagaaggccgagguggagaugaagcccgacagcagccccagcgaggugcccgagggcgugagcgagaccgagggcgcccugcagaucagcgccgcccccgagcccaccaccgugcccggcagaaccaucguggccgugggcagcauggaggaggccgugauccugcccuucagaauccccccccccccccuggccagcguggaccuggacgaggacuucaucuucaccgagccccugccccccccccuggaguucgccaacagcuucgacauccccgacgacagagccgccagcgugcccgcccugagcgaccuggugaagcagaagaagagcgacaccccccagagccccagccugaacagcagccagcccaccaacagcgccgacagcaagaagcccgccagccugagcaacugccugcccgccagcuuccugcccccccccgagagcuucgacgccguggccgacagcggcaucgaggagguggacagcagaagcagcagcgaccaccaccuggagaccaccagcaccaucagcaccgugagcagcaucagcacccugagcagcgagggcggcgagaacguggacaccugcaccguguacgccgacggccaggccuucaugguggacaagccccccgugccccccaagcccaagaugaagcccaucauccacaagagcaacgcccuguaccaggacgcccugguggaggaggacguggacagcuucgugauccccccccccgcccccccccccccccccggcagcgcccagcccggcauggccaaggugcugcagcccagaaccagcaagcuguggggcgacgugaccgagaucaagagccccauccugagcggccccaaggccaacgugaucagcgagcugaacagcauccugcagcagaugaacagagagaagcuggccaagcccggcgagggccuggacagccccaugggcgccaagagcgccagccuggcccccagaagccccgagaucaugagcaccaucagcggcaccagaagcaccaccgugaccuucaccgugagacccggcaccagccagcccaucacccugcagagcagaccccccgacuacgagagcagaaccagcggcaccagaagagcccccagccccguggugagccccaccgagaugaacaaggagacccugcccgccccccugagcgccgccaccgccagccccagccccgcccugagcgacguguucagccugcccagccagccccccagcggcgaccuguucggccugaaccccgccggcagaagcagaagccccagccccagcauccugcagcagcccaucagcaacaagcccuucaccaccaagcccgugcaccuguggaccaagcccgacguggccgacuggcuggagagccugaaccugggcgagcacaaggaggccuucauggacaacgagaucgacggcagccaccugcccaaccugcagaaggaggaccugaucgaccugggcgugaccagagugggccacagaaugaacaucgagagagcccugaagcagcugcuggacagauaa

SEQ ID NO: 23295 - RNA, 5196 nt, Artificial Sequence
  SHANK3__Homo_sapiens__NP_277052
auggacggccccggcgccagcgccgugguggugagagugggcauccccgaccugcagcagaccaagugccugagacuggaccccgccgcccccgugugggccgccaagcagagagugcugugcgcccugaaccacagccugcaggacgcccugaacuacggccuguuccagccccccagcagaggcagagccggcaaguuccuggacgaggagagacugcugcaggaguacccccccaaccuggacaccccccugcccuaccuggaguucagauacaagagaagaguguacgcccagaaccugaucgacgacaagcaguucgccaagcugcacaccaaggccaaccugaagaaguucauggacuacgugcagcugcacagcaccgacaagguggccagacugcuggacaagggccuggaccccaacuuccacgaccccgacagcggcgagugcccccugagccuggccgcccagcuggacaacgccaccgaccugcugaaggugcugaagaacggcggcgcccaccuggacuucagaaccagagacggccugaccgccgugcacugcgccaccagacagagaaacgccgccgcccugaccacccugcuggaccugggcgccagccccgacuacaaggacagcagaggccugaccccccuguaccacagcgcccugggcggcggcgacgcccugugcugcgagcugcugcugcacgaccacgcccagcugggcaucaccgacgagaacggcuggcaggagauccaccaggccugcagauucggccacgugcagcaccuggagcaccugcuguucuacggcgccgacaugggcgcccagaacgccagcggcaacaccgcccugcacaucugcgcccuguacaaccaggagagcugcgccagagugcugcuguucagaggcgccaacagagacgugagaaacuacaacagccagaccgccuuccagguggccaucaucgccggcaacuucgagcuggccgaggugaucaagacccacaaggacagcgacguggugcccuucagagagacccccagcuacgccaagagaagaagacuggccggccccagcggccuggccagccccagaccccugcagagaagcgccagcgacaucaaccugaagggcgaggcccagcccgccgccagccccggccccagccugagaagccugccccaccagcugcugcugcagagacugcaggaggagaaggacagagacagagacgccgaccaggagagcaacaucagcggcccccuggccggcagagccggccagagcaagaucagccccagcggccccggcggccccggccccgcccccggccccggccccgccccccccgccccccccgcccccccccccagaggccccaagagaaagcuguacagcgccgugcccggcagaaaguucaucgccgugaaggcccacagcccccagggcgagggcgagaucccccugcacagaggcgaggccgugaaggugcugagcaucggcgagggcggcuucugggagggcaccgugaagggcagaaccggcugguuccccgccgacugcguggaggaggugcagaugagacagcacgacaccagacccgagaccagagaggacagaaccaagagacuguucagacacuacaccgugggcagcuacgacagccugaccagccacagcgacuacgugaucgacgacaagguggccgugcugcagaagagagaccacgagggcuucggcuucgugcugagaggcgccaaggccgagacccccaucgaggaguucacccccacccccgccuuccccgcccugcaguaccuggagagcguggacguggagggcguggccuggagagccggccugagaaccggcgacuuccugaucgaggugaacggcgugaacguggugaaggugggccacaagcaggugguggcccugaucagacagggcggcaacagacuggugaugaagguggugagcgugaccagaaagcccgaggaggacggcgccagaagaagagccccccccccccccaagagagcccccagcaccacccugacccugagaagcaagagcaugaccgccgagcuggaggagcuggccagcaucagaagaagaaagggcgagaagcuggacgagaugcuggccgccgccgccgagcccacccugagacccgacaucgccgacgccgacagcagagccgccaccgugaagcagagacccaccagcagaagaaucacccccgccgagaucagcagccuguucgagagacagggccugcccggccccgagaagcugcccggcagccugagaaagggcauccccagaaccaagagcgugggcgaggacgagaagcuggccagccugcuggagggcagauuccccagaagcaccagcaugcaggaccccgugagagagggcagaggcauccccccccccccccagaccgcccccccccccccccccgcccccuacuacuucgacagcggccccccccccgccuucagccccccccccccccccggcagagccuacgacaccgugagaagcagcuucaagcccggccuggaggccagacugggcgccggcgccgccggccuguacgagcccggcgccgcccugggcccccugcccuaccccgagagacagaagagagccagaagcaugaucauccugcaggacagcgcccccgagagcggcgacgcccccagacccccccccgccgccaccccccccgagagacccaagagaagacccagaccccccggccccgacagccccuacgccaaccugggcgccuucagcgccagccuguucgcccccagcaagccccagagaagaaagagcccccuggugaagcagcugcagguggaggacgcccaggagagagccgcccuggccgugggcagccccggccccggcggcggcagcuucgccagagagcccagccccacccacagaggccccagacccggcggccuggacuacggcgccggcgacggccccggccuggccuucggcggccccggccccgccaaggacagaagacuggaggagagaagaagaagcaccguguuccugagcgugggcgccaucgagggcagcgcccccggcgccgaccugcccagccugcagcccagcagaagcaucgacgagagacugcugggcaccggccccaccgccggcagagaccugcugcugcccagccccgugagcgcccugaagccccuggugagcggccccagccugggccccagcggcagcaccuucauccacccccugaccggcaagccccuggaccccagcagcccccuggcccuggcccuggccgccagagagagagcccuggccagccaggcccccagcagaagccccacccccgugcacagccccgacgccgacagacccggcccccuguucguggacgugcaggccagagaccccgagagaggcagccuggccagccccgccuucagccccagaagccccgccuggauccccgugcccgccagaagagaggccgagaaggugcccagagaggagagaaagagccccgaggacaagaagagcaugauccugagcgugcuggacaccagccugcagagacccgccggccugaucguggugcacgccaccagcaacggccaggagcccagcagacugggcggcgccgaggaggagagacccggcacccccgagcuggcccccgcccccaugcagagcgccgccguggccgagccccugcccagccccagagcccagccccccggcggcacccccgccgacgccggccccggccagggcagcagcgaggaggagcccgagcugguguucgccgugaaccugccccccgcccagcugagcagcagcgacgaggagaccagagaggagcuggccagaaucggccuggugcccccccccgaggaguucgccaacggcgugcugcuggccaccccccuggccggccccggccccagccccaccaccgugcccagccccgccagcggcaagcccagcagcgagcccccccccgcccccgagagcgccgccgacagcggcguggaggaggccgacaccagaagcagcagcgacccccaccuggagaccaccagcaccaucagcaccgugagcagcaugagcacccugagcagcgagagcggcgagcugaccgacacccacaccagcuucgccgacggccacaccuuccugcuggagaagccccccgugccccccaagcccaagcugaagagcccccugggcaagggccccgugaccuucagagacccccugcugaagcagagcagcgacagcgagcugauggcccagcagcaccacgccgccagcgccggccuggccagcgccgccggccccgccagacccagauaccuguuccagagaagaagcaagcuguggggcgaccccguggagagcagaggccugcccggccccgaggacgacaagcccaccgugaucagcgagcugagcagcagacugcagcagcugaacaaggacaccagaagccugggcgaggagcccgugggcggccugggcagccugcuggaccccgccaagaagagccccaucgccgccgccagacuguucagcagccugggcgagcugagcagcaucagcgcccagagaagccccggcggccccggcggcggcgccagcuacagcgugagacccagcggcagauaccccguggccagaagagcccccagccccgugaagcccgccagccuggagagaguggagggccugggcgccggcgccggcggcgccggcagacccuucggccugaccccccccaccauccugaagagcagcagccugagcaucccccacgagcccaaggaggugagauucguggugagaagcgugagcgccagaagcagaagccccagccccagcccccugcccagccccgccagcggccccggccccggcgcccccggccccagaagacccuuccagcagaagccccugcagcuguggagcaaguucgacgugggcgacuggcuggagagcauccaccugggcgagcacagagacagauucgaggaccacgagaucgagggcgcccaccugcccgcccugaccaaggacgacuucguggagcugggcgugaccagagugggccacagaaugaacaucgagagagcccugagacagcuggacggcagcuaa

SEQ ID NO: 23296 - RNA, 1164 nt, Artificial Sequence
  SHARPIN__Homo_sapiens__NP_112236
auggccccccccgccggcggcgccgccgccgccgccagcgaccugggcagcgccgccgugcugcuggccgugcacgccgccgugagaccccugggcgccggccccgacgccgaggcccagcugagaagacugcagcugagcgccgaccccgagagacccggcagauucagacuggagcugcugggcgccggccccggcgccgugaaccuggaguggccccuggagagcgugagcuacaccaucagaggccccacccagcacgagcugcagcccccccccggcggccccggcacccugagccugcacuuccugaacccccaggaggcccagagaugggccgugcuggugagaggcgccaccguggagggccagaacggcagcaagagcaacagcccccccgcccugggccccgaggccugccccgugagccugcccagcccccccgaggccagcacccugaagggccccccccccgaggccgaccugcccagaagccccggcaaccugaccgagagagaggagcuggccggcagccuggccagagccaucgccggcggcgacgagaagggcgccgcccagguggccgccgugcuggcccagcacagaguggcccugagcgugcagcugcaggaggccugcuucccccccggccccaucagacugcaggugacccuggaggacgccgccagcgccgccagcgccgccagcagcgcccacguggcccugcaggugcacccccacugcaccguggccgcccugcaggagcagguguucagcgagcugggcuucccccccgccgugcagagaugggugaucggcagaugccugugcgugcccgagagaagccuggccagcuacggcgugagacaggacggcgaccccgccuuccuguaccugcugagcgcccccagagaggcccccgccaccggccccagcccccagcacccccagaagauggacggcgagcugggcagacuguucccccccagccugggccugccccccggcccccagcccgccgccagcagccugcccagcccccugcagcccagcuggagcugccccagcugcaccuucaucaacgcccccgacagacccggcugcgagaugugcagcacccagagacccugcaccugggacccccuggccgccgccagcaccuaa

SEQ ID NO: 23297 - RNA, 1155 nt, Artificial Sequence
  SHBG__Homo_sapiens__NP_001139751
auggagagcagaggcccccuggccaccagcagacugcugcugcugcugcugcugcugcugcugagacacaccagacagggcugggcccugagacccgugcugcccacccagagcgcccacgacccccccgccgugcaccugagcaacggccccggccaggagcccaucgccgugaugaccuucgaccugaccaagaucaccaagaccagcagcagcuucgaggugagaaccugggaccccgagggcgugaucuucuacggcgacaccaaccccaaggacgacugguucaugcugggccugagagacggcagacccgagauccagcugcacaaccacugggcccagcugaccgugggcgccggccccagacuggacgacggcagauggcaccagguggaggugaagauggagggcgacagcgugcugcuggagguggacggcgaggaggugcugagacugagacaggugagcggcccccugaccagcaagagacaccccaucaugagaaucgcccugggcggccugcuguuccccgccagcaaccugagacugcccgccgagaucagcgccagcgcccccaccagccugagaagcugcgacguggagagcaaccccggcaucuuccugccccccggcacccaggccgaguucaaccugagagacaucccccagccccacgccgagcccugggccuucagccuggaccugggccugaagcaggccgccggcagcggccaccugcuggcccugggcacccccgagaaccccagcuggcugagccugcaccugcaggaccagaagguggugcugagcagcggcagcggccccggccuggaccugccccuggugcugggccugccccugcagcugaagcugagcaugagcagaguggugcugagccagggcagcaagaugaaggcccuggcccugcccccccugggccuggccccccugcugaaccugugggccaagccccagggcagacuguuccugggcgcccugcccggcgaggacagcagcaccagcuucugccugaacggccugugggcccagggccagagacuggacguggaccaggcccugaacagaagccacgagaucuggacccacagcugcccccagagccccggcaacggcaccgacgccagccacuaa

SEQ ID NO: 23298 - RNA, 1530 nt, Artificial Sequence
  SHB__Homo_sapiens__NP_003019
auggccaaguggcugaacaaguacuucagccugggcaacagcaagaccaagagccccccccagccccccagacccgacuacagagagcagagaagaagaggcgagagacccagccagcccccccaggccgugccccaggccagcagcgccgccagcgccagcugcggccccgccaccgccagcugcuucagcgccagcagcggcagccugcccgacgacagcggcagcaccagcgaccugaucagagccuacagagcccagaaggagagagacuucgaggaccccuacaacggccccggcagcagccugagaaagcugagagccaugugcagacuggacuacugcggcggcagcggcgagcccggcggcgugcagagagccuucagcgccagcagcgccagcggcgccgccggcugcugcugcgccagcagcggcgccggcgccgccgccagcagcagcagcagcagcggcagcccccaccuguacagaagcagcagcgagagaagacccgccacccccgccgaggugagauacaucagccccaagcacagacugaucaagguggagagcgccgccggcggcggcgccggcgacccccugggcggcgccugcgccggcggcagaaccuggagccccaccgccugcggcggcaagaagcugcugaacaagugcgccgccagcgccgccgaggagagcggcgccggcaagaaggacaaggugaccaucgccgacgacuacagcgaccccuucgacgccaagaacgaccugaagagcaaggccggcaagggcgagagcgccggcuacauggagcccuacgaggcccagagaaucaugaccgaguuccagagacaggagagcgugagaagccagcacaagggcauccagcuguacgacacccccuacgagcccgagggccagagcguggacagcgacagcgagagcaccgugagccccagacugagagagagcaagcugccccaggacgacgacagacccgccgacgaguacgaccagcccugggaguggaacagagugaccauccccgcccuggccgcccaguucaacggcaacgagaagagacagagcagccccagccccagcagagacagaagaagacagcugagagcccccggcggcggcuucaagcccaucaagcacggcagccccgaguucugcggcauccugggcgagagaguggaccccgccgugccccuggagaagcagaucugguaccacggcgccaucagcagaggcgacgccgagaaccugcugagacugugcaaggagugcagcuaccuggugagaaacagccagaccagcaagcacgacuacagccugagccugagaagcaaccagggcuucaugcacaugaagcuggccaagaccaaggagaaguacgugcugggccagaacagcccccccuucgacagcgugcccgaggugauccacuacuacaccaccagaaagcugcccaucaagggcgccgagcaccugagccugcuguaccccguggccgugagaacccuguaa

SEQ ID NO: 23299 - RNA, 1755 nt, Artificial Sequence
  SHC1__Homo_sapiens__NP_001123512
auggaccugcugccccccaagcccaaguacaacccccugagaaacgagagccugagcagccuggaggagggcgccagcggcagcaccccccccgaggagcugcccagccccagcgccagcagccugggccccauccugcccccccugcccggcgacgacagccccaccacccugugcagcuucuuccccagaaugagcaaccugagacuggccaaccccgccggcggcagacccggcagcaagggcgagcccggcagagccgccgacgacggcgagggcaucgugggcgccgccaugcccgacagcggcccccugccccugcugcaggacaugaacaagcugagcggcggcggcggcagaagaaccagaguggagggcggccagcugggcggcgaggaguggaccagacacggcagcuucgugaacaagcccaccagaggcuggcugcaccccaacgacaaggugaugggccccggcgugagcuaccuggugagauacaugggcugcguggaggugcugcagagcaugagagcccuggacuucaacaccagaacccaggugaccagagaggccaucagccuggugugcgaggccgugcccggcgccaagggcgccaccagaagaagaaagcccugcagcagaccccugagcagcauccugggcagaagcaaccugaaguucgccggcaugcccaucacccugaccgugagcaccagcagccugaaccugauggccgccgacugcaagcagaucaucgccaaccaccacaugcagagcaucagcuucgccagcggcggcgaccccgacaccgccgaguacguggccuacguggccaaggaccccgugaaccagagagccugccacauccuggagugccccgagggccuggcccaggacgugaucagcaccaucggccaggccuucgagcugagauucaagcaguaccugagaaacccccccaagcuggugaccccccacgacagaauggccggcuucgacggcagcgccugggacgaggaggaggaggagccccccgaccaccaguacuacaacgacuuccccggcaaggagcccccccugggcggcgugguggacaugagacugagagagggcgccgcccccggcgccgccagacccaccgcccccaacgcccagacccccagccaccugggcgccacccugcccgugggccagcccgugggcggcgaccccgaggugagaaagcagaugcccccccccccccccugccccgccggcagagagcuguucgacgaccccagcuacgugaacgugcagaaccuggacaaggccagacaggccgugggcggcgccggcccccccaaccccgccaucaacggcagcgcccccagagaccuguucgacaugaagcccuucgaggacgcccugagagugcccccccccccccagagcgugagcauggccgagcagcugagaggcgagcccugguuccacggcaagcugagcagaagagaggccgaggcccugcugcagcugaacggcgacuuccuggugagagagagcaccaccacccccggccaguacgugcugaccggccugcagagcggccagcccaagcaccugcugcugguggaccccgagggcguggugagaaccaaggaccacagauucgagagcgugagccaccugaucagcuaccacauggacaaccaccugcccaucaucagcgccggcagcgagcugugccugcagcagcccguggagagaaagcuguaa

SEQ ID NO: 23300 - RNA, 1749 nt, Artificial Sequence
  SHC2__Homo_sapiens__NP_036567
augacccagggccccggcggcagagccccccccgccccccccgccccccccgagcccgaggcccccaccaccuucugcgcccugcugcccagaaugccccaguggaaguucgccgcccccggcggcuuccugggcagaggccccgccgccgccagagccgccggcgccagcggcggcgccgacccccagcccgagcccgccggccccggcggcgugcccgcccuggccgccgccgugcugggcgccugcgagcccagaugcgccgcccccugcccccugcccgcccugagcagaugcagaggcgccggcagcagaggcagcagaggcggcagaggcgccgccggcagcggcgacgccgccgccgccgccgaguggaucagaaagggcagcuucauccacaagcccgcccacggcuggcugcaccccgacgccagagugcugggccccggcgugagcuacguggugagauacaugggcugcaucgaggugcugagaagcaugagaagccuggacuucaacaccagaacccaggugaccagagaggccaucaacagacugcacgaggccgugcccggcgugagaggcagcuggaagaagaaggcccccaacaaggcccuggccagcgugcugggcaagagcaaccugagauucgccggcaugagcaucagcauccacaucagcaccgacggccugagccugagcgugcccgccaccagacaggugaucgccaaccaccacaugcccagcaucagcuucgccagcggcggcgacaccgacaugaccgacuacguggccuacguggccaaggaccccaucaaccagagagccugccacauccuggagugcugcgagggccuggcccagagcaucaucagcaccgugggccaggccuucgagcugagauucaagcaguaccugcacagcccccccaagguggcccugccccccgagagacuggccggccccgaggagagcgccuggggcgacgaggaggacagccuggagcacaacuacuacaacagcauccccggcaaggagcccccccugggcggccugguggacagcagacuggcccugacccagcccugcgcccugaccgcccuggaccagggccccagccccagccugagagacgccugcagccugcccugggacgugggcagcaccggcaccgccccccccggcgacggcuacgugcaggccgacgccagaggcccccccgaccacgaggagcaccuguacgugaacacccagggccuggacgcccccgagcccgaggacagccccaagaaggaccuguucgacaugagacccuucgaggacgcccugaagcugcacgagugcagcguggccgccggcgugaccgccgccccccugccccuggaggaccaguggcccagcccccccaccagaagagcccccguggcccccaccgaggagcagcugagacaggagcccugguaccacggcagaaugagcagaagagccgccgagagaaugcugagagccgacggcgacuuccuggugagagacagcgugaccaaccccggccaguacgugcugaccggcaugcacgccggccagcccaagcaccugcugcugguggaccccgagggcguggugagaaccaaggacgugcuguucgagagcaucagccaccugaucgaccaccaccugcagaacggccagcccaucguggccgccgagagcgagcugcaccugagaggcguggugagcagagagcccuaa

SEQ ID NO: 23301 - RNA, 1785 nt, Artificial Sequence
  SHC3__Homo_sapiens__NP_058544
augcugcccagaaccaaguacaacagauucagaaacgacagcgugaccagcguggacgaccugcugcacagccugagcgugagcggcggcggcggcaaggugagcgccgccagagccacccccgccgccgcccccuaccuggugagcggcgaggcccugagaaaggcccccgacgacggccccggcagccugggccaccugcugcacaaggugagccaccugaagcugagcagcagcggccugagaggccugagcagcgccgccagagagagagccggcgccagacugagcggcagcugcagcgcccccagccuggccgcccccgacggcagcgcccccagcgcccccagagcccccgccaugagcgccgccagaaagggcagacccggcgacgagccccugcccagaccccccagaggcgccccccacgccagcgaccaggugcugggccccggcgugaccuacguggugaaguaccugggcugcaucgaggugcugagaagcaugagaagccuggacuucagcaccagaacccagaucaccagagaggccaucagcagagugugcgaggccgugcccggcgccaagggcgccuucaagaagagaaagccccccagcaagaugcugagcagcauccugggcaagagcaaccugcaguucgccggcaugagcaucagccugaccaucagcaccgccagccugaaccugagaacccccgacagcaagcagaucaucgccaaccaccacaugagaagcaucagcuucgccagcggcggcgaccccgacaccaccgacuacguggccuacguggccaaggaccccgugaacagaagagccugccacauccuggagugcugcgacggccuggcccaggacgugaucggcagcaucggccaggccuucgagcugagauucaagcaguaccugcagugccccaccaagauccccgcccugcacgacagaaugcagagccuggacgagcccuggaccgaggaggagggcgacggcagcgaccaccccuacuacaacagcauccccagcaagaugcccccccccggcggcuuccuggacaccagacugaagcccagaccccacgcccccgacaccgcccaguucgccggcaaggagcagaccuacuaccagggcagacaccugggcgacaccuucggcgaggacuggcagcagaccccccugagacagggcagcagcgacaucuacagcacccccgagggcaagcugcacguggcccccaccggcgaggcccccaccuacgugaacacccagcagauccccccccaggccuggcccgccgccgugagcagcgccgagagcagccccagaaaggaccuguucgacaugaagcccuucgaggacgcccugaagaaccagccccugggccccgugcugagcaaggccgccagcguggagugcaucagccccgugagccccagagcccccgacgccaagaugcuggaggagcugcaggccgagaccugguaccagggcgagaugagcagaaaggaggccgagggccugcuggagaaggacggcgacuuccuggugagaaagagcaccaccaaccccggcagcuucgugcugaccggcaugcacaacggccaggccaagcaccugcugcugguggaccccgagggcaccaucagaaccaaggacagaguguucgacagcaucagccaccugaucaaccaccaccuggagagcagccugcccaucgugagcgccggcagcgagcugugccugcagcagcccguggagagaaagcaguaa

SEQ ID NO: 23302 - RNA, 1893 nt, Artificial Sequence
  SHC4__Homo_sapiens__NP_976224
augagagagagaggccaggacagccuggccggccuggugcuguacgugggccuguucggccaccccggcaugcugcacagagccaaguacagcagauucagaaacgagagcaucaccagccuggacgagggcagcagcggcggcagcgugggcaacaagggcagcccccagcccccccaccccgcccuggccccccaccugcccaccgaggacgccacccugcccagccaggagagccccaccccccugugcacccugauccccagaauggccagcaugaagcuggccaaccccgccacccugcugagccugaagaacuucugccugggcaccaaggaggugcccagacugaagcugcaggagagcagagaccccggcagcagcggccccagcagccccgagaccagccugagcagaagcggcaccgccccccccccccagcaggaccuggugggccacagagccaccgcccugacccccgacagcugcccccugcccggccccggcgagcccacccugagaagcagacaggacagacacuuccugcagcaccugcugggcaugggcaugaacuacugcgugagauacaugggcugcguggaggugcugcagagcaugagaagccuggacuucggcaugagaacccaggugaccagagaggccaucagcagacugugcgaggccgugcccggcgccaacggcgccaucaagaagagaaagccccccgugaaguuccugagcaccgugcugggcaagagcaaccugcaguucagcggcaugaacaucaagcugaccaucagcaccugcagccugacccugaugaaccuggacaaccagcagaucaucgccaaccaccacaugcagagcaucagcuucgccagcggcggcgaccccgacaccaccgacuacguggccuacguggccaaggaccccgugaaccagagagccugccacauccuggagugccacaacggcauggcccaggacgugaucagcaccaucggccaggccuucgagcugagauucaagcaguaccugaagaaccccagccugaacaccagcugcgagagcgaggaggugcacaucgacagccacgccgaggagagagaggaccacgaguacuacaacgagauccccggcaagcagccccccgugggcggcgugagcgacaugagaaucaaggugcaggccaccgagcagauggccuacugccccauccagugcgagaagcugugcuaccugcccggcaacagcaagugcagcagcguguacgagaacugccuggagcagagcagagccaucggcaacgugcaccccagaggcgugcagagccagagagacaccagccugcugaagcacaccugcagaguggaccuguucgacgaccccugcuacaucaacacccaggcccugcagagcacccccggcagcgccggcaaccagagaagcgcccagccccugggcagccccuggcacugcggcaaggcccccgagaccgugcagcccggcgccaccgcccagcccgccagcagccacagccugccccacaucaagcagcagcuguggagcgaggagugcuaccacggcaagcugagcagaaaggccgccgagagccugcuggugaaggacggcgacuuccuggugagagagagcgccaccagccccggccaguacgugcugagcggccugcagggcggccaggccaagcaccugcugcugguggaccccgagggcaaggugagaaccaaggaccacguguucgacaacgugggccaccugaucagauaccacauggacaacagccugcccaucaucagcagcggcagcgaggugagccugaagcagcccgugagaaaggacaacaaccccgcccugcugcacagcaacaaguaa

SEQ ID NO: 23303 - RNA, 2019 nt, Artificial Sequence
  SHCBP1__Homo_sapiens__NP_079021
auggccgacggcagccugaccggcggcggccuggaggccgccgccauggcccccgagagaaccggcugggccguggagcaggagcuggccagccuggagaagggccuguuccaggacgaggacagcugcagcgacugcagcuacagagacaagcccggcagcagccugcagagcuucaugcccgagggcaagaccuucuuccccgagaucuuccagaccaaccagcugcuguucuacgagagauucagagccuaccaggacuacauccuggccgacugcaaggccagcgaggugcaggaguucaccgccgaguuccuggagaaggugcuggagcccagcggcuggagagccguguggcacaccaacguguucaaggugcugguggagaucaccgacguggacuucgccgcccugaaggccguggugagacuggccgagcccuaccugugcgacagccaggugagcaccuucaccauggagugcaugaaggagcugcuggaccugaaggagcacagacugccccugcaggagcugugggugguguucgacgacagcggcguguucgaccagaccgcccuggccaucgagcacgugagauucuucuaccagaacaucuggagaagcugggacgaggaggaggaggacgaguacgacuacuucgugagaugcguggagcccagacugagacugcacuacgacauccuggaggacagagugcccagcggccugaucguggacuaccacaaccugcugagccagugcgaggagagcuacagaaaguuccugaaccugagaagcagccugagcaacugcaacagcgacagcgagcaggagaacaucagcaugguggagggccugaagcuguacagcgagauggagcagcugaagcagaagcugaagcugaucgagaacccccugcugagauacguguucggcuaccagaagaacagcaacauccaggccaagggcgugagaagcagcggccagaagaucacccacguggugagcagcaccaugauggccggccugcugagaagccugcugaccgacagacugugccaggagcccggcgaggaggagagagagauccaguuccacagcgacccccugagcgccaucaacgccugcuucgagggcgacaccgugaucgugugccccggccacuacguggugcacggcaccuucagcaucgccgacagcaucgagcuggagggcuacggccugcccgacgacaucgugaucgagaagagaggcaagggcgacaccuucguggacugcaccggcgccgacaucaagaucagcggcaucaaguucgugcagcacgacgccguggagggcauccugaucgugcacagaggcaagaccacccuggagaacugcgugcugcagugcgagaccaccggcgugaccgugagaaccagcgccgaguuccugaugaagaacagcgaccuguacggcgccaagggcgccggcaucgagaucuaccccggcagccagugcacccugagcgacaacggcauccaccacugcaaggagggcauccugaucaaggacuuccuggacgagcacuacgacauccccaagaucagcauggugaacaacaucauccacaacaacgagggcuacggcguggugcuggugaagcccaccaucuucagcgaccugcaggagaacgccgaggacggcaccgaggagaacaaggcccugaagauccagaccagcggcgagcccgacguggccgagagaguggaccuggaggagcugaucgagugcgccaccggcaagauggagcugugcgccagaaccgaccccagcgagcagguggagggcaacugcgagaucgugaacgagcugaucgccgccagcacccagaagggccagaucaagaagaagagacugagcgagcugggcaucacccaggccgacgacaaccugaugagccaggagauguucgugggcaucgugggcaaccaguucaaguggaacggcaagggcagcuucggcaccuuccuguucuaa

SEQ ID NO: 23304 - RNA, 1326 nt, Artificial Sequence
  SHF__Homo_sapiens__NP_001288097
augcugcugagcggcgccccccccgccggcagcagacccggccccagaacccagggcagcgccggcggcggccccggcggcagcagaagaggcgccggcggcgccggcgccggccccggcggcggcggcagcggcggcguggccaaguggcugagagagcaccugggcuucagaggcggcggcggcggcggcggcggcagcaagcccgccccccccgagcccgacuacagaccccccgcccccagccccgccgccccccccgcccccccccccgacauccuggccgccuacagacugcagagagagagagacuucgaggaccccuacagcggcggcagcagcggcagcgccgcccuggccacccccguggcccccggccccacccccccccccagacacggcagccccccccacagacugaucagaguggagacccccggcccccccgccccccccgccgacgagagaaucagcggcccccccgccagcagcgacagacuggccauccuggaggacuacgccgaccccuucgacgugcaggagaccggcgagggcagcgccggcgccagcggcgcccccgagaaggugcccgagaacgacggcuacauggagcccuacgaggcccagaagaugauggccgagaucagaggcagcaaggagaccgccacccagccccugccccuguacgacacccccuacgagcccgaggaggacggcgccacccccgagggcgagggcgcccccuggcccagagagagcagacugcccgaggacgacgagagaccccccgaggaguacgaccagcccugggaguggaagaaggagagaaucagcaaggccuucgccgcccaguucgagggccccgagaagagcugccugagccccggcagagaggagaagggcagacugccccccagacugagcgccggcaaccccaagagcgccaagccccugagcauggagcccagcagcccccugggcgaguggaccgaccccgcccugccccuggagaaccaggugugguaccacggcgccaucagcagaaccgacgccgagaaccugcugagacugugcaaggaggccagcuaccuggugagaaacagcgagaccagcaagaacgacuucagccugagccugaagagcagccagggcuucaugcacaugaagcugagcagaaccaaggagcacaaguacgugcugggccagaacagcccccccuucagcagcgugcccgagaucgugcaccacuacgccagcagaaagcugcccaucaagggcgccgagcacaugagccugcuguaccccguggccaucagaacccuguaa

SEQ ID NO: 23305 - RNA, 213 nt, Artificial Sequence
  SHFM1__Homo_sapiens__NP_006295
augagcgagaagaagcagcccguggaccugggccugcuggaggaggacgacgaguucgaggaguuccccgccgaggacugggccggccuggacgaggacgaggacgcccacgugugggaggacaacugggacgacgacaacguggaggacgacuucagcaaccagcugagagccgagcuggagaagcacggcuacaagauggagaccagcuaa

SEQ ID NO: 23306 - RNA, 1389 nt, Artificial Sequence
  SHH__Homo_sapiens__NP_000184
augcugcugcuggccagaugccugcugcuggugcuggugagcagccugcuggugugcagcggccuggccugcggccccggcagaggcuucggcaagagaagacaccccaagaagcugaccccccuggccuacaagcaguucauccccaacguggccgagaagacccugggcgccagcggcagauacgagggcaagaucagcagaaacagcgagagauucaaggagcugacccccaacuacaaccccgacaucaucuucaaggacgaggagaacaccggcgccgacagacugaugacccagagaugcaaggacaagcugaacgcccuggccaucagcgugaugaaccaguggcccggcgugaagcugagagugaccgagggcugggacgaggacggccaccacagcgaggagagccugcacuacgagggcagagccguggacaucaccaccagcgacagagacagaagcaaguacggcaugcuggccagacuggccguggaggccggcuucgacuggguguacuacgagagcaaggcccacauccacugcagcgugaaggccgagaacagcguggccgccaagagcggcggcugcuuccccggcagcgccaccgugcaccuggagcagggcggcaccaagcuggugaaggaccugagccccggcgacagagugcuggccgccgacgaccagggcagacugcuguacagcgacuuccugaccuuccuggacagagacgacggcgccaagaagguguucuacgugaucgagaccagagagcccagagagagacugcugcugaccgccgcccaccugcuguucguggccccccacaacgacagcgccaccggcgagcccgaggccagcagcggcagcggcccccccagcggcggcgcccugggccccagagcccuguucgccagcagagugagacccggccagagaguguacgugguggccgagagagacggcgacagaagacugcugcccgccgccgugcacagcgugacccugagcgaggaggccgccggcgccuacgccccccugaccgcccagggcaccauccugaucaacagagugcuggccagcugcuacgccgugaucgaggagcacagcugggcccacagagccuucgcccccuucagacuggcccacgcccugcuggccgcccuggcccccgccagaaccgacagaggcggcgacagcggcggcggcgacagaggcggcggcggcggcagaguggcccugaccgcccccggcgccgccgacgcccccggcgccggcgccaccgccggcauccacugguacagccagcugcuguaccagaucggcaccuggcugcuggacagcgaggcccugcacccccugggcauggccgugaagagcagcuaa

SEQ ID NO: 23307 - RNA, 888 nt, Artificial Sequence
  SHISA2__Homo_sapiens__NP_001007539
auguggggcgccagaagaagcagcgugagcagcagcuggaacgccgccagccugcugcagcugcugcuggccgcccugcuggccgccggcgccagagccagcggcgaguacugccacggcuggcuggacgcccagggcguguggagaaucggcuuccagugccccgagagauucgacggcggcgacgccaccaucugcugcggcagcugcgcccugagauacugcugcagcagcgccgaggccagacuggaccagggcggcugcgacaacgacagacagcagggcgccggcgagcccggcagagccgacaaggacggccccgacggcagcgccgugcccaucuacgugcccuuccugaucgugggcagcguguucguggccuucaucauccugggcagccugguggccgccugcugcugcagaugccugagacccaagcaggacccccagcagagcagagcccccggcggcaacagacugauggagaccauccccaugauccccagcgccagcaccagcagaggcagcagcagcagacagagcagcaccgccgccagcagcagcagcagcgccaacagcggcgccagagccccccccaccagaagccagaccaacugcugccugcccgagggcaccaugaacaacguguacgugaacaugcccaccaacuucagcgugcugaacugccagcaggccacccagaucgugccccaccagggccaguaccugcacccccccuacgugggcuacaccgugcagcacgacagcgugcccaugaccgccgugccccccuucauggacggccugcagcccggcuacagacagauccagagccccuucccccacaccaacagcgagcagaagauguaccccgccgugaccguguaa

SEQ ID NO: 23308 - RNA, 717 nt, Artificial Sequence
  SHISA3__Homo_sapiens__NP_001073974
augagagcccugcuggcccugugccugcugcugggcuggcugagauggggccccgccggcgcccagcagagcggcgaguacugccacggcuggguggacgugcagggcaacuaccacgagggcuuccagugccccgaggacuucgacacccuggacgccaccaucugcugcggcagcugcgcccugagauacugcugcgccgccgccgacgccagacuggagcagggcggcugcaccaacgacagaagagagcuggagcaccccggcaucaccgcccagcccguguacgugcccuuccugaucgugggcagcaucuucaucgccuucaucauccugggcagcgugguggccaucuacugcugcaccugccugagacccaaggagcccagccagcagcccaucagauucagccugagaagcuaccagaccgagacccugcccaugauccugaccagcaccagccccagagcccccagcagacagagcagcaccgccaccagcagcagcagcaccggcggcagcaucagaagauucagcuucgccagagccgagcccggcugccuggugcccagcccccccccccccuacaccaccagccacagcauccaccuggcccagcccagcggcuuccuggugagcccccaguacuucgccuacccccugcagcaggagcccccccugcccggcaagagcugccccgacuucagcagcagcuaa

SEQ ID NO: 23309 - RNA, 1503 nt, Artificial Sequence
  SHISA6__Homo_sapiens__NP_001166932
auggcccugagaagacugcugcugcugcugcugcugagccuggagagccuggaccugcugcccagcgugcacggcgccagaggcagagccgccaacagaacccugagcgccggcggcgccgccgugggcggcagaagagccggcggcgcccuggccagaggcggcagagagcugaacggcaccgccagagcccccggcauccccgaggccggcagcagaagaggccagcccgccgccgccguggccgccgccgccagcgccgccgugaccuacgagaccugcuggggcuacuacgacgugagcggccaguacgacaaggaguucgagugcaacaacagcgagagcggcuaccuguacugcugcggcaccugcuacuacagauucugcugcaagaagagacacgagaagcuggaccagagacagugcaccaacuaccagagccccgugugggugcagacccccagcaccaagguggugagccccggccccgagaacaaguacgaccccgagaaggacaagaccaacuucaccguguacaucaccugcggcgugaucgccuucgugaucguggccggcguguucgccaaggugagcuacgacaaggcccacagaccccccagagagaugaacauccacagagcccuggccgacauccugagacagcagggccccauccccaucgcccacugcgagagagagaccaucagcgccaucgacaccagccccaaggagaacacccccgugagaagcagcagcaagaaccacuacacccccgugagaaccgccaagcagacccccgagaagcccagaaugaacaacauccugaccagcgccaccgagcccuacgaccugagcuucagcagaagcuuccagaaccuggcccaccugccccccagcuacgagagcgccgugaagaccaaccccagcaaguacagcagccugaagagacugaccgacaaggaggccgacgaguacuacaugagaagaagacaccugcccgaccuggccgccagaggcacccugccccugaacgugauccagaugagccagcagaagccccugcccagagagagacccagaagacccaucagagccaugagccaggacagagugcugagccccgacagaggccugcccgacgaguucagcaugcccuacgacagaauccugagcgacgagcagcugcugagcaccgagagacugcacagccaggacccccugcugagccccgagagaaccgccuuccccgagcagagccugagcagagccaucagccacaccgacguguucgugagcacccccgugcuggacagauacagaaugagcaagaugcacagccaccccagcgccagcaacaacagcuacgccacccugggccagagccagaccgccgccaagagacacgccuucgccagcagaagacacaacaccguggagcagcugcacuacauccccggccaccacaccugcuacaccgccagcaagaccgaggugaccguguaa

SEQ ID NO: 23310 - RNA, 1275 nt, Artificial Sequence
  SHISA9__Homo_sapiens__NP_001138676
augagaagagugcugagacugcugcugggcugcuuccugaccgagcugugcgccagagugugcagagcccaggagagagccggccacggccagcuggcccagcugggcggcgugcugcugcuggccggcggcaacagaagcggcgccgccagcggcgaggccagcgagggcgccgaggccagcgacgccccccccaccagagcccccacccccgacuucugcagaggcuacuucgacgugaugggccagugggacccccccuucaacugcagcagcggcgacuucaucuucugcugcggcaccugcggcuucagauucugcugcaccuucaagaagagaagacugaaccagagcaccugcaccaacuacgacaccccccuguggcugaacaccggcaagccccccgccagaaaggacgacccccugcacgaccccaccaaggacaagaccaaccugaucguguacaucaucugcggcgugguggccgugauggugcuggugggcaucuucaccaagcugggccuggagaaggcccacagaccccagagagagcacaugagcagagcccuggccgacgugaugagaccccagggccacugcaacaccgaccacauggagagagaccugaacaucguggugcacgugcagcacuacgagaacauggacaccagaacccccaucaacaaccugcacgccacccagaugaacaacgccgugcccaccagcccccugcugcagcagaugggccacccccacagcuaccccaaccugggccagaucagcaaccccuacgagcagcagccccccggcaaggagcugaacaaguacgccagccugaaggccgugggcagcagcgacggcgacugggccgugagcacccugaagagccccaaggccgacaaggugaacgacgacuucuacaccaagagaagacaccuggccgagcuggccgccaagggcaaccugccccugcaccccgugagaguggaggacgagcccagagccuucagccccgagcacggccccgccaagcagaacggccagaagagcagaaccaacaagaugcccccccacccccuggccuacaccagcaccaccaacuucaagggcugggaccccaacgagcagagccugagaagacaggccuacagcaacaagggcaagcugggcaccgccgagaccggcagcagcgacccccugggcaccagaccccagcacuacccccccccccagcccuacuucaucaccaacagcaagaccgaggugaccguguaa

SEQ ID NO: 23311 - RNA, 1038 nt, Artificial Sequence
  SHMT1__Homo_sapiens__NP_001268715
augggccuggaccugcccgacggcggccaccugacccacggcuucaugaccgacaagaagaagaucagcgccaccagcaucuucuucgagagcaugcccuacaaggugaaccccgacaccggcuacaucaacuacgaccagcuggaggagaacgccagacuguuccaccccaagcugaucaucgccggcaccagcugcuacagcagaaaccuggaguacgccagacugagaaagaucgccgacgagaacggcgccuaccugauggccgacauggcccacaucagcggccugguggccgccggcguggugcccagccccuucgagcacugccacguggugaccaccaccacccacaagacccugagaggcugcagagccggcaugaucuucuacagaaagggcgugaagagcguggaccccaagaccggcaaggagauccuguacaaccuggagagccugaucaacagcgccguguuccccggccugcagggcggcccccacaaccacgccaucgccggcguggccguggcccugaagcaggccaugacccuggaguucaagguguaccagcaccaggugguggccaacugcagagcccugagcgaggcccugaccgagcugggcuacaagaucgugaccggcggcagcgacaaccaccugauccugguggaccugagaagcaagggcaccgacggcggcagagccgagaaggugcuggaggccugcagcaucgccugcaacaagaacaccugccccggcgacagaagcgcccugagacccagcggccugagacugggcacccccgcccugaccagcagaggccugcuggagaaggacuuccagaagguggcccacuucauccacagaggcaucgagcugacccugcagauccagagcgacaccggcgugagagccacccugaaggaguucaaggagagacuggccggcgacaaguaccaggccgccgugcaggcccugagagaggagguggagagcuucgccagccuguucccccugcccggccugcccgacuucuaa

SEQ ID NO: 23312 - RNA, 1485 nt, Artificial Sequence
  SHMT2__Homo_sapiens__NP_001159828
augcuguacuucagccuguucugggccgccagaccccugcagagaugcggccagcuggugagaauggccaucagagcccagcacagcaacgccgcccagacccagaccggcgaggccaacagaggcuggaccggccaggagagccugagcgacagcgaccccgagaugugggagcugcugcagagagagaaggacagacagugcagaggccuggagcugaucgccagcgagaacuucugcagcagagccgcccuggaggcccugggcagcugccugaacaacaaguacagcgagggcuaccccggcaagagauacuacggcggcgccgaggugguggacgagaucgagcugcugugccagagaagagcccuggaggccuucgaccuggaccccgcccaguggggcgugaacgugcagcccuacagcggcagccccgccaaccuggccguguacaccgcccugcugcagccccacgacagaaucaugggccuggaccugcccgacggcggccaccugacccacggcuacaugagcgacgugaagagaaucagcgccaccagcaucuucuucgagagcaugcccuacaagcugaaccuggcccugaccgccagacuguucagacccagacugaucaucgccggcaccagcgccuacgccagacugaucgacuacgccagaaugagagaggugugcgacgaggugaaggcccaccugcuggccgacauggcccacaucagcggccugguggccgccaaggugauccccagccccuucaagcacgccgacaucgugaccaccaccacccacaagacccugagaggcgccagaagcggccugaucuucuacagaaagggcgugaaggccguggaccccaagaccggcagagagauccccuacaccuucgaggacagaaucaacuucgccguguuccccagccugcagggcggcccccacaaccacgccaucgccgccguggccguggcccugaagcaggccugcacccccauguucagagaguacagccugcaggugcugaagaacgccagagccauggccgacgcccugcuggagagaggcuacagccuggugagcggcggcaccgacaaccaccuggugcugguggaccugagacccaagggccuggacggcgccagagccgagagagugcuggagcuggugagcaucaccgccaacaagaacaccugccccggcgacagaagcgccaucacccccggcggccugagacugggcgcccccgcccugaccagcagacaguucagagaggacgacuucagaagagugguggacuucaucgacgagggcgugaacaucggccuggaggugaagagcaagaccgccaagcugcaggacuucaagagcuuccugcugaaggacagcgagaccagccagagacuggccaaccugagacagagaguggagcaguucgccagagccuuccccaugcccggcuucgacgagcacuaa

SEQ ID NO: 23313 - RNA, 1611 nt, Artificial Sequence
  SHOC2__Homo_sapiens__NP_001255968
augagcagcagccugggcaaggagaaggacagcaaggagaaggaccccaaggugcccagcgccaaggagagagagaaggaggccaaggccagcggcggcuucggcaaggagagcaaggagaaggagcccaagaccaagggcaaggacgccaaggacggcaagaaggacagcagcgccgcccagcccggcguggccuucagcguggacaacaccaucaagagacccaaccccgcccccggcaccagaaagaagagcagcaacgccgaggugaucaaggagcugaacaagugcagagaggagaacagcaugagacuggaccugagcaagagaagcauccacauccugcccagcagcaucaaggagcugacccagcugaccgagcuguaccuguacagcaacaagcugcagagccugcccgccgaggugggcugccuggugaaccugaugacccuggcccugagcgagaacagccugaccagccugcccgacagccuggacaaccugaagaagcugagaaugcuggaccugagacacaacaagcugagagagauccccagcgugguguacagacuggacagccugaccacccuguaccugagauucaacagaaucaccaccguggagaaggacaucaagaaccugagcaagcugagcaugcugagcaucagagagaacaagaucaagcagcugcccgccgagaucggcaaccugagcagccugagcagacugggccugagauacaacagacugagcgccauccccagaagccuggccaagugcagcgcccuggaggagcugaaccuggagaacaacaacaucagcacccugcccgagagccugcugagcagccuggugaagcugaacagccugacccuggccagaaacugcuuccagcuguaccccgugggcggccccagccaguucagcaccaucuacagccugaacauggagcacaacagaaucaacaagauccccuucggcaucuucagcagagccaaggugcugagcaagcugaacaugaaggacaaccagcugaccagccugccccuggacuucggcaccuggaccagcaugguggagcugaaccuggccaccaaccagcugaccaagauccccgaggacgugagcggccuggugagccuggaggugcugauccugagcaacaaccugcugaagaagcugccccacggccugggcaaccugagaaagcugagagagcuggaccuggaggagaacaagcuggagagccugcccaacgagaucgccuaccugaaggaccugcagaagcuggugcugaccaacaaccagcugaccacccugcccagaggcaucggccaccugaccaaccugacccaccugggccugggcgagaaccugcugacccaccugcccgaggagaucggcacccuggagaaccuggaggagcuguaccugaacgacaaccccaaccugcacagccugcccuucgagcuggcccugugcagcaagcugagcaucaugagcaucgagaacugcccccugagccaccugcccccccagaucguggccggcggccccagcuucaucauccaguuccugaagaugcagggccccuacagagccaugguguaa

SEQ ID NO: 23314 - RNA, 960 nt, Artificial Sequence
  SHOX2__Homo_sapiens__NP_001157150
auggaggagcugaccgccuucgugagcaagagcuucgaccagaaggugaaggagaagaaggaggccaucaccuacagagaggugcuggagagcggcccccugagaggcgccaaggagcccaccggcugcaccgaggccggcagagacgacagaagcagccccgccgugagagccgccggcggcggcggcggcggcggcggcggcggcggcggcggcggcggcggcggcggcgugggcggcggcggcgccggcggcggcgccggcggcggcagaagccccgugagagagcuggacaugggcgccgccgagagaagcagagagcccggcagccccagacugaccgaggugagccccgagcugaaggacagaaaggaggacgccaagggcauggaggacgagggccagaccaagaucaagcagagaagaagcagaaccaacuucacccuggagcagcugaacgagcuggagagacuguucgacgagacccacuaccccgacgccuucaugagagaggagcugagccagagacugggccugagcgaggccagagugcaggugugguuccagaacagaagagccaagugcagaaagcaggagaaccagcugcacaagggcgugcugaucggcgccgccagccaguucgaggccugcagaguggcccccuacgugaacgugggcgcccugagaaugcccuuccagcaggugcaggcccagcugcagcuggacagcgccguggcccacgcccaccaccaccugcacccccaccuggccgcccacgcccccuacaugauguuccccgccccccccuucggccugccccuggccacccuggccgccgacagcgccagcgccgccagcgugguggccgccgccgccgccgccaagaccaccagcaagaacagcagcaucgccgaccugagacugaaggccaagaagcacgccgccgcccugggccuguaa

SEQ ID NO: 23315 - RNA, 879 nt, Artificial Sequence
  SHOX__Homo_sapiens__NP_000442
auggaggagcugaccgccuucgugagcaagagcuucgaccagaagagcaaggacggcaacggcggcggcggcggcggcggcggcaagaaggacagcaucaccuacagagaggugcuggagagcggccuggccagaagcagagagcugggcaccagcgacagcagccugcaggacaucaccgagggcggcggccacugccccgugcaccuguucaaggaccacguggacaacgacaaggagaagcugaaggaguucggcaccgccagaguggccgagggcaucuacgagugcaaggagaagagagaggacgugaagagcgaggacgaggacggccagaccaagcugaagcagagaagaagcagaaccaacuucacccuggagcagcugaacgagcuggagagacuguucgacgagacccacuaccccgacgccuucaugagagaggagcugagccagagacugggccugagcgaggccagagugcaggugugguuccagaacagaagagccaagugcagaaagcaggagaaccagaugcacaagggcgugauccugggcaccgccaaccaccuggacgccugcagaguggcccccuacgugaacaugggcgcccugagaaugcccuuccagcaggugcaggcccagcugcagcuggagggcguggcccacgcccacccccaccugcacccccaccuggccgcccacgcccccuaccugauguucccccccccccccuucggccugcccaucgccagccuggccgagagcgccagcgccgccgccgugguggccgccgccgccaagagcaacagcaagaacagcagcaucgccgaccugagacugaaggccagaaagcacgccgaggcccugggccuguaa

SEQ ID NO: 23316 - RNA, 1437 nt, Artificial Sequence
  SHPK__Homo_sapiens__NP_037408
auggccgccagacccaucacccugggcaucgaccugggcaccaccagcgugaaggccgcccugcugagagccgcccccgacgaccccagcggcuucgccgugcuggccagcugcgccagagccgccagagccgaggccgccguggagagcgccguggccggcccccagggcagagagcaggacgugagcagaauccugcaggcccugcacgagugccuggccgcccugcccagaccccagcugagaagcguggugggcaucggcgugagcggccagaugcacggcgugguguucuggaagaccggccagggcugcgaguggaccgagggcggcaucacccccguguucgagcccagagccgugagccaccuggugaccuggcaggacggcagaugcagcagcgaguuccuggccagccugccccagcccaagagccaccugagcguggccaccggcuucggcugcgccaccaucuucuggcugcugaaguacagacccgaguuccugaagagcuacgacgccgccggcaccauccacgacuacgugguggccaugcugugcggccugcccagaccccugaugagcgaccagaacgccgccagcuggggcuacuucaacacccagagccagagcuggaacguggagacccugagaagcagcggcuuccccgugcaccugcugcccgacaucgccgagcccggcagcguggccggcagaaccagccacaugugguucgagauccccaagggcacccaggugggcguggcccugggcgaccugcaggccagcguguacagcugcauggcccagagaaccgacgccgugcugaacaucagcaccagcgugcagcuggccgccagcaugcccagcggcuuccagcccgcccagacccccgaccccaccgcccccguggccuacuuccccuacuucaacagaaccuaccugggcguggccgccagccugaacggcggcaacgugcuggccaccuucgugcacaugcuggugcaguggauggccgaccugggccuggagguggaggagagcaccguguacagcagaaugauccaggccgccgugcagcagagagacacccaccugaccaucacccccaccgugcugggcgagagacaccugcccgaccagcuggccagcgugaccagaaucagcagcagcgaccugagccugggccacgugaccagagcccugugcagaggcaucgugcagaaccugcacagcaugcugcccauccagcagcugcaggaguggggcguggagagagugaugggcagcggcagcgcccugagcagaaacgacgugcugaagcaggaggugcagagagccuucccccugcccaugagcuucggccaggacguggacgccgccgugggcgccgcccuggugaugcugagaagacaccugaaccagaaggagagcuaa

SEQ ID NO: 23317 - RNA, 5052 nt, Artificial Sequence
  SHPRH__Homo_sapiens__NP_001036148
augagcagcagaagaaagagagccccccccgugagaguggacgaggagaagagacagcagcugcacuggaacaugcacgaggacagaagaaacgagcccaucaucaucagcgacgacgacgagcagcccugccccggcagcgacaccagcagcgcccacuacaucauccugagcgacagccugaaggaggagguggcccacagagacaagaagagaugcagcaagguggugagcuucagcaagcccaucgagaaggaggagaccgugggcaucuucagcccccugagcgugaagcugaacaucgugaucagccccuaccacuucgacaacagcuggaaggccuuccugggcgagcugacccugcagcugcugcccgcccagagccugaucgagaacuucagcgagagaagcaucacccugaugagcagcgagagcagcaaccaguuccugaucuacgugcacagcaagggcgaggacguggagaagcagaagaaggagcccaugagcaucugcgacaagggcauccugguggagagcagcuucagcggcgagaugcuggaggaccugggcuggcugcagaagaagagaagaaucaagcuguaccagaagcccgagggcaaccacaucaucaaggugggcaucuaccugcuggaggccggccuggccaagcuggacuuccugagcgacgccaacagcagaaugaagaaguucaaccagcugaugaagaaggugauggagaagcugcacaacagcaucauccccgacgugcuggaggaggacgaggacgaccccgagagcgagcccgagggccaggacaucgacgagcuguaccacuucgugaagcagacccaccagcaggagacccagagcauccagguggacgugcagcaccccgcccugauccccgugcugagacccuaccagagagaggccgugaacuggaugcugcagcaggagugcuucagaagcagccccgccaccgagagcgcccugcacuuccuguggagagagaucgugaccagcgagggccugaagcuguacuacaaccccuacaccggcugcaucaucagagaguaccccaacagcggcccccagcugcugggcggcauccuggccgacgagaugggccugggcaagaccguggaggugcuggcccugauccugacccacaccagacaggacgugaagcaggacgcccugacccugcccgagggcaagguggugaacuacuucauccccagccacuacuucggcggcaagcugaagaagaccgagauccagaacaucgaguucgagcccaaggagaaggugcagugcccccccaccagagugaugauccugaccgccgugaaggagaugaacggcaagaagggcgugagcauccugagcaucuacaaguacgugagcagcaucuacagauacgacgugcagagaaacagaagccugcugaagagaaugcugaagugccugaucuucgagggccuggugaagcagaucaagggccacggcuucagcggcaccuucacccugggcaagaacuacaaggaggaggacaucugcgacaagaccaagaagcaggccgugggcagccccagaaagauccagaaggagaccagaaagagcggcaacaaggacaccgacagcgaguaccugcccagcgacaccagcgacgacgacgacgaccccuacuacuacuacuacaagagcagaagaaacagaagcaagcugagaaagaagcuggugcccagcaccaagaagggcaagagccagcccuucaucaaccccgacagccagggccacugccccgccaccagcgacagcggcaucaccgacguggccaugagcaagagcaccugcaucagcgaguucaaccaggagcacgagaccgaggacugcgccgagagccugaaccacgccgacagcgacgugccccccagcaacaccaugagccccuucaacaccagcgacuacagauucgagugcaucugcggcgagcuggaccagaucgacagaaagcccagagugcagugccugaagugccaccuguggcagcacgccaagugcgugaacuacgacgagaagaaccugaagaucaagcccuucuacugcccccacugccugguggccauggagcccgugagcaccagagccacccugaucaucagccccagcagcaucugccaccaguggguggacgagaucaacagacacgugagaagcagcagccugagagugcugguguaccagggcgugaagaaggacggcuuccugcagccccacuuccuggccgagcaggacaucgugaucaucaccuacgacgugcugagaagcgagcugaacuacguggacaucccccacagcaacagcgaggacggcagaagacugagaaaccagaagagauacauggccauccccagcccccugguggccguggagugguggagaaucugccuggacgaggcccagaugguggagugccccaccgugaaggccgccgagauggcccagagacugagcggcaucaacagauggugcaucagcggcacccccgugcagagaggccuggaggaccuguucggccuggugguguuccugggcaucgagcccuacugcgugaagcacuggugggugagacugcuguacagacccuacugcaagaagaacccccagcaccuguacagcuucaucgccaagauccuguggagaagcgccaagaaggacgugaucgaccagauccagauccccccccagaccgaggagauccacuggcugcacuucagccccguggagagacacuucuaccacagacagcacgaggugugcugccaggacgugguggugaagcugagaaagaucagcgacugggcccugaagcugagcagccuggacagaagaaccgugaccagcauccuguacccccugcugagacugagacaggccugcugccacccccaggccgugagaggcgaguuccugccccugcagaagagcaccaugaccauggaggagcugcugaccagccugcagaagaagugcggcaccgagugcgaggaggcccacagacagcuggugugcgcccugaacggccuggccggcauccacaucaucaagggcgaguacgcccuggccgccgagcuguacagagaggugcugagaagcagcgaggagcacaagggcaagcugaagaccgacagccugcagagacugcacgccacccacaaccugauggagcugcugaucgccagacaccccggcaucccccccacccugagagacggcagacuggaggaggaggccaagcagcugagagagcacuacaugagcaagugcaacaccgagguggccgaggcccagcaggcccuguaccccgugcagcagaccauccacgagcugcagagaaagauccacagcaacagccccugguggcugaacgugauccacagagccaucgaguucaccaucgacgaggagcuggugcagagagugagaaacgagaucaccagcaacuacaagcagcagaccggcaagcugagcaugagcgagaaguucagagacugcagaggccugcaguuccugcugaccacccagauggaggagcugaacaagugccagaagcuggugagagaggccgugaagaaccuggagggcccccccagcagaaacgugaucgagagcgccaccgugugccaccugagacccgccagacugccccugaacugcugcguguucugcaaggccgacgagcuguucaccgaguacgagagcaagcuguucagcaacaccgugaagggccagaccgccaucuucgaggagaugaucgaggacgaggagggccugguggacgacagagcccccaccaccaccagaggccugugggccaucagcgagaccgagagaagcaugaaggccauccugagcuucgccaagagccacagauucgacguggaguucguggacgagggcagcaccagcauggaccuguucgaggccuggaagaaggaguacaagcugcugcacgaguacuggauggcccugagaaacagagugagcgccguggacgagcuggccauggccaccgagagacugagagugagagaccccagagagcccaagcccaacccccccgugcugcacaucaucgagccccacgagguggagcagaacagaaucaagcugcugaacgacaaggccguggccaccagccagcugcagaagaagcugggccagcugcuguaccugaccaaccuggagaagagccaggacaagaccagcggcggcgugaaccccgagcccugccccaucugcgccagacagcugggcaagcagugggccgugcugaccugcggccacugcuucugcaacgagugcaucagcaucaucaucgagcaguacagcgugggcagccacagaagcagcaucaagugcgccaucugcagacagaccaccagccacaaggagaucagcuacguguucaccagcgagaaggccaaccaggaggaggacauccccgugaagggcagccacagcaccaagguggaggccguggugagaacccugaugaagauccagcugagagaccccggcgccaaggcccugguguucagcaccuggcaggacgugcuggacaucaucagcaaggcccugaccgacaacaacauggaguucgcccagaucagcagagugaagaccuuccaggagaaccugagcgccuucaagagagacccccagaucaacauccugcugcugccccugcacaccggcagcaacggccugaccaucaucgaggccacccacgugcugcugguggagcccauccugaaccccgcccacgagcugcaggccaucggcagagugcacagaaucggccagaccaagcccaccaucgugcacagauuccugaucaaggccaccaucgaggagagaaugcaggccaugcugaagaccgccgagagaagccacaccaacagcagcgccaagcacagcgaggccagcgugcugaccguggccgaccuggccgaccuguucaccaaggagaccgaggagcuggaguaa

SEQ ID NO: 23318 - RNA, 1734 nt, Artificial Sequence
  SHQ1__Homo_sapiens__NP_060600
augcugacccccgccuucgaccugagccaggaccccgacuuccugaccaucgccaucagagugcccuacgccagagugagcgaguucgacguguacuucgagggcagcgacuucaaguucuacgccaagcccuacuuccugagacugacccugcccggcagaaucguggagaacggcagcgagcagggcagcuacgacgccgacaagggcaucuucaccaucagacugcccaaggagacccccggccagcacuucgagggccugaacaugcugaccgcccugcuggcccccagaaagagcagaaccgccaagccccugguggaggagaucggcgccagcgagauccccgaggaggugguggacgacgaggaguucgacugggagaucgagcagacccccugcgaggaggugagcgagagcgcccugaacccccagugccacuacggcuucggcaaccugagaagcggcgugcugcagagacugcaggacgagcugagcgacgugaucgacaucaaggaccccgacuucacccccgccgccgagagaagacagaagagacuggccgccgagcuggccaaguucgaccccgaccacuaccuggccgacuucuucgaggacgaggccaucgagcagauccugaaguacaaccccugguggaccgacaaguacagcaagaugauggccuuccuggagaagagccaggagcaggagaaccacgccacccuggugagcuucagcgaggaggagaaguaccagcugagaaaguucgugaacaagagcuaccugcuggacaagagagccugcagacaggugugcuacagccugaucgacauccugcuggccuacugcuacgagaccagagugaccgagggcgagaagaacguggagagcgccuggaacaucagaaagcugagccccacccugugcugguucgagaccuggaccaacgugcacgacaucauggugagcuucggcagaagagugcugugcuacccccuguacagacacuucaagcuggugaugaaggccuacagagacaccaucaagauccugcagcugggcaagagcgccgugcugaagugccugcuggacauccacaagaucuuccaggagaacgaccccgccuacauccugaacgaccuguacaucagcgacuacugcguguggauccagaaggugaagagcaagaagcuggccgcccuggccgaggcccugaaggaggugagccugaccaaggcccagcugggccuggagcuggaggagcuggaggccgccgcccugcuggugcaggaggaggagaccgcccugaaggccgcccacagcgugagcggccagcagacccugugcagcagcagcgaggccagcgacagcgaggacagcgacagcagcgugagcagcggcaacgaggacagcggcagcgacagcgagcaggacgagcugaaggacagccccagcgagaccgugagcagccugcagggccccuuccuggaggagagcagcgccuuccugaucguggacggcggcgugagaagaaacaccgccauccaggagagcgacgccagccagggcaagccccuggccagcagcuggccccugggcgugagcggcccccugaucgaggagcugggcgagcagcugaagaccaccgugcaggugagcgagcccaagggcaccaccgccgugaacagaagcaacauccaggagagagacggcugccagacccccaacaacuaa

SEQ ID NO: 23319 - RNA, 4851 nt, Artificial Sequence
  SHROOM2__Homo_sapiens__NP_001640
auggagggcgccgagcccagagccagacccgagagacuggccgaggccgagaccagagccgccgacggcggcagacugguggaggugcagcugagcggcggcgcccccuggggcuucacccugaagggcggcagagagcacggcgagccccuggugaucaccaagaucgaggagggcagcaaggccgccgccguggacaagcugcuggccggcgacgagaucgugggcaucaacgacaucggccugagcggcuucagacaggaggccaucugccuggugaagggcagccacaagacccugaagcugguggugaagagaagaagcgagcugggcuggagaccccacagcuggcacgccaccaaguucagcgacagccaccccgagcuggccgccagccccuucaccagcaccagcggcugccccagcuggagcggcagacaccacgccagcagcagcagccacgaccugagcagcagcugggagcagaccaaccugcagagaacccuggaccacuucagcagccugggcagcguggacagccuggaccaccccagcagcagacugagcguggccaagagcaacagcagcaucgaccaccugggcagccacagcaagagagacagcgccuacggcagcuucagcaccagcagcagcacccccgaccacacccugagcaaggccgacaccagcagcgccgagaacauccuguacaccgugggccugugggaggcccccagacagggcggcagacaggcccaggccgccggcgacccccagggcagcgaggagaagcugagcugcuucccccccagagugcccggcgacagcggcaagggccccagacccgaguacaacgccgagcccaagcuggccgcccccggcagaagcaacuucggccccgugugguacgugcccgacaagaagaaggcccccagcagcccccccccccccccccccccccugagaagcgacagcuucgccgccaccaagagccacgagaaggcccagggccccguguucagcgaggccgccgccgcccagcacuucaccgcccuggcccaggcccagcccagaggcgacagaagacccgagcugaccgacagacccuggagaagcgcccaccccggcagccugggcaagggcagcggcggccccggcugcccccaggaggcccacgccgacggcagcuggccccccagcaaggacggcgccagcagcagacugcaggccagccugagcagcagcgacgugagauucccccagagcccccacagcggcagacaccccccccuguacagcgaccacagcccccugugcgccgacagccugggccaggagcccggcgccgccagcuuccagaacgacagccccccccaggugagaggccugagcagcugcgaccagaagcugggcagcggcuggcagggccccagacccugcgugcagggcgaccugcaggccgcccagcugugggccggcugcuggcccagcgacaccgcccugggcgcccuggagagccugcccccccccaccgugggccagagccccagacaccaccugccccagcccgagggcccccccgacgccagagagaccggcagaugcuacccccuggacaagggcgccgagggcugcagcgccggcgcccaggagccccccagagccagcagagccgagaaggccagccagagacuggccgccagcaucaccugggccgacggcgagagcagcagaaucugcccccaggagaccccccugcugcacagccugacccaggagggcaagagaagacccgagagcagccccgaggacagcgccaccagacccccccccuucgacgcccacgugggcaagcccaccagaagaagcgacagauucgccaccacccugagaaacgagauccagaugcacagagccaagcugcagaagagcagaagcaccguggcccugaccgccgccggcgaggccgaggacggcaccggcagauggagagccggccugggcggcggcacccaggagggcccccuggccggcaccuacaaggaccaccugaaggaggcccaggccagagugcugagagccaccagcuucaagagaagagaccuggaccccaaccccggcgaccuguaccccgagagccuggagcacagaaugggcgaccccgacaccgugccccacuucugggaggccggccuggcccagccccccagcagcaccagcggcggcccccacccccccagaaucggcggcagaagaagauucaccgccgagcagaagcugaagagcuacagcgagcccgagaagaugaacgaggugggccugaccagaggcuacagcccccaccagcaccccagaaccagcgaggacaccgugggcaccuucgccgacagauggaaguucuucgaggagaccagcaagcccgugccccagagacccgcccagaagcaggcccugcacggcauccccagagacaagcccgagagacccagaaccgccggcagaaccugcgagggcaccgagcccuggagcagaaccaccagccugggcgacagccugaacgcccacagcgccgccgagaaggccggcaccagcgaccugcccagaagacugggcaccuucgccgaguaccaggccagcuggaaggagcagagaaagccccuggaggccagaagcagcggcagaugccacagcgccgacgacauccuggacgugagccuggacccccaggagagaccccagcacgugcacggcagaagcagaagcagccccagcaccgaccacuacaagcaggaggccagcguggagcugagaagacaggccggcgaccccggcgagcccagagaggagcugcccagcgccgugagagccgaggagggccagagcacccccagacaggccgacgcccagugcagagagggcagccccggcagccagcagcacccccccagccagaaggcccccaacccccccaccuucagcgagcugagccacugcagaggcgcccccgagcugcccagagagggcagaggcagagccggcacccugcccagagacuacagauacagcgaggagagcacccccgccgaccugggccccagagcccagagccccggcagcccccugcacgccagaggccaggacagcuggcccgugagcagcgcccugcugagcaagagacccgccccccagagaccccccccccccaagagagagcccagaagauacagagccaccgacggcgcccccgccgacgcccccgugggcgugcugggcagacccuuccccacccccagccccgccagccuggacguguacguggccagacugagccugagccacagccccagcguguucagcagcgcccagccccaggacacccccaaggccaccgugugcgagagaggcagccagcacgugagcggcgacgccagcagaccccugcccgaggcccugcugccccccaagcagcagcaccugagacugcagaccgccaccauggagaccagcagaagccccagcccccaguucgccccccagaagcugaccgacaagcccccccugcugauccaggacgaggacagcaccagaaucgagagagugauggacaacaacaccaccgugaagauggugcccaucaagaucgugcacagcgagagccagcccgagaaggagagcagacagagccuggccugccccgccgagccccccgcccugccccacggccuggagaaggaccagaucaagacccugagcaccagcgagcaguucuacagcagauucugccuguacaccagacagggcgccgagcccgaggccccccacagagcccagcccgccgagccccagccccugggcacccaggugccccccgagaaggacagaugcaccagcccccccggccugagcuacaugaaggccaaggagaagaccguggaggaccugaagagcgaggagcuggccagagagaucgugggcaaggacaagagccuggccgacauccuggaccccagcgugaagaucaagaccaccauggaccugauggagggcaucuuccccaaggacgagcaccugcuggaggaggcccagcagagaagaaagcugcugcccaagauccccagccccagaagcaccgaggagagaaaggaggagcccagcgugcccgccgccgugagccuggccaccaacagcaccuacuacagcaccagcgcccccaaggccgagcugcugaucaagaugaaggaccugcaggagcagcaggagcacgaggaggacagcggcagcgaccuggaccacgaccugagcgugaagaagcaggagcugaucgagagcaucagcagaaagcugcaggugcugagagaggccagagagagccugcuggaggacgugcaggccaacaccgugcugggcgccgagguggaggccaucgugaagggcgugugcaagcccagcgaguucgacaaguucagaauguucaucggcgaccuggacaagguggugaaccugcugcugagccugagcggcagacuggccagaguggagaacgcccugaacaaccuggacgacggcgccagccccggcgacagacagagccugcuggagaagcagagagugcugauccagcagcacgaggacgccaaggagcugaaggagaaccuggacagaagagagagaaucguguucgacauccuggccaacuaccugagcgaggagagccuggccgacuacgagcacuucgugaagaugaagagcgcccugaucaucgagcagagagagcuggaggacaagauccaccugggcgaggagcagcugaagugccugcuggacagccugcagcccgagagaggcaaguaa

SEQ ID NO: 23320 - RNA, 5991 nt, Artificial Sequence
  SHROOM3__Homo_sapiens__NP_065910
augaugagaaccaccgaggacuuccacaagcccagcgccacccugaacagcaacaccgccaccaagggcagauacaucuaccuggaggccuuccuggagggcggcgcccccuggggcuucacccugaagggcggccuggagcacggcgagccccugaucaucagcaagguggaggagggcggcaaggccgacacccugagcagcaagcugcaggccggcgacgagguggugcacaucaacgaggugacccugagcagcagcagaaaggaggccgugagccuggugaagggcagcuacaagacccugagacugguggugagaagagacgugugcaccgaccccggccacgccgacaccggcgccagcaacuucgugagccccgagcaccugaccagcggcccccagcacagaaaggccgccuggagcggcggcgugaagcugagacugaagcacagaagaagcgagcccgccggcagaccccacagcuggcacaccaccaagagcggcgagaagcagcccgacgccagcaugaugcagaucagccagggcaugaucggcccccccuggcaccagagcuaccacagcagcagcagcaccagcgaccugagcaacuacgaccacgccuaccugagaagaagccccgaccagugcagcagccagggcagcauggagagccuggagcccagcggcgccuacccccccugccaccugagccccgccaagagcaccggcagcaucgaccagcugagccacuuccacaacaagagagacagcgccuacagcagcuucagcaccagcagcagcauccuggaguacccccaccccggcaucagcggcagagagagaagcggcagcauggacaacaccagcgccagaggcggccugcuggagggcaugagacaggccgacaucagauacgugaagaccguguacgacaccagaagaggcgugagcgccgaguacgaggugaacagcagcgcccugcugcugcagggcagagaggccagagccagcgccaacggccagggcuacgacaaguggagcaacauccccagaggcaagggcgugcccccccccagcuggagccagcagugccccagcagccuggagaccgccaccgacaaccugccccccaaggugggcgccccccugccccccgccagaagcgacagcuacgccgccuucagacacagagagagacccagcagcuggagcagccuggaccagaagagacugugcagaccccaggccaacagccugggcagccugaagagccccuucaucgaggagcagcugcacaccgugcuggagaagagccccgagaacagcccccccgugaagcccaagcacaacuacacccagaaggcccagcccggccagccccugcugcccaccagcaucuaccccgugcccagccuggagccccacuucgcccaggugccccagcccagcgugagcagcaacggcaugcuguaccccgcccuggccaaggagagcggcuacaucgccccccagggcgccugcaacaagauggccaccaucgacgagaacggcaaccagaacggcagcggcagacccggcuucgccuucugccagccccuggagcacgaccugcugagccccguggagaagaagcccgaggccaccgccaaguacgugcccagcaaggugcacuucugcagcgugcccgagaacgaggaggacgccagccugaagagacaccugacccccccccagggcaacagcccccacagcaacgagagaaagagcacccacagcaacaagcccagcagccacccccacagccugaagugcccccaggcccaggccuggcaggccggcgaggacaagagaagcagcagacugagcgagcccugggagggcgacuuccaggaggaccacaacgccaaccuguggagaagacuggagagagagggccugggccagagccugagcggcaacuucggcaagaccaagagcgccuucagcagccugcagaacauccccgagagccugagaagacacagcagccuggagcugggcagaggcacccaggagggcuaccccggcggcagacccaccugcgccgugaacaccaaggccgaggaccccggcagaaaggccgcccccgaccugggcagccaccuggacagacaggugagcuaccccagacccgagggcagaaccggcgccagcgccagcuucaacagcaccgaccccagccccgaggagccccccgcccccagccacccccacaccagcagccugggcagaagaggccccggccccggcagcgccagcgcccugcagggcuuccaguacggcaagccccacugcagcgugcuggagaaggugagcaaguucgagcagagagagcagggcagccagagacccagcgugggcggcagcggcuucggccacaacuacagaccccacagaaccgugagcaccagcagcaccagcggcaacgacuucgaggagaccaaggcccacaucagauucagcgagagcgccgagccccugggcaacggcgagcagcacuucaagaacggcgagcugaagcuggaggaggccagcagacagcccugcggccagcagcugagcggcggcgccagcgacagcggcagaggcccccagagacccgacgccagacugcugagaagccagagcaccuuccagcugagcagcgagcccgagagagagcccgaguggagagacagacccggcagccccgagagcccccugcuggacgcccccuucagcagagccuacagaaacagcaucaaggacgcccagagcagagugcugggcgccaccagcuucagaagaagagaccuggagcugggcgcccccguggccagcagaagcuggagacccagacccagcagcgcccacgugggccugagaagccccgaggccagcgccagcgccagcccccacacccccagagagagacacagcgugacccccgccgagggcgaccuggccagacccgugccccccgccgccagaagaggcgccagaagaagacugacccccgagcagaagaagagaagcuacagcgagcccgagaagaugaacgaggugggcaucguggaggaggccgagcccgccccccugggcccccagagaaacggcaugagauuccccgagagcagcguggccgacagaagaagacuguucgagagagacggcaaggccugcagcacccugagccugagcggccccgagcugaagcaguuccagcagagcgcccuggccgacuacauccagagaaagaccggcaagagacccaccagcgccgccggcugcagccugcaggagcccggcccccugagagagagagcccagagcgccuaccugcagcccggccccgccgcccuggagggcagcggccuggccagcgccagcagccugagcagccugagagagcccagccugcagcccagaagagaggccacccugcugcccgccaccguggccgagacccagcaggcccccagagacagaagcagcagcuucgccggcggcagaagacugggcgagagaagaagaggcgaccugcugagcggcgccaacggcggcaccagaggcacccagagaggcgacgagacccccagagagcccagcagcuggggcgccagagccggcaagagcaugagcgccgaggaccugcuggagagaagcgacgugcuggccggccccgugcacgugagaagcagaagcagccccgccaccgccgacaagagacaggacgugcugcugggccaggacagcggcuucggccuggugaaggaccccugcuaccuggccggccccggcagcagaagccugagcugcagcgagagaggccaggaggagaugcugccccuguuccaccaccugacccccagauggggcggcagcggcugcaaggccaucggcgacagcagcgugcccagcgagugccccggcacccuggaccaccagagacaggccagcagaacccccugccccagacccccccuggccggcacccagggccuggugaccgacaccagagccgccccccugacccccaucggcaccccccugcccagcgccauccccagcggcuacugcagccaggacggccagaccggcagacagccccugccccccuacacccccgccaugaugcacagaagcaacggccacacccugacccagccccccggccccagaggcugcgagggcgacggccccgagcacggcguggaggagggcaccagaaagagagugagccugccccaguggcccccccccagcagagccaagugggcccacgccgccagagaggacagccugcccgaggagagcagcgcccccgacuucgccaaccugaagcacuaccagaagcagcagagccugcccagccugugcagcaccagcgaccccgacaccccccugggcgcccccagcacccccggcagaaucagccugagaaucagcgagagcgugcugagagacagcccccccccccacgaggacuacgaggacgagguguucgugagagacccccaccccaaggccaccagcagccccaccuucgagccccugccccccccccccccccccccccccagccaggagacccccguguacagcauggacgacuucccccccccccccccccacaccgugugcgaggcccagcuggacagcgaggaccccgagggccccagacccagcuucaacaagcugagcaaggugaccaucgccagagagagacacaugcccggcgccgcccacguggugggcagccagacccuggccagcagacugcagaccagcaucaagggcagcgaggccgagagcaccccccccagcuucaugagcgugcacgcccagcuggccggcagccugggcggccagcccgcccccauccagacccagagccugagccacgaccccgugagcggcacccagggccuggagaagaaggugagccccgacccccagaagagcagcgaggacaucagaaccgaggcccuggccaaggagaucgugcaccaggacaagagccuggccgacauccuggaccccgacagcagacugaagaccaccauggaccugauggagggccuguuccccagagacgugaaccugcugaaggagaacagcgugaagagaaaggccauccagagaaccgugagcagcagcggcugcgagggcaagagaaacgaggacaaggaggccgugagcaugcuggugaacugccccgccuacuacagcgugagcgcccccaaggccgagcugcugaacaagaucaaggagaugcccgccgaggugaacgaggaggaggagcaggccgacgugaacgagaagaaggccgagcugaucggcagccugacccacaagcuggagacccugcaggaggccaagggcagccugcugaccgacaucaagcugaacaacgcccugggcgaggagguggaggcccugaucagcgagcugugcaagcccaacgaguucgacaaguacagaauguucaucggcgaccuggacaagguggugaaccugcugcugagccugagcggcagacuggccagaguggagaacgugcugagcggccugggcgaggacgccagcaacgaggagagaagcagccuguacgagaagagaaagauccuggccggccagcacgaggacgccagagagcugaaggagaaccuggacagaagagagagaguggugcugggcauccuggccaacuaccugagcgaggagcagcugcaggacuaccagcacuucgugaagaugaagagcacccugcugaucgagcagagaaagcuggacgacaagaucaagcugggccaggagcaggugaagugccugcuggagagccugcccagcgacuucauccccaaggccggcgcccuggcccugccccccaaccugaccagcgagcccauccccgccggcggcugcaccuucagcggcaucuuccccacccugaccagcccccuguaa

SEQ ID NO: 23321 - RNA, 4482 nt, Artificial Sequence
  SHROOM4__Homo_sapiens__NP_065768
auggagaacagacccggcagcuuccaguacgugcccgugcagcugcagggcggcgcccccuggggcuucacccugaagggcggccuggagcacugcgagccccugaccgugagcaagaucgaggacggcggcaaggccgcccugagccagaagaugagaaccggcgacgagcuggugaacaucaacggcaccccccuguacggcagcagacaggaggcccugauccugaucaagggcagcuucagaauccugaagcugaucgugagaagaagaaacgcccccgugagcagaccccacagcuggcacguggccaagcugcuggagggcugccccgaggccgccaccaccaugcacuuccccagcgaggccuucagccugagcuggcacagcggcugcaacaccagcgacgugugcgugcaguggugcccccugagcagacacugcagcaccgagaagagcagcagcaucggcagcauggagagccuggagcagcccggccaggccaccuacgagagccaccugcugcccaucgaccagaacauguaccccaaccagagagacagcgccuacagcagcuucagcgccagcagcaacgccagcgacugcgcccugagccugagacccgaggagcccgccagcaccgacugcaucaugcagggccccggccccaccaaggcccccagcggcagacccaacguggccgagaccagcggcggcagcagaagaaccaacggcggccaccugacccccagcagccagaugagcagcagaccccaggagggcuaccagagcggccccgccaaggccgugagaggccccccccagccccccgugagaagagacagccugcaggccagcagagcccagcugcugaacggcgagcagagaagagccagcgagcccguggugccccugccccagaaggagaagcugagccuggagcccgugcugcccgccagaaaccccaacagauucugcugccugagcggccacgaccaggugaccagcgagggccaccagaacugcgaguucagccagccccccgagagcagccagcagggcagcgagcaccugcugaugcaggccagcaccaaggccgugggcagccccaaggccugcgacagagccagcagcguggacagcaacccccugaacgaggccagcgccgagcuggccaaggccagcuucggcagacccccccaccugaucggccccaccggccacagacacagcgcccccgagcagcugcuggccagccaccugcagcacgugcaccuggacaccagaggcagcaagggcauggagcugccccccgugcaggacggccaccaguggacccugagcccccugcacagcagccacaagggcaagaagagccccugcccccccaccggcggcacccacgaccagagcagcaaggagagaaagaccagacagguggacgacagaagccuggugcugggccaccagagccagagcagccccccccacggcgaggccgacggccaccccagcgagaagggcuuccuggaccccaacagaaccagcagagccgccagcgagcuggccaaccagcagcccagcgccagcggcagccuggugcagcaggccaccgacugcagcagcaccaccaaggccgccagcggcaccgaggccggcgaggagggcgacagcgagcccaaggagugcagcagaaugggcggcagaagaagcggcggcaccagaggcagaagcauccagaacagaagaaagagcgagagauucgccaccaaccugagaaacgagauccagagaagaaaggcccagcugcagaagagcaagggcccccugagccagcugugcgacaccaaggagcccguggaggagacccaggagccccccgagagccccccccugaccgccagcaacaccagccugcugagcagcugcaagaagccccccagccccagagacaagcuguucaacaagagcaugaugcugagagccagaagcagcgagugccugagccaggcccccgagagccacgagagcagaaccggccuggagggcagaaucagccccggccagagacccggccagagcagccugggccugaacaccugguggaaggcccccgaccccagcagcagcgaccccgagaaggcccacgcccacugcggcgugagaggcggccacuggagauggagccccgagcacaacagccagccccugguggccgccgccauggagggccccagcaaccccggcgacaacaaggagcugaaggccagcaccgcccaggccggcgaggacgccauccugcugcccuucgccgacagaagaaaguucuucgaggagagcagcaagagccugagcaccagccaccugcccggccugaccacccacagcaacaagaccuucacccagagacccaagcccaucgaccagaacuuccagcccaugagcagcagcugcagagagcugagaagacaccccauggaccagagcuaccacagcgccgaccagcccuaccacgccaccgaccagagcuaccacagcaugagcccccugcagagcgagacccccaccuacagcgagugcuucgccagcaagggccuggagaacagcaugugcugcaagccccugcacugcggcgacuucgacuaccacagaaccugcagcuacagcugcagcgugcagggcgcccuggugcacgaccccugcaucuacugcagcggcgagaucugccccgcccugcugaagagaaacaugaugcccaacugcuacaacugcagaugccaccaccaccagugcaucagaugcagcgugugcuaccacaacccccagcacagcgcccuggaggacagcagccuggcccccggcaacaccuggaagcccagaaagcugaccgugcaggaguuccccggcgacaaguggaaccccaucaccggcaacagaaagaccagccagagcggcagagagauggcccacagcaagaccagcuucagcugggccacccccuuccaccccugccuggagaaccccgcccuggaccugagcagcuacagagccaucagcagccuggaccugcugggcgacuucaagcacgcccugaagaagagcgaggagaccagcguguacgaggagggcagcagccuggccagcaugccccacccccugagaagcagagccuucagcgagagccacaucagccuggccccccagagcaccagagccuggggccagcacagaagagagcuguucagcaagggcgacgagacccagagcgaccugcugggcgccagaaagaaggccuuccccccccccagaccccccccccccaacugggagaaguacagacuguucagagccgcccagcagcagaagcagcagcagcagcagcagaagcagcaggaggaggaggaggaggaggaggaggaggaggaggaggaggaggaggaggaggaggaggaggccgaggaggaggaggaggagcugcccccccaguacuucagcagcgagaccagcggcagcugcgcccugaaccccgaggaggugcuggagcagccccagccccugagcuucggccaccuggagggcagcagacagggcagccagagcgugcccgccgagcaggagagcuucgcccugcacagcagcgacuuccugccccccaucagaggccaccugggcagccagcccgagcaggcccagccccccugcuacuacggcaucggcggccuguggagaaccagcggccaggaggccaccgagagcgccaagcaggaguuccagcacuucagcccccccagcggcgcccccggcauccccaccagcuacagcgccuacuacaacaucagcguggccaaggccgagcugcugaacaagcugaaggaccagcccgagauggccgagaucggccugggcgaggaggagguggaccacgagcuggcccagaagaagauccagcugaucgagagcaucagcagaaagcugagcgugcugagagaggcccagagaggccugcuggaggacaucaacgccaacagcgcccugggcgaggagguggaggccaaccugaaggccgugugcaagagcaacgaguucgagaaguaccaccuguucgugggcgaccuggacaagguggugaaccugcugcugagccugagcggcagacuggccagaguggagaacgcccugaacagcaucgacagcgaggccaaccaggagaagcuggugcugaucgagaagaagcagcagcugaccggccagcuggccgacgccaaggagcugaaggagcacguggacagaagagagaagcugguguucggcauggugagcagauaccugccccaggaccagcugcaggacuaccagcacuucgugaagaugaagagcgcccugaucaucgagcagagagagcuggaggagaagaucaagcugggcgaggagcagcugaagugccugagagagagccugcugcugggccccagcaacuucuaa

SEQ ID NO: 23322 - RNA, 1467 nt, Artificial Sequence
  SIAE__Homo_sapiens__NP_001186851
auggugcugcagaaggagcccgccggcgccgugaucuggggcuucggcacccccggcgccaccgugaccgugacccugagacagggccaggagaccaucaugaagaaggugaccagcgugaaggcccacagcgacaccuggaugguggugcuggaccccaugaagcccggcggccccuucgaggugauggcccagcagacccuggagaagaucaacuucacccugagagugcacgacgugcuguucggcgacguguggcugugcagcggccagagcaacaugcagaugaccgugcugcagaucuucaacgccaccagagagcugagcaacaccgccgccuaccagagcgugagaauccugagcgugagccccauccaggccgagcaggagcuggaggaccugguggccguggaccugcaguggagcaagcccaccagcgagaaccugggccacggcuacuucaaguacaugagcgccgugugcuggcuguucggcagacaccuguacgacacccugcaguaccccaucggccugaucgccagcagcuggggcggcacccccaucgaggccuggagcagcggcagaagccugaaggccugcggcgugcccaagcagggcagcauccccuacgacagcgugaccggccccagcaagcacagcgugcuguggaacgccaugauccacccccugugcaacaugacccugaagggcguggugugguaccagggcgagagcaacaucaacuacaacaccgaccuguacaacugcaccuuccccgcccugaucgaggacuggagagagaccuuccacagaggcagccagggccagaccgagagauucuuccccuucggccuggugcagcugagcagcgaccugagcaagaagagcagcgacgacggcuucccccagaucagauggcaccagaccgccgacuucggcuacgugcccaaccccaagaugcccaacaccuucauggccguggccauggaccugugcgacagagacagccccuucggcagcauccaccccagagacaagcagaccguggccuacagacugcaccugggcgccagagcccuggccuacggcgagaagaaccugaccuucgagggcccccugcccgagaagaucgagcugcuggcccacaagggccugcugaaccugaccuacuaccagcagauccaggugcagaagaaggacaacaagaucuucgagaucagcugcugcagcgaccacagaugcaaguggcugcccgccagcaugaacaccgugagcacccagagccugacccuggccaucgacagcugccacggcaccgugguggcccugagauacgccuggaccaccuggcccugcgaguacaagcagugcccccuguaccaccccagcagcgcccugcccgccccccccuucaucgccuucaucaccgaccagggccccggccaccagagcaacguggccaaguaa

SEQ ID NO: 23323 - RNA, 942 nt, Artificial Sequence
  SIAH1__Homo_sapiens__NP_001006611
augaccggcaaggccaccccccccagccuguacagcuggagaggcgugcuguucaccugccugcccgccgccagaaccagaaagagaaaggagaugagcagacagaccgccaccgcccugcccaccggcaccagcaagugcccccccagccagagagugcccgcccugaccggcaccaccgccagcaacaacgaccuggccagccuguucgagugccccgugugcuucgacuacgugcugccccccauccugcagugccagagcggccaccuggugugcagcaacugcagacccaagcugaccugcugccccaccugcagaggcccccugggcagcaucagaaaccuggccauggagaagguggccaacagcgugcuguuccccugcaaguacgccagcagcggcugcgagaucacccugccccacaccgagaaggccgaccacgaggagcugugcgaguucagacccuacagcugccccugccccggcgccagcugcaaguggcagggcagccuggacgccgugaugccccaccugaugcaccagcacaagagcaucaccacccugcagggcgaggacaucguguuccuggccaccgacaucaaccugcccggcgccguggacugggugaugaugcagagcugcuucggcuuccacuucaugcuggugcuggagaagcaggagaaguacgacggccaccagcaguucuucgccaucgugcagcugaucggcaccagaaagcaggccgagaacuucgccuacagacuggagcugaacggccacagaagaagacugaccugggaggccacccccagaagcauccacgagggcaucgccaccgccaucaugaacagcgacugccugguguucgacaccagcaucgcccagcuguucgccgagaacggcaaccugggcaucaacgugaccaucagcaugugcuaa

SEQ ID NO: 23324 - RNA, 975 nt, Artificial Sequence
  SIAH2__Homo_sapiens__NP_005058
augagcagacccagcagcaccggccccagcgccaacaagcccugcagcaagcagccccccccccagccccagcacacccccagccccgccgccccccccgccgccgccaccaucagcgccgccggccccggcagcagcgccgugcccgccgccgccgccgugaucagcggccccggcggcggcggcggcgccggccccgugagcccccagcaccacgagcugaccagccuguucgagugccccgugugcuucgacuacgugcugccccccauccugcagugccaggccggccaccuggugugcaaccagugcagacagaagcugagcugcugccccaccugcagaggcgcccugacccccagcaucagaaaccuggccauggagaagguggccagcgccgugcuguuccccugcaaguacgccaccaccggcugcagccugacccugcaccacaccgagaagcccgagcacgaggacaucugcgaguacagacccuacagcugccccugccccggcgccagcugcaaguggcagggcagccuggaggccgugaugagccaccugaugcacgcccacaagagcaucaccacccugcagggcgaggacaucguguuccuggccaccgacaucaaccugcccggcgccguggacugggugaugaugcagagcugcuucggccaccacuucaugcuggugcuggagaagcaggagaaguacgagggccaccagcaguucuucgccaucgugcugcugaucggcaccagaaagcaggccgagaacuucgccuacagacuggagcugaacggcaacagaagaagacugaccugggaggccacccccagaagcauccacgacggcguggccgccgccaucaugaacagcgacugccugguguucgacaccgccaucgcccaccuguucgccgacaacggcaaccugggcaucaacgugaccaucagcaccugcugccccuaa

SEQ ID NO: 23325 - RNA, 2484 nt, Artificial Sequence
  SIDT1__Homo_sapiens__NP_060169
augagaggcugccugagacuggcccugcugugcgcccugcccuggcugcugcuggccgccagccccggccaccccgccaagagccccagacagccccccgcccccagaagagaccccuucgacgccgccagaggcgccgacuucgaccacguguacagcggcguggugaaccugagcaccgagaacaucuacagcuucaacuacaccagccagcccgaccaggugaccgccgugagaguguacgugaacagcagcagcgagaaccugaacuaccccgugcuggugguggugagacagcagaaggaggugcugagcuggcaggugccccugcuguuccagggccuguaccagagaagcuacaacuaccaggaggugagcagaacccugugccccagcgaggccaccaacgagaccggcccccugcagcagcugaucuucguggacguggccagcauggccccccugggcgcccaguacaagcugcuggugaccaagcugaagcacuuccagcugagaaccaacguggccuuccacuucaccgccagccccagccagccccaguacuuccuguacaaguuccccaaggacguggacagcgugaucaucaagguggugagcgagauggccuaccccugcagcguggugagcgugcagaacaucaugugccccguguacgaccuggaccacaacguggaguucaacggcguguaccagagcaugaccaagaaggccgccaucacccugcagaagaaggacuuccccggcgagcaguucuucgugguguucgugaucaagcccgaggacuacgccugcggcggcagcuucuucauccaggagaaggagaaccagaccuggaaccugcagagaaagaagaaccuggaggugaccaucgugcccagcaucaaggagagcguguacgugaagagcagccuguucagcguguucaucuuccugagcuucuaccugggcugccugcuggugggcuucgugcacuaccugagauuccagagaaagagcaucgacggcagcuucggcagcaacgacggcagcggcaacaugguggccagccaccccaucgccgccagcacccccgagggcagcaacuacggcaccaucgacgagagcagcagcagccccggcagacagaugagcagcagcgacggcggcccccccggccagagcgacaccgacagcagcguggaggagagcgacuucgacaccaugcccgacaucgagagcgacaagaacaucaucagaaccaagauguuccuguaccugagcgaccugagcagaaaggacagaagaaucgugagcaagaaguacaagaucuacuucuggaacaucaucaccaucgccguguucuacgcccugcccgugauccagcuggugaucaccuaccagaccguggugaacgugaccggcaaccaggacaucugcuacuacaacuuccugugcgcccacccccugggcgugcugagcgccuucaacaacauccugagcaaccugggccacgugcugcugggcuuccuguuccugcugaucgugcugagaagagacauccugcacagaagagcccuggaggccaaggacaucuucgccguggaguacggcauccccaagcacuucggccuguucuacgccaugggcaucgcccugaugauggagggcgugcugagcgccugcuaccacgugugccccaacuacagcaacuuccaguucgacaccagcuucauguacaugaucgccggccugugcaugcugaagcuguaccagaccagacaccccgacaucaacgccagcgccuacagcgccuacgccagcuucgccguggugaucauggugaccgugcugggcgugguguucggcaagaacgacgugugguucugggugaucuucagcgccauccacgugcuggccagccuggcccugagcacccagaucuacuacaugggcagauucaagaucgaccugggcaucuucagaagagccgccaugguguucuacaccgacugcauccagcagugcagcagaccccuguacauggacagaauggugcugcugguggugggcaaccuggugaacuggagcuucgcccuguucggccugaucuacagacccagagacuucgccagcuacaugcugggcaucuucaucugcaaccugcugcuguaccuggccuucuacaucaucaugaagcugagaagcagcgagaaggugcugcccgugccccuguucugcaucguggccaccgccgugaugugggccgccgcccuguacuucuucuuccagaaccugagcagcugggagggcacccccgccgagagcagagagaagaacagagagugcauccugcuggacuucuucgacgaccacgacaucuggcacuuccugagcgccaccgcccuguucuucagcuuccuggugcugcugacccuggacgacgaccuggacguggugagaagagaccagauccccguguucuaa

SEQ ID NO: 23326 - RNA, 1233 nt, Artificial Sequence
  SIGIRR__Homo_sapiens__NP_001128526
augcccggcgugugcgacagagcccccgacuuccugagccccagcgaggaccaggugcugagacccgcccugggcagcagcguggcccugaacugcaccgccuggguggugagcggcccccacugcagccugcccagcgugcaguggcugaaggacggccugccccugggcaucggcggccacuacagccugcacgaguacagcugggugaaggccaaccugagcgaggugcuggugagcagcgugcugggcgugaacgugaccagcaccgagguguacggcgccuucaccugcagcauccagaacaucagcuucagcagcuucacccugcagagagccggccccaccagccacguggccgccgugcuggccagccugcuggugcugcuggcccugcugcuggccgcccugcuguacgugaagugcagacugaacgugcugcugugguaccaggacgccuacggcgagguggagaucaacgacggcaagcuguacgacgccuacgugagcuacagcgacugccccgaggacagaaaguucgugaacuucauccugaagccccagcuggagagaagaagaggcuacaagcuguuccuggacgacagagaccugcugcccagagccgagcccagcgccgaccugcuggugaaccugagcagaugcagaagacugaucguggugcugagcgacgccuuccugagcagagccuggugcagccacagcuucagagagggccugugcagacugcuggagcugaccagaagacccaucuucaucaccuucgagggccagagaagagaccccgcccaccccgcccugagacugcugagacagcacagacaccuggugacccugcugcuguggagacccggcagcgugacccccagcagcgacuucuggaaggaggugcagcuggcccugcccagaaaggugcaguacagacccguggagggcgacccccagacccagcugcaggacgacaaggaccccaugcugauccugagaggcagagugcccgagggcagagcccuggacagcgagguggaccccgaccccgagggcgaccugggcgugagaggccccguguucggcgagcccagcgcccccccccacaccagcggcgugagccugggcgagagcagaagcagcgagguggacgugagcgaccugggcagcagaaacuacagcgccagaaccgacuucuacugccuggugagcaaggacgacauguaa

SEQ ID NO: 23327 - RNA, 1809 nt, Artificial Sequence
  SIGLEC11__Homo_sapiens__NP_001128635
auggugcccggccaggcccagccccagagccccgagaugcugcugcugccccugcugcugcccgugcugggcgccggcagccugaacaaggaccccagcuacagccugcaggugcagagacaggugcccgugcccgagggccugugcgugaucgugagcugcaaccugagcuaccccagagacggcugggacgagagcaccgccgccuacggcuacugguucaagggcagaaccagccccaagaccggcgcccccguggccaccaacaaccagagcagagagguggagaugagcaccagagacagauuccagcugaccggcgaccccggcaagggcagcugcagccuggugaucagagacgcccagagagaggacgaggccugguacuucuucagaguggagagaggcagcagagugagacacagcuuccugagcaacgccuucuuccugaaggugaccgcccugaccaagaagcccgacguguacauccccgagacccuggagcccggccagcccgugaccgugaucugcguguucaacugggccuucaagaagugccccgcccccagcuucagcuggaccggcgccgcccugagccccagaagaaccagacccagcaccagccacuucagcgugcugagcuucacccccagcccccaggaccacgacaccgaccugaccugccacguggacuucagcagaaagggcgugagcgcccagagaaccgugagacugagaguggccuacgcccccaaggaccugaucaucagcaucagccacgacaacaccagcgcccuggagcugcagggcaacgugaucuaccuggaggugcagaagggccaguuccugagacugcugugcgccgccgacagccagccccccgccacccugagcugggugcugcaggacagagugcugagcagcagccaccccuggggccccagaacccugggccuggagcugagaggcgugagagccggcgacagcggcagauacaccugcagagccgagaacagacugggcagccagcagcaggcccuggaccugagcgugcaguacccccccgagaaccugagagugauggugagccaggccaacagaaccgugcuggagaaccugggcaacggcaccagccugcccgugcuggagggccagagccugagacuggugugcgugacccacagcagcccccccgccagacugagcuggaccagauggggccagaccgugggccccagccagcccagcgaccccggcgugcuggagcugccccccauccagauggagcacgagggcgaguucaccugccacgcccagcacccccugggcagccagcacgugagccugagccugagcgugcacuggaagcuggagcacggcggcggccugggccugggcgccgcccugggcgccggcguggccgcccugcuggccuucugcagcugccuggugguguucagagugaagaucugcagaaaggaggccagaaagagagccgccgccgagcaggacgugcccagcacccugggccccaucagccagggccaccagcacgagugcagcgccggcagcagccaggaccaccccccccccggcgccgccaccuacacccccggcaagggcgaggagcaggagcugcacuacgccagccugagcuuccagggccugagacugugggagcccgccgaccaggaggcccccagcaccaccgaguacagcgagaucaagauccacaccggccagccccugagaggccccggcuucggccugcagcuggagagagagaugagcggcauggugcccaaguaa

SEQ ID NO: 23328 - RNA, 1191 nt, Artificial Sequence
  SIGLEC14__Homo_sapiens__NP_001092082
augcugccccugcugcugcugccccugcuguggggcggcagccugcaggagaagcccguguacgagcugcaggugcagaagagcgugaccgugcaggagggccugugcgugcuggugcccugcagcuucagcuaccccuggagaagcugguacagcagccccccccuguacguguacugguucagagacggcgagauccccuacuacgccgaggugguggccaccaacaaccccgacagaagagugaagcccgagacccagggcagauucagacugcugggcgacgugcagaagaagaacugcagccugagcaucggcgacgccagaauggaggacaccggcagcuacuucuucagaguggagagaggcagagacgugaaguacagcuaccagcagaacaagcugaaccuggaggugaccgcccugaucgagaagcccgacauccacuuccuggagccccuggagagcggcagacccaccagacugagcugcagccugcccggcagcugcgaggccggccccccccugaccuucagcuggaccggcaacgcccugagcccccuggaccccgagaccaccagaagcagcgagcugacccugacccccagacccgaggaccacggcaccaaccugaccugccaggugaagagacagggcgcccaggugaccaccgagagaaccgugcagcugaacgugagcuacgccccccagaaccuggccaucagcaucuucuucagaaacggcaccggcaccgcccugagaauccugagcaacggcaugagcgugcccauccaggagggccagagccuguuccuggccugcaccguggacagcaacccccccgccagccugagcugguucagagagggcaaggcccugaaccccagccagaccagcaugagcggcacccuggagcugcccaacaucggcgccagagagggcggcgaguucaccugcagagugcagcacccccugggcagccagcaccugagcuucauccugagcgugcagagaagcagcagcagcugcaucugcgugaccgagaagcagcagggcagcuggccccuggugcugacccugaucagaggcgcccugaugggcgccggcuuccugcugaccuacggccugaccuggaucuacuacaccagaugcggcggcccccagcagagcagagccgagagacccggcuaa

SEQ ID NO: 23329 - RNA, 5130 nt, Artificial Sequence
  SIGLEC1__Homo_sapiens__XP_011527630
augggcuuccugcccaagcugcugcugcuggccagcuucuuccccgccggccaggccagcuggggcgugagcagcccccaggacgugcagggcgugaagggcagcugccugcugauccccugcaucuucagcuuccccgccgacguggaggugcccgacggcaucaccgccaucugguacuacgacuacagcggccagagacagguggugagccacagcgccgaccccaagcugguggaggccagauucagaggcagaaccgaguucaugggcaaccccgagcacagagugugcaaccugcugcugaaggaccugcagcccgaggacagcggcagcuacaacuucagauucgagaucagcgaggugaacagauggagcgacgugaagggcacccuggugaccgugaccgaggagcccagagugcccaccaucgccagccccguggagcugcuggagggcaccgagguggacuucaacugcagcacccccuacgugugccugcaggagcaggugagacugcaguggcagggccaggaccccgccagaagcgugaccuucaacagccagaaguucgagcccaccggcgugggccaccuggagacccugcacauggccaugagcuggcaggaccacggcagaauccugagaugccagcugagcguggccaaccacagagcccagagcgagauccaccugcaggugaaguacgcccccaagggcgugaagauccugcugagccccagcggcagaaacauccugcccggcgagcuggugacccugaccugccaggugaacagcagcuaccccgccgugagcagcaucaaguggcugaaggacggcgugagacugcagaccaagaccggcgugcugcaccugccccaggccgccuggagcgacgccggcguguacaccugccaggccgagaacggcgugggcagccuggugagcccccccaucagccugcacaucuucauggccgaggugcaggugagccccgccggccccauccuggagaaccagaccgugacccuggugugcaacacccccaacgaggcccccagcgaccugagauacagcugguacaagaaccacgugcugcuggaggacgcccacagccacacccugagacugcaccuggccaccagagccgacaccggcuucuacuucugcgaggugcagaacgugcacggcagcgagagaagcggccccgugagcgugguggugaaccaccccccccugacccccgugcugaccgccuuccuggagacccaggccggccuggugggcauccugcacugcagcguggugagcgagccccuggccacccuggugcugagccacggcggccacauccuggccagcaccagcggcgacagcgaccacagccccagauucagcggcaccagcggccccaacagccugagacuggagaucagagaccuggaggagaccgacagcggcgaguacaagugcagcgccaccaacagccugggcaacgccaccagcacccuggacuuccacgccaacgccgccagacugcugaucagccccgccgccgaggugguggagggccaggccgugacccugagcugcagaagcggccugagccccacccccgacgccagauucagcugguaccugaacggcgcccugcugcacgagggccccggcagcagccugcugcugcccgccgccagcagcaccgacgccggcagcuaccacugcagagccagagacggccacagcgccagcggccccagcagccccgccgugcugaccgugcuguacccccccagacagcccaccuucaccaccagacuggaccuggacgccgccggcgccggcgccggcagaagaggccugcugcugugcagaguggacagcgacccccccgccagacugcagcugcugcacaaggacagagugguggccaccagccugcccagcggcggcggcugcagcaccugcggcggcugcagccccagaaugaaggugaccaaggcccccaaccugcugagaguggagauccacaacccccugcuggaggaggagggccuguaccugugcgaggccagcaacgcccugggcaacgccagcaccagcgccaccuucaacggccaggccaccgugcuggccaucgcccccagccacacccugcaggagggcaccgaggccaaccugaccugcaacgugagcagagaggccgccggcagccccgccaacuucagcugguucagaaacggcgugcugugggcccagggcccccuggagaccgugacccugcugcccguggccagaaccgacgccgcccuguacgccugcagaauccugaccgaggccggcgcccagcugagcacccccgugcugcugagcgugcuguacccccccgacagacccaagcugagcgcccugcuggacaugggccagggccacauggcccuguucaucugcaccguggacagcagaccccuggcccugcuggcccuguuccacggcgagcaccugcuggccaccagccugggcccccaggugcccagccacggcagauuccaggccaaggccgaggccaacagccugaagcuggaggugagagagcugggccugggcgacagcggcagcuacagaugcgaggccaccaacgugcugggcagcagcaacaccagccuguucuuccaggugagaggcgccugggugcaggugagccccagccccgagcugcaggagggccaggccguggugcugagcugccaggugcacaccggcgugcccgagggcaccagcuacagaugguacagagacggccagccccugcaggagagcaccagcgccacccugagauucgccgccaucacccugacccaggccggcgccuaccacugccaggcccaggcccccggcagcgccaccaccagccuggccgcccccaucagccugcacgugagcuacgcccccagacacgugacccugaccacccugauggacaccggccccggcagacugggccugcugcugugcagaguggacagcgacccccccgcccagcugagacugcugcacggcgacagacugguggccagcacccugcagggcgugggcggccccgagggcagcagccccagacugcacguggccguggcccccaacacccugagacuggagauccacggcgccaugcuggaggacgagggcguguacaucugcgaggccagcaacacccugggccaggccagcgccagcgccgacuucgacgcccaggccgugaacgugcagguguggcccggcgccaccgugagagagggccagcuggugaaccugaccugccugguguggaccacccaccccgcccagcugaccuacaccugguaccaggacggccagcagagacuggacgcccacagcaucccccugcccaacgugaccgugagagacgccaccagcuacagaugcggcgugggcccccccggcagagcccccagacugagcagacccaucacccuggacgugcuguacgcccccagaaaccugagacugaccuaccugcuggagagccacggcggccagcuggcccuggugcugugcaccguggacagcagaccccccgcccagcuggcccugagccacgccggcagacugcuggccagcagcaccgccgccagcgugcccaacacccugagacuggagcugagaggcccccagcccagagacgagggcuucuacagcugcagcgccagaagcccccugggccaggccaacaccagccuggagcugagacuggagggcgugagagugauccuggcccccgaggccgccgugcccgagggcgcccccaucaccgugaccugcgccgaccccgccgcccacgcccccacccuguacaccugguaccacaacggcagauggcugcaggagggccccgccgccagccugagcuuccugguggccaccagagcccacgccggcgccuacagcugccaggcccaggacgcccagggcaccagaagcagcagacccgccgcccugcaggugcuguacgccccccaggacgccgugcugagcagcuucagagacagcagagccagaagcauggccgugauccagugcaccguggacagcgagccccccgccgagcuggcccugagccacgacggcaaggugcuggccaccagcagcggcgugcacagccuggccagcggcaccggccacgugcagguggccagaaacgcccugagacugcaggugcaggacgugcccgccggcgacgacaccuacgugugcaccgcccagaaccugcugggcagcaucagcaccaucggcagacugcagguggagggcgccagagugguggccgagcccggccuggacgugcccgagggcgccgcccugaaccugagcugcagacugcugggcggccccggccccgugggcaacagcaccuucgccugguucuggaacgacagaagacugcacgccgagcccgugcccacccuggccuucacccacguggccagagcccaggccggcauguaccacugccuggccgagcugcccaccggcgccgccgccagcgcccccgugaugcugagagugcuguacccccccaagacccccaccaugaugguguucguggagcccgagggcggccugagaggcauccuggacugcagaguggacagcgagccccuggccagccugacccugcaccugggcagcagacugguggccagcagccagccccagggcgcccccgccgagccccacauccacgugcuggccagccccaacgcccugagaguggacaucgaggcccugagacccagcgaccagggcgaguacaucugcagcgccagcaacgugcugggcagcgccagcaccagcaccuacuucggcgugagagcccugcacagacugcaccaguuccagcagcugcugugggugcugggccugcuggugggccugcugcugcugcugcugggccugggcgccugcuacaccuggagaagaagaagagugugcaagcagagcaugggcgagaacagcguggagauggccuuccagaaggagaccacccagcugaucgaccccgacgccgccaccugcgagaccagcaccugcgcccccccccugggcuaa

SEQ ID NO: 23330 - RNA, 1656 nt, Artificial Sequence
  SIGLEC5__Homo_sapiens__NP_003821
augcugccccugcugcugcugccccugcuguggggcggcagccugcaggagaagcccguguacgagcugcaggugcagaagagcgugaccgugcaggagggccugugcgugcuggugcccugcagcuucagcuaccccuggagaagcugguacagcagccccccccuguacguguacugguucagagacggcgagauccccuacuacgccgaggugguggccaccaacaaccccgacagaagagugaagcccgagacccagggcagauucagacugcugggcgacgugcagaagaagaacugcagccugagcaucggcgacgccagaauggaggacaccggcagcuacuucuucagaguggagagaggcagagacgugaaguacagcuaccagcagaacaagcugaaccuggaggugaccgcccugaucgagaagcccgacauccacuuccuggagccccuggagagcggcagacccaccagacugagcugcagccugcccggcagcugcgaggccggccccccccugaccuucagcuggaccggcaacgcccugagcccccuggaccccgagaccaccagaagcagcgagcugacccugacccccagacccgaggaccacggcaccaaccugaccugccagaugaagagacagggcgcccaggugaccaccgagagaaccgugcagcugaacgugagcuacgccccccagaccaucaccaucuucagaaacggcaucgcccuggagauccugcagaacaccagcuaccugcccgugcuggagggccaggcccugagacugcugugcgacgcccccagcaacccccccgcccaccugagcugguuccagggcagccccgcccugaacgccacccccaucagcaacaccggcauccuggagcugagaagagugagaagcgccgaggagggcggcuucaccugcagagcccagcacccccugggcuuccugcagaucuuccugaaccugagcguguacagccugccccagcugcugggccccagcugcagcugggaggccgagggccugcacugcagaugcagcuucagagccagacccgcccccagccugugcuggagacuggaggagaagccccuggagggcaacagcagccagggcagcuucaaggugaacagcagcagcgccggccccugggccaacagcagccugauccugcacggcggccugagcagcgaccugaaggugagcugcaaggccuggaacaucuacggcagccagagcggcagcgugcugcugcugcagggcagaagcaaccugggcaccggcguggugcccgccgcccugggcggcgccggcgugauggcccugcugugcaucugccugugccugaucuucuuccugaucgugaaggccagaagaaagcaggccgccggcagacccgagaagauggacgacgaggaccccaucaugggcaccaucaccagcggcagcagaaagaagcccuggcccgacagccccggcgaccaggccagcccccccggcgacgcccccccccuggaggagcagaaggagcugcacuacgccagccugagcuucagcgagaugaagagcagagagcccaaggaccaggaggcccccagcaccaccgaguacagcgagaucaagaccagcaaguaa

SEQ ID NO: 23331 - RNA, 438 nt, Artificial Sequence
  SIGLEC7__Homo_sapiens__NP_001264130
augcugcugcugcugcugcugccccugcuguggggcagagagagaguggagggccagaagagcaacagaaaggacuacagccugaccaugcagagcagcgugaccgugcaggagggcaugugcgugcacgugagaugcagcuucagcuaccccguggacagccagaccgacagcgaccccgugcacggcuacugguucagagccggcaacgacaucagcuggaaggcccccguggccaccaacaaccccgccugggccgugcaggaggagaccagagacagauuccaccugcugggcgacccccagaccaagaacugcacccugagcaucagagacgccagaaugagcgacgccggcagauacuucuucagaauggagaagggcaacaucaaguggaacuacaaguacgaccagcugagcgugaacgugaccggcuaa

SEQ ID NO: 23332 - RNA, 1500 nt, Artificial Sequence
  SIGLEC8__Homo_sapiens__NP_055257
augcugcugcugcugcugcugcugccccugcuguggggcaccaagggcauggagggcgacagacaguacggcgacggcuaccugcugcaggugcaggagcuggugaccgugcaggagggccugugcgugcacgugcccugcagcuucagcuacccccaggacggcuggaccgacagcgaccccgugcacggcuacugguucagagccggcgacagacccuaccaggacgcccccguggccaccaacaaccccgacagagaggugcaggccgagacccagggcagauuccagcugcugggcgacaucuggagcaacgacugcagccugagcaucagagacgccagaaagagagacaagggcagcuacuucuucagacuggagagaggcagcaugaaguggagcuacaagagccagcugaacuacaagaccaagcagcugagcguguucgugaccgcccugacccacagacccgacauccugauccugggcacccuggagagcggccacagcagaaaccugaccugcagcgugcccugggccugcaagcagggcaccccccccaugaucagcuggaucggcgccagcgugagcagccccggccccaccaccgccagaagcagcgugcugacccugacccccaagccccaggaccacggcaccagccugaccugccaggugacccugcccggcaccggcgugaccaccaccagcaccgugagacuggacgugagcuacccccccuggaaccugaccaugaccguguuccagggcgacgccaccgccagcaccgcccugggcaacggcagcagccugagcgugcuggagggccagagccugagacuggugugcgccgugaacagcaacccccccgccagacugagcuggaccagaggcagccugacccugugccccagcagaagcagcaaccccggccugcuggagcugcccagagugcacgugagagacgagggcgaguucaccugcagagcccagaacgcccagggcagccagcacaucagccugagccugagccugcagaacgagggcaccggcaccagcagacccgugagccaggugacccuggccgccgugggcggcgccggcgccaccgcccuggccuuccugagcuucugcaucaucuucaucaucgugagaagcugcagaaagaagagcgccagacccgccgccggcgugggcgacaccggcauggaggacgccaaggccaucagaggcagcgccagccagggcccccugaccgagagcuggaaggacggcaacccccugaagaagcccccccccgccguggcccccagcagcggcgaggagggcgagcugcacuacgccacccugagcuuccacaaggugaagccccaggacccccagggccaggaggccaccgacagcgaguacagcgagaucaagauccacaagagagagaccgccgagacccaggccugccugagaaaccacaaccccagcagcaaggaggugagaggcuaa

SEQ ID NO: 23333 - RNA, 1440 nt, Artificial Sequence
  SIGLEC9__Homo_sapiens__NP_001185487
augcugcugcugcugcugccccugcuguggggcagagagagagccgagggccagaccagcaagcugcugaccaugcagagcagcgugaccgugcaggagggccugugcgugcacgugcccugcagcuucagcuaccccagccacggcuggaucuaccccggccccguggugcacggcuacugguucagagagggcgccaacaccgaccaggacgcccccguggccaccaacaaccccgccagagccgugugggaggagaccagagacagauuccaccugcugggcgacccccacaccaagaacugcacccugagcaucagagacgccagaagaagcgacgccggcagauacuucuucagaauggagaagggcagcaucaaguggaacuacaagcaccacagacugagcgugaacgugaccgcccugacccacagacccaacauccugauccccggcacccuggagagcggcugcccccagaaccugaccugcagcgugcccugggccugcgagcagggcaccccccccaugaucagcuggaucggcaccagcgugagcccccuggaccccagcaccaccagaagcagcgugcugacccugaucccccagccccaggaccacggcaccagccugaccugccaggugaccuuccccggcgccagcgugaccaccaacaagaccgugcaccugaacgugagcuaccccccccagaaccugaccaugaccguguuccagggcgacggcaccgugagcaccgugcugggcaacggcagcagccugagccugcccgagggccagagccugagacuggugugcgccguggacgccguggacagcaacccccccgccagacugagccugagcuggagaggccugacccugugccccagccagcccagcaaccccggcgugcuggagcugcccugggugcaccugagagacgccgccgaguucaccugcagagcccagaacccccugggcagccagcagguguaccugaacgugagccugcagagcaaggccaccagcggcgugacccagggcguggugggcggcgccggcgccaccgcccugguguuccugagcuucugcgugaucuucgugguggugagaagcugcagaaagaagagcgccagacccgccgccggcgugggcgacaccggcaucgaggacgccaacgccgugagaggcagcgccagccagauccugaaccacuucaucggcuuccccaccuuccugggccugggcuucgaguuccugcugaaccugagagaccugugcugccaccccgacagcgaguucuacguguaccacuucagccacuucagacugaucaagaacaucgccggcgagaucguguggagccuggagggcaagauccuguggcugcuggacgugagcgacuucuuccacugguucuuccugaucugcgugggcuaa

SEQ ID NO: 23334 - RNA, 612 nt, Artificial Sequence
  SIGMAR1__Homo_sapiens__NP_001269136
augcagugggccgugggcagaagaugggccugggccgcccugcugcuggccguggccgccgugcugacccaggugguguggcuguggcugggccuggaccacgagcuggccuucagcagacugaucguggagcugagaagacugcaccccggccacgugcugcccgacgaggagcugcaguggguguucgugaacgccggcggcuggaugggcgccaugugccugcugcacgccagccugagcgaguacgugcugcuguucggcaccgcccugggcagcagaggccacagcggcagauacugggccgagaucagcgacaccaucaucagcggcaccuuccaccaguggagagagggcaccaccaagagcgagguguucuaccccggcgagaccguggugcacggccccggcgaggccaccgccguggaguggggccccaacaccuggaugguggaguacggcagaggcgugauccccagcacccuggccuucgcccuggccgacaccguguucagcacccaggacuuccugacccuguucuacacccugagaagcuacgccagaggccugagacuggagcugaccaccuaccuguucggccaggaccccuaa

SEQ ID NO: 23335 - RNA, 5484 nt, Artificial Sequence
  SI__Homo_sapiens__NP_001032
auggccagaaagaaguucagcggccuggagaucagccugaucgugcuguucgugaucgugaccaucaucgccaucgcccugaucguggugcuggccaccaagacccccgccguggacgagaucagcgacagcaccagcacccccgccaccaccagagugaccaccaaccccagcgacagcggcaagugccccaacgugcugaacgaccccgugaacgugagaaucaacugcauccccgagcaguuccccaccgagggcaucugcgcccagagaggcugcugcuggagacccuggaacgacagccugauccccuggugcuucuucguggacaaccacggcuacaacgugcaggacaugaccaccaccagcaucggcguggaggccaagcugaacagaauccccagccccacccuguucggcaacgacaucaacagcgugcuguucaccacccagaaccagacccccaacagauucagauucaagaucaccgaccccaacaacagaagauacgaggugccccaccaguacgugaaggaguucaccggccccaccgugagcgacacccuguacgacgugaagguggcccagaaccccuucagcauccaggugaucagaaagagcaacggcaagacccuguucgacaccagcaucggcccccugguguacagcgaccaguaccugcagaucagcaccagacugcccagcgacuacaucuacggcaucggcgagcaggugcacaagagauucagacacgaccugagcuggaagaccuggcccaucuucaccagagaccagcugcccggcgacaacaacaacaaccuguacggccaccagaccuucuucaugugcaucgaggacaccagcggcaagagcuucggcguguuccugaugaacagcaacgccauggagaucuucauccagcccacccccaucgugaccuacagagugaccggcggcauccuggacuucuacauccugcugggcgacacccccgagcagguggugcagcaguaccagcagcuggugggccugcccgccaugcccgccuacuggaaccugggcuuccagcugagcagauggaacuacaagagccuggacguggugaaggagguggugagaagaaacagagaggccggcauccccuucgacacccaggugaccgacaucgacuacauggaggacaagaaggacuucaccuacgaccagguggccuucaacggccugccccaguucgugcaggaccugcacgaccacggccagaaguacgugaucauccuggaccccgccaucagcaucggcagaagagccaacggcaccaccuacgccaccuacgagagaggcaacacccagcacguguggaucaacgagagcgacggcagcacccccaucaucggcgagguguggcccggccugaccguguaccccgacuucaccaaccccaacugcaucgacuggugggccaacgagugcagcaucuuccaccaggaggugcaguacgacggccuguggaucgacaugaacgaggugagcagcuucauccagggcagcaccaagggcugcaacgugaacaagcugaacuacccccccuucacccccgacauccuggacaagcugauguacagcaagaccaucugcauggacgccgugcagaacuggggcaagcaguacgacgugcacagccuguacggcuacagcauggccaucgccaccgagcaggccgugcagaagguguuccccaacaagagaagcuucauccugaccagaagcaccuucgccggcagcggcagacacgccgcccacuggcugggcgacaacaccgccagcugggagcagauggaguggagcaucaccggcaugcuggaguucagccuguucggcaucccccuggugggcgccgacaucugcggcuucguggccgagaccaccgaggagcugugcagaagauggaugcagcugggcgccuucuaccccuucagcagaaaccacaacagcgacggcuacgagcaccaggaccccgccuucuucggccagaacagccugcuggugaagagcagcagacaguaccugaccaucagauacacccugcugcccuuccuguacacccuguucuacaaggcccacguguucggcgagaccguggccagacccgugcugcacgaguucuacgaggacaccaacagcuggaucgaggacaccgaguuccuguggggccccgcccugcugaucacccccgugcugaagcagggcgccgacaccgugagcgccuacauccccgacgccaucugguacgacuacgagagcggcgccaagagacccuggagaaagcagagaguggacauguaccugcccgccgacaagaucggccugcaccugagaggcggcuacaucauccccauccaggagcccgacgugaccaccaccgccagcagaaagaacccccugggccugaucguggcccugggcgagaacaacaccgccaagggcgacuucuucugggacgacggcgagaccaaggacaccauccagaacggcaacuacauccuguacaccuucagcgugagcaacaacacccuggacaucgugugcacccacagcagcuaccaggagggcaccacccuggccuuccagaccgugaagauccugggccugaccgacagcgugaccgaggugagaguggccgagaacaaccagcccaugaacgcccacagcaacuucaccuacgacgccagcaaccaggugcugcugaucgccgaccugaagcugaaccugggcagaaacuucagcgugcaguggaaccagaucuucagcgagaacgagagauucaacugcuaccccgacgccgaccuggccaccgagcagaagugcacccagagaggcugcguguggagaaccggcagcagccugagcaaggcccccgagugcuacuuccccagacaggacaacagcuacagcgugaacagcgccagauacagcagcaugggcaucaccgccgaccugcagcugaacaccgccaacgccagaaucaagcugcccagcgaccccaucagcacccugagaguggaggugaaguaccacaagaacgacaugcugcaguucaagaucuacgacccccagaagaagagauacgaggugcccgugccccugaacauccccaccacccccaucagcaccuacgaggacagacuguacgacguggagaucaaggagaaccccuucggcauccagaucagaagaagaagcagcggcagagugaucugggacagcuggcugcccggcuucgccuucaacgaccaguucauccagaucagcaccagacugcccagcgaguacaucuacggcuucggcgagguggagcacaccgccuucaagagagaccugaacuggaacaccuggggcauguucaccagagaccagccccccggcuacaagcugaacagcuacggcuuccaccccuacuacauggcccuggaggaggagggcaacgcccacggcguguuccugcugaacagcaacgccauggacgugaccuuccagcccacccccgcccugaccuacagaaccgugggcggcauccuggacuucuacauguuccugggccccacccccgagguggccaccaagcaguaccacgaggugaucggccaccccgugaugcccgccuacugggcccugggcuuccagcugugcagauacggcuacgccaacaccagcgaggugagagagcuguacgacgccaugguggccgccaacauccccuacgacgugcaguacaccgacaucgacuacauggagagacagcuggacuucaccaucggcgaggccuuccaggaccugccccaguucguggacaagaucagaggcgagggcaugagauacaucaucauccuggaccccgccaucagcggcaacgagaccaagaccuaccccgccuucgagagaggccagcagaacgacguguucgugaaguggcccaacaccaacgacaucugcugggccaagguguggcccgaccugcccaacaucaccaucgacaagacccugaccgaggacgaggccgugaacgccagcagagcccacguggccuuccccgacuucuucagaaccagcaccgccgaguggugggccagagagaucguggacuucuacaacgagaagaugaaguucgacggccuguggaucgacaugaacgagcccagcagcuucgugaacggcaccaccaccaaccagugcagaaacgacgagcugaacuacccccccuacuuccccgagcugaccaagagaaccgacggccugcacuucagaaccaucugcauggaggccgagcagauccugagcgacggcaccagcgugcugcacuacgacgugcacaaccuguacggcuggagccagaugaagcccacccacgacgcccugcagaagaccaccggcaagagaggcaucgugaucagcagaagcaccuaccccaccagcggcagauggggcggccacuggcugggcgacaacuacgccagaugggacaacauggacaagagcaucaucggcaugauggaguucagccuguucggcaugagcuacaccggcgccgacaucugcggcuucuucaacaacagcgaguaccaccugugcaccagauggaugcagcugggcgccuucuaccccuacagcagaaaccacaacaucgccaacaccagaagacaggaccccgccagcuggaacgagaccuucgccgagaugagcagaaacauccugaacaucagauacacccugcugcccuacuucuacacccagaugcacgagauccacgccaacggcggcaccgugaucagaccccugcugcacgaguucuucgacgagaagcccaccugggacaucuucaagcaguuccuguggggccccgccuucauggugacccccgugcuggagcccuacgugcagaccgugaacgccuacgugcccaacgccagaugguucgacuaccacaccggcaaggacaucggcgugagaggccaguuccagaccuucaacgccagcuacgacaccaucaaccugcacgugagaggcggccacauccugcccugccaggagcccgcccagaacaccuucuacagcagacagaagcacaugaagcugaucguggccgccgacgacaaccagauggcccagggcagccuguucugggacgacggcgagagcaucgacaccuacgagagagaccuguaccugagcgugcaguucaaccugaaccagaccacccugaccagcaccauccugaagagaggcuacaucaacaagagcgagaccagacugggcagccugcacguguggggcaagggcaccacccccgugaacgccgugacccugaccuacaacggcaacaagaacagccugcccuucaacgaggacaccaccaacaugauccugagaaucgaccugaccacccacaacgugacccuggaggagcccaucgagaucaacuggagcuaa

SEQ ID NO: 23336 - RNA, 2352 nt, Artificial Sequence
  SIK1__Homo_sapiens__NP_775490
auggugaucaugagcgaguucagcgccgaccccgccggccagggccagggccagcagaagccccugagagugggcuucuacgacaucgagagaacccugggcaagggcaacuucgccguggugaagcuggccagacacagagugaccaagacccagguggccaucaagaucaucgacaagaccagacuggacagcagcaaccuggagaagaucuacagagaggugcagcugaugaagcugcugaaccacccccacaucaucaagcuguaccaggugauggagaccaaggacaugcuguacaucgugaccgaguucgccaagaacggcgagauguucgacuaccugaccagcaacggccaccugagcgagaacgaggccagaaagaaguucuggcagauccugagcgccguggaguacugccacgaccaccacaucgugcacagagaccugaagaccgagaaccugcugcuggacggcaacauggacaucaagcuggccgacuucggcuucggcaacuucuacaagagcggcgagccccugagcaccuggugcggcagcccccccuacgccgcccccgagguguucgagggcaaggaguacgagggcccccagcuggacaucuggagccugggcguggugcuguacgugcuggugugcggcagccugcccuucgacggccccaaccugcccacccugagacagagagugcuggagggcagauucagaauccccuucuucaugagccaggacugcgagagccugaucagaagaaugcuggugguggaccccgccagaagaaucaccaucgcccagaucagacagcacagauggaugagagccgagcccugccugcccggccccgccugccccgccuucagcgcccacagcuacaccagcaaccugggcgacuacgacgagcaggcccugggcaucaugcagacccugggcguggacagacagagaaccguggagagccugcagaacagcagcuacaaccacuucgccgccaucuacuaccugcugcuggagagacugaaggaguacagaaacgcccagugcgccagacccggccccgccagacagcccagacccagaagcagcgaccugagcggccuggaggugccccaggagggccugagcaccgaccccuucagacccgcccugcugugcccccagccccagacccuggugcagagcgugcugcaggccgagauggacugcgagcugcagagcagccugcaguggccccuguucuuccccguggacgccagcugcagcggcguguucagacccagacccgugagccccagcagccugcuggacaccgccaucagcgaggaggccagacagggccccggccuggaggaggagcaggacacccaggagagccugcccagcagcaccggcagaagacacacccuggccgaggugagcaccagacugagcccccugaccgcccccugcaucguggugagccccagcaccaccgccagccccgccgagggcaccagcagcgacagcugccugaccuucagcgccagcaagagccccgccggccugagcggcacccccgccacccagggccugcugggcgccugcagccccgugagacuggccagccccuuccugggcagccagagcgccacccccgugcugcaggcccagggcggccugggcggcgccgugcugcugcccgugagcuuccaggagggcagaagagccagcgacaccagccugacccagggccugaaggccuucagacagcagcugagaaagaccaccagaaccaagggcuuccugggccugaacaagaucaagggccuggccagacaggugugccaggcccccgccagcagagccagcagaggcggccugagccccuuccacgcccccgcccagagccccggccugcacggcggcgccgccggcagcagagagggcuggagccugcuggaggaggugcuggagcagcagagacugcugcagcugcagcaccaccccgccgccgcccccggcugcagccaggccccccagcccgcccccgcccccuucgugaucgcccccugcgacggccccggcgccgccccccugcccagcacccugcugaccagcggccugccccugcugccccccccccugcugcagaccggcgccagccccguggccagcgccgcccagcugcuggacacccaccugcacaucggcaccggccccaccgcccugcccgccgugcccccccccagacuggccagacuggcccccggcugcgagccccugggccugcugcagggcgacugcgagauggaggaccugaugcccugcagccugggcaccuucgugcuggugcaguaa

SEQ ID NO: 23337 - RNA, 2781 nt, Artificial Sequence
  SIK2__Homo_sapiens__NP_056006
auggugauggccgacggccccagacaccugcagagaggccccgugagagugggcuucuacgacaucgagggcacccugggcaagggcaacuucgccguggugaagcugggcagacacagaaucaccaagaccgagguggccaucaagaucaucgacaagagccagcuggacgccgugaaccuggagaagaucuacagagaggugcagaucaugaagaugcuggaccacccccacaucaucaagcuguaccaggugauggagaccaagagcaugcuguaccuggugaccgaguacgccaagaacggcgagaucuucgacuaccuggccaaccacggcagacugaacgagagcgaggccagaagaaaguucuggcagauccugagcgccguggacuacugccacggcagaaagaucgugcacagagaccugaaggccgagaaccugcugcuggacaacaacaugaacaucaagaucgccgacuucggcuucggcaacuucuucaagagcggcgagcugcuggccaccuggugcggcagcccccccuacgccgcccccgagguguucgagggccagcaguacgagggcccccagcuggacaucuggagcaugggcguggugcuguacgugcuggugugcggcgcccugcccuucgacggccccacccugcccauccugagacagagagugcuggagggcagauucagaauccccuacuucaugagcgaggacugcgagcaccugaucagaagaaugcuggugcuggaccccagcaagagacugaccaucgcccagaucaaggagcacaaguggaugcugaucgaggugcccgugcagagacccgugcuguacccccaggagcaggagaacgagcccagcaucggcgaguucaacgagcaggugcugagacugaugcacagccugggcaucgaccagcagaagaccaucgagagccugcagaacaagagcuacaaccacuucgccgccaucuacuuccugcugguggagagacugaagagccacagaagcagcuuccccguggagcagagacuggacggcagacagagaagacccagcaccaucgccgagcagaccguggccaaggcccagaccgugggccugcccgugaccaugcacagccccaacaugagacugcugagaagcgcccugcugccccaggccagcaacguggaggccuucagcuuccccgccagcggcugccaggccgaggccgccuucauggaggaggagugcguggacacccccaaggugaacggcugccugcuggaccccgugccccccgugcuggugagaaagggcugccagagccugcccagcaacaugauggagaccagcaucgacgagggccuggagaccgagggcgaggccgaggaggaccccgcccacgccuucgaggccuuccagagcaccagaagcggccagagaagacacacccugagcgaggugaccaaccagcugguggugaugcccggcgccggcaagaucuucagcaugaacgacagccccagccuggacagcguggacagcgaguacgacaugggcagcgugcagagagaccugaacuuccuggaggacaaccccagccugaaggacaucaugcuggccaaccagcccagccccagaaugaccagccccuucaucagccugagacccaccaaccccgccaugcaggcccugagcagccagaagagagaggugcacaacagaagccccgugagcuucagagagggcagaagagccagcgacaccagccugacccagggcaucguggccuucagacagcaccugcagaaccuggccagaaccaagggcauccuggagcugaacaaggugcagcugcuguacgagcagaucggccccgaggccgaccccaaccuggcccccgccgccccccagcugcaggaccuggccagcagcugcccccaggaggaggugagccagcagcaggagagcgugagcacccugcccgccagcgugcacccccagcugagccccagacagagccuggagacccaguaccugcagcacagacugcagaagcccagccugcugagcaaggcccagaacaccugccagcuguacugcaaggagccccccagaagccuggagcagcagcugcaggagcacagacugcagcagaagagacuguuccugcagaagcagagccagcugcaggccuacuucaaccagaugcagaucgccgagagcagcuacccccagcccagccagcagcugccccugcccagacaggagacccccccccccagccagcaggccccccccuucagccugacccagccccugagccccgugcuggagcccagcagcgagcagaugcaguacagccccuuccugagccaguaccaggagaugcagcugcagccccugcccagcaccagcggccccagagccgcccccccccugcccacccagcugcagcagcagcagccccccccccccccccccccccccccccccagacagcccggcgccgcccccgccccccugcaguucagcuaccagaccugcgagcugcccagcgccgccagccccgcccccgacuaccccacccccugccaguaccccguggacggcgcccagcagagcgaccugaccggccccgacugccccagaagccccggccugcaggaggcccccagcagcuacgacccccuggcccugagcgagcugcccggccuguucgacugcgagaugcuggacgccguggacccccagcacaacggcuacgugcuggugaacuaa

SEQ ID NO: 23338 - RNA, 3786 nt, Artificial Sequence
  SIK3__Homo_sapiens__NP_001268678
auggccgccgccgccgccagcggcgccggcggcgccgccggcgccggcaccggcggcgccggccccgccggcagacugcugcccccccccgcccccggcagccccgccgcccccgccgccgugagccccgccgccggccagcccagaccccccgcccccgccagcagaggccccaugcccgccagaaucggcuacuacgagaucgacagaaccaucggcaagggcaacuucgccguggugaagagagccacccaccuggugaccaaggccaagguggccaucaagaucaucgacaagacccagcuggacgaggagaaccugaagaagaucuucagagaggugcagaucaugaagaugcugugccacccccacaucaucagacuguaccaggugauggagaccgagagaaugaucuaccuggugaccgaguacgccagcggcggcgagaucuucgaccaccugguggcccacggcagaauggccgagaaggaggccagaagaaaguucaagcagaucgugaccgccguguacuucugccacugcagaaacaucgugcacagagaccugaaggccgagaaccugcugcuggacgccaaccugaacaucaagaucgccgacuucggcuucagcaaccuguucacccccggccagcugcugaagaccuggugcggcagcccccccuacgccgcccccgagcuguucgagggcaaggaguacgacggccccaagguggacaucuggagccugggcguggugcuguacgugcuggugugcggcgcccugcccuucgacggcagcacccugcagaaccugagagccagagugcugagcggcaaguucagaauccccuucuucaugagcaccgagugcgagcaccugaucagacacaugcuggugcuggaccccaacaagagacugagcauggagcagaucugcaagcacaaguggaugaagcugggcgacgccgaccccaacuucgacagacugaucgccgagugccagcagcugaaggaggagagacagguggacccccugaacgaggacgugcugcuggccauggaggacaugggccuggacaaggagcagacccugcaggccgagcaggccggcaccgccaugaacaucagcgugccccaggugcagcugaucaaccccgagaaccagaucguggagcccgacggcacccugaaccuggacagcgacgagggcgaggagcccagccccgaggcccuggugagauaccugagcaugagaagacacaccgugggcguggccgaccccagaaccgaggugauggaggaccugcagaagcugcugcccggcuuccccggcgugaacccccaggcccccuuccugcagguggcccccaacgugaacuucaugcacaaccugcugcccaugcagaaccugcagcccaccggccagcuggaguacaaggagcagagccugcugcagccccccacccugcagcugcugaacggcaugggcccccugggcagaagagccagcgacggcggcgccaacauccagcugcacgcccagcagcugcugaagagacccagaggccccagcccccuggugaccaugacccccgccgugcccgccgugacccccguggacgaggagagcagcgacggcgagcccgaccaggaggccgugcagagauaccuggccaacagaagcaagagacacacccuggccaugaccaaccccaccgccgagaucccccccgaccugcagagacagcugggccagcagcccuucagaagcagaguguggcccccccaccuggugcccgaccagcacagaagcaccuacaaggacagcaacacccugcaccugcccaccgagagauucagccccgugagaagauucagcgacggcgccgccagcauccaggccuucaaggcccaccuggagaagaugggcaacaacagcagcaucaagcagcugcagcaggagugcgagcagcugcagaagauguacggcggccagaucgacgagagaacccuggagaagacccagcagcagcacaugcuguaccagcaggagcagcaccaccagauccugcagcagcagauccaggacagcaucugccccccccagcccagccccccccugcaggccgccugcgagaaccagcccgcccugcugacccaccagcugcagagacugagaauccagcccagcagccccccccccaaccaccccaacaaccaccuguucagacagcccagcaacagccccccccccaugagcagcgccaugauccagccccacggcgccgccagcagcagccaguuccagggccugcccagcagaagcgccaucuuccagcagcagcccgagaacugcagcagcccccccaacguggcccugaccugccugggcaugcagcagcccgcccagagccagcaggugaccauccaggugcaggagcccguggacaugcugagcaacaugcccggcaccgccgccggcagcagcggcagaggcaucagcaucagccccagcgccggccagaugcagaugcagcacagaaccaaccugauggccacccugagcuacggccacagaccccugagcaagcagcugagcgccgacagcgccgaggcccacagcgcccaccagcagcccccccacuacaccaccagcgcccugcagcaggcccugcugagccccaccccccccgacuacaccagacaccagcaggugccccacauccugcagggccugcugagccccagacacagccugaccggccacagcgacaucagacugccccccaccgaguucgcccagcugaucaagagacagcagcagcagagacagcagcagcagcagcagcagcagcagcaggaguaccaggagcuguucagacacaugaaccagggcgacgccggcagccuggcccccagccugggcggccagagcaugaccgagagacaggcccugagcuaccagaacgccgacagcuaccaccaccacaccagcccccagcaccugcugcagaucagagcccaggagugcgugagccaggccagcagccccacccccccccacggcuacgcccaccagcccgcccugaugcacagcgagagcauggaggaggacugcagcugcgagggcgccaaggacggcuuccaggacagcaagagcagcagcacccugaccaagggcugccacgacagcccccugcugcugagcaccggcggccccggcgaccccgagagccugcugggcaccgugagccacgcccaggagcugggcauccaccccuacggccaccagcccaccgccgccuucagcaagaacaaggugcccagcagagagcccgugaucggcaacugcauggacagaagcagccccggccaggccguggagcugcccgaccacaacggccugggcuaccccgccagacccagcgugcacgagcaccacagacccagagcccugcagagacaccacaccauccagaacagcgacgacgccuacgugcagcuggacaaccugcccggcaugagccugguggccggcaaggcccugagcagcgccagaaugagcgacgccgugcugagccagagcagccugaugggcagccagcaguuccaggacggcgagaacgaggagugcggcgccagccugggcggccacgagcaccccgaccugagcgacggcagccagcaccugaacagcagcugcuaccccagcaccugcaucaccgacauccugcugagcuacaagcaccccgaggugagcuucagcauggagcaggccggcguguaa

SEQ ID NO: 23339 - RNA, 1386 nt, Artificial Sequence
  SIL1__Homo_sapiens__NP_071909
auggccccccagagccugcccagcagcagaauggccccccugggcaugcugcugggccugcugauggccgccugcuucaccuucugccugagccaccagaaccugaaggaguucgcccugaccaaccccgagaagagcagcaccaaggagaccgagagaaaggagaccaaggccgaggaggagcuggacgccgaggugcuggagguguuccaccccacccacgaguggcaggcccugcagcccggccaggccgugcccgccggcagccacgugagacugaaccugcagaccggcgagagagaggccaagcugcaguacgaggacaaguucagaaacaaccugaagggcaagagacuggacaucaacaccaacaccuacaccagccaggaccugaagagcgcccuggccaaguucaaggagggcgccgagauggagagcagcaaggaggacaaggccagacaggccgaggugaagagacuguucagacccaucgaggagcugaagaaggacuucgacgagcugaacguggugaucgagaccgacaugcagaucauggugagacugaucaacaaguucaacagcagcagcagcagccuggaggagaagaucgccgcccuguucgaccuggaguacuacgugcaccagauggacaacgcccaggaccugcugagcuucggcggccugcagguggugaucaacggccugaacagcaccgagccccuggugaaggaguacgccgccuucgugcugggcgccgccuucagcagcaaccccaaggugcagguggaggccaucgagggcggcgcccugcagaagcugcuggugauccuggccaccgagcagccccugaccgccaagaagaaggugcuguucgcccugugcagccugcugagacacuuccccuacgcccagagacaguuccugaagcugggcggccugcaggugcugagaacccuggugcaggagaagggcaccgaggugcuggccgugagaguggugacccugcuguacgaccuggugaccgagaagauguucgccgaggaggaggccgagcugacccaggagaugagccccgagaagcugcagcaguacagacaggugcaccugcugcccggccugugggagcagggcuggugcgagaucaccgcccaccugcuggcccugcccgagcacgacgccagagagaaggugcugcagacccugggcgugcugcugaccaccugcagagacagauacagacaggacccccagcugggcagaacccuggccagccugcaggccgaguaccaggugcuggccagccuggagcugcaggacggcgaggacgagggcuacuuccaggagcugcugggcagcgugaacagccugcugaaggagcugagauaa

SEQ ID NO: 23340 - RNA, 2301 nt, Artificial Sequence
  SIM1__Homo_sapiens__XP_005267157
augaaggagaagagcaagaacgccgccagaaccagaagagagaaggagaacagcgaguucuacgagcuggccaagcugcugccccugcccagcgccaucaccagccagcuggacaaggccagcaucaucagacugaccaccagcuaccugaagaugagagugguguuccccgagggccugggcgaggccuggggccacagcagcagaaccagcccccuggacaacgugggcagagagcugggcagccaccugcugcagacccuggacggcuucaucuucgugguggcccccgacggcaagaucauguacaucagcgagaccgccagcgugcaccugggccugagccagguggagcugaccggcaacagcaucuacgaguacauccaccccgccgaccacgacgagaugaccgccgugcugaccgcccaccagcccuaccacagccacuucgugcaggaguacgagaucgagagaagcuucuuccugagaaugaagugcgugcuggccaagagaaacgccggccugaccugcggcggcuacaaggugauccacugcagcggcuaccugaagaucagacaguacagccuggacaugagccccuucgacggcugcuaccagaacgugggccugguggccgugggccacagccugccccccagcgccgugaccgagaucaagcugcacagcaacauguucauguucagagccagccuggacaugaagcugaucuuccuggacagcagaguggccgagcugaccggcuacgagccccaggaccugaucgagaagacccuguaccaccacgugcacggcugcgacaccuuccaccugagaugcgcccaccaccugcugcuggugaagggccaggugaccaccaaguacuacagauuccuggccaagcacggcggcugggugugggugcagagcuacgccaccaucgugcacaacagcagaagcagcagaccccacugcaucgugagcgugaacuacgugcugaccgacaccgaguacaagggccugcagcugagccuggaccagaucagcgccagcaagcccgccuucagcuacaccagcagcagcacccccaccaugaccgacaacagaaagggcgccaagagcagacugagcagcagcaagagcaagagcagaaccagccccuacccccaguacagcggcuuccacaccgagagaagcgagagcgaccacgacagccaguggggcggcagcccccugaccgacaccgccagcccccagcugcuggaccccgccgacagacccggcagccagcacgacgccagcugcgccuacagacaguucagcgacagaagcagccugugcuacggcuucgcccuggaccacagcagacugguggaggagagacacuuccacacccaggccugcgagggcggcagaugcgaggccggcagauacuuccugggcaccccccaggccggcagagagcccugguggggcagcagagccgcccugccccugaccaaggccagccccgagagcagagaggccuacgagaacagcaugccccacaucgccagcgugcacagaauccacggcagaggccacugggacgaggacagcguggugagcagccccgaccccggcagcgccagcgagagcggcgacagauacagaaccgagcaguaccagagcagcccccacgagcccagcaagaucgagacccugaucagagccacccagcagaugaucaaggaggaggagaacagacugcagcugagaaaggcccccagcgaccagcuggccagcaucaacggcgccggcaagaagcacagccugugcuucgccaacuaccagcagcccccccccaccggcgaggugugccacggcagcgcccuggccaacaccagccccugcgaccacauccagcagagagagggcaagaugcugagcccccacgagaacgacuacgacaacagccccaccgcccugagcagaaucagcagccccaacagcgacagaaucagcaagagcagccugauccuggccaaggacuaccugcacagcgacaucagcccccaccagaccgccggcgaccaccccaccgugagccccaacugcuucggcagccacagacaguacuucgacaagcacgccuacacccugaccggcuacgcccuggagcaccuguacgacagcgagaccaucagaaacuacagccugggcugcaacggcagccacuucgacgugaccagccaccugagaaugcagcccgaccccgcccagggccacaagggcaccagcgugaucaucaccaacggcagcuaa

SEQ ID NO: 23341 - RNA, 2004 nt, Artificial Sequence
  SIM2__Homo_sapiens__NP_005060
augaaggagaagagcaagaacgccgccaagaccagaagagagaaggagaacggcgaguucuacgagcuggccaagcugcugccccugcccagcgccaucaccagccagcuggacaaggccagcaucaucagacugaccaccagcuaccugaagaugagagccguguuccccgagggccugggcgacgccuggggccagcccagcagagccggcccccuggacggcguggccaaggagcugggcagccaccugcugcagacccuggacggcuucguguucgugguggccagcgacggcaagaucauguacaucagcgagaccgccagcgugcaccugggccugagccagguggagcugaccggcaacagcaucuacgaguacauccaccccagcgaccacgacgagaugaccgccgugcugaccgcccaccagccccugcaccaccaccugcugcaggaguacgagaucgagagaagcuucuuccugagaaugaagugcgugcuggccaagagaaacgccggccugaccugcagcggcuacaaggugauccacugcagcggcuaccugaagaucagacaguacaugcuggacaugagccuguacgacagcugcuaccagaucgugggccugguggccgugggccagagccugccccccagcgccaucaccgagaucaagcuguacagcaacauguucauguucagagccagccuggaccugaagcugaucuuccuggacagcagagugaccgaggugaccggcuacgagccccaggaccugaucgagaagacccuguaccaccacgugcacggcugcgacguguuccaccugagauacgcccaccaccugcugcuggugaagggccaggugaccaccaaguacuacagacugcugagcaagagaggcggcugggugugggugcagagcuacgccaccguggugcacaacagcagaagcagcagaccccacugcaucgugagcgugaacuacgugcugaccgagaucgaguacaaggagcugcagcugagccuggagcaggugagcaccgccaagagccaggacagcuggagaaccgcccugagcaccagccaggagaccagaaagcuggugaagcccaagaacaccaagaugaagaccaagcugagaaccaaccccuaccccccccagcaguacagcagcuuccagauggacaagcuggagugcggccagcugggcaacuggagagccagcccccccgccagcgccgccgccccccccgagcugcagccccacagcgagagcagcgaccugcuguacacccccagcuacagccugcccuucagcuaccacuacggccacuucccccuggacagccacguguucagcagcaagaagcccaugcugcccgccaaguucggccagccccagggcagccccugcgagguggccagauucuuccugagcacccugcccgccagcggcgagugccaguggcacuacgccaacccccuggugcccagcagcagcagccccgccaagaacccccccgagccccccgccaacaccgccagacacagccuggugcccagcuacgaggcccccgccgccgccgugagaagauucggcgaggacaccgccccccccagcuuccccagcugcggccacuacagagaggagcccgcccugggccccgccaaggccgccagacaggccgccagagacggcgccagacuggcccuggccagagccgcccccgagugcugcgccccccccacccccgaggcccccggcgcccccgcccagcugcccuucgugcugcugaacuaccacagagugcuggccagaagaggcccccugggcggcgccgcccccgccgccagcggccuggccugcgcccccggcggccccgaggccgccaccggcgcccugagacugagacaccccagccccgccgccaccagcccccccggcgccccccugccccacuaccugggcgccagcgugaucaucaccaacggcagauaa

SEQ ID NO: 23342 - RNA, 3822 nt, Artificial Sequence
  SIN3A__Homo_sapiens__XP_006720530
augaagagaagacuggacgaccaggagagccccguguacgccgcccagcagagaagaauccccggcagcaccgaggccuucccccaccagcacagagugcuggcccccgccccccccguguacgaggccgugagcgagaccaugcagagcgccaccggcauccaguacagcgugacccccagcuaccaggugagcgccaugccccagagcagcggcagccacggccccgccaucgccgccgugcacagcagccaccaccaccccaccgccgugcagccccacggcggccagguggugcagagccacgcccaccccgccccccccguggcccccgugcagggccagcagcaguuccagagacugaagguggaggacgcccugagcuaccuggaccaggugaagcugcaguucggcagccagccccagguguacaacgacuuccuggacaucaugaaggaguucaagagccagagcaucgacacccccggcgugaucagcagagugagccagcuguucaagggccaccccgaccugaucaugggcuucaacaccuuccugccccccggcuacaagaucgaggugcagaccaacgacauggugaacgugaccacccccggccaggugcaccagauccccacccacggcauccagccccagccccagccccccccccagcaccccagccagcccagcgcccagagcgcccccgcccccgcccagcccgccccccagcccccccccgccaaggugagcaagcccagccagcugcaggcccacacccccgccagccagcagacccccccccugccccccuacgccagccccagaagcccccccgugcagccccacacccccgugaccaucagccugggcaccgcccccagccugcagaacaaccagcccguggaguucaaccacgccaucaacuacgugaacaagaucaagaacagauuccagggccagcccgacaucuacaaggccuuccuggagauccugcacaccuaccagaaggagcagagaaacgccaaggaggccggcggcaacuacacccccgcccugaccgagcaggagguguacgcccagguggccagacuguucaagaaccaggaggaccugcugagcgaguucggccaguuccugcccgacgccaacagcagcgugcugcugagcaagaccaccgccgagaagguggacagcgugagaaacgaccacggcggcaccgugaagaagccccagcugaacaacaagccccagagacccagccagaacggcugccagaucagaagacaccccaccggcaccaccccccccgugaagaagaagcccaagcugcugaaccugaaggacagcagcauggccgacgccagcaagcacggcggcggcaccgagagccuguucuucgacaaggugagaaaggcccugagaagcgccgaggccuacgagaacuuccugagaugccuggugaucuucaaccaggaggugaucagcagagccgagcuggugcagcuggugagccccuuccugggcaaguuccccgagcuguucaacugguucaagaacuuccugggcuacaaggagagcgugcaccuggagaccuaccccaaggagagagccaccgagggcaucgccauggagaucgacuacgccagcugcaagagacugggcagcagcuacagagcccugcccaagagcuaccagcagcccaagugcaccggcagaaccccccugugcaaggaggugcugaacgacaccugggugagcuuccccagcuggagcgaggacagcaccuucgugagcagcaagaagacccaguacgaggagcacaucuacagaugcgaggacgagagauucgagcuggacguggugcuggagaccaaccuggccaccaucagagugcuggaggccauccagaagaagcugagcagacugagcgccgaggagcaggccaaguucagacuggacaacacccugggcggcaccagcgaggugauccacagaaaggcccugcagagaaucuacgccgacaaggccgccgacaucaucgacggccugagaaagaaccccagcaucgccgugcccaucgugcugaagagacugaagaugaaggaggaggaguggagagaggcccagagaggcuucaacaagguguggagagagcagaacgagaaguacuaccugaagagccuggaccaccagggcaucaacuucaagcagaacgacaccaaggugcugagaagcaagagccugcugaacgagaucgagagcaucuacgacgagagacaggagcaggccaccgaggagaacgccggcgugcccgugggcccccaccugagccuggccuacgaggacaagcagauccuggaggacgccgccgcccugaucauccaccacgugaagagacagaccggcauccagaaggaggacaaguacaagaucaagcagaucaugcaccacuucauccccgaccugcuguucgcccagagaggcgaccugagcgacguggaggaggaggaggaggaggagauggacguggacgaggccaccggcgccgugaagaagcacaacggcgugggcggcagcccccccaagagcaagcugcuguucagcaacaccgccgcccagaagcugagaggcauggacgagguguacaaccuguucuacgugaacaacaacugguacaucuucaugagacugcaccagauccugugccugagacugcugagaaucugcagccaggccgagagacagaucgaggaggagaacagagagagagagugggagagagaggugcugggcaucaagagagacaagagcgacagccccgccauccagcugagacugaaggagcccauggacguggacguggaggacuacuaccccgccuuccuggacauggugagaagccugcuggacggcaacaucgacagcagccaguacgaggacagccugagagagauguucaccauccacgccuacaucgccuucaccauggacaagcugauccagagcaucgugagacagcugcagcacaucgugagcgacgagaucugcgugcaggugaccgaccuguaccuggccgagaacaacaacggcgccaccggcggccagcugaacacccagaacagcagaagccugcuggagagcaccuaccagagaaaggccgagcagcugaugagcgacgagaacugcuucaagcugauguucauccagagccagggccaggugcagcugaccaucgagcugcuggacaccgaggaggagaacagcgacgaccccguggaggccgagagauggagcgacuacguggagagauacaugaacagcgacaccaccagccccgagcugagagagcaccuggcccagaagcccguguuccugcccagaaaccugagaagaaucagaaagugccagagaggcagagagcagcaggagaaggagggcaaggagggcaacagcaagaagaccauggagaacguggacagccuggacaagcuggagugcagauucaagcugaacagcuacaagaugguguacgugaucaagagcgaggacuacauguacagaagaaccgcccugcugagagcccaccagagccacgagagagugagcaagagacugcaccagagauuccaggccuggguggacaaguggaccaaggagcacgugcccagagagauggccgccgagaccagcaaguggcugaugggcgagggccuggagggccuggugcccugcaccaccaccugcgacaccgagacccugcacuucgugagcaucaacaaguacagagugaaguacggcaccguguucaaggcccccuaa

SEQ ID NO: 23343 - RNA, 3393 nt, Artificial Sequence
  SIN3B__Homo_sapiens__NP_001284524
auggcccacgccggcggcggcagcggcggcagcggcgccggcggccccgccggcagaggccugagcggcgccagauggggcagaagcggcagcgccggccacgagaagcugcccgugcacguggaggacgcccugaccuaccuggaccaggugaagaucagauucggcagcgaccccgccaccuacaacggcuuccuggagaucaugaaggaguucaagagccagagcaucgacacccccggcgugaucagaagagugagccagcuguuccacgagcaccccgaccugaucgugggcuucaacgccuuccugccccugggcuacagaaucgacauccccaagaacggcaagcugaacauccagagcccccugaccagccaggagaacagccacaaccacggcgacggcgccgaggacuucaagcagcaggugcccuacaaggaggacaagccccaggugccccuggagagcgacagcguggaguucaacaacgccaucagcuacgugaacaagaucaagaccagauuccuggaccaccccgagaucuacagaagcuuccuggagauccugcacaccuaccagaaggagcagcugaacaccagaggcagacccuucagaggcaugagcgaggaggagguguucaccgagguggccaaccuguucagaggccaggaggaccugcugagcgaguucggccaguuccugcccgaggccaagagaagccuguucaccggcaacggccccugcgagaugcacagcgugcagaagaacgagcacgacaagacccccgagcacagcagaaagagaagcagacccagccugcugagacccgugagcgcccccgccaagaagaagaugaagcugagaggcaccaaggaccugagcaucgccgccgugggcaaguacggcacccugcaggaguucagcuucuucgacaaggugagaagagugcugaagagccaggagguguacgagaacuuccugagaugcaucgcccuguucaaccaggagcuggugagcggcagcgagcugcugcagcuggugagccccuuccugggcaaguuccccgagcuguucgcccaguucaagagcuuccugggcgugaaggagcugagcuucgccccccccaugagcgacagaagcggcgacggcaucagcagagagaucgacuacgccagcugcaagagaaucggcagcagcuacagagcccugcccaagaccuaccagcagcccaagugcagcggcagaaccgccaucugcaaggaggugcugaacgacaccugggugagcuuccccagcuggagcgaggacagcaccuucgugagcagcaagaagacccccuacgaggagcagcugcacagaugcgaggacgagagauucgagcuggacguggugcuggagaccaaccuggccaccaucagagugcuggagagcgugcagaagaagcugagcagaauggcccccgaggaccaggagaaguucagacuggacgacagccugggcggcaccagcgaggugauccagagaagagccaucuacagaaucuacggcgacaaggcccccgagaucaucgagagccugaagaagaaccccgugaccgccgugcccguggugcugaagagacugaaggccaaggaggaggaguggagagaggcccagcagggcuucaacaagaucuggagagagcaguacgagaaggccuaccugaagagccuggaccaccaggccgugaacuucaagcagaacgacaccaaggcccugagaagcaagagccugcugaacgagaucgagagcguguacgacgagcaccaggagcagcacagcgagggcagaagcgcccccagcagcgagccccaccugaucuucguguacgaggacagacagauccuggaggacgccgccgcccugaucagcuacuacgugaagagacagcccgccauccagaaggaggaccagggcaccauccaccagcugcugcaccaguucgugcccagccuguucuucagccagcagcuggaccugggcgccagcgaggagagcgccgacgaggacagagacagcccccagggccagaccaccgaccccagcgagagaaagaagcccgcccccggcccccacagcagcccccccgaggagaagggcgccuucggcgacgcccccgccaccgagcagcccccccugcccccccccgccccccacaagccccuggacgacguguacagccuguucuucgccaacaacaacugguacuucuuccugagacugcaccagacccugugcagcagacugcugaagaucuacagacaggcccagaagcagcugcuggaguacagaaccgagaaggagagagagaagcugcugugcgagggcagaagagagaagggcagcgaccccgccauggagcugagacugaagcagcccagcgagguggagcuggaggaguacuaccccgccuuccuggacauggugagaagccugcuggagggcagcaucgaccccacccaguacgaggacacccugagagagauguucaccauccacgccuacgugggcuucaccauggacaagcuggugcagaacaucgccagacagcugcaccaccuggugagcgacgacgugugccugaaggugguggagcuguaccugaacgagaagaagagaggcgccgccggcggcaaccugagcagcagaugcgugagagccgccagagagaccagcuaccaguggaaggccgagagaugcauggccgacgagaacugcuucaaggugauguuccugcagagaaagggccaggugaucaugaccaucgagcugcuggacaccgaggaggcccagaccgaggaccccguggaggugcagcaccuggccagauacguggagcaguacgugggcaccgagggcgccagcagcagccccaccgagggcuuccugcugaagcccguguuccugcagagaaaccugaagaaguucagaagaagauggcagagcgagcaggccagagcccugagaggcgaggccagaagcagcuggaagagacuggugggcguggagagcgccugcgacguggacugcagauucaagcugagcacccacaagaugguguucaucgugaacagcgaggacuacauguacagaagaggcacccugugcagagccaagcaggugcagccccuggugcugcugagacaccaccagcacuucgaggaguggcacagcagauggcuggaggacaacgugaccguggaggccgccagccuggugcaggacuggcugaugggcgaggaggacgaggacauggugcccugcaagacccugugcgagaccgugcacgugcacggccugcccgugaccagauacagagugcaguacagcagaagacccgccagccccuaa

SEQ ID NO: 23344 - RNA, 3129 nt, Artificial Sequence
  SIPA1__Homo_sapiens__NP_694985
augcccaugugggccggcggcgugggcagccccagaagaggcauggcccccgccagcaccgacgaccuguucgccagaaagcugagacagcccgccagacccccccugaccccccacaccuucgagcccagacccgugagaggcccccugcugagaagcggcagcgacgccggcgaggccagaccccccacccccgccagccccagagccagagcccacagccacgaggaggccagcagacccgccgccaccagcaccagacuguucaccgacccccuggcccugcugggccugcccgccgaggagcccgagcccgccuucccccccgugcuggagcccagaugguucgcccacuacgacgugcagagccugcuguucgacugggcccccagaagccagggcaugggcagccacagcgaggccagcagcggcacccuggccagcgccgaggaccaggccgccagcagcgaccugcugcacggcgcccccggcuucgugugcgagcugggcggcgagggcgagcugggccugggcggccccgccagcccccccgugccccccgcccugcccaacgccgccgugagcauccuggaggagccccagaacagaaccagcgccuacagccuggagcacgccgaccugggcgccggcuacuacagaaaguacuucuacggcaaggagcaccagaacuucuucggcauggacgagagccugggccccguggccgugagccugagaagagaggagaaggagggcagcggcggcggcacccugcacagcuacagagugaucgugagaaccacccagcugagaacccugagaggcaccaucagcgaggacgcccugccccccggcccccccagaggccugagccccagaaagcugcuggagcacguggccccccagcugagccccagcugccugagacugggcagcgccagccccaaggugcccagaacccugcugacccuggacgagcaggugcugagcuuccagagaaaggugggcauccuguacugcagagccggccagggcagcgaggaggagauguacaacaaccaggaggccggccccgccuucaugcaguuccugacccugcugggcgacguggugagacugaagggcuucgagagcuacagagcccagcuggacaccaagaccgacagcaccggcacccacagccuguacaccaccuaccaggaccacgagaucauguuccacgugagcaccaugcugcccuacacccccaacaaccagcagcagcugcugagaaagagacacaucggcaacgacaucgugaccaucguguuccaggagcccggcagcaagcccuucugccccaccaccaucagaagccacuuccagcacguguuccugguggugagagcccacacccccugcaccccccacaccaccuacagaguggccgugagcagaacccaggacacccccgccuucggccccgcccugcccgccggcggcggccccuucgccgccaacgccgacuucagagccuuccugcuggccaaggcccugaacggcgagcaggccgccggccacgccagacaguuccacgccauggccaccagaaccagacagcaguaccugcaggaccuggccaccaacgaggugaccaccaccagccuggacagcgccagcagauucggccugcccagccugggcggcagaagaagagccgcccccagaggccccggcgccgagcugcaggccgccggcagccugguguggggcgugagagccgcccccggcgccagaguggccgccggcgcccaggccagcggccccgagggcaucgaggugcccugccugcugggcaucagcgccgaggcccuggugcugguggcccccagagacggcagagugguguucaacugcgccugcagagacgugcuggccuggaccuucagcgagcagcagcuggaccuguaccacggcagaggcgaggccaucacccugagauucgacggcagccccggccaggccgugggcgaggugguggccagacugcagcuggugagcagaggcugcgagaccagagagcuggcccugcccagagacggccagggcagacugggcuucgagguggacgccgagggcuucgugacccacguggagagauucaccuucgccgagaccgccggccugagacccggcgccagacugcugagagugugcggccagacccugcccagccugagacccgaggccgccgcccagcugcugagaagcgcccccaaggugugcgugaccgugcugccccccgacgagagcggcagacccagaagaagcuucagcgagcuguacacccugagccugcaggagcccagcagaagaggcgcccccgaccccgugcaggacgaggugcagggcgugacccugcugcccaccaccaagcagcugcugcaccugugccugcaggacggcggcagcccccccggccccggcgaccuggccgaggagagaaccgaguuccugcacagccagaacagccugagccccagaagcagccugagcgacgaggcccccgugcugcccaacaccacccccgaccugcugcuggccaccaccgccaagcccagcgugcccagcgccgacagcgagaccccccugacccaggacagacccggcagccccagcggcagcgaggacaagggcaaccccgcccccgagcugagagccagcuuccugcccagaacccugagccugagaaacagcaucagcagaaucaugagcgaggccggcagcggcacccuggaggacgaguggcaggccaucagcgagaucgccagcaccugcaacaccauccuggagagccugagcagagagggccagcccauccccgagagcggcgaccccaagggcacccccaagagcgacgccgagcccgagcccggcaaccugagcgagaaggugagccaccuggagagcaugcugagaaagcugcaggaggaccugcagaaggagaaggccgacagagccgcccuggaggaggaggugagaagccugagacacaacaacagaagacugcaggccgagagcgagagcgccgccaccagacugcugcuggccagcaagcagcugggcagccccaccgccgaccuggccuaa

SEQ ID NO: 23345 - RNA, 5169 nt, Artificial Sequence
  SIPA1L2__Homo_sapiens__NP_065859
augagcgaccccagacagagccaggaggagaagcacaagcugggcagagccagcagcaaguucaaggacccccccagaaucaugcagagcgacgacuacuucgccagaaaguucaaggccaucaacggcaacaugggccccaccaccagccugaacgccagcaacagcaacgagaccggcggcggcggccccgccaacggcacccccgccgugcccaagaugggcgugagagccagagugagcgaguggccccccaagaaggacugcagcaaggagcugaccugcaaggcccugugggagagcagaagccagaccagcuacgagagcaucaccagcgugcugcagaacggccagagcgaccagagcgagggccagcaggacgagcagcuggaccuggacuucguggaggccaaguacaccaucggcgacaucuucgugcacagcccccagagaggccugcaccccaucagacagagaagcaacagcgacgugaccaucagcgacaucgacgccgaggacgugcuggaccagaacgccgugaaccccaacaccggcgccgcccugcacagagaguacggcagcaccagcagcaucgacagacagggccugagcggcgagaacuucuucgccaugcugagaggcuacagaguggagaacuacgaccacaaggccauggugcccuucggcuuccccgaguucuucagaugcgaccccgccaucagccccagccugcacgccgccgcccagaucagcagaggcgaguucgugagaaucagcggccuggacuacguggacagcgcccugcugaugggcagagacagagacaagcccuucaagagaagacugaagagcgagagcguggagaccagccuguucagaaagcugagaaccgugaagagcgagcacgagaccuucaaguucaccagcgagcuggaggagagcagacuggagagaggcaucagacccuggaacugccagagaugcuucgcccacuacgacgugcagagcauccuguucaacaucaacgaggccauggccaccagagccaacgugggcaagagaaagaacaucaccaccggcgccagcgccgccagccagacccagaugcccaccggccagaccggcaacugcgagagcccccugggcagcaaggaggaccugaacagcaaggagaaccuggacgccgacgagggcgacggcaagagcaacgaccuggugcugagcugccccuacuucagaaacgagaccggcggcgagggcgacagaagaaucgcccugagcagagccaacagcagcagcuucagcagcggcgagagcugcagcuucgagagcagccugagcagccacugcaccaacgccggcgugagcgugcuggaggugcccagagagaaccagcccauccacagagagaaggugaagagauacaucaucgagcacaucgaccugggcgccuacuacuacagaaaguucuucuacggcaaggagcaccagaacuacuucggcaucgacgagaaccugggccccguggccgugagcaucagaagagagaagguggaggacgccaaggagaaggagggcagccaguucaacuacagaguggccuucagaaccagcgagcugaccacccugagaggcgccauccuggaggacgccauccccagcaccgccagacacggcaccgccagaggccugccccugaaggaggugcuggaguacgugauccccgagcugagcauccagugccugagacaggccagcaacagccccaaggugagcgagcagcugcugaagcuggacgagcagggccugagcuuccagcacaagaucggcauccuguacugcaaggccggccagagcaccgaggaggagauguacaacaacgagaccgccggccccgccuucgaggaguuccuggaccugcugggccagagagugagacugaagggcuucagcaaguacagagcccagcuggacaacaagaccgacagcaccggcacccacagccuguacaccaccuacaaggacuacgagcugauguuccacgugagcacccugcugcccuacaugcccaacaacagacagcagcugcugagaaagagacacaucggcaacgacaucgugaccaucguguuccaggagcccggcgcccugcccuucacccccaagagcaucagaagccacuuccagcacguguucgugaucgugaaggugcacaaccccugcaccgagaacgugugcuacagcgugggcgugagcagaagcaaggacgugccccccuucggcccccccauccccaagggcgugaccuuccccaagagcgccguguucagagacuuccugcuggccaaggugaucaacgccgagaacgccgcccacaagagcgagaaguucagagccauggccaccagaaccagacaggaguaccugaaggaccuggccgagaacuucgugaccaccgccaccguggacaccagcgugaaguucagcuucaucacccugggcgccaagaagaaggagaaggugaagcccagaaaggacgcccaccuguucagcaucggcgccaucauguggcacgugaucgccagagacuucggccagagcgccgacaucgagugccugcugggcaucagcaacgaguucaucaugcugaucgagaaggacagcaagaacgugguguucaacugcagcugcagagacgugaucggcuggaccagcggccuggugagcaucaagguguucuacgagagaggcgagugcgugcugcugagcagcguggacaacugcgccgaggacaucagagagaucgugcagagacuggugaucgugaccagaggcugcgagaccguggagaugacccugagaagaaacggccugggccagcugggcuuccacgugaacuucgagggcaucguggccgacguggagcccuucggcuucgccuggaaggccggccugagacagggcagcagacugguggagaucugcaagguggccguggccacccugacccacgagcagaugaucgaccugcugagaaccagcgugaccgugaagguggugaucauccagccccacgacgacggcagccccagaagaggcugcagcgagcugugcagaauccccaugguggaguacaagcuggacagcgagggcacccccugcgaguacaagacccccuucagaagaaacaccaccuggcacagagugcccacccccgcccugcagccccugagcagagccagccccauccccggcacccccgacagacugcccugccagcagcugcugcagcaggcccaggccgccauccccagaagcaccagcuucgacagaaagcugcccgacggcaccagaagcagccccagcaaccagagcagcagcagcgaccccggccccggcggcagcggccccuggagaccccaggugggcuacgacggcugccagagcccccugcugcuggagcaccagggcagcggcccccuggagugcgacggcgccagagagagagaggacaccauggaggccagcagacaccccgagaccaaguggcacggcccccccagcaaggugcugggcagcuacaaggagagagcccugcagaaggacggcagcugcaaggacagccccaacaagcugagccacaucggcgacaagagcugcagcagccacagcagcagcaacacccugagcagcaacaccagcagcaacagcgacgacaagcacuucggcagcggcgaccugauggaccccgagcugcugggccugaccuacaucaagggcgccagcaccgacagcggcaucgacaccgcccccugcaugcccgccaccauccugggccccgugcaccuggccggcagcagaagccugauccacagcagagccgagcagugggccgacgccgccgacgugagcggccccgacgacgagcccgccaagcuguacagcgugcacggcuacgccagcaccaucagcgccggcagcgccgccgagggcagcaugggcgaccugagcgagaucagcagccacagcagcggcagccaccacagcggcagccccagcgcccacugcagcaagagcagcggcagccuggacagcagcaagguguacaucgugagccacagcagcggccagcaggugcccggcagcaugagcaagcccuaccacagacagggcgccgugaacaaguacgugaucggcuggaagaagagcgagggcagccccccccccgaggagcccgaggugaccgagugccccggcauguacagcgagauggacgugaugagcaccgccacccagcaccagaccguggugggcgacgccguggccgagacccagcacgugcugagcaaggaggacuuccugaagcugaugcugcccgacagcccccugguggaggagggcagaagaaaguucagcuucuacggcaaccugagccccagaagaagccuguacagaacccugagcgacgagagcaucugcagcaacagaagaggcagcagcuucggcagcagcagaagcagcgugcuggaccaggcccugcccaacgacauccuguucagcaccaccccccccuaccacagcacccugccccccagagcccaccccgcccccagcaugggcagccugagaaacgaguucugguucagcgacggcagccugagcgacaagagcaagugcgccgaccccggccugaugccccugcccgacaccgccaccggccuggacuggacccaccugguggacgccgccagagccuucgagggccuggacagcgacgaggagcugggccugcugugccaccacaccagcuaccuggaccagagaguggccagcuucugcacccugaccgacaugcagcacggccaggaccuggagggcgcccaggagcugccccugugcguggaccccggcagcggcaaggaguucauggacaccaccggcgagagaagccccagcccccugaccggcaaggugaaccagcuggagcugauccugagacagcugcagaccgaccugagaaaggagaagcaggacaaggccgugcugcaggccgaggugcagcaccugagacaggacaacaugagacugcaggaggagagccagaccgccaccgcccagcugagaaaguucaccgagugguucuucaccaccaucgacaagaagagcuaa

SEQ ID NO: 23346 - RNA, 5346 nt, Artificial Sequence
  SIPA1L3__Homo_sapiens__NP_055888
augaccaccuacagagccauccccagcgacggcguggaccuggccgccagcugcggcgccagagugggcgacgugcugcccggcccccacaccggcgacuacgccccccugggcuucugggcccagaacggcagcaugagccagccccugggcgagagccccgccaccgccaccgccaccgccaccgccaccaccagacccagccccaccacccccgccaugcccaagaugggcgugagagccagaguggccgacuggccccccaagagagaggcccugagagagcacagcaaccccagccccagccaggacaccgacggcaccaaggccaccaagauggcccacagcaugagaagcauccagaacggccagccccccaccagcacccccgccagcagcggcagcaaggccuuccacagacugagcagaagaagaagcaaggacguggaguuccaggacggcuggcccagaagccccggcagagccuuccugccccugagacacagaagcagcagcgagaucacccugagcgagugcgacgccgaggacgccggcgagcccagaggcgccagacacaccggcgcccugccccuguucagagaguacggcagcaccagcagcaucgacgugcagggcaugcccgagcagagcuucuucgacauccugaacgaguucagaagcgagcagcccgacgccagaggcugccaggcccugaccgagcugcugagagccgaccccggcccccaccugaugggcggcggcggcggcgccaagggcgacagccacaacggccagcccgccaaggacagccugcugccccugcagcccaccaaggagaaggagaaggccagaaagaagcccgccagaggccugggcggcggcgacaccguggacagcagcaucuucagaaagcugagaagcagcaagcccgagggcgaggccggcagaagccccggcgaggccgacgagggcagaagcccccccgaggccagcagacccugggugugccagaagagcuucgcccacuucgacgugcagagcaugcuguucgaccugaacgaggccgccgccaacagagugagcgugagccagagaagaaacaccaccaccggcgccagcgccgccagcgccgccagcgccauggccagccugaccgccagcagagcccacagccugggcggccuggaccccgccuucaccagcaccgaggaccugaacugcaaggagaaccuggagcaggaccugggcgacgacaacagcaacgaccugcugcugagcugcccccacuucagaaacgagaucggcggcgagugcgagagaaacgugagcuucagcagagccagcgugggcagccccagcagcggcgagggccaccuggccgagcccgcccugagcgccuacagaaccaacgccagcaucagcgugcuggaggugcccaaggagcagcagagaacccagagcagacccagacaguacagcaucgagcacguggaccugggcgccagauacuaccaggacuacuucgugggcaaggagcacgccaacuacuucggcguggacgagaagcugggccccguggccgugagcaucaagagagagaagcuggaggaccacaaggagcacggcccccaguaccaguacagaaucaucuucagaaccagagagcugaucacccugagaggcagcauccuggaggacgccacccccaccgccaccaagcacggcaccggcagaggccugccccugaaggacgcccuggaguacgugauccccgagcugaacauccacugccugagacuggcccugaacacccccaaggugaccgagcagcugcugaagcuggacgagcagggccugugcagaaagcacaaggugggcauccuguacugcaaggccggccagagcagcgaggaggagauguacaacaacgaggaggccggccccgccuucgaggaguuccugagccugaucggcgagaaggugugccugaagggcuucaccaaguacgccgcccagcuggacgugaagaccgacagcaccggcacccacagccuguacaccauguaccaggacuacgagaucauguuccacgugagcacccugcugcccuacacccccaacaacagacagcagcugcugagaaagagacacaucggcaacgacaucgugaccaucaucuuccaggagcccggcgcccugcccuucacccccaagaacaucagaagccacuuccagcacguguucaucaucgugagagugcacaaccccugcaccgacaacgugugcuacagcauggccgugaccagaagcaaggacgccccccccuucggcccccccauccccagcggcaccaccuucagaaagagcgacguguucagagacuuccugcuggccaaggugaucaacgccgagaacgccgcccacaagagcgacaaguuccacaccauggccaccagaaccagacaggaguaccugaaggaccuggccgagaacugcgugagcaacacccccaucgacagcaccggcaaguucaaccugaucagccugaccagcaagaagaaggagaagaccaaggccagagccggcgccgagcagcacagcgccggcgccaucgccuggagagugguggcccaggacuacgcccagggcguggagaucgacugcauccugggcaucagcaacgaguucguggugcugcuggaccugagaaccaaggaggugguguucaacugcuacugcggcgacgugaucggcuggacccccgacagcagcacccugaagaucuucuacggcagaggcgaccacaucuuccugcaggccaccgagggcagcguggaggacaucagagagaucgugcagagacugaaggugaugaccagcggcugggagaccguggacaugacccugagaagaaacggccugggccagcugggcuuccacgugaaguacgacggcaccguggccgagguggaggacuacggcuucgccuggcaggccggccugagacagggcagcagacugguggagaucugcaagguggccguggugacccugacccacgaccagaugaucgaccugcugagaaccagcgugaccgugaagguggugaucaucccccccuucgaggacggcacccccagaagaggcuggcccgagaccuacgacaugaacaccagcgagcccaagaccgagcaggagagcaucacccccggcggcagaccccccuacagaagcaacgcccccuggcaguggagcggccccgccagccacaacagccugcccgccagcaagugggccacccccaccacccccggccacgcccagagccugagcagaccccugaagcagacccccaucgugcccuucagagagagccagccccugcacagcaagagacccgugagcuuccccgagacccccuacaccgugagccccgccggcgccgacagagugccccccuacagacagcccagcggcagcuucagcacccccggcagcgccaccuacgugagauacaagcccagccccgagagauacaccgccgccccccacccccugcugagccuggacccccacuucagccacgacggcaccagcagcggcgacagcagcagcggcggccugaccagccaggagagcaccauggagagacagaagcccgagccccuguggcacgugcccgcccaggccagacugagcgccaucgccggcagcagcggcaacaagcaccccagcagacaggacgccgccggcaaggacagccccaacagacacagcaagggcgagccccaguacagcagccacagcagcagcaacacccugagcagcaacgccagcagcagccacagcgacgacagaugguucgacccccuggacccccuggagcccgagcaggacccccugagcaagggcggcagcagcgacagcggcaucgacaccacccuguacaccagcagccccagcugcaugagccuggccaaggcccccagacccgccaagccccacaagccccccggcagcaugggccugugcggcggcggcagagaggccgccggcagaagccaccacgccgacagaagaagagaggugagccccgcccccgccguggccggccagagcaagggcuacagacccaagcuguacagcagcggcagcagcacccccaccggccuggccggcggcagcagagacccccccagacagcccagcgacaugggcagcagagugggcuaccccgcccagguguacaagaccgccagcgccgagacccccagacccagccagcuggcccagcccagccccuuccagcugagcgccagcgugcccaagagcuucuucagcaagcagcccgugagaaacaagcaccccaccggcuggaagagaaccgaggagcccccccccagaccccugcccuucagcgaccccaagaagcagguggacaccaacaccaagaacguguucggccagcccagacugagagccagccugagagaccugagaagccccagaaagaacuacaagagcaccaucgaggacgaccugaagaagcugaucaucauggacaaccugggccccgagcaggagagagacaccggccagagcccccagaagggccugcagagaacccugagcgacgagagccugugcagcggcagaagagagcccagcuucgccagccccgccggccuggagcccggccugcccagcgacgugcuguucaccagcaccugcgccuuccccagcagcacccugcccgccagaagacagcaccagcacccccacccccccgugggccccggcgccacccccgccgccggcagcggcuuccccgagaagaagagcaccaucagcgccagcgagcugagccuggccgacggcagagacagaccccugagaagacuggaccccggccugaugccccugcccgacaccgccgccggccuggaguggagcagccuggugaacgccgccaaggccuacgaggugcagagagccgugagccuguucagccugaacgaccccgcccugagccccgacaucccccccgcccacagccccgugcacagccaccugagccuggagagaggcccccccacccccagaaccacccccaccaugagcgaggagcccccccuggaccugaccggcaagguguaccagcuggaggugaugcugaagcagcugcacaccgaccugcagaaggagaagcaggacaagguggugcugcagagcgagguggccagccugagacagaacaaccagagacugcaggaggagagccaggccgccagcgagcagcugagaaaguucgccgagaucuucugcagagagaagaaggagcuguaa

SEQ ID NO: 23347 - RNA, 1515 nt, Artificial Sequence
  SIRPA__Homo_sapiens__NP_542970
auggagcccgccggccccgcccccggcagacugggcccccugcugugccugcugcuggccgccagcugcgccuggagcggcguggccggcgaggaggagcugcaggugauccagcccgacaagagcgugcugguggccgccggcgagaccgccacccugagaugcaccgccaccagccugauccccgugggccccauccagugguucagaggcgccggccccggcagagagcugaucuacaaccagaaggagggccacuuccccagagugaccaccgugagcgaccugaccaagagaaacaacauggacuucagcaucagaaucggcaacaucacccccgccgacgccggcaccuacuacugcgugaaguucagaaagggcagccccgacgacguggaguucaagagcggcgccggcaccgagcugagcgugagagccaagcccagcgcccccguggugagcggccccgccgccagagccaccccccagcacaccgugagcuucaccugcgagagccacggcuucagccccagagacaucacccugaagugguucaagaacggcaacgagcugagcgacuuccagaccaacguggaccccgugggcgagagcgugagcuacagcauccacagcaccgccaagguggugcugaccagagaggacgugcacagccaggugaucugcgagguggcccacgugacccugcagggcgacccccugagaggcaccgccaaccugagcgagaccaucagagugccccccacccuggaggugacccagcagcccgugagagccgagaaccaggugaacgugaccugccaggugagaaaguucuacccccagagacugcagcugaccuggcuggagaacggcaacgugagcagaaccgagaccgccagcaccgugaccgagaacaaggacggcaccuacaacuggaugagcuggcugcuggugaacgugagcgcccacagagacgacgugaagcugaccugccagguggagcacgacggccagcccgccgugagcaagagccacgaccugaaggugagcgcccaccccaaggagcagggcagcaacaccgccgccgagaacaccggcagcaacgagagaaacaucuacaucguggugggcguggugugcacccugcugguggcccugcugauggccgcccuguaccuggugagaaucagacagaagaaggcccagggcagcaccagcagcaccagacugcacgagcccgagaagaacgccagagagaucacccaggacaccaacgacaucaccuacgccgaccugaaccugcccaagggcaagaagcccgccccccaggccgccgagcccaacaaccacaccgaguacgccagcauccagaccagcccccagcccgccagcgaggacacccugaccuacgccgaccuggacauggugcaccugaacagaacccccaagcagcccgcccccaagcccgagcccagcuucagcgaguacgccagcgugcaggugcccagaaaguaa

SEQ ID NO: 23348 - RNA, 546 nt, Artificial Sequence
  SIRPB1__Homo_sapiens__NP_001077379
augcccgugcccgccagcuggccccaccugcccagccccuuccugcugaugacccugcugcugggcagacugaccggcguggccggcgaggacgagcugcaggugauccagcccgagaagagcgugagcguggccgccggcgagagcgccacccugagaugcgccaugaccagccugauccccgugggccccaucaugugguucagaggcgccggcgccggcagagagcugaucuacaaccagaaggagggccacuuccccagagugaccaccgugagcgagcugaccaagagaaacaaccuggacuucagcaucagcaucagcaacaucacccccgccgacgccggcaccuacuacugcgugaaguucagaaagggcagccccgacgacguggaguucaagagcggcgccggcaccgagcugagcgugagagaggccgcccuggcccccaccgccccccugcugguggcccugcugcugggccccaagcugcugcugguggugggcgugagcgccaucuacaucugcuggaagcagaaggccuaa

SEQ ID NO: 23349 - RNA, 831 nt, Artificial Sequence
  SIRPG__Homo_sapiens__NP_001034597
augcccgugcccgccagcuggccccacccccccggccccuuccugcugcugacccugcugcugggccugaccgagguggccggcgaggaggagcugcagaugauccagcccgagaagcugcugcuggugaccgugggcaagaccgccacccugcacugcaccgugaccagccugcugcccgugggccccgugcugugguucagaggcgugggccccggcagagagcugaucuacaaccagaaggagggccacuuccccagagugaccaccgugagcgaccugaccaagagaaacaacauggacuucagcaucagaaucagcagcaucacccccgccgacgugggcaccuacuacugcgugaaguucagaaagggcagccccgagaacguggaguucaagagcggccccggcaccgagauggcccugggcgccaagcccagcgcccccguggugcugggccccgccgccagaaccacccccgagcacaccgugagcuucaccugcgagagccacggcuucagccccagagacaucacccugaagugguucaagaacggcaacgagcugagcgacuuccagaccaacguggaccccaccggccagagcguggccuacagcaucagaagcaccgccagaguggugcuggaccccugggacgugagaagccaggugaucugcgagguggcccacgugacccugcagggcgacccccugagaggcaccgccaaccugagcgaggccaucagaggccccgccagcagccugaccgcccugcugcugaucgccgugcugcugggccccaucuacgugcccuggaagcagaagaccuaa

SEQ ID NO: 23350 - RNA, 1359 nt, Artificial Sequence
  SIRT1__Homo_sapiens__NP_001135970
auguucgacaucgaguacuucagaaaggaccccagacccuucuucaaguucgccaaggagaucuaccccggccaguuccagcccagccugugccacaaguucaucgcccugagcgacaaggagggcaagcugcugagaaacuacacccagaacaucgacacccuggagcagguggccggcauccagagaaucauccagugccacggcagcuucgccaccgccagcugccugaucugcaaguacaagguggacugcgaggccgugagaggcgacaucuucaaccagguggugcccagaugccccagaugccccgccgacgagccccuggccaucaugaagcccgagaucguguucuucggcgagaaccugcccgagcaguuccacagagccaugaaguacgacaaggacgagguggaccugcugaucgugaucggcagcagccugaaggugagacccguggcccugauccccagcagcaucccccacgaggugccccagauccugaucaacagagagccccugccccaccugcacuucgacguggagcugcugggcgacugcgacgugaucaucaacgagcugugccacagacugggcggcgaguacgccaagcugugcugcaaccccgugaagcugagcgagaucaccgagaagccccccagaacccagaaggagcuggccuaccugagcgagcugccccccaccccccugcacgugagcgaggacagcagcagccccgagagaaccagcccccccgacagcagcgugaucgugacccugcuggaccaggccgccaagagcaacgacgaccuggacgugagcgagagcaagggcugcauggaggagaagccccaggaggugcagaccagcagaaacguggagagcaucgccgagcagauggagaaccccgaccugaagaacgugggcagcagcaccggcgagaagaacgagagaaccagcguggccggcaccgugagaaagugcuggcccaacagaguggccaaggagcagaucagcagaagacuggacggcaaccaguaccuguuccugccccccaacagauacaucuuccacggcgccgagguguacagcgacagcgaggacgacgugcugagcagcagcagcugcggcagcaacagcgacagcggcaccugccagagccccagccuggaggagcccauggaggacgagagcgagaucgaggaguucuacaacggccuggaggacgagcccgacgugcccgagagagccggcggcgccggcuucggcaccgacggcgacgaccaggaggccaucaacgaggccaucagcgugaagcaggaggugaccgacaugaacuaccccagcaacaagagcuaa

SEQ ID NO: 23351 - RNA, 705 nt, Artificial Sequence
  SIRT2__Homo_sapiens__NP_001180215
auggacuuccugagaaaccuguucagccagacccugagccugggcagccagaaggagagacugcuggacgagcugacccuggagggcguggccagauacaugcagagcgagagaugcagaagagugaucugccuggugggcgccggcaucagcaccagcgccggcauccccgacuucagaagccccagcaccggccuguacgacaaccuggagaaguaccaccugcccuaccccgaggccaucuucgagaucagcuacuucaagaagcaccccgagcccuucuucgcccuggccaaggagcuguaccccggccaguucaagcccaccaucugccacuacuucaugagacugcugaaggacaagggccugcugcugagaugcuacacccagaacaucgacacccuggagagaaucgccggccuggagcaggaggaccugguggaggcccacggcaccuucuacaccagccacugcgugagcgccagcugcagacacgaguacccccugagcuggaugaaggagaagaucuucagcgaggugacccccaagugcgaggacugccagagccuggugaagcccgacaucguguucuucggcgagagccugcccgccagauucuucagcugcaugcagagcgacuuccugaagguggaccugcugcuggugaugggcaccagccugcagggcagaggccuggccggcuaa

SEQ ID NO: 23352 - RNA, 774 nt, Artificial Sequence
  SIRT3__Homo_sapiens__NP_001017524
auggugggcgccggcaucagcacccccagcggcauccccgacuucagaagccccggcagcggccuguacagcaaccugcagcaguacgaccugcccuaccccgaggccaucuucgagcugcccuucuucuuccacaaccccaagcccuucuucacccuggccaaggagcuguaccccggcaacuacaagcccaacgugacccacuacuuccugagacugcugcacgacaagggccugcugcugagacuguacacccagaacaucgacggccuggagagagugagcggcauccccgccagcaagcugguggaggcccacggcaccuucgccagcgccaccugcaccgugugccagagacccuuccccggcgaggacaucagagccgacgugauggccgacagagugcccagaugccccgugugcaccggcguggugaagcccgacaucguguucuucggcgagccccugccccagagauuccugcugcacgugguggacuuccccauggccgaccugcugcugauccugggcaccagccuggagguggagcccuucgccagccugaccgaggccgugagaagcagcgugcccagacugcugaucaacagagaccuggugggcccccuggccuggcaccccagaagcagagacguggcccagcugggcgacguggugcacggcguggagagccugguggagcugcugggcuggaccgaggagaugagagaccuggugcagagagagaccggcaagcuggacggccccgacaaguaa

SEQ ID NO: 23353 - RNA, 945 nt, Artificial Sequence
  SIRT4__Homo_sapiens__NP_036372
augaagaugagcuucgcccugaccuucagaagcgccaagggcagauggaucgccaaccccagccagcccugcagcaaggccagcaucggccuguucgugcccgccagccccccccuggaccccgagaaggugaaggagcugcagagauucaucacccugagcaagagacugcuggugaugaccggcgccggcaucagcaccgagagcggcauccccgacuacagaagcgagaaggugggccuguacgccagaaccgacagaagacccauccagcacggcgacuucgugagaagcgcccccaucagacagagauacugggccagaaacuucgugggcuggccccaguucagcagccaccagcccaaccccgcccacugggcccugagcaccugggagaagcugggcaagcuguacuggcuggugacccagaacguggacgcccugcacaccaaggccggcagcagaagacugaccgagcugcacggcugcauggacagagugcugugccuggacugcggcgagcagacccccagaggcgugcugcaggagagauuccaggugcugaaccccaccuggagcgccgaggcccacggccuggcccccgacggcgacguguuccugagcgaggagcaggugagaagcuuccaggugcccaccugcgugcagugcggcggccaccugaagcccgacgugguguucuucggcgacaccgugaaccccgacaagguggacuucgugcacaagagagugaaggaggccgacagccugcugguggugggcagcagccugcagguguacagcggcuacagauucauccugaccgccugggagaagaagcugcccaucgccauccugaacaucggccccaccagaagcgacgaccuggccugccugaagcugaacagcagaugcggcgagcugcugccccugaucgaccccugcuaa

SEQ ID NO: 23354 - RNA, 879 nt, Artificial Sequence
  SIRT5__Homo_sapiens__NP_001180196
augagaccccugcagaucgugcccagcagacugaucagccagcuguacugcggccugaagccccccgccagcaccagaaaccagaucugccugaagauggccagacccagcagcagcauggccgacuucagaaaguucuucgccaaggccaagcacaucgugaucaucagcggcgccggcgugagcgccgagagcggcgugcccaccuucagaggcgccggcggcuacuggagaaaguggcaggcccaggaccuggccaccccccuggccuucgcccacaaccccagcagagugugggaguucuaccacuacagaagagaggugaugggcagcaaggagcccaacgccggccacagagccaucgccgagugcgagaccagacugggcaagcagggcagaagagugguggugaucacccagaacaucgacgagcugcacagaaaggccggcaccaagaaccugcuggagauccacggcagccuguucaagaccagaugcaccagcugcggcgugguggccgagaacuacaagagccccaucugccccgcccugagcggcaagggcugcgaggaggccggcugcggcggccugcugagaccccacguggugugguucggcgagaaccuggaccccgccauccuggaggagguggacagagagcuggcccacugcgaccugugccugguggugggcaccagcagcgugguguaccccgccgccauguucgccccccagguggccgccagaggcgugcccguggccgaguucaacaccgagaccacccccgccaccaacagauucagauuccacuuccagggccccugcggcaccacccugcccgaggcccuggccugccacgagaacgagaccgugagcuaa

SEQ ID NO: 23355 - RNA, 987 nt, Artificial Sequence
  SIRT6__Homo_sapiens__NP_001180214
augagcgugaacuacgccgccggccugagccccuacgccgacaagggcaagugcggccugcccgagaucuucgacccccccgaggagcuggagagaaaggugugggagcuggccagacugguguggcagagcagcagcgugguguuccacaccggcgccggcaucagcaccgccagcggcauccccgacuucagaggcccccacggcguguggaccauggaggagagaggccuggcccccaaguucgacaccaccuucgagagcgccagacccacccagacccacauggcccuggugcagcuggagagagugggccugcugagauuccuggugagccagaacguggacggccugcacgugagaagcggcuuccccagagacaagcuggccgagcugcacggcaacauguucguggaggagugcgccaagugcaagacccaguacgugagagacaccguggugggcaccaugggccugaaggccaccggcagacugugcaccguggccaaggccagaggccugagagccugcagaaacgccgaccugagcaucacccugggcaccagccugcagaucagacccagcggcaaccugccccuggccaccaagagaagaggcggcagacuggugaucgugaaccugcagcccaccaagcacgacagacacgccgaccugagaauccacggcuacguggacgaggugaugaccagacugaugaagcaccugggccuggagauccccgccugggacggccccagagugcuggagagagcccugcccccccugcccagaccccccacccccaagcuggagcccaaggaggagagccccaccagaaucaacggcagcauccccgccggccccaagcaggagcccugcgcccagcacaacggcagcgagcccgccagccccaagagagagagacccaccagccccgccccccacagaccccccaagagagugaaggccaaggccgugcccagcuaa

SEQ ID NO: 23356 - RNA, 1203 nt, Artificial Sequence
  SIRT7__Homo_sapiens__NP_057622
auggccgccggcggccugagcagaagcgagagaaaggccgccgagagagugagaagacugagagaggagcagcagagagagagacugagacaggugagcagaauccugagaaaggccgccgccgagagaagcgccgaggagggcagacugcuggccgagagcgccgaccuggugaccgagcugcagggcagaagcagaagaagagagggccugaagagaagacaggaggaggugugcgacgaccccgaggagcugagaggcaaggugagagagcuggccagcgccgugagaaacgccaaguaccuggugguguacaccggcgccggcaucagcaccgccgccagcauccccgacuacagaggccccaacggcguguggacccugcugcagaagggcagaagcgugagcgccgccgaccugagcgaggccgagcccacccugacccacaugagcaucaccagacugcacgagcagaagcuggugcagcacguggugagccagaacugcgacggccugcaccugagaagcggccugcccagaaccgccaucagcgagcugcacggcaacauguacaucgaggugugcaccagcugcgugcccaacagagaguacgugagaguguucgacgugaccgagagaaccgcccugcacagacaccagaccggcagaaccugccacaagugcggcacccagcugagagacaccaucgugcacuucggcgagagaggcacccugggccagccccugaacugggaggccgccaccgaggccgccagcagagccgacaccauccugugccugggcagcagccugaaggugcugaagaaguaccccagacuguggugcaugaccaagccccccagcagaagacccaagcuguacaucgugaaccugcaguggacccccaaggacgacugggccgcccugaagcugcacggcaagugcgacgacgugaugagacugcugauggccgagcugggccuggagauccccgccuacagcagauggcaggaccccaucuucagccuggccaccccccugagagccggcgaggagggcagccacagcagaaagagccugugcagaagcagagaggaggccccccccggcgacagaggcgccccccugagcagcgcccccauccugggcggcugguucggcagaggcugcaccaagagaaccaagagaaagaaggugaccuaa

SEQ ID NO: 23357 - RNA, 591 nt, Artificial Sequence
  SIT1__Homo_sapiens__NP_055265
augaaccaggccgaccccagacugagagccgugugccuguggacccugaccagcgccgccaugagcagaggcgacaacugcaccgaccugcuggcccugggcauccccagcaucacccaggccuggggccugugggugcugcugggcgccgugacccugcuguuccugaucagccuggccgcccaccugagccaguggaccagaggcagaagcagaagccaccccggccagggcagaagcggcgagagcguggaggaggugccccuguacggcaaccugcacuaccugcagaccggcagacugagccaggaccccgagcccgaccagcaggaccccacccugggcggccccgccagagccgccgaggaggugaugugcuacaccagccugcagcugagacccccccagggcagaauccccggccccggcacccccgugaaguacagcgagguggugcuggacagcgagcccaagagccaggccagcggccccgagcccgagcuguacgccagcgugugcgcccagaccagaagagccagagccagcuuccccgaccaggccuacgccaacagccagcccgccgccagcuaa

SEQ ID NO: 23358 - RNA, 528 nt, Artificial Sequence
  SIVA1__Homo_sapiens__NP_006418
augcccaagagaagcugccccuucgccgacguggccccccugcagcugaaggugagagugagccagagagagcugagcagaggcgugugcgccgagagauacagccaggagguguucgagaagaccaagagacugcuguuccugggcgcccaggccuaccuggaccacgugugggacgagggcugcgccguggugcaccugcccgagagccccaagcccggccccaccggcgcccccagagccgccagaggccagaugcugaucggccccgacggcagacugaucagaagccugggccaggccagcgaggccgaccccagcggcguggccagcaucgccugcagcagcugcgugagagccguggacggcaaggccgugugcggccagugcgagagagcccugugcggccagugcgugagaaccugcuggggcugcggcagcguggccugcacccugugcggccugguggacugcagcgacauguacgagaaggugcugugcaccagcugcgccauguucgagaccuaa

SEQ ID NO: 23359 - RNA, 855 nt, Artificial Sequence
  SIX1__Homo_sapiens__NP_005973
augagcaugcugcccagcuucggcuucacccaggagcagguggccugcgugugcgaggugcugcagcagggcggcaaccuggagagacugggcagauuccuguggagccugcccgccugcgaccaccugcacaagaacgagagcgugcugaaggccaaggccgugguggccuuccacagaggcaacuucagagagcuguacaagauccuggagagccaccaguucagcccccacaaccaccccaagcugcagcagcuguggcugaaggcccacuacguggaggccgagaagcugagaggcagaccccugggcgccgugggcaaguacagagugagaagaaaguucccccugcccagaaccaucugggacggcgaggagaccagcuacugcuucaaggagaagagcagaggcgugcugagagagugguacgcccacaaccccuaccccagccccagagagaagagagagcuggccgaggccaccggccugaccaccacccaggugagcaacugguucaagaacagaagacagagagacagagccgccgaggccaaggagagagagaacaccgagaacaacaacagcagcagcaacaagcagaaccagcugagcccccuggagggcggcaagccccugaugagcagcagcgaggaggaguucagccccccccagagccccgaccagaacagcgugcugcugcugcagggcaacaugggccacgccagaagcagcaacuacagccugcccggccugaccgccagccagcccagccacggccugcagacccaccagcaccagcugcaggacagccugcugggcccccugaccagcagccugguggaccugggcagcuaa

SEQ ID NO: 23360 - RNA, 876 nt, Artificial Sequence
  SIX2__Homo_sapiens__NP_058628
augagcaugcugcccaccuucggcuucacccaggagcagguggccugcgugugcgaggugcugcagcagggcggcaacaucgagagacugggcagauuccuguggagccugcccgccugcgagcaccugcacaagaacgagagcgugcugaaggccaaggccgugguggccuuccacagaggcaacuucagagagcuguacaagauccuggagagccaccaguucagcccccacaaccacgccaagcugcagcagcuguggcugaaggcccacuacaucgaggccgagaagcugagaggcagaccccugggcgccgugggcaaguacagagugagaagaaaguucccccugcccagaagcaucugggacggcgaggagaccagcuacugcuucaaggagaagagcagaagcgugcugagagagugguacgcccacaaccccuaccccagccccagagagaagagagagcuggccgaggccaccggccugaccaccacccaggugagcaacugguucaagaacagaagacagagagacagagccgccgaggccaaggagagagagaacaacgagaacagcaacagcaacagccacaacccccugaacggcagcggcaagagcgugcugggcagcagcgaggacgagaagacccccagcggcacccccgaccacagcagcagcagccccgcccugcugcugagcccccccccccccggccugcccagccugcacagccugggccacccccccggccccagcgccgugcccgugcccgugcccggcggcggcggcgccgacccccugcagcaccaccacggccugcaggacagcauccugaaccccaugagcgccaaccugguggaccugggcagcuaa

SEQ ID NO: 23361 - RNA, 999 nt, Artificial Sequence
  SIX3__Homo_sapiens__NP_005404
augguguucagaagcccccuggaccuguacagcagccacuuccugcugcccaacuucgccgacagccaccacagaagcauccugcuggccagcagcggcggcggcaacggcgccggcggcggcggcggcgccggcggcggcagcggcggcggcaacggcgccggcggcggcggcgccggcggcgccggcggcggcggcggcggcggcagcagagccccccccgaggagcugagcauguuccagcugcccacccugaacuucagccccgagcagguggccagcgugugcgagacccuggaggagaccggcgacaucgagagacugggcagauuccuguggagccugcccguggcccccggcgccugcgaggccaucaacaagcacgagagcauccugagagccagagccgugguggccuuccacaccggcaacuucagagaccuguaccacauccuggagaaccacaaguucaccaaggagagccacggcaagcugcaggccauguggcuggaggcccacuaccaggaggccgagaagcugagaggcagaccccugggccccguggacaaguacagagugagaaagaaguucccccugcccagaaccaucugggacggcgagcagaagacccacugcuucaaggagagaaccagaagccugcugagagagugguaccugcaggaccccuaccccaaccccagcaagaagagagagcuggcccaggccaccggccugacccccacccaggugggcaacugguucaagaacagaagacagagagacagagccgccgccgccaagaacagacugcagcaccaggccaucggccccagcggcaugagaagccuggccgagcccggcugccccacccacggcagcgccgagagccccagcaccgccgccagccccaccaccagcgugagcagccugaccgagagagccgacaccggcaccagcauccugagcgugaccagcagcgacagcgagugcgacguguaa

SEQ ID NO: 23362 - RNA, 2346 nt, Artificial Sequence
  SIX4__Homo_sapiens__NP_059116
augagcagcagcagccccaccggccagaucgccagcgccgccgacaucaagcaggagaacggcauggagagcgccagcgagggccaggaggcccacagagagguggccggcggcgccgccgugggccugagcccccccgcccccgcccccuucccccuggagcccggcgacgccgccaccgccgccgccagagugagcggcgaggagggcgccguggccgccgccgccgccggcgccgccgccgaccaggugcagcugcacagcgagcugcugggcagacaccaccacgccgccgccgccgccgcccagaccccccuggccuucagccccgaccacguggccugcgugugcgaggcccugcagcagggcggcaaccuggacagacuggccagauuccuguggagccugccccagagcgaccugcugagaggcaacgagagccugcugaaggccagagcccugguggccuuccaccagggcaucuaccccgagcuguacagcauccuggagagccacagcuucgagagcgccaaccacccccugcugcagcagcugugguacaaggccagauacaccgaggccgagagagccagaggcagaccccugggcgccguggacaaguacagacugagaagaaaguucccccugcccagaaccaucugggacggcgaggagaccguguacugcuucaaggagaagagcagaaacgcccugaaggagcuguacaagcagaacagauaccccagccccgccgagaagagacaccuggccaagaucaccggccugagccugacccaggugagcaacugguucaagaacagaagacagagagacagaaaccccagcgagacccagagcaagagcgagagcgacggcaaccccagcaccgaggacgagagcagcaagggccacgaggaccugagcccccacccccugagcagcagcagcgacggcaucaccaaccugagccugagcagccacauggagcccguguacaugcagcagaucggcaacgccaagaucagccugagcagcagcggcgugcugcugaacggcagccuggugcccgccagcaccagccccguguuccugaacggcaacagcuucauccagggccccagcggcgugauccugaacggccugaacgugggcaacacccaggccguggcccugaacccccccaagaugagcagcaacaucgugagcaacggcaucagcaugaccgacauccugggcagcaccagccaggacgugaaggaguucaaggugcugcagagcagcgccaacagcgccaccaccaccagcuacagccccagcgugcccgugagcuuccccggccugauccccagcaccgaggugaagagagagggcauccagaccguggccagccaggacggcggcagcguggugaccuucaccacccccgugcagaucaaccaguacggcaucgugcagauccccaacagcggcgccaacagccaguuccugaacggcagcaucggcuucagcccccugcagcugccccccgugagcguggccgccagccagggcaacaucagcgugagcagcagcaccagcgacggcagcaccuucaccagcgagagcaccaccgugcagcagggcaagguguuccugagcagccuggcccccagcgccgugguguacaccgugcccaacaccggccagaccaucggcagcgugaagcaggagggccuggagagaagccugguguucagccagcugaugcccgugaaccagaacgcccaggugaacgccaaccugagcagcgagaacaucagcggcagcggccugcacccccuggccagcagccuggugaacgugagccccacccacaacuucagccugagccccagcacccugcugaaccccaccgagcugaacagagacaucgccgacagccagcccaugagcgcccccguggccagcaagagcaccgugaccagcgugagcaacaccaacuacgccacccugcagaacugcagccugaucaccggccaggaccugcugagcgugcccaugacccaggccgcccugggcgagaucgugcccaccgccgaggaccaggugggccaccccagccccgccgugcaccaggacuucgugcaggagcacagacuggugcugcagagcguggccaacaugaaggagaacuuccugagcaacagcgagagcaaggccaccagcagccugaugaugcuggacagcaagagcaaguacgugcuggacggcaugguggacaccgugugcgaggaccuggagaccgacaagaaggagcuggccaagcugcagaccgugcagcuggacgaggacaugcaggaccuguaa

SEQ ID NO: 23363 - RNA, 2220 nt, Artificial Sequence
  SIX5__Homo_sapiens__NP_787071
auggccacccugcccgccgagcccagcgccggccccgccgccggcggcgaggccguggccgccgccgccgccaccgaggaggaggaggaggaggccagacagcugcugcagacccugcaggccgccgagggcgaggccgccgccgccgccggcgccggcgccggcgccgccgccgccggcgccgagggccccggcagccccggcgugcccggcagcccccccgaggccgccagcgagccccccaccggccugagauucagccccgagcagguggccugcgugugcgaggcccugcugcaggccggccacgccggcagacugagcagauuccugggcgcccugccccccgccgagagacugagaggcagcgaccccgugcugagagccagagcccugguggccuuccagagaggcgaguacgccgagcuguacagacugcuggagagcagacccuuccccgccgcccaccacgccuuccugcaggaccuguaccugagagccagauaccacgaggccgagagagccagaggcagagcccugggcgccguggacaaguacagacugagaaagaaguucccccugcccaagaccaucugggacggcgaggagaccguguacugcuucaaggagagaagcagagccgcccugaaggccugcuacagaggcaacagauaccccacccccgacgagaagagaagacuggccacccugaccggccugagccugacccaggugagcaacugguucaagaacagaagacagagagacagaaccggcgccggcggcggcgcccccugcaagagcgagagcgacggcaaccccaccaccgaggacgagagcagcagaagccccgaggaccuggagagaggcgccgcccccgugagcgccgaggccgccgcccagggcagcaucuuccuggccggcaccggcccccccgcccccugccccgccagcagcagcauccuggugaacggcagcuuccuggccgccagcggcagccccgccgugcugcugaacggcggccccgugaucaucaacggccuggcccugggcgaggccagcagccugggcccccugcugcugaccggcggcggcggcgccccccccccccagcccagcccccagggcgccagcgagaccaagaccagccuggugcuggacccccagaccggcgaggugagacuggaggaggcccagagcgaggcccccgagaccaagggcgcccagguggccgcccccggccccgcccugggcgaggaggugcugggcccccuggcccagguggugcccggcccccccaccgccgccaccuucccccugccccccggccccgugcccgccguggccgccccccagguggugccccugagccccccccccggcuaccccaccggccugagccccaccagcccccugcugaaccugccccagguggugcccaccagccagguggugacccugccccaggccgugggcccccugcagcugcuggccgccggccccggcagccccgugaagguggccgccgccgccggccccgccaacgugcaccugaucaacagcggcgugggcgugaccgcccugcagcugcccagcgccaccgcccccggcaacuuccugcuggccaaccccgugagcggcagccccaucgugaccggcguggccgugcagcagggcaagaucauccugaccgccaccuuccccaccagcaugcuggugagccaggugcugccccccgcccccggccuggcccugccccugaagcccgagaccgccaucagcgugcccgagggcggccugcccguggcccccagccccgcccugcccgaggcccacgcccugggcacccugagcgcccagcagcccccccccgccgccgccaccaccagcagcaccagccugcccuucagccccgacagccccggccugcugcccaacuuccccgcccccccccccgagggccugaugcugagccccgccgccgugcccguguggagcgccggccuggagcugagcgccggcaccgagggccugcuggaggccgagaagggccugggcacccaggccccccacaccgugcugagacugcccgaccccgaccccgagggccugcugcugggcgccaccgccggcggcgagguggacgagggccuggaggccgaggccaaggugcugacccagcugcagagcgugcccguggaggagccccuggagcuguaa

SEQ ID NO: 23364 - RNA, 741 nt, Artificial Sequence
  SIX6__Homo_sapiens__NP_031400
auguuccagcugcccauccugaacuucagcccccagcagguggccggcgugugcgagacccuggaggagagcggcgacguggagagacugggcagauuccuguggagccugcccguggcccccgccgccugcgaggcccugaacaagaacgagagcgugcugagagccagagccaucguggccuuccacggcggcaacuacagagagcuguaccacauccuggagaaccacaaguucaccaaggagagccacgccaagcugcaggcccuguggcuggaggcccacuaccaggaggccgagaagcugagaggcagaccccugggccccguggacaaguacagagugagaaagaaguucccccugcccagaaccaucugggacggcgagcagaagacccacugcuucaaggagagaaccagacaccugcugagagagugguaccugcaggaccccuaccccaaccccagcaagaagagagagcuggcccaggccaccggccugacccccacccaggugggcaacugguucaagaacagaagacagagagacagagccgccgccgccaagaacagacugcagcagcaggugcugagccagggcagcggcagagcccugagagccgagggcgacggcacccccgaggugcugggcguggccaccagccccgccgccagccugagcagcaaggccgccaccagcgccaucagcaucaccagcagcgacagcgagugcgacaucuaa

SEQ ID NO: 23365 - RNA, 768 nt, Artificial Sequence
  SKA1__Homo_sapiens__NP_001034624
auggccagcagcgaccuggagcagcugugcagccacgugaacgagaagaucggcaacaucaagaagacccugagccugagaaacugcggccaggagcccacccugaagaccgugcugaacaagaucggcgacgagaucaucgugaucaacgagcugcugaacaagcuggagcuggagauccaguaccaggagcagaccaacaacagccugaaggagcugugcgagagccuggaggaggacuacaaggacaucgagcaccugaaggagaacgugcccagccaccugccccaggugaccgugacccagagcugcgugaagggcagcgaccuggaccccgaggagcccaucaagguggaggagcccgagcccgugaagaagccccccaaggagcagagaagcaucaaggagaugcccuucaucaccugcgacgaguucaacggcgugcccagcuacaugaagagcagacugaccuacaaccagaucaacgacgugaucaaggagaucaacaaggccgugaucagcaaguacaagauccugcaccagcccaagaagagcaugaacagcgugaccagaaaccuguaccacagauucaucgacgaggagaccaaggacaccaagggcagauacuucaucguggaggccgacaucaaggaguucaccacccugaaggccgacaagaaguuccacgugcugcugaacauccugagacacugcagaagacugagcgaggugagaggcggcggccugaccagauacgugaucaccuaa

SEQ ID NO: 23366 - RNA, 228 nt, Artificial Sequence
  SKA2__Homo_sapiens__NP_001094065
auggccagcgaggugggccacaaccuggagagccccgagacccccggcggcggcggcuggaccagaguggaguuccccccccccgcccccaagggcgccgccaccguguggugccugaacagacugggcagcagaaagcugagccugaucuggaucaccuucaacaccggcuggaacaugaagagcagacugaucauccugauccagcaggugagcugccaccacuaa

SEQ ID NO: 23367 - RNA, 1080 nt, Artificial Sequence
  SKAP1__Homo_sapiens__NP_003717
augcaggccgccgcccugcccgaggagaucagauggcugcuggaggacgccgaggaguuccuggccgagggccugagaaacgagaaccugagcgccguggccagagaccacagagaccacauccugagaggcuuccagcagaucaaggccagauacuacugggacuuccagccccagggcggcgacaucggccaggacagcagcgacgacaaccacagcggcacccugggccugagccugaccagcgacgcccccuuccugagcgacuaccaggacgagggcauggaggacaucgugaagggcgcccaggagcuggacaacgugaucaagcagggcuaccuggagaagaagagcaaggaccacagcuucuucggcagcgaguggcagaagagauggugcguggugagcagaggccuguucuacuacuacgccaacgagaagagcaagcagcccaagggcaccuuccugaucaagggcuacggcgugagaauggccccccaccugagaagagacagcaagaaggagagcugcuucgagcugaccagccaggacagaagaagcuacgaguucaccgccaccagccccgccgaggccagagacuggguggaccagaucagcuuccugcugaaggaccugagcagccugaccauccccuacgaggaggacgaggaggaggaggagaaggaggagaccuacgacgacaucgacggcuucgacagccccagcugcggcagccagugcagacccaccauccugcccggcagcgugggcaucaaggagcccaccgaggagaaggaggaggaggacaucuacgaggugcugcccgacgaggagcacgaccuggaggaggacgagagcggcaccagaagaaagggcguggacuacgccagcuacuaccagggccugugggacugccacggcgaccagcccgacgagcugagcuuccagagaggcgaccugaucagaauccugagcaaggaguacaacauguacggcuggugggugggcgagcugaacagccuggugggcaucgugcccaaggaguaccugaccaccgccuucgagguggaggagagauaa

SEQ ID NO: 23368 - RNA, 564 nt, Artificial Sequence
  SKAP2__Homo_sapiens__NP_001290397
augaacaacacccugagaaaggacggcaagaaggacugcugcuucgagaucagcgcccccgacaagagaaucuaccaguucaccgccgccagccccaaggacgccgaggagugggugcagcagcugaaguucgugcugcaggacauggagagcgacaucauccccgaggacuacgacgagagaggcgagcuguacgacgacguggaccacccccugcccaucagcaacccccugaccagcagccagcccaucgacgacgagaucuacgaggagcugcccgaggaggaggaggacagcgcccccgugaagguggaggagcagagaaagaugagccaggacagcgugcaccacaccagcggcgacaagagcaccgacuacgccaacuucuaccagggccugugggacugcaccggcgccuucagcgacgagcugagcuucaagagaggcgacgugaucuacauccugagcaaggaguacaacagauacggcuggugggugggcgagaugaagggcgccaucggccuggugcccaaggccuacaucauggagauguacgacaucuaa

SEQ ID NO: 23369 - RNA, 1917 nt, Artificial Sequence
  SKIL__Homo_sapiens__NP_001138569
auggagaaccugcagaccaacuucagccuggugcagggcagcaccaagaagcugaacggcaugggcgacgacggcagcccccccgccaagaagaugaucaccgacauccacgccaacggcaagaccaucaacaaggugcccaccgugaagaaggagcaccuggacgacuacggcgaggcccccguggagaccgacggcgagcacgugaagagaaccugcaccagcgugcccgagacccugcaccugaaccccagccugaagcacacccuggcccaguuccaccugagcagccagagcagccugggcggccccgccgccuucagcgccagacacagccaggagagcaugagccccaccguguuccugccccugcccagcccccaggugcugcccggcccccugcugauccccagcgacagcagcaccgagcugacccagaccgugcuggagggcgagagcaucagcugcuuccaggugggcggcgagaagagacugugccugccccaggugcugaacagcgugcugagagaguucacccugcagcagaucaacaccgugugcgacgagcuguacaucuacugcagcagaugcaccagcgaccagcugcacauccugaaggugcugggcauccugcccuucaacgcccccagcugcggccugaucacccugaccgacgcccagagacugugcaacgcccugcugagacccagaaccuucccccagaacggcagcgugcugcccgccaagagcagccuggcccagcugaaggagaccggcagcgccuucgagguggagcacgagugccugggcaagugccagggccuguucgccccccaguucuacgugcagcccgacgcccccugcauccagugccuggagugcugcggcauguucgccccccagaccuucgugaugcacagccacagaagccccgacaagagaaccugccacuggggcuucgagagcgccaaguggcacugcuaccugcacgugaaccagaaguaccugggcacccccgaggagaagaagcugaagaucauccuggaggagaugaaggagaaguucagcaugagaagcggcaagagaaaccagagcaagaccgacgcccccagcggcauggagcugcagagcugguaccccgugaucaagcaggagggcgaccacgugagccagacccacagcuuccugcaccccagcuacuaccuguacaugugcgacaaggugguggcccccaacgugagccugaccagcgccgugagccagagcaaggagcugaccaagaccgaggccaacgccagcaucagcaacaacagcaccagcaagagaaagagcgagagcgccaccugcaaccuggugagagacaucaacaaggugggcaucggccugguggccgccgccagcagcccccugcuggugaaggacgugaucugcgaggacgacaagggcaagaucauggaggaggugaugagaaccuaccugaagcagcaggagaagcugaaccugauccugcagaagaagcagcagcugcagauggaggugaagaugcugagcagcagcaagagcaugaaggagcugaccgaggagcagcagaaccugcagaaggagcuggagagccugcagaacgagcacgcccagagaauggaggaguucuacguggagcagaaggaccuggagaagaagcuggagcagaucaugaagcagaagugcaccugcgacagcaaccuggagaaggacaaggaggccgaguacgccggccagcuggccgagcugagacagagacuggaccacgccgaggccgacagacaggagcugcaggacgagcugagacaggagagagaggccagacagaagcuggagaugaugaucaaggagcugaagcugcagauccugaagagcagcaagaccgccaaggaguaa

SEQ ID NO: 23370 - RNA, 3129 nt, Artificial Sequence
  SKIV2L2__Homo_sapiens__NP_056175
auggccgacgccuucggcgacgagcuguucagcguguucgagggcgacagcaccaccgccgccggcaccaagaaggacaaggagaaggacaagggcaaguggaagggcccccccggcagcgccgacaaggccggcaagagauucgacggcaagcugcagagcgagagcaccaacaacggcaagaacaagagagacguggacuucgagggcaccgacgagcccaucuucggcaagaagcccagaaucgaggagagcaucaccgaggaccugagccuggccgaccugaugcccagagugaaggugcagagcguggagaccguggagggcugcacccacgagguggcccugcccgccgaggaggacuaccugccccugaagcccagagugggcaaggccgccaaggaguaccccuucauccuggacgccuuccagagagaggccauccagugcguggacaacaaccagagcgugcuggugagcgcccacaccagcgccggcaagaccgugugcgccgaguacgccaucgcccuggcccugagagagaagcagagagugaucuucaccagccccaucaaggcccugagcaaccagaaguacagagagauguacgaggaguuccaggacgugggccugaugaccggcgacgugaccaucaaccccaccgccagcugccuggugaugaccaccgagauccugagaagcaugcuguacagaggcagcgaggugaugagagagguggccugggugaucuucgacgagauccacuacaugagagacagcgagagaggcguggugugggaggagaccaucauccugcugcccgacaacgugcacuacguguuccugagcgccaccauccccaacgccagacaguucgccgaguggaucugccaccugcacaagcagcccugccacgugaucuacaccgacuacagacccaccccccugcagcacuacaucuuccccgccggcggcgacggccugcaccuggugguggacgagaacggcgacuucagagaggacaacuucaacaccgccaugcaggugcugagagacgccggcgaccuggccaagggcgaccagaagggcagaaagggcggcaccaagggccccagcaacguguucaagaucgugaagaugaucauggagagaaacuuccagcccgugaucaucuucagcuucagcaagaaggacugcgaggccuacgcccugcagaugaccaagcuggacuucaacaccgacgaggagaagaagaugguggaggagguguucagcaacgccaucgacugccugagcgacgaggacaagaagcugccccagguggagcacgugcugccccugcugaagagaggcaucggcauccaccacggcggccugcugcccauccugaaggagaccaucgagauccuguucagcgagggccugaucaaggcccuguucgccaccgagaccuucgccaugggcaucaacaugcccgccagaaccgugcuguucaccaacgccagaaaguucgacggcaaggacuucagauggaucagcagcggcgaguacauccagaugagcggcagagccggcagaagaggcauggacgacagaggcaucgugauccugaugguggacgagaagaugagccccaccaucggcaagcagcugcugaagggcagcgccgacccccugaacagcgccuuccaccugaccuacaacauggugcugaaccugcugagaguggaggagaucaaccccgaguacaugcuggagaagagcuucuaccaguuccagcacuacagagccauccccggcgugguggagaaggugaagaacagcgaggagcaguacaacaagaucgugauccccaacgaggagagcguggugaucuacuacaagaucagacagcagcuggccaagcugggcaaggagaucgaggaguacauccacaagcccaaguacugccugcccuuccugcagcccggcagacuggugaaggugaagaacgagggcgacgacuucggcuggggcgugguggugaacuucagcaagaagagcaacgugaagcccaacagcggcgagcuggacccccuguacgugguggaggugcugcugagaugcagcaaggagagccugaagaacagcgccaccgaggccgccaagcccgccaagcccgacgagaagggcgagaugcagguggugcccgugcuggugcaccugcugagcgccaucagcagcgugagacuguacauccccaaggaccugagacccguggacaacagacagagcgugcugaagagcauccaggaggugcagaagagauuccccgacggcaucccccugcuggaccccaucgacgacaugggcauccaggaccagggccugaagaaggugauccagaagguggaggccuucgagcacagaauguacagccacccccugcacaacgaccccaaccuggagaccguguacacccugugcgagaagaaggcccagaucgccaucgacaucaagagcgccaagagagagcugaagaaggccagaaccgugcugcagauggacgagcugaagugcagaaagagagugcugagaagacugggcuucgccaccagcagcgacgugaucgagaugaagggcagaguggccugcgagaucagcagcgccgacgagcugcugcugaccgagaugauguucaacggccuguucaacgaccugagcgccgagcaggccaccgcccugcugagcugcuucguguuccaggagaacagcagcgagaugcccaagcugaccgagcagcuggccggcccccugagacagaugcaggagugcgccaagagaaucgccaaggugagcgccgaggccaagcuggagaucgacgaggagaccuaccugagcagcuucaagccccaccugauggacgugguguacaccugggccaccggcgccaccuucgcccacaucugcaagaugaccgacguguucgagggcagcaucaucagaugcaugagaagacuggaggagcugcugagacagaugugccaggccgccaaggccaucggcaacaccgagcuggagaacaaguucgccgagggcaucaccaagaucaagagagacaucguguucgccgccagccuguaccuguaa

SEQ ID NO: 23371 - RNA, 3741 nt, Artificial Sequence
  SKIV2L__Homo_sapiens__NP_008860
augauggagaccgagagacuggugcugcccccccccgacccccuggaccugccccugagagccguggagcugggcugcaccggccacugggagcugcugaaccugcccggcgcccccgagagcagccugccccacggccugccccccugcgcccccgaccugcagcaggaggccgagcagcuguuccugagcagccccgccuggcugccccugcacggcguggagcacagcgccagaaaguggcagagaaagaccgaccccuggagccugcuggccgugcugggcgcccccgugcccagcgaccugcaggcccagagacaccccaccaccggccagauccugggcuacaaggaggugcugcuggagaacaccaaccugagcgccaccaccagccugagccugagaagaccccccggccccgccagccagagccuguggggcaaccccacccaguaccccuucuggcccggcggcauggacgagcccaccaucaccgaccugaacaccagagaggaggccgaggaggagaucgacuucgagaaggaccugcugaccaucccccccggcuucaagaagggcauggacuucgcccccaaggacugccccacccccgcccccggccugcugagccugagcugcaugcuggagccccuggaccugggcggcggcgacgaggacgagaacgaggccgugggccagcccggcggccccagaggcgacaccgugagcgccagccccugcagcgccccccuggccagagccagcagccuggaggaccuggugcugaaggaggccagcaccgccgugagcacccccgaggcccccgagccccccagccaggagcagugggccauccccguggacgccaccagccccgugggcgacuucuacagacugaucccccagcccgccuuccagugggccuucgagcccgacguguuccagaagcaggccauccugcaccuggagagacacgacagcguguucguggccgcccacaccagcgccggcaagaccgugguggccgaguacgccaucgcccuggcccagaagcacaugaccagaaccaucuacaccagccccaucaaggcccugagcaaccagaaguucagagacuucagaaacaccuucggcgacgugggccugcugaccggcgacgugcagcugcaccccgaggccagcugccugaucaugaccaccgagauccugagaagcaugcuguacagcggcagcgacgugaucagagaccuggagugggugaucuucgacgaggugcacuacaucaacgacguggagagaggcguggugugggaggaggugcugaucaugcugcccgaccacgugagcaucauccugcugagcgccaccgugcccaacgcccuggaguucgccgacuggaucggcagacugaagagaagacagaucuacgugaucagcaccgugaccagacccgugccccuggagcacuaccuguucaccggcaacagcagcaagacccagggcgagcuguuccugcugcuggacagcagaggcgccuuccacaccaagggcuacuacgccgccguggaggccaagaaggagagaaugagcaagcacgcccagaccuucggcgccaagcagcccacccaccagggcggccccgcccaggacagaggcguguaccugagccugcuggccagccugagaaccagagcccagcugcccguggugguguucaccuucagcagaggcagaugcgacgagcaggccagcggccugaccagccuggaccugaccaccagcagcgagaagagcgagauccaccuguuccugcagagaugccuggccagacugagaggcagcgacagacagcugccccaggugcugcacaugagcgagcugcugaacagaggccugggcgugcaccacagcggcauccugcccauccugaaggagaucguggagaugcuguucagcagaggccuggugaaggugcuguucgccaccgagaccuucgccaugggcgugaacaugcccgccagaaccgugguguucgacagcaugagaaagcacgacggcagcaccuucagagaccugcugcccggcgaguacgugcagauggccggcagagccggcagaagaggccuggaccccaccggcaccgugauccugcugugcaagggcagagugcccgagauggccgaccugcacagaaugaugaugggcaagcccagccagcugcagagccaguucagacugaccuacaccaugauccugaaccugcugagaguggacgcccugagaguggaggacaugaugaagagaagcuucagcgaguuccccagcagaaaggacagcaaggcccacgagcaggcccuggccgagcugaccaagagacugggcgcccuggaggagcccgacaugaccggccagcugguggaccugcccgaguacuacagcuggggcgaggagcugaccgagacccagcacaugauccagagaagaaucauggagagcgugaacggccugaagagccugagcgccggcagaguggugguggugaagaaccaggagcaccacaacgcccugggcgugauccugcaggugagcagcaacagcaccagcagaguguucaccacccuggugcugugcgacaagccccugagccaggacccccaggacagaggccccgccaccgccgaggugcccuaccccgacgaccuggugggcuucaagcuguuccugcccgagggccccugcgaccacaccguggugaagcugcagcccggcgacauggccgccaucaccaccaaggugcugagagugaacggcgagaagauccuggaggacuucagcaagagacagcagcccaaguucaagaaggaccccccccuggccgccgugaccaccgccgugcaggagcugcugagacuggcccaggcccaccccgccggcccccccacccuggaccccgugaacgaccugcagcugaaggacaugagcgugguggagggcggccugagagccagaaagcuggaggagcugauccagggcgcccagugcgugcacagccccagauuccccgcccaguaccugaagcugagagagagaaugcagauccagaaggagauggagagacugagauuccugcugagcgaccagagccugcugcugcugcccgaguaccaccagagaguggaggugcugagaacccugggcuacguggacgaggccggcaccgugaagcuggccggcagaguggccugcgccaugagcagccacgagcugcugcugaccgagcugauguucgacaacgcccugagcacccugagacccgaggagaucgccgcccugcugagcggccuggugugccagagccccggcgacgccggcgaccagcugcccaacacccugaagcagggcaucgagagagugagagccguggccaagagaaucggcgaggugcagguggccugcggccugaaccagaccguggaggaguucgugggcgagcugaacuucggccugguggaggugguguacgagugggccagaggcaugcccuucagcgagcuggccggccugagcggcacccccgagggccugguggugagaugcauccagagacuggccgagaugugcagaagccugagaggcgccgccagacuggugggcgagcccgugcugggcgccaagauggagaccgccgccacccugcugagaagagacaucguguucgccgccagccuguacacccaguaa

SEQ ID NO: 23372 - RNA, 2607 nt, Artificial Sequence
  SKOR1__Homo_sapiens__NP_001244953
augauccccaagagccuggugcaggccgccgagacccagagaggccugugcgagcccggcggcaagggcagagagggcagaagcggcggcaagggcgagaccagacccagaggcgugggcacccaggagggcaagggcaccauccccggcagccccagagagaagagaggcgagagaggcgagggcgaccccgcccugcugcccgccgaggaccuguggagacugcccggcagcaaggacagacugagaagcagccugcugcccccccccggcccccccagcagcgacagcggccccggcccccccagcagccacagcggcaagaccgcccagggccccagaacccugaacugggccagaaagcagagcgccagaaccagcagcaaccugugcgccuggagccuggccauggccaccaagauggccgagauccccagcagccccuacgagcccggccagagaggcaugaaggacacccagagaggcgacgccccccagagaggcagccccgagcccagaauccugcagcuggccagagugggcaacguguaccugaaggaggagagcagcagaagcggcagacuggaggccaagaaguggauccccaccaaguuccuggagaaccugagcgugccccacguggaccugggcggcaaccagcuguggagcggcggcauggaggcccugaccacccagcugggccccggcagagagggcagcagcagccccaacagcaagcaggagcugcagcccuacagcggcagcagcgcccugaagcccaaccaggugggcgagaccagccuguacggcgugcccaucgugagccuggugaucgacggccaggagagacugugccuggcccagaucagcaacacccugcugaagaacuacagcuacaacgagauccacaacagaagaguggcccugggcaucaccugcgugcagugcacccccgugcagcuggagauccugagaagagccggcgccaugcccaucagcagcagaagaugcggcaugaucaccaagagagaggccgagagacugugcaagagcuuccugggcgagcacaagccccccaagcugcccgagaacuucgccuucgacguggugcacgagugcgccuggggcagcagaggcagcuucauccccgccagauacaacagcagcagagccaagugcaucaagugcggcuacugcagcauguacuucagccccaacaaguucaucuuccacagccacagaacccccgacgccaaguacacccagcccgacgccgccaacuucaacagcuggagaagacaccugaagcugagcgacaagagcgccaccgacgagcugagccacgccugggaggacagaggccugggccuggccaccggcgccagcggccccgccggccccggcggccccggcggcggcgccggcgugagaagcuaccccgugauccccgugcccagcaagggcuucggccugcugcagaagcugccccccccccuguucccccaccccuacggcuuccccaccgccuucggccugugccccaagaaggacgaccccgugcugggcgccggcgagcccaagggcggcagcuacgugagcgccuucagacccguggugaaggacaccgagagcaucgccaagcuguacggcagcgccagagaggccuacggcgccggccccgccagaggccccggccccggcgccggcagcggcggcuacgugagccccgacuuccugagcgagggcagcagcagcuacaacagcgccagccccgacguggacaccgccgacgagcccgagguggacguggagagcaacagauuccccgacgacgaggacgcccaggaggagaccgagcccagcgcccccagcgccggcggcggccccgacgccggcagacccgccuucggcgaccuggccgccgaggaccuggugagaagacccgagagaagcccccccagcggcggcggcggcuacgagcugagagagcccugcggcccccugggcggccccgcccccgccaagguguucgcccccgagagagacgagcacgugaagagcgccgccguggcccugggccccgccgccagcuacgugugcacccccgaggcccacgagcccgacaaggaggacaaccacagccccgccgacgaccuggagaccagaaagagcuaccccgaccagagaagcaucagccagcccagccccgccaacaccgacagaggcgaggacggccugacccuggacgugaccggcacccaccugguggagaaggacaucgagaaccuggccagagaggagcugcagaagcugcugcuggagcagauggagcugagaaagaagcuggagagagaguuccagagccugaaggacaacuuccaggaccagaugaagagagagcuggccuacagagaggagauggugcagcagcugcagaucgugagagacacccugugcaacgagcuggaccaggagagaaaggccagauacgccauccagcagaagcugaaggaggcccacgacgcccugcaccacuucagcugcaagaugcugacccccagacacugcaccggcaacugcagcuucaagcccccccugcugcccuaa

SEQ ID NO: 23373 - RNA, 891 nt, Artificial Sequence
  SKOR2__Homo_sapiens__NP_001032891
auggccagcagcccccugcccggccccaacgacauccugcuggccagccccagcagcgccuuccagcccgacacccugagccagcccagacccggccacgccaaccugaagcccaaccaggugggccaggugauccuguacggcauccccaucgugagccuggugaucgacggccaggagagacugugccuggcccagaucagcaacacccugcugaagaacuucagcuacaacgagauccacaacagaagaguggcccugggcaucaccugcgugcagugcacccccgugcagcuggagauccugagaagagccggcgccaugcccaucagcagcagaagaugcggcaugaucaccaagagagaggccgagagacugugcaagagcuuccugggcgagaacagaccccccaagcugcccgacaacuucgccuucgacgugagccacgagugcgccuggggcugcagaggcagcuucauccccgccagauacaacagcagcagagccaagugcaucaagugcagcuacugcaacauguacuucagccccaacaaguucaucuuccacagccacagaacccccgacgccaaguacacccagcccgacgccgccaacuucaacagcuggagaagacaccugaagcugaccgacaagagcccccaggacgagcugguguucgccugggaggacgugaaggccauguucaacggcggcagcagaaagagagcccugccccagcccggcgcccaccccgccugccacccccugagcagcaucagaaccagaagcaucgccuucagcagccagacccugaugcugcuggaggagaucuucggcgagaaggaccaggaggacuacaugagaaucaacgaggacaacaucuggcuguaa

SEQ ID NO: 23374 - RNA, 483 nt, Artificial Sequence
  SKP1__Homo_sapiens__NP_008861
augcccagcaucaagcugcagagcagcgacggcgagaucuucgagguggacguggagaucgccaagcagagcgugaccaucaagaccaugcuggaggaccugggcauggacgacgagggcgacgacgaccccgugccccugcccaacgugaacgccgccauccugaagaaggugauccaguggugcacccaccacaaggacgacccccccccccccgaggacgacgagaacaaggagaagagaaccgacgacauccccgugugggaccaggaguuccugaagguggaccagggcacccuguucgagcugauccuggccgccaacuaccuggacaucaagggccugcuggacgugaccugcaagaccguggccaacaugaucaagggcaagacccccgaggagaucagaaagaccuucaacaucaagaacgacuucaccgaggaggaggaggcccaggugggcagcacccaguucugccuguaa

SEQ ID NO: 23375 - RNA, 633 nt, Artificial Sequence
  SKP2__Homo_sapiens__NP_001230049
auggaccagccccuggccgagcacuucagcacccuggccaagaacagcaaccuggugagacugaaccugagcggcugcagcggcuucagcgaguucgcccugcagacccugcugagcagcugcagcagacuggacgagcugaaccugagcuggugcuucgacuucaccgagaagcacgugcagguggccguggcccacgugagcgagaccaucacccagcugaaccugagcggcuacagaaagaaccugcagaagagcgaccugagcacccuggugagaagaugccccaaccuggugcaccuggaccugagcgacagcgugaugcugaagaacgacugcuuccaggaguucuuccagcugaacuaccugcagcaccugagccugagcagaugcuacgacaucauccccgagacccugcuggagcugggcgagauccccacccugaagacccugcagguguucggcaucgugcccgacggcacccugcagcugcugaaggaggcccugccccaccugcagaucaacugcagccacuucaccaccaucgccagacccaccaucggcaacaagaagaaccaggagaucuggggcaucaagugcagacugacccugcagaagcccagcugccuguaa

SEQ ID NO: 23376 - RNA, 786 nt, Artificial Sequence
  SLA2__Homo_sapiens__NP_115590
augggcagccugcccagcagaagaaagagccugcccagccccagccugagcagcagcgugcagggccagggccccgugaccauggaggccgagagaagcaaggccaccgccguggcccugggcagcuuccccgccggcggccccgccgagcugagccugagacugggcgagccccugaccaucgugagcgaggacggcgacugguggaccgugcugagcgaggugagcggcagagaguacaacauccccagcgugcacguggccaaggugagccacggcuggcuguacgagggccugagcagagagaaggccgaggagcugcugcugcugcccggcaaccccggcggcgccuuccugaucagagagagccagaccagaagaggcagcuacagccugagcgugagacugagcagacccgccagcugggacagaaucagacacuacagaauccacugccuggacaacggcuggcuguacaucagccccagacugaccuuccccagccugcaggcccugguggaccacuacagcgagcuggccgacgacaucugcugccugcugaaggagcccugcgugcugcagagagccggcccccugcccggcaaggacaucccccugcccgugaccgugcagagaaccccccugaacuggaaggagcuggacagcagccugcuguucagcgaggccgccaccggcgaggagagccugcugagcgagggccugagagagagccugagcuucuacaucagccugaacgacgaggccgugagccuggacgacgccuaa

SEQ ID NO: 23377 - RNA, 831 nt, Artificial Sequence
  SLA__Homo_sapiens__NP_001039021
augggcaacagcaugaagagcacccccgcccccgccgagagaccccugcccaaccccgagggccuggacagcgacuuccuggccgugcugagcgacuaccccagccccgacaucagcccccccaucuucagaagaggcgagaagcugagagugaucagcgacgagggcggcugguggaaggccaucagccugagcaccggcagagagagcuacauccccggcaucugcguggccagaguguaccacggcuggcuguucgagggccugggcagagacaaggccgaggagcugcugcagcugcccgacaccaaggugggcagcuucaugaucagagagagcgagaccaagaagggcuucuacagccugagcgugagacacagacaggugaagcacuacagaaucuucagacugcccaacaacugguacuacaucagccccagacugaccuuccagugccuggaggaccuggugaaccacuacagcgagguggccgacggccugugcugcgugcugaccacccccugccugacccagagcaccgccgcccccgccgugagagccagcagcagccccgugacccugagacagaagaccguggacuggagaagagugagcagacugcaggaggaccccgagggcaccgagaacccccugggcguggacgagagccuguucagcuacggccugagagagagcaucgccagcuaccugagccugaccagcgaggacaacaccagcuucgacagaaagaagaagagcaucagccugauguacggcggcagcaagagaaagagcagcuucuucagcagcccccccuacuucgaggacuaa

SEQ ID NO: 23378 - RNA, 1746 nt, Artificial Sequence
  SLAIN2__Homo_sapiens__NP_065897
auggaggacgugaacagcaacgugaacgccgaccaggaggugagaaagcugcaggagcuggugaagaagcuggagaagcagaacgagcagcugagaagcagaagcggcgccgugcagggcgccggcagccugggccccggcagccccgugagagccggcgccagcauccccagcagcggcgccgccagccccagaggcuucccccugggccugagcgccaagagcggcggcggccccggcagcggccccagaagaaccagcagcgaggagcugagagacgccaccagccugcuggccgccggcgagggcggccugcuggacgagguggagccccugagacccgacgagcuggagagacugagcggcugggaggaggaggaggagagcuggcuguacagcagccccaagaagaagcugacccccaugcagaagagcgugagcccccugguguggugcagacaggugcuggacuaccccagccccgacguggagugcgccaagaagagccugauccacaagcuggaccagaccaugagcgcccugaagagacagaaccuguacaacaaccccuucaacagcaugagcuacaccagccccuacagccccaacgccagcagccccuacagcagcggcuucaacagccccagcagcacccccgugagaccccccaucgugaagcagcugauccugcccggcaacagcggcaaccugaagagcagcgacagaaaccccccccugagcccccagagcagcaucgacagcgagcugagcgccagcgagcuggacgaggacagcaucggcagcaacuacaagcugaacgacgugaccgacgugcagauccuggccagaaugcaggaggagagccugagacaggaguacgccgccaccaccagcagaagaagcagcggcagcagcugcaacagcaccagaagaggcaccuucagcgaccaggagcuggacgcccagagccuggacgacgaggacgacaacaugcaccacgccguguaccccgccgugaacagauucagccccagccccagaaacagccccagacccagccccaagcagagccccagaaacagccccagaagcagaagccccgccagaggcaucgaguacagcagagugagcccccagcccaugaucagcagacugcagcagcccagacugagccugcagggccaccccaccgaccugcagaccagcaacgugaagaacgaggagaagcugagaagaagccugcccaaccugagcagaaccagcaacacccagguggacagcgugaagagcagcagaagcgacagcaacuuccaggugcccaacggcggcauccccagaaugcagccccaggccagcgccauccccagccccggcaaguucagaagccccgccgcccccagcccccuggcccugagacagcccgugaaggccuucagcaaccacggcagcggcagccccggcagccaggagaucacccagcugacccagaccaccagcagccccggcccccccauggugcagagcaccgugagcgccaacccccccagcaacaucaacagcgccacccugaccagacccgccggcaccaccgccaugagaagcggccugcccagacccagcgcccccagcgccggcggcauccccgugcccagaagcaagcuggcccagcccgugagaagaagccugcccgcccccaagaccuacggcagcaugaaggacgacagcuggaaggacggcugcuacuaa

SEQ ID NO: 23379 - RNA, 1008 nt, Artificial Sequence
  SLAMF1__Homo_sapiens__NP_003028
auggaccccaagggccugcugagccugaccuucgugcuguuccugagccuggccuucggcgccagcuacggcaccggcggcagaaugaugaacugccccaagauccugagacagcugggcagcaaggugcugcugccccugaccuacgagagaaucaacaagagcaugaacaagagcauccacaucguggugaccauggccaagagccuggagaacagcguggagaacaagaucgugagccuggaccccagcgaggccggcccccccagauaccugggcgacagauacaaguucuaccuggagaaccugacccugggcaucagagagagcagaaaggaggacgagggcugguaccugaugacccuggagaagaacgugagcgugcagagauucugccugcagcugagacuguacgagcaggugagcacccccgagaucaaggugcugaacaagacccaggagaacggcaccugcacccugauccugggcugcaccguggagaagggcgaccacguggccuacagcuggagcgagaaggccggcacccacccccugaaccccgccaacagcagccaccugcugagccugacccugggcccccagcacgccgacaacaucuacaucugcaccgugagcaaccccaucagcaacaacagccagaccuucagccccuggcccggcugcagaaccgaccccagcgagaccaagcccugggccguguacgccggccugcugggcggcgugaucaugauccugaucaugguggugauccugcagcugagaagaagaggcaagaccaaccacuaccagaccaccguggagaagaagagccugaccaucuacgcccaggugcagaagcccggcccccugcagaagaagcuggacagcuuccccgcccaggaccccugcaccaccaucuacguggccgccaccgagcccgugcccgagagcgugcaggagaccaacagcaucaccguguacgccagcgugacccugcccgagagcuaa

SEQ ID NO: 23380 - RNA, 999 nt, Artificial Sequence
  SLAMF6__Homo_sapiens__NP_001171643
augcuguggcuguuccagagccugcuguucguguucugcuucggccccggcaacguggugagccagagcagccugaccccccugauggugaacggcauccugggcgagagcgugacccugccccuggaguuccccgccggcgagaaggugaacuucaucaccuggcuguucaacgagaccagccuggccuucaucgugccccacgagaccaagagccccgagauccacgugaccaaccccaagcagggcaagagacugaacuucacccagagcuacagccugcagcugagcaaccugaagauggaggacaccggcagcuacagagcccagaucagcaccaagaccagcgccaagcugagcagcuacacccugagaauccugagacagcugagaaacauccaggugaccaaccacagccagcuguuccagaacaugaccugcgagcugcaccugaccugcagcguggaggacgccgacgacaacgugagcuucagaugggaggcccugggcaacacccugagcagccagcccaaccugaccgugagcugggaccccagaaucagcagcgagcaggacuacaccugcaucgccgagaacgccgugagcaaccugagcuucagcgugagcgcccagaagcugugcgaggacgugaagauccaguacaccgacaccaagaugauccuguucauggugagcggcaucugcaucguguucggcuucaucauccugcugcugcuggugcugagaaagagaagagacagccugagccugagcacccagagaacccagggccccgccgagagcgccagaaaccuggaguacgugagcgugagccccaccaacaacaccguguacgccagcgugacccacagcaacagagagaccgagaucuggacccccagagagaacgacaccaucaccaucuacagcaccaucaaccacagcaaggagagcaagcccaccuucagcagagccaccgcccuggacaacgugguguaa

SEQ ID NO: 23381 - RNA, 498 nt, Artificial Sequence
  SLAMF7__Homo_sapiens__NP_001269517
auggccggcagccccaccugccugacccugaucuacauccuguggcagcugaccggcagcgccgccagcggccccgugaaggagcuggugggcagcgugggcggcgccgugaccuucccccugaagagcaaggugaagcagguggacagcaucguguggaccuucaacaccaccccccuggugaccauccagcccgagggcggcaccaucaucgugacccagaacagaaacagagagagaguggacuuccccgacggcggcuacagccugaagcugagcaagcugaagaagaacgacagcggcaucuacuacgugggcaucuacagcagcagccugcagcagcccagcacccaggaguacgugcugcacguguacgagaacaaccccaagggcagaagcagcaaguacggccugcugcacugcggcaacaccgagaaggacggcaagagcccccugaccgcccacgacgccagacacaccaaggccaucugccuguaa

SEQ ID NO: 23382 - RNA, 858 nt, Artificial Sequence
  SLAMF8__Homo_sapiens__NP_064510
auggugaugagaccccuguggagccugcugcugugggaggcccugcugcccaucaccgugaccggcgcccaggugcugagcaaggugggcggcagcgugcugcugguggccgccagaccccccggcuuccaggugagagaggccaucuggagaagccuguggcccagcgaggagcugcuggccaccuucuucagaggcagccuggagacccuguaccacagcagauuccugggcagagcccagcugcacagcaaccugagccuggagcugggcccccuggagagcggcgacagcggcaacuucagcgugcugaugguggacaccagaggccagcccuggacccagacccugcagcugaagguguacgacgccgugcccagacccguggugcagguguucaucgccguggagagagacgcccagcccagcaagaccugccagguguuccugagcugcugggcccccaacaucagcgagaucaccuacagcuggagaagagagaccaccauggacuucggcauggagccccacagccuguucaccgacggccaggugcugagcaucagccugggccccggcgacagagacguggccuacagcugcaucgugagcaaccccgugagcugggaccuggccaccgugacccccugggacagcugccaccacgaggccgcccccggcaaggccagcuacaaggacgugcugcuggugguggugcccgugagccugcugcugaugcuggugacccuguucagcgccuggcacuggugccccugcagcggcaagaagaagaaggacgugcacgccgacagagugggccccgagaccgagaacccccuggugcaggaccugcccuaa

SEQ ID NO: 23383 - RNA, 813 nt, Artificial Sequence
  SLBP__Homo_sapiens__NP_006518
auggccugcagacccagaagcccccccagacaccagagcagaugcgacggcgacgccagcccccccagccccgccagauggagccugggcagaaagagaagagccgacggcagaagauggagacccgaggacgccgaggaggccgagcacagaggcgccgagagaagacccgagagcuucaccacccccgagggccccaagcccagaagcagaugcagcgacugggccagcgccguggaggaggacgagaugagaaccagagugaacaaggagauggccagauacaagagaaagcugcugaucaacgacuucggcagagagagaaagagcagcagcggcagcagcgacagcaaggagagcaugagcaccgugcccgccgacuucgagaccgacgagagcgugcugaugagaagacagaagcagaucaacuacggcaagaacaccaucgccuacgacagauacaucaaggaggugcccagacaccugagacagcccggcauccaccccaagacccccaacaaguucaagaaguacagcagaagaagcugggaccagcagaucaagcuguggaagguggcccugcacuucugggacccccccgccgaggagggcugcgaccugcaggagauccaccccguggaccuggagagcgccgagagcagcagcgagccccagaccagcagccaggacgacuucgacguguacagcggcacccccaccaaggugagacacauggacagccagguggaggacgaguucgaccuggaggccugccugaccgagccccugagagacuucagcgccaugagcuaa

SEQ ID NO: 23384 - RNA, 1050 nt, Artificial Sequence
  SLC10A1__Homo_sapiens__NP_003040
auggaggcccacaacgccagcgcccccuucaacuucacccugccccccaacuucggcaagagacccaccgaccuggcccugagcgugauccugguguucaugcuguucuucaucaugcugagccugggcugcaccauggaguucagcaagaucaaggcccaccuguggaagcccaagggccuggccaucgcccugguggcccaguacggcaucaugccccugaccgccuucgugcugggcaagguguucagacugaagaacaucgaggcccuggccauccuggugugcggcugcagccccggcggcaaccugagcaacguguucagccuggccaugaagggcgacaugaaccugagcaucgugaugaccaccugcagcaccuucugcgcccugggcaugaugccccugcugcuguacaucuacagcagaggcaucuacgacggcgaccugaaggacaaggugcccuacaagggcaucgugaucagccuggugcuggugcugauccccugcaccaucggcaucgugcugaagagcaagagaccccaguacaugagauacgugaucaagggcggcaugaucaucauccugcugugcagcguggccgugaccgugcugagcgccaucaacgugggcaagagcaucauguucgccaugaccccccugcugaucgccaccagcagccugaugcccuucaucggcuuccugcugggcuacgugcugagcgcccuguucugccugaacggcagaugcagaagaaccgugagcauggagaccggcugccagaacgugcagcugugcagcaccauccugaacguggccuucccccccgaggugaucggcccccuguucuucuucccccugcuguacaugaucuuccagcugggcgagggccugcugcugaucgccaucuucuggugcuacgagaaguucaagacccccaaggacaagaccaagaugaucuacaccgccgccaccaccgaggagaccauccccggcgcccugggcaacggcaccuacaagggcgaggacugcagccccugcaccgccuaa

SEQ ID NO: 23385 - RNA, 1047 nt, Artificial Sequence
  SLC10A2__Homo_sapiens__NP_000443
augaacgaccccaacagcugcguggacaacgccaccgugugcagcggcgccagcugcguggugcccgagagcaacuucaacaacauccugagcguggugcugagcaccgugcugaccauccugcuggcccuggugauguucagcaugggcugcaacguggagaucaagaaguuccugggccacaucaagagacccuggggcaucugcgugggcuuccugugccaguucggcaucaugccccugaccggcuucauccugagcguggccuucgacauccugccccugcaggccgugguggugcugaucaucggcugcugccccggcggcaccgccagcaacauccuggccuacuggguggacggcgacauggaccugagcgugagcaugaccaccugcagcacccugcuggcccugggcaugaugccccugugccugcugaucuacaccaagauguggguggacagcggcagcaucgugauccccuacgacaacaucggcaccagccugguggcccugguggugcccgugagcaucggcauguucgugaaccacaaguggccccagaaggccaagaucauccugaagaucggcagcaucgccggcgccauccugaucgugcugaucgccguggugggcggcauccuguaccagagcgccuggaucaucgcccccaagcuguggaucaucggcaccaucuuccccguggccggcuacagccugggcuuccugcuggccagaaucgccggccugcccugguacagaugcagaaccguggccuucgagaccggcaugcagaacacccagcugugcagcaccaucgugcagcugagcuucacccccgaggagcugaacgugguguucaccuucccccugaucuacagcaucuuccagcuggccuucgccgccaucuuccugggcuucuacguggccuacaagaagugccacggcaagaacaaggccgagauccccgagagcaaggagaacggcaccgagcccgagagcagcuucuacaaggccaacggcggcuuccagcccgacgagaaguaa

SEQ ID NO: 23386 - RNA, 1134 nt, Artificial Sequence
  SLC10A6__Homo_sapiens__NP_932069
augagagccaacugcagcagcagcagcgccugccccgccaacagcagcgaggaggagcugcccgugggccuggaggugcacggcaaccuggagcugguguucaccguggugagcaccgugaugaugggccugcugauguucagccugggcugcagcguggagaucagaaagcuguggagccacaucagaagacccuggggcaucgccgugggccugcugugccaguucggccugaugcccuucaccgccuaccugcuggccaucagcuucagccugaagcccgugcaggccaucgccgugcugaucaugggcugcugccccggcggcaccaucagcaacaucuucaccuucuggguggacggcgacauggaccugagcaucagcaugaccaccugcagcaccguggccgcccugggcaugaugccccugugcaucuaccuguacaccuggagcuggagccugcagcagaaccugaccauccccuaccagaacaucggcaucacccuggugugccugaccauccccguggccuucggcguguacgugaacuacagauggcccaagcagagcaagaucauccugaagaucggcgccguggugggcggcgugcugcugcuggugguggccguggccggcguggugcuggccaagggcagcuggaacagcgacaucacccugcugaccaucagcuucaucuucccccugaucggccacgugaccggcuuccugcuggcccuguucacccaccagagcuggcagagaugcagaaccaucagccuggagaccggcgcccagaacauccagaugugcaucaccaugcugcagcugagcuucaccgccgagcaccuggugcagaugcugagcuucccccuggccuacggccuguuccagcugaucgacggcuuccugaucguggccgccuaccagaccuacaagagaagacugaagaacaagcacggcaagaagaacagcggcugcaccgaggugugccacaccagaaagagcaccagcagcagagagaccaacgccuuccuggaggugaacgaggagggcgccaucacccccggcccccccggccccauggacugccacagagcccuggagcccgugggccacaucaccagcugcgaguaa

SEQ ID NO: 23387 - RNA, 1023 nt, Artificial Sequence
  SLC10A7__Homo_sapiens__NP_001025169
augagacugcuggagagaaugagaaaggacugguucauggugggcaucgugcuggccaucgccggcgccaagcuggagcccagcaucggcgugaacggcggcccccugaagcccgagaucaccgugagcuacaucgccguggccaccaucuucuucaacagcggccugagccugaagaccgaggagcugaccagcgcccuggugcaccugaagcugcaccuguucauccagaucuucacccuggccuucuuccccgccaccaucuggcuguuccugcagcugcugagcaucacccccaucaacgaguggcugcugaagggccugcagaccgugggcugcaugcccccccccgugagcagcgccgugauccugaccaaggccgugggcggcaacgaggccgccgccaucuucaacagcgccuucggcagcuuccugggcaucgugaucaccccccugcugcugcugcuguuccugggcagcagcagcagcgugcccuucaccagcaucuucagccagcuguucaugaccgugguggugccccugaucaucggccagaucgugagaagauacaucaaggacuggcuggagagaaagaagccccccuucggcgccaucagcagcagcgugcugcugaugaucaucuacaccaccuucugcgacaccuucagcaaccccaacaucgaccuggacaaguucagccuggugcugauccuguucaucaucuucagcauccagcugagcuucaugcugcugaccuucaucuucagcaccagaaacaacagcggcuucacccccgccgacaccguggccaucaucuucugcagcacccacaagagccugacccugggcauccccaugcugaagaucguguucgccggccacgagcaccugagccugaucagcgugccccugcugaucuaccaccccgcccagauccugcugggcagcgugcuggugcccaccaucaagagcuggauggugagcagacagaagggcgugaagcugaccagacccaccguguaa

SEQ ID NO: 23388 - RNA, 1653 nt, Artificial Sequence
  SLC11A1__Homo_sapiens__NP_000569
augaccggcgacaagggcccccagagacugagcggcagcagcuacggcagcaucagcagccccaccagccccaccagccccggcccccagcaggccccccccagagagaccuaccugagcgagaagauccccauccccgacaccaagcccggcaccuucagccugagaaagcugugggccuucaccggccccggcuuccugaugagcaucgccuuccuggaccccggcaacaucgagagcgaccugcaggccggcgccguggccggcuucaagcugcugugggugcugcugugggccaccgugcugggccugcugugccagagacuggccgccagacugggcguggugaccggcaaggaccugggcgaggugugccaccuguacuaccccaaggugcccagaaccgugcuguggcugaccaucgagcuggccaucgugggcagcgacaugcaggaggugaucggcaccgccaucgccuucaaccugcugagcgccggcagaaucccccuguggggcggcgugcugaucaccaucguggacaccuucuucuuccuguuccuggacaacuacggccugagaaagcuggaggccuucuucggccugcugaucaccaucauggcccugaccuucggcuacgaguacgugguggccagacccgagcagggcgcccugcugagaggccuguuccugcccagcugccccggcugcggccaccccgagcugcugcaggccgugggcaucgugggcgccaucaucaugccccacaacaucuaccugcacagcgcccuggugaagagcagagagaucgacagagccagaagagccgacaucagagaggccaacauguacuuccugaucgaggccaccaucgcccugagcgugagcuucaucaucaaccuguucgugauggccguguucggccaggccuucuaccagaagaccaaccaggccgccuucaacaucugcgccaacagcagccugcacgacuacgccaagaucuuccccaugaacaacgccaccguggccguggacaucuaccagggcggcgugauccugggcugccuguucggccccgccgcccuguacaucugggccaucggccugcuggccgccggccagagcagcaccaugaccggcaccuacgccggccaguucgugauggagggcuuccugagacugagauggagcagauucgccagagugcugcugaccagaagcugcgccauccugcccaccgugcugguggccguguucagagaccugagagaccugagcggccugaacgaccugcugaacgugcugcagagccugcugcugcccuucgccgugcugcccauccugaccuucaccagcaugcccacccugaugcaggaguucgccaacggccugcugaacaagguggugaccagcagcaucauggugcuggugugcgccaucaaccuguacuucguggugagcuaccugcccagccugccccaccccgccuacuucggccuggccgcccugcuggccgccgccuaccugggccugagcaccuaccugguguggaccugcugccuggcccacggcgccaccuuccuggcccacagcagccaccaccacuuccuguacggccugcuggaggaggaccagaagggcgagaccagcggcuaa

SEQ ID NO: 23389 - RNA, 1686 nt, Artificial Sequence
  SLC11A2__Homo_sapiens__NP_000608
auggugcugggccccgagcagaagaugagcgacgacagcgugagcggcgaccacggcgagagcgccagccugggcaacaucaaccccgccuacagcaaccccagccugagccagagccccggcgacagcgaggaguacuucgccaccuacuucaacgagaagaucagcauccccgaggaggaguacagcugcuucagcuucagaaagcugugggccuucaccggccccggcuuccugaugagcaucgccuaccuggaccccggcaacaucgagagcgaccugcagagcggcgccguggccggcuucaagcugcuguggauccugcugcuggccacccuggugggccugcugcugcagagacuggccgccagacugggcguggugaccggccugcaccuggccgaggugugccacagacaguaccccaaggugcccagagugauccuguggcugaugguggagcuggccaucaucggcagcgacaugcaggaggugaucggcagcgccaucgccaucaaccugcugagcgugggcagaaucccccuguggggcggcgugcugaucaccaucgccgacaccuucguguuccuguuccuggacaaguacggccugagaaagcuggaggccuucuucggcuuccugaucaccaucauggcccugaccuucggcuacgaguacgugaccgugaagcccagccagagccaggugcugaagggcauguucgugcccagcugcagcggcugcagaaccccccagaucgagcaggccgugggcaucgugggcgccgugaucaugccccacaacauguaccugcacagcgcccuggugaagagcagacaggugaacagaaacaacaagcaggaggugagagaggccaacaaguacuucuucaucgagagcugcaucgcccuguucgugagcuucaucaucaacguguucguggugagcguguucgccgaggccuucuucggcaagaccaacgagcaggugguggaggugugcaccaacaccagcagcccccacgccggccuguuccccaaggacaacagcacccuggccguggacaucuacaagggcggcguggugcugggcugcuacuucggccccgccgcccuguacaucugggccgugggcauccuggccgccggccagagcagcaccaugaccggcaccuacagcggccaguucgugauggagggcuuccugaaccugaaguggagcagauucgccagaguggugcugaccagaagcaucgccaucauccccacccugcugguggccguguuccaggacguggagcaccugaccggcaugaacgacuuccugaacgugcugcagagccugcagcugcccuucgcccugauccccauccugaccuucaccagccugagacccgugaugagcgacuucgccaacggccugggcuggagaaucgccggcggcauccuggugcugaucaucugcagcaucaacauguacuucguggugguguacgugagagaccugggccacguggcccuguacgugguggccgccguggugagcguggccuaccugggcuucguguucuaccugggcuggcagugccugaucgcccugggcaugagcuuccuggacugcggccacaccgugagcaucagcaagggccugcugaccgaggaggccaccagaggcuacgugaaguaa

SEQ ID NO: 23390 - RNA, 3300 nt, Artificial Sequence
  SLC12A1__Homo_sapiens__NP_000329
augagccugaacaacagcagcaacguguuccuggacagcgugcccagcaacaccaacagauuccaggugagcgugaucaacgagaaccacgagagcagcgccgccgccgacgacaacaccgaccccccccacuacgaggagaccagcuucggcgacgaggcccagaagagacugagaaucagcuucagacccggcaaccaggagugcuacgacaacuuccugcagagcggcgagaccgccaagaccgacgccagcuuccacgccuacgacagccacaccaacaccuacuaccugcagaccuucggccacaacaccauggacgccgugcccaagaucgaguacuacagaaacaccggcagcaucagcggccccaaggugaacagacccagccugcuggagauccacgagcagcuggccaagaacguggccgugacccccagcagcgccgacagaguggccaacggcgacggcauccccggcgacgagcaggccgagaacaaggaggacgaccaggccggcguggugaaguucggcugggugaagggcgugcuggugagaugcaugcugaacaucuggggcgugaugcuguucaucagacugagcuggaucgugggcgaggccggcaucggccugggcgugcugaucauccugcugagcaccauggugaccagcaucaccggccugagcaccagcgccaucgccaccaacggcuucgugagaggcggcggcgccuacuaccugaucagcagaagccugggccccgaguucggcggcagcaucggccugaucuucgccuucgccaacgccguggccguggccauguacguggugggcuucgccgagaccgugguggaccugcugaaggagagcgacagcaugaugguggaccccaccaacgacaucagaaucaucggcagcaucaccguggugauccugcugggcaucagcguggccggcauggagugggaggccaaggcccaggugauccugcuggugauccugcugaucgccaucgccaacuucuucaucggcaccgugauccccagcaacaacgagaagaagagcagaggcuucuucaacuaccaggccagcaucuucgccgagaacuucggccccagauucaccaagggcgagggcuucuucagcguguucgccaucuucuuccccgccgccaccggcauccuggccggcgccaacaucagcggcgaccuggaggacccccaggacgccauccccagaggcaccaugcuggccaucuucaucaccaccguggccuaccugggcguggccaucugcgugggcgccugcguggugagagacgccaccggcaacaugaacgacaccaucaucagcggcaugaacugcaacggcagcgccgccugcggccugggcuacgacuucagcagaugcagacacgagcccugccaguacggccugaugaacaacuuccaggugaugagcauggugagcggcuucggcccccugaucaccgccggcaucuucagcgccacccugagcagcgcccuggccagccuggugagcgcccccaagguguuccaggcccugugcaaggacaacaucuacaaggcccugcaguucuucgccaagggcuacggcaagaacaacgagccccugagaggcuacauccugaccuuccugaucgccauggccuucauccugaucgccgagcugaacaccaucgcccccaucaucagcaacuucuuccuggccagcuacgcccugaucaacuucagcugcuuccacgccagcuacgccaagagccccggcuggagacccgccuacggcaucuacaacaugugggugagccuguucggcgccgugcugugcugcgccgugauguucgugaucaacuggugggccgccgugaucaccuacgugaucgaguucuuccuguacguguacgugaccugcaagaagcccgacgugaacuggggcagcagcacccaggcccugagcuacgugagcgcccuggacaacgcccuggagcugaccaccguggaggaccacgugaagaacuucagaccccagugcaucgugcugaccggcggccccaugaccagacccgcccugcuggacaucacccacgccuucaccaagaacagcggccugugcaucugcugcgagguguucgugggccccagaaagcugugcgugaaggagaugaacagcggcauggccaagaagcaggccuggcugaucaagaacaagaucaaggccuucuacgccgccguggccgccgacugcuucagagacggcgugagaagccugcugcaggccagcggccugggcagaaugaagcccaacacccuggugaucggcuacaagaagaacuggagaaaggccccccugaccgagaucgagaacuacgugggcaucauccacgacgccuucgacuucgagaucggcguggugaucgugagaaucagccagggcuucgacaucagccaggugcugcaggugcaggaggagcuggagagacuggagcaggagagacuggcccuggaggccaccaucaaggacaacgagugcgaggaggagagcggcggcaucagaggccuguucaagaaggccggcaagcugaacaucaccaagaccacccccaagaaggacggcagcaucaacaccagccagagcaugcacgugggcgaguucaaccagaagcugguggaggccagcacccaguucaagaagaagcaggagaagggcaccaucgacgugugguggcuguucgacgacggcggccugacccugcugauccccuacauccugacccugagaaagaaguggaaggacugcaagcugagaaucuacgugggcggcaagaucaacagaaucgaggaggagaagaucgugauggccagccugcugagcaaguucagaaucaaguucgccgacauccacaucaucggcgacaucaacaucagacccaacaaggagagcuggaagguguucgaggagaugaucgagcccuacagacugcacgagagcugcaaggaccugaccaccgccgagaagcugaagagagagacccccuggaagaucaccgacgccgagcuggaggccgugaaggagaagagcuacagacaggugagacugaacgagcugcugcaggagcacagcagagccgccaaccugaucgugcugagccugcccguggccagaaagggcagcaucagcgaccugcuguacauggccuggcuggagauccugaccaagaaccugccccccgugcugcuggugagaggcaaccacaagaacgugcugaccuucuacagcuaa

SEQ ID NO: 23391 - RNA, 3591 nt, Artificial Sequence
  SLC12A2__Homo_sapiens__NP_001243390
auggagcccagacccaccgcccccagcagcggcgcccccggccuggccggcgugggcgagacccccagcgccgccgcccuggccgccgccagaguggagcugcccggcaccgccgugcccagcgugcccgaggacgccgcccccgccagcagagacggcggcggcgugagagacgagggccccgccgccgccggcgacggccugggcagaccccugggccccacccccagccagagcagauuccagguggaccuggugagcgagaacgccggcagagccgccgccgccgccgccgccgccgccgccgccgccgccgccgccggcgccggcgccggcgccaagcagacccccgccgacggcgaggccagcggcgagagcgagcccgccaagggcagcgaggaggccaagggcagauucagagugaacuucguggaccccgccgccagcagcagcgccgaggacagccugagcgacgccgccggcgugggcguggacggccccaacgugagcuuccagaacggcggcgacaccgugcugagcgagggcagcagccugcacagcggcggcggcggcggcagcggccaccaccagcacuacuacuacgacacccacaccaacaccuacuaccugagaaccuucggccacaacaccauggacgccgugcccagaaucgaccacuacagacacaccgccgcccagcugggcgagaagcugcugagacccagccuggccgagcugcacgacgagcuggagaaggagcccuucgaggacggcuucgccaacggcgaggagagcacccccaccagagacgccguggugaccuacaccgccgagagcaagggcguggugaaguucggcuggaucaagggcgugcuggugagaugcaugcugaacaucuggggcgugaugcuguucaucagacugagcuggaucgugggccaggccggcaucggccugagcgugcuggugaucaugauggccaccguggugaccaccaucaccggccugagcaccagcgccaucgccaccaacggcuucgugagaggcggcggcgccuacuaccugaucagcagaagccugggccccgaguucggcggcgccaucggccugaucuucgccuucgccaacgccguggccguggccauguacguggugggcuucgccgagaccgugguggagcugcugaaggagcacagcauccugaugaucgacgagaucaacgacaucagaaucaucggcgccaucaccguggugauccugcugggcaucagcguggccggcauggagugggaggccaaggcccagaucgugcugcuggugauccugcugcuggccaucggcgacuucgugaucggcaccuucaucccccuggagagcaagaagcccaagggcuucuucggcuacaagagcgagaucuucaacgagaacuucggccccgacuucagagaggaggagaccuucuucagcguguucgccaucuucuuccccgccgccaccggcauccuggccggcgccaacaucagcggcgaccuggccgacccccagagcgccauccccaagggcacccugcuggccauccugaucaccacccugguguacgugggcaucgccgugagcgugggcagcugcguggugagagacgccaccggcaacgugaacgacaccaucgugaccgagcugaccaacugcaccagcgccgccugcaagcugaacuucgacuucagcagcugcgagagcagccccugcagcuacggccugaugaacaacuuccaggugaugagcauggugagcggcuucaccccccugaucagcgccggcaucuucagcgccacccugagcagcgcccuggccagccuggugagcgcccccaagaucuuccaggcccugugcaaggacaacaucuaccccgccuuccagauguucgccaagggcuacggcaagaacaacgagccccugagaggcuacauccugaccuuccugaucgcccugggcuucauccugaucgccgagcugaacgugaucgcccccaucaucagcaacuucuuccuggccagcuacgcccugaucaacuucagcguguuccacgccagccuggccaagagccccggcuggagacccgccuucaaguacuacaacauguggaucagccugcugggcgccauccugugcugcaucgugauguucgugaucaacuggugggccgcccugcugaccuacgugaucgugcugggccuguacaucuacgugaccuacaagaagcccgacgugaacuggggcagcagcacccaggcccugaccuaccugaacgcccugcagcacagcaucagacugagcggcguggaggaccacgugaagaacuucagaccccagugccuggugaugaccggcgcccccaacagcagacccgcccugcugcaccuggugcacgacuucaccaagaacgugggccugaugaucugcggccacgugcacaugggccccagaagacaggccaugaaggagaugagcaucgaccaggccaaguaccagagauggcugaucaagaacaagaugaaggccuucuacgcccccgugcacgccgacgaccugagagagggcgcccaguaccugaugcaggccgccggccugggcagaaugaagcccaacacccuggugcugggcuucaagaaggacuggcugcaggccgacaugagagacguggacauguacaucaaccuguuccacgacgccuucgacauccaguacggcgugguggugaucagacugaaggagggccuggacaucagccaccugcagggccaggaggagcugcugagcagccaggagaagagccccggcaccaaggacgugguggugagcguggaguacagcaagaagagcgaccuggacaccagcaagccccugagcgagaagcccaucacccacaaggagagcaagggccccaucgugccccugaacguggccgaccagaagcugcuggaggccagcacccaguuccagaagaagcagggcaagaacaccaucgacgugugguggcuguucgacgacggcggccugacccugcugauccccuaccugcugaccaccaagaagaaguggaaggacugcaagaucagaguguucaucggcggcaagaucaacagaaucgaccacgacagaagagccauggccacccugcugagcaaguucagaaucgacuucagcgacaucauggugcugggcgacaucaacaccaagcccaagaaggagaacaucaucgccuucgaggagaucaucgagcccuacagacugcacgaggacgacaaggagcaggacaucgccgacaagaugaaggaggacgagcccuggagaaucaccgacaacgagcuggagcuguacaagaccaagaccuacagacagaucagacugaacgagcugcugaaggagcacagcagcaccgccaacaucaucgugaugagccugcccguggccagaaagggcgccgugagcagcgcccuguacauggccuggcuggaggcccugagcaaggaccugccccccauccugcuggugagaggcaaccaccagagcgugcugaccuucuacagcuaa

SEQ ID NO: 23392 - RNA, 3093 nt, Artificial Sequence
  SLC12A3__Homo_sapiens__NP_000330
auggccgagcugcccaccaccgagacccccggcgacgccacccugugcagcggcagauucaccaucagcacccugcugagcagcgacgagcccagcccccccgccgccuacgacagcagccaccccagccaccugacccacagcagcaccuucugcaugagaaccuucggcuacaacaccaucgacguggugcccaccuacgagcacuacgccaacagcacccagcccggcgagcccagaaaggugagacccacccuggccgaccugcacagcuuccugaagcaggagggcagacaccugcacgcccuggccuucgacagcagacccagccacgagaugaccgacggccugguggagggcgaggccggcaccagcagcgagaagaaccccgaggagcccgugagauucggcugggugaagggcgugaugaucagaugcaugcugaacaucuggggcgugauccuguaccugagacugcccuggaucaccgcccaggccggcaucgugcugaccuggaucaucauccugcugagcgugaccgugaccagcaucaccggccugagcaucagcgccaucagcaccaacggcaaggugaagagcggcggcaccuacuuccugaucagcagaagccugggccccgagcugggcggcagcaucggccugaucuucgccuucgccaacgccgugggcguggccaugcacaccgugggcuucgccgagaccgugagagaccugcugcaggaguacggcgcccccaucguggaccccaucaacgacaucagaaucaucggcguggugagcgugaccgugcugcuggccaucagccuggccggcauggagugggagagcaaggcccaggugcuguucuuccuggugaucauggugagcuucgccaacuaccuggugggcacccugaucccccccagcgaggacaaggccagcaagggcuucuucagcuacagagccgacaucuucgugcagaaccuggugcccgacuggagaggccccgacggcaccuucuucggcauguucagcaucuucuuccccagcgccaccggcauccuggccggcgccaacaucagcggcgaccugaaggaccccgccaucgccauccccaagggcacccugauggccaucuucuggaccaccaucagcuaccuggccaucagcgccaccaucggcagcugcguggugagagacgccagcggcgugcugaacgacaccgugacccccggcuggggcgccugcgagggccuggccugcagcuacggcuggaacuucaccgagugcacccagcagcacagcugccacuacggccugaucaacuacuaccagaccaugagcauggugagcggcuucgccccccugaucaccgccggcaucuucggcgccacccugagcagcgcccuggccugccuggugagcgccgccaagguguuccagugccugugcgaggaccagcuguacccccugaucggcuucuucggcaagggcuacggcaagaacaaggagcccgugagaggcuaccugcuggccuacgccaucgccguggccuucaucaucaucgccgagcugaacaccaucgcccccaucaucagcaacuucuuccugugcagcuacgcccugaucaacuucagcugcuuccacgccagcaucaccaacagccccggcuggagacccagcuuccaguacuacaacaagugggccgcccuguucggcgccaucaucagcguggugaucauguuccugcugaccuggugggccgcccugaucgccaucggcguggugcuguuccugcugcuguacgugaucuacaagaagcccgaggugaacuggggcagcagcgugcaggccggcagcuacaaccuggcccugagcuacagcgugggccugaacgagguggaggaccacaucaagaacuacagaccccagugccuggugcugaccggcccccccaacuucagacccgcccugguggacuucgugggcaccuucaccagaaaccugagccugaugaucugcggccacgugcugaucggcccccacaagcagagaaugcccgagcugcagcugaucgccaacggccacaccaaguggcugaacaagagaaagaucaaggccuucuacagcgacgugaucgccgaggaccugagaagaggcgugcagauccugaugcaggccgccggccugggcagaaugaagcccaacauccugguggugggcuucaagaagaacuggcagagcgcccaccccgccaccguggaggacuacaucggcauccugcacgacgccuucgacuucaacuacggcgugugcgugaugagaaugagagagggccugaacgugagcaagaugaugcaggcccacaucaaccccguguucgaccccgccgaggacggcaaggaggccagcgccagaggcgccagacccagcgugagcggcgcccuggaccccaaggcccuggugaaggaggagcaggccaccaccaucuuccagagcgagcagggcaagaagaccaucgacaucuacuggcuguucgacgacggcggccugacccugcugauccccuaccugcugggcagaaagagaagauggagcaagugcaagaucagaguguucgugggcggccagaucaacagaauggaccaggagagaaaggccaucaucagccugcugagcaaguucagacugggcuuccacgaggugcacauccugcccgacaucaaccagaaccccagagccgagcacaccaagagauucgaggacaugaucgcccccuucagacugaacgacggcuucaaggacgaggccaccgugaacgagaugagaagagacugccccuggaagaucagcgacgaggagaucaccaagaacagagugaagagccugagacaggugagacugaacgagaucgugcuggacuacagcagagacgccgcccugaucgugaucacccugcccaucggcagaaagggcaagugccccagcagccuguacauggccuggcuggagacccugagccaggaccugagaccccccgugauccugaucagaggcaaccaggagaacgugcugaccuucuacugccaguaa

SEQ ID NO: 23393 - RNA, 3240 nt, Artificial Sequence
  SLC12A4__Homo_sapiens__NP_001139433
augccccacuucaccguggugcccguggacggccccagaagaggcgacuacgacaaccuggagggccugagcuggguggacuacggcgagagagccgagcuggacgacagcgacggccacggcaaccacagagagagcagccccuuccugagcccccuggaggccagcagaggcaucgacuacuacgacagaaaccuggcccuguucgaggaggagcuggacaucagacccaaggugagcagccugcugggcaagcuggugagcuacaccaaccugacccagggcgccaaggagcacgaggaggccgagagcggcgagggcaccagaagaagagccgccgaggcccccagcaugggcacccugaugggcguguaccugcccugccugcagaacaucuucggcgugauccuguuccugagacugaccuggauggugggcaccgccggcgugcugcaggcccugcugaucgugcugaucugcugcugcugcacccugcugaccgccaucagcaugagcgccaucgccaccaacggcguggugcccgccggcggcagcuacuucaugaucagcagaagccugggccccgaguucggcggcgccgugggccugugcuucuaccugggcaccaccuucgccgccgccauguacauccugggcgccaucgagauccugcugaccuacaucgccccccccgccgccaucuucuaccccagcggcgcccacgacaccagcaacgccacccugaacaacaugagaguguacggcaccaucuuccugaccuucaugacccuggugguguucgugggcgugaaguacgugaacaaguucgccagccuguuccuggccugcgugaucaucagcauccugagcaucuacgccggcggcaucaagagcaucuucgacccccccguguuccccgugugcaugcugggcaacagaacccugagcagagaccaguucgacaucugcgccaagaccgccgugguggacaacgagaccguggccacccagcuguggagcuucuucugccacagccccaaccugaccaccgacagcugcgaccccuacuucaugcugaacaacgugaccgagauccccggcauccccggcgccgccgccggcgugcugcaggagaaccuguggagcgccuaccuggagaagggcgacaucguggagaagcacggccugcccagcgccgacgcccccagccugaaggagagccugccccuguacgugguggccgacaucgccaccagcuucaccgugcuggugggcaucuucuuccccagcgugaccggcaucauggccggcagcaacagaagcggcgaccugagagacgcccagaagagcauccccgugggcaccauccuggccaucaucaccaccagccugguguacuucagcagcguggugcuguucggcgccugcaucgagggcguggugcugagagacaaguacggcgacggcgugagcagaaaccugguggugggcacccuggccuggcccagccccugggugaucgugaucggcagcuucuucagcaccugcggcgccggccugcagagccugaccggcgcccccagacugcugcaggccaucgccaaggacaacaucauccccuuccugagaguguucggccacggcaaggugaacggcgagcccaccugggcccugcugcugaccgcccugaucgccgagcugggcauccugaucgccagccuggacaugguggcccccauccugagcauguucuuccugaugugcuaccuguucgugaaccuggccugcgccgugcagacccugcugagaacccccaacuggagacccagauucaaguacuaccacugggcccugagcuuccugggcaugagccugugccuggcccugauguucgugagcagcugguacuacgcccugguggccaugcugaucgccggcaugaucuacaaguacaucgaguaccagggcgccgagaaggaguggggcgacggcaucagaggccugagccugagcgccgccagauacgcccugcugagacuggaggagggccccccccacaccaagaacuggagaccccagcugcuggugcugcugaagcuggacgaggaccugcacgugaaguaccccagacugcugaccuucgccagccagcugaaggccggcaagggccugaccaucgugggcagcgugauccagggcagcuuccuggagagcuacggcgaggcccaggccgccgagcagaccaucaagaacaugauggagaucgagaaggugaagggcuucugccagguggugguggccagcaaggugagagagggccuggcccaccugauccagagcugcggccugggcggcaugagacacaacagcguggugcugggcuggcccuacggcuggagacagagcgaggaccccagagccuggaagaccuucaucgacaccgugagaugcaccaccgccgcccaccuggcccugcuggugcccaagaacaucgccuucuaccccagcaaccacgagagauaccuggagggccacaucgacgugugguggaucgugcacgacggcggcaugcugaugcugcugcccuuccugcugagacagcacaagguguggagaaagugcagaaugagaaucuucaccguggcccagauggacgacaacagcauccagaugaagaaggaccuggccguguuccuguaccaccugagacuggaggccgagcacaacagcgacaucagcgccuacaccuacgagagaacccugaugauggagcagagaagccagaugcugagacagaugagacugaccaagaccgagagagagagagaggcccagcuggugaaggacagacacagcgcccugagacuggagagccuguacagcgacgaggaggacgagagcgccgugggcgccgacaagauccagaugaccuggaccagagacaaguacaugaccgagaccugggaccccagccacgcccccgacaacuucagagagcuggugcacaucaagcccgaccagagcaacgugagaagaaugcacaccgccgugaagcugaacgaggugaucgugaccagaagccacgacgccagacuggugcugcugaacaugcccggcccccccagaaacagcgagggcgacgagaacuacauggaguuccuggaggugcugaccgagggccuggagagagugcugcuggugagaggcggcggcagagaggugaucaccaucuacagcuaa

SEQ ID NO: 23394 - RNA, 3420 nt, Artificial Sequence
  SLC12A5__Homo_sapiens__NP_001128243
augagcagaagauucaccgugaccagccugccccccgccggccccgccagaagccccgaccccgagagcagaagacacagcguggccgaccccagacaccugcccggcgaggacgugaagggcgacggcaaccccaaggagagcagccccuucaucaacagcaccgacaccgagaagggcaaggaguacgacggcaagaacauggcccuguucgaggaggagauggacaccagccccauggugagcagccugcugagcggccuggccaacuacaccaaccugccccagggcagcagagagcacgaggaggccgagaacaacgagggcggcaagaagaagcccgugcaggcccccagaaugggcaccuucaugggcguguaccugcccugccugcagaacaucuucggcgugauccuguuccugagacugaccuggguggugggcaucgccggcaucauggagagcuucugcaugguguucaucugcugcagcugcaccaugcugaccgccaucagcaugagcgccaucgccaccaacggcguggugcccgccggcggcagcuacuacaugaucagcagaagccugggccccgaguucggcggcgccgugggccugugcuucuaccugggcaccaccuucgccggcgccauguacauccugggcaccaucgagauccugcuggccuaccuguuccccgccauggccaucuucaaggccgaggacgccagcggcgaggccgccgccaugcugaacaacaugagaguguacggcaccugcgugcugaccugcauggccaccgugguguucgugggcgugaaguacgugaacaaguucgcccugguguuccugggcugcgugauccugagcauccuggccaucuacgccggcgugaucaagagcgccuucgacccccccaacuuccccaucugccugcugggcaacagaacccugagcagacacggcuucgacgugugcgccaagcuggccugggagggcaacgagaccgugaccaccagacuguggggccuguucugcagcagcagauuccugaacgccaccugcgacgaguacuucaccagaaacaacgugaccgagauccagggcauccccggcgccgccagcggccugaucaaggagaaccuguggagcagcuaccugaccaagggcgugaucguggagagaagcggcaugaccagcgugggccuggccgacggcacccccaucgacauggaccaccccuacguguucagcgacaugaccagcuacuucacccugcuggugggcaucuacuuccccagcgugaccggcaucauggccggcagcaacagaagcggcgaccugagagacgcccagaagagcauccccaccggcaccauccuggccaucgccaccaccagcgccguguacaucagcagcguggugcuguucggcgccugcaucgagggcguggugcugagagacaaguucggcgaggccgugaacggcaaccugguggugggcacccuggccuggcccagccccugggugaucgugaucggcagcuucuucagcaccugcggcgccggccugcagagccugaccggcgcccccagacugcugcaggccaucagcagagacggcaucgugcccuuccugcagguguucggccacggcaaggccaacggcgagcccaccugggcccugcugcugaccgccugcaucugcgagaucggcauccugaucgccagccuggacgagguggcccccauccugagcauguucuuccugaugugcuacauguucgugaaccuggccugcgccgugcagacccugcugagaacccccaacuggagacccagauucagauacuaccacuggacccugagcuuccugggcaugagccugugccuggcccugauguucaucugcagcugguacuacgcccugguggccaugcugaucgccggccugaucuacaaguacaucgaguacagaggcgccgagaaggaguggggcgacggcaucagaggccugagccugagcgccgccagauacgcccugcugagacuggaggagggccccccccacaccaagaacuggagaccccagcugcuggugcuggugagaguggaccaggaccagaacguggugcacccccagcugcugagccugaccagccagcugaaggccggcaagggccugaccaucgugggcagcgugcuggagggcaccuuccuggagaaccacccccaggcccagagagccgaggagagcaucagaagacugauggaggccgagaaggugaagggcuucugccagguggugaucagcagcaaccugagagacggcgugagccaccugauccagagcggcggccugggcggccugcagcacaacaccgugcuggugggcuggcccagaaacuggagacagaaggaggaccaccagaccuggagaaacuucaucgagcuggugagagagaccaccgccggccaccuggcccugcuggugaccaagaacgugagcauguuccccggcaaccccgagagauucagcgagggcagcaucgacgugugguggaucgugcacgacggcggcaugcugaugcugcugcccuuccugcugagacaccacaagguguggagaaagugcaagaugagaaucuucaccguggcccagauggacgacaacagcauccagaugaagaaggaccugaccaccuuccuguaccaccugagaaucaccgccgagguggaggugguggagaugcacgagagcgacaucagcgccuacaccuacgagaagacccuggugauggagcagagaagccagauccugaagcagaugcaccugaccaagaacgagagagagagagagauccagagcaucaccgacgagagcagaggcagcaucagaagaaagaaccccgccaacaccagacugagacugaacgugcccgaggagaccgccggcgacagcgaggagaagcccgaggaggaggugcagcugauccacgaccagagcgcccccagcugccccagcagcagccccagccccggcgaggagcccgagggcgagggcgagaccgaccccgagaaggugcaccugaccuggaccaaggacaagagcguggccgagaagaacaagggccccagccccgugagcagcgagggcaucaaggacuucuucagcaugaagcccgagugggagaaccugaaccagagcaacgugagaagaaugcacaccgccgugagacugaacgaggugaucgugaagaagagcagagacgccaagcuggugcugcugaacaugcccggcccccccagaaacagaaacggcgacgagaacuacauggaguuccuggaggugcugaccgagcaccuggacagagugaugcuggugagaggcggcggcagagaggugaucaccaucuacagcuaa

SEQ ID NO: 23395 - RNA, 3276 nt, Artificial Sequence
  SLC12A6__Homo_sapiens__NP_001035960
augagcgagaugagcggcgccaccaccagccuggccaccguggcccuggacccccccagcgacagaaccagccacccccaggacgugaucgaggaccugagccagaacagcaucaccggcgagcacagccagcugcuggacgacggccacaagaaggccagaaacgccuaccugaacaacagcaacuacgaggagggcgacgaguacuucgacaagaaccuggcccuguucgaggaggagauggacaccagacccaaggugagcagccugcugaacagaauggccaacuacaccaaccugacccagggcgccaaggagcacgaggaggccgagaacaucaccgagggcaagaagaagcccaccaagaccccccagaugggcaccuucaugggcguguaccugcccugccugcagaacaucuucggcgugauccuguuccugagacugaccuggguggugggcaccgccggcgugcugcaggccuucgccaucgugcugaucugcugcugcugcaccaugcugaccgccaucagcaugagcgccaucgccaccaacggcguggugcccgccggcggcagcuacuucaugaucagcagagcccugggccccgaguucggcggcgccgugggccugugcuucuaccugggcaccaccuucgccgccgccauguacauccugggcgccaucgagaucuuccugguguacaucgugcccagagccgccaucuuccacagcgacgacgcccugaaggagagcgccgccaugcugaacaacaugagaguguacggcaccgccuuccuggugcugauggugcuggugguguucaucggcgugagauacgugaacaaguucgccagccuguuccuggccugcgugaucgugagcauccuggccaucuacgccggcgccaucaagagcagcuucgcccccccccacuuccccgugugcaugcugggcaacagaacccugagcagcagacacaucgacgugugcagcaagaccaaggagaucaacaacaugaccgugcccagcaagcuguggggcuucuucugcaacagcagccaguucuucaacgccaccugcgacgaguacuucgugcacaacaacgugaccagcauccagggcauccccggccuggccagcggcaucaucaccgagaaccuguggagcaacuaccugcccaagggcgagaucaucgagaagcccagcgccaagagcagcgacgugcugggcagccugaaccacgaguacgugcugguggacaucaccaccagcuucacccugcuggugggcaucuucuuccccagcgugaccggcaucauggccggcagcaacagaagcggcgaccugaaggacgcccagaagagcauccccaucggcaccauccuggccauccugaccaccagcuucguguaccugagcaacguggugcuguucggcgccugcaucgagggcguggugcugagagacaaguucggcgacgccgugaagggcaaccugguggugggcacccugagcuggcccagccccugggugaucgugaucggcagcuucuucagcaccugcggcgccggccugcagagccugaccggcgcccccagacugcugcaggccaucgccaaggacaacaucauccccuuccugagaguguucggccacagcaaggccaacggcgagcccaccugggcccugcugcugaccgccgccaucgccgagcugggcauccugaucgccagccuggaccugguggcccccauccugagcauguucuuccugaugugcuaccuguucgugaaccuggccugcgcccugcagacccugcugagaacccccaacuggagacccagauucagauacuaccacugggcccugagcuucaugggcaugagcaucugccuggcccugauguucaucagcagcugguacuacgccaucguggccauggugaucgccggcaugaucuacaaguacaucgaguaccagggcgccgagaaggaguggggcgacggcaucagaggccugagccugagcgccgccagauucgcccugcugagacuggaggagggccccccccacaccaagaacuggagaccccagcugcuggugcugcugaagcuggacgaggaccugcacgugaagcaccccagacugcugaccuucgccagccagcugaaggccggcaagggccugaccaucgugggcagcgugaucgugggcaacuuccuggagaacuacggcgaggcccuggccgccgagcagaccaucaagcaccugauggaggccgagaaggugaagggcuucugccagcuggugguggccgccaagcugagagagggcaucagccaccugauccagagcugcggccugggcggcaugaagcacaacaccguggugaugggcuggcccaacggcuggagacagagcgaggacgccagagccuggaagaccuucaucggcaccgugagagugaccaccgccgcccaccuggcccugcugguggccaagaacaucagcuucuuccccagcaacguggagcaguucagcgagggcaacaucgacgugugguggaucgugcacgacggcggcaugcugaugcugcugcccuuccugcugaagcagcacaagguguggagaaagugcagcaucagaaucuucaccguggcccagcuggaggacaacagcauccagaugaagaaggaccuggccaccuuccuguaccaccugagaaucgaggccgagguggaggugguggagaugcacgacagcgacaucagcgccuacaccuacgagagaacccugaugauggagcagagaagccagaugcugagacacaugagacugagcaagaccgagagagacagagaggcccagcuggugaaggacagaaacagcaugcugagacugaccagcaucggcagcgacgaggacgaggagaccgagaccuaccaggagaaggugcacaugaccuggaccaaggacaaguacauggccagcagaggccagaaggccaagagcauggagggcuuccaggaccugcugaacaugagacccgaccagagcaacgugagaagaaugcacaccgccgugaagcugaacgaggugaucgugaacaagagccacgaggccaagcuggugcugcugaacaugcccggcccccccagaaaccccgagggcgacgagaacuacauggaguuccuggaggugcugaccgagggccuggagagagugcugcuggugagaggcggcggcagcgaggugaucaccaucuacagcuaa

SEQ ID NO: 23396 - RNA, 3252 nt, Artificial Sequence
  SLC12A7__Homo_sapiens__NP_006589
augcccaccaacuucaccguggugcccguggaggcccacgccgacggcggcggcgacgagaccgccgagagaaccgaggcccccggcacccccgagggccccgagcccgagagacccagccccggcgacggcaaccccagagagaacagccccuuccugaacaacguggagguggagcaggagagcuucuucgagggcaagaacauggcccuguucgaggaggagauggacagcaaccccauggugagcagccugcugaacaagcuggccaacuacaccaaccugagccagggcgugguggagcacgaggaggacgaggagagcagaagaagagaggccaaggcccccagaaugggcaccuucaucggcguguaccugcccugccugcagaacauccugggcgugauccuguuccugagacugaccuggaucgugggcguggccggcgugcuggagagcuuccugaucguggccaugugcugcaccugcaccaugcugaccgccaucagcaugagcgccaucgccaccaacggcguggugcccgccggcggcagcuacuacaugaucagcagaagccugggccccgaguucggcggcgccgugggccugugcuucuaccugggcaccaccuucgccggcgccauguacauccugggcaccaucgagaucuuccugaccuacaucagccccggcgccgccaucuuccaggccgaggccgccggcggcgaggccgccgccaugcugcacaacaugagaguguacggcaccugcacccuggugcugauggcccuggugguguucgugggcgugaaguacgugaacaagcuggcccugguguuccuggccugcguggugcugagcauccuggccaucuacgccggcgugaucaagagcgccuucgacccccccgacauccccgugugccugcugggcaacagaacccugagcagaagaagcuucgacgccugcgugaaggccuacggcauccacaacaacagcgccaccagcgcccuguggggccuguucugcaacggcagccagcccagcgccgccugcgacgaguacuucauccagaacaacgugaccgagauccagggcauccccggcgccgccagcggcguguuccuggagaaccuguggagcaccuacgcccacgccggcgccuucguggagaagaagggcgugcccagcgugcccguggccgaggagagcagagccagcgcccugcccuacgugcugaccgacaucgccgccagcuucacccugcuggugggcaucuacuuccccagcgugaccggcaucauggccggcagcaacagaagcggcgaccugaaggacgcccagaagagcauccccaccggcaccauccuggccaucgugaccaccagcuucaucuaccugagcugcaucgugcuguucggcgccugcaucgagggcguggugcugagagacaaguucggcgaggcccugcagggcaaccuggugaucggcaugcuggccuggcccagccccugggugaucgugaucggcagcuucuucagcaccugcggcgccggccugcagagccugaccggcgcccccagacugcugcaggccaucgccagagacggcaucgugcccuuccugcagguguucggccacggcaaggccaacggcgagcccaccugggcccugcugcugaccgugcugaucugcgagaccggcauccugaucgccagccuggacagcguggcccccauccugagcauguucuuccugaugugcuaccuguucgugaaccuggccugcgccgugcagacccugcugagaacccccaacuggagacccagauucaaguucuaccacuggacccugagcuuccugggcaugagccugugccuggcccugauguucaucugcagcugguacuacgcccugagcgccaugcugaucgccggcugcaucuacaaguacaucgaguacagaggcgccgagaaggaguggggcgacggcaucagaggccugagccugaacgccgccagauacgcccugcugagaguggagcacggccccccccacaccaagaacuggagaccccaggugcuggugaugcugaaccuggacgccgagcaggccgugaagcaccccagacugcugagcuucaccagccagcugaaggccggcaagggccugaccaucgugggcagcgugcuggagggcaccuaccuggacaagcacauggaggcccagagagccgaggagaacaucagaagccugaugagcaccgagaagaccaagggcuucugccagcugguggugagcagcagccugagagacggcaugagccaccugauccagagcgccggccugggcggccugaagcacaacaccgugcugauggccuggcccgccagcuggaagcaggaggacaaccccuucagcuggaagaacuucguggacaccgugagagacaccaccgccgcccaccaggcccugcugguggccaagaacguggacagcuucccccagaaccaggagagauucggcggcggccacaucgacgugugguggaucgugcacgacggcggcaugcugaugcugcugcccuuccugcugagacagcacaagguguggagaaagugcagaaugagaaucuucaccguggcccagguggacgacaacagcauccagaugaagaaggaccugcagauguuccuguaccaccugagaaucagcgccgagguggaggugguggagaugguggagaacgacaucagcgccuucaccuacgagagaacccugaugauggagcagagaagccagaugcugaagcagaugcagcugagcaagaacgagcaggagagagaggcccagcugauccacgacagaaacaccgccagccacaccgccgccgccgccagaacccaggccccccccacccccgacaaggugcagaugaccuggaccagagagaagcugaucgccgagaaguacagaagcagagacaccagccugagcggcuucaaggaccuguucagcaugaagcccgaccagagcaacgugagaagaaugcacaccgccgugaagcugaacggcguggugcugaacaagagccaggacgcccagcuggugcugcugaacaugcccggcccccccaagaacagacagggcgacgagaacuacauggaguuccuggaggugcugaccgagggccugaacagagugcugcuggugagaggcggcggcagagaggugaucaccaucuacagcuaa

SEQ ID NO: 23397 - RNA, 2145 nt, Artificial Sequence
  SLC12A8__Homo_sapiens__NP_001182412
augacccagaugagccaggugcaggagcuguuccacgaggccgcccagcaggacgcccuggcccagccccagcccugguggaagacccagcuguucaugugggagcccgugcuguucggcaccugggacggcguguucaccagcugcaugaucaacaucuucggcguggugcuguuccugagaaccggcuggcuggugggcaacaccggcgugcugcugggcauguuccuggugagcuucgugauccugguggcccuggugaccgugcugagcggcaucggcgugggcgagagaagcagcaucggcagcggcggcguguacagcaugaucagcagcgugcugggcggccagaccggcggcaccaucggccugcuguacguguucggccagugcguggccggcgccauguacaucaccggcuucgccgagagcaucagcgaccugcugggccugggcaacaucugggccgugagaggcaucagcguggccgugcugcuggcccugcugggcaucaaccuggccggcgugaaguggaucaucagacugcagcugcugcugcuguuccugcuggccgugagcacccuggacuucguggugggcagcuucacccaccuggaccccgagcacggcuucaucggcuacagccccgagcugcugcagaacaacacccugcccgacuacagccccggcgagagcuucuucaccguguucggcguguucuuccccgccgccaccggcgugauggccggcuucaacaugggcggcgaccugagagagcccgccgccagcaucccccugggcagccuggccgccgugggcaucagcugguuccuguacaucguguucguguuccugcugggcgccaucugcaccagagaggcccugagauacgacuuccugaucgccgagaaggugagccugaugggcuuccuguuccugcugggccuguacaucagcagccuggccagcugcaugggcggccuguacggcgcccccagaauccugcagugcaucgcccaggagaaggugauccccgcccuggccugccugggccagggcaagggccccaacaagacccccguggccgccaucugccugaccagccuggugaccauggccuucguguucgugggccaggugaacgugcuggcccccaucgugaccaucaacuucaugcugaccuacguggccguggacuacagcuacuucagccugagcaugugcagcugcagccugacccccgugcccgagcccgugcugagagagggcgccgagggccugcacugcagcgagcaccugcugcuggagaaggcccccagcuacggcagcgagggccccgcccagagagugcuggagggcacccugcuggaguucaccaaggacauggaccagcugcugcagcugaccagaaagcuggagagcagccagcccagacagggcgagggcaacagaacccccgagagccagaagagaaagagcaagaaggccaccaagcagacccugcaggacagcuuccugcuggaccugaagagcccccccagcuuccccguggagaucagcgacagacugcccgccgccagcugggagggccaggagagcugcuggaacaagcagaccagcaagagcgagggcacccagcccgagggcaccuacggcgagcagcuggugcccgagcugugcaaccagagcgagagcagcggcgaggacuucuuccugaagagcagacugcaggagcaggacguguggagaagaagcaccagcuucuacacccacaugugcaaccccugggugagccugcugggcgccgugggcagccugcugaucauguucgugauccaguggguguacacccuggugaacaugggcguggccgccaucguguacuucuacaucggcagagccagccccggccugcaccugggcagcgccagcaacuucagcuucuucagauggaugagaagccugcugcugcccagcugcagaagccugagaagcccccaggagcagaucauccuggcccccagccuggccaagguggacauggagaugacccagcugacccaggagaacgccgacuucgccaccagagacagauaccaccacagcagccuggugaacagagagcagcugaugccccacuacuaa

SEQ ID NO: 23398 - RNA, 1896 nt, Artificial Sequence
  SLC12A9__Homo_sapiens__NP_001254741
auggccagcgagagcagcccccugcuggccuacagacugcugggcgaggagggcguggcccugcccgccaacggcgccggcggccccggcggcgccagcgccagaaagcugagcaccuuccugggcgugguggugcccaccgugcugagcauguucagcaucgugguguuccugagaaucggcuucguggugggccacgccggccugcugcaggcccuggccaugcugcugguggccuacuucauccuggcccugaccgugcugagcgugugcgccaucgccaccaacggcgccgugcagggcggcggcgccuacuucaugaucagcagaacccugggccccgaggugggcggcagcaucggccugauguucuaccuggccaacgugugcggcugcgccgugagccugcugggccugguggagagcgugcuggacguguucggcgccgacgccaccggccccagcggccugagagugcugccccagggcuacggcuggaaccugcuguacggcagccugcugcugggccuggugggcggcgugugcacccugggcgccggccuguacgccagagccagcuuccugaccuuccugcuggugagcggcagccuggccagcgugcugaucagcuucguggccgugggccccagagacaucagacugacccccagacccggccccaacggcagcagccugccccccagauucggccacuucaccggcuucaacagcagcacccugaaggacaaccugggcgccggcuacgccgaggacuacaccaccggcgccgugaugaacuucgccagcguguucgccgugcuguucaacggcugcaccggcaucauggccggcgccaacaugagcggcgagcugaaggaccccagcagagccaucccccugggcaccaucguggccguggccuacaccuucuucguguacgugcugcuguucuuccugagcagcuucaccugcgacagaacccugcugcaggaggacuacggcuucuucagagccaucagccuguggcccccccuggugcugaucggcaucuacgccaccgcccugagcgccagcaugagcagccugaucggcgccagcagaauccugcacgcccuggccagagacgaccuguucggcgugauccuggcccccgccaagguggugagcagaggcggcaaccccugggccgccgugcuguacagcuggggccuggugcagcuggugcugcuggccggcaagcugaacacccuggccgccguggugaccguguucuaccugguggccuacgccgccguggaccugagcugccugagccuggagugggccagcgcccccaacuucagacccaccuucagccuguucagcuggcacaccugccugcugggcguggccagcugccugcugaugauguuccugaucagccccggcgccgccggcggcagccugcugcugaugggccugcuggccgcccugcugaccgccagaggcggccccagcagcuggggcuacgugagccaggcccugcuguuccaccaggugagaaaguaccugcugagacuggacgugagaaaggaccacgugaaguucuggagaccccagcugcugcugcuggugggcaaccccagaggcgcccugccccugcugagacuggccaaccagcugaagaagggcggccuguacgugcugggccacgugacccugggcgaccuggacagccugcccagcgaccccgugcagccccaguacggcgccuggcugagccugguggacagagcccaggugaaggccuucguggaccugacccugagccccagcgugagacagggcgcccagcaccugcugagaaucagcggccuggagagcggcacccugcugcccuggggcuucagaagcuaa

SEQ ID NO: 23399 - RNA, 1788 nt, Artificial Sequence
  SLC13A1__Homo_sapiens__NP_071889
augaaguucuucagcuacauccugguguacagaagauuccuguucgugguguucaccgugcuggugcugcugccccugcccaucgugcugcacaccaaggaggccgagugcgccuacacccuguucgugguggccaccuucuggcugaccgaggcccugccccugagcgugaccgcccugcugcccagccugaugcugcccauguucggcaucaugcccagcaagaagguggccagcgccuacuucaaggacuuccaccugcugcugaucggcgugaucugccuggccaccagcaucgagaaguggaaccugcacaagagaaucgcccugaagauggugaugauggugggcgugaaccccgccuggcugacccugggcuucaugagcagcaccgccuuccugagcauguggcugagcaacaccagcaccgccgccauggugaugcccaucgccgaggccguggugcagcagaucaucaacgccgaggccgagguggaggccacccagaugaccuacuucaacggcagcaccaaccacggccuggagaucgacgagagcgugaacggccacgagaucaacgagagaaaggagaagaccaagcccgugcccggcuacaacaacgacaccggcaagaucagcagcaagguggagcuggagaagaacagcggcaugagaaccaaguacagaaccaagaagggccacgugaccagaaagcugaccugccugugcaucgccuacagcagcaccaucggcggccugaccaccaucaccggcaccagcaccaaccugaucuucgccgaguacuucaacaccagauaccccgacugcagaugccugaacuucggcagcugguucaccuucagcuuccccgccgcccugaucauccugcugcugagcuggaucuggcugcaguggcuguuccugggcuucaacuucaaggagauguucaagugcggcaagaccaagaccgugcagcagaaggccugcgccgaggugaucaagcaggaguaccagaagcugggccccaucagauaccaggagaucgugacccuggugcuguucaucaucauggcccugcugugguucagcagagaccccggcuucgugcccggcuggagcgcccuguucagcgaguaccccggcuucgccaccgacagcaccguggcccugcugaucggccugcuguucuuccugauccccgccaagacccugaccaagaccacccccaccggcgagaucguggccuucgacuacagcccccugaucaccuggaaggaguuccagagcuucaugcccugggacaucgccauccuggugggcggcggcuucgcccuggccgacggcugcgaggagagcggccugagcaaguggaucggcaacaagcugagcccccugggcagccugcccgccuggcugaucauccugaucagcagccugauggugaccagccugaccgagguggccagcaaccccgccaccaucacccuguuccugcccauccugagcccccuggccgaggccauccacgugaacccccuguacauccugauccccagcacccugugcaccagcuucgccuuccugcugcccguggccaacccccccaacgccaucguguucagcuacggccaccugaaggugaucgacauggugaaggccggccugggcgugaacaucgugggcguggccguggugaugcugggcaucugcaccuggaucgugcccauguucgaccuguacaccuaccccagcugggcccccgccaugagcaacgagaccaugcccuaa

SEQ ID NO: 23400 - RNA, 1926 nt, Artificial Sequence
  SLC13A2__Homo_sapiens__NP_001139447
auggccaccugcuggcaggcccugugggccuacagaagcuaccugaucguguucuucgugcccauccugcugcugccccugcccauccuggugcccagcaaggaggccuacugcgccuacgccaucauccugauggcccuguucuggugcaccgaggcccugccccuggccgugaccgcccuguucccccugauccuguuccccaugaugggcaucguggacgccagcgagaucauccagagacccuuccccagcagcuucgagagccccggcgagugccagagcgugggcaugagcgugaccgccagccacaaccugggcggcaccgugggcgacagcagaguguuccccccccugagccacgugagcaccugccagguggccguggaguaccugaaggacagcaaccugcuguucuucggcggccugcugguggccaucgccguggagcacuggaaccugcacaagagaaucgcccugagagugcugcugaucgugggcgugagacccgccccccugauccugggcuucaugcuggugaccgccuuccugagcauguggaucagcaacaccgccaccagcgccaugauggugcccaucgcccacgccgugcuggaccagcugcacagcagccaggccagcagcaacguggaggagggcagcaacaaccccaccuucgagcugcaggagcccagcccccagaaggaggugaccaagcuggacaacggccaggcccugcccgugaccagcgccagcagcgagggcagagcccaccugagccagaagcaccugcaccugacccagugcaugagccugugcgugugcuacagcgccagcaucggcggcaucgccacccugaccggcaccgcccccaaccuggugcugcagggccagaucaacagccuguucccccagaacggcaacguggugaacuucgccagcugguucagcuucgccuuccccaccauggugauccugcugcugcuggccuggcuguggcugcagauccuguuccugggcuucaacuucagaaagaacuucggcaucggcgagaagaugcaggagcagcagcaggccgccuacugcgugauccagaccgagcacagacugcugggccccaugaccuucgccgagaaggccaucagcauccuguucgugauccuggugcugcugugguucaccagagagcccggcuucuuccugggcuggggcaaccuggccuuccccaacgccaagggcgagagcauggugagcgacggcaccguggccaucuucaucggcaucaucauguucaucauccccagcaaguuccccggccugacccaggaccccgagaaccccggcaagcugaaggccccccugggccugcuggacuggaagaccgugaaccagaagaugcccuggaacaucgugcugcugcugggcggcggcuacgcccuggccaagggcagcgagagaagcggccugagcgaguggcugggcaacaagcugaccccccugcagagcgugcccgcccccgccaucgccaucauccugagccugcugguggccaccuucaccgagugcaccagcaacguggccaccaccaccaucuuccugcccauccuggccagcauggcccaggccaucugccugcacccccuguacgugaugcugcccugcacccuggccaccagccuggccuucaugcugcccguggccaccccccccaacgccaucguguucagcuucggcgaccugaaggugcuggacauggccagagccggcuuccugcugaacaucaucggcgugcugaucaucgcccuggccaucaacagcuggggcaucccccuguucagccugcacagcuuccccagcugggcccagagcaacaccaccgcccagugccugcccagccuggccaacaccaccacccccagccccuaa

SEQ ID NO: 23401 - RNA, 1668 nt, Artificial Sequence
  SLC13A3__Homo_sapiens__NP_001011554
auggccguguacuggugcaccgaggcccugccccugagcgugaccgcccugcugcccaucgugcuguuccccuucaugggcauccugcccagcaacaaggugugcccccaguacuuccuggacaccaacuuccuguuccugagcggccugaucauggccagcgccaucgaggaguggaaccugcacagaagaaucgcccugaagauccugaugcuggugggcgugcagcccgccagacugauccugggcaugauggugaccaccagcuuccugagcauguggcugagcaacaccgccagcaccgccaugaugcugcccaucgccaacgccauccugaagagccuguucggccagaaggaggugagaaaggaccccagccaggagagcgaggagaacaccgccgccgugagaagaaacggccugcacaccgugcccaccgagaugcaguuccuggccagcaccgaggccaaggaccaccccggcgagaccgaggugccccuggaccugcccgccgacagcagaaaggaggacgaguacagaagaaacaucuggaagggcuuccugaucagcauccccuacagcgccagcaucggcggcaccgccacccugaccggcaccgcccccaaccugauccugcugggccagcugaagagcuucuucccccagugcgacguggugaacuucggcagcugguucaucuucgccuucccccugaugcugcuguuccugcuggccggcuggcuguggaucagcuuccuguacggcggccugagcuucagaggcuggagaaagaacaagagcgagaucagaaccaacgccgaggacagagccagagccgugaucagagaggaguaccagaaccugggccccaucaaguucgccgagcaggccguguucauccuguucugcauguucgccauccugcuguucaccagagaccccaaguucauccccggcugggccagccuguucaaccccggcuuccugagcgacgccgugaccggcguggccaucgugaccauccuguucuucuuccccagccagagacccagccugaaguggugguucgacuucaaggcccccaacaccgagaccgagccccugcugaccuggaagaaggcccaggagaccgugcccuggaacaucauccugcugcugggcggcggcuucgccauggccaagggcugcgaggagagcggccugagcguguggaucggcggccagcugcacccccuggagaacgugccccccgcccuggccgugcugcugaucaccguggugaucgccuucuucaccgaguucgccagcaacaccgccaccaucaucaucuuccugcccgugcuggccgagcuggccaucagacugagagugcacccccuguaccugaugauccccggcaccgugggcugcagcuucgccuucaugcugcccgugagcaccccccccaacagcaucgccuucgccagcggccaccugcuggugaaggacauggugagaaccggccugcugaugaaccugaugggcgugcugcugcugagccuggccaugaacaccugggcccagaccaucuuccagcugggcaccuuccccgacugggccgacauguacagcgugaacgugaccgcccugccccccacccuggccaacgacaccuucagaacccuguaa

SEQ ID NO: 23402 - RNA, 1569 nt, Artificial Sequence
  SLC13A5__Homo_sapiens__NP_001137310
auggccagcgcccugagcuacgugagcaaguucaagagcuucgugauccuguucgugaccccccugcugcugcugccccuggugauccugaugcccgccaaguucgugagaugcgccuacgugaucauccugauggccaucuacuggugcaccgaggugaucccccuggccgugaccagccugaugcccgugcugcuguucccccuguuccagauccuggacagcagacaggugugcgugcaguacaugaaggacaccaacaugcuguuccugggcggccugaucguggccguggccguggagagauggaaccugcacaagagaaucgcccugagaacccugcugugggugggcgccaagcccgccagacugaugcugggcuucaugggcgugaccgcccugcugagcauguggaucagcaacaccgccaccaccgccaugauggugcccaucguggaggccauccugcagcagauggaggccaccagcgccgccaccgaggccggccuggagcugguggacaagggcaaggccaaggagcugcccggcagccaggugaucuucgagggccccacccugggccagcaggaggaccaggagagaaagagacugugcaaggccaugacccugugcaucugcuacgccgccagcaucggcggcaccgccacccugaccggcaccggccccaacguggugcugcugggccagaugaacgagcuguuccccgacagcaaggaccuggugaacuucgccagcugguucgccuucgccuuccccaacaugcuggugaugcugcuguucgccuggcuguggcugcaguucguguacaugagauucaacuucaagaagagcuggggcugcggccuggagagcaagaagaacgagaaggccgcccugaaggugcugcaggaggaguacagaaagcugggcccccugagcuucgccgagaucaacgugcugaucugcuucuuccugcuggugauccugugguucagcagagaccccggcuucaugcccggcuggcugaccguggccuggguggagggcgagaccaaguacgugagcgacgccaccguggccaucuucguggccacccugcuguucaucgugcccagccagaagcccaaguucaacuucagaagccagaccgaggaggagagaaagacccccuucuacccccccccccugcuggacuggaaggugacccaggagaaggugcccuggggcaucgugcugcugcugggcggcggcuucgcccuggccaagggcagcgaggccagcggccugagcguguggaugggcaagcagauggagccccugcacgccgugccccccgccgccaucacccugauccugagccugcugguggccguguucaccgagugcaccagcaacguggccaccaccacccuguuccugcccaucuucgccagcauggugaagaccggcgugaucaugaacaucaucggcguguucugcguguuccuggccgugaacaccuggggcagagccaucuucgaccuggaccacuuccccgacugggccaacgugacccacaucgagaccuaa

SEQ ID NO: 23403 - RNA, 1338 nt, Artificial Sequence
  SLC14A1__Homo_sapiens__NP_001122060
augaacggcagaagccugaucggcggcgccggcgacgccagacacggccccguguggaaggaccccuucggcaccaaggccggcgacgccgccagaagaggcaucgccagacugagccuggcccuggccgacggcagccaggagcaggagcccgaggaggagaucgccauggaggacagccccaccauggugagaguggacagccccaccauggugagaggcgagaaccaggugagccccugccagggcagaagaugcuuccccaaggcccugggcuacgugaccggcgacaugaaggagcuggccaaccagcugaaggacaagcccguggugcugcaguucaucgacuggauccugagaggcaucagccaggugguguucgugaacaaccccgugagcggcauccugauccuggugggccugcuggugcagaaccccuggugggcccugaccggcuggcugggcaccguggugagcacccugauggcccugcugcugagccaggacagaagccugaucgccagcggccuguacggcuacaacgccacccuggugggcgugcugauggccguguucagcgacaagggcgacuacuucugguggcugcugcugcccgugugcgccaugagcaugaccugccccaucuucagcagcgcccugaacagcaugcugagcaagugggaccugcccguguucacccugcccuucaacauggcccugagcauguaccugagcgccaccggccacuacaaccccuucuuccccgccaagcuggugauccccaucaccaccgcccccaacaucagcuggagcgaccugagcgcccuggagcugcugaagagcauccccgugggcgugggccagaucuacggcugcgacaaccccuggaccggcggcaucuuccugggcgccauccugcugagcagcccccugaugugccugcacgccgccaucggcagccugcugggcaucgccgccggccugagccugagcgcccccuucgaggacaucuacuucggccuguggggcuucaacagcagccuggccugcaucgccaugggcggcauguucauggcccugaccuggcagacccaccugcuggcccugggcugcgcccuguucaccgccuaccugggcgugggcauggccaacuucauggccgaggugggccugcccgccugcaccuggcccuucugccuggccacccugcuguuccugaucaugaccaccaagaacagcaacaucuacaagaugccccugagcaaggugaccuaccccgaggagaacagaaucuucuaccugcaggccaagaagagaaugguggagagcccccuguaa

SEQ ID NO: 23404 - RNA, 2763 nt, Artificial Sequence
  SLC14A2__Homo_sapiens__XP_011524518
augagcgacccccacagcagcccccugcugcccgagccccugagcagcagauacaagcuguacgaggccgaguucaccagccccagcuggcccagcaccagccccgacacccaccccgcccugccccugcuggagaugcccgaggagaaggaccugagaagcagcaacgaggacagccacaucgugaagaucgagaagcugaacgagagaagcaagagaaaggacgacggcguggcccacagagacagcgccggccagagaugcaucugccugagcaaggccgugggcuaccugaccggcgacaugaaggaguacagaaucuggcugaaggacaagcaccuggcccugcaguucaucgacugggugcugagaggcaccgcccaggugauguucaucaacaacccccugagcggccugaucaucuucaucggccugcugauccagaaccccugguggaccaucaccggcggccugggcaccguggugagcacccugaccgcccuggcccugggccaggacagaagcgccaucgccagcggccugcacggcuacaacggcaugcuggugggccugcugauggccguguucagcgagaagcuggacuacuacugguggcugcuguuccccgugaccuucaccgccaugagcugccccgugcugagcagcgcccugaacagcaucuucagcaagugggaccugcccguguucacccugcccuucaacaucgccgugacccuguaccuggccgccaccggccacuacaaccuguucuuccccaccacccugguggagcccgugagcagcgugcccaacaucaccuggaccgagauggagaugccccugcugcugcaggccauccccgugggcgugggccagguguacggcugcgacaaccccuggaccggcggcguguuccugguggcccuguucaucagcagcccccugaucugccugcacgccgccaucggcagcaucgugggccugcuggccgcccugagcguggccacccccuucgagaccaucuacaccggccuguggagcuacaacugcgugcugagcugcaucgccaucggcggcauguucuacgcccugaccuggcagacccaccugcuggcccugaucugcgcccuguucugcgccuacauggaggccgccaucagcaacaucaugagcguggugggcgugccccccggcaccugggccuucugccuggccaccaucaucuuccugcugcugaccaccaacaaccccgccaucuucagacugccccugagcaaggugaccuaccccgaggccaacagaaucuacuaccugaccgugaagagcggcgaggaggagaaggcccccagcggcggcggcggcgagcacccccccaccgccggccccaagguggaggagggcagcgaggccgugcugagcaagcacagaagcguguuccacaucgaguggagcagcaucagaagaagaagcaagguguucggcaagggcgagcaccaggagagacagaacaaggaccccuuccccuacagauacagaaagcccaccguggagcugcuggaccuggacaccauggaggagagcagcgagaucaagguggagaccaacaucagcaagaccagcuggaucagaagcagcauggccgccagcggcaagagagugagcaaggcccugagcuacaucaccggcgagaugaaggagugcggcgagggccugaaggacaagagccccguguuccaguucuucgacugggugcugagaggcaccagccaggugauguucgugaacaacccccugagcggcauccugaucauccugggccuguucauccagaaccccuggugggccaucagcggcugccugggcaccaucaugagcacccugaccgcccugauccugagccaggacaagagcgccaucgccgccggcuuccacggcuacaacggcgugcuggugggccugcugauggccguguucagcgacaagggcgacuacuacugguggcugcugcugcccgugaucaucaugagcaugagcugccccauccugagcagcgcccugggcaccaucuucagcaagugggaccugcccguguucacccugcccuucaacaucaccgugacccuguaccuggccgccaccggccacuacaaccuguucuuccccaccacccugcugcagcccgccagcgccaugcccaacaucaccuggagcgaggugcaggugccccugcugcugagagccauccccgugggcaucggccagguguacggcugcgacaaccccuggaccggcggcaucuuccugaucgcccuguucaucagcagcccccugaucugccugcacgccgccaucggcagcaccaugggcaugcuggccgcccugaccaucgccacccccuucgacagcaucuacuucggccugugcggcuucaacagcacccuggccugcaucgccaucggcggcauguucuacgugaucaccuggcagacccaccugcuggccaucgccugcgcccuguucgccgccuaccugggcgccgcccuggccaacaugcugagcguguucggccugccccccugcaccuggcccuucugccugagcgcccugaccuuccugcugcugaccaccaacaaccccgccaucuacaagcugccccugagcaaggugaccuaccccgaggccaacagaaucuacuaccugagccaggagagaaacagaagagccagcaucaucaccaaguaccaggccuacgacgugagcuaa

SEQ ID NO: 23405 - RNA, 2127 nt, Artificial Sequence
  SLC15A1__Homo_sapiens__NP_005064
augggcaugagcaagagccacagcuucuucggcuacccccugagcaucuucuucaucguggugaacgaguucugcgagagauucagcuacuacggcaugagagccauccugauccuguacuucaccaacuucaucagcugggacgacaaccugagcaccgccaucuaccacaccuucguggcccugugcuaccugacccccauccugggcgcccugaucgccgacagcuggcugggcaaguucaagaccaucgugagccugagcaucguguacaccaucggccaggccgugaccagcgugagcagcaucaacgaccugaccgaccacaaccacgacggcacccccgacagccugcccgugcacguggugcugagccugaucggccuggcccugaucgcccugggcaccggcggcaucaagcccugcgugagcgccuucggcggcgaccaguucgaggagggccaggagaagcagagaaacagauucuucagcaucuucuaccuggccaucaacgccggcagccugcugagcaccaucaucacccccaugcugagagugcagcagugcggcauccacagcaagcaggccugcuacccccuggccuucggcgugcccgccgcccugauggccguggcccugaucguguucgugcugggcagcggcauguacaagaaguucaagccccagggcaacaucaugggcaagguggccaagugcaucggcuucgccaucaagaacagauucagacacagaagcaaggccuuccccaagagagagcacuggcuggacugggccaaggagaaguacgacgagagacugaucagccagaucaagauggugaccagagugauguuccuguacaucccccugcccauguucugggcccuguucgaccagcagggcagcagauggacccugcaggccaccaccaugagcggcaagaucggcgcccuggagauccagcccgaccagaugcagaccgugaacgccauccugaucgugaucauggugcccaucuucgacgccgugcuguacccccugaucgccaagugcggcuucaacuucaccagccugaagaagauggccgugggcauggugcuggccagcauggccuucgugguggccgccaucgugcagguggagaucgacaagacccugcccguguuccccaagggcaacgaggugcagaucaaggugcugaacaucggcaacaacaccaugaacaucagccugcccggcgagauggugacccugggccccaugagccagaccaacgccuucaugaccuucgacgugaacaagcugaccagaaucaacaucagcagccccggcagccccgugaccgccgugaccgacgacuucaagcagggccagagacacacccugcuggugugggcccccaaccacuaccagguggugaaggacggccugaaccagaagcccgagaagggcgagaacggcaucagauucgugaacaccuucaacgagcugaucaccaucaccaugagcggcaagguguacgccaacaucagcagcuacaacgccagcaccuaccaguucuuccccagcggcaucaagggcuucaccaucagcagcaccgagauccccccccagugccagcccaacuucaacaccuucuaccuggaguucggcagcgccuacaccuacaucgugcagagaaagaacgacagcugccccgaggugaagguguucgaggacaucagcgccaacaccgugaacauggcccugcagaucccccaguacuuccugcugaccugcggcgaggugguguucagcgugaccggccuggaguucagcuacagccaggcccccagcaacaugaagagcgugcugcaggccggcuggcugcugaccguggccgugggcaacaucaucgugcugaucguggccggcgccggccaguucagcaagcagugggccgaguacauccuguucgccgcccugcugcugguggugugcgugaucuucgccaucauggccagauucuacaccuacaucaaccccgccgagaucgaggcccaguucgacgaggacgagaagaagaacagacuggagaagagcaaccccuacuucaugagcggcgccaacagccagaagcagauguaa

SEQ ID NO: 23406 - RNA, 2097 nt, Artificial Sequence
  SLC15A2__Homo_sapiens__NP_001139470
augaaccccuuccagaagaacgagagcaaggagacccuguucagccccgugagcaucgaggaggugccccccagaccccccagcccccccaagaagcccagccccaccaucugcggcagcaacuacccccugagcaucgccuucaucguggugaacgaguucugcgagagauucagcuacuacggcaugaaggccgugcugauccuguacuuccuguacuuccugcacuggaacgaggacaccagcaccagcaucuaccacgccuucagcagccugugcuacuucacccccauccugggcgccgccaucgccgacagcuggcugggcaaguucaaggugcugagccugaucggccugagccugaucgcccugggcaccggcggcaucaagcccugcguggccgccuucggcggcgaccaguucgaggagaagcacgccgaggagagaaccagauacuucagcguguucuaccugagcaucaacgccggcagccugaucagcaccuucaucacccccaugcugagaggcgacgugcagugcuucggcgaggacugcuacgcccuggccuucggcgugcccggccugcugauggugaucgcccuggugguguucgccaugggcagcaagaucuacaacaagcccccccccgagggcaacaucguggcccagguguucaagugcaucugguucgccaucagcaacagauucaagaacagaagcggcgacauccccaagagacagcacuggcuggacugggccgccgagaaguaccccaagcagcugaucauggacgugaaggcccugaccagagugcuguuccuguacaucccccugcccauguucugggcccugcuggaccagcagggcagcagauggacccugcaggccaucagaaugaacagaaaccugggcuucuucgugcugcagcccgaccagaugcaggugcugaacccccugcuggugcugaucuucaucccccuguucgacuucgugaucuacagacuggugagcaagugcggcaucaacuucagcagccugagaaagauggccgugggcaugauccuggccugccuggccuucgccguggccgccgccguggagaucaagaucaacgagauggcccccgcccagcccggcccccaggagguguuccugcaggugcugaaccuggccgacgacgaggugaaggugaccguggugggcaacgagaacaacagccugcugaucgagagcaucaagagcuuccagaagaccccccacuacagcaagcugcaccugaagaccaagagccaggacuuccacuuccaccugaaguaccacaaccugagccuguacaccgagcacagcgugcaggagaagaacugguacagccuggugaucagagaggacggcaacagcaucagcagcaugauggugaaggacaccgagagcagaaccaccaacggcaugaccaccgugagauucgugaacacccugcacaaggacgugaacaucagccugagcaccgacaccagccugaacgugggcgaggacuacggcgugagcgccuacagaaccgugcagagaggcgaguaccccgccgugcacugcagaaccgaggacaagaacuucagccugaaccugggccugcuggacuucggcgccgccuaccuguucgugaucaccaacaacaccaaccagggccugcaggccuggaagaucgaggacauccccgccaacaagaugagcaucgccuggcagcugccccaguacgcccuggugaccgccggcgaggugauguucagcgugaccggccuggaguucagcuacagccaggcccccagcagcaugaagagcgugcugcaggccgccuggcugcugaccaucgccgugggcaacaucaucgugcuggugguggcccaguucagcggccuggugcagugggccgaguucauccuguucagcugccugcugcuggugaucugccugaucuucagcaucaugggcuacuacuacgugcccgugaagaccgaggacaugagaggccccgccgacaagcacaucccccacauccagggcaacaugaucaagcuggagaccaagaagaccaagcuguaa

SEQ ID NO: 23407 - RNA, 1734 nt, Artificial Sequence
  SLC15A4__Homo_sapiens__NP_663623
auggagggcagcggcggcggcgccggcgagagagccccccugcugggcgccagaagagccgccgccgccgccgccgccgccggcgccuucgccggcagaagagccgccugcggcgccgugcugcugaccgagcugcuggagagagccgccuucuacggcaucaccagcaaccuggugcuguuccugaacggcgcccccuucugcugggagggcgcccaggccagcgaggcccugcugcuguucaugggccugaccuaccugggcagccccuucggcggcuggcuggccgacgccagacugggcagagccagagccauccugcugagccuggcccuguaccugcugggcaugcuggccuucccccugcuggccgcccccgccaccagagccgcccugugcggcagcgccagacugcugaacugcaccgcccccggccccgacgccgccgccagaugcugcagccccgccaccuucgccggccuggugcuggugggccugggcguggccaccgugaaggccaacaucacccccuucggcgccgaccaggugaaggacagaggccccgaggccaccagaagauucuucaacugguucuacuggagcaucaaccugggcgccauccugagccugggcggcaucgccuacauccagcagaacgugagcuucgugaccggcuacgccauccccaccgugugcgugggccuggccuucgugguguuccugugcggccagagcguguucaucaccaagccccccgacggcagcgccuucaccgacauguucaagauccugaccuacagcugcugcagccagaagagaagcggcgagagacagagcaacggcgagggcaucggcguguuccagcagagcagcaagcagagccuguucgacagcugcaagaugagccacggcggccccuucaccgaggagaagguggaggacgugaaggcccuggugaagaucgugcccguguuccuggcccugauccccuacuggaccguguacuuccagaugcagaccaccuacgugcugcagagccugcaccugagaauccccgagaucagcaacaucaccaccaccccccacacccugcccgccgccuggcugaccauguucgacgccgugcugauccugcugcugaucccccugaaggacaagcugguggaccccauccugagaagacacggccugcugcccagcagccugaagagaaucgccgugggcauguucuucgugaugugcagcgccuucgccgccggcauccuggagagcaagagacugaaccuggugaaggagaagaccaucaaccagaccaucggcaacgugguguaccacgccgccgaccugagccugugguggcaggugccccaguaccugcugaucggcaucagcgagaucuucgccagcaucgccggccuggaguucgccuacagcgccgcccccaagagcaugcagagcgccaucaugggccuguucuucuucuucagcggcgugggcagcuucgugggcagcggccugcuggcccuggugagcaucaaggccaucggcuggaugagcagccacaccgacuucggcaacaucaacggcugcuaccugaacuacuacuucuuccugcuggccgccauccagggcgccacccugcugcuguuccugaucaucagcgugaaguacgaccaccacagagaccaccagagaagcagagccaacggcgugcccaccagcagaagagccuaa

SEQ ID NO: 23408 - RNA, 1548 nt, Artificial Sequence
  SLC16A10__Homo_sapiens__NP_061063
auggugcugagccaggaggagcccgacagcgccagaggcaccagcgaggcccagccccugggccccgcccccaccggcgccgcccccccccccggccccggccccagcgacagccccgaggccgccguggagaagguggagguggagcuggccggccccgccaccgccgagccccacgagccccccgagccccccgagggcggcuggggcuggcuggugaugcuggccgccauguggugcaacggcagcguguucggcauccagaacgccugcggcgugcuguucgugagcaugcuggagaccuucggcagcaaggacgacgacaagaugguguucaagaccgccugggugggcagccugagcaugggcaugaucuucuucugcugccccaucgugagcguguucaccgaccuguucggcugcagaaagaccgccguggugggcgccgccgugggcuucgugggccugaugagcagcagcuucgugagcagcaucgagccccuguaccugaccuacggcaucaucuucgccugcggcugcagcuucgccuaccagcccagccuggugauccugggccacuacuucaagaagagacugggccuggugaacggcaucgugaccgccggcagcagcguguucaccauccugcugccccugcugcugagagugcugaucgacagcgugggccuguucuacacccugagagugcugugcaucuucauguucgugcuguuccuggccggcuucaccuacagaccccuggccaccagcaccaaggacaaggagagcggcggcagcggcagcagccuguucagcagaaagaaguucagcccccccaagaagaucuucaacuucgccaucuucaaggugaccgccuacgccgugugggccgugggcaucccccuggcccuguucggcuacuucgugcccuacgugcaccugaugaagcacgugaacgagagauuccaggacgagaagaacaaggagguggugcugaugugcaucggcgugaccagcggcgugggcagacugcuguucggcagaaucgccgacuacgugcccggcgugaagaagguguaccugcaggugcugagcuucuucuucaucggccugaugagcaugaugaucccccugugcagcaucuucggcgcccugaucgccgugugccugaucaugggccuguucgacggcugcuucaucagcaucauggcccccaucgccuucgagcuggugggcgcccaggacgugagccaggccaucggcuuccugcugggcuucaugagcauccccaugaccgugggcccccccaucgccggccugcugagagacaagcugggcagcuacgacguggccuucuaccuggccggcgugcccccccugaucggcggcgccgugcugugcuucauccccuggauccacagcaagaagcagagagagaucagcaagaccaccggcaaggagaagauggagaagaugcuggagaaccagaacagccugcugagcagcagcagcggcauguucaagaaggagagcgacagcaucaucuaa

SEQ ID NO: 23409 - RNA, 1416 nt, Artificial Sequence
  SLC16A11__Homo_sapiens__NP_699188
augcccgccccccagagaaagcacagaagaggcggcuucagccacagaugcuuccccaccccccagaccgccaugaccccccagcccgccggcccccccgacggcggcuggggcugggugguggccgccgccgccuucgccaucaacggccugagcuacggccugcugagaagccugggccuggccuuccccgaccuggccgagcacuucgacagaagcgcccaggacaccgccuggaucagcgcccuggcccuggccgugcagcaggccgccagccccgugggcagcgcccugagcaccagauggggcgccagacccguggugauggugggcggcgugcuggccagccugggcuucguguucagcgccuucgccagcgaccugcugcaccuguaccugggccugggccugcuggccggcuucggcugggcccugguguucgcccccgcccugggcacccugagcagauacuucagcagaagaagagugcuggccgugggccuggcccugaccggcaacggcgccagcagccugcugcuggcccccgcccugcagcugcugcuggacaccuucggcuggagaggcgcccugcugcugcugggcgccaucacccugcaccugacccccugcggcgcccugcugcugccccuggugcugcccggcgacccccccgccccccccagaagcccccuggccgcccugggccugagccuguucaccagaagagccuucagcaucuucgcccugggcaccgcccuggugggcggcggcuacuucgugcccuacgugcaccuggccccccacgcccuggacagaggccugggcggcuacggcgccgcccuggugguggccguggccgccaugggcgacgccggcgccagacuggugugcggcuggcuggccgaccagggcugggugccccugcccagacugcuggccguguucggcgcccugaccggccugggccuguggguggugggccuggugcccguggugggcggcgaggagagcuggggcggcccccugcuggccgccgccguggccuacggccugagcgccggcagcuacgccccccugguguucggcgugcugcccggccuggugggcgugggcggcguggugcaggccaccggccuggugaugaugcugaugagccugggcggccugcugggccccccccugagcggcuuccugagagacgagaccggcgacuucaccgccagcuuccugcugagcggcagccugauccugagcggcagcuucaucuacaucggccugcccagagcccugcccagcugcggccccgccagcccccccgccacccccccccccgagaccggcgagcugcugcccgccccccaggccgugcugcugagccccggcggccccggcagcacccuggacaccaccugcuaa

SEQ ID NO: 23410 - RNA, 1551 nt, Artificial Sequence
  SLC16A12__Homo_sapiens__NP_998771
augcccagcggcagccacuggaccgccaacagcagcaagaucaucaccuggcugcuggagcagcccggcaaggaggagaagagaaagaccauggccaaggugaacagagccagaagcaccagcccccccgacggcggcuggggcuggaugaucguggccggcugcuuccuggugaccaucugcaccagagccgugaccagaugcaucagcaucuucuucguggaguuccagaccuacuucacccaggacuacgcccagaccgccuggauccacagcaucguggacugcgugaccaugcugugcgccccccugggcagcguggugagcaaccaccugagcugccaggugggcaucaugcugggcggccugcuggccagcaccggccugauccugagcagcuucgccaccagccugaagcaccuguaccugacccugggcgugcugaccggccugggcuucgcccugugcuacagccccgccaucgccauggugggcaaguacuucagcagaagaaaggcccuggccuacggcaucgccaugagcggcagcggcaucggcaccuucauccuggcccccguggugcagcugcugaucgagcaguucagcuggagaggcgcccugcugauccugggcggcuucgugcugaaccugugcgugugcggcgcccugaugagacccaucacccugaaggaggaccacaccacccccgagcagaaccacgugugcagaacccagaaggaggacaucaagagagugagccccuacagcagccugaccaaggagugggcccagaccugccugugcugcugccugcagcaggaguacagcuuccugcugaugagcgacuucguggugcuggccgugagcgugcuguucauggccuacggcugcagcccccuguucguguaccuggugcccuacgcccugagcgugggcgugagccaccagcaggccgccuuccugaugagcauccugggcgugaucgacaucaucggcaacaucaccuucggcuggcugaccgacagaagaugccugaagaacuaccaguacgugugcuaccuguucgccgugggcauggacggccugugcuaccugugccugcccaugcugcagagccugccccugcuggugcccuucagcugcaccuucggcuacuucgacggcgccuacgugacccugauccccguggugaccaccgagaucgugggcaccaccagccugagcagcgcccugggcgugguguacuuccugcacgccgugcccuaccuggugagcccccccaucgccggcagacugguggacaccaccggcagcuacaccgccgccuuccugcugugcggcuucagcaugaucuucagcagcgugcugcugggcuucgccagacugaucaagagaaugagaaagacccagcugcaguucaucgccaaggagagcgaccccaagcugcagcuguggaccaacggcagcguggccuacagcguggccagagagcuggaccagaagcacggcgagcccguggccaccgccgugcccggcuacagccugaccuaa

SEQ ID NO: 23411 - RNA, 1281 nt, Artificial Sequence
  SLC16A13__Homo_sapiens__NP_963860
auggccagaagaaccgagccccccgacggcggcuggggcugggugguggugcugagcgccuucuuccagagcgcccugguguucggcgugcugagaagcuucggcguguucuucguggaguucguggccgccuucgaggagcaggccgccagagugagcuggaucgccagcaucggcaucgccgugcagcaguucggcagccccgugggcagcgcccugagcaccaaguucggccccagacccguggugaugaccggcggcauccuggccgcccugggcaugcugcuggccagcuucgccaccagccugacccaccuguaccugagcaucggccugcugagcggcagcggcugggcccugaccuucgcccccacccuggccugccugagcugcuacuucagcagaagaagaagccuggccaccggccuggcccugaccggcgugggccugagcagcuucaccuucgcccccuucuuccaguggcugcugagccacuacgccuggagaggcagccugcugcuggugagcgcccugagccugcaccugguggccugcggcgcccugcugagaccccccagccuggccgaggaccccgccgugggcggccccagagcccagcugaccagccugcugcaccacggccccuuccugagauacaccguggcccugacccugaucaacaccggcuacuucauccccuaccugcaccugguggcccaccugcaggaccuggacugggacccccugcccgccgccuuccugcugagcgugguggccaucagcgaccuggugggcagaguggugagcggcuggcugggcgacgccgugcccggccccgugaccagacugcugaugcuguggaccacccugaccggcgugagccuggcccuguuccccguggcccaggcccccaccgcccugguggcccuggccguggccuacggcuucaccagcggcgcccuggccccccuggccuucagcgugcugcccgagcugaucggcaccagaagaaucuacugcggccugggccugcugcagaugaucgagagcaucggcggccugcugggccccccccugagcggcuaccugagagacgugaccggcaacuacaccgccagcuucgugguggccggcgccuuccugcugagcggcagcggcauccugcugacccugccccacuucuucugcuucagcaccaccaccagcggcccccaggaccuggugaccgaggcccuggacaccaaggugccccugcccaaggagggccuggaggaggacuaa

SEQ ID NO: 23412 - RNA, 1503 nt, Artificial Sequence
  SLC16A1__Homo_sapiens__XP_011540329
augccccccgccgugggcggccccgugggcuacaccccccccgacggcggcuggggcugggccguggugaucggcgccuucaucagcaucggcuucagcuacgccuuccccaagagcaucaccguguucuucaaggagaucgagggcaucuuccacgccaccaccagcgaggugagcuggaucagcagcaucaugcuggccgugauguacggcggcggccccaucagcagcauccuggugaacaaguacggcagcagaaucgugaugaucgugggcggcugccugagcggcugcggccugaucgccgccagcuucugcaacaccgugcagcagcuguacgugugcaucggcgugaucggcggccugggccuggccuucaaccugaaccccgcccugaccaugaucggcaaguacuucuacaagagaagaccccuggccaacggccuggccauggccggcagccccguguuccugugcacccuggccccccugaaccagguguucuucggcaucuucggcuggagaggcagcuuccugauccugggcggccugcugcugaacugcugcguggccggcgcccugaugagacccaucggccccaagcccaccaaggccggcaaggacaagagcaaggccagccuggagaaggccggcaagagcggcgugaagaaggaccugcacgacgccaacaccgaccugaucggcagacaccccaagcaggagaagagaagcguguuccagaccaucaaccaguuccuggaccugacccuguucacccacagaggcuuccugcuguaccugagcggcaacgugaucauguucuucggccuguucgccccccugguguuccugagcagcuacggcaagagccagcacuacagcagcgagaagagcgccuuccugcugagcauccuggccuucguggacaugguggccagacccagcaugggccugguggccaacaccaagcccaucagacccagaauccaguacuucuucgccgccagcgugguggccaacggcgugugccacaugcuggccccccugagcaccaccuacgugggcuucugcguguacgccggcuucuucggcuucgccuucggcuggcugagcagcgugcuguucgagacccugauggaccuggugggcccccagagauucagcagcgccgugggccuggugaccaucguggagugcugccccgugcugcugggccccccccugcugggcagacugaacgacauguacggcgacuacaaguacaccuacugggccugcggcguggugcugaucaucagcggcaucuaccuguucaucggcaugggcaucaacuacagacugcuggccaaggagcagaaggccaacgagcagaagaaggagagcaaggaggaggagaccagcaucgacguggccggcaagcccaacgaggugaccaaggccgccgagagccccgaccagaaggacaccgacggcggccccaaggaggaggagagccccguguaa

SEQ ID NO: 23413 - RNA, 1620 nt, Artificial Sequence
  SLC16A2__Homo_sapiens__NP_006508
auggcccugcagagccaggccagcgaggaggccaagggccccuggcaggaggccgaccaggagcagcaggagcccgugggcagccccgagcccgagagcgagcccgagcccgagcccgagcccgagcccgugcccgugcccccccccgagccccagcccgagccccagccccugcccgaccccgccccccugcccgagcuggaguucgagagcgagagagugcacgagcccgagcccacccccaccguggagaccagaggcaccgccagaggcuuccagccccccgagggcggcuucggcuggguggugguguucgccgccaccuggugcaacggcagcaucuucggcauccacaacagcgugggcauccuguacagcaugcugcuggaggaggagaaggagaagaacagacagguggaguuccaggccgccugggugggcgcccuggccaugggcaugaucuucuucugcagccccaucgugagcaucuucaccgacagacugggcugcagaaucaccgccaccgccggcgccgccguggccuucaucggccugcacaccagcagcuucaccagcagccugagccugagauacuucaccuacggcauccuguucggcugcggcugcagcuucgccuuccagcccagccuggugauccugggccacuacuuccagagaagacugggccuggccaacggcguggugagcgccggcagcagcaucuucagcaugagcuuccccuuccugaucagaaugcugggcgacaagaucaagcuggcccagaccuuccaggugcugagcaccuucauguucgugcugaugcugcugagccugaccuacagaccccugcugcccagcagccaggacacccccagcaagagaggcgugagaacccugcaccagagauuccuggcccagcugagaaaguacuucaacaugagaguguucagacagagaaccuacagaaucugggccuucggcaucgccgccgccgcccugggcuacuucgugcccuacgugcaccugaugaaguacguggaggaggaguucagcgagaucaaggagaccugggugcugcuggugugcaucggcgccaccagcggccugggcagacuggugagcggccacaucagcgacagcauccccggccugaagaagaucuaccugcaggugcugagcuuccugcugcugggccugaugagcaugaugaucccccugugcagagacuucggcggccugaucguggugugccuguuccugggccugugcgacggcuucuucaucaccaucauggcccccaucgccuucgagcuggugggccccaugcaggccagccaggccaucggcuaccugcugggcaugauggcccugcccaugaucgccggcccccccaucgccggccugcugagaaacugcuucggcgacuaccacguggccuucuacuucgccggcgugccccccaucaucggcgccgugauccuguucuucgugccccugaugcaccagagaauguucaagaaggagcagagagacagcagcaaggacaagaugcuggcccccgaccccgaccccaacggcgagcugcugcccggcagccccaaccccgaggagcccaucuaa

SEQ ID NO: 23414 - RNA, 1398 nt, Artificial Sequence
  SLC16A3__Homo_sapiens__XP_011521909
augggcggcgccgugguggacgagggccccaccggcgugaaggcccccgacggcggcuggggcugggccgugcuguucggcugcuucgugaucaccggcuucagcuacgccuuccccaaggccgugagcguguucuucaaggagcugauccaggaguucggcaucggcuacagcgacaccgccuggaucagcagcauccugcuggccaugcuguacggcaccggcccccugugcagcgugugcgugaacagauucggcugcagacccgugaugcuggugggcggccuguucgccagccugggcaugguggccgccagcuucugcagaagcaucauccagguguaccugaccaccggcgugaucaccggccugggccuggcccugaacuuccagcccagccugaucaugcugaacagauacuucagcaagagaagacccauggccaacggccuggccgccgccggcagccccguguuccugugcgcccugagcccccugggccagcugcugcaggacagauacggcuggagaggcggcuuccugauccugggcggccugcugcugaacugcugcgugugcgccgcccugaugagaccccugguggugaccgcccagcccggcagcggcccccccagacccagcagaagacugcuggaccugagcguguucagagacagaggcuucgugcuguacgccguggccgccagcgugauggugcugggccuguucgugccccccguguucguggugagcuacgccaaggaccugggcgugcccgacaccaaggccgccuuccugcugaccauccugggcuucaucgacaucuucgccagacccgccgccggcuucguggccggccugggcaaggugagacccuacagcguguaccuguucagcuucagcauguucuucaacggccuggccgaccuggccggcagcaccgccggcgacuacggcggccuggugguguucugcaucuucuucggcaucagcuacggcauggugggcgcccugcaguucgaggugcugauggccaucgugggcacccacaaguucagcagcgccaucggccuggugcugcugauggaggccguggccgugcuggugggcccccccagcggcggcaagcugcuggacgccacccacguguacauguacguguucauccuggccggcgccgaggugcugaccagcagccugauccugcugcugggcaacuucuucugcaucagaaagaagcccaaggagccccagcccgagguggccgccgccgaggaggagaagcugcacaagccccccgccgacagcggcguggaccugagagagguggagcacuuccugaaggccgagcccgagaagaacggcgagguggugcacacccccgagaccagcguguaa

SEQ ID NO: 23415 - RNA, 1572 nt, Artificial Sequence
  SLC16A6__Homo_sapiens__NP_004685
augacccagaacaagcugaagcugugcagcaaggccaacguguacaccgaggugcccgacggcggcuggggcugggccguggccgugagcuucuucuucguggagguguucaccuacggcaucaucaagaccuucggcguguucuucaacgaccugauggacagcuucaacgagagcaacagcagaaucagcuggaucaucagcaucugcguguucgugcugaccuucagcgccccccuggccaccgugcugagcaacagauucggccacagacugguggugaugcugggcggccugcuggugagcaccggcaugguggccgccagcuucagccaggaggugagccacauguacguggccaucggcaucaucagcggccugggcuacugcuucagcuuccugcccaccgugaccauccugagccaguacuucggcaagagaagaagcaucgugaccgccguggccagcaccggcgagugcuucgccguguucgccuucgcccccgccaucauggcccugaaggagagaaucggcuggagauacagccugcuguucgugggccugcugcagcugaacaucgugaucuucggcgcccugcugagacccaucuucaucagaggccccgccagccccaagaucgugauccaggagaacagaaaggaggcccaguacaugcuggagaacgagaagaccagaaccagcaucgacagcaucgacagcggcguggagcugaccaccagccccaagaacgugcccacccacaccaaccuggagcuggagcccaaggccgacaugcagcaggugcuggugaagaccagccccagacccagcgagaagaaggccccccugcuggacuucagcauccugaaggagaagagcuucaucugcuacgcccuguucggccuguucgccacccugggcuucuucgcccccagccuguacaucaucccccugggcaucagccugggcaucgaccaggacagagccgccuuccugcugagcaccauggccaucgccgagguguucggcagaaucggcgccggcuucgugcugaacagagagcccaucagaaagaucuacaucgagcugaucugcgugauccugcugaccgugagccuguucgccuucaccuucgccaccgaguucuggggccugaugagcugcagcaucuucuucggcuucauggugggcaccaucggcggcacccacaucccccugcuggccgaggacgacguggugggcaucgagaagaugagcagcgccgccggcguguacaucuucauccagagcaucgccggccuggccggccccccccuggccggccugcugguggaccagagcaagaucuacagcagagccuucuacagcugcgccgccggcauggcccuggccgccgugugccuggcccuggugagacccugcaagaugggccugugccagcaccaccacagcggcgagaccaagguggugagccacagaggcaagacccugcaggacauccccgaggacuuccuggagauggaccuggccaagaacgagcacagagugcacgugcagauggagcccguguaa

SEQ ID NO: 23416 - RNA, 1437 nt, Artificial Sequence
  SLC16A7__Homo_sapiens__XP_005269288
augccccccaugcccagcgccccccccgugcaccccccccccgacggcggcuggggcuggaucguggugggcgccgccuucaucagcaucggcuucagcuacgccuuccccaaggccgugaccguguucuucaaggagauccagcagaucuuccacaccaccuacagcgagaucgccuggaucagcagcaucaugcuggccgugauguacgccggcggccccgugagcagcgugcuggugaacaaguacggcagcagacccguggugaucgccggcggccugcugugcugccugggcauggugcuggccagcuucagcagcagcguggugcagcuguaccugaccaugggcuucaucaccggccugggccuggccuucaaccugcagcccgcccugaccaucaucggcaaguacuucuacagaaagagacccauggccaacggccuggccauggccggcagccccguguuccugagcagccuggcccccuucaaccaguaccuguucaacaccuucggcuggaagggcagcuuccugauccugggcagccugcugcugaacgccugcguggccggcagccugaugagaccccugggccccaaccagaccaccagcaagagcaagaacaagaccggcaagaccgaggacgacagcagccccaagaagaucaagaccaagaagagcaccugggagaaggugaacaaguaccuggacuucagccuguucaagcacagaggcuuccugaucuaccugagcggcaacgugaucauguuccugggcuucuucgcccccaucaucuuccuggcccccuacgccaaggaccagggcaucgacgaguacagcgccgccuuccugcugagcgugauggccuucguggacauguucgccagacccagcgugggccugaucgccaacagcaaguacaucagacccagaauccaguacuucuucagcuucgccaucauguucaacggcgugugccaccugcugugcccccuggcccaggacuacaccagccuggugcuguacgccguguucuucggccugggcuucggcagcgugagcagcgugcuguucgagacccugauggaccuggugggcgcccccagauucagcagcgccgugggccuggugaccaucguggagugcggccccgugcugcugggccccccccuggccggcaagcugguggaccugaccggcgaguacaaguacauguacaugagcugcggcgccaucgugguggccgccagcguguggcugcugaucggcaacgccaucaacuacagacugcuggccaaggagagaaaggaggagaacgccagacagaagaccagagagagcgagccccugagcaagagcaagcacagcgaggacgugaacgugaaggugagcaacgcccagagcgugaccagcgagagagagaccaacaucuaa

SEQ ID NO: 23417 - RNA, 1515 nt, Artificial Sequence
  SLC16A8__Homo_sapiens__NP_037488
augggcgccggcggccccagaagaggcgagggcccccccgacggcggcuggggcuggguggugcugggcgccugcuucguggugaccggcuucgccuacggcuuccccaaggccgugagcguguucuucagagcccugaugagagacuucgacgccggcuacagcgacaccgccugggugagcagcaucaugcuggccaugcuguacggcaccggccccgugagcagcauccuggugaccagauucggcugcagacccgugaugcuggccggcggccugcuggccagcgccggcaugauccuggccagcuucgccaccagacugcuggagcuguaccugaccgccggcgugcugaccggccugggccuggcccugaacuuccagcccagccugaucaugcugggccuguacuucgagagaagaagaccccuggccaacggccuggccgccgccggcagccccguguuccugagcgcccugagcccccugggccagcagcugcuggagagauucggcuggagaggcggcuuccugcugcugggcggccugcugcugcacugcugcgccugcggcgccgugaugagacccccccccggccccggccccagacccagaagagacagcgccggcgacagagccggcgacgcccccggcgaggccgaggccgacggcgccggccugcagcugagagaggccagccccagagugagacccagaagaagacugcuggaccuggccgugugcaccgacagagccuucgccguguacgccgugaccaaguuccugauggcccugggccuguucgugcccgccauccugcuggugaacuacgccaaggacgccggcgugcccgacaccgacgccgccuuccugcugagcaucgugggcuucguggacaucguggccagacccgccugcggcgcccuggccggccuggccagacugagaccccacgugcccuaccuguucagccuggcccugcuggccaacggccugaccgaccugagcagcgccagagccagaagcuacggcgcccugguggccuucugcguggccuucggccugagcuacggcauggugggcgcccugcaguucgaggugcugauggccgccgugggcgcccccagauuccccagcgcccugggccuggugcugcugguggaggccgccgccgugcugaucggcccccccagcgccggcagacugguggacgugcugaagaacuacgagaucaucuucuaccuggccggcagcgagguggcccuggccggcguguucauggccguggccaccaacugcugccugagaugcgccaaggccgcccccagcggccccggcaccgagggcggcgccagcgacaccgaggacgccgaggccgagggcgacagcgagccccugcccgugguggccgaggagcccggcaaccuggaggcccuggaggugcugagcgccagaggcgagcccaccgagcccgagaucgaggccagacccagacuggccgccgagagcguguaa

SEQ ID NO: 23418 - RNA, 1530 nt, Artificial Sequence
  SLC16A9__Homo_sapiens__NP_919274
auggagcugaagaagagccccgacggcggcuggggcugggugaucguguucgugagcuuccugacccaguuccugugcuacggcagcccccuggccgugggcgugcuguacaucgaguggcuggacgccuucggcgagggcaagggcaagaccgccugggugggcagccuggccagcggcgugggccugcuggccagccccgugugcagccugugcgugagcagcuucggcgccagacccgugaccaucuucagcggcuucaugguggccggcggccugaugcugagcagcuucgcccccaacaucuacuuccuguucuucagcuacggcaucguggugggccugggcugcggccugcuguacaccgccaccgugaccaucaccugccaguacuucgacgacagaagaggccuggcccugggccugaucagcaccggcagcagcgugggccuguucaucuacgccgcccugcagagaaugcugguggaguucuacggccuggacggcugccugcugaucgugggcgcccuggcccugaacauccuggccugcggcagccugaugagaccccugcagagcagcgacugcccccugcccaagaagaucgcccccgaggaccugcccgacaaguacagcaucuacaacgagaagggcaagaaccuggaggagaacaucaacauccuggacaagagcuacagcagcgaggagaagugcagaaucacccuggccaacggcgacuggaagcaggacagccugcugcacaagaaccccaccgugacccacaccaaggagcccgagaccuacaagaagaagguggccgagcagaccuacuucugcaagcagcuggccaagagaaaguggcagcuguacaagaacuacugcggcgagaccguggcccuguucaagaacaagguguucagcgcccuguucaucgccauccugcuguucgacaucggcggcuucccccccagccugcugauggaggacguggccagaagcagcaacgugaaggaggaggaguucaucaugccccugaucagcaucaucggcaucaugaccgccgugggcaagcugcugcugggcauccuggccgacuucaaguggaucaacacccuguaccuguacguggccacccugaucaucaugggccuggcccugugcgccauccccuucgccaagagcuacgugacccuggcccugcugagcggcauccugggcuuccugaccggcaacuggagcaucuuccccuacgugaccaccaagaccgugggcaucgagaagcuggcccacgccuacggcauccugauguucuucgccggccugggcaacagccugggcccccccaucgugggcugguucuacgacuggacccagaccuacgacaucgccuucuacuucagcggcuucugcgugcugcugggcggcuucauccugcugcuggccgcccugcccagcugggacaccugcaacaagcagcugcccaagcccgcccccaccaccuuccuguacaagguggccagcaacguguaa

SEQ ID NO: 23419 - RNA, 1404 nt, Artificial Sequence
  SLC17A1__Homo_sapiens__NP_005065
augcagauggacaacagacugccccccaagaaggugcccggcuucugcagcuucagauacggccugagcuuccuggugcacugcugcaacgugaucaucaccgcccagagagccugccugaaccugaccaugguggugauggugaacagcaccgacccccacggccugcccaacaccagcaccaagaagcugcuggacaacaucaagaaccccauguacaacuggagccccgacauccagggcaucauccugagcagcaccagcuacggcgugaucaucauccaggugcccgugggcuacuucagcggcaucuacagcaccaagaagaugaucggcuucgcccugugccugagcagcgugcugagccugcugaucccccccgccgccggcaucggcguggccugggugguggugugcagagccgugcagggcgccgcccagggcaucguggccaccgcccaguucgagaucuacgugaagugggcccccccccuggagagaggcagacugaccagcaugagcaccagcggcuuccugcugggccccuucaucgugcugcuggugaccggcgugaucugcgagagccugggcuggcccaugguguucuacaucuucggcgccugcggcugcgccgugugccugcugugguucgugcuguucuacgacgaccccaaggaccaccccugcaucagcaucagcgagaaggaguacaucaccagcagccuggugcagcaggugagcagcagcagacagagccugcccaucaaggccauccugaagagccugcccgugugggccaucagcaccggcagcuucaccuucuucuggagccacaacaucaugacccuguacacccccauguucaucaacagcaugcugcacgugaacaucaaggagaacggcuuccugagcagccugcccuaccuguucgccuggaucugcggcaaccuggccggccagcugagcgacuucuuccugaccagaaacauccugagcgugaucgccgugagaaagcuguucaccgccgccggcuuccugcugcccgccaucuucggcgugugccugcccuaccugagcagcaccuucuacagcaucgugaucuuccugauccuggccggcgccaccggcagcuucugccugggcggcguguucaucaacggccuggacaucgcccccagauacuucggcuucaucaaggccugcagcacccugaccggcaugaucggcggccugaucgccagcacccugaccggccugauccugaagcaggaccccgagagcgccugguucaagaccuucauccugauggccgccaucaacgugaccggccugaucuucuaccugaucguggccaccgccgagauccaggacugggccaaggagaagcagcacaccagacuguaa

SEQ ID NO: 23420 - RNA, 1437 nt, Artificial Sequence
  SLC17A2__Homo_sapiens__NP_001273052
auggacggcaagcccgccaccagaaagggccccgacuucugcagccugagauacggccuggcccugaucaugcacuucagcaacuucaccaugaucacccagagagugagccugagcaucgccaucaucgccauggugaacaccacccagcagcagggccugagcaacgccagcaccgagggccccguggccgacgccuucaacaacagcagcaucagcaucaaggaguucgacaccaaggccagcguguaccaguggagccccgagacccagggcaucaucuucagcagcaucaacuacggcaucauccugacccugauccccagcggcuaccuggccggcaucuucggcgccaagaagaugcugggcgccggccugcugaucagcagccugcugacccuguucaccccccuggccgccgacuucggcgugauccuggugaucauggugagaaccgugcagggcauggcccagggcauggccuggaccggccaguucaccaucugggccaagugggcccccccccuggagagaagcaagcugaccaccaucgccggcagcggcagcgccuucggcagcuucaucauccugugcgugggcggccugaucagccaggcccugagcuggcccuucaucuucuacaucuucggcagcaccggcugcgugugcugccugcugugguucaccgugaucuacgacgaccccaugcaccaccccugcaucagcgugagagagaaggagcacauccugagcagccuggcccagcagcccagcagccccggcagagccgugcccaucaaggccauggugaccugccugccccugugggccaucuuccugggcuucuucagccacuucuggcugugcaccaucauccugaccuaccugcccaccuacaucagcacccugcugcacgugaacaucagagacagcggcgugcugagcagccugcccuucaucgccgccgccagcugcaccauccugggcggccagcuggccgacuuccugcugagcagaaaccugcugagacugaucaccgugagaaagcuguucagcagccugggccugcugcugcccagcaucugcgccguggcccugcccuucguggccagcagcuacgugaucaccaucauccugcugauccugauccccggcaccagcaaccugugcgacagcggcuucaucaucaacacccuggacaucgcccccagauacgccagcuuccugaugggcaucagcagaggcuucggccugaucgccggcaucaucagcagcaccgccaccggcuuccugaucagccaggacuucgagagcggcuggagaaacguguucuuccugagcgccgccgugaacauguucggccugguguucuaccugaccuucggccaggccgagcugcaggacugggccaaggagagaacccugaccagacuguaa

SEQ ID NO: 23421 - RNA, 1497 nt, Artificial Sequence
  SLC17A3__Homo_sapiens__NP_001091956
auggccaccaagaccgagcugagccccaccgccagagagagcaagaacgcccaggacaugcagguggacgagacccugauccccagaaaggugcccagccugugcagcgccagauacggcaucgcccuggugcugcacuucugcaacuucaccaccaucgcccagaacgugaucaugaacaucaccaugguggccauggugaacagcaccagcccccagagccagcugaacgacagcagcgaggugcugcccguggacagcuucggcggccugagcaaggcccccaagagccugcccgccaaggcccccguguacgacuggagcccccagauccagggcaucaucuucggcgccgugggcuacggcggcauccugaccauggcccccagcggcuaccuggccggcagagugggcaccaagagaguggugggcaucagccuguucgccaccagcuuccugacccugugcaucccccuggccaccgacuucggcaucgugcugcugaucgugaccagaaucgugcagggccugagccagagcagcauccugggcggccaguucgccaucugggagaaguggggccccccccaggagagaagcagacugugcagcaucgcccugagcggcaugcugcugggcugcuucaccgccauccugaucggcggcuucaucagcgagacccugggcuggcccuucguguucuacaucuucggcggcgugggcugcgugugcugccugcugugguucguggugaucuacgacgaccccgugagcuaccccuggaucagcaccagcgagaaggaguacaucaucagcagccugaagcagcaggugggcagcagcaagcagccccugcccaucaaggccaugcugagaagccugcccaucuggagcaucugccugggcugcuucagccaccaguggcuggugagcaccauggugguguacauccccaccuacaucagcagcguguaccacgugaacaucagagacaacggccugcugagcgcccugcccuucaucguggccugggugaucggcauggugggcggcuaccuggccgacuuccugcugaccaagaaguucagacugaucaccgugagaaagaucgccaccauccugggcagccugcccagcagcgcccugaucgugagccugcccuaccugaacagcggcuacaucaccgccaccgcccugcugacccugagcugcggccugagcacccugugccagagcggcaucuacaucaacgugcuggacaucgcccccagauacagcagcuuccugaugggcgccagcagaggcuucagcagcaucgcccccgugaucgugcccaccgugagcggcuuccugcugagccaggaccccgaguucggcuggagaaacguguucuuccugcuguucgccgugaaccugcugggccugcuguucuaccugaucuucggcgaggccgacgugcaggagugggccaaggagagaaagcugaccagacuguaa

SEQ ID NO: 23422 - RNA, 1494 nt, Artificial Sequence
  SLC17A4__Homo_sapiens__NP_005486
augagcaccggccccgacgugaaggccaccgugggcgacaucagcagcgacggcaaccugaacguggcccaggaggagugcagcagaaagggcuucugcagcgugagacacggccuggcccugauccugcagcugugcaacuucagcaucuacacccagcagaugaaccugagcaucgccauccccgccauggugaacaacaccgccccccccagccagcccaacgccagcaccgagagacccagcaccgacagccagggcuacuggaacgagacccugaaggaguucaaggccauggcccccgccuacgacuggagccccgagauccagggcaucauccugagcagccugaacuacggcagcuuccuggcccccauccccagcggcuacguggccggcaucuucggcgccaaguacguggugggcgccggccuguucaucagcagcuuccugacccuguucaucccccuggccgccaacgccggcguggcccugcugaucgugcugagaaucgugcagggcaucgcccaggugauggugcugaccggccaguacagcaucugggugaagugggcccccccccuggagagaagccagcugaccaccaucgccggcagcggcagcaugcugggcagcuucaucgugcugcuggccggcggccugcugugccagaccaucggcuggcccuacguguucuacaucuucggcggcaucggcugcgccugcugcccccugugguucccccugaucuacgacgaccccgugaaccaccccuucaucagcgccggcgagaagagauacaucgugugcagccuggcccagcaggacugcagccccggcuggagccugcccaucagagccaugaucaagagccugccccugugggccauccuggugagcuacuucugcgaguacuggcuguucuacaccaucauggccuacacccccaccuacaucagcagcgugcugcaggccaaccugagagacagcggcauccugagcgcccugcccuucguggugggcugcaucugcaucauccugggcggccugcuggccgacuuccugcugagcagaaagauccugagacugaucaccaucagaaagcuguucaccgccaucggcgugcuguuccccagcgugauccuggugagccugcccugggugagaagcagccacagcaugaccaugaccuuccuggugcugagcagcgccaucagcagcuucugcgagagcggcgcccuggugaacuuccuggacaucgcccccagauacaccggcuuccugaagggccugcugcagguguucgcccacaucgccggcgccaucagccccaccgccgccggcuucuucaucagccaggacagcgaguucggcuggagaaacguguuccugcugagcgccgccgugaacaucagcggccugguguucuaccugaucuucggcagagccgacgugcaggacugggccaaggagcagaccuucacccaccuguaa

SEQ ID NO: 23423 - RNA, 1488 nt, Artificial Sequence
  SLC17A5__Homo_sapiens__NP_036566
augagaagccccgugagagaccuggccagaaacgacggcgaggagagcaccgacagaaccccccugcugcccggcgcccccagagccgaggccgcccccgugugcugcagcgccagauacaaccuggccauccuggccuucuucggcuucuucaucguguacgcccugagagugaaccugagcguggcccugguggacaugguggacagcaacaccacccuggaggacaacagaaccagcaaggccugccccgagcacagcgcccccaucaaggugcaccacaaccagaccggcaagaaguaccagugggacgccgagacccagggcuggauccugggcagcuucuucuacggcuacaucaucacccagauccccggcggcuacguggccagcaagaucggcggcaagaugcugcugggcuucggcauccugggcaccgccgugcugacccuguucacccccaucgccgccgaccugggcgugggcccccugaucgugcugagagcccuggagggccugggcgagggcgugaccuuccccgccaugcacgccauguggagcagcugggcccccccccuggagagaagcaagcugcugagcaucagcuacgccggcgcccagcugggcaccgugaucagccugccccugagcggcaucaucugcuacuacaugaacuggaccuacguguucuacuucuucggcaccaucggcaucuucugguuccugcuguggaucuggcuggugagcgacaccccccagaagcacaagagaaucagccacuacgagaaggaguacauccugagcagccugagaaaccagcugagcagccagaagagcgugcccugggugcccauccugaagagccugccccugugggccaucgugguggcccacuucagcuacaacuggaccuucuacacccugcugacccugcugcccaccuacaugaaggagauccugagauucaacgugcaggagaacggcuuccugagcagccugcccuaccugggcagcuggcugugcaugauccugagcggccaggccgccgacaaccugagagccaaguggaacuucagcacccugugcgugagaagaaucuucagccugaucggcaugaucggccccgccguguuccugguggccgccggcuucaucggcugcgacuacagccuggccguggccuuccugaccaucagcaccacccugggcggcuucugcagcagcggcuucagcaucaaccaccuggacaucgcccccagcuacgccggcauccugcugggcaucaccaacaccuucgccaccauccccggcauggugggccccgugaucgccaagagccugacccccgacaacaccgugggcgaguggcagaccguguucuacaucgccgccgccaucaacguguucggcgccaucuucuucacccuguucgccaagggcgaggugcagaacugggcccugaacgaccaccacggccacagacacuaa

SEQ ID NO: 23424 - RNA, 1749 nt, Artificial Sequence
  SLC17A6__Homo_sapiens__NP_065079
auggagagcgugaagcagagaauccuggcccccggcaaggagggccugaagaacuucgccggcaagagccugggccagaucuacagagugcuggagaagaagcaggacaccggcgagaccaucgagcugaccgaggacggcaagccccuggaggugcccgagagaaaggccccccugugcgacugcaccugcuucggccugcccagaagauacaucaucgccaucaugagcggccugggcuucugcaucagcuucggcaucagaugcaaccugggcguggccaucguggacauggugaacaacagcaccauccacagaggcggcaaggugaucaaggagaaggccaaguucaacugggaccccgagaccgugggcaugauccacggcagcuucuucuggggcuacaucaucacccagauccccggcggcuacaucgccagcagacuggccgccaacagaguguucggcgccgccauccugcugaccagcacccugaacaugcugauccccagcgccgccagagugcacuacggcugcgugaucuucgugagaauccugcagggccugguggagggcgugaccuaccccgccugccacggcaucuggagcaagugggcccccccccuggagagaagcagacuggccaccaccagcuucugcggcagcuacgccggcgccgugaucgccaugccccuggccggcauccuggugcaguacaccggcuggagcagcguguucuacguguacggcagcuucggcauggugugguacauguucuggcugcuggugagcuacgagagccccgccaagcaccccaccaucaccgacgaggagagaagauacaucgaggagagcaucggcgagagcgccaaccugcugggcgccauggagaaguucaagacccccuggagaaaguucuucaccagcaugcccguguacgccaucaucguggccaacuucugcagaagcuggaccuucuaccugcugcugaucagccagcccgccuacuucgaggagguguucggcuucgagaucagcaaggugggcaugcugagcgccgugccccaccuggugaugaccaucaucgugcccaucggcggccagaucgccgacuuccugagaagcaagcagauccugagcaccaccaccgugagaaagaucaugaacugcggcggcuucggcauggaggccacccugcugcugguggugggcuacagccacaccagaggcguggccaucagcuuccuggugcuggccgugggcuucagcggcuucgccaucagcggcuucaacgugaaccaccuggacaucgcccccagauacgccagcauccugaugggcaucagcaacggcgugggcacccugagcggcauggugugccccaucaucgugggcgccaugaccaagaacaagagcagagaggaguggcaguacguguuccugaucgccgcccuggugcacuacggcggcgugaucuucuacgccaucuucgccagcggcgagaagcagcccugggccgaccccgaggagaccagcgaggagaagugcggcuucauccacgaggacgagcuggacgaggagaccggcgacaucacccagaacuacaucaacuacggcaccaccaagagcuacggcgccaccacccaggccaacggcggcuggcccagcggcugggagaagaaggaggaguucgugcagggcgaggugcaggacagccacagcuacaaggacagaguggacuacagcuaa

SEQ ID NO: 23425 - RNA, 1683 nt, Artificial Sequence
  SLC17A7__Homo_sapiens__NP_064705
auggaguucagacaggaggaguucagaaagcuggccggcagagcccugggcaagcugcacagacugcuggagaagagacaggagggcgccgagacccuggagcugagcgccgacggcagacccgugaccacccagaccagagacccccccgugguggacugcaccugcuucggccugcccagaagauacaucaucgccaucaugagcggccugggcuucugcaucagcuucggcaucagaugcaaccugggcguggccaucgugagcauggugaacaacagcaccacccacagaggcggccacgugguggugcagaaggcccaguucagcugggaccccgagaccgugggccugauccacggcagcuucuucuggggcuacaucgugacccagauccccggcggcuucaucugccagaaguucgccgccaacagaguguucggcuucgccaucguggccaccagcacccugaacaugcugauccccagcgccgccagagugcacuacggcugcgugaucuucgugagaauccugcagggccugguggagggcgugaccuaccccgccugccacggcaucuggagcaagugggcccccccccuggagagaagcagacuggccaccaccgccuucugcggcagcuacgccggcgccgugguggccaugccccuggccggcgugcuggugcaguacagcggcuggagcagcguguucuacguguacggcagcuucggcaucuucugguaccuguucuggcugcuggugagcuacgagagccccgcccugcaccccagcaucagcgaggaggagagaaaguacaucgaggacgccaucggcgagagcgccaagcugaugaacccccugaccaaguucagcacccccuggagaagauucuucaccagcaugcccguguacgccaucaucguggccaacuucugcagaagcuggaccuucuaccugcugcugaucagccagcccgccuacuucgaggagguguucggcuucgagaucagcaaggugggccuggugagcgcccugccccaccuggugaugaccaucaucgugcccaucggcggccagaucgccgacuuccugagaagcagaagaaucaugagcaccaccaacgugagaaagcugaugaacugcggcggcuucggcauggaggccacccugcugcugguggugggcuacagccacagcaagggcguggccaucagcuuccuggugcuggccgugggcuucagcggcuucgccaucagcggcuucaacgugaaccaccuggacaucgcccccagauacgccagcauccugaugggcaucagcaacggcgugggcacccugagcggcauggugugccccaucaucgugggcgccaugaccaagcacaagaccagagaggaguggcaguacguguuccugaucgccagccuggugcacuacggcggcgugaucuucuacggcguguucgccagcggcgagaagcagcccugggccgagcccgaggagaugagcgaggagaagugcggcuucgugggccacgaccagcuggccggcagcgacgacagcgagauggaggacgaggccgagccccccggcgccccccccgcccccccccccagcuacggcgccacccacagcaccuuccagccccccagaccccccccccccgugagagacuacuaa

SEQ ID NO: 23426 - RNA, 1620 nt, Artificial Sequence
  SLC17A8__Homo_sapiens__NP_001138760
augcccuucaaggccuucgacaccuucaaggagaagauccugaagcccggcaaggagggcgugaagaacgccgugggcgacagccugggcauccugcagagaaagaucgacggcaccaccgaggaggaggacaacaucgagcugaacgaggagggcagacccgugcagaccagcagacccagccccccccugugcgacugccacugcugcggccugcccaagagauacaucaucgccaucaugagcggccugggcuucugcaucagcuucggcaucagaugcaaccugggcguggccaucguggagauggugaacaacagcaccguguacguggacggcaagcccgagauccagaccgcccaguucaacugggaccccgagaccgugggccugauccacggcagcuucuucuggggcuacaucaugacccagauccccggcggcuucaucagcaacaaguucgccgccaacagaguguucggcgccgccaucuuccugaccagcacccugaacauguucauccccagcgccgccagagugcacuacggcugcgugaugugcgugagaauccugcagggccugguggagggcgugaccuaccccgccugccacggcauguggagcaagugggcccccccccuggagagaagcagacuggccaccaccagcuucugcggcagcuacgccggcgccgugguggccaugccccuggccggcgugcuggugcaguacaucggcuggagcagcguguucuacaucuacggcauguucggcaucaucugguacauguucuggcugcugcaggccuacgagugccccgccgcccaccccaccaucagcaacgaggagaagaccuacaucgagaccagcaucggcgagggcgccaacguggugagccugagcgugggccugcugagcgccgugccccacauggugaugaccaucguggugcccaucggcggccagcuggccgacuaccugagaagcagacagauccugaccaccaccgccgugagaaagaucaugaacugcggcggcuucggcauggaggccacccugcugcugguggugggcuucagccacaccaagggcguggccaucagcuuccuggugcuggccgugggcuucagcggcuucgccaucagcggcuucaacgugaaccaccuggacaucgcccccagauacgccagcauccugaugggcaucagcaacggcgugggcacccugagcggcauggugugcccccugaucgugggcgccaugaccagacacaagaccagagaggaguggcagaacguguuccugaucgccgcccuggugcacuacagcggcgugaucuucuacggcguguucgccagcggcgagaagcaggagugggccgaccccgagaaccugagcgaggagaagugcggcaucaucgaccaggacgagcuggccgaggagaucgagcugaaccacgagagcuucgccagccccaagaagaagaugagcuacggcgccaccagccagaacugcgaggugcagaagaaggaguggaagggccagagaggcgccacccuggacgaggaggagcugaccagcuaccagaacgaggagagaaacuucagcaccaucagcuaa

SEQ ID NO: 23427 - RNA, 1578 nt, Artificial Sequence
  SLC18A1__Homo_sapiens__XP_011542926
augcugagaaccauccuggacgccccccagagacugcugaaggagggcagagccagcagacagcuggugcugguggugguguucguggcccugcugcuggacaacaugcuguucaccgugguggugcccaucgugcccaccuuccuguacgacauggaguucaaggaggugaacagcagccugcaccugggccacgccggcagcagcccccacgcccuggccagccccgccuucagcaccaucuucagcuucuucaacaacaacaccguggccguggaggagagcgugcccagcggcaucgccuggaugaacgacaccgccagcaccauccccccccccgccaccgaggccaucagcgcccacaagaacaacugccugcagggcaccggcuuccuggaggaggagaucaccagagugggcgugcuguucgccagcaaggccgugaugcagcugcuggugaaccccuucgugggcccccugaccaacagaaucggcuaccacauccccauguucgccggcuucgugaucauguuccugagcaccgugauguucgccuucagcggcaccuacacccugcuguucguggccagaacccugcagggcaucggcagcagcuucagcagcguggccggccugggcaugcuggccagcguguacaccgacgaccacgagagaggcagagccaugggcaccgcccugggcggccuggcccugggccugcuggugggcgcccccuucggcagcgugauguacgaguucgugggcaagagcgcccccuuccugauccuggccuuccuggcccugcuggacggcgcccugcagcugugcauccugcagcccagcaaggugagccccgagagcgccaagggcaccccccuguucaugcugcugaaggaccccuacauccugguggccgccggcagcaucugcuucgccaacaugggcguggccauccuggagcccacccugcccaucuggaugaugcagaccaugugcagccccaaguggcagcugggccuggccuuccugcccgccagcgugagcuaccugaucggcaccaaccuguucggcgugcuggccaacaagaugggcagauggcugugcagccugaucggcaugcugguggugggcaccagccugcugugcgugccccuggcccacaacaucuucggccugaucggccccaacgccggccugggccuggccaucggcaugguggacagcagcaugaugcccaucaugggccaccugguggaccugagacacaccagcguguacggcagcguguacgccaucgccgacguggccuucugcaugggcuucgccaucggccccagcaccggcggcgccaucgugaaggccaucggcuuccccuggcugauggugaucaccggcgugaucaacaucguguacgccccccugugcuacuaccugagaagcccccccgccaaggaggagaagcuggccauccugagccaggacugccccauggagaccagaauguacgccacccagaagcccaccaaggaguucccccugggcgaggacagcgacgaggagcccgaccacgaggaguaa

SEQ ID NO: 23428 - RNA, 1545 nt, Artificial Sequence
  SLC18A2__Homo_sapiens__NP_003045
auggcccugagcgagcuggcccuggugagauggcugcaggagagcagaagaagcagaaagcugauccuguucaucguguuccuggcccugcugcuggacaacaugcugcugaccgugguggugcccaucauccccagcuaccuguacagcaucaagcacgagaagaacgccaccgagauccagaccgccagacccgugcacaccgccagcaucagcgacagcuuccagagcaucuucagcuacuacgacaacagcaccauggugaccggcaacgccaccagagaccugacccugcaccagaccgccacccagcacauggugaccaacgccagcgccgugcccagcgacugccccagcgaggacaaggaccugcugaacgagaacgugcaggugggccugcuguucgccagcaaggccaccgugcagcugaucaccaaccccuucaucggccugcugaccaacagaaucggcuaccccauccccaucuucgccggcuucugcaucauguucgugagcaccaucauguucgccuucagcagcagcuacgccuuccugcugaucgccagaagccugcagggcaucggcagcagcugcagcagcguggccggcaugggcaugcuggccagcguguacaccgacgacgaggagagaggcaacgugaugggcaucgcccugggcggccuggccaugggcgugcuggugggcccccccuucggcagcgugcuguacgaguucgugggcaagaccgcccccuuccuggugcuggccgcccuggugcugcuggacggcgccauccagcuguucgugcugcagcccagcagagugcagcccgagagccagaagggcaccccccugaccacccugcugaaggaccccuacauccugaucgccgccggcagcaucugcuucgccaacaugggcaucgccaugcuggagcccgcccugcccaucuggaugauggagaccaugugcagcagaaaguggcagcugggcguggccuuccugcccgccagcaucagcuaccugaucggcaccaacaucuucggcauccuggcccacaagaugggcagauggcugugcgcccugcugggcaugaucaucgugggcgugagcauccugugcauccccuucgccaagaacaucuacggccugaucgcccccaacuucggcgugggcuucgccaucggcaugguggacagcagcaugaugcccaucaugggcuaccugguggaccugagacacgugagcguguacggcagcguguacgccaucgccgacguggccuucugcaugggcuacgccaucggccccagcgccggcggcgccaucgccaaggccaucggcuuccccuggcugaugaccaucaucggcaucaucgacauccuguucgccccccugugcuucuuccugagaagcccccccgccaaggaggagaagauggccauccugauggaccacaacugccccaucaagaccaagauguacacccagaacaacauccagagcuaccccaucggcgaggacgaggagagcgagagcgacuaa

SEQ ID NO: 23429 - RNA, 1599 nt, Artificial Sequence
  SLC18A3__Homo_sapiens__NP_003046
auggagagcgccgagcccgccggccaggccagagccgccgccaccaagcugagcgaggccgugggcgccgcccugcaggagcccagaagacagagaagacuggugcuggugaucgugugcguggcccugcugcuggacaacaugcuguacauggugaucgugcccaucgugcccgacuacaucgcccacaugagaggcggcggcgagggccccaccagaacccccgaggugugggagcccacccugccccugcccacccccgccaacgccagcgccuacaccgccaacaccagcgccagccccaccgccgccuggcccgccggcagcgcccugagacccagauaccccaccgagagcgaggacgugaagaucggcgugcuguucgccagcaaggccauccugcagcugcuggugaacccccugagcggccccuucaucgacagaaugagcuacgacgugccccugcugaucggccugggcgugauguucgccagcaccgugcuguucgccuucgccgaggacuacgccacccuguucgccgccagaagccugcagggccugggcagcgccuucgccgacaccagcggcaucgccaugaucgccgacaaguaccccgaggagcccgagagaagcagagcccugggcguggcccuggccuucaucagcuucggcagccugguggccccccccuucggcggcauccuguacgaguucgccggcaagagagugcccuuccuggugcuggccgccgugagccuguucgacgcccugcugcugcuggccguggccaagcccuucagcgccgccgccagagccagagccaaccugcccgugggcacccccauccacagacugaugcuggaccccuacaucgccgugguggccggcgcccugaccaccugcaacaucccccuggccuuccuggagcccaccaucgccaccuggaugaagcacaccauggccgccagcgagugggagaugggcauggccuggcugcccgccuucgugccccacgugcugggcguguaccugaccgugagacuggccgccagauacccccaccugcaguggcuguacggcgcccugggccuggccgugaucggcgccagcagcugcaucgugcccgccugcagaagcuucgccccccugguggugagccugugcggccugugcuucggcaucgcccugguggacaccgcccugcugcccacccuggccuuccugguggacgugagacacgugagcguguacggcagcguguacgccaucgccgacaucagcuacagcguggccuacgcccugggccccaucguggccggccacaucgugcacagccugggcuucgagcagcugagccugggcaugggccuggccaaccugcuguacgcccccgugcugcugcugcugagaaacgugggccugcugaccagaagcagaagcgagagagacgugcugcuggacgagcccccccagggccuguacgacgccgugagacugagagagagacccgugagcggccaggacggcgagcccagaagcccccccggccccuucgacgccugcgaggacgacuacaacuacuacuacaccagaagcuaa

SEQ ID NO: 23430 - RNA, 1470 nt, Artificial Sequence
  SLC19A1__Homo_sapiens__NP_001192135
auggugcccagcagccccgccguggagaagcaggugcccguggagcccggccccgaccccgagcugagaagcuggagacaccuggugugcuaccugugcuucuacggcuucauggcccagaucagacccggcgagagcuucaucacccccuaccugcugggccccgacaagaacuucaccagagagcaggugaccaacgagaucacccccgugcugagcuacagcuaccuggccgugcuggugcccguguuccugcugaccgacuaccugagauacacccccgugcugcugcugcagggccugagcuucgugagcguguggcugcugcugcugcugggccacagcguggcccacaugcagcugauggagcuguucuacagcgugaccauggccgccagaaucgccuacagcagcuacaucuucagccuggugagacccgccagauaccagagaguggccggcuacagcagagccgccgugcugcugggcguguucaccagcagcgugcugggccagcugcuggugaccgugggcagagugagcuucagcacccugaacuacaucagccuggccuuccugaccuucagcguggugcuggcccuguuccugaagagacccaagagaagccuguucuucaacagagacgacagaggcagaugcgagaccagcgccagcgagcuggagagaaugaaccccggccccggcggcaagcugggccacgcccugagaguggccugcggcgacagcgugcuggccagaaugcugagagagcugggcgacagccugagaagaccccagcugagacuguggagccugugguggguguucaacagcgccggcuacuaccuggugguguacuacgugcacauccuguggaacgagguggaccccaccaccaacagcgccagaguguacaacggcgccgccgacgccgccagcacccugcugggcgccaucaccagcuucgccgccggcuucgugaagaucagaugggccagauggagcaagcugcugaucgccggcgugaccgccacccaggccggccugguguuccugcuggcccacaccagacaccccagcagcaucuggcugugcuacgccgccuucgugcuguucagaggcagcuaccaguuccuggugcccaucgccaccuuccagaucgccagcagccugagcaaggagcugugcgcccugguguucggcgugaacaccuucuucgccaccaucgugaagaccaucaucaccuucaucgugagcgacgugagaggccugggccugcccgugagaaagcagaacgaggagcugcacguggccagccugagccuguggaagagccaccugagacuggccgccgacacccugagcagcgagggcagcagcggcagcggccccagaagcugguuccugagccccacccugagagccgcccugcacggccccgugugccccagcgaggugugccccagcuaa

SEQ ID NO: 23431 - RNA, 1494 nt, Artificial Sequence
  SLC19A2__Homo_sapiens__NP_008927
auggacgugcccggccccgugagcagaagagccgccgccgccgccgccaccgugcugcugagaaccgccagagugagaagagagugcugguuccugcccaccgcccugcugugcgccuacggcuucuucgccagccugagacccagcgagcccuuccugacccccuaccugcugggccccgacaagaaccugaccgagagagagguguucaacgagaucuaccccguguggaccuacagcuaccuggugcugcuguuccccguguuccuggccaccgacuaccugagauacaagcccguggugcugcugcagggccugagccugaucgugaccugguucaugcugcuguacgcccagggccugcuggccauccaguuccuggaguucuucuacggcaucgccaccgccaccgagaucgccuacuacagcuacaucuacagcgugguggaccugggcauguaccagaaggugaccagcuacugcagaagcgccacccuggugggcuucaccgugggcagcgugcugggccagauccuggugagcguggccggcuggagccuguucagccugaacgugaucagccugaccugcgugagcguggccuucgccguggccugguuccugcccaugccccagaagagccuguucuuccaccacauccccagcaccugccagagagugaacggcaucaaggugcagaacggcggcaucgugaccgacacccccgccagcaaccaccugcccggcugggaggacaucgagagcaagaucccccugaacauggaggagccccccguggaggagcccgagcccaagcccgacagacugcuggugcugaaggugcuguggaacgacuuccugaugugcuacagcagcagaccccugcugugcuggagcguguggugggcccugagcaccugcggcuacuuccagguggugaacuacacccagggccugugggagaaggugaugcccagcagauacgccgccaucuacaacggcggcguggaggccgugagcacccugcugggcgccguggccguguucgccgugggcuacaucaagaucagcuggagcaccuggggcgagaugacccugagccuguucagccugcugaucgccgccgccguguacaucauggacaccgugggcaacaucugggugugcuacgccagcuacgugguguucagaaucaucuacaugcugcugaucaccaucgccaccuuccagaucgccgccaaccugagcauggagagauacgcccugguguucggcgugaacaccuucaucgcccuggcccugcagacccugcugacccugaucgugguggacgccagcggccugggccuggagaucaccacccaguuccugaucuacgccagcuacuucgcccugaucgccgugguguuccuggccagcggcgccgugagcgugaugaagaagugcagaaagcuggaggacccccagagcagcagccaggugaccaccagcuaa

SEQ ID NO: 23432 - RNA, 1479 nt, Artificial Sequence
  SLC19A3__Homo_sapiens__XP_005246931
augaacccccugggcagcgccagcagagccaccguggaccagcugaccgaccugcccagcaaggagcagcugagcugcgugguguucgcccuguggccccccgccuucagcagcaaccugagcgaccccggcgugaagaucaccaacgagaucuuccccguguggaccuacagcuaccuggugcugcugcugcccguguucgugcugaccgacuacgugagauacaagcccgugaucauccugcagggcaucagcuucaucaucaccuggcugcugcugcuguucggccagggcgugaagaccaugcaggugguggaguucuucuacggcauggugaccgccgccgagguggccuacuacgccuacaucuacagcguggugagccccgagcacuaccagagagugagcggcuacugcagaagcgugacccuggccgccuacaccgccggcagcgugcuggcccagcugcuggugagccuggccaacaugagcuacuucuaccugaacgugaucagccuggccagcgugagcguggccuuccuguucagccuguuccugcccaugcccaagaagagcauguucuuccacgccaagcccagcagagagaucaagaagagcagcagcgugaaccccgugcuggaggagacccacgagggcgaggcccccggcugcgaggagcagaagcccaccagcgagauccugagcaccagcggcaagcugaacaagggccagcugaacagccugaagcccagcaacgugaccguggacguguucgugcagugguuccaggaccugaaggagugcuacagcagcaagagacuguucuacuggagccuguggugggccuucgccaccgccggcuucaaccaggugcugaacuacgugcagauccugugggacuacaaggcccccagccaggacagcagcaucuacaacggcgccguggaggccaucgccaccuucggcggcgccguggccgccuucgccgugggcuacgugaaggugaacugggaccugcugggcgagcuggcccuggugguguucagcguggugaacgccggcagccuguuccugaugcacuacaccgccaacaucugggccugcuacgccggcuaccugaucuucaagagcagcuacaugcugcugaucaccaucgccguguuccagaucgccgugaaccugaacguggagagauacgcccugguguucggcaucaacaccuucaucgcccuggugauccagaccaucaugaccgugaucgugguggaccagagaggccugaaccugcccgugagcauccaguuccugguguacggcagcuacuucgccgugaucgccggcaucuuccugaugagaagcauguacaucaccuacagcaccaagagccagaaggacgugcagagccccgcccccagcgagaaccccgacgugagccaccccgaggaggagagcaacaucaucaugagcaccaagcuguaa

SEQ ID NO: 23433 - RNA, 1575 nt, Artificial Sequence
  SLC1A1__Homo_sapiens__NP_004161
augggcaagcccgccagaaagggcugcgaguggaagagauuccugaagaacaacugggugcugcugagcaccguggccgccguggugcugggcaucaccaccggcgugcuggugagagagcacagcaaccugagcacccuggagaaguucuacuucgccuuccccggcgagauccugaugagaaugcugaagcugaucauccugccccugaucaucagcagcaugaucaccggcguggccgcccuggacagcaacgugagcggcaagaucggccugagagccgugguguacuacuucugcaccacccugaucgccgugauccugggcaucgugcugguggugagcaucaagcccggcgugacccagaaggugggcgagaucgccagaaccggcagcacccccgaggugagcaccguggacgccaugcuggaccugaucagaaacauguuccccgagaaccuggugcaggccugcuuccagcaguacaagaccaagagagaggaggugaagccccccagcgaccccgagaugaacaugaccgaggagagcuucaccgccgugaugaccaccgccaucagcaagaacaagaccaaggaguacaagaucgugggcauguacagcgacggcaucaacgugcugggccugaucguguucugccugguguucggccuggugaucggcaagaugggcgagaagggccagauccugguggacuucuucaacgcccugagcgacgccaccaugaagaucgugcagaucaucaugugcuacaugccccugggcauccuguuccugaucgccggcaagaucaucgagguggaggacugggagaucuucagaaagcugggccuguacauggccaccgugcugaccggccuggccauccacagcaucgugauccugccccugaucuacuucaucguggugagaaagaaccccuucagauucgccaugggcauggcccaggcccugcugaccgcccugaugaucagcagcagcagcgccacccugcccgugaccuucagaugcgccgaggagaacaaccagguggacaagagaaucaccagauucgugcugcccgugggcgccaccaucaacauggacggcaccgcccuguacgaggccguggccgccguguucaucgcccagcugaacgaccuggaccugggcaucggccagaucaucaccaucagcaucaccgccaccagcgccagcaucggcgccgccggcgugccccaggccggccuggugaccauggugaucgugcugagcgccgugggccugcccgccgaggacgugacccugaucaucgccguggacuggcugcuggacagauucagaaccauggugaacgugcugggcgacgccuucggcaccggcaucguggagaagcugagcaagaaggagcuggagcagauggacgugagcagcgaggugaacaucgugaaccccuucgcccuggagagcaccauccuggacaacgaggacagcgacaccaagaagagcuacgugaacggcggcuucgccguggacaagagcgacaccaucagcuucacccagaccagccaguucuaa

SEQ ID NO: 23434 - RNA, 1698 nt, Artificial Sequence
  SLC1A2__Homo_sapiens__NP_001182657
augcccaagcagguggaggugagaaugcacgacagccaccugggcagcgaggagcccaagcacagacaccugggccugagacugugcgacaagcugggcaagaaccugcugcugacccugaccguguucggcgugauccugggcgccgugugcggcggccugcugagacuggccagccccauccaccccgacguggugaugcugaucgccuuccccggcgacauccugaugagaaugcugaagaugcugauccugccccugaucaucagcagccugaucaccggccugagcggccuggacgccaaggccagcggcagacugggcaccagagccaugguguacuacaugagcaccaccaucaucgccgccgugcugggcgugauccuggugcuggccauccaccccggcaaccccaagcugaagaagcagcugggccccggcaagaagaacgacgaggugagcagccuggacgccuuccuggaccugaucagaaaccuguuccccgagaaccuggugcaggccugcuuccagcagauccagaccgugaccaagaaggugcugguggcccccccccccgacgaggaggccaacgccaccagcgccguggugagccugcugaacgagaccgugaccgaggugcccgaggagaccaagauggugaucaagaagggccuggaguucaaggacggcaugaacgugcugggccugaucggcuucuucaucgccuucggcaucgccaugggcaagaugggcgaccaggccaagcugaugguggacuucuucaacauccugaacgagaucgugaugaagcuggugaucaugaucaugugguacagcccccugggcaucgccugccugaucugcggcaagaucaucgccaucaaggaccuggaggugguggccagacagcugggcauguacauggugaccgugaucaucggccugaucauccacggcggcaucuuccugccccugaucuacuucguggugaccagaaagaaccccuucagcuucuucgccggcaucuuccaggccuggaucaccgcccugggcaccgccagcagcgccggcacccugcccgugaccuucagaugccuggaggagaaccugggcaucgacaagagagugaccagauucgugcugcccgugggcgccaccaucaacauggacggcaccgcccuguacgaggccguggccgccaucuucaucgcccagaugaacggcguggugcuggacggcggccagaucgugaccgugagccugaccgccacccuggccagcgugggcgccgccagcauccccagcgccggccuggugaccaugcugcugauccugaccgccgugggccugcccaccgaggacaucagccugcugguggccguggacuggcugcuggacagaaugagaaccagcgugaacguggugggcgacagcuucggcgccggcaucguguaccaccugagcaagagcgagcuggacaccaucgacagccagcacagagugcacgaggacaucgagaugaccaagacccagagcaucuacgacgacaugaagaaccacagagagagcaacagcaaccagugcguguacgccgcccacaacagcgugaucguggacgagugcaaggugacccuggccgccaacggcaagagcgccgacugcagcguggaggaggagcccuggaagagagagaaguaa

SEQ ID NO: 23435 - RNA, 1494 nt, Artificial Sequence
  SLC1A3__Homo_sapiens__NP_001160167
augaccaagagcaacggcgaggagcccaagaugggcggcagaauggagagauuccagcagggcgugagaaagagaacccugcuggccaagaagaaggugcagaacaucaccaaggaggacgugaagagcuaccuguucagaaacgccuucgugcugcugaccgugaccgccgugaucgugggcaccauccugggcuucacccugagacccuacagaaugagcuacagagaggugaaguacuucagcuuccccggcgagcugcugaugagaaugcugcagaugcuggugcugccccugaucaucagcagccuggugaccggcauggccgcccuggacagcaaggccagcggcaagaugggcaugagagccgugguguacuacaugaccaccaccaucaucgccguggugaucggcaucaucaucgugaucaucauccaccccggcaagggcaccaaggagaacaugcacagagagggcaagaucgugagagugaccgccgccgacgccuuccuggaccugaucagaaacauguucccccccaaccugguggaggccugcuucaagcaguucaagaccaacuacgagaagagaagcuucaaggugcccauccaggccaacgagacccuggugggcgccgugaucaacaacgugagcgaggccauggagacccugaccagaaucaccgaggagcuggugcccgugcccggcagcgugaacggcgugaacgcccugggccuggugguguucagcaugugcuucggcuucgugaucggcaacaugaaggagcagggccaggcccugagagaguucuucgacagccugaacgaggccaucaugagacugguggccgugaucaugugguacgcccccgugggcauccuguuccugaucgccggcaagaucguggagauggaggacaugggcgugaucggcggccagcuggccauguacaccgugaccgugaucgugggccugcugauccacgccgugaucgugcugccccugcuguacuuccuggugaccagaaagaaccccuggguguucaucggcggccugcugcaggcccugaucaccgcccugggcaccagcagcagcagcgccacccugcccaucaccuucaagugccuggaggagaacaacggcguggacaagagagugaccagauucgugcugcccgugggcgccaccaucaacauggacggcaccgcccuguacgaggcccuggccgccaucuucaucgcccaggugaacaacuucgagcugaacuucggccagaucaucaccaucagagacagacugagaaccaccaccaacgugcugggcgacagccugggcgccggcaucguggagcaccugagcagacacgagcugaagaacagagacguggagaugggcaacagcgugaucgaggagaacgagaugaagaagcccuaccagcugaucgcccaggacaacgagaccgagaagcccaucgacagcgagaccaagauguaa

SEQ ID NO: 23436 - RNA, 705 nt, Artificial Sequence
  SLC1A4__Homo_sapiens__NP_001180422
augaacauccugggccuggugcuguucgcccuggugcugggcguggcccugaagaagcugggcagcgagggcgaggaccugaucagauucuucaacagccugaacgaggccaccauggugcuggugagcuggaucaugugcagcgccacccugcccagcaugaugaagugcaucgaggagaacaacggcguggacaagagaaucagcagauucauccugcccaucggcgccaccgugaacauggacggcgccgccaucuuccagugcguggccgccguguucaucgcccagcugaacaacguggagcugaacgccggccagaucuucaccauccuggugaccgccaccgccagcagcgugggcgccgccggcgugcccgccggcggcgugcugaccaucgccaucauccuggaggccaucggccugcccacccacgaccugccccugauccuggccguggacuggaucguggacagaaccaccaccguggugaacguggagggcgacgcccugggcgccggcauccugcaccaccugaaccagaaggccaccaagaagggcgagcaggagcuggccgaggugaagguggaggccauccccaacugcaagagcgaggaggagaccagcccccuggugacccaccagaaccccgccggccccguggccagcgcccccgagcuggagagcaaggagagcgugcuguaa

SEQ ID NO: 23437 - RNA, 942 nt, Artificial Sequence
  SLC1A5__Homo_sapiens__NP_001138616
augaacauccugggccuggugguguucgccaucguguucggcguggcccugagaaagcugggccccgagggcgagcugcugaucagauucuucaacagcuucaacgaggccaccauggugcuggugagcuggaucaugugguacgcccccgugggcaucauguuccugguggccggcaagaucguggagauggaggacgugggccugcuguucgccagacugggcaaguacauccugugcugccugcugggccacgccauccacggccugcuggugcugccccugaucuacuuccuguucaccagaaagaaccccuacagauuccuguggggcaucgugaccccccuggccaccgccuucggcaccagcagcagcagcgccacccugccccugaugaugaagugcguggaggagaacaacggcguggccaagcacaucagcagauucauccugcccaucggcgccaccgugaacauggacggcgccgcccuguuccagugcguggccgccguguucaucgcccagcugagccagcagagccuggacuucgugaagaucaucaccauccuggugaccgccaccgccagcagcgugggcgccgccggcauccccgccggcggcgugcugacccuggccaucauccuggaggccgugaaccugcccguggaccacaucagccugauccuggccguggacuggcugguggacagaagcugcaccgugcugaacguggagggcgacgcccugggcgccggccugcugcagaacuacguggacagaaccgagagcagaagcaccgagcccgagcugauccaggugaagagcgagcugccccuggacccccugcccgugcccaccgaggagggcaacccccugcugaagcacuacagaggccccgccggcgacgccaccguggccagcgagaaggagagcgugauguaa

SEQ ID NO: 23438 - RNA, 939 nt, Artificial Sequence
  SLC1A6__Homo_sapiens__NP_001259017
augagcagccacggcaacagccuguuccugagagagagcggccagagacugggcagagugggcuggcugcagagacugcaggagagccugcagcagagagcccugagaaccagacugagacugcagaccaugacccuggagcacgugcugagauuccugagaagaaacgccuucauccugcugaccgugagcgccguggugaucggcgugagccuggccuucgcccugagacccuaccagcugaccuacagacagaucaaguacuucagcuuccccggcgagcugcugaugagaaugcugcagaugcuggugcugccccugaucgugagcagccuggugaccggcauggccagccuggacaacaaggccaccggcagaaugggcaugagagccgccguguacuacauggugaccaccaucaucgccguguucaucggcauccugauggugaccaucauccaccccggcaagggcagcaaggagggccugcacagagagggcagaaucgagaccauccccaccgccgacgccuucauggaccugaucagaaacauguucccccccaaccugguggaggccugcuucaagcaguucaagacccaguacagcaccagaguggugaccagaaccauggugagaaccgagaacggcagcgagcccggcgccagcaugcccccccccuucagcguggagaacggcaccagcuuccuggagaacgugaccagagcccugggcacccugcaggagaugcugagcuucgaggagaccgugcccgugcccggcagcgccaacggcaucaacgcccugggccuggugguguucagcguggccuucggccuggugaucggcggcaugaagcacaagggcagagugcugagagacuucuucgacagccugaacgaggccaucaugagacuggugggcaucaucaucugguaa

SEQ ID NO: 23439 - RNA, 2040 nt, Artificial Sequence
  SLC20A1__Homo_sapiens__NP_005406
auggccacccugaucaccagcaccaccgccgccaccgccgccagcggcccccugguggacuaccuguggaugcugauccugggcuucaucaucgccuucgugcuggccuucagcgugggcgccaacgacguggccaacagcuucggcaccgccgugggcagcggcguggugacccugaagcaggccugcauccuggccagcaucuucgagaccgugggcagcgugcugcugggcgccaaggugagcgagaccaucagaaagggccugaucgacguggagauguacaacagcacccagggccugcugauggccggcagcgugagcgccauguucggcagcgccguguggcagcugguggccagcuuccugaagcugcccaucagcggcacccacugcaucgugggcgccaccaucggcuucagccugguggccaagggccaggagggcgugaaguggagcgagcugaucaagaucgugaugagcugguucgugagcccccugcugagcggcaucaugagcggcauccuguucuuccuggugagagccuucauccugcacaaggccgaccccgugcccaacggccugagagcccugcccguguucuacgccugcaccgugggcaucaaccuguucagcaucauguacaccggcgccccccugcugggcuucgacaagcugccccuguggggcaccauccugaucagcgugggcugcgccguguucugcgcccugaucgugugguucuucgugugccccagaaugaagagaaagaucgagagagagaucaagugcagccccagcgagagcccccugauggagaagaagaacagccugaaggaggaccacgaggagaccaagcugagcgugggcgacaucgagaacaagcaccccgugagcgaggugggccccgccaccgugccccugcaggccgugguggaggagagaaccgugagcuucaagcugggcgaccuggaggaggcccccgagagagagagacugcccagcguggaccugaaggaggagaccagcaucgacagcaccgugaacggcgccgugcagcugcccaacggcaaccuggugcaguucagccaggccgugagcaaccagaucaacagcagcggccacuaccaguaccacaccgugcacaaggacagcggccuguacaaggagcugcugcacaagcugcaccuggccaaggugggcgacugcaugggcgacagcggcgacaagccccugagaagaaacaacagcuacaccagcuacaccauggccaucugcggcaugccccuggacagcuucagagccaaggagggcgagcagaagggcgaggagauggagaagcugaccuggcccaacgccgacagcaagaagagaaucagaauggacagcuacaccagcuacugcaacgccgugagcgaccugcacagcgccagcgagaucgacaugagcgugaaggccgagaugggccugggcgacagaaagggcagcaacggcagccuggaggagugguacgaccaggacaagcccgaggugagccugcuguuccaguuccugcagauccugaccgccugcuucggcagcuucgcccacggcggcaacgacgugagcaacgccaucggcccccugguggcccuguaccugguguacgacaccggcgacgugagcagcaagguggccacccccaucuggcugcugcuguacggcggcgugggcaucugcgugggccuguggguguggggcagaagagugauccagaccaugggcaaggaccugacccccaucacccccagcagcggcuucagcaucgagcuggccagcgcccugaccguggugaucgccagcaacaucggccugcccaucagcaccacccacugcaaggugggcagcguggugagcgugggcuggcugagaagcaagaaggccguggacuggagacuguucagaaacaucuucauggccugguucgugaccgugcccaucagcggcgugaucagcgccgccaucauggccaucuucagauacgugauccugagaauguaa

SEQ ID NO: 23440 - RNA, 1959 nt, Artificial Sequence
  SLC20A2__Homo_sapiens__XP_005273670
auggccauggacgaguaccuguggauggugauccugggcuucaucaucgccuucauccuggccuucagcgugggcgccaacgacguggccaacagcuucggcaccgccgugggcagcggcguggugacccugagacaggccugcauccuggccagcaucuucgagaccaccggcagcgugcugcugggcgccaaggugggcgagaccaucagaaagggcaucaucgacgugaaccuguacaacgagaccguggagacccugauggccggcgaggugagcgccauggugggcagcgccguguggcagcugaucgccagcuuccugagacugcccaucagcggcacccacugcaucgugggcagcaccaucggcuucagccugguggccaucggcaccaagggcgugcaguggauggagcuggugaagaucguggccagcugguucaucagcccccugcugagcggcuucaugagcggccugcuguucgugcugaucagaaucuucauccugaagaaggaggaccccgugcccaacggccugagagcccugcccguguucuacgccgccaccaucgccaucaacguguucagcaucauguacaccggcgcccccgugcugggccuggugcugcccaugugggccaucgcccugaucagcuucggcguggcccugcuguucgccuucuucguguggcuguucgugugccccuggaugagaagaaagaucaccggcaagcugcagaaggagggcgcccugagcagagugagcgacgagagccugagcaaggugcaggaggccgagagccccguguucaaggagcugcccggcgccaaggccaacgacgacagcaccaucccccugaccggcgccgccggcgagacccugggcaccagcgagggcaccagcgccggcagccaccccagagccgccuacggcagagcccugagcaugacccacggcagcgugaagagccccaucagcaacggcaccuucggcuucgacggccacaccagaagcgacggccacguguaccacaccgugcacaaggacagcggccuguacaaggaccugcugcacaagauccacaucgacagaggccccgaggagaagcccgcccaggagagcaacuacagacugcugagaagaaacaacagcuacaccugcuacaccgccgccaucugcggccugcccgugcacgccaccuucagagccgccgacagcagcgcccccgaggacagcgagaagcuggugggcgacaccgugagcuacagcaagaagagacugagauacgacagcuacagcagcuacugcaacgccguggccgaggccgagaucgaggccgaggagggcggcguggagaugaagcuggccagcgagcuggccgaccccgaccagcccagagaggaccccgccgaggaggagaaggaggagaaggacgcccccgaggugcaccugcuguuccacuuccugcaggugcugaccgccugcuucggcagcuucgcccacggcggcaacgacgugagcaacgccaucggcccccugguggcccuguggcugaucuacaagcagggcggcgugacccaggaggccgccacccccguguggcugcuguucuacggcggcgugggcaucugcaccggccuguggguguggggcagaagagugauccagaccaugggcaaggaccugacccccaucacccccagcagcggcuucaccaucgagcuggccagcgccuucaccguggugaucgccagcaacaucggccugcccgugagcaccacccacugcaaggugggcagcgugguggccgugggcuggaucagaagcagaaaggccguggacuggagacuguucagaaacaucuucguggccugguucgugaccgugcccguggccggccuguucagcgccgccgugauggcccugcugauguacggcauccugcccuacguguaa

SEQ ID NO: 23441 - RNA, 1653 nt, Artificial Sequence
  SLC22A11__Homo_sapiens__NP_060954
auggccuucagcaagcugcuggagcaggccggcggcgugggccuguuccagacccugcaggugcugaccuucauccugcccugccugaugauccccagccagaugcugcuggagaacuucagcgccgccauccccggccacagaugcuggacccacaugcuggacaacggcagcgccgugagcaccaacaugacccccaaggcccugcugaccaucagcaucccccccggccccaaccagggcccccaccagugcagaagauucagacagccccaguggcagcugcuggaccccaacgccaccgccaccagcuggagcgaggccgacaccgagcccugcguggacggcuggguguacgacagaagcguguucaccagcaccaucguggccaagugggaccuggugugcagcagccagggccugaagccccugagccagagcaucuucaugagcggcauccuggugggcagcuucaucuggggccugcugagcuacagauucggcagaaagcccaugcugagcuggugcugccugcagcuggccguggccggcaccagcaccaucuucgcccccaccuucgugaucuacugcggccugagauucguggccgccuucggcauggccggcaucuuccugagcagccugacccugaugguggaguggaccaccaccagcagaagagccgugaccaugaccguggugggcugcgccuucagcgccggccaggccgcccugggcggccuggccuucgcccugagagacuggagaacccugcagcuggccgccagcgugcccuucuucgccaucagccugaucagcugguggcugcccgagagcgccagauggcugaucaucaagggcaagcccgaccaggcccugcaggagcugagaaagguggccagaaucaacggccacaaggaggccaagaaccugaccaucgaggugcugaugagcagcgugaaggaggagguggccagcgccaaggagcccagaagcgugcuggaccuguucugcgugcccgugcugagauggagaagcugcgccaugcugguggugaacuucagccugcugaucagcuacuacggccugguguucgaccugcagagccugggcagagacaucuuccugcugcaggcccuguucggcgccguggacuuccugggcagagccaccaccgcccugcugcugagcuuccugggcagaagaaccauccaggccggcagccaggccauggccggccuggccauccuggccaacaugcuggugccccaggaccugcagacccugagagugguguucgccgugcugggcaagggcugcuucggcaucagccugaccugccugaccaucuacaaggccgagcuguuccccacccccgugagaaugaccgccgacggcauccugcacaccgugggcagacugggcgccaugaugggcccccugauccugaugagcagacaggcccugccccugcugcccccccugcuguacggcgugaucagcaucgccagcagccugguggugcuguucuuccugcccgagacccagggccugccccugcccgacaccauccaggaccuggagagccagaagagcaccgccgcccagggcaacagacaggaggccgugaccguggagagcaccagccuguaa

SEQ ID NO: 23442 - RNA, 1560 nt, Artificial Sequence
  SLC22A12__Homo_sapiens__NP_001263255
auggccuucagcgagcugcuggaccuggugggcggccugggcagauuccaggugcugcagaccauggcccugauggugagcaucauguggcugugcacccagagcaugcuggagaacuucagcgccgccgugcccagccacagaugcugggccccccugcuggacaacagcaccgcccaggccagcauccugggcagccugagccccgaggcccugcuggccaucagcaucccccccggccccaaccagagaccccaccagugcagaagauucagacagccccaguggcagcugcuggaccccaacgccaccgccaccagcuggagcgaggccgacaccgagcccugcguggacggcuggguguacgacagaagcaucuucaccagcaccaucguggccaaguggaaccuggugugcgacagccacgcccugaagcccauggcccagagcaucuaccuggccggcauccuggugggcgccgccgccugcggccccgccagcgacagauucggcagaagacuggugcugaccuggagcuaccugcagauggccgugauggugauggaguggaccgccgccagagccagaccccuggugaugacccugaacagccugggcuucagcuucggccacggccugaccgccgccguggccuacggcgugagagacuggacccugcugcagcugguggugagcgugcccuucuuccugugcuuccuguacagcugguggcuggccgagagcgccagauggcugcugaccaccggcagacuggacuggggccugcaggagcuguggagaguggccgccaucaacggcaagggcgccgugcaggacacccugacccccgaggugcugcugagcgccaugagagaggagcugagcaugggccagccccccgccagccugggcacccugcugagaaugcccggccugagauucagaaccugcaucagcacccugugcugguucgccuucggcuucaccuucuucggccuggcccuggaccugcaggcccugggcagcaacaucuuccugcugcagauguucaucggcgugguggacauccccgccaagaugggcgcccugcugcugcugagccaccugggcagaagacccacccuggccgccagccugcugcuggccggccugugcauccuggccaacacccuggugccccacgagaugggcgcccugagaagcgcccuggccgugcugggccugggcggcgugggcgccgccuucaccugcaucaccaucuacagcagcgagcuguuccccaccgugcugagaaugaccgccgugggccugggccagauggccgccagaggcggcgccauccugggcccccuggugagacugcugggcgugcacggccccuggcugccccugcugguguacggcaccgugcccgugcugagcggccuggccgcccugcugcugcccgagacccagagccugccccugcccgacaccauccaggacgugcagaaccaggccgugaagaaggccacccacggcacccugggcaacagcgugcugaagagcacccaguucuaa

SEQ ID NO: 23443 - RNA, 1656 nt, Artificial Sequence
  SLC22A13__Homo_sapiens__NP_004247
auggcccaguucgugcaggugcuggccgagaucggcgacuucggcagauuccagauccagcugcugauccugcugugcgugcugaacuuccugagccccuucuacuucuucgcccacguguucauggugcuggacgagccccaccacugcgccguggccugggugaagaaccacaccuucaaccugagcgccgccgagcagcuggugcugagcgugccccuggacaccgccggccaccccgagcccugccugauguucagacccccccccgccaacgccagccugcaggacauccugagccacagauucaacgagacccagcccugcgacaugggcugggaguaccccgagaacagacugcccagccugaagaacgaguucaaccuggugugcgacagaaagcaccugaaggacaccacccagagcguguucauggccggccugcuggugggcacccugauguucggcccccugugcgacagaaucggcagaaaggccaccauccuggcccagcugcugcuguucacccugaucggccuggccaccgccuucgugcccagcuucgagcuguacauggcccugagauucgccguggccaccgccguggccggccugagcuucagcaacgugacccugcugaccgagugggugggccccagcuggagaacccaggccguggugcuggcccagugcaacuucagccugggccagauggugcuggccggccuggccuacggcuucagaaacuggagacugcugcagaucaccggcaccgcccccggccugcugcuguucuucuacuucugggcccugcccgagagcgccagauggcugcugaccagaggcagaauggacgaggccauccagcugauccagaaggccgccagcgugaacagaagaaagcugagccccgagcugaugaaccagcuggugcccgagaagaccggccccagcggcaacgcccuggaccuguucagacacccccagcugagaaaggugacccugaucaucuucugcgugugguucguggacagccugggcuacuacggccugagccugcaggugggcgacuucggccuggacguguaccugacccagcugaucuucggcgccguggaggugcccgccagaugcagcagcaucuucaugaugcagagauucggcagaaaguggagccagcugggcacccuggugcugggcggccugaugugcaucaucaucaucuucauccccgccgaccugcccgugguggugaccaugcuggccguggugggcaagauggccaccgccgccgccuucaccaucagcuacguguacagcgccgagcuguuccccaccauccugagacagaccggcaugggccuggugggcaucuucagcagaaucggcggcauccugaccccccuggugauccugcugggcgaguaccacgccgcccugcccaugcugaucuacggcagccugcccaucguggccggccugcugugcacccugcugcccgagacccacggccagggccugaaggacacccugcaggaccuggagcugggcccccaccccagaagccccaagagcgugcccagcgagaaggagaccgaggccaagggcagaaccagcagccccggcguggccuucgugagcagcaccuacuucuaa

SEQ ID NO: 23444 - RNA, 1785 nt, Artificial Sequence
  SLC22A14__Homo_sapiens__NP_004794
auggccggcgaggagaacuucaaggaggagcugagaagccaggacgccagcagaaaccugaaccagcacgagguggccggccacccccacagcuggagccuggagaugcugcugagaagacugagagccgugcacaccaagcaggacgacaaguucgccaaccugcuggacgccgugggcgaguucggcaccuuccagcagagacugguggcccugaccuucauccccagcaucaugagcgccuucuucauguucgccgaccacuucguguucaccgcccagaagcccuacugcaacaccagcuggauccuggccgugggcccccaccugagcaaggccgagcagcugaaccugaccaucccccaggcccccaacggcagcuuccugaccugcuucauguaccugcccgugcccuggaaccuggacagcaucauccaguucggccugaacgacaccgacaccugccaggacggcuggaucuaccccgacgccaagaagagaagccugaucaacgaguucgaccuggugugcggcauggagaccaagaaggacaccgcccagaucauguucauggccggccugcccaucggcagccugaucuucagacugaucaccgacaagaugggcagauaccccgccauccugcugagccugcugggccugaucaucuucggcuucggcaccgccuucaugaacagcuuccaccuguaccuguucuucagauucggcaucagccagagcguggugggcuacgccaucagcagcaucagccuggccaccgaguggcuggugggcgagcacagagcccacgccaucauccugggccacugcuucuucgccgugggcgccgugcugcugaccggcaucgccuacagccugccccacuggcagcugcuguuccuggugggcggcauccuggugauccccuucaucagcuacaucuggauccugcccgagagccccagauggcugaugaugaagggcaaggugaaggaggccaagcaggugcugugcuacgccgccagcgugaacaagaagaccauccccagcaaccugcuggacgagcugcagcugcccagaaagaaggugaccagagccagcgugcuggacuucugcaagaacagacagcugugcaaggugacccuggugaugagcugcgugugguucaccgugagcuacaccuacuucacccugagccugagaaugagagagcugggcgugagcgugcacuucagacacguggugcccagcaucauggaggugcccgccagacugugcugcaucuuccugcugcagcagaucggcagaaaguggagccuggccgugacccugcugcaggccaucaucuggugccugcugcugcuguuccugcccgagggcgaggacggccugagacugaaguggcccagaugccccgccaccgagcugaagagcaugaccauccuggugcugaugcugagagaguucagccuggccgccaccgugaccguguucuuccuguacaccgccgagcugcugcccaccgugcugagagccaccggccugggccuggugagccuggccagcguggccggcgccauccugagccugaccaucaucagccagacccccagccugcugcccaucuuccugugcugcgugcuggccaucguggccuucagccugagcagccugcugcccgagaccagagaccagccccugagcgagagccugaaccacagcagccagaucagaaacaaggugaaggacaugaagaccaaggagaccagcagcgacgacguguaa

SEQ ID NO: 23445 - RNA, 1734 nt, Artificial Sequence
  SLC22A16__Homo_sapiens__NP_149116
augggcagcagacacuucgagggcaucuacgaccacgugggccacuucggcagauuccagagagugcuguacuucaucugcgccuuccagaacaucagcugcggcauccacuaccuggccagcguguucaugggcgugaccccccaccacgugugcagaccccccggcaacgugagccaggugguguuccacaaccacagcaacuggagccuggaggacaccggcgcccugcugagcagcggccagaaggacuacgugaccgugcagcugcagaacggcgagaucugggagcugagcagaugcagcagaaacaagagagagaacaccagcagccugggcuacgaguacaccggcagcaagaaggaguuccccugcguggacggcuacaucuacgaccagaacaccuggaagagcaccgccgugacccaguggaaccuggugugcgacagaaaguggcuggccaugcugauccagccccuguucauguucggcgugcugcugggcagcgugaccuucggcuacuucagcgacagacugggcagaagaguggugcugugggccaccagcagcagcauguuccuguucggcaucgccgccgccuucgccguggacuacuacaccuucauggccgccagauucuuccuggccaugguggccagcggcuaccugguggugggcuucguguacgugauggaguucaucggcaugaagagcagaaccugggccagcgugcaccugcacagcuucuucgccgugggcacccugcugguggcccugaccggcuaccuggugagaaccugguggcuguaccagaugauccugagcaccgugaccgugcccuucauccugugcugcugggugcugcccgagacccccuucuggcugcugagcgagggcagauacgaggaggcccagaagaucguggacaucauggccaaguggaacagagccagcagcugcaagcugagcgagcugcugagccuggaccugcagggccccgugagcaacagccccaccgaggugcagaagcacaaccugagcuaccuguucuacaacuggagcaucaccaagagaacccugaccguguggcugaucugguucaccggcagccugggcuucuacagcuucagccugaacagcgugaaccugggcggcaacgaguaccugaaccuguuccugcugggcgugguggagauccccgccuacaccuucgugugcaucgccauggacaaggugggcagaagaaccgugcuggccuacagccuguucugcagcgcccuggccugcggcguggugauggugaucccccagaagcacuacauccugggcguggugaccgccauggugggcaaguucgccaucggcgccgccuucggccugaucuaccuguacaccgccgagcuguaccccaccaucgugagaagccuggccgugggcagcggcagcauggugugcagacuggccagcauccuggcccccuucagcguggaccugagcagcaucuggaucuucaucccccagcuguucgugggcaccauggcccugcugagcggcgugcugacccugaagcugcccgagacccugggcaagagacuggccaccaccugggaggaggccgccaagcuggagagcgagaacgagagcaagagcagcaagcugcugcugaccaccaacaacagcggccuggagaagaccgaggccaucacccccagagacagcggccugggcgaguaa

SEQ ID NO: 23446 - RNA, 1563 nt, Artificial Sequence
  SLC22A17__Homo_sapiens__NP_057693
auggccagcgaccccaucuucacccuggcccccccccugcacugccacuacggcgccuucccccccaacgccagcggcugggagcagccccccaacgccagcggcgugagcguggccagcgccgcccuggccgccagcgccgccagcagaguggccaccagcaccgaccccagcugcagcggcuucgccccccccgacuucaaccacugccugaaggacugggacuacaacggccugcccgugcugaccaccaacgccaucggccagugggaccuggugugcgaccugggcuggcaggugauccuggagcagauccuguucauccugggcuucgccagcggcuaccuguuccugggcuaccccgccgacagauucggcagaagaggcaucgugcugcugacccugggccuggugggccccugcggcgugggcggcgccgccgccggcagcagcaccggcgugauggcccugagauuccugcugggcuuccugcuggccggcguggaccugggcguguaccugaugagacuggagcugugcgaccccacccagagacugagaguggcccuggccggcgagcuggugggcgugggcggccacuuccuguuccugggccuggcccuggugagcaaggacuggagauuccugcagagaaugaucaccgcccccugcauccuguuccuguucuacggcuggcccggccuguuccuggagagcgccagauggcugaucgugaagagacagaucgaggaggcccagagcgugcugagaauccuggccgagagaaacagaccccacggccagaugcugggcgaggaggcccaggaggcccugcaggaccuggagaacaccugcccccugcccgccaccagcagcuucagcuucgccagccugcugaacuacagaaacaucuggaagaaccugcugauccugggcuucaccaacuucaucgcccacgccaucagacacugcuaccagcccgugggcggcggcggcagccccagcgacuucuaccugugcagccugcuggccagcggcaccgccgcccuggccugcguguuccugggcgugaccguggacagauucggcagaagaggcauccugcugcugagcaugacccugaccggcaucgccagccuggugcugcugggccugugggacuaccugaacgaggccgccaucaccaccuucagcgugcugggccuguucagcagccaggccgccgccauccugagcacccugcuggccgccgaggugauccccaccaccgugagaggcagaggccugggccugaucauggcccugggcgcccugggcggccugagcggccccgcccagagacugcacaugggccacggcgccuuccugcagcacguggugcuggccgccugcgcccugcugugcauccugagcaucaugcugcugcccgagaccaagagaaagcugcugcccgaggugcugagagacggcgagcugugcagaagacccagccugcugagacagcccccccccaccagaugcgaccacgugccccugcuggccacccccaaccccgcccuguaa

SEQ ID NO: 23447 - RNA, 453 nt, Artificial Sequence
  SLC22A18AS__Homo_sapiens__NP_001289791
augagaugcgccgagggcgccuggugguucagccccgacggccccgccggcagcgccgccagcaucuggcccgccgagggcgccgagggccugcccggccagcugggcagagacagacuggaggugguguacagcgugcccgacaacgugcccggccagaacggcagcagaagaccccuggugugcaagaucaccggcaagugccugagcgugugcagcgaggagaacgccaaggccggcggcugcagcgccuucccccugcugcugagccagcugggcgccagaaugaccggcagagagcacgcccacaagggccccgagcugaccacccccgacagcggccugcccagaccccccaaccccgcccuggccggcuucagagcccuggcccagcacagccccccccugggcaccagcacccccagcgccgugcugcugagcgccgccaccuaa

SEQ ID NO: 23448 - RNA, 1275 nt, Artificial Sequence
  SLC22A18__Homo_sapiens__NP_899056
augcagggcgccagagcccccagagaccagggcagaagccccggcagaaugagcgcccugggcagaagcagcgugauccugcugaccuacgugcuggccgccaccgagcugaccugccuguucaugcaguucagcaucgugcccuaccugagcagaaagcugggccuggacagcaucgccuucggcuaccugcagaccaccuucggcgugcugcagcugcugggcggccccguguucggcagauucgccgaccagagaggcgccagagccgcccugacccugagcuuccuggccgcccuggcccuguaccugcugcuggccgccgccagcagccccgcccugcccggcguguaccugcuguucgccagcagacugcccggcgcccugaugcacacccugcccgccgcccagauggugaucaccgaccugagcgcccccgaggagagacccgccgcccugggcagacugggccugugcuucggcgugggcgugauccugggcagccugcugggcggcacccuggugagcgccuacggcauccagugccccgccauccuggccgcccuggccacccugcugggcgccgugcugagcuucaccugcauccccgccagcaccaagggcgccaagaccgacgcccaggccccccugcccggcggccccagagccagcguguucgaccugaaggccaucgccagccugcugagacugcccgacgugcccagaaucuuccuggugaagguggccagcaacugccccaccggccuguucauggugauguucagcaucaucagcauggacuucuuccagcuggaggccgcccaggccggcuaccugaugagcuucuucggccugcugcagauggugacccagggccuggugaucggccagcugagcagccacuucagcgaggaggugcugcugagagccagcgugcugguguucaucguggugggccuggccauggccuggaugagcagcguguuccacuucugccugcuggugcccggccugguguucagccugugcacccugaacguggugaccgacagcaugcugaucaaggccgugagcaccagcgacaccggcaccaugcugggccugugcgccagcgugcagccccugcugagaacccugggccccaccgugggcggccugcuguacagaagcuucggcgugcccguguucggccacgugcagguggccaucaacacccuggugcugcuggugcuguggagaaagcccaugccccagagaaaggacaaggugagauaa

SEQ ID NO: 23449 - RNA, 1665 nt, Artificial Sequence
  SLC22A1__Homo_sapiens__NP_003048
augcccaccguggacgacauccuggagcaggugggcgagagcggcugguuccagaagcaggccuuccugauccugugccugcugagcgccgccuucgcccccaucugcgugggcaucguguuccugggcuucacccccgaccaccacugccagagccccggcguggccgagcugagccagagaugcggcuggagccccgccgaggagcugaacuacaccgugcccggccugggccccgccggcgaggccuuccugggccagugcagaagauacgagguggacuggaaccagagcgcccugagcugcguggacccccuggccagccuggccaccaacagaagccaccugccccugggccccugccaggacggcuggguguacgacacccccggcagcagcaucgugaccgaguucaaccuggugugcgccgacagcuggaagcuggaccuguuccagagcugccugaacgccggcuuccuguucggcagccugggcgugggcuacuucgccgacagauucggcagaaagcugugccugcugggcaccgugcuggugaacgccgugagcggcgugcugauggccuucagccccaacuacaugagcaugcugcuguucagacugcugcagggccuggugagcaagggcaacuggauggccggcuacacccugaucaccgaguucgugggcagcggcagcagaagaaccguggccaucauguaccagauggccuucaccgugggccugguggcccugaccggccuggccuacgcccugccccacuggagauggcugcagcuggccgugagccugcccaccuuccuguuccugcuguacuacuggugcgugcccgagagccccagauggcugcugagccagaagagaaacaccgaggccaucaagaucauggaccacaucgcccagaagaacggcaagcugccccccgccgaccugaagaugcugagccuggaggaggacgugaccgagaagcugagccccagcuucgccgaccuguucagaacccccagacugagaaagagaaccuucauccugauguaccugugguucaccgacagcgugcuguaccagggccugauccugcacaugggcgccaccagcggcaaccuguaccuggacuuccuguacagcgcccugguggagauccccggcgccuucaucgcccugaucaccaucgacagagugggcagaaucuaccccauggccaugagcaaccugcuggccggcgccgccugccuggugaugaucuucaucagccccgaccugcacuggcugaacaucaucaucaugugcgugggcagaaugggcaucaccaucgccauccagaugaucugccuggugaacgccgagcuguaccccaccuucgugagaaaccugggcgugauggugugcagcagccugugcgacaucggcggcaucaucacccccuucaucguguucagacugagagagguguggcaggcccugccccugauccuguucgccgugcugggccugcuggccgccggcgugacccugcugcugcccgagaccaagggcguggcccugcccgagaccaugaaggacgccgagaaccugggcagaaaggccaagcccaaggagaacaccaucuaccugaaggugcagaccagcgagcccagcggcaccuaa

SEQ ID NO: 23450 - RNA, 1086 nt, Artificial Sequence
  SLC22A23__Homo_sapiens__NP_001273385
auggccaucgacagaagaagagaggccgccggcggcggccccggcagacagcccgcccccgccgaggagaacggcagccugccccccggcgacgccgccgccagcgccccccugggcggcagagccggccccggcggcggcgccgagauccagccccugcccccccugcaccccggcggcggcccccaccccagcugcugcagcgccgccgccgcccccagccugcugcugcuggacuacgacggcagcgugcugcccuuccugggcggccugggcggcggcuaccagaagacccuggugcugcugaccuggauccccgcccuguucaucggcuucagccaguucagcgacagcuuccugcuggaccagcccaacuucuggugcagaggcgccggcaagggcaccgagcuggccggcgugaccaccaccggcagaggcggcgacaugggcaacuggaccagccugcccaccacccccuucgccaccgcccccugggaggccgccggcaacagaagcaacagcagcggcgccgacggcggcgacacccccccccugcccagcccccccgacaagggcgacaacgccagcaacugcgacugcagagccugggacuacggcaucagagccggccuggugcagaacguggugagcaagugggaccuggugugcgacaacgccuggaaggugcacaucgccaaguucagccugcuggugggccugaucuucggcuaccugaucaccggcugcaucgccgacugggugggcagaagacccgugcugcuguucagcaucaucuucauccugaucuucggccugaccguggcccugagcgugaacgugaccauguucagcacccugagauucuucgagggcuucugccuggccggcaucauccugacccuguacgcccugagaaucgagcugugcccccccggcaagagauucaugaucaccaugguggccagcuucguggccauggccggccaguuccugaugcccggccuggccgcccugugcagagacuggcaggugcugcaggcccugaucaucugccccuuccugcugaugcugcuguacuggagcuaa

SEQ ID NO: 23451 - RNA, 1659 nt, Artificial Sequence
  SLC22A24__Homo_sapiens__NP_001129978
augggcuucgacgugcugcuggaccaggugggcggcaugggcagauuccagaucugccugaucgccuucuucugcaucaccaacauccugcuguuccccaacaucgugcuggagaacuucaccgccuucacccccagccacagaugcugggugccccugcuggacaacgacaccgugagcgacaacgacaccggcacccugagcaaggacgaccugcugagaaucagcaucccccuggacagcaaccugagaccccagaagugccagagauucauccacccccaguggcagcugcugcaccugaacggcaccuuccccaacaccaacgagcccgacaccgagcccugcguggacggcuggguguacgacagaagcagcuuccugagcaccaucgugaccgagugggaccuggugugcgagagccagagccugaagagcauggugcagagccuguucauggccggcagccugcugggcggccugaucuacggccaccugagcgacagagugggcagaaagaucaucugcaagcugugcuuccugcagcuggccaucagcaacaccugcgccgccuucgcccccaccuuccugguguacugcauccugagauuccuggccggcuucagcaccaugaccauccugggcaacaccuucauccugagccuggaguggacccugcccagaagcagaagcaugaccaucauggugcugcugugcagcuacagcgugggccagaugcugcugggcggccuggccuucgccauccaggacuggcacauccugcagcugaccgugagcacccccaucaucgugcuguuccugagcagcuggaagaugguggagagcgccagauggcugaucaucaacaaccagcuggacgagggccugaaggagcugagaagaguggcccacaucaacggcaagaagaacaccgaggagacccugaccaccgagcuggugagaagcaccaugaagaaggagcuggacgccgugagaaucaagaccagcaucuucagccuguucagagcccccaagcugagaaugagaguguucggccugugcuucgugagauucgccaucaccgugcccuucuacggccugauccugaaccugcagcaccugggcagcaacgugagccuguuccagauccugugcggcgccgugaccuucaccgccagaugcgugagccugcugacccugaaccacaugggcagaagaaucagccagauccuguucaccuuccccgugggccuguucauccuggugaacaccuuccugccccaggagaugcagauccugagaguggugcuggccacccugggcaucggcagcgugagcgccgccagcaacagcgccagcgugcaccacaacgagcuggugcccaccauccugagaagcaccguggccggcaucaacgccgugagcggcagaaccggcgccgcccuggccccccugcugaugacccugauggccuacagcccccaccugcccuggaucagcuacggcguguuccccauccuggccgugcccgugauccugcugcugcccgagaccagagaccugccccugcccaacaccauccaggacguggagaacgacagaaaggacagcagaaacaucaagcaggaggacaccugcaugaaggugacccaguucuaa

SEQ ID NO: 23452 - RNA, 1668 nt, Artificial Sequence
  SLC22A2__Homo_sapiens__NP_003049
augcccaccaccguggacgacgugcuggagcacggcggcgaguuccacuucuuccagaagcagauguucuuccugcuggcccugcugagcgccaccuucgcccccaucuacgugggcaucguguuccugggcuucacccccgaccacagaugcagaagccccggcguggccgagcugagccugagaugcggcuggagccccgccgaggagcugaacuacaccgugcccggccccggccccgccggcgaggccagccccagacagugcagaagauacgagguggacuggaaccagagcaccuucgacugcguggacccccuggccagccuggacaccaacagaagcagacugccccugggccccugcagagacggcuggguguacgagacccccggcagcagcaucgugaccgaguucaaccuggugugcgccaacagcuggaugcuggaccuguuccagagcagcgugaacgugggcuucuucaucggcagcaugagcaucggcuacaucgccgacagauucggcagaaagcugugccugcugaccaccgugcugaucaacgccgccgccggcgugcugauggccaucagccccaccuacaccuggaugcugaucuucagacugauccagggccuggugagcaaggccggcuggcugaucggcuacauccugaucaccgaguucgugggcagaagauacagaagaaccgugggcaucuucuaccagguggccuacaccgugggccugcuggugcuggccggcguggccuacgcccugccccacuggagauggcugcaguucaccgugagccugcccaacuucuucuuccugcuguacuacuggugcauccccgagagccccagauggcugaucagccagaacaagaacgccgaggccaugagaaucaucaagcacaucgccaagaagaacggcaagagccugcccgccagccugcagagacugagacuggaggaggagaccggcaagaagcugaaccccagcuuccuggaccuggugagaaccccccagaucagaaagcacaccaugauccugauguacaacugguucaccagcagcgugcuguaccagggccugaucaugcacaugggccuggccggcgacaacaucuaccuggacuucuucuacagcgcccugguggaguuccccgccgccuucaugaucauccugaccaucgacagaaucggcagaagauaccccugggccgccagcaacaugguggccggcgccgccugccuggccagcguguucauccccggcgaccugcaguggcugaagaucaucaucagcugccugggcagaaugggcaucaccauggccuacgagaucgugugccuggugaacgccgagcuguaccccaccuucaucagaaaccugggcgugcacaucugcagcagcaugugcgacaucggcggcaucaucacccccuuccugguguacagacugaccaacaucuggcuggagcugccccugaugguguucggcgugcugggccugguggccggcggccuggugcugcugcugcccgagaccaagggcaaggcccugcccgagaccaucgaggaggccgagaacaugcagagacccagaaagaacaaggagaagaugaucuaccugcaggugcagaagcuggacaucccccugaacuaa

SEQ ID NO: 23453 - RNA, 1671 nt, Artificial Sequence
  SLC22A3__Homo_sapiens__NP_068812
augcccagcuucgacgaggcccugcagagagugggcgaguucggcagauuccagagaagaguguuccugcugcugugccugaccggcgugaccuucgccuuccuguucgugggcgugguguuccugggcacccagcccgaccacuacuggugcagaggccccagcgccgccgcccuggccgagagaugcggcuggagccccgaggaggaguggaacagaaccgcccccgccagcagaggccccgagccccccgagagaagaggcagaugccagagauaccugcuggaggccgccaacgacagcgccagcgccaccagcgcccugagcugcgccgacccccuggccgccuuccccaacagaagcgccccccuggugcccugcagaggcggcuggagauacgcccaggcccacagcaccaucgugagcgaguucgaccuggugugcgugaacgccuggaugcuggaccugacccaggccauccugaaccugggcuuccugaccggcgccuucacccugggcuacgccgccgacagauacggcagaaucgugaucuaccugcugagcugccugggcgugggcgugaccggcguggugguggccuucgcccccaacuuccccguguucgugaucuucagauuccugcagggcguguucggcaagggcaccuggaugaccugcuacgugaucgugaccgagaucgugggcagcaagcagagaagaaucgugggcaucgugauccagauguucuucacccugggcaucaucauccugcccggcaucgccuacuucauccccaacuggcagggcauccagcuggccaucacccugcccagcuuccuguuccugcuguacuacuggguggugcccgagagccccagauggcugaucaccagaaagaagggcgacaaggcccugcagauccugagaagaaucgccaagugcaacggcaaguaccugagcagcaacuacagcgagaucaccgugaccgacgaggaggugagcaaccccagcuuccuggaccuggugagaaccccccagaugagaaagugcacccugauccugauguucgccugguucaccagcgccgugguguaccagggccuggugaugagacugggcaucaucggcggcaaccuguacaucgacuucuucaucagcggcgugguggagcugcccggcgcccugcugauccugcugaccaucgagagacugggcagaagacugcccuucgccgccagcaacaucguggccggcguggccugccuggugaccgccuuccugcccgagggcaucgccuggcugagaaccaccguggccacccugggcagacugggcaucaccauggccuucgagaucguguaccuggugaacagcgagcuguaccccaccacccugagaaacuucggcgugagccugugcagcggccugugcgacuucggcggcaucaucgcccccuuccugcuguucagacuggccgccguguggcuggagcugccccugaucaucuucggcauccuggccagcaucugcggcggccuggugaugcugcugcccgagaccaagggcaucgcccugcccgagaccguggacgacguggagaagcugggcagcccccacagcugcaagugcggcagaaacaagaagacccccgugagcagaagccaccuguaa

SEQ ID NO: 23454 - RNA, 1656 nt, Artificial Sequence
  SLC22A4__Homo_sapiens__NP_003050
augagagacuacgacgaggugaucgccuuccugggcgaguggggccccuuccagagacugaucuucuuccugcugagcgccagcaucauccccaacggcuucaacggcaugagcgugguguuccuggccggcacccccgagcacagaugcagagugcccgacgccgccaaccugagcagcgccuggagaaacaacagcgugccccugagacugagagacggcagagaggugccccacagcugcagcagauacagacuggccaccaucgccaacuucagcgcccugggccuggagcccggcagagacguggaccugggccagcuggagcaggagagcugccuggacggcugggaguucagccaggacguguaccugagcaccguggugaccgaguggaaccuggugugcgaggacaacuggaaggugccccugaccaccagccuguucuucgugggcgugcugcugggcagcuucgugagcggccagcugagcgacagauucggcagaaagaacgugcuguucgccaccauggccgugcagaccggcuucagcuuccugcagaucuucagcaucagcugggagauguucaccgugcuguucgugaucgugggcaugggccagaucagcaacuacgugguggccuucauccugggcaccgagauccugggcaagagcgugagaaucaucuucagcacccugggcgugugcaccuucuucgccgugggcuacaugcugcugccccuguucgccuacuucaucagagacuggagaaugcugcugcuggcccugaccgugcccggcgugcugugcgugccccuguggugguucauccccgagagccccagauggcugaucagccagagaagauucagagaggccgaggacaucauccagaaggccgccaagaugaacaacaucgccgugcccgccgugaucuucgacagcguggaggagcugaacccccugaagcagcagaaggccuucauccuggaccuguucagaaccagaaacaucgccaucaugaccaucaugagccugcugcuguggaugcugaccagcgugggcuacuucgcccugagccuggacgcccccaaccugcacggcgacgccuaccugaacugcuuccugagcgcccugaucgagauccccgccuacaucaccgccuggcugcugcugagaacccugcccagaagauacaucaucgccgccgugcuguucuggggcggcggcgugcugcuguucauccagcuggugcccguggacuacuacuuccugagcaucggccuggugaugcugggcaaguucggcaucaccagcgccuucagcaugcuguacguguucaccgccgagcuguaccccacccuggugagaaacauggccgugggcgugaccagcaccgccagcagagugggcagcaucaucgcccccuacuucguguaccugggcgccuacaacagaaugcugcccuacaucgugaugggcagccugaccgugcugaucggcauccugacccuguucuuccccgagagccugggcaugacccugcccgagacccuggagcagaugcagaaggugaagugguucagaagcggcaagaagaccagagacagcauggagaccgaggagaaccccaaggugcugaucaccgccuucuaa

SEQ ID NO: 23455 - RNA, 1674 nt, Artificial Sequence
  SLC22A5__Homo_sapiens__NP_003051
augagagacuacgacgaggugaccgccuuccugggcgaguggggccccuuccagagacugaucuucuuccugcugagcgccagcaucauccccaacggcuucaccggccugagcagcguguuccugaucgccacccccgagcacagaugcagagugcccgacgccgccaaccugagcagcgccuggagaaaccacaccgugccccugagacugagagacggcagagaggugccccacagcugcagaagauacagacuggccaccaucgccaacuucagcgcccugggccuggagcccggcagagacguggaccugggccagcuggagcaggagagcugccuggacggcugggaguucagccaggacguguaccugagcaccaucgugaccgaguggaaccuggugugcgaggacgacuggaaggccccccugaccaucagccuguucuucgugggcgugcugcugggcagcuucaucagcggccagcugagcgacagauucggcagaaagaacgugcuguucgugaccaugggcaugcagaccggcuucagcuuccugcagaucuucagcaagaacuucgagauguucguggugcuguucgugcuggugggcaugggccagaucagcaacuacguggccgccuucgugcugggcaccgagauccugggcaagagcgugagaaucaucuucagcacccugggcgugugcaucuucuacgccuucggcuacauggugcugccccuguucgccuacuucaucagagacuggagaaugcugcugguggcccugaccaugcccggcgugcugugcguggcccuguggugguucauccccgagagccccagauggcugaucagccagggcagauucgaggaggccgaggugaucaucagaaaggccgccaaggccaacggcaucguggugcccagcaccaucuucgaccccagcgagcugcaggaccugagcagcaagaagcagcagagccacaacauccuggaccugcugagaaccuggaacaucagaauggugaccaucaugagcaucaugcuguggaugaccaucagcgugggcuacuucggccugagccuggacacccccaaccugcacggcgacaucuucgugaacugcuuccugagcgccaugguggaggugcccgccuacgugcuggccuggcugcugcugcaguaccugcccagaagauacagcauggccaccgcccuguuccugggcggcagcgugcugcuguucaugcagcuggugccccccgaccuguacuaccuggccaccgugcuggugauggugggcaaguucggcgugaccgccgccuucagcaugguguacguguacaccgccgagcuguaccccaccguggugagaaacaugggcgugggcgugagcagcaccgccagcagacugggcagcauccugagccccuacuucguguaccugggcgccuacgacagauuccugcccuacauccugaugggcagccugaccauccugaccgccauccugacccuguuccugcccgagagcuucggcaccccccugcccgacaccaucgaccagaugcugagagugaagggcaugaagcacagaaagacccccagccacaccagaaugcugaaggacggccaggagagacccaccauccugaagagcaccgccuucuaa

SEQ ID NO: 23456 - RNA, 1692 nt, Artificial Sequence
  SLC22A6__Homo_sapiens__NP_004781
auggccuucaacgaccugcugcagcaggugggcggcgugggcagauuccagcagauccaggugacccugguggugcugccccugcugcugauggccagccacaacacccugcagaacuucaccgccgccauccccacccaccacugcagaccccccgccgacgccaaccugagcaagaacggcggccuggagguguggcugcccagagacagacagggccagcccgagagcugccugagauucaccagcccccaguggggccugcccuuccugaacggcaccgaggccaacggcaccggcgccaccgagcccugcaccgacggcuggaucuacgacaacagcaccuuccccagcaccaucgugaccgagugggaccuggugugcagccacagagcccugagacagcuggcccagagccuguacauggugggcgugcugcugggcgccaugguguucggcuaccuggccgacagacugggcagaagaaaggugcugauccugaacuaccugcagaccgccgugagcggcaccugcgccgccuucgcccccaacuuccccaucuacugcgccuucagacugcugagcggcauggcccuggccggcaucagccugaacugcaugacccugaacguggaguggaugcccauccacaccagagccugcgugggcacccugaucggcuacguguacagccugggccaguuccugcuggccggcguggccuacgccgugccccacuggagacaccugcagcugcuggugagcgcccccuucuucgccuucuucaucuacagcugguucuucaucgagagcgccagauggcacagcagcagcggcagacuggaccugacccugagagcccugcagagaguggccagaaucaacggcaagagagaggagggcgccaagcugagcauggaggugcugagagccagccugcagaaggagcugaccaugggcaagggccaggccagcgccauggagcugcugagaugccccacccugagacaccuguuccugugccugagcaugcugugguucgccaccagcuucgccuacuacggccuggugauggaccugcagggcuucggcgugagcaucuaccugauccaggugaucuucggcgccguggaccugcccgccaagcuggugggcuuccuggugaucaacagccugggcagaagacccgcccagauggccgcccugcugcuggccggcaucugcauccugcugaacggcgugaucccccaggaccagagcaucgugagaaccagccuggccgugcugggcaagggcugccuggccgccagcuucaacugcaucuuccuguacaccggcgagcuguaccccaccaugaucagacagaccggcaugggcaugggcagcaccauggccagagugggcagcaucgugagcccccuggugagcaugaccgccgagcuguaccccagcaugccccuguucaucuacggcgccgugcccguggccgccagcgccgugaccgugcugcugcccgagacccugggccagccccugcccgacaccgugcaggaccuggagagcagaugggcccccacccagaaggaggccggcaucuaccccagaaagggcaagcagaccagacagcagcaggagcaccagaaguacauggugccccugcaggccagcgcccaggagaagaacggccuguaa

SEQ ID NO: 23457 - RNA, 1641 nt, Artificial Sequence
  SLC22A7__Homo_sapiens__NP_006663
augggcuucgaggagcugcuggagcaggugggcggcuucggccccuuccagcugagaaacguggcccugcuggcccugcccagagugcugcugccccugcacuuccugcugcccaucuuccuggccgccgugcccgcccacagaugcgcccugcccggcgcccccgccaacuucagccaccaggacguguggcuggaggcccaccugcccagagagcccgacggcacccugagcagcugccugagauucgccuacccccaggcccugcccaacaccacccugggcgaggagagacagagcagaggcgagcuggaggacgagcccgccaccgugcccugcagccagggcugggaguacgaccacagcgaguucagcagcaccaucgccaccgagugggaccuggugugcgagcagaagggccugaacagagccgccagcaccuucuucuucgccggcgugcuggugggcgccguggccuucggcuaccugagcgacagauucggcagaagaagacugcugcugguggccuacgugagcacccuggugcugggccuggccagcgccgccagcgugagcuacgugauguucgccaucaccagaacccugaccggcagcgcccuggccggcuucaccaucaucgugaugccccuggagcuggaguggcuggacguggagcacagaaccguggccggcgugcugagcagcaccuucuggaccggcggcgugaugcugcuggcccuggugggcuaccugaucagagacuggagauggcugcugcuggccgugacccugcccugcgcccccggcauccugagccuguggugggugcccgagagcgccagauggcugcugacccagggccacgugaaggaggcccacagauaccugcugcacugcgccagacugaacggcagacccgugugcgaggacagcuucagccaggaggccgugagcaagguggccgccggcgagagaguggugagaagacccagcuaccuggaccuguucagaacccccagacugagacacaucagccugugcugcgugguggugugguucggcgugaacuucagcuacuacggccugagccuggacgugagcggccugggccugaacguguaccagacccagcugcuguucggcgccguggagcugcccagcaagcugcugguguaccugagcgugagauacgccggcagaagacugacccaggccggcacccugcugggcaccgcccuggccuucggcaccagacugcuggugagcagcgacaugaagagcuggagcaccgugcuggccgugaugggcaaggccuucagcgaggccgccuucaccaccgccuaccuguucaccagcgagcuguaccccaccgugcugagacagaccggcaugggccugaccgcccuggugggcagacugggcggcagccuggccccccuggccgcccugcuggacggcguguggcugagccugcccaagcugaccuacggcggcaucgcccugcuggccgccggcaccgcccugcugcugcccgagaccagacaggcccagcugcccgagaccauccaggacguggagagaaagagcgcccccaccagccugcaggaggaggagaugcccaugaagcaggugcagaacuaa

SEQ ID NO: 23458 - RNA, 1629 nt, Artificial Sequence
  SLC22A8__Homo_sapiens__NP_001171661
augaccuucagcgagauccuggacagagugggcagcaugggccacuuccaguuccugcacguggccauccugggccugcccauccugaacauggccaaccacaaccugcugcagaucuucaccgccgccacccccgugcaccacugcagacccccccacaacgccagcaccggccccugggugcugcccaugggccccaacggcaagcccgagagaugccugagauucgugcacccccccaacgccagccugcccaacgacacccagagagccauggagcccugccuggacggcuggguguacaacagcaccaaggacagcaucgugaccgagugggaccuggugugcaacagcaacaagcugaaggagauggcccagagcaucuucauggccggcauccugaucggcggccuggugcugggcgaccugagcgacagauucggcagaagacccauccugaccugcagcuaccugcugcuggccgccagcggcagcggcgccgccuucagccccaccuuccccaucuacaugguguucagauuccugugcggcuucggcaucagcggcaucacccugagcaccgugauccugaacguggagugggugcccaccagaaugagagccaucaugagcaccgcccugggcuacugcuacaccuucggccaguucauccugcccggccuggccuacgccaucccccaguggagauggcugcagcugaccgugagcauccccuucuucguguucuuccugagcagcugguggacccccgagagcaucagauggcuggugcugagcggcaagagcagcaaggcccugaagauccugagaagaguggccguguucaacggcaagaaggaggagggcgagagacugagccuggaggagcugaagcugaaccugcagaaggagaucagccuggccaaggccaaguacaccgccagcgaccuguucagaauccccaugcugagaagaaugaccuucugccugagccuggccugguucgccaccggcuucgccuacuacagccuggccaugggcguggaggaguucggcgugaaccuguacauccugcagaucaucuucggcggcguggacgugcccgccaaguucaucaccauccugagccugagcuaccugggcagacacaccacccaggccgccgcccugcugcuggccggcggcgccauccuggcccugaccuucgugccccuggaccugcagaccgugagaaccgugcuggccguguucggcaagggcugccugagcagcagcuucagcugccuguuccuguacaccagcgagcuguaccccaccgugaucagacagaccggcaugggcgugagcaaccuguggaccagagugggcagcauggugagcccccuggugaagaucaccggcgaggugcagcccuucauccccaacaucaucuacggcaucaccgcccugcugggcggcagcgccgcccuguuccugcccgagacccugaaccagccccugcccgagaccaucgaggaccuggagaacuggagccugagagccaagaagcccaagcaggagcccgagguggagaaggccagccagagaaucccccugcagccccacggccccggccugggcagcagcuaa

SEQ ID NO: 23459 - RNA, 1797 nt, Artificial Sequence
  SLC23A1__Homo_sapiens__NP_005838
augagagcccaggaggaccuggagggcagaacccagcacgagaccaccagagaccccagcaccccccugcccaccgagcccaaguucgacaugcuguacaagaucgaggacgugccccccugguaccugugcauccugcugggcuuccagcacuaccugaccugcuucagcggcaccaucgccgugcccuuccugcuggccgaggcccugugcgugggccacgaccagcacauggugagccagcugaucggcaccaucuucaccugcgugggcaucaccacccugauccagaccaccgugggcaucagacugccccuguuccaggccagcgccuucgccuuccuggugcccgccaaggccauccuggcccuggagagauggaagugcccccccgaggaggagaucuacggcaacuggagccugccccugaacaccagccacaucuggcaccccagaaucagagaggugcagggcgccaucauggugagcagcgugguggagguggugaucggccugcugggccugcccggcgcccugcugaacuacaucggcccccugaccgugacccccaccgugagccugaucggccugagcguguuccaggccgccggcgacagagccggcagccacuggggcaucagcgccugcagcauccugcugaucauccuguucagccaguaccugagaaaccugaccuuccugcugcccguguacagauggggcaagggccugacccugcugagaauccagaucuucaagauguuccccaucaugcuggccaucaugaccguguggcugcugugcuacgugcugacccugaccgacgugcugcccaccgaccccaaggccuacggcuuccaggccagaaccgacgccagaggcgacaucauggccaucgcccccuggaucagaauccccuaccccugccaguggggccugcccaccgugaccgccgccgccgugcugggcauguucagcgccacccuggccggcaucaucgagagcaucggcgacuacuacgccugcgccagacuggccggcgccccccccccccccgugcacgccaucaacagaggcaucuucaccgagggcaucugcugcaucaucgccggccugcugggcaccggcaacggcagcaccagcagcagccccaacaucggcgugcugggcaucaccaaggugggcagcagaagaguggugcaguacggcgccgccaucaugcuggugcugggcaccaucggcaaguucaccgcccuguucgccagccugcccgaccccauccugggcggcauguucugcacccuguucggcaugaucaccgccgugggccugagcaaccugcaguucguggacaugaacagcagcagaaaccuguucgugcugggcuucagcauguucuucggccugacccugcccaacuaccuggagagcaaccccggcgccaucaacaccggcauccuggagguggaccagauccugaucgugcugcugaccaccgagauguucgugggcggcugccuggccuucauccuggacaacaccgugcccggcagccccgaggagagaggccugauccaguggaaggccggcgcccacgccaacagcgacaugagcagcagccugaagagcuacgacuuccccaucggcaugggcaucgugaagagaaucaccuuccugaaguacauccccaucugccccguguucaagggcuucagcagcagcagcaaggaccagaucgccauccccgaggacacccccgagaacaccgagaccgccagcgugugcaccaagguguaa

SEQ ID NO: 23460 - RNA, 1953 nt, Artificial Sequence
  SLC23A2__Homo_sapiens__NP_005107
augaugggcaucggcaagaacaccaccagcaagagcauggaggccggcagcagcaccgagggcaaguacgaggacgaggccaagcaccccgccuucuucacccugcccguggugaucaacggcggcgccaccagcagcggcgagcaggacaacgaggacaccgagcugauggccaucuacaccaccgagaacggcaucgccgagaagagcagccuggccgagacccuggacagcaccggcagccuggacccccagagaagcgacaugaucuacaccaucgaggacgugccccccugguaccugugcaucuuccugggccugcagcacuaccugaccugcuucagcggcaccaucgccgugcccuuccugcuggccgacgccaugugcgugggcuacgaccagugggccaccagccagcugaucggcaccaucuucuucugcgugggcaucaccacccugcugcagaccaccuucggcugcagacugccccuguuccaggccagcgccuucgccuuccuggcccccgccagagccauccugagccuggacaaguggaagugcaacaccaccgacgugagcguggccaacggcaccgccgagcugcugcacaccgagcacaucugguaccccagaaucagagagauccagggcgccaucaucaugagcagccugaucgagguggugaucggccugcugggccugcccggcgcccugcugaaguacaucggcccccugaccaucacccccaccguggcccugaucggccugagcggcuuccaggccgccggcgagagagccggcaagcacuggggcaucgccaugcugaccaucuuccuggugcugcuguucagccaguacgccagaaacgugaaguucccccugcccaucuacaagagcaagaagggcuggaccgccuacaagcugcagcuguucaagauguuccccaucauccuggccauccuggugagcuggcugcugugcuucaucuucaccgugaccgacguguucccccccgacagcaccaaguacggcuucuacgccagaaccgacgccagacagggcgugcugcugguggcccccugguucaaggugcccuaccccuuccaguggggccugcccaccgugagcgccgccggcgugaucggcaugcugagcgccgugguggccagcaucaucgagagcaucggcgacuacuacgccugcgccagacugagcugcgccccccccccccccauccacgccaucaacagaggcaucuucguggagggccugagcugcgugcuggacggcaucuucggcaccggcaacggcagcaccagcagcagccccaacaucggcgugcugggcaucaccaaggugggcagcagaagagugauccagugcggcgccgcccugaugcuggcccugggcaugaucggcaaguucagcgcccuguucgccagccugcccgaccccgugcugggcgcccuguucugcacccuguucggcaugaucaccgccgugggccugagcaaccugcaguucaucgaccugaacagcagcagaaaccuguucgugcugggcuucagcaucuucuucggccuggugcugcccagcuaccugagacagaacccccuggugaccggcaucaccggcaucgaccaggugcugaacgugcugcugaccaccgccauguucgugggcggcugcguggccuucauccuggacaacaccauccccggcacccccgaggagagaggcaucagaaaguggaagaagggcgugggcaagggcaacaagagccuggacggcauggagagcuacaaccugcccuucggcaugaacaucaucaagaaguacagaugcuucagcuaccugcccaucagccccaccuucgugggcuacaccuggaagggccugagaaagagcgacaacagcagaagcagcgacgaggacagccaggccaccggcuaa

SEQ ID NO: 23461 - RNA, 3300 nt, Artificial Sequence
  SLC24A1__Homo_sapiens__NP_004718
augggcaagcugaucagaaugggcccccaggagagauggcugcugagaaccaagagacugcacuggagcagacugcuguuccugcugggcaugcugaucaucggcagcaccuaccagcaccugagaagacccagaggccugagcagccugugggccgccgugagcagccaccagcccaucaagcuggccagcagagaccugagcagcgaggagaugaugaugaugagcagcagccccagcaagcccagcagcgagaugggcggcaagaugcuggugccccaggccagcgugggcagcgacgaggccacccugagcaugaccguggagaacauccccagcaugcccaagagaaccgccaagaugauccccaccaccaccaagaacaacuacagccccaccgccgccggcaccgagagaagaaaggaggacacccccaccagcagcagaacccugaccuacuacaccagcaccagcagcagacagaucgugaagaaguacacccccacccccagaggcgagaugaagagcuacagccccacccaggugagagagaaggugaaguacacccccagccccagaggcagaagagugggcaccuacgugcccagcaccuucaugaccauggagaccagccacgccaucacccccagaaccaccgugaaggacagcgacaucaccgccaccuacaagauccuggagaccaacagccugaagagaaucauggaggagaccacccccaccacccugaagggcauguucgacagcacccccaccuuccugacccacgagguggaggccaacgugcugaccagccccagaagcgugauggagaagaacaaccuguucccccccagaagaguggagagcaacagcagcgcccaccccuggggccuggugggcaagagcaaccccaagaccccccagggcaccgugcugcugcacacccccgccaccagcgagggccaggugaccaucagcaccaugaccggcagcagccccgccgagaccaaggccuucaccgccgccuggagccugagaaaccccagccccagaaccagcgugagcgccaucaagaccgcccccgccaucguguggagacuggccaagaagcccagcaccgcccccagcaccagcaccacccccaccgugagagccaagcugaccaugcaggugcaccacugcgugguggugaagcccacccccgccaugcugaccacccccagccccagccugaccaccgcccugcugcccgaggagcugagccccagccccagcgugcugccccccagccugcccgaccugcaccccaagggcgaguacccccccgaccuguucagcguggaggagagaagacagggcuggguggugcugcacguguucggcaugauguacguguucguggcccuggccaucgugugcgacgaguacuucgugcccgcccugggcgugaucaccgacaagcugcagaucagcgaggacguggccggcgccaccuucauggccgccggcggcagcgcccccgagcuguucaccagccugaucggcguguucaucagccacagcaacgugggcaucggcaccaucgugggcagcgccguguucaacauccuguucgugaucggcaccugcagccuguucagcagagagauccugaaccugaccugguggccccuguucagagacgugagcuucuacauccuggaccugaucaugcugauccuguucuuccuggacagccugaucgccuggugggagagccugcugcugcugcuggccuacgccuucuacguguucaccaugaaguggaacaagcacaucgaggugugggugaaggagcagcugagcagaagacccguggccaaggugauggcccuggaggaccugagcaagcccggcgacggcgccaucgccguggacgagcugcaggacaacaagaagcugaagcugcccagccugcugaccagaggcagcagcagcaccagccugcacaacagcaccaucagaagcaccaucuaccagcugaugcugcacagccuggacccccugagagaggugagacuggccaaggagaaggaggaggagagccugaaccagggcgccagagcccagccccaggccaaggccgagagcaagcccgaggaggaggagcccgccaagcugcccgccgugaccgugacccccgcccccgugcccgacaucaagggcgaccagaaggagaaccccggcggccaggaggacguggccgaggccgagagcaccggcgagaugcccggcgaggagggcgagaccgccggcgagggcgagaccgaggagaagagcggcggcgagacccagcccgagggcgagggcgagaccgagacccagggcaagggcgaggagugcgaggacgagaacgaggccgagggcaagggcgacaacgagggcgaggacgagggcgagauccacgccgaggacggcgagaugaagggcaacgagggcgagaccgagagccaggagcugagcgccgagaaccacggcgaggccaagaacgacgagaagggcguggaggacggcggcggcagcgacggcggcgacagcgaggaggaggaggaggaggaggaggagcaggaggaggaggaggaggaggaggagcaggaggaggaggaggaggaggaggaggaggaggaggagaagggcaacgaggagccccugagccuggacuggcccgagaccagacagaagcaggccaucuaccuguuccugcugcccaucguguucccccuguggcugaccgugcccgacgugagaagacaggagagcagaaaguucuucguguucaccuuccugggcagcaucauguggaucgccauguucagcuaccugaugguguggugggcccaccaggugggcgagaccaucggcaucagcgaggagaucaugggccugaccauccuggccgccggcaccagcauccccgaccugaucaccagcgugaucguggccagaaagggccugggcgacauggccgugagcagcagcgugggcagcaacaucuucgacaucaccgugggccugcccgugcccuggcugcuguucagccugaucaacggccugcagcccgugcccgugagcagcaacggccuguucugcgccaucgugcugcuguuccugaugcugcuguucgugaucagcagcaucgccagcugcaaguggagaaugaacaagauccugggcuucaccauguuccugcuguacuucguguuccugaucaucagcgugaugcuggaggacagaaucaucagcugccccgugagcguguaa

SEQ ID NO: 23462 - RNA, 1986 nt, Artificial Sequence
  SLC24A2__Homo_sapiens__XP_005251482
auggaccugcagcagagcaccaccaucaccagccuggagaaguggugccuggacgagagccugagcggcugcagaagacacuacagcgugaagaagaagcugaagcugaucagagugcugggccuguucaugggccugguggccaucagcaccgugagcuucagcaucagcgccuucagcgagaccgacacccagagcaccggcgaggccagcguggugagcggccccagaguggcccagggcuaccaccagagaacccugcuggaccugaacgacaagauccuggacuacaccccccagcccccccugagcaaggagggcgagagcgagaacagcaccgaccacgcccagggcgacuaccccaaggacaucuucagccuggaggagagaagaaagggcgccaucauccugcacgugaucggcaugaucuacauguucaucgcccuggccaucgugugcgacgaguucuucgugcccagccugaccgugaucaccgagaagcugggcaucagcgacgacguggccggcgccaccuucauggccgccggcggcagcgcccccgagcuguucaccagccugaucggcguguucaucgcccacagcaacgugggcaucggcaccaucgugggcagcgccguguucaacauccuguucgugaucggcaugugcgcccuguucagcagagagauccugaaccugaccugguggccccuguucagagacgugagcuucuacaucguggaccugaucaugcugaucaucuucuuccuggacaacgugaucauguggugggagagccugcugcugcugaccgccuacuucugcuacgugguguucaugaaguucaacgugcagguggagaagugggugaagcagaugaucaacagaaacaagguggugaaggugaccgcccccgaggcccaggccaagcccagcgccgccagagacaaggacgagcccacccugcccgccaagcccagacugcagagaggcggcagcagcgccagccugcacaacagccugaugagaaacagcaucuuccagcugaugauccacacccuggacccccuggccgaggagcugggcagcuacggcaagcugaaguacuacgacaccaugaccgaggagggcagauucagagagaaggccagcauccugcacaagaucgccaagaagaagugccacguggacgagaacgagagacagaacggcgccgccaaccacguggagaagaucgagcugcccaacagcaccagcaccgacguggagaugacccccagcagcgacgccagcgagcccgugcagaacggcaaccugagccacaacaucgagggcgccgaggcccagaccgccgacgaggaggaggaccagccccugagccuggccuggcccagcgagaccagaaagcaggugaccuuccugaucguguuccccaucguguucccccuguggaucacccugcccgacgugagaaagcccagcagcagaaaguucuuccccaucaccuucuucggcagcaucaccuggaucgccguguucagcuaccugaugguguggugggcccaccaggugggcgagaccaucggcaucagcgaggagaucaugggccugaccauccuggccgccggcaccagcauccccgaccugaucaccagcgugaucguggccagaaagggccugggcgacauggccgugagcagcagcgugggcagcaacaucuucgacaucaccgugggccugccccugcccuggcugcuguacaccgugauccacagauuccagcccguggccgugagcagcaacggccuguucugcgccaucgugcugcuguucaucaugcugcuguucgugauccugagcaucgcccugugcaaguggagaaugaacaagauccugggcuucaucauguucggccuguacuucguguuccugguggugagcgugcugcuggaggacagaauccugaccugccccgugagcaucuaa

SEQ ID NO: 23463 - RNA, 1935 nt, Artificial Sequence
  SLC24A3__Homo_sapiens__NP_065740
augagacccagcggcgacgaggacagagccagaagaagaagaagaagaagaagaagaagagaccugcugcugagccagcugugcuuccuggccagcguggcccugcugcuguggagccugagcagccugagagagcagaaggagcuggaccugauggaccuggugggcgaggacagaaaguggaugauggccagaaagcugaugcaggugaacgacacccugaccagcgaggacgccggccugagaaacagcaagaacugcaccgagcccgcccugcacgaguuccccaacgacaucuucaccaacgaggacagaagacagggcgccguggugcugcacgugcugugcgccaucuacauguucuacgcccuggccaucgugugcgacgacuucuucgugcccagccuggagaagaucugcgagagacugcaccugagcgaggacguggccggcgccaccuucauggccgccggcagcagcgcccccgagcuguucaccagcgugaucggcguguucaucaccaagggcgacgugggcgugggcaccaucgugggcagcgccguguucaacauccugugcaucaucggcgugugcggccuguucgccggccaggugguggcccugagcagcuggugccugcugagagacagcaucuacuacacccugagcgugaucgcccugaucguguucaucuacgacgagaaggugagcuggugggagagccuggugcuggugcugauguaccugaucuacaucgugaucaugaaguacaacgccugcauccaccagugcuucgagagaagaaccaagggcgccggcaacauggugaacggccuggccaacaacgccgagaucgacgacagcagcaacugcgacgccaccguggugcugcugaagaaggccaacuuccacagaaaggccagcgugaucaugguggacgagcugcugagcgccuacccccaccagcugagcuucagcgaggccggccugagaaucaugaucaccagccacuucccccccaagaccagacugagcauggccagcagaaugcugaucaacgagagacagagacugaucaacagcagagccuacaccaacggcgagagcgagguggccaucaagauccccaucaagcacaccguggagaacggcaccggccccagcagcgcccccgacagaggcgugaacggcaccagaagagacgacgugguggccgaggccggcaacgagaccgagaacgagaacgaggacaacgagaacgacgaggaggaggaggaggacgaggacgacgacgagggccccuacacccccuucgacacccccagcggcaagcuggagaccgugaagugggccuucaccuggccccugagcuucgugcuguacuucaccgugcccaacugcaacaagcccagaugggagaagugguucauggugaccuucgccagcagcacccuguggaucgccgccuucagcuacaugaugguguggauggugaccaucaucggcuacacccugggcauccccgacgugaucaugggcaucaccuuccuggccgccggcaccagcgugcccgacugcauggccagccugaucguggccagacagggcaugggcgacauggccgugagcaacagcaucggcagcaacguguucgacauccugaucggccugggccugcccugggcccugcagacccuggccguggacuacggcagcuacaucagacugaacagcagaggccugaucuacagcgugggccugcugcuggccagcguguucgugaccguguucggcgugcaccugaacaaguggcagcuggacaagaagcugggcugcggcugccugcugcuguacggcguguuccugugcuucagcaucaugaccgaguucaacguguucaccuucgugaaccugcccaugugcggcgaccacuaa

SEQ ID NO: 23464 - RNA, 1869 nt, Artificial Sequence
  SLC24A4__Homo_sapiens__NP_705932
auggcccugagaggcacccugagaccccugaaggugagaagaagaagagagaugcugccccagcaggugggcuucgugugcgccgugcuggcccuggugugcugcgccagcggccuguucggcagccugggccacaagaccgccagcgccagcaagagagugcugcccgacaccuggagaaacagaaagcugauggcccccgugaacggcacccagaccgccaagaacugcaccgaccccgccauccacgaguuccccaccgaccuguucagcaacaaggagagacagcacggcgccgugcugcugcacauccugggcgcccuguacauguucuacgcccuggccaucgugugcgacgacuucuucgugcccagccuggagaagaucugcgagagacugcaccugagcgaggacguggccggcgccaccuucauggccgccggcagcagcacccccgagcuguucgccagcgugaucggcguguucaucacccacggcgacgugggcgugggcaccaucgugggcagcgccguguucaacauccugugcaucaucggcgugugcggccuguucgccggccagguggugagacugaccuggugggccgugugcagagacagcguguacuacaccaucagcgugaucgugcugaucguguucaucuacgacgagcagaucguguggugggagggccuggugcugaucauccuguacguguucuacauccugaucaugaaguacaacgugaagaugcaggccuucuucaccgugaagcagaagagcaucgccaacggcaaccccgugaacagcgagcuggaggccggcaacgacuucuacgacggcagcuacgacgaccccagcgugccccugcugggccaggugaaggagaagccccaguacggcaagaaccccguggugaugguggacgagaucaugagcagcagcccccccaaguucaccuuccccgaggccggccugagaaucaugaucaccaacaaguucggccccagaaccagacugagaauggccagcagaaucaucaucaacgagagacagagacugaucaacagcgccaacggcgugagcagcaagccccugcagaacggcagacacgagaacaucgagaacggcaacgugcccguggagaaccccgaggacccccagcagaaccaggagcagcagccccccccccagccccccccccccgagcccgagcccguggaggccgacuuccugagccccuucagcgugcccgaggccagaggcgacaaggugaaguggguguucaccuggccccugaucuuccugcugugcgugaccauccccaacugcagcaagcccagaugggagaaguucuucauggugaccuucaucaccgccacccuguggaucgccguguucagcuacaucaugguguggcuggugaccaucaucggcuacacccugggcauccccgacgugaucaugggcaucaccuuccuggccgccggcaccagcgugcccgacugcauggccagccugaucguggccagacagggccugggcgacauggccgugagcaacaccaucggcagcaacguguucgacauccuggugggccugggcgugcccuggggccugcagaccaugguggugaacuacggcagcaccgugaagaucaacagcagaggccugguguacagcguggugcugcugcugggcagcguggcccugaccgugcugggcauccaccugaacaaguggagacuggacagaaagcugggcguguacgugcuggugcuguacgccaucuuccugugcuucagcaucaugaucgaguucaacguguucaccuucgugaaccugcccaugugcagagaggacgacuaa

SEQ ID NO: 23465 - RNA, 1503 nt, Artificial Sequence
  SLC24A5__Homo_sapiens__NP_995322
augcagaccaagggcggccagaccugggccagaagagcccugcugcugggcauccugugggccaccgcccaccugccccugagcggcaccagccugccccagagacugcccagagccaccggcaacagcacccagugcgugaucagccccagcagcgaguuccccgagggcuucuucaccagacaggagagaagagacggcggcaucaucaucuacuuccugaucaucguguacauguucauggccaucagcaucgugugcgacgaguacuuccugcccagccuggagaucaucagcgagagccugggccugagccaggacguggccggcaccaccuucauggccgccggcagcagcgcccccgagcuggugaccgccuuccugggcguguucaucaccaagggcgacaucggcaucagcaccauccugggcagcgccaucuacaaccugcugggcaucugcgccgccugcggccugcugagcaacaccgugagcacccugagcugcuggccccuguucagagacugcgccgccuacaccaucagcgccgccgccgugcugggcaucaucuacgacaaccagguguacugguacgagggcgcccugcugcugcugaucuacggccuguacgugcuggugcugugcuucgacaucaagaucaaccaguacaucaucaagaagugcagccccugcugcgccugccuggccaaggccauggagagaagcgagcagcagccccugaugggcugggaggacgagggccagcccuucaucagaagacagagcagaaccgacagcggcaucuucuacgaggacagcggcuacagccagcugagcaucagccugcacggccugagccaggugagcgaggacccccccagcguguucaacaugcccgaggccgaccugaagagaaucuucugggugcugagccugcccaucaucacccugcuguuccugaccacccccgacugcagaaagaaguucuggaagaacuacuucgugaucaccuucuucaugagcgccaucuggaucagcgccuucaccuacauccugguguggauggugaccaucaccggcgagacccuggagauccccgacaccgugaugggccugacccugcuggccgccggcaccagcauccccgacaccaucgccagcgugcugguggccagaaagggcaagggcgacauggccaugagcaacaucgugggcagcaacguguucgacaugcugugccugggcauccccugguucaucaagaccgccuucaucaacggcagcgcccccgccgaggugaacagcagaggccugaccuacaucaccaucagccugaacaucagcaucaucuuccuguuccuggccgugcacuucaacggcuggaagcuggacagaaagcugggcaucgugugccugcugagcuaccugggccuggccacccugagcgugcuguacgagcugggcaucaucggcaacaacaagaucagaggcugcggcggcuaa

SEQ ID NO: 23466 - RNA, 891 nt, Artificial Sequence
  SLC25A10__Homo_sapiens__NP_001257817
auggccgccgaggccagagugagcagaugguacuucggcggccuggccagcugcggcgccgccugcugcacccacccccuggaccugcugaaggugcaccugcagacccagcaggaggugaagcugagaaugaccggcauggcccugagaguggugagaaccgacggcauccuggcccuguacagcggccugagcgccagccugugcagacagaugaccuacagccugaccagauucgccaucuacgagaccgugagagacagaguggccaagggcagccagggcccccugcccuuccacgagaaggugcugcugggcagcgugagcggccuggccggcggcuucgugggcacccccgccgaccuggugaacgugagaaugcagaacgacgugaagcugccccagggccagagaagaaacuacgcccacgcccuggacggccuguacagaguggccagagaggagggccugagaagacuguucagcggcgccaccauggccagcagcagaggcgcccuggugaccgugggccagcugagcugcuacgaccaggccaagcagcuggugcugagcaccggcuaccugagcgacaacaucuucacccacuucguggccagcuucaucgccgccgccggcgacgagccccccccccagggcggcugcgccaccuuccugugccagccccuggacgugcugaagaccagacugaugaacagcaagggcgaguaccagggcguguuccacugcgccguggagaccgccaagcugggcccccuggccuucuacaagggccuggugcccgccggcaucagacugaucccccacaccgugcugaccuucguguuccuggagcagcugagaaagaacuucggcaucaaggugcccagcuaa

SEQ ID NO: 23467 - RNA, 2037 nt, Artificial Sequence
  SLC25A12__Homo_sapiens__NP_003696
auggccgugaaggugcagaccaccaagagaggcgacccccacgagcugagaaacaucuuccugcaguacgccagcaccgagguggacggcgagagauacaugacccccgaggacuucgugcagagauaccugggccuguacaacgaccccaacagcaaccccaagaucgugcagcugcuggccggcguggccgaccagaccaaggacggccugaucagcuaccaggaguuccuggccuucgagagcgugcugugcgcccccgacagcauguucaucguggccuuccagcuguucgacaagagcggcaacggcgaggugaccuucgagaacgugaaggagaucuucggccagaccaucauccaccaccacauccccuucaacugggacugcgaguucaucagacugcacuucggccacaacagaaagaagcaccugaacuacaccgaguucacccaguuccugcaggagcugcagcuggagcacgccagacaggccuucgcccugaaggacaagagcaagagcggcaugaucagcggccuggacuucagcgacaucauggugaccaucagaagccacaugcugacccccuucguggaggagaaccuggugagcgccgccggcggcagcaucagccaccaggugagcuucagcuacuucaacgccuucaacagccugcugaacaacauggagcuggugagaaagaucuacagcacccuggccggcaccagaaaggacguggaggugaccaaggaggaguucgcccagagcgccaucagauacggccaggugaccccccuggagaucgacauccuguaccagcuggccgaccuguacaacgccagcggcagacugacccuggccgacaucgagagaaucgccccccuggccgagggcgcccugcccuacaaccuggccgagcugcagagacagcagagccccggccugggcagacccaucuggcugcagaucgccgagagcgccuacagauucacccugggcagcguggccggcgccgugggcgccaccgccguguaccccaucgaccuggugaagaccagaaugcagaaccagagaggcagcggcagcguggugggcgagcugauguacaagaacagcuucgacugcuucaagaaggugcugagauacgagggcuucuucggccuguacagaggccugaucccccagcugaucggcguggcccccgagaaggccaucaagcugaccgugaacgacuucgugagagacaaguucaccagaagagacggcagcgugccccugcccgccgaggugcuggccggcggcugcgccggcggcagccaggugaucuucaccaacccccuggagaucgugaagaucagacugcagguggccggcgagaucaccaccggccccagagugagcgcccugaacgugcugagagaccugggcaucuucggccuguacaagggcgccaaggccugcuuccugagagacauccccuucagcgccaucuacuuccccguguacgcccacugcaagcugcugcuggccgacgagaacggccacgugggcggccugaaccugcuggccgccggcgccauggccggcgugcccgccgccagccuggugacccccgccgacgugaucaagaccagacugcagguggccgccagagccggccagaccaccuacagcggcgugaucgacugcuucagaaagauccugagagaggagggccccagcgccuucuggaagggcaccgccgccagaguguucagaagcagcccccaguucggcgugacccuggugaccuacgagcugcugcagagaugguucuacaucgacuucggcggccugaagcccgccggcagcgagcccacccccaagagcagaaucgccgaccugccccccgccaaccccgaccacaucggcggcuacagacuggccaccgccaccuucgccggcaucgagaacaaguucggccuguaccugcccaaguucaagagccccagcguggccguggugcagcccaaggccgccguggccgccacccaguaa

SEQ ID NO: 23468 - RNA, 2031 nt, Artificial Sequence
  SLC25A13__Homo_sapiens__NP_001153682
auggccgccgccaagguggcccugaccaagagagccgaccccgccgagcugagaaccaucuuccugaaguacgccagcaucgagaagaacggcgaguucuucaugagccccaacgacuucgugaccagauaccugaacaucuucggcgagagccagcccaaccccaagaccguggagcugcugagcggcgugguggaccagaccaaggacggccugaucagcuuccaggaguucguggccuucgagagcgugcugugcgcccccgacgcccuguucaugguggccuuccagcuguucgacaaggccggcaagggcgaggugaccuucgaggacgugaagcagguguucggccagaccaccauccaccagcacauccccuucaacugggacagcgaguucgugcagcugcacuucggcaaggagagaaagagacaccugaccuacgccgaguucacccaguuccugcuggagauccagcuggagcacgccaagcaggccuucgugcagagagacaacgccagaaccggcagagugaccgccaucgacuucagagacaucauggugaccaucagaccccacgugcugacccccuucguggaggagugccugguggccgccgccggcggcaccaccagccaccaggugagcuucagcuacuucaacggcuucaacagccugcugaacaacauggagcugaucagaaagaucuacagcacccuggccggcaccagaaaggacguggaggugaccaaggaggaguucgugcuggccgcccagaaguucggccaggugacccccauggagguggacauccuguuccagcuggccgaccuguacgagcccagaggcagaaugacccuggccgacaucgagagaaucgccccccuggaggagggcacccugcccuucaaccuggccgaggcccagagacagcagaaggccagcggcgacagcgccagacccgugcugcugcagguggccgagagcgccuacagauucggccugggcagcguggccggcgccgugggcgccaccgccguguaccccaucgaccuggugaagaccagaaugcagaaccagagaagcaccggcagcuucgugggcgagcugauguacaagaacagcuucgacugcuucaagaaggugcugagauacgagggcuucuucggccuguacagaggccugcugccccagcugcugggcguggcccccgagaaggccaucaagcugaccgugaacgacuucgugagagacaaguucaugcacaaggacggcagcgugccccuggccgccgagauccuggccggcggcugcgccggcggcagccaggugaucuucaccaacccccuggagaucgugaagaucagacugcagguggccggcgagaucaccaccggccccagagugagcgcccugagcguggugagagaccugggcuucuucggcaucuacaagggcgccaaggccugcuuccugagagacauccccuucagcgccaucuacuuccccugcuacgcccacgugaaggccagcuucgccaacgaggacggccaggugagccccggcagccugcugcuggccggcgccaucgccggcaugcccgccgccagccuggugacccccgccgacgugaucaagaccagacugcagguggccgccagagccggccagaccaccuacagcggcgugaucgacugcuucagaaagauccugagagaggagggccccaaggcccuguggaagggcgccggcgccagaguguucagaagcagcccccaguucggcgugacccugcugaccuacgagcugcugcagagaugguucuacaucgacuucggcggcgugaagcccaugggcagcgagcccgugcccaagagcagaaucaaccugcccgcccccaaccccgaccacgugggcggcuacaagcuggccguggccaccuucgccggcaucgagaacaaguucggccuguaccugccccuguucaagcccagcgugagcaccagcaaggccaucggcggcggccccuaa

SEQ ID NO: 23469 - RNA, 978 nt, Artificial Sequence
  SLC25A14__Homo_sapiens__NP_001269124
augggcaucuuccccggcaucauccugaucuuccugagagugaaguucgccaccgccgccgugaucgugagcggccaccagaagagcaccaccgugagccacgagaugagcggccugaacuggaagcccuucguguacggcggccuggccagcaucguggccgaguucggcaccuuccccguggaccugaccaagaccagacugcaggugcagggccagagcaucgacgccagauucaaggagaucaaguacagaggcauguuccacgcccuguucagaaucugcaaggaggagggcgugcuggcccuguacagcggcaucgcccccgcccugcugagacaggccagcuacggcaccaucaagaucggcaucuaccagagccugaagagacuguucguggagagacuggaggacgagacccugcugaucaacaugaucugcggcguggugagcggcgugaucagcagcaccaucgccaaccccaccgacgugcugaagaucagaaugcaggcccagggcagccuguuccagggcagcaugaucggcagcuucaucgacaucuaccagcaggagggcaccagaggccuguggagaggcguggugcccaccgcccagagagccgccaucguggugggcguggagcugcccguguacgacaucaccaagaagcaccugauccugagcggcaugaugggcgacaccauccugacccacuucgugagcagcuucaccugcggccuggccggcgcccuggccagcaaccccguggacguggugagaaccagaaugaugaaccagagagccaucgugggccacguggaccuguacaagggcaccguggacggcauccugaagauguggaagcacgagggcuucuucgcccuguacaagggcuucuggcccaacuggcugagacugggccccuggaacaucaucuucuucaucaccuacgagcagcugaagagacugcagaucuaa

SEQ ID NO: 23470 - RNA, 906 nt, Artificial Sequence
  SLC25A15__Homo_sapiens__NP_055067
augaagagcaaccccgccauccaggccgccaucgaccugaccgccggcgccgccggcggcaccgccugcgugcugaccggccagcccuucgacaccaugaaggugaagaugcagaccuuccccgaccuguacagaggccugaccgacugcugccugaagaccuacagccaggugggcuucagaggcuucuacaagggcaccagccccgcccugaucgccaacaucgccgagaacagcgugcuguucaugugcuacggcuucugccagcagguggugagaaagguggccggccuggacaagcaggccaagcugagcgaccugcagaacgccgccgccggcagcuucgccagcgccuucgccgcccuggugcugugccccaccgagcuggugaagugcagacugcagaccauguacgagauggagaccagcggcaagaucgccaagagccagaacaccguguggagcgugaucaagagcauccugagaaaggacggcccccugggcuucuaccacggccugagcagcacccugcugagagaggugcccggcuacuucuucuucuucggcggcuacgagcugagcagaagcuucuucgccagcggcagaagcaaggacgagcugggccccgugccccugaugcugagcggcggcgugggcggcaucugccuguggcuggccguguaccccguggacugcaucaagagcagaauccaggugcugagcaugagcggcaagcaggccggcuucaucagaaccuucaucaacguggugaagaacgagggcaucaccgcccuguacagcggccugaagcccaccaugaucagagccuuccccgccaacggcgcccuguuccuggccuacgaguacagcagaaagcugaugaugaaccagcuggaggccuacuaa

SEQ ID NO: 23471 - RNA, 705 nt, Artificial Sequence
  SLC25A16__Homo_sapiens__XP_006718050
augaugaucagaaucuuccccuacggcgccauccaguucauggccuucgagcacuacaagacccugaucaccaccaagcugggcaucagcggccacgugcacagacugauggccggcagcauggccggcaugaccgccgugaucugcaccuacccccuggacauggugagagugagacuggccuuccaggugaagggcgagcacagcuacaccggcaucauccacgccuucaagaccaucuacgccaaggagggcggcuucuucggcuucuacagaggccugaugcccaccauccugggcauggcccccuacgccggcgugagcuucuucaccuucggcacccugaagagcgugggccugagccacgcccccacccugcugggcagacccagcagcgacaaccccaacgugcuggugcugaagacccacgugaaccugcugugcggcggcguggccggcgccaucgcccagaccaucagcuaccccuucgacgugaccagaagaagaaugcagcugggcaccgugcugcccgaguucgagaagugccugaccaugagagacaccaugaaguacguguacggccaccacggcaucagaaagggccuguacagaggccugagccugaacuacaucagaugcauccccagccaggccguggccuucaccaccuacgagcugaugaagcaguucuuccaccugaacuaa

SEQ ID NO: 23472 - RNA, 948 nt, Artificial Sequence
  SLC25A18__Homo_sapiens__NP_001290413
augacccaccaggaccugagcaucaccgccaagcugaucaacggcggcguggccggccuggugggcgugaccugcguguuccccaucgaccuggccaagaccagacugcagaaccagcacggcaaggccauguacaagggcaugaucgacugccugaugaagaccgccagagccgagggcuucuucggcauguacagaggcgccgccgugaaccugacccuggugacccccgagaaggccaucaagcuggccgccaacgacuucuucagaagacugcugauggaggacggcaugcagagaaaccugaagauggagaugcuggccggcugcggcgccggcaugugccaggugguggugaccugccccauggagaugcugaagauccagcugcaggacgccggcagacuggccgugcaccaccagggcagcgccagcgcccccagcaccagcagaagcuacaccaccggcagcgccagcacccacagaagacccagcgccacccugaucgccugggagcugcugagaacccagggccuggccggccuguacagaggccugggcgccacccugcugagagacauccccuucagcaucaucuacuucccccuguucgccaaccugaacaaccugggcuucaacgagcuggccggcaaggccagcuucgcccacagcuucgugagcggcugcguggccggcagcaucgccgccguggccgugaccccccuggacgugcugaagaccagaauccagacccugaagaagggccugggcgaggacauguacagcggcaucaccgacugcgccagaaagcuguggauccaggagggccccagcgccuucaugaagggcgccggcugcagagcccuggugaucgccccccuguucggcaucgcccagggcguguacuucaucggcaucggcgagagaauccugaagugcuucgacuaa

SEQ ID NO: 23473 - RNA, 963 nt, Artificial Sequence
  SLC25A19__Homo_sapiens__XP_006722070
auggugggcuacgaccccaagcccgacggcagaaacaacaccaaguuccagguggccguggccggcagcgugagcggccuggugaccagagcccugaucagccccuucgacgugaucaagaucagauuccagcugcagcacgagagacugagcagaagcgaccccagcgccaaguaccacggcauccugcaggccagcagacagauccugcaggaggagggccccaccgccuucuggaagggccacgugcccgcccagauccugagcaucggcuacggcgccgugcaguuccugagcuucgagaugcugaccgagcuggugcacagaggcagcguguacgacgccagagaguucagcgugcacuucgugugcggcggccuggccgccugcauggccacccugaccgugcaccccguggacgugcugagaaccagauucgccgcccagggcgagcccaagguguacaacacccugagacacgccgugggcaccauguacagaagcgagggcccccagguguucuacaagggccuggcccccacccugaucgccaucuuccccuacgccggccugcaguucagcugcuacagcagccugaagcaccuguacaagugggccauccccgccgagggcaagaagaacgagaaccugcagaaccugcugugcggcagcggcgccggcgugaucagcaagacccugaccuacccccuggaccuguucaagaagagacugcaggugggcggcuucgagcacgccagagccgccuucggccaggugagaagauacaagggccugauggacugcgccaagcaggugcugcagaaggagggcgcccugggcuucuucaagggccugagccccagccugcugaaggccgcccugagcaccggcuucauguucuucagcuacgaguucuucugcaacguguuccacugcaugaacagaaccgccagccagagauaa

SEQ ID NO: 23474 - RNA, 957 nt, Artificial Sequence
  SLC25A1__Homo_sapiens__NP_001243463
auguuccccgccgcccuggccagaagacccagaagacccaagagcggcaccggcgagggccccgagagacagagacccggcggcagccugagaagcggcuuccccgugcccgccggcggccuggccggcggcaucgagaucugcaucaccuuccccaccgaguacgugaagacccagcugcagcuggacgagagaagccacccccccagauacagaggcaucggcgacugcgugagacagaccgugagaagccacggcgugcugggccuguacagaggccugagcagccugcuguacggcagcauccccaaggccgccgugagauucggcauguucgaguuccugagcaaccacaugagagacgcccagggcagacuggacagcaccagaggccugcugugcggccugggcgccggcguggccgaggccguggugguggugugccccauggagaccaucaaggugaaguucauccacgaccagaccagccccaaccccaaguacagaggcuucuuccacggcgugagagagaucgugagagagcagggccugaagggcaccuaccagggccugaccgccaccgugcugaagcagggcagcaaccaggccaucagauucuucgugaugaccagccugagaaacugguacagaggcgacaaccccaacaagcccaugaacccccugaucaccggcguguucggcgccaucgccggcgccgccagcguguucggcaacaccccccuggacgugaucaagaccagaaugcagggccuggaggcccacaaguacagaaacaccugggacugcggccugcagauccugaagaaggagggccugaaggccuucuacaagggcaccgugcccagacugggcagagugugccuggacguggccaucguguucgugaucuacgacgagguggugaagcugcugaacaagguguggaagaccgacuaa

SEQ ID NO: 23475 - RNA, 906 nt, Artificial Sequence
  SLC25A20__Homo_sapiens__NP_000378
auggccgaccagcccaagcccaucagcccccugaagaaccugcuggccggcggcuucggcggcgugugccugguguucgugggccacccccuggacaccgugaaggugagacugcagacccagccccccagccugcccggccagccccccauguacagcggcaccuucgacugcuucagaaagacccuguucagagagggcaucaccggccuguacagaggcauggccgcccccaucaucggcgugacccccauguucgccgugugcuucuucggcuucggccugggcaagaagcugcagcagaagcaccccgaggacgugcugagcuacccccagcuguucgccgccggcaugcugagcggcguguucaccaccggcaucaugacccccggcgagagaaucaagugccugcugcagauccaggccagcagcggcgagagcaaguacaccggcacccuggacugcgccaagaagcuguaccaggaguucggcaucagaggcaucuacaagggcaccgugcugacccugaugagagacgugcccgccagcggcauguacuucaugaccuacgaguggcugaagaacaucuucacccccgagggcaagagagugagcgagcugagcgcccccagaauccugguggccggcggcaucgccggcaucuucaacugggccguggccaucccccccgacgugcugaagagcagauuccagaccgccccccccggcaaguaccccaacggcuucagagacgugcugagagagcugaucagagacgagggcgugaccagccuguacaagggcuucaacgccgugaugaucagagccuuccccgccaacgccgccugcuuccugggcuucgagguggccaugaaguuccugaacugggccacccccaaccuguaa

SEQ ID NO: 23476 - RNA, 897 nt, Artificial Sequence
  SLC25A21__Homo_sapiens__NP_001164641
augagcgccaagcccgaggugagccuggugagagaggccagcagacagaucguggccggcggcagcgccggccugguggagaucugccugaugcacccccuggacguggugaagaccagauuccagauccagagaugcgccaccgaccccaacagcuacaagagccugguggacagcuucagaaugaucuuccagauggagggccuguucggcuucuacaagggcauccugccccccauccuggccgagacccccaagagagccgugaaguucuucaccuucgagcaguacaagaagcugcugggcuacgugagccugagccccgcccugaccuucgccaucgccggccugggcagcggccugaccgaggccaucguggugaaccccuucgagguggugaaggugggccugcaggccaacagaaacaccuucgccgagcagcccagcaccgugggcuacgccagacagaucaucaagaaggagggcuggggccugcagggccugaacaagggccugaccgccacccugggcagacacggcguguucaacaugguguacuucggcuucuacuacaacgugaagaacaugauccccgugaacaaggaccccauccuggaguucuggagaaaguucggcaucggccugcugagcggcaccaucgccagcgugaucaacauccccuucgacguggccaagagcagaauccagggcccccagcccgugcccggcgagaucaaguacagaaccugcuucaagaccauggccaccguguaccaggaggagggcauccuggcccuguacaagggccugcugcccaagaucaugagacugggccccggcggcgccgugaugcugcugguguacgaguacaccuacagcuggcugcaggagaacuaa

SEQ ID NO: 23477 - RNA, 972 nt, Artificial Sequence
  SLC25A22__Homo_sapiens__XP_011518673
auggccgacaagcagaucagccugcccgccaagcugaucaacggcggcaucgccggccugaucggcgugaccugcguguuccccaucgaccuggccaagaccagacugcagaaccagcagaacggccagagaguguacaccagcaugagcgacugccugaucaagaccgugagaagcgagggcuacuucggcauguacagaggcgccgccgugaaccugacccuggugacccccgagaaggccaucaagcuggccgccaacgacuucuucagacaccagcugagcaaggacggccagaagcugacccugcugaaggagaugcuggccggcugcggcgccggcaccugccaggugaucgugaccacccccauggagaugcugaagauccagcugcaggacgccggcagaaucgccgcccagagaaagauccuggccgcccagggccagcugagcgcccagggcggcgcccagcccagcguggaggcccccgccgcccccagacccaccgccacccagcugaccagagaccugcugagaagcagaggcaucgccggccuguacaagggccugggcgccacccugcugagagacgugcccuucagcgugguguacuucccccuguucgccaaccugaaccagcugggcagacccgccagcgaggagaagagccccuucuacgugagcuuccuggccggcugcguggccggcagcgccgccgccguggccgugaaccccugcgacguggugaagaccagacugcagagccugcagagaggcgugaacgaggacaccuacagcggcauccuggacugcgccagaaagauccugagacacgagggccccagcgccuuccugaagggcgccuacugcagagcccuggugaucgccccccuguucggcaucgcccaggugguguacuuccugggcaucgccgagagccugcugggccugcugcaggacccccaggccuaa

SEQ ID NO: 23478 - RNA, 1407 nt, Artificial Sequence
  SLC25A23__Homo_sapiens__NP_077008
augagaggcagccccggcgacgccgagagaagacagagauggggcagacuguucgaggagcuggacagcaacaaggacggcagaguggacgugcacgagcugagacagggccuggccagacugggcggcggcaaccccgaccccggcgcccagcagggcaucagcagcgagggcgacgccgaccccgacggcggccuggaccuggaggaguucagcagauaccugcaggagagagagcagagacugcugcugauguuccacagccuggacagaaaccaggacggccacaucgacgugagcgagauccagcagagcuucagagcccugggcaucagcaucagccuggagcaggccgagaagauccugcacagcauggacagagacggcaccaugaccaucgacuggcaggaguggagagaccacuuccugcugcacagccuggagaacguggaggacgugcuguacuucuggaagcacagcaccgugcuggacaucggcgagugccugaccgugcccgacgaguucagcaagcaggagaagcugaccggcaugugguggaagcagcugguggccggcgccguggccggcgccgugagcagaaccggcaccgccccccuggacagacugaagguguucaugcaggugcacgccagcaagaccaacagacugaacauccugggcggccugagaagcauggugcuggagggcggcaucagaagccuguggagaggcaacggcaucaacgugcugaagaucgcccccgagagcgccaucaaguucauggccuacgagcagaucaagagagccauccugggccagcaggagacccugcacgugcaggagagauucguggccggcagccuggccggcgccaccgcccagaccaucaucuaccccauggaggugcugaagaccagacugacccugagaagaaccggccaguacaagggccugcuggacugcgccagaagaauccuggagagagagggccccagagccuucuacagaggcuaccugcccaacgugcugggcaucauccccuacgccggcaucgaccuggccguguacgagacccugaagaacugguggcugcagcaguacagccacgacagcgccgaccccggcauccuggugcugcuggccugcggcaccaucagcagcaccugcggccagaucgccagcuacccccuggcccuggugagaaccagaaugcaggcccaggccagcaucgagggcggcccccagcugagcaugcugggccugcugagacacauccugagccaggagggcaugagaggccuguacagaggcaucgcccccaacuucaugaaggugauccccgccgugagcaucagcuacgugguguacgagaacaugaagcaggcccugggcgugaccagcagauaa

SEQ ID NO: 23479 - RNA, 1512 nt, Artificial Sequence
  SLC25A25__Homo_sapiens__NP_001006642
auggugagcagcgugcugugcagaugcguggccagccccccccccgacgccgccgccaccgccgccagcagcagcgccagcagccccgccagcgugggcgaccccugcggcggcgccaucugcggcggccccgaccacagacugagacuguggagacuguuccagacccuggacgugaacagagacggcggccugugcgugaacgaccuggccgugggccugagaagacugggccugcacagaaccgagggcgagcugcagaagaucgugcaggccggcgacaaggaccuggacggccagcuggacuucgaggaguucgugcacuaccugcaggaccacgagaagaagcugagacugguguucaagagccuggacaagaagaacgacggcagaaucgacgcccaggagaucaugcagagccugagagaccugggcgugaagaucagcgagcagcaggccgagaagauccugaagagcauggacaagaacggcaccaugaccaucgacuggaacgaguggagagacuaccaccugcugcaccccguggagaacauccccgagaucauccuguacuggaagcacagcaccaucuucgacgugggcgagaaccugaccgugcccgacgaguucaccguggaggagagacagaccggcaugugguggagacaccugguggccggcggcggcgccggcgccgugagcagaaccugcaccgccccccuggacagacugaaggugcugaugcaggugcacgccagcagaagcaacaacaugggcaucgugggcggcuucacccagaugaucagagagggcggcgccagaagccuguggagaggcaacggcaucaacgugcugaagaucgcccccgagagcgccaucaaguucauggccuacgagcagaucaagagacuggugggcagcgaccaggagacccugagaauccacgagagacugguggccggcagccuggccggcgccaucgcccagagcagcaucuaccccauggaggugcugaagaccagaauggcccugagaaagaccggccaguacagcggcaugcuggacugcgccagaagaauccuggccagagagggcguggccgccuucuacaagggcuacgugcccaacaugcugggcaucauccccuacgccggcaucgaccuggccguguacgagacccugaagaacgccuggcugcagcacuacgccgugaacagcgccgaccccggcguguucgugcugcuggccugcggcaccaugagcagcaccugcggccagcuggccagcuacccccuggcccuggugagaaccagaaugcaggcccaggccagcaucgagggcgcccccgaggugaccaugagcagccuguucaagcacauccugagaaccgagggcgccuucggccuguacagaggccuggcccccaacuucaugaaggugauccccgccgugagcaucagcuacgugguguacgagaaccugaagaucacccugggcgugcagagcagauaa

SEQ ID NO: 23480 - RNA, 903 nt, Artificial Sequence
  SLC25A27__Homo_sapiens__NP_001190980
augagcgugcccgaggaggaggagagacugcugccccugacccagagauggcccagagccagcaaguuccugcugagcggcugcgccgccaccguggccgagcuggccaccuucccccuggaccugaccaagaccagacugcagaugcagggcgaggccgcccuggccagacugggcgacggcgccagagagagcgcccccuacagaggcauggugagaaccgcccugggcaucaucgaggaggagggcuuccugaagcuguggcagggcgugacccccgccaucuacagacacgugguguacagcggcggcagaauggugaccuacgagcaccugagagaggugguguucggcaagagcgaggacgagcacuacccccuguggaagagcgugaucggcggcaugauggccggcgugaucggccaguuccuggccaaccccaccgaccuggugaaggugcagaugcagauggagggcaagagaaagcuggagggcaagccccugagauucagaggcgugcaccacgccuucgccaagauccuggccgagggcggcaucagaggccugugggccggcugggugcccaacauccagagagccgcccuggugaacaugggcgaccugaccaccuacgacaccgugaagcacuaccuggugcugaacaccccccuggaggacaacaucaugacccacggccugagcagccugugcagcggccugguggccagcauccugggcacccccgccgacgugaucaagagcagaaucaugaaccagcccagagacaagcagggcagaggccugcuguacaagagcagcaccgacugccugauccaggccgugcagggcgagggcuucaugagccuguacaagggcuuccugcccagcuggcugagaauguaa

SEQ ID NO: 23481 - RNA, 906 nt, Artificial Sequence
  SLC25A2__Homo_sapiens__NP_114153
augaagagcggccccggcauccaggccgccaucgaccugaccgccggcgccgccggcggcaccgccugcgugcugaccggccagcccuucgacaccaucaaggugaagaugcagaccuuccccgaccuguacaagggccugaccgacugcuuccugaagaccuacgcccaggugggccugagaggcuucuacaagggcaccggccccgcccugauggccuacguggccgagaacagcgugcuguucaugugcuacggcuucugccagcaguucgugagaaagguggccggcauggacaagcaggccaagcugagcgaccugcagaccgccgccgccggcagcuucgccagcgccuucgccgcccuggcccugugccccaccgagcuggugaagugcagacugcagaccauguacgagauggagaugagcggcaagaucgccaagagccacaacaccaucuggagcguggugaagggcauccugaagaaggacggcccccugggcuucuaccacggccugagcagcacccugcugcaggaggugcccggcuacuucuucuucuucggcggcuacgagcugagcagaagcuucuucgccagcggcagaagcaaggacgagcugggccccgugcaccugaugcugagcggcggcguggccggcaucugccuguggcuggugguguuccccguggacugcaucaagagcagaauccaggugcugagcauguacggcaagcaggccggcuucaucggcacccugcugagcguggugagaaacgagggcaucguggcccuguacagcggccugaaggccaccaugaucagagccauccccgccaacggcgcccuguucguggccuacgaguacagcagaaagaugaugaugaagcagcuggaggccuacuaa

SEQ ID NO: 23482 - RNA, 936 nt, Artificial Sequence
  SLC25A36__Homo_sapiens__NP_001098117
augagccagagagacacccuggugcaccuguucgccggcggcugcggcggcaccgugggcgccauccugaccugcccccuggagguggugaagaccagacugcagagcagcagcgugacccuguacaucagcgaggugcagcugaacaccauggccggcgccagcgugaacagaguggugagccccggcccccugcacugccugaaggugauccuggagaaggagggccccagaagccuguucagaggccugggccccaaccuggugggcguggcccccagcagagccaucuacuucgccgccuacagcaacugcaaggagaagcugaacgacguguucgaccccgacagcacccaggugcacaugaucagcgccgccauggccggcuucaccgccaucaccgccaccaaccccaucuggcugaucaagaccagacugcagcuggacgccagaaacagaggcgagagaagaaugggcgccuucgagugcgugagaaagguguaccagaccgacggccugaagggcuucuacagaggcaugagcgccagcuacgccggcaucagcgagaccgugauccacuucgugaucuacgagagcaucaagcagaagcugcuggaguacaagaccgccagcaccauggagaacgacgaggagagcgugaaggaggccagcgacuucgugggcaugaugcuggccgccgccaccagcaagaccugcgccaccaccaucgccuacccccacgagguggugagaaccagacugagagaggagggcaccaaguacagaagcuucuuccagacccugagccugcuggugcaggaggagggcuacggcagccuguacagaggccugaccacccaccuggugagacagauccccaacaccgccaucaugauggccaccuacgagcuggugguguaccugcugaacggcuaa

SEQ ID NO: 23483 - RNA, 1017 nt, Artificial Sequence
  SLC25A37__Homo_sapiens__NP_057696
auggagcugagaagcggcagcgugggcagccaggccguggccagaagaauggacggcgacagcagagacggcggcggcggcaaggacgccaccggcagcgaggacuacgagaaccugcccaccagcgccagcgugagcacccacaugaccgccggcgccauggccggcauccuggagcacagcgugauguaccccguggacagcgugaagaccagaaugcagagccugagccccgaccccaaggcccaguacaccagcaucuacggcgcccugaagaagaucaugagaaccgagggcuucuggagaccccugagaggcgugaacgugaugaucaugggcgccggccccgcccacgccauguacuucgccugcuacgagaacaugaagagaacccugaacgacguguuccaccaccagggcaacagccaccuggccaacggcaucgccggcagcauggccacccugcugcacgacgccgugaugaaccccgccgagguggugaagcagagacugcagauguacaacagccagcacagaagcgccaucagcugcaucagaaccguguggagaaccgagggccugggcgccuucuacagaagcuacaccacccagcugaccaugaacauccccuuccagagcauccacuucaucaccuacgaguuccugcaggagcaggugaacccccacagaaccuacaacccccagagccacaucaucagcggcggccuggccggcgcccuggccgccgccgccaccaccccccuggacgugugcaagacccugcugaacacccaggagaacguggcccugagccuggccaacaucagcggcagacugagcggcauggccaacgccuucagaaccguguaccagcugaacggccuggccggcuacuucaagggcauccaggccagagugaucuaccagaugcccagcaccgccaucagcuggagcguguacgaguucuucaaguacuuccugaccaagagacagcuggagaacagagcccccuacuaa

SEQ ID NO: 23484 - RNA, 915 nt, Artificial Sequence
  SLC25A38__Homo_sapiens__NP_060345
augauccagaacagcagacccagccugcugcagccccaggacgugggcgacaccguggagacccugaugcugcaccccgugaucaaggccuuccugugcggcagcaucagcggcaccugcagcacccugcuguuccagccccuggaccugcugaagaccagacugcagacccugcagcccagcgaccacggcagcagaagagugggcaugcuggccgugcugcugaagguggugagaaccgagagccugcugggccuguggaagggcaugagccccagcaucgugagaugcgugcccggcgugggcaucuacuucggcacccuguacagccugaagcaguacuuccugagaggccacccccccaccgcccuggagagcgugaugcugggcgugggcagcagaagcguggccggcgugugcaugagccccaucaccgugaucaagaccagauacgagagcggcaaguacggcuacgagagcaucuacgccgcccugagaagcaucuaccacagcgagggccacagaggccuguucagcggccugaccgccacccugcugagagacgcccccuucagcggcaucuaccugauguucuacaaccagaccaagaacaucgugccccacgaccagguggacgccacccugauccccaucaccaacuucagcugcggcaucuucgccggcauccuggccagccuggugacccagcccgccgacgugaucaagacccacaugcagcuguacccccugaaguuccaguggaucggccaggccgugacccugaucuucaaggacuacggccugagaggcuucuuccagggcggcauccccagagcccugagaagaacccugauggccgccauggccuggaccguguacgaggagaugauggccaagaugggccugaagagcuaa

SEQ ID NO: 23485 - RNA, 1086 nt, Artificial Sequence
  SLC25A3__Homo_sapiens__NP_002626
auguucagcagcguggcccaccuggccagagccaaccccuucaacaccccccaccugcagcuggugcacgacggccugggcgaccugagaagcagcagccccggccccaccggccagcccagaagacccagaaaccuggccgccgccgccguggaggaguacagcugcgaguucggcagcgccaaguacuacgcccugugcggcuucggcggcgugcugagcugcggccugacccacaccgccguggugccccuggaccuggugaagugcagaaugcagguggacccccagaaguacaagggcaucuucaacggcuucagcgugacccugaaggaggacggcgugagaggccuggccaagggcugggcccccaccuuccugggcuacagcaugcagggccugugcaaguucggcuucuacgagguguucaaggugcuguacagcaacaugcugggcgaggagaacaccuaccuguggagaaccagccuguaccuggccgccagcgccagcgccgaguucuucgccgacaucgcccuggcccccauggaggccgccaaggugagaauccagacccagcccggcuacgccaacacccugagagacgccgcccccaagauguacaaggaggagggccugaaggccuucuacaagggcguggccccccuguggaugagacagauccccuacaccaugaugaaguucgccugcuucgagagaaccguggaggcccuguacaaguucguggugcccaagcccagaagcgagugcagcaagcccgagcagcugguggugaccuucguggccggcuacaucgccggcguguucugcgccaucgugagccaccccgccgacagcguggugagcgugcugaacaaggagaagggcagcagcgccagccuggugcugaagagacugggcuucaagggcguguggaagggccuguucgccagaaucaucaugaucggcacccugaccgcccugcagugguucaucuacgacagcgugaagguguacuucagacugcccagaccccccccccccgagaugcccgagagccugaagaagaagcugggccugacccaguaa

SEQ ID NO: 23486 - RNA, 1017 nt, Artificial Sequence
  SLC25A40__Homo_sapiens__NP_061331
auggaccccgagaccagaggccaggagaucaucaaggugaccccccugcagcagaugcuggccagcugcaccggcgccauccugaccagcgugaucgugaccccccuggacguggugaagaucagacugcaggcccagaacaacccccugcccaagggcaagugcuucguguacagcaacggccugauggaccaccugugcgugugcgaggagggcggcaacaagcugugguacaagaagcccggcaacuuccagggcacccuggacgccuucuucaagaucaucagaaacgagggcaucaagagccuguggagcggccugccccccacccuggugauggccgugcccgccaccgugaucuacuucaccugcuacgaccagcugagcgcccugcugagaagcaagcugggcgagaacgagaccugcauccccaucguggccggcaucguggccagauucggcgccgugaccgugaucagcccccuggagcugaucagaaccaagaugcagagcaagaaguucagcuacguggagcugcacagauucgugagcaagaaggugagcgaggacggcuggaucagccuguggagaggcugggcccccaccgugcugagagacgugcccuucagcgccauguacugguacaacuacgagauccugaagaaguggcugugcgagaagagcggccuguacgagcccaccuucaugaucaacuucaccagcggcgcccugagcggcagcuucgccgccguggccacccugcccuucgacguggugaagacccagaagcagacccagcuguggaccuacgagagccacaagaucagcaugccccugcacaugagcaccuggaucaucaugaagaacaucguggccaagaacggcuucagcggccuguucagcggccugauccccagacugaucaagaucgcccccgccugcgccaucaugaucagcaccuacgaguucggcaaggccuucuuccagaagcagaacgugagaagacagcaguacuaa

SEQ ID NO: 23487 - RNA, 1113 nt, Artificial Sequence
  SLC25A41__Homo_sapiens__NP_775908
augggcgcccagcccggcgagccccagaacaccugcagcagaauccagacccuguucagaagagugaagacccugcugaucaaggcccccccccccccccagccccccccccccccccccagcuggaaccccggcugcacccacguguacggcuacgccuucggccacaugcacgacaacaaccuggagcaccugcccagccagcaggugcuggacaccggcgagcagcugauggugcccguggaggugcuggagguggacaacaaggaggcccuguggaaguuccugcugagcggcgccauggccggcgccgugagcagaaccggcaccgccccccuggacagagccaagguguacaugcagguguacagcagcaagaccaacuucaccaaccugcugggcggccugcagagcauggugcaggagggcggcuucagaagccuguggagaggcaacggcaucaacgugcugaagaucgcccccgaguacgccaucaaguucagcguguucgagcagugcaagaacuacuucugcggcauccagggcagcccccccuuccaggagagacugcuggccggcagccuggccguggccaucagccagacccugaucaaccccauggaggugcugaagaccagacugacccugagaagaaccggccaguacaagggccugcuggacugcgccagacagauccugcagagagagggcaccagagcccuguacagaggcuaccugcccaacaugcugggcaucauccccuacgccugcaccgaccuggccguguacgagaugcugcagugcuucugggugaagagcggcagagacaugggcgaccccagcggccuggugagccugagcagcgugacccugagcaccaccugcggccagauggccagcuacccccugacccuggugagaaccagaaugcaggcccaggacaccguggagggcagcaaccccaccaugagaggcgugcugcagagaauccuggcccagcagggcuggcugggccuguacagaggcaugacccccacccugcugaaggugcugcccgccggcggcaucagcuacgugguguacgaggccaugaagaagacccugggcaucuaa

SEQ ID NO: 23488 - RNA, 957 nt, Artificial Sequence
  SLC25A42__Homo_sapiens__NP_848621
augggcaacggcgugaaggagggccccgugagacugcacgaggacgccgaggccgugcugagcagcagcgugagcagcaagagagaccacagacaggugcugagcagccugcugagcggcgcccuggccggcgcccuggccaagaccgccguggccccccuggacagaaccaagaucaucuuccaggugagcagcaagagauucagcgccaaggaggccuucagagugcuguacuacaccuaccugaacgagggcuuccugagccuguggagaggcaacagcgccaccauggugagaguggugcccuacgccgccauccaguucagcgcccacgaggaguacaagagaauccugggcagcuacuacggcuucagaggcgaggcccugccccccuggcccagacuguucgccggcgcccuggccggcaccaccgccgccagccugaccuacccccuggaccuggugagagccagaauggccgugacccccaaggagauguacagcaacaucuuccacguguucaucagaaucagcagagaggagggccugaagacccuguaccacggcuucaugcccaccgugcugggcgugauccccuacgccggccugagcuucuucaccuacgagacccugaagagccugcacagagaguacagcggcagaagacagcccuaccccuucgagagaaugaucuucggcgccugcgccggccugaucggccagagcgccagcuacccccuggacguggugagaagaagaaugcagaccgccggcgugaccggcuaccccagagccagcaucgccagaacccugagaaccaucgugagagaggagggcgccgugagaggccuguacaagggccugagcaugaacugggugaagggccccaucgccgugggcaucagcuucaccaccuucgaccugaugcagauccugcugagacaccugcagagcuaa

SEQ ID NO: 23489 - RNA, 1026 nt, Artificial Sequence
  SLC25A43__Homo_sapiens__NP_660348
auggccaccuggagaagagacggcagacugaccggcggccagagacugcugugcgccggccuggccggcacccugagccugagccugaccgccccccuggagcuggccaccgugcuggcccaggugggcguggugagaggccacgccagaggccccugggccaccggccacagaguguggagagccgagggccugagagcccuguggaagggcaacgccguggccugccugagacuguuccccugcagcgccgugcagcuggccgccuacagaaaguucguggugcuguucaccgacgaccugggccacaucagccaguggagcagcaucauggccggcagccuggccggcauggugagcaccaucgugaccuaccccaccgaccugaucaagaccagacugaucaugcagaacauccuggagcccagcuacagaggccugcugcacgccuucagcaccaucuaccagcaggagggcuuccuggcccuguacagaggcgugagccugaccguggugggcgcccugcccuucagcgccggcagccugcugguguacaugaaccuggagaagaucuggaacggccccagagaccaguucagccugccccagaacuucgccaacgugugccuggccgccgccgugacccagacccugagcuuccccuucgagaccgugaagagaaagaugcaggcccagagccccuaccugccccacagcggcggcguggacgugcacuucagcggcgccguggacugcuucagacagaucgugaaggcccagggcgugcugggccuguggaacggccugaccgccaaccugcugaagaucgugcccuacuucggcaucauguucagcaccuucgaguucugcaagagaaucugccuguaccagaacggcuacauccugagcccccugagcuacaagcugacccccggcguggaccagagccugcagccccaggagcugagagagcugaagaaguucuucaagaccagaaagcccaagcccaagaagcccacccuguaa

SEQ ID NO: 23490 - RNA, 795 nt, Artificial Sequence
  SLC25A45__Homo_sapiens__NP_001265179
augcccguggaggaguucguggccggcuggaucagcggcgcccugggccuggugcugggccaccccuucgacaccgugaagcugcugggcuucuucaagggcaugagcuuccccaucgccagcaucgccguggugaacagcgugcuguucggcguguacagcaacacccugcuggugcugaccgccaccagccaccaggagagaagagcccagccccccagcuacaugcacaucuuccuggccggcugcaccggcggcuuccugcaggccuacugccuggcccccuucgaccugaucaaggugagacugcagaaccagaccgagcccagagcccagcccggcagccccccccccagauaccagggccccgugcacugcgccgccagcaucuucagagaggagggccccagaggccuguucagaggcgccugggcccugacccugagagacacccccaccgugggcaucuacuucaucaccuacgagggccugugcagacaguacacccccgagggccagaaccccagcagcgccaccgugcugguggccggcggcuucgccggcaucgccagcuggguggccgccaccccccuggacgugaucaagagcagaaugcagauggacggccugagaagaagaguguaccagggcaugcuggacugcauggugagcagcaucagacaggagggccugggcguguucuucagaggcgugaccaucaacagcgccagagccuuccccgugaacgccgugaccuuccugagcuacgaguaccugcugagaugguggggcuaa

SEQ ID NO: 23491 - RNA, 1014 nt, Artificial Sequence
  SLC25A46__Homo_sapiens__NP_001290178
augcaccccagaagacccgacggcuucgacggccugggcuacagaggcggcgccagagacgagcagggcuucggcggcgccuuccccgccagaagcuucagcaccggcagcgaccugggccacugggugaccaccccccccgacauccccggcagcagaaaccugcacuggggcgagaagagcccccccuacggcgugcccaccaccagcacccccuacgagggccccaccgaggagcccuucagcagcggcggcggcggcagcgugcagggccagagcagcgagcagcugaacagauucgccggcuucggcaucggccuggccagccuguucaccgagaacgugcuggcccaccccugcaucgugcugagaagacagugccaggugaacuaccacgcccagcacuaccaccugacccccuucaccgugaucaacaucauguacagcuucaacaagacccagggccccagagcccuguggaagggcaugggcagcaccuucaucgugcagggcgugacccugggcgccgagggcaucaucagcgaguucaccccccugcccagagaggugcugcacaaguggagccccaagcagaucggcgagcaccugcugcugaagagccugaccuacgugguggccaugcccuucuacagcgccagccugaucgagaccgugcagagcaugcuggacgccuacuuccccgagcugaucgccaacuucgccgccagccugugcagcgacgugauccuguacccccuggagaccgugcugcacagacugcacauccagggcaccagaaccaucaucgacaacaccgaccugggcuacgaggugcugcccaucaacacccaguacgagggcaugagagacugcaucaacaccaucagacaggaggagggcguguucggcuucuacaagggcuucggcgccgugaucauccaguacacccugcacgccgccgugcugcagaucaccaagaucaucuacagcacccugcugcagaacaacaucuaa

SEQ ID NO: 23492 - RNA, 927 nt, Artificial Sequence
  SLC25A47__Homo_sapiens__NP_997000
auggacuucguggccggcgccaucggcggcgugugcggcguggccgugggcuacccccuggacaccgugaaggugagaauccagaccgagcccaaguacaccggcaucuggcacugcgugagagacaccuaccacagagagagaguguggggcuucuacagaggccugagccugcccgugugcaccgugagccuggugagcagcgugagcuucggcaccuacagacacugccuggcccacaucugcagacugagauacggcaaccccgacgccaagcccaccaaggccgacaucacccugagcggcugcgccagcggccuggugagaguguuccugaccagccccaccgagguggccaaggugagacugcagacccagacccaggcccagaagcagcagagaagacugagcgccagcggcccccuggccgugccccccaugugccccgugccccccgccugccccgagcccaaguacagaggcccccugcacugccuggccaccguggccagagaggagggccugugcggccuguacaagggcagcagcgcccuggugcugagagacggccacagcuucgccaccuacuuccugagcuacgccgugcugugcgaguggcugagccccgccggccacagcagacccgacgugcccggcgugcugguggccggcggcugcgccggcgugcuggccugggccguggccacccccauggacgugaucaagagcagacugcaggccgacggccagggccagagaagauacagaggccugcugcacugcauggugaccagcgugagagaggagggccccagagugcuguucaagggccuggugcugaacugcugcagagccuuccccgugaacauggugguguucguggccuacgaggccgugcugagacuggccagaggccugcugaccuaa

SEQ ID NO: 23493 - RNA, 897 nt, Artificial Sequence
  SLC25A4__Homo_sapiens__NP_001142
augggcgaccacgccuggagcuuccugaaggacuuccuggccggcggcguggccgccgccgugagcaagaccgccguggcccccaucgagagagugaagcugcugcugcaggugcagcacgccagcaagcagaucagcgccgagaagcaguacaagggcaucaucgacugcguggugagaauccccaaggagcagggcuuccugagcuucuggagaggcaaccuggccaacgugaucagauacuuccccacccaggcccugaacuucgccuucaaggacaaguacaagcagcuguuccugggcggcguggacagacacaagcaguucuggagauacuucgccggcaaccuggccagcggcggcgccgccggcgccaccagccugugcuucguguacccccuggacuucgccagaaccagacuggccgccgacgugggcaagggcgccgcccagagagaguuccacggccugggcgacugcaucaucaagaucuucaagagcgacggccugagaggccuguaccagggcuucaacgugagcgugcagggcaucaucaucuacagagccgccuacuucggcguguacgacaccgccaagggcaugcugcccgaccccaagaacgugcacaucuucgugagcuggaugaucgcccagagcgugaccgccguggccggccuggugagcuaccccuucgacaccgugagaagaagaaugaugaugcagagcggcagaaagggcgccgacaucauguacaccggcaccguggacugcuggagaaagaucgccaaggacgagggcgccaaggccuucuucaagggcgccuggagcaacgugcugagaggcaugggcggcgccuucgugcuggugcuguacgacgagaucaagaaguacguguaa

SEQ ID NO: 23494 - RNA, 924 nt, Artificial Sequence
  SLC25A52__Homo_sapiens__NP_001029344
augcccuucaugagaaagauccugagcaacaugaucgacagcgaggcccacgagaagagaccccccauccugaccagcagcaagcaggacaucagcccccacaucaccaacgugggcgagaugaagcacuaccugugcggcugcugcgccgccuucaacaacguggccaucaccuaccccauccagaaggugcuguucagacagcagcuguacggcaucaagaccagagacgccgugcugcagcugagaagagacggcuucagaaaccuguacagaggcauccugcccccccugaugcagaagaccaccacccuggcccugauguucggccuguacgaggaccugagcugccugcugagaaagcacgugagagcccccgaguucgccacccacggcguggccgccgugcuggccggcaccgccgaggccaucuucaccccccuggagagagugcagacccugcugcagaaccacaagcaccacgacaaguucaccaacaccuaccaggccuucaaggcccugaagugccacggcaucggcgaguacuacagaggccuggugcccauccuguucagaaacggccugagcaacgugcuguucuucggccugagaggccccaucaaggagcaccugcccaccgccaccacccacagcgcccaccuggugaacgacuucaucggcggcggccugcugggcgccaugcugggcuuccugugcuuccccaucaacguggugaagaccagacugcagagccagaucggcggcgaguuccagagcuuccccaagguguuccagaagaucuggcuggagagagacagaaagcugaucaaccuguucagaggcgcccaccugaacuaccacagaagccugaucagcuggggcaucaucaacgccaccuacgaguuccugcugaaguucaucuaa

SEQ ID NO: 23495 - RNA, 897 nt, Artificial Sequence
  SLC25A5__Homo_sapiens__NP_001143
augaccgacgccgccgugagcuucgccaaggacuuccuggccggcggcguggccgccgccaucagcaagaccgccguggcccccaucgagagagugaagcugcugcugcaggugcagcacgccagcaagcagaucaccgccgacaagcaguacaagggcaucaucgacugcguggugagaauccccaaggagcagggcgugcugagcuucuggagaggcaaccuggccaacgugaucagauacuuccccacccaggcccugaacuucgccuucaaggacaaguacaagcagaucuuccugggcggcguggacaagagaacccaguucuggcuguacuucgccggcaaccuggccagcggcggcgccgccggcgccaccagccugugcuucguguacccccuggacuucgccagaaccagacuggccgccgacgugggcaaggccggcgccgagagagaguucagaggccugggcgacugccuggugaagaucuacaagagcgacggcaucaagggccuguaccagggcuucaacgugagcgugcagggcaucaucaucuacagagccgccuacuucggcaucuacgacaccgccaagggcaugcugcccgaccccaagaacacccacaucgugaucagcuggaugaucgcccagaccgugaccgccguggccggccugaccagcuaccccuucgacaccgugagaagaagaaugaugaugcagagcggcagaaagggcaccgacaucauguacaccggcacccuggacugcuggagaaagaucgccagagacgagggcggcaaggccuucuucaagggcgccuggagcaacgugcugagaggcaugggcggcgccuucgugcuggugcuguacgacgagaucaagaaguacaccuaa

SEQ ID NO: 23496 - RNA, 897 nt, Artificial Sequence
  SLC25A6__Homo_sapiens__NP_001627
augaccgagcaggccaucagcuucgccaaggacuuccuggccggcggcaucgccgccgccaucagcaagaccgccguggcccccaucgagagagugaagcugcugcugcaggugcagcacgccagcaagcagaucgccgccgacaagcaguacaagggcaucguggacugcaucgugagaauccccaaggagcagggcgugcugagcuucuggagaggcaaccuggccaacgugaucagauacuuccccacccaggcccugaacuucgccuucaaggacaaguacaagcagaucuuccugggcggcguggacaagcacacccaguucuggagauacuucgccggcaaccuggccagcggcggcgccgccggcgccaccagccugugcuucguguacccccuggacuucgccagaaccagacuggccgccgacgugggcaagagcggcaccgagagagaguucagaggccugggcgacugccuggugaagaucaccaagagcgacggcaucagaggccuguaccagggcuucagcgugagcgugcagggcaucaucaucuacagagccgccuacuucggcguguacgacaccgccaagggcaugcugcccgaccccaagaacacccacaucguggugagcuggaugaucgcccagaccgugaccgccguggccggcguggugagcuaccccuucgacaccgugagaagaagaaugaugaugcagagcggcagaaagggcgccgacaucauguacaccggcaccguggacugcuggagaaagaucuucagagacgagggcggcaaggccuucuucaagggcgccuggagcaacgugcugagaggcaugggcggcgccuucgugcuggugcuguacgacgagcugaagaaggugaucuaa

SEQ ID NO: 23497 - RNA, 2106 nt, Artificial Sequence
  SLC26A1__Homo_sapiens__NP_071325
auggacgagagccccgagccccugcagcagggcagaggccccgugcccgugagaagacagagacccgcccccagaggccugagagagaugcugaaggccagacuguggugcagcugcagcugcagcgugcugugcgugagagcccuggugcaggaccugcugcccgccaccagauggcugagacaguacagacccagagaguaccuggccggcgacgugaugagcggccuggugaucggcaucauccuggugccccaggccaucgccuacagccugcuggccggccugcagcccaucuacagccuguacaccagcuucuucgccaaccugaucuacuuccugaugggcaccagcagacacgugagcgugggcaucuucagccugcugugccugauggugggccaggugguggacagagagcugcagcuggccggcuucgaccccagccaggacggccugcagcccggcgccaacagcagcacccugaacggcagcgccgccaugcuggacugcggcagagacugcuacgccaucagaguggccaccgcccugacccugaugaccggccuguaccaggugcugaugggcgugcugagacugggcuucgugagcgccuaccugagccagccccugcuggacggcuucgccaugggcgccagcgugaccauccugaccagccagcugaagcaccugcugggcgugagaauccccagacaccagggccccggcaugguggugcugaccuggcugagccugcugagaggcgccggccaggccaacgugugcgacguggugaccagcaccgugugccuggccgugcugcuggccgccaaggagcugagcgacagauacagacacagacugagagugccccugcccaccgagcugcuggugaucgugguggccacccuggugagccacuucggccagcugcacaagagauucggcagcagcguggccggcgacauccccaccggcuucaugcccccccaggugcccgagcccagacugaugcagagaguggcccuggacgccguggcccuggcccugguggccgccgccuucagcaucagccuggccgagauguucgccagaagccacggcuacagcgugagagccaaccaggagcugcuggccgugggcugcugcaacgugcugcccgccuuccugcacugcuucgccaccagcgccgcccuggccaagagccuggugaagaccgccaccggcugcagaacccagcugagcagcguggugagcgccaccguggugcugcuggugcugcuggcccuggccccccuguuccacgaccugcagagaagcgugcuggccugcgugaucguggugagccugagaggcgcccugagaaaggugugggaccugcccagacuguggagaaugagccccgccgacgcccuggugugggccggcaccgccgccaccugcaugcuggugagcaccgaggccggccugcuggccggcgugauccugagccugcugagccuggccggcagaacccagagacccagaaccgcccugcuggccagaaucggcgacaccgccuucuacgaggacgccaccgaguucgagggccuggugcccgagcccggcgugagaguguucagauucggcggcccccuguacuacgccaacaaggacuucuuccugcagagccuguacagccugaccggccuggacgccggcugcauggccgccagaagaaaggagggcggcagcgagaccggcgugggcgagggcggccccgcccagggcgaggaccugggccccgugagcaccagagccgcccuggugcccgccgccgccggcuuccacaccguggugaucgacugcgccccccugcuguuccuggacgccgccggcgugagcacccugcaggaccugagaagagacuacggcgcccugggcaucagccugcugcuggccugcugcagcccccccgugagagacauccugagcagaggcggcuuccugggcgagggccccggcgacaccgccgaggaggagcagcuguuccugagcgugcacgacgccgugcagaccgccagagccagacacagagagcuggaggccaccgacgcccaccuguaa

SEQ ID NO: 23498 - RNA, 2220 nt, Artificial Sequence
  SLC26A2__Homo_sapiens__NP_000103
augagcagcgagagcaaggagcagcacaacgugagccccagagacagcgccgagggcaacgacagcuaccccagcggcauccaccuggagcugcagagagagagcagcaccgacuucaagcaguucgagaccaacgaccagugcagacccuaccacagaauccugaucgagagacaggagaagagcgacaccaacuucaaggaguucgugaucaagaagcugcagaagaacugccagugcagccccgccaaggccaagaacaugauccugggcuuccugcccgugcugcaguggcugcccaaguacgaccugaagaagaacauccugggcgacgugaugagcggccugaucgugggcauccugcuggugccccagagcaucgccuacagccugcuggccggccaggagcccguguacggccuguacaccagcuucuucgccagcaucaucuacuuccugcugggcaccagcagacacaucagcgugggcaucuucggcgugcugugccugaugaucggcgagaccguggacagagagcugcagaaggccggcuacgacaacgcccacagcgcccccagccugggcauggugagcaacggcagcacccugcugaaccacaccagcgacagaaucugcgacaagagcugcuacgccaucauggugggcagcaccgugaccuucaucgccggcguguaccagguggccaugggcuucuuccaggugggcuucgugagcguguaccugagcgacgcccugcugagcggcuucgugaccggcgccagcuucaccauccugaccagccaggccaaguaccugcugggccugaaccugcccagaaccaacggcgugggcagccugaucaccaccuggauccacguguucagaaacauccacaagaccaaccugugcgaccugaucaccagccugcugugccugcuggugcugcugcccaccaaggagcugaacgagcacuucaagagcaagcugaaggcccccauccccaucgagcuggugguggugguggccgccacccuggccagccacuucggcaagcugcacgagaacuacaacagcagcaucgccggccacauccccaccggcuucaugccccccaaggugcccgaguggaaccugauccccagcguggccguggacgccaucgccaucagcaucaucggcuucgccaucaccgugagccugagcgagauguucgccaagaagcacggcuacaccgugaaggccaaccaggagauguacgccaucggcuucugcaacaucauccccagcuucuuccacugcuucaccaccagcgccgcccuggccaagacccuggugaaggagagcaccggcugccacacccagcugagcggcguggugaccgcccuggugcugcugcuggugcugcuggugaucgccccccuguucuacagccugcagaagagcgugcugggcgugaucaccaucgugaaccugagaggcgcccugagaaaguucagagaccugcccaagauguggagcaucagcagaauggacaccgugaucugguucgugaccaugcugagcagcgcccugcugagcaccgagaucggccugcuggugggcgugugcuucagcaucuucugcgugauccugagaacccagaagcccaagagcagccugcugggccugguggaggagagcgagguguucgagagcgugagcgccuacaagaaccugcagaucaagcccggcaucaagaucuucagauucguggccccccuguacuacaucaacaaggagugcuucaagagcgcccuguacaagcagaccgugaaccccauccugaucaagguggccuggaagaaggccgccaagagaaagaucaaggagaagguggugacccugggcggcauccaggacgagaugagcgugcagcugagccacgacccccuggagcugcacaccaucgugaucgacugcagcgccauccaguuccuggacaccgccggcauccacacccugaaggaggugagaagagacuacgaggccaucggcauccaggugcugcuggcccagugcaaccccaccgugagagacagccugaccaacggcgaguacugcaagaaggaggaggagaaccugcuguucuacagcguguacgaggccauggccuucgccgaggugagcaagaaccagaagggcgugugcgugcccaacggccugagccugagcagcgacuaa

SEQ ID NO: 23499 - RNA, 2295 nt, Artificial Sequence
  SLC26A3__Homo_sapiens__XP_011514169
augaucgagcccuucggcaaccaguacaucguggccagacccguguacagcaccaacgccuucgaggagaaccacaagaagaccggcagacaccacaagaccuuccuggaccaccugaaggugugcugcagcugcagcccccagaaggccaagagaaucgugcugagccuguuccccaucgccagcuggcugcccgccuacagacugaaggaguggcugcugagcgacaucgugagcggcaucagcaccggcaucguggccgugcugcagggccuggccuucgcccugcugguggacaucccccccguguacggccuguacgccagcuucuuccccgccaucaucuaccuguucuucggcaccagcagacacaucagcgugggccccuuccccauccugagcaugauggugggccuggccgugagcggcgccgugagcaaggccgugcccgacagaaacgccaccacccugggccugcccaacaacagcaacaacagcagccugcuggacgacgagagagugagaguggccgccgccgccagcgugaccgugcugagcggcaucauccagcuggccuucggcauccugagaaucggcuucguggugaucuaccugagcgagagccugaucagcggcuucaccaccgccgccgccgugcacgugcuggugagccagcugaaguucaucuuccagcugaccgugcccagccacaccgaccccgugagcaucuucaaggugcuguacagcguguucagccagaucgagaagaccaacaucgccgaccuggugaccgcccugaucgugcugcugguggugagcaucgugaaggagaucaaccagagauucaaggacaagcugcccgugcccauccccaucgaguucaucaugaccgugaucgccgccggcgugagcuacggcugcgacuucaagaacagauucaagguggccguggugggcgacaugaaccccggcuuccagccccccaucacccccgacguggagaccuuccagaacaccgugggcgacugcuucggcaucgccaugguggccuucgccguggccuucagcguggccagcguguacagccugaaguacgacuacccccuggacggcaaccaggagcugaucgcccugggccugggcaacaucgugugcggcguguucagaggcuucgccggcagcaccgcccugagcagaagcgccgugcaggagagcaccggcggcaagacccagaucgccggccugaucggcgccaucaucgugcugaucguggugcuggccaucggcuuccugcuggccccccugcagaagagcgugcuggccgcccuggcccugggcaaccugaagggcaugcugaugcaguucgccgagaucggcagacuguggagaaaggacaaguacgacugccugaucuggaucaugaccuucaucuucaccaucgugcugggccugggccugggccuggccgccagcguggccuuccagcugcugaccaucguguucagaacccaguuccccaagugcagcacccuggccaacaucggcagaaccaacaucuacaagaacaagaaggacuacuacgacauguacgagcccgagggcgugaagaucuucagaugccccagccccaucuacuucgccaacaucggcuucuucagaagaaagcugaucgacgccgugggcuucagcccccugagaauccugagaaagagaaacaaggcccugagaaagaucagaaagcugcagaagcagggccugcugcaggugacccccaagggcuucaucugcaccguggacaccaucaaggacagcgacgaggagcuggacaacaaccagaucgaggugcuggaccagcccaucaacaccaccgaccugcccuuccacaucgacuggaacgacgaccugccccugaacaucgaggugcccaagaucagccugcacagccugauccuggacuucagcgccgugagcuuccuggacgugagcagcgugagaggccugaagagcauccugcaggaguucaucagaaucaagguggacguguacaucgugggcaccgacgacgacuucaucgagaagcugaacagauacgaguucuucgacggcgaggugaagagcagcaucuucuuccugaccauccacgacgccgugcugcacauccugaugaagaaggacuacagcaccagcaaguucaaccccagccaggagaaggacggcaagaucgacuucaccaucaacaccaacggcggccugagaaacagaguguacgaggugcccguggagaccaaguucuaa

SEQ ID NO: 23500 - RNA, 2343 nt, Artificial Sequence
  SLC26A4__Homo_sapiens__NP_000432
auggccgcccccggcggcagaagcgagcccccccagcugcccgaguacagcugcagcuacauggugagcagacccguguacagcgagcuggccuuccagcagcagcacgagagaagacugcaggagagaaagacccugagagagagccuggccaagugcugcagcugcagcagaaagagagccuucggcgugcugaagacccuggugcccauccuggaguggcugcccaaguacagagugaaggaguggcugcugagcgacgugaucagcggcgugagcaccggccugguggccacccugcagggcauggccuacgcccugcuggccgccgugcccgugggcuacggccuguacagcgccuucuuccccauccugaccuacuucaucuucggcaccagcagacacaucagcgugggccccuuccccguggugagccugauggugggcagcguggugcugagcauggcccccgacgagcacuuccuggugagcagcagcaacggcaccgugcugaacaccaccaugaucgacaccgccgccagagacaccgccagagugcugaucgccagcgcccugacccugcuggugggcaucauccagcugaucuucggcggccugcagaucggcuucaucgugagauaccuggccgacccccuggugggcggcuucaccaccgccgccgccuuccaggugcuggugagccagcugaagaucgugcugaacgugagcaccaagaacuacaacggcgugcugagcaucaucuacacccugguggagaucuuccagaacaucggcgacaccaaccuggccgacuucaccgccggccugcugaccaucguggugugcauggccgugaaggagcugaacgacagauucagacacaagauccccgugcccauccccaucgaggugaucgugaccaucaucgccaccgccaucagcuacggcgccaaccuggagaagaacuacaacgccggcaucgugaagagcauccccagaggcuuccugccccccgagcugccccccgugagccuguucagcgagaugcuggccgccagcuucagcaucgccgugguggccuacgccaucgccgugagcgugggcaagguguacgccaccaaguacgacuacaccaucgacggcaaccaggaguucaucgccuucggcaucagcaacaucuucagcggcuucuucagcugcuucguggccaccaccgcccugagcagaaccgccgugcaggagagcaccggcggcaagacccagguggccggcaucaucagcgccgccaucgugaugaucgccauccuggcccugggcaagcugcuggagccccugcagaagagcgugcuggccgccguggugaucgccaaccugaagggcauguucaugcagcugugcgacauccccagacuguggagacagaacaagaucgacgccgugaucuggguguucaccugcaucgugagcaucauccugggccuggaccugggccugcuggccggccugaucuucggccugcugaccguggugcugagagugcaguuccccagcuggaacggccugggcagcauccccagcaccgacaucuacaagagcaccaagaacuacaagaacaucgaggagccccagggcgugaagauccugagauucagcagccccaucuucuacggcaacguggacggcuucaagaagugcaucaagagcaccgugggcuucgacgccaucagaguguacaacaagagacugaaggcccugagaaagauccagaagcugaucaagagcggccagcugagagccaccaagaacggcaucaucagcgacgccgugagcaccaacaacgccuucgagcccgacgaggacaucgaggaccuggaggagcuggacauccccaccaaggagaucgagauccagguggacuggaacagcgagcugcccgugaaggugaacgugcccaaggugcccauccacagccuggugcuggacugcggcgccaucagcuuccuggacguggugggcgugagaagccugagagugaucgugaaggaguuccagagaaucgacgugaacguguacuucgccagccugcaggacuacgugaucgagaagcuggagcagugcggcuucuucgacgacaacaucagaaaggacaccuucuuccugaccgugcacgacgccauccuguaccugcagaaccaggugaagagccaggagggccagggcagcauccuggagaccaucacccugauccaggacugcaaggacacccuggagcugaucgagaccgagcugaccgaggaggagcuggacgugcaggacgaggccaugagaacccuggccagcuaa

SEQ ID NO: 23501 - RNA, 2139 nt, Artificial Sequence
  SLC26A5__Homo_sapiens__NP_001161434
auggaccacgccgaggagaacgagauccuggccgccacccagagauacuacguggagagacccaucuucagccaccccgugcugcaggagagacugcacaccaaggacaaggugcccgacagcaucgccgacaagcugaagcaggccuucaccugcacccccaagaagaucagaaacaucaucuacauguuccugcccaucaccaaguggcugcccgccuacaaguucaaggaguacgugcugggcgaccuggugagcggcaucagcaccggcgugcugcagcugccccagggccuggccuucgccaugcuggccgccgugccccccaucuucggccuguacagcagcuucuaccccgugaucauguacugcuuccugggcaccagcagacacaucagcaucggccccuucgccgugaucagccugaugaucggcggcguggccgugagacuggugcccgacgacaucgugauccccggcggcgugaacgccaccaacggcaccgaggccagagacgcccugagagugaagguggccaugagcgugacccugcugagcggcaucauccaguucugccugggcgugugcagauucggcuucguggccaucuaccugaccgagccccuggugagaggcuucaccaccgccgccgccgugcacguguucaccagcaugcugaaguaccuguucggcgugaagaccaagagauacagcggcaucuucagcgugguguacagcaccguggccgugcugcagaacgugaagaaccugaacgugugcagccugggcgugggccugaugguguucggccugcugcugggcggcaaggaguucaacgagagauucaaggagaagcugcccgcccccaucccccuggaguucuucgccguggugaugggcaccggcaucagcgccggcuucaaccugaaggagagcuacaacguggacguggugggcacccugccccugggccugcugccccccgccaaccccgacaccagccuguuccaccugguguacguggacgccaucgccaucgccaucgugggcuucagcgugaccaucagcauggccaagacccuggccaacaagcacggcuaccagguggacggcaaccaggagcugaucgcccugggccugugcaacagcaucggcagccuguuccagaccuucagcaucagcugcagccugagcagaagccuggugcaggagggcaccggcggcaagacccagcuggccggcugccuggccagccugaugauccugcuggugauccuggccaccggcuuccuguucgagagccugccccagaccaucuggcugaccaccuucgugagcagccuguuccugggccuggacuacggccugaucaccgccgugaucaucgcccugcugaccgugaucuacagaacccagagccccagcuacaaggugcugggcaagcugcccgagaccgacguguacaucgacaucgacgccuacgaggaggugaaggagauccccggcaucaagaucuuccagaucaacgcccccaucuacuacgccaacagcgaccuguacagcaacgcccugaagagaaagaccggcgugaaccccgccgugaucaugggcgccagaagaaaggccaugagaaaguacgccaaggaggugggcaacgccaacauggccaacgccaccguggugaaggccgacgccgagguggacggcgaggacgccaccaagcccgaggaggaggacggcgaggugaaguacccccccaucgugaucaagagcaccuuccccgaggagaugcagagauucaugccccccggcgacaacgugcacaccgugauccuggacuucacccaggugaacuucaucgacagcgugggcgugaagacccuggccggcaucgugaaggaguacggcgacgugggcaucuacguguaccuggccggcugcagcgcccagguggugaacgaccugaccagaaacagauucuucgagaaccccgcccugugggagcugcuguuccacagcauccacgacgccgugcugggcagccagcugagagaggcccuggccgagcaggaggccagcgccccccccagccaggaggaccuggagcccaacgccacccccgccacccccgaggccuaa

SEQ ID NO: 23502 - RNA, 2217 nt, Artificial Sequence
  SLC26A6__Homo_sapiens__NP_001035544
auggaccugagaagaagagacuaccacauggagagaccccugcugaaccaggagcaccuggaggagcugggcagauggggcagcgcccccagaacccaccaguggagaaccuggcugcagugcagcagagccagagccuacgcccugcugcugcagcaccugcccgugcugguguggcugcccagauaccccgugagagacuggcugcugggcgaccugcugagcggccugagcguggccaucaugcagcugccccagggccuggccuacgcccugcuggccggccugccccccguguucggccuguacagcagcuucuaccccguguucaucuacuuccuguucggcaccagcagacacaucagcgugggcaccuucgccgugaugagcgugauggugggcagcgugaccgagagccuggccccccaggcccugaacgacagcaugaucaacgagaccgccagagacgccgccagagugcagguggccagcacccugagcgugcuggugggccuguuccaggugggccugggccugauccacuucggcuucguggugaccuaccugagcgagccccuggugagaggcuacaccaccgccgccgccgugcagguguucgugagccagcugaaguacguguucggccugcaccugagcagccacagcggcccccugagccugaucuacaccgugcuggaggugugcuggaagcugccccagagcaaggugggcaccguggugaccgccgccguggccggcguggugcuggugguggugaagcugcugaacgacaagcugcagcagcagcugcccaugcccauccccggcgagcugcugacccugaucggcgccaccggcaucagcuacggcaugggccugaagcacagauucgagguggacguggugggcaacauccccgccggccuggugccccccguggcccccaacacccagcuguucagcaagcuggugggcagcgccuucaccaucgccguggugggcuucgccaucgccaucagccugggcaagaucuucgcccugagacacggcuacagaguggacagcaaccaggagcugguggcccugggccugagcaaccugaucggcggcaucuuccagugcuuccccgugagcugcagcaugagcagaagccuggugcaggagagcaccggcggcaacagccagguggccggcgccaucagcagccuguucauccugcugaucaucgugaagcugggcgagcuguuccacgaccugcccaaggccgugcuggccgccaucaucaucgugaaccugaagggcaugcugagacagcugagcgacaugagaagccuguggaaggccaacagagccgaccugcugaucuggcuggugaccuucaccgccaccauccugcugaaccuggaccugggccuggugguggccgugaucuucagccugcugcuggugguggugagaacccagaugccccacuacagcgugcugggccaggugcccgacaccgacaucuacagagacguggccgaguacagcgaggccaaggaggugagaggcgugaagguguucagaagcagcgccaccguguacuucgccaacgccgaguucuacagcgacgcccugaagcagagaugcggcguggacguggacuuccugaucagccagaagaagaagcugcugaagaagcaggagcagcugaagcugaagcagcugcagaaggaggagaagcugagaaagcaggccgccagccccaagggcgccagcgugagcaucaacgugaacaccagccuggaggacaugagaagcaacaacguggaggacugcaagaugaugcaggugagcagcggcgacaagauggaggacgccaccgccaacggccaggaggacagcaaggcccccgacggcagcacccugaaggcccugggccugccccagcccgacuuccacagccugauccuggaccugggcgcccugagcuucguggacaccgugugccugaagagccugaagaacaucuuccacgacuucagagagaucgagguggagguguacauggccgccugccacagccccguggugagccagcuggaggccggccacuucuucgacgccagcaucaccaagaagcaccuguucgccagcgugcacgacgccgugaccuucgcccugcagcaccccagacccgugcccgacagccccgugagcgugaccagacuguaa

SEQ ID NO: 23503 - RNA, 1971 nt, Artificial Sequence
  SLC26A7__Homo_sapiens__NP_439897
augaccggcgccaagagaaagaagaagagcaugcuguggagcaagaugcacaccccccagugcgaggacaucauccaguggugcagaagaagacugcccauccuggacugggccccccacuacaaccugaaggagaaccugcugcccgacaccgugagcggcaucaugcuggccgugcagcaggugacccagggccuggccuucgccgugcugagcagcgugcaccccguguucggccuguacggcagccuguuccccgccaucaucuacgccaucuucggcaugggccaccacguggccaccggcaccuucgcccugaccagccugaucagcgccaacgccguggagagaaucgugccccagaacaugcagaaccugaccacccagagcaacaccagcgugcugggccugagcgacuucgagaugcagagaauccacguggccgccgccgugagcuuccugggcggcgugauccagguggccauguucgugcugcagcugggcagcgccaccuucguggugaccgagcccgugaucagcgccaugaccaccggcgccgccacccacguggugaccagccaggugaaguaccugcugggcaugaagaugcccuacaucagcggcccccugggcuucuucuacaucuacgccuacguguucgagaacaucaagagcgugagacuggaggcccugcugcugagccugcugagcaucguggugcuggugcuggugaaggagcugaacgagcaguucaagagaaagaucaagguggugcugcccguggaccuggugcugaucaucgccgccagcuucgccugcuacugcaccaacauggagaacaccuacggccuggagguggugggccacaucccccagggcauccccagccccagagccccccccaugaacauccugagcgccgugaucaccgaggccuucggcguggcccuggugggcuacguggccagccuggcccuggcccagggcagcgccaagaaguucaaguacagcaucgacgacaaccaggaguuccuggcccacggccugagcaacaucgugagcagcuucuucuucugcauccccagcgccgccgccaugggcagaaccgccggccuguacagcaccggcgccaagacccagguggccugccugaucagcugcaucuucgugcugaucgugaucuacgccaucggcccccugcuguacuggcugcccaugugcgugcuggccagcaucaucguggugggccugaagggcaugcugauccaguucagagaccugaagaaguacuggaacguggacaagaucgacuggggcaucugggugagcaccuacguguucaccaucugcuucgccgccaacgugggccugcuguucggcguggugugcaccaucgccaucgugaucggcagauuccccagagccaugaccgugagcaucaagaacaugaaggagauggaguucaaggugaagaccgagauggacagcgagacccugcagcaggugaagaucaucagcaucaacaacccccugguguuccugaacgccaagaaguucuacaccgaccugaugaacaugauccagaaggagaacgccugcaaccagccccuggacgacaucagcaagugcgagcagaacacccugcugaacagccugagcaacggcaacugcaacgaggaggccagccagagcugccccaacgagaagugcuaccugauccuggacugcagcggcuucaccuucuucgacuacagcggcgugagcaugcugguggagguguacauggacugcaagggcagaagcguggacgugcugcuggcccacugcaccgccagccugaucaaggccaugaccuacuacggcaaccuggacagcgagaagcccaucuucuucgagagcgugagcgccgccaucagccacauccacagcaacaagaaccugagcaagcugagcgaccacagcgagguguaa

SEQ ID NO: 23504 - RNA, 2913 nt, Artificial Sequence
  SLC26A8__Homo_sapiens__NP_001180405
auggcccagcuggagagaagcgccaucagcggcuucagcagcaagagcagaagaaacagcuucgccuacgacgugaagagagagguguacaacgaggagaccuuccagcaggagcacaagagaaaggccagcagcagcggcaacaugaacaucaacaucaccaccuucagacaccacgugcagugcagaugcagcuggcacagauuccugagaugcgugcugaccaucuuccccuuccuggaguggaugugcauguacagacugaaggacuggcugcugggcgaccugcuggccggcaucagcgugggccuggugcaggugccccagggccugacccugagccugcuggccagacagcugauccccccccugaacaucgccuacgccgccuucugcagcagcgugaucuacgugaucuucggcagcugccaccagaugagcaucggcagcuucuuccuggugagcgcccugcugaucaacgugcugaaggugagccccuucaacaacggccagcuggugaugggcagcuucgugaagaacgaguucagcgcccccagcuaccugaugggcuacaacaagagccugagcgugguggccaccaccaccuuccugaccggcaucauccagcugaucaugggcgugcugggccugggcuucaucgccaccuaccugcccgagagcgccaugagcgccuaccuggccgccguggcccugcacaucaugcugagccagcugaccuucaucuucggcaucaugaucagcuuccacgccggccccaucagcuucuucuacgacaucaucaacuacugcguggcccugcccaaggccaacagcaccagcauccugguguuccugaccguggugguggcccugagaaucaacaagugcaucagaaucagcuucaaccaguaccccaucgaguuccccauggagcuguuccugaucaucggcuucaccgugaucgccaacaagaucagcauggccaccgagaccagccagacccugaucgacaugauccccuacagcuuccugcugcccgugacccccgacuucagccugcugcccaagaucauccugcaggccuucagccugagccuggugagcagcuuccugcugaucuuccugggcaagaagaucgccagccugcacaacuacagcgugaacagcaaccaggaccugaucgccaucggccugugcaacguggugagcagcuucuucagaagcugcguguucaccggcgccaucgccagaaccaucauccaggacaagagcggcggcagacagcaguucgccagccuggugggcgccggcgugaugcugcugcugauggugaagaugggccacuucuucuacacccugcccaacgccgugcuggccggcaucauccugagcaacgugauccccuaccuggagaccaucagcaaccugcccagccuguggagacaggaccaguacgacugcgcccuguggaugaugaccuucagcagcagcaucuuccugggccuggacaucggccugaucaucagcguggugagcgccuucuucaucaccaccgugagaagccacagagccaagauccugcugcugggccagauccccaacaccaacaucuacagaagcaucaacgacuacagagagaucaucaccauccccggcgugaagaucuuccagugcugcagcagcaucaccuucgugaacguguacuaccugaagcacaagcugcugaaggagguggacauggugaaggugccccugaaggaggaggagaucuucagccuguucaacagcagcgacaccaaccugcagggcggcaagaucugcagaugcuucugcaacugcgacgaccuggagccccugcccagaauccuguacaccgagagauucgagaacaagcuggaccccgaggccagcagcaucaaccugauccacugcagccacuucgagagcaugaacaccagccagaccgccagcgaggaccaggugcccuacaccgugagcagcgugagccagaagaaccagggccagcaguacgaggagguggaggagguguggcugcccaacaacagcagcagaaacagcagccccggccugcccgacguggccgagagccagggcagaagaagccugauccccuacagcgacgccagccugcugcccagcgugcacaccaucauccuggacuucagcauggugcacuacguggacagcagaggccugguggugcugagacagaucugcaacgccuuccagaacgccaacauccugauccugaucgccggcugccacagcagcaucgugagagccuucgagagaaacgacuucuucgacgccggcaucaccaagacccagcuguuccugagcgugcacgacgccgugcuguucgcccugagcagaaaggugaucggcagcagcgagcugagcaucgacgagagcgagaccgugaucagagagaccuacagcgagaccgacaagaacgacaacagcagauacaagaugagcagcagcuuccugggcagccagaagaacgugagccccggcuucaucaagauccagcagcccguggaggaggagagcgagcuggaccuggagcuggagagcgagcaggaggccggccugggccuggaccuggaccuggacagagagcuggagcccgagauggagcccaaggccgagaccgagaccaagacccagaccgagauggagccccagcccgagaccgagcccgagauggagcccaaccccaagagcagacccagagcccacaccuucccccagcagagauacuggcccauguaccaccccagcauggccagcacccagagccagacccagaccagaaccuggagcguggagagaagaagacaccccauggacagcuacagccccgagggcaacagcaacgaggacguguaa

SEQ ID NO: 23505 - RNA, 2664 nt, Artificial Sequence
  SLC26A9__Homo_sapiens__NP_599152
augagccagcccagacccagauacgugguggacagagccgccuacagccugacccuguucgacgacgaguucgagaagaaggacagaaccuaccccgugggcgagaagcugagaaacgccuucagaugcagcagcgccaagaucaaggccgugguguucggccugcugcccgugcugagcuggcugcccaaguacaagaucaaggacuacaucauccccgaccugcugggcggccugagcggcggcagcauccaggugccccagggcauggccuucgcccugcuggccaaccugcccgccgugaacggccuguacagcagcuucuucccccugcugaccuacuucuuccugggcggcgugcaccagauggugcccggcaccuucgccgugaucagcauccuggugggcaacaucugccugcagcuggcccccgagagcaaguuccagguguucaacaacgccaccaacgagagcuacguggacaccgccgccauggaggccgagagacugcacgugagcgccacccuggccugccugaccgccaucauccagaugggccugggcuucaugcaguucggcuucguggccaucuaccugagcgagagcuucaucagaggcuucaugaccgccgccggccugcagauccugaucagcgugcugaaguacaucuucggccugaccauccccagcuacaccggccccggcagcaucguguucaccuucaucgacaucugcaagaaccugccccacaccaacaucgccagccugaucuucgcccugaucagcggcgccuuccuggugcuggugaaggagcugaacgccagauacaugcacaagaucagauuccccauccccaccgagaugaucgugguggugguggccaccgccaucagcggcggcugcaagaugcccaagaaguaccacaugcagaucgugggcgagauccagagaggcuuccccacccccgugagccccguggugagccaguggaaggacaugaucggcaccgccuucagccuggccaucgugagcuacgugaucaaccuggccaugggcagaacccuggccaacaagcacggcuacgacguggacagcaaccaggagaugaucgcccugggcugcagcaacuucuucggcagcuucuucaagauccacgugaucugcugcgcccugagcgugacccuggccguggacggcgccggcggcaagagccagguggccagccugugcgugagccugguggugaugaucaccaugcuggugcugggcaucuaccuguacccccugcccaagagcgugcugggcgcccugaucgccgugaaccugaagaacagccugaagcagcugaccgaccccuacuaccuguggagaaagagcaagcuggacugcugcaucuggguggugagcuuccugagcagcuucuuccugagccugcccuacggcguggccgugggcguggccuucagcgugcugguggugguguuccagacccaguucagaaacggcuacgcccuggcccaggugauggacaccgacaucuacgugaaccccaagaccuacaacagagcccaggacauccagggcaucaagaucaucaccuacugcagcccccuguacuucgccaacagcgagaucuucagacagaaggugaucgccaagaccggcauggacccccagaaggugcugcuggccaagcagaaguaccugaagaagcaggagaagagaagaaugagacccacccagcagagaagaagccuguucaugaagaccaagaccgugagccugcaggagcugcagcaggacuucgagaacgccccccccaccgaccccaacaacaaccagacccccgccaacggcaccagcgugagcuacaucaccuucagccccgacagcagcagccccgcccagagcgagccccccgccagcgccgaggcccccggcgagcccagcgacaugcuggccagcgugccccccuucgugaccuuccacacccugauccuggacaugagcggcgugagcuucguggaccugaugggcaucaaggcccuggccaagcugagcagcaccuacggcaagaucggcgugaagguguuccuggugaacauccacgcccagguguacaacgacaucagccacggcggcguguucgaggacggcagccuggagugcaagcacguguuccccagcauccacgacgccgugcuguucgcccaggccaacgccagagacgugacccccggccacaacuuccagggcgcccccggcgacgccgagcugagccuguacgacagcgaggaggacaucagaagcuacugggaccuggagcaggagauguucggcagcauguuccacgccgagacccugaccgcccuggagagccugagcgccgccggcggcugcuaccccuacagaagcgagagccuggugagcccccuguucaccagacaggcccuggccgccauggacaagccccccgcccacagcaccccccccaccagcgcccugagccuggccgccgagggccaccuggacuuccagcugcugagagugagccagaagcagaaggacaaguacaacugcgccggccugcuguacaagcugcagaaggugagccagagcccccacggcagcgugagcgacggcgugagacugagcagaaccuaa

SEQ ID NO: 23506 - RNA, 1977 nt, Artificial Sequence
  SLC27A1__Homo_sapiens__XP_011526304
augagagcccccggcgccggcgccgccagcguggugagccuggcccugcuguggcugcugggccugcccuggaccuggagcgccgccgccgcccugggcguguacgugggcagcggcggcuggagauuccugagaaucgugugcaagaccgccagaagagaccuguucggccugagcgugcugaucagagugagacuggagcugagaagacaccagagagccggccacaccauccccagaaucuuccaggccguggugcagagacagcccgagagacuggcccugguggacgccggcaccggcgagugcuggaccuucgcccagcuggacgccuacagcaacgccguggccaaccuguucagacagcugggcuucgcccccggcgacgugguggccaucuuccuggagggcagacccgaguucgugggccuguggcugggccuggccaaggccggcauggaggccgcccugcugaacgugaaccugagaagagagccccuggccuucugccugggcaccagcggcgccaaggcccugaucuucggcggcgagaugguggccgccguggccgaggugagcggccaccugggcaagagccugaucaaguucugcagcggcgaccugggccccgagggcauccugcccgacacccaccugcuggacccccugcugaaggaggccagcaccgccccccuggcccagauccccagcaagggcauggacgacagacuguucuacaucuacaccagcggcaccaccggccugcccaaggccgccaucguggugcacagcagauacuacagaauggccgccuucggccaccacgccuacagaaugcaggccgccgacgugcuguacgacugccugccccuguaccacagcgccggcaacaucaucggcgugggccagugccugaucuacggccugaccguggugcugagaaagaaguucagcgccagcagauucugggacgacugcaucaaguacaacugcaccaucaacggcgugagacacugcagacugcugugccugguggugcaguacaucggcgagaucugcagauaccugcugaagcagcccgugagagaggccgagagaagacacagagugagacuggccgugggcaacggccugagacccgccaucugggaggaguucaccgagagauucggcgugagacagaucggcgaguucuacggcgccaccgagugcaacugcagcaucgccaacauggacggcaaggugggcagcugcggcuucaacagcagaauccugccccacguguaccccaucagacuggugaaggugaacgaggacaccauggagcugcugagagacgcccagggccugugcauccccugccaggccggcgagcccggccugcuggugggccagaucaaccagcaggacccccugagaagauucgacggcuacgugagcgagagcgccaccagcaagaagaucgcccacagcguguucagcaagggcgacagcgccuaccugagcggcgacgugcuggugauggacgagcugggcuacauguacuucagagacagaagcggcgacaccuucagauggagaggcgagaacgugagcaccaccgagguggagggcgugcugagcagacugcugggccagaccgacguggccguguacggcguggccgugcccggcguggagggcaaggccggcauggccgccguggccgacccccacagccugcuggaccccaacgccaucuaccaggagcugcagaaggugcuggcccccuacgccagacccaucuuccugagacugcugccccagguggacaccaccggcaccuucaagauccagaagaccagacugcagagagagggcuucgaccccagacagaccagcgacagacuguucuuccuggaccugaagcagggccacuaccugccccugaacgaggccguguacaccagaaucugcagcggcgccuucgcccuguaa

SEQ ID NO: 23507 - RNA, 1704 nt, Artificial Sequence
  SLC27A2__Homo_sapiens__NP_001153101
augcugagcgccaucuacaccgugcuggccggccugcuguuccugccccugcuggugaaccugugcugccccuacuucuuccaggacaucggcuacuuccugaagguggccgccgugggcagaagagugagaagcuacggcaagagaagacccgccagaaccauccugagagccuuccuggagaaggccagacagaccccccacaagcccuuccugcuguucagagacgagacccugaccuacgcccagguggacagaagaagcaaccagguggccagagcccugcacgaccaccugggccugagacagggcgacugcguggcccugcugaugggcaacgagcccgccuacguguggcuguggcugggccuggugaagcugggcugcgccauggccugccugaacuacaacaucagagccaagagccugcugcacugcuuccagugcugcggcgccaaggugcugcuggugagccccgagcugcaggccgccguggaggagauccugcccagccugaagaaggacgacgugagcaucuacuacgugagcagaaccagcaacaccgacggcaucgacagcuuccuggacaagguggacgaggugagcaccgagcccauccccgagagcuggagaagcgaggugaccuucagcacccccgcccuguacaucuacaccagcggcaccaccggcgccacccuggcccugagaaccaaguucagcgccagccaguucugggacgacugcagaaaguacaacgugaccgugauccaguacaucggcgagcugcugagauaccugugcaacagcccccagaagcccaacgacagagaccacaaggugagacuggcccugggcaacggccugagaggcgacguguggagacaguucgugaagagauucggcgacaucugcaucuacgaguucuacgccgccaccgagggcaacaucggcuucaugaacuacgccagaaaggugggcgccgugggcagagugaacuaccugcagaagaagaucaucaccuacgaccugaucaaguacgacguggagaaggacgagcccgugagagacgagaacggcuacugcgugagagugcccaagggcgaggugggccugcuggugugcaagaucacccagcugacccccuucaacggcuacgccggcgccaaggcccagaccgagaagaagaagcugagagacguguucaagaagggcgaccuguacuucaacagcggcgaccugcugaugguggaccacgagaacuucaucuacuuccacgacagagugggcgacaccuucagauggaagggcgagaacguggccaccaccgagguggccgacaccgugggccugguggacuucgugcaggaggugaacguguacggcgugcacgugcccgaccacgagggcagaaucggcauggccagcaucaagaugaaggagaaccacgaguucgacggcaagaagcuguuccagcacaucgccgacuaccugcccagcuacgccagacccagauuccugagaauccaggacaccaucgagaucaccggcaccuucaagcacagaaagaugacccugguggaggagggcuucaaccccgccgugaucaaggacgcccuguacuuccuggacgacaccgccaagauguacgugcccaugaccgaggacaucuacaacgccaucagcgccaagacccugaagcuguaa

SEQ ID NO: 23508 - RNA, 2193 nt, Artificial Sequence
  SLC27A3__Homo_sapiens__NP_077306
augggcgugugccagagaaccagagcccccuggaaggagaagagccagcuggagagagccgcccugggcuucagaaagggcggcagcggcauguucgccagcggcuggaaccagaccgugcccaucgaggaggccggcagcauggccgcccugcugcugcugccccugcugcugcugcugccccugcugcugcugaagcugcaccuguggccccagcugagauggcugcccgccgaccuggccuucgccgugagagcccugugcugcaagagagcccugagagccagagcccuggccgccgccgccgccgaccccgagggccccgagggcggcugcagccuggccuggagacuggccgagcuggcccagcagagagccgcccacaccuuccugauccacggcagcagaagauucagcuacagcgaggccgagagagagagcaacagagccgccagagccuuccugagagcccugggcugggacuggggccccgacggcggcgacagcggcgagggcagcgccggcgagggcgagagagccgcccccggcgccggcgacgccgccgccggcagcggcgccgaguucgccggcggcgacggcgccgccagaggcggcggcgccgccgccccccugagccccggcgccaccguggcccugcugcugcccgccggccccgaguuccuguggcugugguucggccuggccaaggccggccugagaaccgccuucgugcccaccgcccugagaagaggcccccugcugcacugccugagaagcugcggcgccagagcccuggugcuggcccccgaguuccuggagagccuggagcccgaccugcccgcccugagagccaugggccugcaccugugggccgccggccccggcacccaccccgccggcaucagcgaccugcuggccgaggugagcgccgagguggacggccccgugcccggcuaccugagcagcccccagagcaucaccgacaccugccuguacaucuucaccagcggcaccaccggccugcccaaggccgccagaaucagccaccugaagauccugcagugccagggcuucuaccagcugugcggcgugcaccaggaggacgugaucuaccuggcccugccccuguaccacaugagcggcagccugcugggcaucgugggcugcaugggcaucggcgccaccguggugcugaagagcaaguucagcgccggccaguucugggaggacugccagcagcacagagugaccguguuccaguacaucggcgagcugugcagauaccuggugaaccagccccccagcaaggccgagagaggccacaaggugagacuggccgugggcagcggccugagacccgacaccugggagagauucgugagaagauucggcccccugcaggugcuggagaccuacggccugaccgagggcaacguggccaccaucaacuacaccggccagagaggcgccgugggcagagccagcuggcuguacaagcacaucuuccccuucagccugaucagauacgacgugaccaccggcgagcccaucagagacccccagggccacugcauggccaccagccccggcgagcccggccugcugguggcccccgugagccagcagagccccuuccugggcuacgccggcggccccgagcuggcccagggcaagcugcugaaggacguguucagacccggcgacguguucuucaacaccggcgaccugcuggugugcgacgaccagggcuuccugagauuccacgacagaaccggcgacaccuucagauggaagggcgagaacguggccaccaccgagguggccgagguguucgaggcccuggacuuccugcaggaggugaacguguacggcgugaccgugcccggccacgagggcagagccggcauggccgcccuggugcugagacccccccacgcccuggaccugaugcagcuguacacccacgugagcgagaaccugccccccuacgccagacccagauuccugagacugcaggagagccuggccaccaccgagaccuucaagcagcagaaggugagaauggccaacgagggcuucgaccccagcacccugagcgacccccuguacgugcuggaccaggccgugggcgccuaccugccccugaccaccgccagauacagcgcccugcuggccggcaaccugagaaucuaa

SEQ ID NO: 23509 - RNA, 1932 nt, Artificial Sequence
  SLC27A4__Homo_sapiens__NP_005085
augcugcugggcgccagccuggugggcgugcugcuguucagcaagcuggugcugaagcugcccuggacccaggugggcuucagccugcuguuccuguaccugggcagcggcggcuggagauucaucagaguguucaucaagaccaucagaagagacaucuucggcggccuggugcugcugaaggugaaggccaaggugagacagugccugcaggagagaagaaccgugcccauccuguucgccagcaccgugagaagacaccccgacaagaccgcccugaucuucgagggcaccgacacccacuggaccuucagacagcuggacgaguacagcagcagcguggccaacuuccugcaggccagaggccuggccagcggcgacguggccgccaucuucauggagaacagaaacgaguucgugggccuguggcugggcauggccaagcugggcguggaggccgcccugaucaacaccaaccugagaagagacgcccugcugcacugccugaccaccagcagagccagagcccugguguucggcagcgagauggccagcgccaucugcgaggugcacgccagccuggaccccagccugagccuguucugcagcggcagcugggagcccggcgccgugccccccagcaccgagcaccuggacccccugcugaaggacgcccccaagcaccugcccagcugccccgacaagggcuucaccgacaagcuguucuacaucuacaccagcggcaccaccggccugcccaaggccgccaucguggugcacagcagauacuacagaauggccgcccugguguacuacggcuucagaaugagacccaacgacaucguguacgacugccugccccuguaccacagcgccggcaacaucgugggcaucggccagugccugcugcacggcaugaccguggugaucagaaagaaguucagcgccagcagauucugggacgacugcaucaaguacaacugcaccaucgugcaguacaucggcgagcugugcagauaccugcugaaccagccccccagagaggccgagaaccagcaccaggugagaauggcccugggcaacggccugagacagagcaucuggaccaacuucagcagcagauuccacaucccccagguggccgaguucuacggcgccaccgagugcaacugcagccugggcaacuucgacagccaggugggcgccugcggcuucaacagcagaauccugagcuucguguaccccaucagacuggugagagugaacgaggacaccauggagcugaucagaggccccgacggcgugugcauccccugccagcccggcgagcccggccagcuggugggcagaaucauccagaaggacccccugagaagauucgacggcuaccugaaccagggcgccaacaacaagaagaucgccaaggacguguucaagaagggcgaccaggccuaccugaccggcgacgugcuggugauggacgagcugggcuaccuguacuucagagacagaaccggcgacaccuucagauggaagggcgagaacgugagcaccaccgagguggagggcacccugagcagacugcuggacauggccgacguggccguguacggcguggaggugcccggcaccgagggcagagccggcauggccgccguggccagccccaccggcaacugcgaccuggagagauucgcccaggugcuggagaaggagcugccccuguacgccagacccaucuuccugagacugcugcccgagcugcacaagaccggcaccuacaaguuccagaagaccgagcugagaaaggagggcuucgaccccgccaucgugaaggacccccuguucuaccuggacgcccagaagggcagauacgugccccuggaccaggaggccuacagcagaauccaggccggcgaggagaagcuguaa

SEQ ID NO: 23510 - RNA, 2073 nt, Artificial Sequence
  SLC27A5__Homo_sapiens__NP_036386
augggcgugagacagcagcuggcccugcugcugcugcugcugcugcugcuguggggccugggccagcccguguggcccguggccguggcccugacccugagauggcugcugggcgaccccaccugcugcgugcugcugggccuggccaugcuggccagacccuggcugggccccugggugccccacggccugagccuggccgccgccgcccuggcccugacccugcugcccgccagacugccccccggccugagauggcugcccgccgacgugaucuuccuggccaagauccugcaccugggccugaagaucagaggcugccugagcagacagccccccgacaccuucguggacgccuucgagagaagagccagagcccagcccggcagagcccugcugguguggaccggccccggcgccggcagcgugaccuucggcgagcuggacgccagagccugccaggccgccugggcccugaaggccgagcugggcgaccccgccagccugugcgccggcgagcccaccgcccugcuggugcuggccagccaggccgugcccgcccugugcauguggcugggccuggccaagcugggcugccccaccgccuggaucaacccccacggcagaggcaugccccuggcccacagcgugcugagcagcggcgccagagugcuggugguggaccccgaccugagagagagccuggaggagauccugcccaagcugcaggccgagaacaucagaugcuucuaccugagccacaccagccccacccccggcgugggcgcccugggcgccgcccuggacgccgcccccagccaccccgugcccgccgaccugagagccggcaucaccuggagaagccccgcccuguucaucuacaccagcggcaccaccggccugcccaagcccgccauccugacccacgagagagugcugcagaugagcaagaugcugagccugagcggcgccaccgccgacgacgugguguacaccgugcugccccuguaccacgugaugggccugguggugggcauccugggcugccuggaccugggcgccaccugcgugcuggcccccaaguucagcaccagcugcuucugggacgacugcagacagcacggcgugaccgugauccuguacgugggcgagcugcugagauaccugugcaacaucccccagcagcccgaggacagaacccacaccgugagacuggccaugggcaacggccugagagccgacgugugggagaccuuccagcagagauucggccccaucagaaucugggagguguacggcagcaccgagggcaacaugggccuggugaacuacgugggcagaugcggcgcccugggcaagaugagcugccugcugagaaugcugagccccuucgagcuggugcaguucgacauggaggccgccgagcccgugagagacaaccagggcuucugcauccccgugggccugggcgagcccggccugcugcugaccaagguggugagccagcagcccuucgugggcuacagaggccccagagagcugagcgagagaaagcuggugagaaacgugagacagagcggcgacguguacuacaacaccggcgacgugcuggccauggacagagagggcuuccuguacuucagagacagacugggcgacaccuucagauggaagggcgagaacgugagcacccacgagguggagggcgugcugagccagguggacuuccugcagcaggugaacguguacggcgugugcgugcccggcugcgagggcaaggugggcauggccgccgugcagcuggcccccggccagaccuucgacggcgagaagcuguaccagcacgugagagccuggcugcccgccuacgccaccccccacuucaucagaauccaggacgccauggaggugaccagcaccuucaagcugaugaagaccagacuggugagagagggcuucaacgugggcaucgugguggacccccuguucgugcuggacaacagagcccagagcuucagaccccugaccgccgagauguaccaggccgugugcgagggcaccuggagacuguaa

SEQ ID NO: 23511 - RNA, 1950 nt, Artificial Sequence
  SLC28A1__Homo_sapiens__NP_004204
auggagaacgaccccagcagaagaagagagagcaucagccugacccccguggccaagggccuggagaacaugggcgccgacuuccuggagagccuggaggagggccagcugcccagaagcgaccugagccccgccgagaucagaagcagcuggagcgaggccgcccccaagcccuucagcagauggagaaaccugcagcccgcccugagagccagaagcuucugcagagagcacaugcagcuguucagauggaucggcaccggccugcugugcaccggccugagcgccuuccugcugguggccugccugcuggacuuccagagagcccuggcccuguucgugcugaccugcguggugcugaccuuccugggccacagacugcugaagagacugcugggccccaagcugagaagauuccugaagccccagggccaccccagacugcugcugugguucaagagaggccuggcccuggccgccuuccugggccuggugcuguggcugagccuggacaccagccagagacccgagcagcuggugagcuucgccggcaucugcguguucguggcccugcuguucgccugcagcaagcaccacugcgccgugagcuggagagccgugagcuggggccugggccugcaguucgugcugggccugcuggugaucagaaccgagcccggcuucaucgccuucgaguggcugggcgagcagaucagaaucuuccugagcuacaccaaggccggcagcagcuucguguucggcgaggcccuggugaaggacguguucgccuuccaggugcugcccaucaucguguucuucagcugcgugaucagcgugcuguaccacgugggccugaugcagugggugauccugaagaucgccuggcugaugcaggugaccaugggcaccaccgccaccgagacccugagcguggccggcaacaucuucgugagccagaccgaggccccccugcugaucagacccuaccuggccgacaugacccugagcgaggugcacguggugaugaccggcggcuacgccaccaucgccggcagccugcugggcgccuacaucagcuucggcaucgacgccaccagccugaucgccgccagcgugauggccgcccccugcgcccuggcccugagcaagcugguguaccccgagguggaggagagcaaguucagaagagaggagggcgugaagcugaccuacggcgacgcccagaaccugaucgaggccgccagcaccggcgccgccaucagcgugaaggugguggccaacaucgccgccaaccugaucgccuuccuggccgugcuggacuucaucaacgccgcccugagcuggcugggcgacaugguggacauccagggccugagcuuccagcugaucugcagcuacauccugagacccguggccuuccugaugggcguggccugggaggacugccccgugguggccgagcugcugggcaucaagcuguuccugaacgaguucguggccuaccaggaccugagcaaguacaagcagagaagacuggccggcgccgaggagugggugggcgacagaaagcaguggaucagcgugagagccgaggugcugaccaccuucgcccugugcggcuucgccaacuucagcagcaucggcaucaugcugggcggccugaccagcauggugccccagagaaagagcgacuucagccagaucgugcugagagcccuguucaccggcgccugcgugagccuggugaacgccugcauggccggcauccuguacaugcccagaggcgccgagguggacugcaugagccugcugaacaccacccugagcagcagcagcuucgagaucuaccagugcugcagagaggccuuccagagcgugaaccccgaguucagccccgaggcccuggacaacugcugcagauucuacaaccacaccaucugcgcccaguaa

SEQ ID NO: 23512 - RNA, 1977 nt, Artificial Sequence
  SLC28A2__Homo_sapiens__XP_011520500
auggagaaggccagcggcagacagagcaucgcccugagcaccguggagaccggcaccgugaaccccggccuggagcugauggagaaggagguggagcccgagggcagcaagagaaccgacgcccagggccacagccugggcgacggccugggccccagcaccuaccagagaagaagcagauggcccuucagcaaggccagaagcuucugcaagacccacgccagccuguucaagaagauccugcugggccugcugugccuggccuacgccgccuaccugcuggccgccugcauccugaacuuccagagagcccuggcccuguucgugaucaccugccuggugaucuucgugcuggugcacagcuuccugaagaagcugcugggcaagaagcugaccagaugccugaagcccuucgagaacagcagacugagacuguggaccaaguggguguucgccggcgugagccuggugggccugauccuguggcuggcccuggacaccgcccagagacccgagcagcugauccccuucgccggcaucugcauguucauccugauccuguucgccugcagcaagcaccacagcgccgugagcuggagaaccguguucagcggccugggccugcaguucguguucggcauccuggugaucagaaccgaccugggcuacaccguguuccaguggcugggcgagcaggugcagaucuuccugaacuacaccguggccggcagcagcuucguguucggcgacacccuggugaaggacguguucgccuuccaggcccugcccaucaucaucuucuucggcugcguggugagcauccuguacuaccugggccuggugcaguggguggugcagaagguggccugguuccugcagaucaccaugggcaccaccgccaccgagacccuggccguggccggcaacaucuucgugggcaugaccgaggccccccugcugaucagacccuaccugggcgacaugacccugagcgagauccacgccgugaugaccggcggcuucgccaccaucagcggcaccgugcugggcgccuucaucgccuucggcguggacgccagcagccugaucagcgccagcgugauggccgcccccugcgcccuggccagcagcaagcuggccuaccccgagguggaggagagcaaguucaagagcgaggagggcgugaagcugcccagaggcaaggagagaaacgugcuggaggccgccagcaacggcgccguggacgccaucggccuggccaccaacguggccgccaaccugaucgccuuccuggccgugcuggccuucaucaacgccgcccugagcuggcugggcgagcugguggacauccagggccugaccuuccaggugaucugcagcuaccugcugagacccaugguguucaugaugggcguggaguggaccgacugccccaugguggccgagauggugggcaucaaguucuucaucaacgaguucguggccuaccagcagcugagccaguacaagaacaagagacugagcggcauggaggaguggaucgagggcgagaagcaguggaucagcgugagagccgagaucaucaccaccuucagccugugcggcuucgccaaccugagcagcaucggcaucacccugggcggccugaccagcaucgugccccacagaaagagcgaccugagcaaggugguggugagagcccuguucaccggcgccugcgugagccugaucagcgccugcauggccggcauccuguacgugcccagaggcgccgaggccgacugcgugagcuuccccaacaccagcuucaccaacagaaccuacgagaccuacaugugcugcagaggccuguuccagagcaccagccugaacggcaccaacccccccagcuucagcggccccugggaggacaaggaguucagcgccauggcccugaccaacugcugcggcuucuacaacaacaccgugugcgccuaa

SEQ ID NO: 23513 - RNA, 2076 nt, Artificial Sequence
  SLC28A3__Homo_sapiens__NP_001186562
auggagcugagaagcaccgccgcccccagagccgagggcuacagcaacgugggcuuccagaacgaggagaacuuccuggagaacgagaacaccagcggcaacaacagcaucagaagcagagccgugcagagcagagagcacaccaacaccaagcaggacgaggagcaggugaccguggagcaggacagccccagaaacagagagcacauggaggacgacgacgaggagaugcagcagaagggcugccuggagagaagauacgacaccgugugcggcuucugcagaaagcacaagaccacccugagacacaucaucuggggcauccugcuggccggcuaccuggugauggugaucagcgccugcgugcugaacuuccacagagcccugccccuguucgugaucaccguggccgccaucuucuucguggugugggaccaccugauggccaaguacgagcacagaaucgacgagaugcugagccccggcagaagacugcugaacagccacugguucuggcugaagugggugaucuggagcagccuggugcuggccgugaucuucuggcuggccuucgacaccgccaagcugggccagcagcagcuggugagcuucggcggccugaucauguacaucgugcugcuguuccuguucagcaaguaccccaccagaguguacuggagacccgugcuguggggcaucggccugcaguuccugcugggccugcugauccugagaaccgaccccggcuucaucgccuucgacuggcugggcagacaggugcagaccuuccuggaguacaccgacgccggcgccagcuucguguucggcgagaaguacaaggaccacuucuucgccuucaaggugcugcccaucgugguguucuucagcaccgugaugagcaugcuguacuaccugggccugaugcaguggaucaucagaaaggugggcuggaucaugcuggugaccaccggcagcagccccaucgagagcgugguggccagcggcaacaucuucgugggccagaccgagagcccccugcuggugagacccuaccugcccuacaucaccaagagcgagcugcacgccaucaugaccgccggcuucagcaccaucgccggcagcgugcugggcgccuacaucagcuucggcgugcccagcagccaccugcugaccgccagcgugaugagcgcccccgccagccuggccgccgccaagcuguucuggcccgagaccgagaagcccaagaucacccugaagaacgccaugaagauggagagcggcgacagcggcaaccugcuggaggccgccacccagggcgccagcagcagcaucagccugguggccaacaucgccgugaaccugaucgccuuccuggcccugcugagcuucaugaacagcgcccugagcugguucggcaacauguucgacuacccccagcugagcuucgagcugaucugcagcuacaucuucaugcccuucagcuucaugaugggcguggaguggcaggacagcuucaugguggccagacugaucggcuacaagaccuucuucaacgaguucguggccuacgagcaccugagcaaguggauccaccugagaaaggagggcggccccaaguucgugaacggcgugcagcaguacaucagcaucagaagcgagaucaucgccaccuacgcccugugcggcuucgccaacaucggcagccugggcaucgugaucggcggccugaccagcauggcccccagcagaaagagagacaucgccagcggcgccgugagagcccugaucgccggcaccguggccugcuucaugaccgccugcaucgccggcauccugagcagcacccccguggacaucaacugccaccacgugcuggagaacgccuucaacagcaccuuccccggcaacaccaccaaggugaucgccugcugccagagccugcugagcagcaccguggccaagggccccggcgaggugauccccggcggcaaccacagccuguacagccugaagggcugcugcacccugcugaaccccagcaccuucaacugcaacggcaucagcaacaccuucuaa

SEQ ID NO: 23514 - RNA, 1371 nt, Artificial Sequence
  SLC29A1__Homo_sapiens__NP_001071643
augaccaccagccaccagccccaggacagauacaaggccguguggcugaucuucuucaugcugggccugggcacccugcugcccuggaacuucuucaugaccgccacccaguacuucaccaacagacuggacaugagccagaacgugagccuggugaccgccgagcugagcaaggacgcccaggccagcgccgcccccgccgccccccugcccgagagaaacagccugagcgccaucuucaacaacgugaugacccugugcgccaugcugccccugcugcuguucaccuaccugaacagcuuccugcaccagagaaucccccagagcgugagaauccugggcagccugguggccauccugcugguguuccugaucaccgccauccuggugaaggugcagcuggacgcccugcccuucuucgugaucaccaugaucaagaucgugcugaucaacagcuucggcgccauccugcagggcagccuguucggccuggccggccugcugcccgccagcuacaccgcccccaucaugagcggccagggccuggccggcuucuucgccagcguggccaugaucugcgccaucgccagcggcagcgagcugagcgagagcgccuucggcuacuucaucaccgccugcgccgugaucauccugaccaucaucugcuaccugggccugcccagacuggaguucuacagauacuaccagcagcugaagcuggagggccccggcgagcaggagaccaagcuggaccugaucagcaagggcgaggagcccagagccggcaaggaggagagcggcgugagcgugagcaacagccagcccaccaacgagagccacagcaucaaggccauccugaagaacaucagcgugcuggccuucagcgugugcuucaucuucaccaucaccaucggcauguuccccgccgugaccguggaggugaagagcagcaucgccggcagcagcaccugggagagauacuucauccccgugagcugcuuccugaccuucaacaucuucgacuggcugggcagaagccugaccgccguguucauguggcccggcaaggacagcagauggcugcccagccuggugcuggccagacugguguucgugccccugcugcugcugugcaacaucaagcccagaagauaccugaccgugguguucgagcacgacgccugguucaucuucuucauggccgccuucgccuucagcaacggcuaccuggccagccugugcaugugcuucggccccaagaaggugaagcccgccgaggccgagaccgccggcgccaucauggccuucuuccugugccugggccuggcccugggcgccguguucagcuuccuguucagagccaucguguaa

SEQ ID NO: 23515 - RNA, 1371 nt, Artificial Sequence
  SLC29A2__Homo_sapiens__XP_011543277
auggccagaggcgacgcccccagagacagcuaccaccuggugggcaucagcuucuucauccugggccugggcacccugcugcccuggaacuucuucaucaccgccauccccuacuuccaggccagacuggccggcgccggcaacagcaccgccagaauccugagcaccaaccacaccggccccgaggacgccuucaacuucaacaacugggugacccugcugagccagcugccccugcugcuguucacccugcugaacagcuuccuguaccagugcgugcccgagaccgugagaauccugggcagccugcuggccauccugcugcuguucgcccugaccgccgcccuggugaagguggacaugagccccggccccuucuucagcaucaccauggccagcgugugcuucaucaacagcuucagcgccgugcugcagggcagccuguucggccagcugggcaccaugcccagcaccuacagcacccuguuccugagcggccagggccuggccggcaucuucgccgcccuggccaugcugcugagcauggccagcggcguggacgccgagaccagcgcccugggcuacuucaucacccccugcgugggcauccugaugagcaucgugugcuaccugagccugccccaccugaaguucgccagauacuaccuggccaacaagagcagccaggcccaggcccaggagcuggagaccaaggccgagcugcugcagagcgacgagaacggcauccccagcagcccccagaagguggcccugacccuggaccuggaccuggagaaggagcccgagagcgagcccgacgagccccagaagcccggcaagcccagcguguucaccguguuccagaagaucuggcugaccgcccugugccuggugcugguguucaccgugacccugagcguguuccccgccaucaccgccauggugaccagcagcaccagccccggcaaguggagccaguucuucaaccccaucugcugcuuccugcuguucaacaucauggacuggcugggcagaagccugaccagcuacuuccuguggcccgacgaggacagcagacugcugccccugcuggugugccugagauuccuguucgugccccuguucaugcugugccacgugccccagagaagcagacugcccauccuguucccccaggacgccuacuucaucaccuucaugcugcuguucgccgugagcaacggcuaccuggugagccugaccaugugccuggcccccagacaggugcugccccacgagagagagguggccggcgcccugaugaccuucuuccuggcccugggccugagcugcggcgccagccugagcuuccuguucaaggcccugcuguaa

SEQ ID NO: 23516 - RNA, 1428 nt, Artificial Sequence
  SLC29A3__Homo_sapiens__NP_060814
auggccguggugagcgaggacgacuuccagcacagcagcaacagcaccuacagaaccaccagcagcagccugagagccgaccaggaggcccugcuggagaagcugcuggacagacccccccccggccugcagagacccgaggacagauucugcggcaccuacaucaucuucuucagccugggcaucggcagccugcugcccuggaacuucuucaucaccgccaaggaguacuggauguucaagcugagaaacagcagcagccccgccaccggcgaggaccccgagggcagcgacauccugaacuacuucgagagcuaccuggccguggccagcaccgugcccagcaugcugugccugguggccaacuuccugcuggugaacagaguggccgugcacaucagagugcuggccagccugaccgugauccuggccaucuucauggugaucaccgcccuggugaagguggacaccagcagcuggaccagaggcuucuucgccgugaccaucgugugcauggugauccugagcggcgccagcaccguguucagcagcagcaucuacggcaugaccggcagcuuccccaugagaaacagccaggcccugaucagcggcggcgccaugggcggcaccgugagcgccguggccagccugguggaccuggccgccagcagcgacgugagaaacagcgcccuggccuucuuccugaccgccaccguguuccuggugcugugcaugggccuguaccugcugcugagcagacuggaguacgccagauacuacaugagacccgugcuggccgcccacguguucagcggcgaggaggagcugccccaggacagccugagcgcccccagcguggccagcagauucaucgacagccacacccccccccugagacccauccugaagaagaccgccagccugggcuucugcgugaccuacguguucuucaucaccagccugaucuaccccgccaucugcaccaacaucgagagccugaacaagggcagcggcagccuguggaccaccaaguucuucaucccccugaccaccuuccugcuguacaacuucgccgaccugugcggcagacagcugaccgccuggauccaggugcccggccccaacagcaaggcccugcccggcuucgugcugcugagaaccugccugaucccccuguucgugcugugcaacuaccagcccagagugcaccugaagaccgugguguuccagagcgacguguaccccgcccugcugagcagccugcugggccugagcaacggcuaccugagcacccuggcccugcuguacggccccaagaucgugcccagagagcuggccgaggccaccggcguggugaugagcuucuacgugugccugggccugacccugggcagcgccugcagcacccugcuggugcaccugaucuaa

SEQ ID NO: 23517 - RNA, 1593 nt, Artificial Sequence
  SLC29A4__Homo_sapiens__XP_006715730
augggcagcgugggcagccagagacuggaggagcccagcguggccggcacccccgaccccggcguggugaugagcuucaccuucgacagccaccagcuggaggaggccgccgaggccgcccagggccagggccugagagccagaggcgugcccgccuucaccgacaccacccuggacgagcccgugcccgacgacagauaccacgccaucuacuucgccaugcugcuggccggcgugggcuuccugcugcccuacaacagcuucaucaccgacguggacuaccugcaccacaaguaccccggcaccagcaucguguucgacaugagccugaccuacauccugguggcccuggccgccgugcugcugaacaacgugcugguggagagacugacccugcacaccagaaucaccgccggcuaccugcuggcccugggcccccugcuguucaucagcaucugcgacguguggcugcagcuguucagcagagaccaggccuacgccaucaaccuggccgccgugggcaccguggccuucggcugcaccgugcagcagagcagcuucuacggcuacaccggcaugcugcccaagagauacacccagggcgugaugaccggcgagagcaccgccggcgugaugaucagccugagcagaauccugaccaagcugcugcugcccgacgagagagccagcacccugaucuucuuccuggugagcguggcccuggagcugcugugcuuccugcugcaccugcuggugagaagaagcagauucgugcuguucuacaccaccagacccagagacagccacagaggcagacccggccugggcagaggcuacggcuacagagugcaccacgacgugguggccggcgacgugcacuucgagcaccccgcccccgcccuggcccccaacgagagccccaaggacagccccgcccacgaggugaccggcagcggcggcgccuacaugagauucgacgugcccagacccagagugcagagaagcuggcccaccuucagagcccugcugcugcacagauacgugguggccagagugaucugggccgacaugcugagcaucgccgugaccuacuucaucacccugugccuguuccccggccuggagagcgagaucagacacugcauccugggcgaguggcugcccauccugaucauggccguguucaaccugagcgacuucgugggcaagauccuggccgcccugcccguggacuggagaggcacccaccugcuggccugcagcugccugagagugguguucaucccccuguucauccugugcguguaccccagcggcaugcccgcccugagacaccccgccuggcccugcaucuucagccugcugaugggcaucagcaacggcuacuucggcagcgugcccaugauccuggccgccggcaaggugagccccaagcagagagagcuggccggcaacaccaugaccgugagcuacaugagcggccugacccugggcagcgccguggccuacugcaccuacagccugaccagagacgcccacggcagcugccugcacgccagcaccgccaacggcagcauccuggccggccuguaa

SEQ ID NO: 23518 - RNA, 1626 nt, Artificial Sequence
  SLC2A10__Homo_sapiens__NP_110404
augggccacagcccccccgugcugccccugugcgccagcgugagccugcugggcggccugaccuucggcuacgagcuggccgugaucagcggcgcccugcugccccugcagcuggacuucggccugagcugccuggagcaggaguuccuggugggcagccugcugcugggcgcccugcuggccagccuggugggcggcuuccugaucgacugcuacggcagaaagcaggccauccugggcagcaaccuggugcugcuggccggcagccugacccugggccuggccggcagccuggccuggcuggugcugggcagagccguggugggcuucgccaucagccugagcagcauggccugcugcaucuacgugagcgagcuggugggccccagacagagaggcgugcuggugagccuguacgaggccggcaucaccgugggcauccugcugagcuacgcccugaacuacgcccuggccggcacccccuggggcuggagacacauguucggcugggccaccgcccccgccgugcugcagagccugagccugcuguuccugcccgccggcaccgacgagaccgccacccacaaggaccugaucccccugcagggcggcgaggcccccaagcugggccccggcagacccagauacagcuuccuggaccuguucagagccagagacaacaugagaggcagaaccaccgugggccugggccuggugcuguuccagcagcugaccggccagcccaacgugcugugcuacgccagcaccaucuucagcagcgugggcuuccacggcggcagcagcgccgugcuggccagcgugggccugggcgccgugaagguggccgccacccugaccgccaugggccugguggacagagccggcagaagagcccugcugcuggccggcugcgcccugauggcccugagcgugagcggcaucggccuggugagcuucgccgugcccauggacagcggccccagcugccuggccgugcccaacgccaccggccagaccggccugcccggcgacagcggccugcugcaggacagcagccugccccccauccccagaaccaacgaggaccagagagagcccauccugagcaccgccaagaagaccaagccccaccccagaagcggcgaccccagcgccccccccagacuggcccugagcagcgcccugcccggccccccccugcccgccagaggccacgcccugcugagauggaccgcccugcugugccugaugguguucgugagcgccuucagcuucggcuucggccccgugaccuggcuggugcugagcgagaucuaccccguggagaucagaggcagagccuucgccuucugcaacagcuucaacugggccgccaaccuguucaucagccugagcuuccuggaccugaucggcaccaucggccugagcuggaccuuccugcuguacggccugaccgccgugcugggccugggcuucaucuaccuguucgugcccgagaccaagggccagagccuggccgagaucgaccagcaguuccagaagagaagauucacccugagcuucggccacagacagaacagcaccggcauccccuacagcagaaucgagaucagcgccgccagcuaa

SEQ ID NO: 23519 - RNA, 1491 nt, Artificial Sequence
  SLC2A11__Homo_sapiens__NP_001020109
augagagcccugagaagacugauccagggcagaauccugcugcugaccaucugcgccgccggcaucggcggcaccuuccaguucggcuacaaccugagcaucaucaacgcccccacccugcacauccaggaguucaccaacgagaccuggcaggccagaaccggcgagccccugcccgaccaccuggugcugcugauguggagccugaucgugagccuguacccccugggcggccuguucggcgcccugcuggccggcccccuggccaucacccugggcagaaagaagagccugcuggugaacaacaucuucguggugagcgccgccauccuguucggcuucagcagaaaggccggcagcuucgagaugaucaugcugggcagacugcuggugggcgugaacgccggcgugagcaugaacauccagcccauguaccugggcgagagcgcccccaaggagcugagaggcgccguggccaugagcagcgccaucuucaccgcccugggcaucgugaugggccagguggugggccugagagagcugcugggcggcccccaggccuggccccugcugcuggccagcugccuggugcccggcgcccugcagcuggccagccugccccugcugcccgagagccccagauaccugcugaucgacugcggcgacaccgaggccugccuggccgcccugagaagacugagaggcagcggcgaccuggccggcgagcuggaggagcuggaggaggagagagccgccugccagggcugcagagccagaagacccugggagcuguuccagcacagagcccugagaagacaggugaccagccugguggugcugggcagcgccauggagcugugcggcaacgacagcguguacgccuacgccagcagcguguucagaaaggccggcgugcccgaggccaagauccaguacgccaucaucggcaccggcagcugcgagcugcugaccgccguggugagcugcguggugaucgagagagugggcagaagagugcugcugaucggcggcuacagccugaugaccugcuggggcagcaucuucaccguggcccugugccugcagagcagcuuccccuggacccuguaccuggccauggccugcaucuucgccuucauccugagcuucggcaucggccccgccggcgugaccggcauccuggccaccgagcuguucgaccagauggccagacccgccgccugcauggugugcggcgcccugauguggaucaugcugauccuggugggccugggcuuccccuucaucauggaggcccugagccacuuccuguacgugcccuuccugggcgugugcgugugcggcgccaucuacaccggccuguuccugcccgagaccaagggcaagaccuuccaggagaucagcaaggagcugcacagacugaacuuccccagaagagcccagggccccaccuggagaagccuggaggugauccagagcaccgagcuguaa

SEQ ID NO: 23520 - RNA, 1854 nt, Artificial Sequence
  SLC2A12__Homo_sapiens__NP_660159
auggugcccguggagaacaccgagggccccagccugcugaaccagaagggcaccgccguggagaccgagggcagcggcagcagacacccccccugggccagaggcugcggcauguucaccuuccugagcagcgugaccgccgccgugagcggccugcuggugggcuacgagcugggcaucaucagcggcgcccugcugcagaucaagacccugcuggcccugagcugccacgagcaggagaugguggugagcagccuggugaucggcgcccugcuggccagccugaccggcggcgugcugaucgacagauacggcagaagaaccgccaucauccugagcagcugccugcugggccugggcagccuggugcugauccugagccugagcuacaccgugcugaucgugggcagaaucgccaucggcgugagcaucagccugagcagcaucgccaccugcguguacaucgccgagaucgccccccagcacagaagaggccugcuggugagccugaacgagcugaugaucgugaucggcauccugagcgccuacaucagcaacuacgccuucgccaacguguuccacggcuggaaguacauguucggccuggugaucccccugggcgugcugcaggccaucgccauguacuuccugccccccagccccagauuccuggugaugaagggccaggagggcgccgccagcaaggugcugggcagacugagagcccugagcgacaccaccgaggagcugaccgugaucaagagcagccugaaggacgaguaccaguacagcuucugggaccuguucagaagcaaggacaacaugagaaccagaaucaugaucggccugacccugguguucuucgugcagaucaccggccagcccaacauccuguucuacgccagcaccgugcugaagagcgugggcuuccagagcaacgaggccgccagccuggccagcaccggcgugggcguggugaaggugaucagcaccauccccgccacccugcugguggaccacgugggcagcaagaccuuccugugcaucggcagcagcgugauggccgccagccuggugaccaugggcaucgugaaccugaacauccacaugaacuucacccacaucugcagaagccacaacagcaucaaccagagccuggacgagagcgugaucuacggccccggcaaccugagcaccaacaacaacacccugagagaccacuucaagggcaucagcagccacagcagaagcagccugaugccccugagaaacgacguggacaagagaggcgagaccaccagcgccagccugcugaacgccggccugagccacaccgaguaccagaucgugaccgaccccggcgacgugcccgccuuccugaaguggcugagccuggccagccugcugguguacguggccgccuucagcaucggccugggccccaugcccuggcuggugcugagcgagaucuuccccggcggcaucagaggcagagccauggcccugaccagcagcaugaacuggggcaucaaccugcugaucagccugaccuuccugaccgugaccgaccugaucggccugcccugggugugcuucaucuacaccaucaugagccuggccagccugcuguucguggugauguucauccccgagaccaagggcugcagccuggagcagaucagcauggagcuggccaaggugaacuacgugaagaacaacaucugcuucaugagccaccaccaggaggagcuggugcccaagcagccccagaagagaaagccccaggagcagcugcuggagugcaacaagcugugcggcagaggccagagcagacagcugagccccgagaccuaa

SEQ ID NO: 23521 - RNA, 1947 nt, Artificial Sequence
  SLC2A13__Homo_sapiens__NP_443117
augagcagaaaggccagcgagaacguggaguacacccugagaagccugagcagccugaugggcgagagaagaagaaagcagcccgagcccgacgccgccagcgccgccggcgagugcagccugcuggccgccgccgagagcagcaccagccugcagagcgccggcgccggcggcggcggcgugggcgaccuggagagagccgccagaagacaguuccagcaggacgagacccccgccuucguguacgugguggccguguucagcgcccugggcggcuuccuguucggcuacgacaccggcguggugagcggcgccaugcugcugcugaagagacagcugagccuggacgcccuguggcaggagcugcuggugagcagcaccgugggcgccgccgccgugagcgcccuggccggcggcgcccugaacggcguguucggcagaagagccgccauccugcuggccagcgcccuguucaccgccggcagcgccgugcuggccgccgccaacaacaaggagacccugcuggccggcagacugguggugggccugggcaucggcaucgccagcaugaccgugcccguguacaucgccgaggugagcccccccaaccugagaggcagacuggugaccaucaacacccuguucaucaccggcggccaguucuucgccagcgugguggacggcgccuucagcuaccugcagaaggacggcuggagauacaugcugggccuggccgccgugcccgccgugauccaguucuucggcuuccuguuccugcccgagagccccagauggcugauccagaagggccagacccagaaggccagaagaauccugagccagaugagaggcaaccagaccaucgacgaggaguacgacagcaucaagaacaacaucgaggaggaggagaaggaggugggcagcgccggccccgugaucugcagaaugcugagcuacccccccaccagaagagcccugaucgugggcugcggccugcagauguuccagcagcugagcggcaucaacaccaucauguacuacagcgccaccauccugcagaugagcggcguggaggacgacagacuggccaucuggcuggccagcgugaccgccuucaccaacuucaucuucacccuggugggcguguggcugguggagaaggugggcagaagaaagcugaccuucggcagccuggccggcaccaccguggcccugaucauccuggcccugggcuucgugcugagcgcccaggugagccccagaaucaccuucaagcccaucgcccccagcggccagaacgccaccugcaccagauacagcuacugcaacgagugcaugcuggaccccgacugcggcuucugcuacaagaugaacaagagcaccgugaucgacagcagcugcgugcccgugaacaaggccagcaccaacgaggccgccuggggcagaugcgagaacgagaccaaguucaagaccgaggacaucuucugggccuacaacuucugccccacccccuacagcuggaccgcccugcugggccugauccuguaccugguguucuucgcccccggcaugggccccaugcccuggaccgugaacagcgagaucuacccccugugggccagaagcaccggcaacgccugcagcagcggcaucaacuggaucuucaacgugcuggugagccugaccuuccugcacaccgccgaguaccugaccuacuacggcgccuucuuccuguacgccggcuucgccgccgugggccugcuguucaucuacggcugccugcccgagaccaagggcaagaagcuggaggagaucgagagccuguucgacaacagacugugcaccugcggcaccagcgacagcgacgagggcagauacaucgaguacaucagagugaagggcagcaacuaccaccugagcgacaacgacgccagcgacguggaguaa

SEQ ID NO: 23522 - RNA, 1494 nt, Artificial Sequence
  SLC2A14__Homo_sapiens__NP_001273163
auggacaacagacagaacgugacccccgcccugaucuucgccaucaccguggccaccaucggcagcuuccaguucggcuacaacaccggcgugaucaacgcccccgagaccaucaucaaggaguucaucaacaagacccugaccgacaaggccaacgccccccccagcgaggugcugcugaccaaccuguggagccugagcguggccaucuucagcgugggcggcaugaucggcagcuucagcgugggccuguucgugaacagauucggcagaagaaacagcaugcugaucgugaaccugcuggccgccaccggcggcugccugaugggccugugcaagaucgccgagagcguggagaugcugauccugggcagacuggugaucggccuguucugcggccugugcaccggcuucgugcccauguacaucggcgagaucagccccaccgcccugagaggcgccuucggcacccugaaccagcugggcaucgugaucggcauccugguggcccagaucuucggccuggagcugauccugggcagcgaggagcuguggcccgugcugcugggcuucaccauccugcccgccauccugcagagcgccgcccugcccugcugccccgagagccccagauuccugcugaucaacagaaagaaggaggagaacgccaccagaauccugcagagacuguggggcacccaggacgugagccaggacauccaggagaugaaggacgagagcgccagaaugagccaggagaagcaggugaccgugcuggagcuguucagagugagcagcuacagacagcccaucaucaucagcaucgugcugcagcugagccagcagcugagcggcaucaacgccguguucuacuacagcaccggcaucuucaaggacgccggcgugcagcagcccaucuacgccaccaucagcgccggcguggugaacaccaucuucacccugcugagccuguuccugguggagagagccggcagaagaacccugcacaugaucggccugggcggcauggccuucugcagcacccugaugaccgugagccugcugcugaagaaccacuacaacggcaugagcuucgugugcaucggcgccauccugguguucguggccugcuucgagaucggccccggccccauccccugguucaucguggccgagcuguucagccagggccccagacccgccgccauggccguggccggcugcagcaacuggaccagcaacuuccuggugggccugcuguuccccagcgccgccuacuaccugggcgccuacguguucaucaucuucaccggcuuccugaucaccuuccuggccuucaccuucuucaaggugcccgagaccagaggcagaaccuucgaggacaucaccagagccuucgagggccaggcccacggcgccgacagaagcggcaaggacggcgugaugggcaugaacagcaucgagcccgccaaggagaccaccaccaacguguaa

SEQ ID NO: 23523 - RNA, 1575 nt, Artificial Sequence
  SLC2A2__Homo_sapiens__NP_000331
augaccgaggacaaggugaccggcacccugguguucaccgugaucaccgccgugcugggcagcuuccaguucggcuacgacaucggcgugaucaacgccccccagcaggugaucaucagccacuacagacacgugcugggcgugccccuggacgacagaaaggccaucaacaacuacgugaucaacagcaccgacgagcugcccaccaucagcuacagcaugaaccccaagcccacccccugggccgaggaggagaccguggccgccgcccagcugaucaccaugcuguggagccugagcgugagcagcuucgccgugggcggcaugaccgccagcuucuucggcggcuggcugggcgacacccugggcagaaucaaggccaugcugguggccaacauccugagccuggugggcgcccugcugaugggcuucagcaagcugggccccagccacauccugaucaucgccggcagaagcaucagcggccuguacugcggccugaucagcggccuggugcccauguacaucggcgagaucgcccccaccgcccugagaggcgcccugggcaccuuccaccagcuggccaucgugaccggcauccugaucagccagaucaucggccuggaguucauccugggcaacuacgaccuguggcacauccugcugggccugagcggcgugagagccauccugcagagccugcugcuguucuucugccccgagagccccagauaccuguacaucaagcuggacgaggaggugaaggccaagcagagccugaagagacugagaggcuacgacgacgugaccaaggacaucaacgagaugagaaaggagagagaggaggccagcagcgagcagaaggugagcaucauccagcuguucaccaacagcagcuacagacagcccauccugguggcccugaugcugcacguggcccagcaguucagcggcaucaacggcaucuucuacuacagcaccagcaucuuccagaccgccggcaucagcaagcccguguacgccaccaucggcgugggcgccgugaacaugguguucaccgccgugagcguguuccugguggagaaggccggcagaagaagccuguuccugaucggcaugagcggcauguucgugugcgccaucuucaugagcgugggccuggugcugcugaacaaguucagcuggaugagcuacgugagcaugaucgccaucuuccuguucgugagcuucuucgagaucggccccggccccauccccugguucaugguggccgaguucuucagccagggccccagacccgccgcccuggccaucgccgccuucagcaacuggaccugcaacuucaucguggcccugugcuuccaguacaucgccgacuucugcggccccuacguguucuuccuguucgccggcgugcugcuggccuucacccuguucaccuucuucaaggugcccgagaccaagggcaagagcuucgaggagaucgccgccgaguuccagaagaagagcggcagcgcccacagacccaaggccgccguggagaugaaguuccugggcgccaccgagaccguguaa

SEQ ID NO: 23524 - RNA, 1491 nt, Artificial Sequence
  SLC2A3__Homo_sapiens__NP_008862
augggcacccagaaggugacccccgcccugaucuucgccaucaccguggccaccaucggcagcuuccaguucggcuacaacaccggcgugaucaacgcccccgagaagaucaucaaggaguucaucaacaagacccugaccgacaagggcaacgccccccccagcgaggugcugcugaccagccuguggagccugagcguggccaucuucagcgugggcggcaugaucggcagcuucagcgugggccuguucgugaacagauucggcagaagaaacagcaugcugaucgugaaccugcuggccgugaccggcggcugcuucaugggccugugcaagguggccaagagcguggagaugcugauccugggcagacuggugaucggccuguucugcggccugugcaccggcuucgugcccauguacaucggcgagaucagccccaccgcccugagaggcgccuucggcacccugaaccagcugggcaucguggugggcauccugguggcccagaucuucggccuggaguucauccugggcagcgaggagcuguggccccugcugcugggcuucaccauccugcccgccauccugcagagcgccgcccugcccuucugccccgagagccccagauuccugcugaucaacagaaaggaggaggagaacgccaagcagauccugcagagacuguggggcacccaggacgugagccaggacauccaggagaugaaggacgagagcgccagaaugagccaggagaagcaggugaccgugcuggagcuguucagagugagcagcuacagacagcccaucaucaucagcaucgugcugcagcugagccagcagcugagcggcaucaacgccguguucuacuacagcaccggcaucuucaaggacgccggcgugcaggagcccaucuacgccaccaucggcgccggcguggugaacaccaucuucaccguggugagccuguuccugguggagagagccggcagaagaacccugcacaugaucggccugggcggcauggccuucugcagcacccugaugaccgugagccugcugcugaaggacaacuacaacggcaugagcuucgugugcaucggcgccauccugguguucguggccuucuucgagaucggccccggccccauccccugguucaucguggccgagcuguucagccagggccccagacccgccgccauggccguggccggcugcagcaacuggaccagcaacuuccuggugggccugcuguuccccagcgccgcccacuaccugggcgccuacguguucaucaucuucaccggcuuccugaucaccuuccuggccuucaccuucuucaaggugcccgagaccagaggcagaaccuucgaggacaucaccagagccuucgagggccaggcccacggcgccgacagaagcggcaaggacggcgugauggagaugaacagcaucgagcccgccaaggagaccaccaccaacguguaa

SEQ ID NO: 23525 - RNA, 1164 nt, Artificial Sequence
  SLC2A4RG__Homo_sapiens__NP_064446
auggagagacccccccccagagccgccggcagagaccccagcgcccugagagccgaggcccccuggcugagagccgagggccccggccccagagccgcccccgugaccgugcccacccccccccagggcagcagcgugggcggcggcuucgccggccuggaguucgccagaccccaggagagcgagcccagagccagcgaccugggcgcccccagaaccuggaccggcgccgccgccggccccagaacccccagcgcccacauccccgugcccgcccagagagccacccccggcaaggccagacuggacgaggugauggccgccgccgcccugaccagccugagcaccagcccccugcugcugggcgcccccguggccgccuucagccccgagcccggccuggagcccuggaaggaggcccuggugagaccccccggcagcuacagcagcagcagcaacagcggcgacuggggcugggaccuggccagcgaccagagcagccccagcacccccagccccccccugccccccgaggccgcccacuuccuguucggcgagcccacccugagaaagagaaagagccccgcccaggugauguuccagugccuguggaagagcugcggcaaggugcugagcaccgccagcgccaugcagagacacaucagacuggugcaccugggcagacaggccgagcccgagcagagcgacggcgaggaggacuucuacuacaccgagcuggacgugggcguggacacccugaccgacggccugagcagccugacccccgugagccccaccgccagcaugccccccgccuuccccagacuggagcugcccgagcugcuggagccccccgcccugcccagcccccugagaccccccgcccccccccugccccccccccccgugcugagcaccguggccaacccccagagcugccacagcgacagaguguaccagggcugccugacccccgccagacuggagccccagcccaccgaggugggcgccugcccccccgcccugagcagcagaaucggcgugacccugagaaagcccagaggcgacgccaagaagugcagaaagguguacggcauggagagaagagaccuguggugcaccgccugcagauggaagaaggccugccagagauuccuggacuaa

SEQ ID NO: 23526 - RNA, 1476 nt, Artificial Sequence
  SLC2A5__Homo_sapiens__XP_011540307
augagacugacccuggugcuggcccuggccacccugaucgccgccuucggcagcagcuuccaguacggcuacaacguggccgccgugaacagccccgcccugcugaugcagcaguucuacaacgagaccuacuacggcagaaccggcgaguucauggaggacuucccccugacccugcuguggagcgugaccgugagcauguuccccuucggcggcuucaucggcagccugcuggugggcccccuggugaacaaguucggcagaaagggcgcccugcuguucaacaacaucuucagcaucgugcccgccauccugaugggcugcagcagaguggccaccagcuucgagcugaucaucaucagcagacugcuggugggcaucugcgccggcgugagcagcaacguggugcccauguaccugggcgagcuggcccccaagaaccugagaggcgcccugggcguggugccccagcuguucaucaccgugggcauccugguggcccagaucuucggccugagaaaccugcuggccaacguggacggcuggcccauccugcugggccugaccggcgugcccgccgcccugcagcugcugcugcugcccuucuuccccgagagccccagauaccugcugauccagaagaaggacgaggccgccgccaagaaggcccugcagacccugagaggcugggacagcguggacagagagguggccgagaucagacaggaggacgaggccgagaaggccgccggcuucaucagcgugcugaagcuguucagaaugagaagccugagauggcagcugcugagcaucaucgugcugaugggcggccagcagcugagcggcgugaacgccaucuacuacuacgccgaccagaucuaccugagcgccggcgugcccgaggagcacgugcaguacgugaccgccggcaccggcgccgugaacguggugaugaccuucugcgccguguucgugguggagcugcugggcagaagacugcugcugcugcugggcuucagcaucugccugaucgccugcugcgugcugaccgccgcccuggcccugcaggacaccgugagcuggaugcccuacaucagcaucgugugcgugaucagcuacgugaucggccacgcccugggccccagccccauccccgcccugcugaucaccgagaucuuccugcagagcagcagacccagcgccuucauggugggcggcagcgugcacuggcugagcaacuucaccgugggccugaucuuccccuucauccaggagggccugggccccuacagcuucaucguguucgccgugaucugccugcugaccaccaucuacaucuuccugaucgugcccgagaccaaggccaagaccuucaucgagaucaaccagaucuucaccaagaugaacaaggugagcgagguguaccccgagaaggaggagcugaaggagcugccccccgugaccagcgagcaguaa

SEQ ID NO: 23527 - RNA, 1338 nt, Artificial Sequence
  SLC2A6__Homo_sapiens__NP_001138571
augcaggagccccugcugggcgccgagggccccgacuacgacaccuuccccgagaagcccccccccagccccggcgacagagccagagugggcacccugcagaacaagagaguguuccuggccaccuucgccgccgugcugggcaacuucagcuucggcuacgcccugguguacaccagccccgugauccccgcccuggagagaagccuggaccccgaccugcaccugaccaagagccaggccagcugguucggcagcguguucacccugggcgccgccgccggcggccugagcgccaugauccugaacgaccugcugggcagaaagcugagcaucauguucagcgccgugcccagcgccgccggcuacgcccugauggccggcgcccacggccuguggaugcugcugcugggcagaacccugaccggcuucgccggcggccugaccgccgccugcauccccguguacgugagcgagaucgccccccccggcgugagaggcgcccugggcgccaccccccagcugauggccguguucggcagccugagccuguacgcccugggccugcugcugcccuggagauggcuggccguggccggcgaggcccccgugcugaucaugauccugcugcugagcuucaugcccaacagccccagauuccugcugagcagaggcagagacgaggaggcccugagagcccuggccuggcugagaggcaccgacguggacgugcacugggaguucgagcagauccaggacaacgugagaagacagagcagcagagugagcugggccgaggccagagccccccacgugugcagacccaucaccguggcccugcugaugagacugcugcagcagcugaccggcaucacccccauccugguguaccugcagagcaucuucgacagcaccgccgugcugcugccccccaaggacgacgccgccaucgugggcgccgugagacugcugagcgugcugaucgccgcccugaccauggaccuggccggcagaaaggugcugcuguucgugagcggcuacgccgugggcuggggccccaucaccuggcugcugaugagcgaggugcugccccugagagccagaggcguggccagcggccugugcgugcuggccagcuggcugaccgccuucgugcugaccaagagcuuccugcccguggugagcaccuucggccugcaggugcccuucuucuucuucgccgccaucugccuggugagccugguguucaccggcugcugcgugcccgagaccaagggcagaagccuggagcagaucgagagcuucuucagaaccggcagaagaagcuuccugagauaa

SEQ ID NO: 23528 - RNA, 1236 nt, Artificial Sequence
  SLC2A8__Homo_sapiens__NP_001258640
augacccccgaggaccccgaggagacccagccccugcugggcccccccggcggcagcgcccccagaggcagaagaguguuccuggccgccuucgccgccgcccugggcccccugagcuucggcuucgcccugggcuacagcagccccgccauccccagccugcagagagccgccccccccgcccccagacuggacgacgccgccgccagcugguucggcgccguggugacccugggcgccgccgccggcggcgugcugggcggcuggcugguggacagagccggcagaaagcugagccugcugcugugcagcgugcccuucguggccggcuucgccgugaucaccgccgcccaggacguguggaugcugcugggcggcagacugcugaccggccuggccugcggcguggccagccugguggcccccguguacaucagcgagaucgccuaccccgccgugagaggccugcugggcagcugcgugcagcugauggugguggugggcauccugcuggccuaccuggccggcugggugcuggaguggagauggcuggccgugcugggcugcgugccccccagccugaugcugcugcugaugugcuucaugcccgagacccccagauuccugcugacccagcacagaagacaggaggccauggccgcccugagauuccuguggggcagcgagcagggcugggaggacccccccaucggcgccgagcagagcuuccaccuggcccugcugagacagcccggcaucuacaagcccuucaucaucggcgugagccugauggccuuccagcagcugagcggcgugaacgccgugauguucuacgccgagaccaucuucgaggaggccaaguucaaggacagcagccuggccagcgugguggugggcgugauccaggugcuguucaccgccguggccgcccugaucauggacagagccggcagaagacugcugcuggugcugagcggcguggugaugguguucagcaccagcgccuucggcgccuacuucaagcugacccagggcggccccggcaacagcagccacguggccaucagcgcccccgugagcgcccagcccguggacgccagcgugggccuggccuggcuggccgugggcagcaugugccuguucaucgccggcggcccccaggcccuguggagccugcuggccugccugagauuccugcaccugcagugccccuuccacuucgugcugugccccuaa

SEQ ID NO: 23529 - RNA, 1536 nt, Artificial Sequence
  SLC2A9__Homo_sapiens__NP_001001290
augaagcugagcaagaaggacagaggcgaggacgaggagagcgacagcgccaagaagaagcuggacuggagcugcagccugcugguggccagccuggccggcgccuucggcagcagcuuccuguacggcuacaaccugagcguggugaacgcccccacccccuacaucaaggccuucuacaacgagagcugggagagaagacacggcagacccaucgaccccgacacccugacccugcuguggagcgugaccgugagcaucuucgccaucggcggccuggugggcacccugaucgugaagaugaucggcaaggugcugggcagaaagcacacccugcuggccaacaacggcuucgccaucagcgccgcccugcugauggccugcagccugcaggccggcgccuucgagaugcugaucgugggcagauucaucaugggcaucgacggcggcguggcccugagcgugcugcccauguaccugagcgagaucagccccaaggagaucagaggcagccugggccaggugaccgccaucuucaucugcaucggcguguucaccggccagcugcugggccugcccgagcugcugggcaaggagagcaccuggcccuaccuguucggcgugaucguggugcccgccguggugcagcugcugagccugcccuuccugcccgacagccccagauaccugcugcuggagaagcacaacgaggccagagccgugaaggccuuccagaccuuccugggcaaggccgacgugagccaggagguggaggaggugcuggccgagagcagagugcagagaagcaucagacuggugagcgugcuggagcugcugagagcccccuacgugagauggcagguggugaccgugaucgugaccauggccugcuaccagcugugcggccugaacgccaucugguucuacaccaacagcaucuucggcaaggccggcaucccccccgccaagauccccuacgugacccugagcaccggcggcaucgagacccuggccgccguguucagcggccuggugaucgagcaccugggcagaagaccccugcugaucggcggcuucggccugaugggccuguucuucggcacccugaccaucacccugacccugcaggaccacgcccccugggugcccuaccugagcaucgugggcauccuggccaucaucgccagcuucugcagcggccccggcggcauccccuucauccugaccggcgaguucuuccagcagagccagagacccgccgccuucaucaucgccggcaccgugaacuggcugagcaacuucgccgugggccugcuguuccccuucauccagaagagccuggacaccuacugcuuccugguguucgccaccaucugcaucaccggcgccaucuaccuguacuucgugcugcccgagaccaagaacagaaccuacgccgagaucagccaggccuucagcaagagaaacaaggccuacccccccgaggagaagaucgacagcgccgugaccgacggcaagaucaacggcagacccuaa

SEQ ID NO: 23530 - RNA, 1458 nt, Artificial Sequence
  SLC30A10__Homo_sapiens__NP_061183
augggcagauacagcggcaagaccugcagacugcuguucaugcuggugcugaccguggccuucuucguggccgagcuggugagcggcuaccugggcaacagcaucgcccugcugagcgacagcuucaacaugcugagcgaccugaucagccugugcgugggccugagcgccggcuacaucgccagaagacccaccagaggcuucagcgccaccuacggcuacgccagagccgagguggugggcgcccugagcaacgccguguuccugaccgcccugugcuucaccaucuucguggaggccgugcugagacuggccagacccgagagaaucgacgaccccgagcuggugcugaucgugggcgugcugggccugcuggugaacguggugggccugcugaucuuccaggacugcgccgccugguucgccugcugccugagaggcagaagcagaagacugcagcagagacagcagcuggccgagggcugcgugcccggcgccuucggcggcccccagggcgccgaggaccccagaagagccgccgaccccaccgcccccggcagcgacagcgccgugacccugagaggcaccagcguggagagaaagagagagaagggcgccaccguguucgccaacguggccggcgacagcuucaacacccagaacgagcccgaggacaugaugaagaaggagaagaagagcgaggcccugaacaucagaggcgugcugcugcacgugaugggcgacgcccugggcagcguggugguggugaucaccgccaucaucuucuacgugcugccccugaagagcgaggaccccugcaacuggcagugcuacaucgaccccagccugaccgugcugauggugaucaucauccugagcagcgccuucccccugaucaaggagaccgccgccauccugcugcagauggugcccaagggcgugaacauggaggagcugaugagcaagcugagcgccgugcccggcaucagcagcgugcacgaggugcacaucugggagcuggugagcggcaagaucaucgccacccugcacaucaaguaccccaaggacagaggcuaccaggacgccagcaccaagaucagagagaucuuccaccacgccggcauccacaacgugaccauccaguucgagaacguggaccugaaggagccccuggagcagaaggaccugcugcugcugugcaacagccccugcaucagcaagggcugcgccaagcagcugugcugcccccccggcgcccugccccuggcccacgugaacggcugcgccgagcacaacggcggccccagccuggacaccuacggcagcgacggccugagcagaagagacgccagagagguggccaucgaggugagccuggacagcugccugagcgaccacggccagagccugaacaagacccaggaggaccagugcuacgugaacagaacccacuucuaa

SEQ ID NO: 23531 - RNA, 1524 nt, Artificial Sequence
  SLC30A1__Homo_sapiens__NP_067017
augggcugcuggggcagaaacagaggcagacugcugugcaugcuggcccugaccuucauguucauggugcuggaggugguggugagcagagugaccagcagccuggccaugcugagcgacagcuuccacaugcugagcgacgugcuggcccuggugguggcccugguggccgagagauucgccagaagaacccacgccacccagaagaacaccuucggcuggaucagagccgaggugaugggcgcccuggugaacgccaucuuccugaccggccugugcuucgccauccugcuggaggccaucgagagauucaucgagccccacgagaugcagcagccccugguggugcugggcgugggcguggccggccugcuggugaacgugcugggccugugccuguuccaccaccacagcggcuucagccaggacagcggccacggccacagccacggcggccacggccacggccacggccugcccaagggccccagagugaagagcaccagacccggcagcagcgacaucaacguggcccccggcgagcagggccccgaccaggaggagaccaacacccugguggccaacaccagcaacagcaacggccugaagcuggaccccgccgaccccgagaaccccagaagcggcgacaccguggaggugcaggugaacggcaaccuggugagagagcccgaccacauggagcuggaggaggacagagccggccagcugaacaugagaggcguguuccugcacgugcugggcgacgcccugggcagcgugaucgugguggugaacgcccugguguucuacuucagcuggaagggcugcagcgagggcgacuucugcgugaaccccugcuuccccgaccccugcaaggccuucguggagaucaucaacagcacccacgccagcguguacgaggccggccccugcugggugcuguaccuggaccccacccugugcguggugauggugugcauccugcuguacaccaccuacccccugcugaaggagagcgcccugauccugcugcagaccgugcccaagcagaucgacaucagaaaccugaucaaggagcugagaaacguggagggcguggaggaggugcacgagcugcacguguggcagcuggccggcagcagaaucaucgccaccgcccacaucaagugcgaggaccccaccagcuacauggagguggccaagaccaucaaggacguguuccacaaccacggcauccacgccaccaccauccagcccgaguucgccagcgugggcagcaagagcagcguggugcccugcgagcuggccugcagaacccagugcgcccugaagcagugcugcggcacccugccccaggcccccagcggcaaggacgccgagaagacccccgccgugagcaucagcugccuggagcugagcaacaaccuggagaagaagcccagaagaaccaaggccgagaacauccccgccguggugaucgagaucaagaacaugcccaacaagcagcccgagagcagccuguaa

SEQ ID NO: 23532 - RNA, 1167 nt, Artificial Sequence
  SLC30A3__Homo_sapiens__NP_003450
auggagcccagccccgccgccggcggccuggagaccaccagacuggugagccccagagacagaggcggcgccggcggcagccugagacugaagagccuguucaccgagcccagcgagccccugcccgaggagagcaagcccguggagaugcccuuccaccacugccacagagacccccugcccccccccggccugacccccgagagacugcacgccagaagacagcuguacgccgccugcgccgugugcuucguguucauggccggcgagguggugggcggcuaccuggcccacagccuggccaucaugaccgacgccgcccaccugcuggccgacgugggcagcaugaugggcagccuguucagccuguggcugagcaccagacccgccaccagaaccaugaccuucggcuggcacagaagcgagacccugggcgcccuggccagcguggugagccuguggauggugaccggcauccugcuguaccuggccuucgugagacugcugcacagcgacuaccacaucgagggcggcgccaugcugcugaccgccagcaucgccgugugcgccaaccugcugauggccuucgugcugcaccaggccggccccccccacagccacggcagcagaggcgccgaguacgccccccuggaggagggccccgaggagccccugccccugggcaacaccagcgugagagccgccuucgugcacgugcugggcgaccugcugcagagcuucggcgugcuggccgccagcauccugaucuacuucaagccccaguacaaggccgccgaccccaucagcaccuuccuguucagcaucugcgcccugggcagcaccgcccccacccugagagacgugcugagaauccugauggagggcacccccagaaacgugggcuucgagcccgugagagacacccugcugagcgugcccggcgugagagccacccacgagcugcaccugugggcccugacccugaccuaccacguggccagcgcccaccuggccaucgacagcaccgccgaccccgaggccgugcuggccgaggccagcagcagacuguacagcagauucggcuucagcagcugcacccugcagguggagcaguaccagcccgagauggcccagugccugagaugccaggagcccccccaggccuaa

SEQ ID NO: 23533 - RNA, 1290 nt, Artificial Sequence
  SLC30A4__Homo_sapiens__XP_011520299
auggccggcagcggcgccuggaagagacugaagagcaugcugagaaaggacgacgccccccuguuccugaacgacaccagcgccuucgacuucagcgacgaggccggcgacgagggccugagcagauucaacaagcugagaguggugguggccgacgacggcagcgaggcccccgagagacccgugaacggcgcccaccccacccugcaggccgacgacgacagccugcuggaccaggaccugccccugaccaacagccagcugagccugaagguggacagcugcgacaacugcagcaagcagagagagauccugaagcagagaaaggugaaggccagacugaccaucgccgccgugcuguaccugcuguucaugaucggcgagcuggugggcggcuacaucgccaacagccuggccaucaugaccgacgcccugcacaugcugaccgaccugagcgccaucauccugacccugcuggcccuguggcugagcagcaagagccccaccaagagauucaccuucggcuuccacagacuggaggugcugagcgccaugaucagcgugcugcugguguacauccugaugggcuuccugcuguacgaggccgugcagagaaccauccacaugaacuacgagaucaacggcgacaucaugcugaucaccgccgccgugggcguggccgugaacgugaucaugggcuuccugcugaaccagagcggccacagacacagccacagccacagccugcccagcaacagccccaccagaggcagcggcugcgagagaaaccacggccaggacagccuggccgugagagccgccuucgugcacgcccugggcgaccuggugcagagcgugggcgugcugaucgccgccuacaucaucagauucaagcccgaguacaagaucgccgaccccaucugcaccuacguguucagccugcugguggccuucaccaccuucagaaucaucugggacaccguggugaucauccuggagggcgugcccagccaccugaacguggacuacaucaaggaggcccugaugaagaucgaggacguguacagcguggaggaccugaacaucuggagccugaccagcggcaagagcaccgccaucgugcacauccagcugauccccggcagcagcagcaagugggaggaggugcagagcaaggccaaccaccugcugcugaacaccuucggcauguacagaugcaccauccagcugcagagcuacagacaggagguggacagaaccugcgccaacugccagagcagcagccccuaa

SEQ ID NO: 23534 - RNA, 2298 nt, Artificial Sequence
  SLC30A5__Homo_sapiens__NP_075053
auggaggagaaguacggcggcgacgugcuggccggccccggcggcggcggcggccugggccccguggacgugcccagcgccagacugaccaaguacaucgugcugcugugcuucaccaaguuccugaaggccgugggccuguucgagagcuacgaccugcugaaggccgugcacaucgugcaguucaucuucauccugaagcugggcaccgccuucuucauggugcuguuccagaagcccuucagcagcggcaagaccaucaccaagcaccaguggaucaagaucuucaagcacgccguggccggcugcaucaucagccugcugugguucuucggccugacccugugcggcccccugagaacccugcugcuguucgagcacagcgacaucguggugaucagccugcugagcgugcuguucaccagcagcggcggcggccccgccaagaccagaggcgccgccuucuucaucaucgccgugaucugccugcugcuguucgacaacgacgaccugauggccaagauggccgagcaccccgagggccaccacgacagcgcccugacccacaugcuguacaccgccaucgccuuccugggcguggccgaccacaagggcggcgugcugcugcuggugcuggcccugugcugcaaggugggcuuccacaccgccagcagaaagcugagcguggacgugggcggcgccaagagacugcaggcccugagccaccuggugagcgugcugcugcugugccccugggugaucgugcugagcgugaccaccgagagcaagguggagagcugguucagccugaucaugcccuucgccaccgugaucuucuucgugaugauccuggacuucuacguggacagcaucugcagcgugaagauggaggugagcaagugcgccagauacggcagcuuccccaucuucaucagcgcccugcuguucggcaacuucuggacccaccccaucaccgaccagcugagagccaugaacaaggccgcccaccaggagagcaccgagcacgugcugagcggcggcgugguggugagcgccaucuucuucauccugagcgccaacauccugagcagccccagcaagagaggccagaagggcacccugaucggcuacagccccgagggcaccccccuguacaacuucaugggcgacgccuuccagcacagcagccagagcauccccagauucaucaaggagagccugaagcagauccuggaggagagcgacagcagacagaucuucuacuuccugugccugaaccugcuguucaccuucguggagcuguucuacggcgugcugaccaacagccugggccugaucagcgacggcuuccacaugcuguucgacugcagcgcccuggugaugggccuguucgccgcccugaugagcagauggaaggccaccagaaucuucagcuacggcuacggcagaaucgagauccugagcggcuucaucaacggccuguuccugaucgugaucgccuucuucguguucauggagagcguggccagacugaucgacccccccgagcuggacacccacaugcugacccccgugagcgugggcggccugaucgugaaccugaucggcaucugcgccuucagccacgcccacagccacgcccacggcgccagccagggcagcugccacagcagcgaccacagccacagccaccacaugcacggccacagcgaccacggccacggccacagccacggcagcgccggcggcggcaugaacgccaacaugagaggcguguuccugcacgugcuggccgacacccugggcagcaucggcgugaucgugagcaccgugcugaucgagcaguucggcugguucaucgccgacccccugugcagccuguucaucgccauccugaucuuccugagcguggugccccugaucaaggacgccugccaggugcugcugcugagacugccccccgaguacgagaaggagcugcacaucgcccuggagaagauccagaagaucgagggccugaucagcuacagagacccccacuucuggagacacagcgccagcaucguggccggcaccauccacauccaggugaccagcgacgugcuggagcagagaaucgugcagcaggugaccggcauccugaaggacgccggcgugaacaaccugaccauccagguggagaaggaggccuacuuccagcacaugagcggccugagcaccggcuuccacgacgugcuggccaugaccaagcagauggagagcaugaaguacugcaaggacggcaccuacaucauguaa

SEQ ID NO: 23535 - RNA, 1506 nt, Artificial Sequence
  SLC30A6__Homo_sapiens__NP_001180442
augggcaccauccaccuguucagaaagccccagagaagcuucuucggcaagcugcugagagaguucagacugguggccgccgacagaagaagcuggaagauccugcuguucggcgugaucaaccugaucugcaccggcuuccugcugauguggugcagcagcaccaacagcaucgcccugaccgccuacaccuaccugaccaucuucgaccuguucagagacggcgugagccccuucuggcugggcuggagccagacccccgaccugaaguggagcacccaccugggccugcccaagugcugggacaacagaagagagcugcccugccugagcaacagccugaugaccugccugaucagcuacugggugacccugagaaagcccagccccguguacagcuucggcuucgagagacuggaggugcuggccguguucgccagcaccgugcuggcccagcugggcgcccuguucauccugaaggagagcgccgagagauuccuggagcagcccgagauccacaccggcagacugcuggugggcaccuucguggcccugugcuucaaccuguucaccaugcugagcaucagaaacaagcccuucgccuacgugagcgaggccgccagcaccagcuggcugcaggagcacguggccgaccugagcagaagccugugcggcaucauccccggccugagcagcaucuuccugcccagaaugaaccccuucgugcugaucgaccuggccggcgccuucgcccugugcaucaccuacaugcugaucgagaucaacaacuacuucgccguggacaccgccagcgccaucgccaucgcccugaugaccuucggcaccauguaccccaugagcguguacagcggcaaggugcugcugcagaccacccccccccacgugaucggccagcuggacaagcugaucagagaggugagcacccuggacggcgugcuggaggugagaaacgagcacuucuggacccugggcuucggcagccuggccggcagcgugcacgugagaaucagaagagacgccaacgagcagauggugcuggcccacgugaccaacagacuguacacccuggugagcacccugaccgugcagaucuucaaggacgacuggaucagacccgcccugcugagcggccccguggccgccaacgugcugaacuucagcgaccaccacgugauccccaugccccugcugaagggcaccgacgaccugaaccccgugaccagcacccccgccaagcccagcagccccccccccgaguucagcuucaacacccccggcaagaacgugaaccccgugauccugcugaacacccagaccagacccuacggcuucggccugaaccacggccacacccccuacagcagcaugcugaaccagggccugggcgugcccggcaucggcgccacccagggccugagaaccggcuucaccaacauccccagcagauacggcaccaacaacagaaucggccagcccagacccuaa

SEQ ID NO: 23536 - RNA, 921 nt, Artificial Sequence
  SLC30A7__Homo_sapiens__XP_011539081
auguucuucgacagcaccgccauccuggccggccuggccgccagcgugaucagcaaguggagagacaacgacgccuucagcuacggcuacgugagagccgaggugcuggccggcuucgugaacggccuguuccugaucuucaccgccuucuucaucuucagcgagggcguggagagagcccuggccccccccgacgugcaccacgagagacugcugcuggugagcauccugggcuucguggugaaccugaucggcaucuucguguucaagcacggcggccacggccacagccacggcagcggccacggccacagccacagccuguucaacggcgcccuggaccaggcccacggccacguggaccacugccacagccacgaggugaagcacggcgccgcccacagccacgaccacgcccacggccacggccacuuccacagccacgacggccccagccugaaggagaccaccggccccagcagacagauccugcagggcguguuccugcacauccuggccgacacccugggcagcaucggcgugaucgccagcgccaucaugaugcagaacuucggccugaugaucgccgaccccaucugcagcauccugaucgccauccugaucguggugagcgugaucccccugcugagagagagcgugggcauccugaugcagagaacccccccccugcuggagaacagccugccccagugcuaccagagagugcagcagcugcagggcguguacagccugcaggagcagcacuucuggacccugugcagcgacguguacgugggcacccugaagcugaucguggcccccgacgccgacgccagauggauccugagccagacccacaacaucuucacccaggccggcgugagacagcuguacgugcagaucgacuucgccgccauguaa

SEQ ID NO: 23537 - RNA, 963 nt, Artificial Sequence
  SLC30A8__Homo_sapiens__NP_001166286
auguaccacugccacagcggcagcaagcccaccgagaagggcgccaacgaguacgccuacgccaaguggaagcugugcagcgccagcgccaucugcuucaucuucaugaucgccgagguggugggcggccacaucgccggcagccuggccguggugaccgacgccgcccaccugcugaucgaccugaccagcuuccugcugagccuguucagccuguggcugagcagcaagccccccagcaagagacugaccuucggcuggcacagagccgagauccugggcgcccugcugagcauccugugcaucuggguggugaccggcgugcugguguaccuggccugcgagagacugcuguaccccgacuaccagauccaggccaccgugaugaucaucgugagcagcugcgccguggccgccaacaucgugcugaccguggugcugcaccagagaugccugggccacaaccacaaggaggugcaggccaacgccagcgugagagccgccuucgugcacgcccugggcgaccuguuccagagcaucagcgugcugaucagcgcccugaucaucuacuucaagcccgaguacaagaucgccgaccccaucugcaccuucaucuucagcauccuggugcuggccagcaccaucaccauccugaaggacuucagcauccugcugauggagggcgugcccaagagccugaacuacagcggcgugaaggagcugauccuggccguggacggcgugcugagcgugcacagccugcacaucuggagccugaccaugaaccaggugauccugagcgcccacguggccaccgccgccagcagagacagccagguggugagaagagagaucgccaaggcccugagcaagagcuucaccaugcacagccugaccauccagauggagagccccguggaccaggaccccgacugccuguucugcgaggaccccugcgacuaa

SEQ ID NO: 23538 - RNA, 1707 nt, Artificial Sequence
  SLC30A9__Homo_sapiens__NP_006336
augcugcccggccuggccgccgccgccgcccacagaugcagcuggagcagccugugcagacugagacugagaugcagagccgccgccugcaaccccagcgacagacaggaguggcagaaccuggugaccuucggcagcuucagcaacauggugcccugcagccaccccuacaucggcacccugagccaggugaagcuguacagcaccaacgugcagaaggagggccagggcagccagacccugagaguggagaaggugcccagcuucgagaccgccgagggcaucggcaccgagcugaaggccccccugaagcaggagccccugcaggugagagugaaggccgugcugaagaagagagaguacggcagcaaguacacccagaacaacuucaucaccggcgugagagccaucaacgaguucugccugaagagcagcgaccuggagcagcugagaaagaucagaagaagaagcccccacgaggacaccgagagcuucaccguguaccugagaagcgacguggaggccaagagccuggagguguggggcagccccgaggcccuggccagagagaagaagcugagaaaggaggccgagaucgaguacagagagagacuguucagaaaccagaagauccugagagaguacagagacuuccugggcaacaccaagcccagaagcagaaccgccagcguguucuucaagggccccggcaagguggugaugguggccaucugcaucaacggccugaacugcuucuucaaguuccuggccuggaucuacaccggcagcgccagcauguucagcgaggccauccacagccugagcgacaccugcaaccagggccugcuggcccugggcaucagcaagagcgugcagacccccgaccccagccaccccuacggcuucagcaacaugagauacaucagcagccugaucagcggcgugggcaucuucaugaugggcgccggccugagcugguaccacggcgugaugggccugcugcacccccagcccaucgagagccugcugugggccuacugcauccuggccggcagccuggugagcgagggcgccacccugcugguggccgugaacgagcugagaagaaacgccagagccaagggcaugagcuucuacaaguacgugauggagagcagagaccccagcaccaacgugauccugcuggaggacaccgccgccgugcugggcgugaucaucgccgccaccugcaugggccugaccagcaucaccggcaacccccuguacgacagccugggcagccugggcgugggcacccugcugggcauggugagcgccuuccugaucuacaccaacaccgaggcccugcugggcagaagcauccagcccgagcaggugcagagacugaccgagcugcuggagaacgaccccagcgugagagccauccacgacgugaaggccaccgaccugggccugggcaaggugagauucaaggccgagguggacuucgacggcagaguggugaccagaagcuaccuggagaagcaggacuucgaccagaugcugcaggagauccaggaggugaagacccccgaggagcuggagaccuucaugcugaagcacggcgagaacaucaucgacacccugggcgccgagguggacagacuggagaaggagcugaagaagagaaaccccgaggugagacacguggaccuggagauccuguaa

SEQ ID NO: 23539 - RNA, 573 nt, Artificial Sequence
  SLC31A1__Homo_sapiens__NP_001850
auggaccacagccaccacaugggcaugagcuacauggacagcaacagcaccaugcagcccagccaccaccaccccaccaccagcgccagccacagccacggcggcggcgacagcagcaugaugaugaugcccaugaccuucuacuucggcuucaagaacguggagcugcuguucagcggccuggugaucaacaccgccggcgagauggccggcgccuucguggccguguuccugcuggccauguucuacgagggccugaagaucgccagagagagccugcugagaaagagccaggugagcaucagauacaacagcaugcccgugcccggccccaacggcaccauccugauggagacccacaagaccgugggccagcagaugcugagcuucccccaccugcugcagaccgugcugcacaucauccagguggugaucagcuacuuccugaugcugaucuucaugaccuacaacggcuaccugugcaucgccguggccgccggcgccggcaccggcuacuuccuguucagcuggaagaaggccguggugguggacaucaccgagcacugccacuaa

SEQ ID NO: 23540 - RNA, 432 nt, Artificial Sequence
  SLC31A2__Homo_sapiens__NP_001851
auggccaugcacuucaucuucagcgacaccgccgugcugcuguucgacuucuggagcgugcacagccccgccggcauggcccugagcgugcuggugcugcugcugcuggccgugcuguacgagggcaucaaggugggcaaggccaagcugcugaaccaggugcuggugaaccugcccaccagcaucagccagcagaccaucgccgagaccgacggcgacagcgccggcagcgacagcuuccccgugggcagaacccaccacagaugguaccugugccacuucggccagagccugauccacgugauccagguggugaucggcuacuucaucaugcuggccgugaugagcuacaacaccuggaucuuccugggcguggugcugggcagcgccgugggcuacuaccuggccuacccccugcugagcaccgccuaa

SEQ ID NO: 23541 - RNA, 1578 nt, Artificial Sequence
  SLC32A1__Homo_sapiens__NP_542119
auggccacccugcugagaagcaagcugagcaacguggccaccagcgugagcaacaagagccaggccaagaugagcggcauguucgccagaaugggcuuccaggccgccaccgacgaggaggccgugggcuucgcccacugcgacgaccuggacuucgagcacagacagggccugcagauggacauccugaaggccgagggcgagcccugcggcgacgagggcgccgaggcccccguggagggcgacauccacuaccagagaggcagcggcgccccccugccccccagcggcagcaaggaccaggugggcggcggcggcgaguucggcggccacgacaagcccaagaucaccgccugggaggccggcuggaacgugaccaacgccauccagggcauguucgugcugggccugcccuacgccauccugcacggcggcuaccugggccuguuccugaucaucuucgccgccguggugugcugcuacaccggcaagauccugaucgccugccuguacgaggagaacgaggacggcgagguggugagagugagagacagcuacguggccaucgccaacgccugcugcgcccccagauuccccacccugggcggcagaguggugaacguggcccagaucaucgagcuggugaugaccugcauccuguacgugguggugagcggcaaccugauguacaacagcuuccccggccugcccgugagccagaagagcuggagcaucaucgccaccgccgugcugcugcccugcgccuuccugaagaaccugaaggccgugagcaaguucagccugcugugcacccuggcccacuucgugaucaacauccuggugaucgccuacugccugagcagagccagagacugggccugggagaaggugaaguucuacaucgacgugaagaaguuccccaucagcaucggcaucaucguguucagcuacaccagccagaucuuccugcccagccuggagggcaacaugcagcagcccagcgaguuccacugcaugaugaacuggacccacaucgccgccugcgugcugaagggccuguucgcccugguggccuaccugaccugggccgacgagaccaaggaggugaucaccgacaaccugcccggcagcaucagagccguggugaacaucuuccugguggccaaggcccugcugagcuacccccugcccuucuucgccgccguggaggugcuggagaagagccuguuccaggagggcagcagagccuucuuccccgccugcuacagcggcgacggcagacugaagagcuggggccugacccugagaugcgcccuggugguguucacccugcugauggccaucuacgugccccacuucgcccugcugaugggccugaccggcagccugaccggcgccggccugugcuuccugcugcccagccuguuccaccugagacugcuguggagaaagcugcuguggcaccagguguucuucgacguggccaucuucgugaucggcggcaucugcagcgugagcggcuucgugcacagccuggagggccugaucgaggccuacagaaccaacgccgaggacuaa

SEQ ID NO: 23542 - RNA, 1650 nt, Artificial Sequence
  SLC33A1__Homo_sapiens__NP_001177921
augagccccaccaucagccacaaggacagcagcagacagagaagacccggcaacuucagccacagccuggacaugaagagcggcccccugccccccggcggcugggacgacagccaccuggacagcgccggcagagagggcgacagagaggcccugcugggcgacaccggcaccggcgacuuccugaaggccccccagagcuucagagccgagcugagcagcauccugcugcugcuguuccuguacgugcugcagggcaucccccugggccuggccggcagcaucccccugauccugcagagcaagaacgugagcuacaccgaccaggccuucuucagcuucguguucuggcccuucagccugaagcugcugugggccccccugguggacgccguguacgugaagaacuucggcagaagaaagagcuggcuggugcccacccaguacauccugggccuguucaugaucuaccugagcacccagguggacagacugcugggcaacaccgacgacagaacccccgacgugaucgcccugaccguggccuucuuccuguucgaguuccuggccgccacccaggacaucgccguggacggcugggcccugaccaugcugagcagagagaacgugggcuacgccagcaccugcaacagcgugggccagaccgccggcuacuuccugggcaacgugcuguuccuggcccuggagagcgccgacuucugcaacaaguaccugagauuccagccccagcccagaggcaucgugacccugagcgacuuccuguucuucuggggcaccguguuccugaucaccaccacccugguggcccugcugaagaaggagaacgaggugagcguggugaaggaggagacccagggcaucaccgacaccuacaagcugcuguucgccaucaucaagaugcccgccgugcugaccuucugccugcugauccugaccgccaagaucggcuucagcgccgccgacgccgugaccggccugaagcugguggaggagggcgugcccaaggagcaccuggcccugcuggccgugcccauggugccccugcagaucauccugccccugaucaucagcaaguacaccgccggcccccagccccugaacaccuucuacaaggccaugcccuacagacugcugcugggccuggaguacgcccugcuggugugguggacccccaagguggagcaccagggcggcuuccccaucuacuacuacaucguggugcugcugagcuacgcccugcaccaggugaccguguacagcauguacgugagcaucauggccuucaacgccaaggugagcgacccccugaucggcggcaccuacaugacccugcugaacaccgugagcaaccugggcggcaacuggcccagcaccguggcccuguggcugguggacccccugaccgugaaggagugcgugggcgccagcaaccagaacugcagaacccccgacgccguggagcugugcaagaagcugggcggcagcugcgugaccgcccuggacggcuacuacguggagagcaucaucugcguguucaucggcuucggcuggugguucuuccugggccccaaguucaagaagcugcaggacgagggcagcagcagcuggaagugcaagagaaacaacuaa

SEQ ID NO: 23543 - RNA, 1023 nt, Artificial Sequence
  SLC34A1__Homo_sapiens__NP_001161051
augcugagcuacggcgagagacugggcagccccgccgugagcccccugcccgugagaggcggccacgugaugagaggcaccgccuucgccuacgugcccagcccccaggugcugcacagaauccccggcaccagcgccuacgccuuccccagccugggccccguggcccuggccgagcacaccugccccugcggcgaggugcuggagagacacgagccccugcccgccaagcuggcccuggaggaggagcagaagcccgagagcagacuggugcccaagcugagacaggccggcgccaugcugcugaaggugccccugaugcugaccuuccuguaccuguucgugugcagccuggacaugcugagcagcgccuuccagcuggccggcggcaagguggccggcgacaucuucaaggacaacgccauccugagcaaccccguggccggccugguggugggcauccuggugaccgugcuggugcagagcagcagcaccagcaccagcaucaucgugagcauggugagcagcggccugcuggaggugagcagcgccauccccaucaucaugggcagcaacaucggcaccagcgugaccaacaccaucguggcccugaugcaggccggcgacagaaccgacuucagaagagccuucgccggcgccaccgugcacgacugcuucaacuggcugagcgugcuggugcugcugccccuggaggccgccaccggcuaccugcaccacaucaccagacuggugguggccagcuucaacauccacggcggcagagacgcccccgaccugcugaagaucaucaccgagcccuucaccaagcugaucauccagcuggacgagagcgugaucaccagcaucgccaccggcgacgagagccugagaaaccacagccugauccagaucuggugccaccccgacagccugcagcagaaccuggagggcagagagaucacccacuucgaccugagaaagaagcaggccauggaggacagcagcgugccccacugccccuaa

SEQ ID NO: 23544 - RNA, 2070 nt, Artificial Sequence
  SLC34A2__Homo_sapiens__NP_001171470
auggcccccuggcccgagcugggcgacgcccagcccaaccccgacaaguaccuggagggcgccgccggccagcagcccaccgcccccgacaagagcaaggagaccaacaagaacaacaccgaggcccccgugaccaagaucgagcugcugcccagcuacagcaccgccacccugaucgacgagcccaccgagguggacgaccccuggaaccugcccacccugcaggacagcggcaucaaguggagcgagagagacaccaagggcaagauccugugcuucuuccagggcaucggcagacugauccugcugcugggcuuccuguacuucuucgugugcagccuggacauccugagcagcgccuuccagcuggugggcggcaagauggccggccaguucuucagcaacagcagcaucaugagcaacccccugcugggccuggugaucggcgugcuggugaccgugcuggugcagagcagcagcaccagcaccagcaucguggugagcauggugagcagcagccugcugaccgugagagccgccauccccaucaucaugggcgccaacaucggcaccagcaucaccaacaccaucguggcccugaugcaggugggcgacagaagcgaguucagaagagccuucgccggcgccaccgugcacgacuucuucaacuggcugagcgugcuggugcugcugcccguggagguggccacccacuaccuggagaucaucacccagcugaucguggagagcuuccacuucaagaacggcgaggacgcccccgaccugcugaaggugaucaccaagcccuucaccaagcugaucgugcagcuggacaagaaggugaucagccagaucgccaugaacgacgagaaggccaagaacaagagccuggugaagaucuggugcaagaccuucaccaacaagacccagaucaacgugaccgugcccagcaccgccaacugcaccagccccagccugugcuggaccgacggcauccagaacuggaccaugaagaacgugaccuacaaggagaacaucgccaagugccagcacaucuucgugaacuuccaccugcccgaccuggccgugggcaccauccugcugauccugagccugcuggugcugugcggcugccugaucaugaucgugaagauccugggcagcgugcugaagggccagguggccaccgugaucaagaagaccaucaacaccgacuuccccuuccccuucgccuggcugaccggcuaccuggccauccuggugggcgccggcaugaccuucaucgugcagagcagcagcguguucaccagcgcccugaccccccugaucggcaucggcgugaucaccaucgagagagccuacccccugacccugggcagcaacaucggcaccaccaccaccgccauccuggccgcccuggccagccccggcaacgcccugagaagcagccugcagaucgcccugugccacuucuucuucaacaucagcggcauccugcugugguaccccauccccuucaccagacugcccaucagaauggccaagggccugggcaacaucagcgccaaguacagaugguucgccguguucuaccugaucaucuucuucuuccugaucccccugaccguguucggccugagccuggccggcuggagagugcuggugggcgugggcgugcccgugguguucaucaucauccuggugcugugccugagacugcugcagagcagaugccccagagugcugcccaagaagcugcagaacuggaacuuccugccccuguggaugagaagccugaagcccugggacgccguggugagcaaguucaccggcugcuuccagaugagaugcugcugcugcugcagagugugcugcagagccugcugccugcugugcggcugccccaagugcugcagaugcagcaagugcugcgaggaccuggaggaggcccaggagggccaggacgugcccgugaaggcccccgagaccuucgacaacaucaccaucagcagagaggcccagggcgaggugcccgccagcgacagcaagaccgagugcaccgcccuguaa

SEQ ID NO: 23545 - RNA, 1800 nt, Artificial Sequence
  SLC34A3__Homo_sapiens__NP_001170788
augcccagcagccugcccggcagccaggugccccaccccacccuggacgccguggaccugguggagaagacccugagaaacgagggcaccagcagcagcgcccccgugcuggaggagggcgacaccgaccccuggacccugccccagcugaaggacaccagccagcccuggaaggagcugagaguggccggcagacugagaagaguggccggcagcgugcugaaggccugcggccugcugggcagccuguacuucuucaucugcagccuggacgugcugagcagcgccuuccagcugcugggcagcaagguggccggcgacaucuucaaggacaacguggugcugagcaaccccguggccggccuggugaucggcgugcuggugaccgcccuggugcagagcagcagcaccagcagcagcaucguggugagcaugguggccgccaagcugcugaccgugagagugagcgugcccaucaucaugggcgugaacgugggcaccagcaucaccagcacccuggugagcauggcccagagcggcgacagagacgaguuccagagagccuucagcggcagcgccgugcacggcaucuucaacuggcugaccgugcuggugcugcugccccuggagagcgccaccgcccugcuggagagacugagcgagcuggcccugggcgccgccagccugacccccagagcccaggcccccgacauccugaaggugcugaccaagccccugacccaccugaucgugcagcuggacagcgacaugaucaugagcagcgccaccggcaacgccaccaacagcagccugaucaagcacuggugcggcaccaccggccagcccacccaggagaacagcagcugcggcgccuucggccccugcaccgagaagaacagcaccgcccccgccgacagacugcccugcagacaccuguucgccggcaccgagcugaccgaccuggccgugggcugcauccugcuggccggcagccugcuggugcugugcggcugccuggugcugaucgugaagcugcugaacagcgugcugagaggcagaguggcccagguggugagaaccgugaucaacgccgacuuccccuucccccugggcuggcugggcggcuaccuggccgugcuggccggcgccggccugaccuucgcccugcagagcagcagcguguucaccgccgccguggugccccugaugggcgugggcgugaucagccuggacagagccuacccccugcugcugggcagcaacaucggcaccaccaccaccgcccugcuggccgcccuggccagccccgccgacagaaugcugagcgcccugcagguggcccugauccacuucuucuucaaccuggccggcauccugcugugguaccuggugcccgcccugagacugcccaucccccuggccagacacuucggcguggugaccgccagauacagauggguggccggcguguaccugcugcugggcuuccugcugcugccccuggccgccuucggccugagccuggccggcggcauggugcuggccgccgugggcggcccccuggugggccuggugcugcuggugauccuggugaccgugcugcagagaagaagacccgccuggcugcccgugagacugagaagcugggccuggcugcccguguggcugcacagccuggagcccugggacagacuggugaccagaugcugccccugcaacgugugcagcccccccaaggccaccaccaaggaggccuacugcuacgagaaccccgagauccuggccagccagcagcuguaa

SEQ ID NO: 23546 - RNA, 837 nt, Artificial Sequence
  SLC35A1__Homo_sapiens__NP_001161870
auggccgcccccagagacaacgugacccugcuguucaagcuguacugccuggccgugaugacccugauggccgccguguacaccaucgcccugagauacaccagaaccagcgacaaggagcuguacuucagcaccaccgccgugugcaucaccgaggugaucaagcugcugcugagcgugggcauccuggccaaggagaccggcagccugggcagauucaaggccagccugagagagaacgugcugggcagccccaaggagcugcugaagcugagcgugcccagccugguguacgccgugcagaacaacauggccuuccuggcccugagcaaccuggacgccgccguguaccaggugaccuaccagcugaagauccccugcaccgcccugugcaccgugcugaugcugaacagaacccugagcaagcugcagugggugagcguguucaugcugugcgccggcgugacccuggugcaguggaagcccgcccaggccaccaagguggugguggagcagaacccccugcugggcuucggcgccaucgccaucgccgugcugugcagcggcuucgccgugcuggccagcgugggcggccuguacaccagcgugguggugaaguacaccgacaacaucaugaagggcuucagcgccgccgccgccaucgugcugagcaccaucgccagcgugaugcuguucggccugcagaucacccugaccuucgcccugggcacccugcuggugugcgugagcaucuaccuguacggccugcccagacaggacaccaccagcauccagcagggcgagaccgccagcaaggagagagugaucggcguguaa

SEQ ID NO: 23547 - RNA, 729 nt, Artificial Sequence
  SLC35A2__Homo_sapiens__NP_001027460
auggccgccgugggcgccggcggcagcaccgccgcccccggccccggcgccgugagcgccggcgcccuggagcccggcaccgccagcgccgcccacagaagacugaaguacaucagccuggccgugcugguggugcagaacgccagccugauccugagcaucagauacgccagaacccugcccggcgacagauucuucgccaccaccgccguggugauggccgaggugcugaagggccugaccugccugcugcugcuguucgcccagaagagaggcaacgugaagcaccuggugcuguuccugcacgaggccgugcuggugcaguacguggacacccugaagcuggccgugcccagccugaucuacacccugcagaacaaccugcaguacguggccaucagcaaccugcccgccgccaccuuccagcccagccccagaugcagccagagccacagccugugccugugccugagacugagagcccugagaagccccgccgccagcagagccgccaccaccaccgccgccguguucccccccuggagaccccaccacggcgcccugagcgccaaggugagcgccggcgaggugagagccggcagcaacggcggcacccagggcagaggcaccggcguggagggcgugggccaccugcaggaccccagcagacacccccccggccccggcagcagcggcuucggcagauggagcuuccugcccggccacuaa

SEQ ID NO: 23548 - RNA, 936 nt, Artificial Sequence
  SLC35A3__Homo_sapiens__XP_011539439
augagcagcagaagcgugcugagccccguggugggcaccgacgcccccgaccagcaccuggagcugaagaagccccaggagcugaaggagauggagagacugccccuggccaacgaggacaagaccauguucgccaaccugaaguacgugagccugggcauccugguguuccagaccaccagccuggugcugaccaugagauacagcagaacccugaaggaggagggccccagauaccugagcagcaccgccguggugguggccgagcugcugaagaucauggccugcauccugcugguguacaaggacagcaagugcagccugagagcccugaacagagugcugcacgacgagauccugaacaagcccauggagacccugaagcuggccauccccagcggcaucuacacccugcagaacaaccugcuguacguggcccugagcaaccuggacgccgccaccuaccaggugaccuaccagcugaagauccugaccaccgcccuguucagcgugagcaugcugagcaagaagcugggcguguaccaguggcugagccuggugauccugaugaccggcguggccuucgugcaguggcccagcgacagccagcuggacagcaaggagcugagcgccggcagccaguucgugggccugauggccgugcugaccgccugcuucagcagcggcuucgccggcguguacuucgagaagauccugaaggagaccaagcagagcguguggaucagaaacauccagcugggcuucuucggcagcaucuucggccugaugggcguguacaucuacgacggcgagcuggugagcaagaacggcuucuuccagggcuacaacagacugaccuggaucgugguggugcugcagugccuguuccccuggagccaccccugcaacaacagcuacuucuucguguggcuguaa

SEQ ID NO: 23549 - RNA, 975 nt, Artificial Sequence
  SLC35A4__Homo_sapiens__NP_542401
augagcguggaggacggcggcaugcccggccugggcagacccagacaggccagauggacccugaugcugcugcugagcaccgccauguacggcgcccacgccccccugcuggcccugugccacguggacggcagagugcccuucagacccagcagcgccgugcugcugaccgagcugaccaagcugcugcugugcgccuucagccugcuggugggcuggcaggccuggccccagggccccccccccuggagacaggccgcccccuucgcccugagcgcccugcuguacggcgccaacaacaaccuggugaucuaccugcagagauacauggaccccagcaccuaccaggugcugagcaaccugaagaucggcagcaccgccgugcuguacugccugugccugagacacagacugagcgugagacagggccuggcccugcugcugcugauggccgccggcgccugcuacgccgccggcggccugcaggugcccggcaacacccugcccagccccccccccgccgccgccgccagccccaugccccugcacaucaccccccugggccugcugcugcugauccuguacugccugaucagcggccugagcagcguguacaccgagcugcugaugaagagacagagacugccccuggcccugcagaaccuguuccuguacaccuucggcgugcugcugaaccugggccugcacgccggcggcggcagcggccccggccugcuggagggcuucagcggcugggccgcccugguggugcugagccaggcccugaacggccugcugaugagcgccgugaugaagcacggcagcagcaucaccagacuguucguggugagcugcagccugguggugaacgccgugcugagcgccgugcugcugagacugcagcugaccgccgccuucuuccuggccacccugcugaucggccuggccaugagacuguacuacggcagcagauaa

SEQ ID NO: 23550 - RNA, 1020 nt, Artificial Sequence
  SLC35B2__Homo_sapiens__NP_001273442
augcugcuggccaugcccgcccugugguaccuggccaccagcuggugcagcaccagcggcggcagaaccaccuggagacccgugagcuaccugaccuggggcgugcugcaggagagagugaugaccagaagcuacggcgccaccgccaccagccccggcgagagauucaccgacagccaguuccuggugcugaugaacagagugcuggcccugaucguggccggccugagcugcgugcugugcaagcagcccagacacggcgcccccauguacagauacagcuucgccagccugagcaacgugcugagcagcuggugccaguacgaggcccugaaguucgugagcuuccccacccaggugcuggccaaggccagcaaggugauccccgugaugcugaugggcaagcuggugagcagaagaagcuacgagcacugggaguaccugaccgccacccugaucagcaucggcgugagcauguuccugcugagcagcggccccgagcccagaagcagccccgccaccacccugagcggccugauccugcuggccggcuacaucgccuucgacagcuucaccagcaacuggcaggacgcccuguucgccuacaagaugagcagcgugcagaugauguucggcgugaacuucuucagcugccuguucaccgugggcagccugcuggagcagggcgcccugcuggagggcaccagauucaugggcagacacagcgaguucgccgcccacgcccugcugcugagcaucugcagcgccugcggccagcuguucaucuucuacaccaucggccaguucggcgccgccguguucaccaucaucaugacccugagacaggccuucgccauccugcugagcugccugcuguacggccacaccgugaccguggugggcggccugggcguggccgugguguucgccgcccugcugcugagaguguacgccagaggcagacugaagcagagaggcaagaaggccgugcccguggagagccccgugcagaagguguaa

SEQ ID NO: 23551 - RNA, 996 nt, Artificial Sequence
  SLC35B4__Homo_sapiens__NP_116215
augagacccgcccuggccgugggccugguguucgccggcugcugcagcaacgugaucuuccuggagcugcuggccagaaagcaccccggcugcggcaacaucgugaccuucgcccaguuccuguucaucgccguggagggcuuccuguucgaggccgaccugggcagaaagccccccgccauccccaucagauacuacgccaucauggugaccauguucuucaccgugagcguggugaacaacuacgcccugaaccugaacaucgccaugccccugcacaugaucuucagaagcggcagccugaucgccaacaugauccugggcaucaucauccugaagaagagauacagcaucuucaaguacaccagcaucgcccuggugagcgugggcaucuucaucugcaccuucaugagcgccaagcaggugaccagccagagcagccugagcgagaacgacggcuuccaggccuucgugugguggcugcugggcaucggcgcccugaccuucgcccugcugaugagcgccagaaugggcaucuuccaggagacccuguacaagagauucggcaagcacagcaaggaggcccuguucuacaaccacgcccugccccugcccggcuucguguuccuggccagcgacaucuacgaccacgccgugcuguucaacaagagcgagcuguacgagauccccgugaucggcgugacccugcccaucaugugguucuaccugcugaugaacaucaucacccaguacgugugcaucagaggcguguucauccugaccaccgagugcgccagccugaccgugacccugguggugacccugagaaaguucgugagccugaucuucagcauccuguacuuccagaaccccuucacccuguggcacuggcugggcacccuguucguguucaucggcacccugauguacaccgagguguggaacaaccugggcaccaccaagagcgagccccagaaggacagcaagaagaacuaa

SEQ ID NO: 23552 - RNA, 1056 nt, Artificial Sequence
  SLC35C1__Homo_sapiens__NP_001138738
auggcccugaccggcgccagcgaccccagcgccgaggccgaggccaacggcgagaagcccuuccugcugagagcccugcagaucgcccugguggugagccuguacugggugaccagcaucagcaugguguuccugaacaaguaccugcuggacagccccagccugagacuggacacccccaucuucgugaccuucuaccagugccuggugaccacccugcugugcaagggccugagcgcccuggccgccugcugccccggcgccguggacuuccccagccugagacuggaccugagaguggccagaagcgugcugccccugagcgugguguucaucggcaugaucaccuucaacaaccugugccugaaguacgugggcguggccuucuacaacgugggcagaagccugaccaccguguucaacgugcugcugagcuaccugcugcugaagcagaccaccagcuucuacgcccugcugaccugcggcaucaucaucggcggcuucuggcugggcguggaccaggagggcgccgagggcacccugagcuggcugggcaccguguucggcgugcuggccagccugugcgugagccugaacgccaucuacaccaccaaggugcugcccgccguggacggcagcaucuggagacugaccuucuacaacaacgugaacgccugcauccuguuccugccccugcugcugcugcugggcgagcugcaggcccugagagacuucgcccagcugggcagcgcccacuucuggggcaugaugacccugggcggccuguucggcuucgccaucggcuacgugaccggccugcagaucaaguucaccagcccccugacccacaacgugagcggcaccgccaaggccugcgcccagaccgugcuggccgugcuguacuacgaggagaccaagagcuuccugugguggaccagcaacaugauggugcugggcggcagcagcgccuacaccugggugagaggcugggagaugaagaagacccccgaggagcccagccccaaggacagcgagaagagcgccaugggcguguaa

SEQ ID NO: 23553 - RNA, 1251 nt, Artificial Sequence
  SLC35D3__Homo_sapiens__NP_001008783
augagacagcugugcagaggcagagugcugggcaucagcguggccaucgcccacggcguguucagcggcagccugaacauccugcugaaguuccugaucagcagauaccaguucagcuuccugacccuggugcagugccugaccagcagcaccgccgcccugagccuggagcugcugagaagacugggccugaucgccgugccccccuucggccugagccuggccagaagcuucgccggcguggccgugcugagcacccugcagagcagccugacccuguggagccugagaggccugagccugcccauguacgugguguucaagagaugccugccccuggugaccaugcugaucggcgugcuggugcugaagaacggcgcccccagccccggcgugcuggccgccgugcugaucaccaccugcggcgccgcccuggccggcgccggcgaccugaccggcgaccccaucggcuacgugaccggcgugcuggccgugcuggugcacgccgccuaccuggugcugauccagaaggccagcgccgacaccgagcacggcccccugaccgcccaguacgugaucgccgugagcgccaccccccugcuggugaucugcagcuucgccagcaccgacagcauccacgccuggaccuuccccggcuggaaggaccccgccauggugugcaucuucguggccugcauccugaucggcugcgccaugaacuucaccacccugcacugcaccuacaucaacagcgccgugaccaccagcuucgugggcguggugaagagcaucgccaccaucaccgugggcaugguggccuucagcgacguggagcccaccagccuguucaucgccggcgugguggugaacacccugggcagcaucaucuacugcguggccaaguucauggagaccagaaagcagagcaacuacgaggaccuggaggcccagcccagaggcgaggaggcccagcugagcggcgaccagcugcccuucgugauggaggagcugcccggcgagggcggcaacggcagaagcgagggcggcgaggccgccggcggccccgcccaggagagcagacaggaggugagaggcagccccagaggcgugccccugguggccggcagcagcgaggagggcagcagaagaagccugaaggacgccuaccuggagguguggagacuggugagaggcaccagauacaugaagaaggacuaccugaucgagaacgaggagcugcccagccccuaa

SEQ ID NO: 23554 - RNA, 1227 nt, Artificial Sequence
  SLC35F1__Homo_sapiens__NP_001025029
augaucccccccgagcagccccagcagcagcugcagccccccagccccgccccccccaaccacguggugaccaccaucgagaaccugcccgccgagggcagcggcggcggcggcagccugagcgccagcagcagagccggcgugagacagagaaucagaaaggugcugaacagagagaugcugaucagcguggcccugggccaggugcugagccugcugaucugcggcaucggccugaccagcaaguaccugagcgaggacuuccacgccaacacccccguguuccagagcuuccugaacuacauccugcuguuccugguguacaccaccacccuggccgugagacagggcgaggagaaccugcuggccauccugagaagaagaugguggaaguacaugauccugggccugaucgaccuggaggccaacuaccugguggugaaggccuaccaguacaccacccugaccagcauccagcugcuggacugcuucgugauccccguggugauccugcugagcugguucuuccugcugaucagauacaaggccgugcacuucaucggcaucguggugugcauccugggcaugggcugcauggugggcgccgacgugcuggugggcagacaccagggcgccggcgagaacaagcuggugggcgaccugcuggugcugggcggcgccacccuguacggcaucagcaacgugugggaggaguacaucaucagaacccugagcagaguggaguuccugggcaugaucggccuguucggcgccuucuucagcggcauccagcuggccaucauggagcacaaggagcugcugaaggugcccugggacuggcagaucggccugcuguacgugggcuucagcgccugcauguucggccuguacagcuucaugcccguggugaucaagaagaccagcgccaccagcgugaaccugagccugcugaccgccgaccuguacagccuguucugcggccuguuccuguuccacuacaaguucagcggccuguaccugcugagcuucuucaccauccugaucggccuggugcuguacagcagcaccagcaccuacaucgcccaggaccccagaguguacaagcaguucagaaaccccagcggccccgugguggaccugcccaccaccgcccagguggagcccagcgugaccuacaccagccugggccaggagaccgaggaggagccccacgugagaguggccuaa

SEQ ID NO: 23555 - RNA, 1125 nt, Artificial Sequence
  SLC35F2__Homo_sapiens__NP_059985
auggaggccgacagccccgccggccccggcgcccccgagccccuggccgagggcgccgccgccgaguucagcagccugcugagaagaaucaagggcaagcuguucaccuggaacauccugaagaccaucgcccugggccagaugcugagccugugcaucugcggcaccgccaucaccagccaguaccuggccgagagauacaaggugaacacccccaugcugcagagcuucaucaacuacugccugcuguuccugaucuacaccgugaugcuggccuucagaagcggcagcgacaaccugcuggugauccugaagagaaagugguggaaguacauccugcugggccuggccgacguggaggccaacuacgugaucgugagagccuaccaguacaccacccugaccagcgugcagcugcuggacugcuucggcauccccgugcugauggcccugagcugguucauccugcacgccagauacagagugauccacuucaucgccguggccgugugccugcugggcgugggcaccauggugggcgccgacauccuggccggcagagaggacaacagcggcagcgacgugcugaucggcgacauccuggugcugcugggcgccagccuguacgccaucagcaacgugugcgaggaguacaucgugaagaagcugagcagacaggaguuccugggcauggugggccuguucggcaccaucaucagcggcauccagcugcugaucguggaguacaaggacaucgccagcauccacugggacuggaagaucgcccugcuguucguggccuucgcccugugcauguucugccuguacagcuucaugccccuggugaucaaggugaccagcgccaccagcgugaaccugggcauccugaccgccgaccuguacagccuguucgugggccuguuccuguucggcuacaaguucagcggccuguacauccugagcuucaccgugaucauggugggcuucauccuguacugcagcacccccaccagaaccgccgagcccgccgagagcagcgugccccccgugaccagcaucggcaucgacaaccugggccugaagcuggaggagaaccugcaggagacccacagcgccgugcuguaa

SEQ ID NO: 23556 - RNA, 1266 nt, Artificial Sequence
  SLC35F3__Homo_sapiens__NP_001287774
augaagaagcacagcgccagaguggccccccugagcgccugcaacagccccgugcugacccugaccaagguggagggcgaggagagacccagagacagccccggccccgccgaggcccaggcccccgccggcguggaggccggcggcagagccagcagaagaugcuggaccugcagcagagcccagcugaagaagaucuucuggggcguggccguggugcugugcgugugcagcagcugggccggcagcacccagcuggccaagcugaccuucagaaaguucgacgcccccuucacccugaccugguucgccaccaacuggaacuuccuguucuucccccuguacuacgugggccacgugugcaagagcaccgagaagcagagcgugaagcagagauacagagagugcugcagauucuucggcgacaacggccugacccugaagguguucuucaccaaggccgcccccuucggcgugcuguggacccugaccaacuaccuguaccugcacgccaucaagaagaucaacaccaccgacgugagcgugcuguucugcugcaacaaggccuucguguuccugcugagcuggaucgugcugagagacagauucaugggcgugagaaucguggccgccauccuggccaucgccggcaucgugaugaugaccuacgccgacggcuuccacagccacagcgugaucggcaucgcccuggugguggccagcgccagcaugagcgcccuguacaaggugcuguucaagcugcugcugggcagcgccaaguucggcgaggccgcccuguuccugagcauccugggcguguucaacauccuguucaucaccugcauccccaucauccuguacuucaccaagguggaguacuggagcagcuucgacgacauccccuggggcaaccugugcggcuucagcgugcugcugcugaccuucaacaucgugcugaacuucggcaucgccgugaccuaccccacccugaugagccugggcaucgugcugagcauccccgugaacgccgugaucgaccacuacaccagccagaucguguucaacggcgugagagugaucgccaucaucaucaucggccugggcuuccugcugcugcugcugcccgaggagugggacguguggcugaucaagcugcugaccagacugaaggugagaaagaaggaggagcccgccgagggcgccgccgaccugagcagcggcccccagagcaagaacagaagagccagacccagcuucgccagauaa

SEQ ID NO: 23557 - RNA, 1599 nt, Artificial Sequence
  SLC35F4__Homo_sapiens__XP_011535022
augcuggugcaccugagagacagccuguacccccagcugggcaucaaccagcugagcuacaccagaaagcuggccaccagaugcagcagcguggugaccgccagcuacaccgugcugaagcccgagaagagaaagauccugcugcaguacaaguuccagaaggagaccuuccagcugcccuucaagaccaccuucuggaucaacaacuuccagaucgugaucuucccccugggcagccugugcagcaccagcagaagcagcgugaccagaugcaagcccggcgccaacugccccagcagccacagcggcaucagcagacagcugagcccccugagcgugaccgaggacagcagcgcccccauccuggagcugcagaaccagggcagcagcggcgugugcggccacagaguggagagacagaacagaagcgccgacgacggcacccagacccacagcgagaacagcagccaggagaacagaaucaaggccagaugccugagcugcaccagcauggugcugaagggcaucuggggccugcugaucauccugagcgugagcagcagcugggugggcaccacccagaucgugaagaucaccuacaagaacuucuacugccccuucuucaugaccugguucagcaccaacuggaacaucauguucuuccccguguacuacagcggccaccuggccaccgcccaggagaagcagagccccaugaagaaguucagagagugcagcagaaucuucggcgaggacggccugacccugaagcuguuccugaagagaaccgcccccuucagcauccuguggacccugaccaacuaccuguaccugcuggcccugaagaagcugaccgccaccgacgugagcgcccuguucugcugcaacaaggccuucguguuccugcugagcuggaucgugcugaaggacagauucaugggcgugagaaucguggccgccaucauggccaucaccggcaucgugaugauggccuacgccgacaacuuccacgccgacagcaucaucggcguggccuucgccgugggcagcgccagcaccagcgcccuguacaaggugcuguucaagauguuccugggcagcgccaacuucggcgaggccgcccacuucgugagcacccugggcuucuucaaccugaucuucaucagcuucacccccgugauccuguacuucaccaagguggagcacuggagcagcuucgccgcccugcccuggggcugccugugcggcauggccggccuguggcuggccuucaacauccuggugaacgugggcguggugcugaccuaccccauccugaucagcaucggcaccgugcugagcgugcccggcaacgccgccguggaccugcugaagcaggaggugaucuucaacguggugagacuggccgccaccaucaucaucugcaucggcuuccugcugaugcugcugcccgaggagugggacgagaucacccugagauucaucaacagccugaaggagaagaagagcgaggagcacguggacgacgugaccgaccccagcauccaccugagaggcagaggcagagccaacggcaccgugagcaucccccuggccuaa

SEQ ID NO: 23558 - RNA, 1116 nt, Artificial Sequence
  SLC35F6__Homo_sapiens__NP_060347
auggccuggaccaaguaccagcuguuccuggccggccugaugcuggugaccggcagcaucaacacccugagcgccaagugggccgacaacuucauggccgagggcugcggcggcagcaaggagcacagcuuccagcaccccuuccugcaggccgugggcauguuccugggcgaguucagcugccuggccgccuucuaccugcugagaugcagagccgccggccagagcgacagcagcguggacccccagcagcccuucaacccccugcuguuccugccccccgcccugugcgacaugaccggcaccagccugauguacguggcccugaacaugaccagcgccagcagcuuccagaugcugagaggcgccgugaucaucuucaccggccuguucagcguggccuuccugggcagaagacuggugcugagccaguggcugggcauccuggccaccaucgccggccuggugguggugggccuggccgaccugcugagcaagcacgacagccagcacaagcugagcgaggugaucaccggcgaccugcugaucaucauggcccagaucaucguggccauccagauggugcuggaggagaaguucguguacaagcacaacgugcacccccugagagccgugggcaccgagggccuguucggcuucgugauccugagccugcugcuggugcccauguacuacauccccgccggcagcuucagcggcaaccccagaggcacccuggaggacgcccuggacgccuucugccaggugggccagcagccccugaucgccguggcccugcugggcaacaucagcagcaucgccuucuucaacuucgccggcaucagcgugaccaaggagcugagcgccaccaccagaauggugcuggacagccugagaaccguggugaucugggcccugagccuggcccugggcugggaggccuuccacgcccugcagauccugggcuuccugauccugcugaucggcaccgcccuguacaacggccugcacagaccccugcugggcagacugagcagaggcagaccccuggccgaggagagcgagcaggagagacugcugggcggcaccagaacccccaucaacgacgccagcuaa

SEQ ID NO: 23559 - RNA, 1098 nt, Artificial Sequence
  SLC35G1__Homo_sapiens__NP_001128130
augagaccccaggacagcaccggcguggccgagcugcaggagcccggccugccccugaccgacgacgccccccccggcgccaccgaggagcccgccgccgccgaggccgccggcgcccccgacagaggcagaugcuggcugugccugagcagccccugcugcagcagaaccgagcccgaggccaagaagaaggcccccugccccggccugggccuguucuacacccugcugagcgccuuccuguucagcgugggcagccuguucgugaagaaggugcaggacgugcacgccguggagaucagcgccuucagaugcguguuccagaugcugguggugauccccugccugaucuacagaaagaccggcuucaucggccccaagggccagagaaucuuccugauccugagaggcgugcugggcagcaccgccaugaugcugaucuacuacgccuaccagaccaugagccuggccgacgccaccgugaucaccuucagcagccccguguucaccagcaucuucgccuggaucugccugaaggagaaguacagccccugggacgcccuguucaccguguucaccaucaccggcgugauccugaucgugagaccccccuuccuguucggcagcgacaccagcggcauggaggagagcuacagcggccaccugaagggcaccuucgccgccaucggcagcgccguguucgccgccagcacccuggugauccugagaaagaugggcaagagcguggacuacuuccugagcaucugguacuacguggugcugggccugguggagagcgugaucauccugagcgugcugggcgaguggagccugcccuacugcggccuggacagacuguuccugaucuucaucggccuguucggccugggcggccagaucuucaucaccaaggcccugcagaucgagaaggccggccccguggccaucaugaagaccauggacgugguguucgccuucaucuuccagaucaucuucuucaacaacgugcccaccugguggaccgugggcggcgcccugugcgugguggccagcaacgugggcgccgccaucagaaagugguaccagagcagcaaguaa

SEQ ID NO: 23560 - RNA, 1239 nt, Artificial Sequence
  SLC35G2__Homo_sapiens__NP_001091069
auggacaccagccccagcagaaaguaccccgugaagaagagagugaagauccaccccaacaccgugauggugaaguacaccagccacuacccccagcccggcgacgacggcuacgaggagaucaacgagggcuacggcaacuucauggaggagaaccccaagaagggccugcugagcgagaugaagaagaagggcagagccuucuucggcaccauggacacccugcccccccccaccgaggaccccaugaucaacgagaucggccaguuccagagcuucgccgagaagaacaucuuccagagcagaaagauguggaucgugcuguucggcagcgcccuggcccacggcugcguggcccugaucaccagacuggugagcgacagaagcaaggugcccagccuggagcugaucuucaucagaagcguguuccaggugcugagcgugcugguggugugcuacuaccaggaggcccccuucggccccagcggcuacagacugagacuguucuucuacggcgugugcaacgugaucagcaucaccugcgccuacaccagcuucagcaucgugccccccagcaacggcaccaccauguggagagccaccaccaccguguucagcgccauccuggccuuccugcugguggacgagaagauggccuacguggacauggccaccguggugugcagcauccugggcgugugccuggugaugauccccaacaucguggacgaggacaacagccugcugaacgccuggaaggaggccuucggcuacaccaugaccgugauggccggccugaccaccgcccugagcaugaucguguacagaagcaucaaggagaagaucagcauguggaccgcccuguucaccuucggcuggaccggcaccaucuggggcaucagcaccauguucauccugcaggagcccaucaucccccuggacggcgagaccuggagcuaccugaucgccaucugcgugugcagcaccgccgccuuccugggcguguacuacgcccuggacaaguuccaccccgcccuggugagcaccgugcagcaccuggagaucgugguggccauggugcugcagcugcuggugcugcacaucuuccccagcaucuacgacguguucggcggcgugaucaucaugaucagcguguucgugcuggccggcuacaagcuguacuggagaaaccugagaaagcaggacuaccaggagauccuggacagccccaucaaguaa

SEQ ID NO: 23561 - RNA, 1017 nt, Artificial Sequence
  SLC35G5__Homo_sapiens__NP_473369
auggccggcagccaccccuacuucaaccugcccgacagcacccaccccagcccccccagcgccccccccagccugagauggcaccagagaugccagcccagcggcgccaccaacggccugcugguggcccugcugggcggcggccugcccgccggcuucgugggcccccugagcagaauggccuaccagggcagcaaccugcccagccuggagcugcugaucugcagaugccuguuccaccugcccaucgcccugcugcugaagcugagaggcgacccccugcugggcccccccgacaucagaggcugggccugcuucugcgcccugcugaacgugcugagcaucggcugcgccuacagcgccgugcagguggugcccgccggcaacgccgccaccgugagaaagggcagcagcaccgugugcagcgccgugcugacccugugccuggagagccagggccugggcggcuacgaguggugcggccugcugggcagcauccugggccugaucaucauccugggccccggccuguggacccugcaggagggcaccaccggcguguacaccacccugggcuacgugcaggccuuccugggcggccuggcccugagccugggccugcugguguacagaagccugcacuuccccagcugccugcccaccguggccuuccugagcggccuggugggccugcugggcugcgugcccggccuguucgugcugcagacccccgugcugcccagcgaccugcugagcuggagcugcgugggcgccgagggcauccuggcccuggugagcuucaccugcgugggcuacgccgugaccaaggcccaccccgcccuggugugcgccgugcugcacagcgagguggugguggcccugauccugcaguacuacaugcugcacgagaccguggcccugagcgacaucaugggcgccggcguggugcugggcagcaucgccaucaucaccgccagaaaccugagcugcgagagaaccggcaagguggaggaguaa

SEQ ID NO: 23562 - RNA, 1017 nt, Artificial Sequence
  SLC35G6__Homo_sapiens__NP_001096084
auggccggcagccaccccuaccugaacccccccgacagcacccaccccagcccccccagcgccccccccagccugagauggcaccagugcugccagcccagcgacgccaccaacggccugcugguggcccugcugggcggcggccugcccgccggcuucgugggcccccugagccacauggccuaccaggccagcaaccugcccagccuggagcugcugaucugcagaugccuguuccaccugcccaucgcccugcugcugaagcugagaggcgacccccugcugggcccccccgacaucagaggcagagccuacuucuacgcccugcugaacgugcugagcaucggcugcgccuacagcgccgugcagguggugcccgccggcaacgccgccaccgugagaaagggcagcagcaccgugugcagcgccgugcugacccugugccuggagagccagggccugagcggcuacgacuggugcggccugcugggcagcauccugggccugaucaucaucgugggccccggccuguggacccugcaggagggcaucaccggcguguacaccgcccugggcuacggccaggccuucgugggcggccuggcccugagccugggccugcugguguacagaagccugcacuuccccagcugccugcccaccguggccuuccugagcggccuggugggccugcugggcagcgugcccggccuguucgugcugcagccccccgugcugcccagcgaccugcccagcuggagcugcgugggcgccgugggcauccuggcccuggugagcuucaccugcgugagcuacgccgugaccaaggcccaccccgcccuggugugcgccgugcugcacagcgagguggugguggcccugauccugcaguacuacaugcugcacgagaccguggcccccagcgacaucgugggcgccggcguggugcugggcagcaucgccaucaucaccgccuggaaccugagcugcgagagagagggcaagguggaggaguaa

SEQ ID NO: 23563 - RNA, 1431 nt, Artificial Sequence
  SLC36A1__Homo_sapiens__NP_510968
augagcacccagagacugagaaacgaggacuaccacgacuacagcagcaccgacgugagccccgaggagagccccagcgagggccugaacaaccugagcagccccggcagcuaccagagauucggccagagcaacagcaccaccugguuccagacccugauccaccugcugaagggcaacaucggcaccggccugcugggccugccccuggccgugaagaacgccggcaucgugaugggccccaucagccugcugaucaucggcaucguggccgugcacugcaugggcauccuggugaagugcgcccaccacuucugcagaagacugaacaagagcuucguggacuacggcgacaccgugauguacggccuggagagcagccccugcagcuggcugagaaaccacgcccacuggggcagaagagugguggacuucuuccugaucgugacccagcugggcuucugcugcguguacuucguguuccuggccgacaacuucaagcaggugaucgaggccgccaacggcaccaccaacaacugccacaacaacgagaccgugauccugacccccaccauggacagcagacuguacaugcugagcuuccugcccuuccuggugcugcugguguucaucagaaaccugagagcccugagcaucuucagccugcuggccaacaucaccaugcuggugagccuggugaugaucuaccaguucaucgugcagagaauccccgaccccagccaccugccccugguggcccccuggaagaccuacccccuguucuucggcaccgccaucuucagcuucgagggcaucggcauggugcugccccuggagaacaagaugaaggaccccagaaaguucccccugauccuguaccugggcauggugaucgugaccauccuguacaucagccugggcugccugggcuaccugcaguucggcgccaacauccagggcagcaucacccugaaccugcccaacugcuggcuguaccagagcgugaagcugcuguacagcaucggcaucuucuucaccuacgcccugcaguucuacgugcccgccgagaucaucauccccuucuucgugagcagagcccccgagcacugcgagcuggugguggaccuguucgugagaaccgugcuggugugccugaccugcauccuggccauccugauccccagacuggaccuggugaucagccuggugggcagcgugagcagcagcgcccuggcccugaucauccccccccugcuggaggugaccaccuucuacagcgagggcaugagcccccugaccaucuucaaggacgcccugaucagcauccugggcuucgugggcuucguggugggcaccuacgaggcccuguacgagcugauccagcccagcaacgcccccaucuucaucaacagcaccugcgccuucaucuaa

SEQ ID NO: 23564 - RNA, 1452 nt, Artificial Sequence
  SLC36A2__Homo_sapiens__NP_861441
augagcgugaccaagagcaccgagggcccccagggcgccguggccaucaagcuggaccugaugagcccccccgagagcgccaagaagcuggagaacaaggacagcaccuuccuggacgagagccccagcgagagcgccggccugaagaagaccaagggcaucaccguguuccaggcccugauccaccuggugaagggcaacaugggcaccggcauccugggccugccccuggccgugaagaacgccggcauccugaugggcccccugagccugcuggugaugggcuucaucgccugccacugcaugcacauccuggugaagugcgcccagagauucugcaagagacugaacaagcccuucauggacuacggcgacaccgugaugcacggccuggaggccaaccccaacgccuggcugcagaaccacgcccacuggggcagacacaucgugagcuucuuccugaucaucacccagcugggcuucugcugcguguacaucguguuccuggccgacaaccugaagcaggugguggaggccgugaacagcaccaccaacaacugcuacagcaacgagaccgugauccugacccccaccauggacagcagacuguacaugcugagcuuccugcccuuccuggugcugcuggugcugaucagaaaccugagaauccugaccaucuucagcaugcuggccaacaucagcaugcuggugagccuggugaucaucauccaguacaucacccaggagauccccgaccccagcagacugccccugguggccagcuggaagaccuacccccuguucuucggcaccgccaucuucagcuucgagagcaucggcguggugcugccccuggagaacaagaugaagaacgccagacacuuccccgccauccugagccugggcaugagcaucgugaccagccuguacaucggcauggccgcccugggcuaccugagauucggcgacgacaucaaggccagcaucagccugaaccugcccaacugcuggcuguaccagagcgugaagcugcuguacaucgccggcauccugugcaccuacgcccugcaguucuacgugcccgccgagaucaucauccccuucgccaucagcagagugagcaccagaugggcccugccccuggaccugagcaucagacuggugauggugugccugaccugccugcuggccauccugauccccagacuggaccuggugaucagccuggugggcagcgugagcggcaccgcccuggcccugaucauccccccccugcuggaggugaccaccuucuacagcgagggcaugagcccccugaccaucuucaaggacgcccugaucagcauccugggcuucgugggcuucguggugggcaccuaccaggcccuggacgagcugcugaagagcgaggacagccaccccuucagcaacagcaccaccuucgugagauaa

SEQ ID NO: 23565 - RNA, 1602 nt, Artificial Sequence
  SLC37A1__Homo_sapiens__NP_061837
auggccagacugcccgccggcaucagauucaucaucagcuucagcagagaccagugguacagagccuucaucuucauccugaccuuccugcuguacgccagcuuccaccugagcagaaagcccaucagcaucgugaagggcgagcugcacaaguacugcaccgccugggacgaggccgacgugagauucagcagccagaacagaaagagcggcagcgccgccccccaccagcugcccgacaacgagaccgacugcggcugggcccccuucgacaagaacaacuaccagcagcugcugggcgcccuggacuacagcuuccugugcgccuacgccgugggcauguaccugagcggcaucaucggcgagagacugcccaucagauacuaccugaccuucggcaugcuggccagcggcgccuucaccgcccuguucggccugggcuacuucuacaacauccacagcuucggcuucuacguggugacccaggugaucaacggccuggugcagaccaccggcuggcccagcguggugaccugccugggcaacugguucggcaagggcagaagaggccugaucaugggcguguggaacagccacaccagcgugggcaacauccugggcagccugaucgccggcuacugggugagcaccugcuggggccugagcuucguggugcccggcgccaucguggccgccaugggcaucgugugcuuccuguuccugaucgagcaccccaacgacgugagaugcagcagcacccuggugacccacagcaagggcuacgagaacggcaccaacagacugagacugcagaagcagauccugaagagcgagaagaacaagccccuggaccccgagaugcagugccugcugcugagcgacggcaagggcagcauccaccccaaccacguggugauccugcccggcgacggcggcagcggcaccgccgccaucagcuucaccggcgcccugaagauccccggcgugaucgaguucagccugugccugcuguucgccaagcuggugagcuacaccuuccuguucuggcugccccuguacaucaccaacguggaccaccuggacgccaagaaggccggcgagcugagcacccuguucgacgugggcggcaucuucggcggcauccuggccggcgugaucagcgacagacuggagaagagagccagcaccugcggccugaugcugcugcuggccgcccccacccuguacaucuucagcaccgugagcaagaugggccuggaggccaccaucgccaugcugcugcugagcggcgcccuggugagcggccccuacacccugaucaccaccgccgugagcgccgaccugggcacccacaagagccugaagggcaacgcccacgcccugagcaccgugaccgccaucaucgacggcaccggcagcgugggcgccgcccugggcccccugcuggccggccugcugagccccagcggcuggagcaacguguucuacaugcugauguucgccgacgccugcgcccugcuguuccugaucagacugauccacaaggagcugagcugccccggcagcgccaccggcgaccaggugcccuucaaggagcaguaa

SEQ ID NO: 23566 - RNA, 1506 nt, Artificial Sequence
  SLC37A2__Homo_sapiens__NP_001138762
augagaagcagccuggcccccggcgugugguucuucagagccuucagcagagacagcugguucagaggccugauccugcugcugaccuuccugaucuacgccugcuaccacaugagcagaaagcccaucagcaucgugaagagcagacugcaccagaacugcagcgagcagaucaagcccaucaacgacacccacagccugaacgacaccauguggugcagcugggcccccuucgacaaggacaacuacaaggagcugcugggcggcguggacaacgccuuccugaucgccuacgccaucggcauguucaucagcggcguguucggcgagagacugccccugagauacuaccugagcgccggcaugcugcugagcggccuguucaccagccuguucggccugggcuacuucuggaacauccacgagcugugguacuucguggugauccaggugugcaacggccuggugcagaccaccggcuggcccagcguggugaccugcgugggcaacugguucggcaagggcaagagaggcuucaucaugggcaucuggaacagccacaccagcgugggcaacauccugggcagccugaucgccggcaucugggugaacggccaguggggccugagcuucaucgugcccggcaucaucaccgccgugaugggcgugaucaccuuccuguuccugaucgagcaccccgaggacguggacugcgcccccccccagcaccacggcgagcccgccgagaaccaggacaaccccgaggaccccggcaacagccccugcagcaucagagagagcggccuggagaccguggccaagugcagcaagggccccugcgaggagcccgccgccaucagcuucuucggcgcccugagaauccccggcgugguggaguucagccugugccugcuguucgccaagcuggugagcuacaccuuccuguacuggcugccccuguacaucgccaacguggcccacuucagcgccaaggaggccggcgaccugagcacccuguucgacgugggcggcaucaucggcggcaucguggccggccuggugagcgacuacaccaacggcagagccaccaccugcugcgugaugcugauccuggccgcccccaugauguuccuguacaacuacaucggccaggacggcaucgccagcagcaucgugaugcugaucaucugcggcggccuggugaacggccccuacgcccugaucaccaccgccgugagcgccgaccugggcacccacaagagccugaagggcaacgccaaggcccugagcaccgugaccgccaucaucgacggcaccggcagcaucggcgccgcccugggcccccugcuggccggccugaucagccccaccggcuggaacaacguguucuacaugcugaucagcgccgacgugcuggccugccugcugcugugcagacugguguacaaggagauccuggccuggaaggugagccugagcagaggcagcggcuacaaggagaucuaa

SEQ ID NO: 23567 - RNA, 1290 nt, Artificial Sequence
  SLC37A4__Homo_sapiens__NP_001157749
auggccgcccagggcuacggcuacuacagaaccgugaucuucagcgccauguucggcggcuacagccuguacuacuucaacagaaagaccuucagcuucgugaugcccagccugguggaggagaucccccuggacaaggacgaccugggcuucaucaccagcagccagagcgccgccuacgccaucagcaaguucgugagcggcgugcugagcgaccagaugagcgccagauggcuguucagcagcggccugcugcuggugggccuggugaacaucuucuucgccuggagcagcaccgugcccguguucgccgcccugugguuccugaacggccuggcccagggccugggcuggccccccugcggcaaggugcugagaaagugguucgagcccagccaguucggcaccuggugggccauccugagcaccagcaugaaccuggccggcggccugggccccauccuggccaccauccuggcccagagcuacagcuggagaagcacccuggcccugagcggcgcccugugcgugguggugagcuuccugugccugcugcugauccacaacgagcccgccgacgugggccugagaaaccuggaccccaugcccagcgagggcaagaagggcagccugaaggaggagagcacccugcaggagcugcugcugagccccuaccugugggugcugagcaccggcuaccuggugguguucggcgugaagaccugcugcaccgacuggggccaguucuuccugauccaggagaagggccagagcgcccuggugggcagcagcuacaugagcgcccuggaggugggcggccuggugggcagcaucgccgccggcuaccugagcgacagagccauggccaaggccggccugagcaacuacggcaaccccagacacggccugcugcuguucaugauggccggcaugaccgugagcauguaccuguucagagugaccgugaccagcgacagccccaagcuguggauccuggugcugggcgccguguucggcuucagcagcuacggccccaucgcccuguucggcgugaucgccaacgagagcgccccccccaaccugugcggcaccagccacgccaucgugggccugauggccaacgugggcggcuuccuggccggccugcccuucagcaccaucgccaagcacuacagcuggagcaccgccuucuggguggccgaggugaucugcgccgccagcaccgccgccuucuuccugcugagaaacaucagaaccaagaugggcagagugagcaagaaggccgaguaa

SEQ ID NO: 23568 - RNA, 1464 nt, Artificial Sequence
  SLC38A1__Homo_sapiens__NP_001265316
augaugcacuucaagagcggccuggagcugaccgagcugcagaacaugaccgugcccgaggacgacaacaucagcaacgacagcaacgacuucaccgagguggagaacggccagaucaacagcaaguucaucagcgacagagagagcagaagaagccugaccaacagccaccuggagaagaagaagugcgacgaguacauccccggcaccaccagccugggcaugagcguguucaaccugagcaacgccaucaugggcagcggcauccugggccuggccuucgcccuggccaacaccggcauccugcuguuccuggugcugcugaccagcgugacccugcugagcaucuacagcaucaaccugcugcugaucugcagcaaggagaccggcugcaugguguacgagaagcugggcgagcagguguucggcaccaccggcaaguucgugaucuucggcgccaccagccugcagaacaccggcgccaugcugagcuaccuguucaucgugaagaacgagcugcccagcgccaucaaguuccugaugggcaaggaggagaccuucagcgccugguacguggacggcagagugcugguggugaucgugaccuucggcaucauccugccccugugccugcugaagaaccugggcuaccugggcuacaccagcggcuucagccugagcugcaugguguucuuccugaucguggugaucuacaagaaguuccagauccccugcaucgugcccgagcugaacagcaccaucagcgccaacagcaccaacgccgacaccugcacccccaaguacgugaccuucaacagcaagaccguguacgcccugcccaccaucgccuucgccuucgugugccaccccagcgugcugcccaucuacagcgagcugaaggacagaagccagaagaagaugcagauggugagcaacaucagcuucuucgccauguucgugauguacuuccugaccgccaucuucggcuaccugaccuucuacgacaacgugcagagcgaccugcugcacaaguaccagagcaaggacgacauccugauccugaccgugagacuggccgugaucguggccgugauccugaccgugcccgugcuguucuucaccgugagaagcagccuguucgagcuggccaagaagaccaaguucaaccugugcagacacaccguggugaccugcauccugcugguggugaucaaccugcuggugaucuucauccccagcaugaaggacaucuucggcguggugggcgugaccagcgccaacaugcugaucuucauccugcccagcagccuguaccugaagaucaccgaccaggacggcgacaagggcacccagagaaucugggccgcccuguuccugggccugggcgugcuguucagccuggugagcaucccccuggugaucuacgacugggccugcagcagcagcagcgacgagggccacuaa

SEQ ID NO: 23569 - RNA, 1521 nt, Artificial Sequence
  SLC38A2__Homo_sapiens__NP_061849
augaagaaggccgagaugggcagauucagcaucagccccgacgaggacagcagcagcuacagcagcaacagcgacuucaacuacagcuaccccaccaagcaggccgcccugaagagccacuacgccgacguggaccccgagaaccagaacuuccugcuggagagcaaccugggcaagaagaaguacgagaccgaguuccaccccggcaccaccagcuucggcaugagcguguucaaccugagcaacgccaucgugggcagcggcauccugggccugagcuacgccauggccaacaccggcaucgcccuguucaucauccugcugaccuucgugagcaucuucagccuguacagcgugcaccugcugcugaagaccgccaacgagggcggcagccugcuguacgagcagcugggcuacaaggccuucggccuggugggcaagcuggccgccagcggcagcaucaccaugcagaacaucggcgccaugagcagcuaccuguucaucgugaaguacgagcugccccuggugauccaggcccugaccaacaucgaggacaagaccggccugugguaccugaacggcaacuaccuggugcugcuggugagccugguggugauccugccccugagccuguucagaaaccugggcuaccugggcuacaccagcggccugagccugcugugcaugguguucuuccugaucguggugaucugcaagaaguuccaggugcccugccccguggaggccgcccugaucaucaacgagaccaucaacaccacccugacccagcccaccgcccuggugcccgcccugagccacaacgugaccgagaacgacagcugcagaccccacuacuucaucuucaacagccagaccguguacgccgugcccauccugaucuucagcuucgugugccaccccgccgugcugcccaucuacgaggagcugaaggacagaagcagaagaagaaugaugaacgugagcaagaucagcuucuucgccauguuccugauguaccugcuggccgcccuguucggcuaccugaccuucuacgagcacguggagagcgagcugcugcacaccuacagcagcauccugggcaccgacauccugcugcugaucgugagacuggccgugcugauggccgugacccugaccgugcccguggugaucuuccccaucagaagcagcgugacccaccugcugugcgccagcaaggacuucagcugguggagacacagccugaucaccgugagcauccuggccuucaccaaccugcuggugaucuucgugcccaccaucagagacaucuucggcuucaucggcgccagcgccgccagcaugcugaucuucauccugcccagcgccuucuacaucaagcuggugaagaaggagcccaugaagagcgugcagaagaucggcgcccuguucuuccugcugagcggcgugcuggugaugaccggcagcauggcccugaucgugcuggacugggugcacaacgcccccggcggcggccacuaa

SEQ ID NO: 23570 - RNA, 1644 nt, Artificial Sequence
  SLC38A4__Homo_sapiens__NP_001137296
auggaccccauggagcugagaaacgugaacaucgagcccgacgacgagagcagcagcggcgagagcgcccccgacagcuacaucggcaucggcaacagcgagaaggccgccaugagcagccaguucgccaacgaggacaccgagagccagaaguuccugaccaacggcuuccugggcaagaagaagcuggccgacuacgccgacgagcaccaccccggcaccaccagcuucggcaugagcagcuucaaccugagcaacgccaucaugggcagcggcauccugggccugagcuacgccauggccaacaccggcaucauccuguucaucaucaugcugcuggccguggccauccugagccuguacagcgugcaccugcugcugaagaccgccaaggagggcggcagccugaucuacgagaagcugggcgagaaggccuucggcuggcccggcaagaucggcgccuucgugagcaucaccaugcagaacaucggcgccaugagcagcuaccuguucaucaucaaguacgagcugcccgaggugaucagagccuucaugggccuggaggagaacaccggcgagugguaccugaacggcaacuaccugaucaucuucgugagcgugggcaucauccugccccugagccugcugaagaaccugggcuaccugggcuacaccagcggcuucagccugaccugcaugguguucuucgugagcguggugaucuacaagaaguuccagauccccugcccccugcccgugcuggaccacagcgugggcaaccugagcuucaacaacacccugcccaugcacguggugaugcugcccaacaacagcgagagcagcgacgugaacuucaugauggacuacacccacagaaaccccgccggccuggacgagaaccaggccaagggcagccugcacgacagcggcguggaguacgaggcccacagcgacgacaagugcgagcccaaguacuucguguucaacagcagaaccgccuacgccauccccauccugguguucgccuucgugugccaccccgaggugcugcccaucuacagcgagcugaaggacagaagcagaagaaagaugcagaccgugagcaacaucagcaucaccggcaugcuggugauguaccugcuggccgcccuguucggcuaccugaccuucuacggcgagguggaggacgagcugcugcacgccuacagcaagguguacacccuggacaucccccugcugauggugagacuggccgugcugguggccgugacccugaccgugcccaucgugcuguuccccaucagaaccagcgugaucacccugcuguuccccaagagacccuucagcuggaucagacacuuccugaucgccgccgugcugaucgcccugaacaacgugcuggugauccuggugcccaccaucaaguacaucuucggcuucaucggcgccagcagcgccaccaugcugaucuucauccugcccgccguguucuaccugaagcuggugaagaaggagaccuucagaagcccccagaaggugggcgcccugaucuuccugguggugggcaucuucuucaugaucggcagcauggcccugaucaucaucgacuggaucuacgacccccccaacagcaagcaccacuaa

SEQ ID NO: 23571 - RNA, 1419 nt, Artificial Sequence
  SLC38A5__Homo_sapiens__NP_277053
auggagcugcaggaccccaagaugaacggcgcccugcccagcgacgccgugggcuacagacaggagagagagggcuuccugcccagcagaggccccgcccccggcagcaagcccgugcaguucauggacuucgagggcaagaccagcuucggcaugagcguguucaaccugagcaacgccaucaugggcagcggcauccugggccuggccuacgccauggcccacaccggcgugaucuucuuccuggcccugcugcugugcaucgcccugcugagcagcuacagcauccaccugcugcugaccugcgccggcaucgccggcaucagagccuacgagcagcugggccagagagccuucggccccgccggcaagguggugguggccaccgugaucugccugcacaacgugggcgccaugagcagcuaccuguucaucaucaagagcgagcugccccuggugaucggcaccuuccuguacauggaccccgagggcgacugguuccugaagggcaaccugcugaucaucaucgugagcgugcugaucauccugccccuggcccugaugaagcaccugggcuaccugggcuacaccagcggccugagccugaccugcaugcuguucuuccuggugagcgugaucuacaagaaguuccagcugggcugcgccaucggccacaacgagaccgccauggagagcgaggcccuggugggccugcccagccagggccugaacagcagcugcgaggcccagauguucaccguggacagccagaugagcuacaccgugcccaucauggccuucgccuucgugugccaccccgaggugcugcccaucuacaccgagcugugcagacccagcaagagaagaaugcaggccguggccaacgugagcaucggcgccauguucugcauguacggccugaccgccaccuucggcuaccugaccuucuacagcagcgugaaggccgagaugcugcacauguacagccagaaggacccccugauccugugcgugagacuggccgugcugcuggccgugacccugaccgugcccguggugcuguuccccaucagaagagcccugcagcagcugcuguuccccggcaaggccuucagcuggcccagacacguggccaucgcccugauccugcuggugcuggugaacgugcuggugaucugcgugcccaccaucagagacaucuucggcgugaucggcagcaccagcgcccccagccugaucuucauccugcccagcaucuucuaccugagaaucgugcccagcgagguggagcccuuccugagcuggcccaagauccaggcccugugcuucggcgugcugggcgugcuguucauggccgugagccugggcuucauguucgccaacugggccaccggccagagcagaaugagcggccacuaa

SEQ ID NO: 23572 - RNA, 1566 nt, Artificial Sequence
  SLC38A6__Homo_sapiens__NP_001166173
auggaggccagcuggggcagcuucaacgccgagagaggcugguacgugagcgugcagcagcccgaggaggccgaggccgaggagcugagcccccugcugagcaacgagcugcacagacagagaagccccggcgugagcuucggccugagcguguucaaccugaugaacgccaucaugggcagcggcauccugggccuggccuacgugcuggccaacaccggcguguucggcuucagcuuccugcugcugaccguggcccugcuggccagcuacagcgugcaccugcugcugagcaugugcauccagaccgccgugaccagcuacgaggaccugggccuguucgccuucggccugcccggcaagcuggugguggccggcaccaucaucauccagaacaucggcgccaugagcagcuaccugcugaucaucaagaccgagcugcccgccgccaucgccgaguuccugaccggcgacuacagcagauacugguaccuggacggccagacccugcugaucaucaucugcgugggcaucguguucccccuggcccugcugcccaagaucggcuuccugggcuacaccagcagccugagcuucuucuucaugauguucuucgcccugguggugaucaucaagaaguggagcauccccugcccccugacccugaacuacguggagaagggcuuccagaucagcaacgugaccgacgacugcaagcccaagcuguuccacuucagcaaggagagcgccuacgcccugcccaccauggccuucagcuuccugugccacaccagcauccugcccaucuacugcgagcugcagagccccagcaagaagagaaugcagaacgugaccaacaccgccaucgcccugagcuuccugaucuacuucaucagcgcccuguucggcuaccugaccuucuacgacaagguggagagcgagcugcugaagggcuacagcaaguaccugagccacgacgugguggugaugaccgugaagcugugcauccuguucgccgugcugcugaccgugccccugauccacuuccccgccagaaaggccgugaccaugauguucuucagcaacuuccccuucagcuggaucagacacuuccugaucacccuggcccugaacaucaucaucgugcugcuggccaucuacgugcccgacaucagaaacguguucggcguggugggcgccagcaccagcaccugccugaucuucaucuuccccggccuguucuaccugaagcugagcagagaggacuuccugagcuggaagaagcugggcggccugauccugagccacagacuggccugcagcggcgugaucagcgcccacugcaaccugugccugcccgacagcagcaacccccccaccagcgccagcagaguggccgagaccaccggcagagacaccauggagaugugcacccagagaaagggccacgccagaacccagcaggagggcaacugccugcaggccaagggcagaggccugagaagaaccaagagagugcacacccugauccugcacuuccccaccagcagaaccgugagcaaguaa

SEQ ID NO: 23573 - RNA, 1389 nt, Artificial Sequence
  SLC38A7__Homo_sapiens__NP_060701
auggcccaggugagcaucaacaacgacuacagcgagugggaccugagcaccgacgccggcgagagagccagacugcugcagagccccugcguggacaccgcccccaagagcgagugggaggccagccccggcggccuggacagaggcaccaccagcacccugggcgccaucuucaucguggugaacgccugccugggcgccggccugcugaacuuccccgccgccuucagcaccgccggcggcguggccgccggcaucgcccugcagaugggcaugcugguguucaucaucagcggccuggugauccuggccuacugcagccaggccagcaacgagagaaccuaccaggagguggugugggccgugugcggcaagcugaccggcgugcugugcgagguggccaucgccguguacaccuucggcaccugcaucgccuuccugaucaucaucggcgaccagcaggacaagaucaucgccgugauggccaaggagcccgagggcgccagcggccccugguacaccgacagaaaguucaccaucagccugaccgccuuccuguucauccugccccugagcauccccagagagaucggcuuccagaaguacgccagcuuccugagcguggugggcaccugguacgugaccgccaucgugaucaucaaguacaucuggcccgacaaggagaugacccccggcaacauccugaccagacccgccagcuggauggccguguucaacgccaugcccaccaucugcuucggcuuccagugccacgugagcagcgugcccguguucaacagcaugcagcagcccgaggugaagaccuggggcggcguggugaccgccgccauggugaucgcccuggccguguacaugggcaccggcaucugcggcuuccugaccuucggcgccgccguggaccccgacgugcugcugagcuaccccagcgaggacauggccguggccguggccagagccuucaucauccugagcgugcugaccagcuaccccauccugcacuucugcggcagagccgugguggagggccuguggcugagauaccagggcgugcccguggaggaggacgugggcagagagagaagaagaagagugcugcagacccuggugugguuccugcugacccugcugcuggcccuguucauccccgacaucggcaaggugaucagcgugaucggcggccuggccgccugcuucaucuucguguuccccggccugugccugauccaggccaagcugagcgagauggaggaggugaagcccgccagcuggugggugcuggugagcuacggcgugcugcuggugacccugggcgccuucaucuucggccagaccaccgccaacgccaucuucguggaccugcuggccuaa

SEQ ID NO: 23574 - RNA, 1308 nt, Artificial Sequence
  SLC38A8__Homo_sapiens__NP_001073911
auggagggccagacccccggcagcagaggccugcccgagaagccccaccccgccaccgccgccgccacccugagcagcaugggcgccguguucauccugaugaagagcgcccugggcgccggccugcugaacuuccccugggccuucagcaaggccggcggcguggugcccgccuuccugguggagcuggugagccugguguuccugaucagcggccuggugauccugggcuacgccgccgccgugagcggccaggccaccuaccagggcguggugagaggccugugcggccccgccaucggcaagcugugcgaggccugcuuccugcugaaccugcugaugaucagcguggccuuccugagagugaucggcgaccagcuggagaagcugugcgacagccugcugagcggcaccccccccgccccccagcccugguacgccgaccagagauucacccugccccugcugagcgugcuggugauccugccccugagcgcccccagagagaucgccuuccagaaguacaccagcauccugggcacccuggccgccugcuaccuggcccuggugaucaccgugcaguacuaccuguggccccagggccuggugagagagagccaccccagccugagccccgccagcuggaccagcguguucagcguguuccccaccaucugcuucggcuuccagugccacgaggccgccgugagcaucuacugcagcaugagaaagagaagccugagccacugggcccuggugagcgugcugagccugcuggccugcugccugaucuacagccugaccggcguguacggcuuccugaccuucggcaccgaggugagcgccgacgugcugaugagcuaccccggcaacgacauggugaucaucguggccagagugcuguucgccgugagcaucgugaccguguaccccaucgugcuguuccugggcagaagcgugaugcaggacuucuggagaagaagcugccugggcggcuggggccccagcgcccuggccgaccccagcggccugugggugagaaugccccugaccauccugugggugaccgugacccuggccauggcccuguucaugcccgaccugagcgagaucgugagcaucaucggcggcaucagcagcuucuucaucuucaucuuccccggccugugccugaucugcgccaugggcguggagcccaucggccccagagugaagugcugccuggagguguggggcguggugagcgugcuggugggcaccuucaucuucggccagagcaccgccgccgccgugugggagauguucuaa

SEQ ID NO: 23575 - RNA, 1497 nt, Artificial Sequence
  SLC38A9__Homo_sapiens__NP_001245215
augaacaagagaauccacuacuacagcagacugaccacccccgccgacaaggcccugaucgcccccgaccacguggugcccgcccccgaggagugcuacguguacagcccccugggcagcgccuacaagcugcagagcuacaccgagggcuacggcaagaacaccagccuggugaccaucuucaugaucuggaacaccaugaugggcaccagcauccugagcauccccuggggcaucaagcaggccggcuucaccaccggcaugugcgugaucauccugaugggccugcugacccuguacugcugcuacagaguggugaagagcagaaccaugauguucagccuggacaccaccagcugggaguaccccgacgugugcagacacuacuucggcagcuucggccaguggagcagccugcuguucagccuggugagccugaucggcgccaugaucguguacugggugcugaugagcaacuuccuguucaacaccggcaaguucaucuucaacuucauccaccacaucaacgacaccgacaccauccugagcaccaacaacagcaaccccgugaucugccccagcgccggcagcggcggccaccccgacaacagcagcaugaucuucuacgccaacgacaccggcgcccagcaguucgagaaguggugggacaagagcagaaccgugcccuucuaccuggugggccugcugcugccccugcugaacuucaagagccccagcuucuucagcaaguucaacauccugggcaccgugagcgugcuguaccugaucuuccuggugaccuucaaggccgugagacugggcuuccaccuggaguuccacugguucauccccaccgaguucuucgugcccgagaucagauuccaguucccccagcugaccggcgugcugacccuggccuucuucauccacaacugcaucaucacccugcugaagaacaacaagaagcaggagaacaacgugagagaccugugcaucgccuacaugcuggugacccugaccuaccuguacaucggcgugcugguguucgccagcuuccccagccccccccugagcaaggacugcaucgagcagaacuuccuggacaacuuccccagcagcgacacccugagcuucaucgccagaaucuuccugcuguuccagaugaugaccguguacccccugcugggcuaccuggccagagugcagcugcugggccacaucuucggcgacaucuaccccagcaucuuccacgugcugauccugaaccugaucaucgugggcgccggcgugaucauggccugcuucuaccccaacaucggcggcaucaucagauacagcggcgccgccugcggccuggccuucguguucaucuaccccagccugaucuacaucaucagccugcaccaggaggagagacugaccuggcccaagcugaucuuccacguguucaucaucauccugggcguggccaaccugaucgugcaguucuucauguaa

SEQ ID NO: 23576 - RNA, 2496 nt, Artificial Sequence
  SLC39A10__Homo_sapiens__NP_001120729
augaaggugcacaugcacaccaaguucugccugaucugccugcugaccuucaucuuccaccacugcaaccacugccacgaggagcacgaccacggccccgaggcccugcacagacagcacagaggcaugaccgagcuggagcccagcaaguucagcaagcaggccgccgagaacgagaagaaguacuacaucgagaagcuguucgagagauacggcgagaacggcagacugagcuucuucggccuggagaagcugcugaccaaccugggccugggcgagagaaaggugguggagaucaaccacgaggaccugggccacgaccacgugagccaccuggacauccuggccgugcaggagggcaagcacuuccacagccacaaccaccagcacagccacaaccaccugaacagcgagaaccagaccgugaccagcgugagcaccaagagaaaccacaagugcgaccccgagaaggagaccguggaggugagcgugaagagcgacgacaagcacaugcacgaccacaaccacagacugagacaccaccacagacugcaccaccaccuggaccacaacaacacccaccacuuccacaacgacagcaucacccccagcgagagaggcgagcccagcaacgagcccagcaccgagaccaacaagacccaggagcagagcgacgugaagcugcccaagggcaagagaaagaagaagggcagaaagagcaacgagaacagcgaggugaucacccccggcuucccccccaaccacgaccagggcgagcaguacgagcacaacagagugcacaagcccgacagagugcacaaccccggccacagccacgugcaccugcccgagagaaacggccacgaccccggcagaggccaccaggaccuggaccccgacaacgagggcgagcugagacacaccagaaagagagaggccccccacgugaagaacaacgccaucaucagccugagaaaggaccugaacgaggacgaccaccaccacgagugccugaacgugacccagcugcugaaguacuacggccacggcgccaacagccccaucagcaccgaccuguucaccuaccugugccccgcccugcuguaccagaucgacagcagacugugcaucgagcacuucgacaagcugcugguggaggacaucaacaaggacaagaaccuggugcccgaggacgaggccaacaucggcgccagcgccuggaucugcggcaucaucagcaucaccgugaucagccugcugagccugcugggcgugauccuggugcccaucaucaaccagggcugcuucaaguuccugcugaccuuccugguggcccuggccgugggcaccaugagcggcgacgcccugcugcaccugcugccccacagccagggcggccacgaccacagccaccagcacgcccacggccacggccacagccacggccacgagagcaacaaguuccuggaggaguacgacgccgugcugaagggccugguggcccugggcggcaucuaccugcuguucaucaucgagcacugcaucagaauguucaagcacuacaagcagcagagaggcaagcagaagugguucaugaagcagaacaccgaggagagcaccaucggcagaaagcugagcgaccacaagcugaacaacacccccgacagcgacuggcugcagcugaagccccuggccggcaccgacgacagcguggugagcgaggacagacugaacgagaccgagcugaccgaccuggagggccagcaggagagcccccccaagaacuaccugugcaucgaggaggagaagaucaucgaccacagccacagcgacggccugcacaccauccacgagcacgaccugcacgccgccgcccacaaccaccacggcgagaacaagaccgugcugagaaagcacaaccaccaguggcaccacaagcacagccaccacagccacggccccugccacagcggcagcgaccugaaggagaccggcaucgccaacaucgccuggauggugaucaugggcgacggcauccacaacuucagcgacggccuggccaucggcgccgccuucagcgccggccugaccggcggcaucagcaccagcaucgccguguucugccacgagcugccccacgagcugggcgacuucgccgugcugcugaaggccggcaugaccgugaagcaggccaucguguacaaccugcugagcgccaugauggccuacaucggcaugcugaucggcaccgccgugggccaguacgccaacaacaucacccuguggaucuucgccgugaccgccggcauguuccuguacguggcccugguggacaugcugcccgagaugcugcacggcgacggcgacaacgaggagcacggcuucugccccgugggccaguucauccugcagaaccugggccugcuguucggcuucgccaucaugcuggugaucgcccuguacgaggacaagaucguguucgacauccaguucuaa

SEQ ID NO: 23577 - RNA, 1029 nt, Artificial Sequence
  SLC39A11__Homo_sapiens__NP_001153242
augcugcagggccacagcagcguguuccaggcccugcugggcaccuucuucaccuggggcaugaccgccgccggcgccgcccugguguucguguucagcagcggccagagaagaauccuggacggcagccugggcuucgccgccggcgugaugcuggccgccagcuacuggagccugcuggcccccgccguggagauggccaccagcagcggcggcuucggcgccuucgccuucuuccccguggccgugggcuucacccugggcgccgccuucguguaccuggccgaccugcugaugccccaccugggcgccgccgaggacccccagaccacccuggcccugaacuucggcagcacccugaugaagaagaagagcgaccccgagggccccgcccugcuguuccccgagagcgagcugagcaucagaaucggcagagccggccugcugagcgacaagagcgagaacggcgaggccuaccagagaaagaaggccgccgccaccggccugcccgagggccccgccgugcccgugcccagcagaggcaaccuggcccagcccggcggcagcagcuggagaagaaucgcccugcugauccuggccaucaccauccacaacgugcccgagggccuggccgugggcgugggcuucggcgccaucgagaagaccgccagcgccaccuucgagagcgccagaaaccuggccaucggcaucggcauccagaacuuccccgagggccuggccgugagccugccccugagaggcgccggcuucagcaccuggagagccuucugguacggccagcugagcggcaugguggagccccuggccggcguguucggcgccuucgccguggugcuggccgagcccauccugcccuacgcccuggccuucgccgccggcgccaugguguacguggugauggacgacaucauccccgaggcccagaucagcggcaacggcaagcuggccagcugggccagcauccugggcuucguggugaugaugagccuggacgugggccugggcuaa

SEQ ID NO: 23578 - RNA, 2076 nt, Artificial Sequence
  SLC39A12__Homo_sapiens__NP_001138667
augugcuucagaaccaagcugagcgugagcugggugccccuguuccugcugcugagcagaguguucagcaccgagaccgacaagcccagcgcccaggacagcagaagcagaggcagcagcggccagcccgccgaccugcugcaggugcugagcgccggcgaccaccccccccacaaccacagcagaagccugaucaagacccugcuggagaagaccggcugccccagaagaagaaacggcaugcagggcgacugcaaccugugcuucgagcccgacgcccugcugcugaucgccggcggcaacuucgaggaccagcugagagaggagguggugcagagagugagccugcugcugcuguacuacaucauccaccaggaggagaucugcagcagcaagcugaacaugagcaacaaggaguacaaguucuaccugcacagccugcugagccugagacaggacgaggacagcagcuuccugagccagaacgagaccgaggacauccuggccuucaccagacaguacuucgacaccagccagagccagugcauggagaccaagacccugcagaagaagagcggcaucgugagcagcgagggcgccaacgagagcacccugccccagcuggccgccaugaucaucacccugagccugcagggcgugugccugggccagggcaaccugcccagccccgacuacuucaccgaguacaucuucagcagccugaacagaaccaacacccugagacugagcgagcuggaccagcugcugaacacccuguggaccagaagcaccugcaucaagaacgagaagauccaccaguuccagagaaagcagaacaacaucaucacccacgaccaggacuacagcaacuucagcagcagcauggagaaggagagcgaggacggccccgugagcugggaccagaccugcuucagcgccagacagcugguggagaucuuccugcagaagggccugagccugaucagcaaggaggacuucaagcagaugagccccggcaucauccagcagcugcugagcugcagcugccaccugcccaaggaccagcaggccaagcugccccccaccacccuggagaaguacggcuacagcaccguggccgugacccugcugacccugggcagcaugcugggcaccgcccuggugcuguuccacagcugcgaggagaacuacagacugauccugcagcuguucgugggccuggccgugggcacccugagcggcgacgcccugcugcaccugaucccccaggugcugggccugcacaagcaggaggcccccgaguucggccacuuccacgagagcaagggccacaucuggaagcugaugggccugaucggcggcauccacggcuucuuccugaucgagaagugcuucauccugcuggugagccccaacgacaagcagggccugagccuggugaacggccacgugggccacagccaccaccuggcccugaacagcgagcugagcgaccaggccggcagaggcaagagcgccagcaccauccagcugaagagccccgaggacagccaggccgccgagaugcccaucggcagcaugaccgccagcaacagaaagugcaaggccaucagccugcuggccaucaugauccuggugggcgacagccugcacaacuucgccgacggccuggccaucggcgccgccuucagcagcagcagcgagagcggcgugaccaccaccaucgccauccugugccacgagaucccccacgagaugggcgacuucgccgugcugcugagcagcggccugagcaugaagaccgccauccugaugaacuucaucagcagccugaccgccuucaugggccuguacaucggccugagcgugagcgccgaccccugcgugcaggacuggaucuucaccgugaccgccggcauguuccuguaccugagccugguggagaugcugcccgagaugacccacgugcagacccagagacccuggaugauguuccugcugcagaacuucggccugauccugggcuggcugagccugcugcugcuggccaucuacgagcagaacaucaagaucuaa

SEQ ID NO: 23579 - RNA, 1116 nt, Artificial Sequence
  SLC39A13__Homo_sapiens__NP_001121697
augcccggcugccccugccccggcugcggcauggccggccccagacugcuguuccugaccgcccuggcccuggagcugcugggcagagccggcggcagccagcccgcccugagaagcagaggcaccgccaccgccugcagacuggacaacaaggagagcgagagcuggggcgcccugcugagcggcgagagacuggacaccuggaucugcagccugcugggcagccugauggugggccugagcggcguguucccccugcuggugaucccccuggagaugggcaccaugcugagaagcgaggccggcgccuggagacugaagcagcugcugagcuucgcccugggcggccugcugggcaacguguuccugcaccugcugcccgaggccugggccuacaccugcagcgccagccccggcggcgagggccagagccugcagcagcagcagcagcugggccugugggugaucgccggcauccugaccuuccuggcccuggagaagauguuccuggacagcaaggaggagggcaccagccaggcccccaacaaggaccccaccgccgccgccgccgcccugaacggcggccacugccuggcccagcccgccgccgagcccggccugggcgccguggugagaagcaucaaggugagcggcuaccugaaccugcuggccaacaccaucgacaacuucacccacggccuggccguggccgccagcuuccuggugagcaagaagaucggccugcugaccaccauggccauccugcugcacgagaucccccacgaggugggcgacuucgccauccugcugagagccggcuucgacagauggagcgccgccaagcugcagcugagcaccgcccugggcggccugcugggcgccggcuucgccaucugcacccagagccccaagggcguggugggcugcagccccgccgccgaggagaccgccgccugggugcugcccuucaccagcggcggcuuccuguacaucgcccuggugaacgugcugcccgaccugcuggaggaggaggaccccuggagaagccugcagcagcugcugcugcugugcgccggcaucguggugauggugcuguucagccuguucguggacuaa

SEQ ID NO: 23580 - RNA, 1479 nt, Artificial Sequence
  SLC39A14__Homo_sapiens__NP_001121903
augaagcugcugcugcugcaccccgccuuccagagcugccugcugcugacccugcugggccuguggagaaccacccccgaggcccacgccagcagccugggcgcccccgccaucagcgccgccagcuuccugcaggaccugauccacagauacggcgagggcgacagccugacccugcagcagcugaaggcccugcugaaccaccuggacgugggcgugggcagaggcaacgugacccagcacgugcagggccacagaaaccugagcaccugcuucagcagcggcgaccuguucaccgcccacaacuucagcgagcagagcagaaucggcagcagcgagcugcaggaguucugccccaccauccugcagcagcuggacagcagagccugcaccagcgagaaccaggagaacgaggagaacgagcagaccgaggagggcagacccagcgccguggagguguggggcuacggccugcugugcgugaccgugaucagccugugcagccugcugggcgccagcguggugcccuucaugaagaagaccuucuacaagagacugcugcuguacuucaucgcccuggccaucggcacccuguacagcaacgcccuguuccagcugauccccgaggccuucggcuucaacccccuggaggacuacuacgugagcaagagcgccgugguguucggcggcuucuaccuguucuucuucaccgagaagauccugaagauccugcugaagcagaagaacgagcaccaccacggccacagccacuacgccagcgagagccugcccagcaagaaggaccaggaggagggcgugauggagaagcugcagaacggcgaccuggaccacaugaucccccagcacugcagcagcgagcuggacggcaaggcccccaugguggacgagaaggugaucgugggcagccugagcgugcaggaccugcaggccagccagagcgccugcuacuggcugaagggcgugagauacagcgacaucggcacccuggccuggaugaucacccugagcgacggccugcacaacuucaucgacggccuggccaucggcgccagcuucaccgugagcguguuccagggcaucagcaccagcguggccauccugugcgaggaguucccccacgagcugggcgacuucgugauccugcugaacgccggcaugagcauccagcaggcccuguucuucaacuuccugagcgccugcugcugcuaccugggccuggccuucggcauccuggccggcagccacuucagcgccaacuggaucuucgcccuggccggcggcauguuccuguacaucagccuggccgacauguuccccgagaugaacgaggugugccaggaggacgagagaaagggcagcauccugauccccuucaucauccagaaccugggccugcugaccggcuucaccaucaugguggugcugaccauguacagcggccagauccagaucggcuaa

SEQ ID NO: 23581 - RNA, 975 nt, Artificial Sequence
  SLC39A1__Homo_sapiens__NP_001258888
augggccccuggggcgagcccgagcugcugguguggagacccgaggccguggccagcgagccccccgugcccgugggccuggaggugaagcugggcgcccuggugcugcugcuggugcugacccugcugugcagccuggugcccaucugcgugcugagaagacccggcgccaaccacgagggcagcgccagcagacagaaggcccugagccuggugagcugcuucgccggcggcguguuccuggccaccugccugcuggaccugcugcccgacuaccuggccgccaucgacgaggcccuggccgcccugcacgugacccugcaguucccccugcaggaguucauccuggccaugggcuucuuccuggugcuggugauggagcagaucacccuggccuacaaggagcagagcggccccagcccccuggaggagaccagagcccugcugggcaccgugaacggcggcccccagcacuggcacgacggccccggcgugccccaggccagcggcgcccccgccacccccagcgcccugagagccugcgugcugguguucagccuggcccugcacagcguguucgagggccuggccgugggccugcagagagacagagccagagccauggagcugugccuggcccugcugcugcacaagggcauccuggccgugagccugagccugagacugcugcagagccaccugagagcccaggugguggccggcugcggcauccuguucagcugcaugaccccccugggcaucggccugggcgccgcccuggccgagagcgccggcccccugcaccagcuggcccagagcgugcuggagggcauggccgccggcaccuuccuguacaucaccuuccuggagauccugccccaggagcuggccagcagcgagcagagaauccugaaggugauccugcugcuggccggcuucgcccugcugaccggccugcuguucauccagaucuaa

SEQ ID NO: 23582 - RNA, 930 nt, Artificial Sequence
  SLC39A2__Homo_sapiens__NP_055394
auggagcagcugcugggcaucaagcugggcugccuguucgcccugcuggcccugacccugggcugcggccugacccccaucugcuucaagugguuccagaucgacgccgccagaggccaccacagacuggugcugagacugcugggcugcaucagcgccggcguguuccugggcgccggcuucaugcacaugaccgccgaggcccuggaggagaucgagagccagauccagaaguucauggugcagaacagaagcgccagcgagagaaacagcagcggcgacgccgacagcgcccacauggaguaccccuacggcgagcugaucaucagccugggcuucuucuucguguucuuccuggagagccuggcccugcagugcugccccggcgccgccggcggcagcaccgugcaggacgaggaguggggcggcgcccacaucuucgagcugcacagccacggccaccugcccagccccagcaagggcccccugagagcccuggugcugcugcugagccugagcuuccacagcguguucgagggccuggccgugggccugcagcccaccguggccgccaccgugcagcugugccuggccgugcuggcccacaagggccuggugguguucggcgugggcaugagacuggugcaccugggcaccagcagcagaugggccguguucagcauccugcugcuggcccugaugagcccccugggccuggccgugggccuggccgugaccggcggcgacagcgagggcggcagaggccuggcccaggccgugcuggagggcguggccgccggcaccuuccuguacgugaccuuccuggagauccugcccagagagcuggccagccccgaggccccccuggccaaguggagcugcguggccgccggcuucgccuucauggccuucaucgcccugugggccuaa

SEQ ID NO: 23583 - RNA, 945 nt, Artificial Sequence
  SLC39A3__Homo_sapiens__NP_653165
auggugaagcugcugguggccaagauccugugcauggugggcguguucuucuucaugcugcugggcagccugcugcccgugaagaucaucgagaccgacuucgagaaggcccacagaagcaagaagauccugagccugugcaacaccuucggcggcggcguguuccuggccaccugcuucaacgcccugcugcccgccgugagagagaagcugcagaaggugcugagccugggccacaucagcaccgacuacccccuggccgagaccauccugcugcugggcuucuucaugaccguguuccuggagcagcugauccugaccuucagaaaggagaagcccagcuucaucgaccuggagaccuucaacgccggcagcgacgugggcagcgacagcgaguacgagagccccuucaugggcggcgccagaggccacgcccuguacguggagccccacggccacggccccagccugagcgugcagggccugagcagagccagccccgugagacugcugagccuggccuucgcccugagcgcccacagcguguucgagggccuggcccugggccugcaggaggagggcgagaagguggugagccuguucgugggcguggccgugcacgagacccugguggccguggcccugggcaucagcauggccagaagcgccaugccccugagagacgccgccaagcuggccgugaccgugagcgccaugaucccccugggcaucggccugggccugggcaucgagagcgcccagggcgugcccggcagcguggccagcgugcugcugcagggccuggccggcggcaccuuccuguucaucaccuuccuggagauccuggccaaggagcuggaggagaagagcgacagacugcugaaggugcuguuccuggugcugggcuacaccgugcuggccggcaugguguuccugaagugguaa

SEQ ID NO: 23584 - RNA, 1869 nt, Artificial Sequence
  SLC39A4__Homo_sapiens__NP_060237
augguggacguggugggccuggagagagagaccggccccagaggcagccccuggcccggccugccccugcccagccuggugggccccgccccccugcugaccugccugugcccccagugccugagcguggaggacgcccugggccugggcgagcccgagggcagcggccugccccccggccccgugcuggaggccagauacguggccagacugagcgccgccgccgugcuguaccugagcaaccccgagggcaccugcgaggacgccagagccggccugugggccagccacgccgaccaccugcuggcccugcuggagagccccaaggcccugacccccggccugagcuggcugcugcagagaaugcaggccagagccgccggccagacccccaagaccgccugcguggacaucccccagcugcuggaggaggccgugggcgccggcgcccccggcagcgccggcggcgugcuggccgcccugcuggaccacgugagaagcggcagcugcuuccacgcccugcccagcccccaguacuucguggacuucguguuccagcagcacagcagcgaggugcccaugacccuggccgagcugagcgcccugaugcagagacugggcgugggcagagaggcccacagcgaccacagccacagacacagaggcgccagcagcagagaccccgugccccugaucagcagcagcaacagcagcagcgugugggacaccgugugccugagcgccagagacgugauggccgccuacggccugagcgagcaggccggcgugacccccgaggccugggcccagcugagccccgcccugcugcagcagcagcugagcggcgccugcaccagccagagcagaccccccgugcaggaccagcugagccagagcgagagauaccuguacggcagccuggccacccugcugaucugccugugcgccguguucggccugcugcugcugaccugcaccggcugcagaggcgugacccacuacauccugcagaccuuccugagccuggccgugggcgcccugaccggcgacgccgugcugcaccugacccccaaggugcugggccugcacacccacagcgaggagggccugagcccccagcccaccuggagacugcuggccaugcuggccggccuguacgccuucuuccuguucgagaaccuguucaaccugcugcugcccagagaccccgaggaccuggaggacggccccugcggccacagcagccacagccacggcggccacagccacggcgugagccugcagcuggcccccagcgagcugagacagcccaagcccccccacgagggcagcagagccgaccugguggccgaggagagccccgagcugcugaaccccgagcccagaagacugagccccgagcugagacugcugcccuacaugaucacccugggcgacgccgugcacaacuucgccgacggccuggccgugggcgccgccuucgccagcagcuggaagaccggccuggccaccagccuggccguguucugccacgagcugccccacgagcugggcgacuucgccgcccugcugcacgccggccugagcgugagacaggcccugcugcugaaccuggccagcgcccugaccgccuucgccggccuguacguggcccuggccgugggcgugagcgaggagagcgaggccuggauccuggccguggccaccggccuguuccuguacguggcccugugcgacaugcugcccgccaugcugaaggugagagaccccagacccuggcugcuguuccugcugcacaacgugggccugcugggcggcuggaccgugcugcugcugcugagccuguacgaggacgacaucaccuucuaa

SEQ ID NO: 23585 - RNA, 1302 nt, Artificial Sequence
  SLC39A6__Homo_sapiens__NP_001092876
augggcauccaggugccccugaacgccaccgaguucaacuaccugugccccgccaucaucaaccagaucgacgccagaagcugccugauccacaccagcgagaagaaggccgagaucccccccaagaccuacagccugcagaucgccugggugggcggcuucaucgccaucagcaucaucagcuuccugagccugcugggcgugauccuggugccccugaugaacagaguguucuucaaguuccugcugagcuuccugguggcccuggccgugggcacccugagcggcgacgccuuccugcaccugcugccccacagccacgccagccaccaccacagccacagccacgaggagcccgccauggagaugaagagaggcccccuguucagccaccugagcagccagaacaucgaggagagcgccuacuucgacagcaccuggaagggccugaccgcccugggcggccuguacuucauguuccugguggagcacgugcugacccugaucaagcaguucaaggacaagaagaagaagaaccagaagaagcccgagaacgacgacgacguggagaucaagaagcagcugagcaaguacgagagccagcugagcaccaacgaggagaagguggacaccgacgacagaaccgagggcuaccugagagccgacagccaggagcccagccacuucgacagccagcagcccgccgugcuggaggaggaggaggugaugaucgcccacgcccacccccaggagguguacaacgaguacgugcccagaggcugcaagaacaagugccacagccacuuccacgacacccugggccagagcgacgaccugauccaccaccaccacgacuaccaccacauccugcaccaccaccaccaccagaaccaccacccccacagccacagccagagauacagcagagaggagcugaaggacgccggcguggccacccuggccuggauggugaucaugggcgacggccugcacaacuucagcgacggccuggccaucggcgccgccuucaccgagggccugagcagcggccugagcaccagcguggccguguucugccacgagcugccccacgagcugggcgacuucgccgugcugcugaaggccggcaugaccgugaagcaggccgugcuguacaacgcccugagcgccaugcuggccuaccugggcauggccaccggcaucuucaucggccacuacgccgagaacgugagcauguggaucuucgcccugaccgccggccuguucauguacguggcccugguggacauggugagcuucuaa

SEQ ID NO: 23586 - RNA, 1410 nt, Artificial Sequence
  SLC39A7__Homo_sapiens__NP_001070984
auggccagaggccugggcgccccccacuggguggccgugggccugcugaccugggccacccugggccugcugguggccggccugggcggccacgacgaccugcacgacgaccugcaggaggacuuccacggccacagccacagacacagccacgaggacuuccaccacggccacagccacgcccacggccacggccacacccacgagagcaucuggcacggccacacccacgaccacgaccacggccacagccacgaggaccugcaccacggccacagccacggcuacagccacgagagccuguaccacagaggccacggccacgaccacgagcacagccacggcggcuacggcgagagcggcgcccccggcaucaagcaggaccuggacgccgugacccugugggccuacgcccugggcgccaccgugcugaucagcgccgcccccuucuucgugcuguuccugauccccguggagagcaacagccccagacacagaagccugcugcagauccugcugagcuucgccagcggcggccugcugggcgacgccuuccugcaccugaucccccacgcccuggagccccacagccaccacacccuggagcagcccggccacggccacagccacagcggccagggccccauccugagcgugggccugugggugcugagcggcaucguggccuuccuggugguggagaaguucgugagacacgugaagggcggccacggccacagccacggccacggccacgcccacagccacaccagaggcagccacggccacggcagacaggagagaagcaccaaggagaagcagagcagcgaggaggaggagaaggagaccagaggcgugcagaagagaagaggcggcagcaccgugcccaaggacggccccgugagaccccagaacgccgaggaggagaagagaggccuggaccugagagugagcggcuaccugaaccuggccgccgaccuggcccacaacuucaccgacggccuggccaucggcgccagcuucagaggcggcagaggccugggcauccugaccaccaugaccgugcugcugcacgaggugccccacgaggugggcgacuucgccauccuggugcagagcggcugcagcaagaagcaggccaugagacugcagcugcugaccgccgugggcgcccuggccggcaccgccugcgcccugcugaccgagggcggcgccgugggcagcgagaucgccggcggcgccggccccggcugggugcugcccuucaccgccggcggcuucaucuacguggccaccgugagcgugcugcccgagcugcugagagaggccagcccccugcagagccugcuggaggugcugggccugcugggcggcgugaucaugauggugcugaucgcccaccuggaguaa

SEQ ID NO: 23587 - RNA, 1383 nt, Artificial Sequence
  SLC39A8__Homo_sapiens__NP_001128618
auggcccccggcagagccguggccggccugcugcugcuggccgccgccggccugggcggcguggccgagggccccggccuggccuucagcgaggacgugcugagcguguucggcgccaaccugagccugagcgccgcccagcugcagcaccugcuggagcagaugggcgccgccagcagagugggcgugcccgagcccggccagcugcacuucaaccagugccugaccgccgaggagaucuucagccugcacggcuucagcaacgccacccagaucaccagcagcaaguucagcgugaucugccccgccgugcugcagcagcugaacuuccaccccugcgaggacagacccaagcacaagaccagacccagccacagcgagguguggggcuacggcuuccugagcgugaccaucaucaaccuggccagccugcugggccugauccugaccccccugaucaagaagagcuacuuccccaagauccugaccuucuucgugggccuggccaucggcacccuguucagcaacgccaucuuccagcugauccccgaggccuucggcuucgaccccaagguggacagcuacguggagaaggccguggccguguucggcggcuucuaccugcuguucuucuucgagagaaugcugaagaugcugcugaagaccuacggccagaacggccacacccacuucggcaacgacaacuucggcccccaggagaagacccaccagcccaaggcccugcccgccaucaacggcgugaccugcuacgccaaccccgccgugaccgaggccaacggccacauccacuucgacaacgugagcguggugagccugcaggacggcaagaaggagcccagcagcugcaccugccugaagggccccaagcugagcgagaucggcaccaucgccuggaugaucacccugugcgacgcccugcacaacuucaucgacggccuggccaucggcgccagcugcacccugagccugcugcagggccugagcaccagcaucgccauccugugcgaggaguucccccacgagcugggcgacuucgugauccugcugaacgccggcaugagcaccagacaggcccugcuguucaacuuccugagcgccugcagcugcuacgugggccuggccuucggcauccuggugggcaacaacuucgcccccaacaucaucuucgcccuggccggcggcauguuccuguacaucagccuggccgacauguuccccgagaugaacgacaugcugagagagaaggugaccggcagaaagaccgacuucaccuucuucaugauccagaacgccggcaugcugaccggcuucaccgccauccugcugaucacccuguacgccggcgagaucgagcuggaguaa

SEQ ID NO: 23588 - RNA, 699 nt, Artificial Sequence
  SLC39A9__Homo_sapiens__NP_001239079
auggacgacuucaucagcaucagccugcugagccuggccaugcuggugggcugcuacguggccggcaucaucccccuggccgugaacuucagcgaggagagacugaagcuggugaccgugcugggcgccggccugcugugcggcaccgcccuggccgugaucgugcccgagggcgugcacgcccuguacgaggacauccuggagggcaagcaccaccaggccagcgagacccacaacgugaucgccagcgacaaggccgccgagaagagcguggugcacgagcacgagcacagccacgaccacacccagcugcacgccuacaucggcgugagccuggugcugggcuucguguucaugcugcugguggaccagaucggcaacagccacgugcacagcaccgacgaccccgaggccgccagaagcagcaacagcaagaucaccaccacccugggccugguggugcacgccgccgccgacggcguggcccugggcgccgccgccagcaccagccagaccagcgugcagcugaucguguucguggccaucaugcugcacaaggcccccgccgccuucggccuggugagcuuccugaugcacgccggccuggagagaaacagaaucagaaagcaccugcugguguucgcccuggccgcccccgugaugagcauggugaccuaccugggccugagcaaggacuaa

SEQ ID NO: 23589 - RNA, 2058 nt, Artificial Sequence
  SLC3A1__Homo_sapiens__NP_000332
auggccgaggacaagagcaagagagacagcaucgagaugagcaugaagggcugccagaccaacaacggcuucgugcacaacgaggacauccuggagcagacccccgaccccggcagcagcaccgacaaccugaagcacagcaccagaggcauccugggcagccaggagcccgacuucaagggcgugcagcccuacgccggcaugcccaaggaggugcuguuccaguucagcggccaggccagauacagaauccccagagagauccuguucuggcugaccguggccagcgugcuggugcugaucgccgccaccaucgccaucaucgcccugagccccaagugccuggacugguggcaggagggccccauguaccagaucuaccccagaagcuucaaggacagcaacaaggacggcaacggcgaccugaagggcauccaggacaagcuggacuacaucaccgcccugaacaucaagaccguguggaucaccagcuucuacaagagcagccugaaggacuucagauacggcguggaggacuucagagagguggaccccaucuucggcaccauggaggacuucgagaaccugguggccgccauccacgacaagggccugaagcugaucaucgacuucauccccaaccacaccagcgacaagcacaucugguuccagcugagcagaaccagaaccggcaaguacaccgacuacuacaucuggcacgacugcacccacgagaacggcaagaccaucccccccaacaacuggcugagcguguacggcaacagcagcuggcacuucgacgaggugagaaaccagugcuacuuccaccaguucaugaaggagcagcccgaccugaacuucagaaaccccgacgugcaggaggagaucaaggagauccugagauucuggcugaccaagggcguggacggcuucagccuggacgccgugaaguuccugcuggaggccaagcaccugagagacgagauccaggugaacaagacccagauccccgacaccgugacccaguacagcgagcuguaccacgacuucaccaccacccaggugggcaugcacgacaucgugagaagcuucagacagaccauggaccaguacagcaccgagcccggcagauacagauucaugggcaccgaggccuacgccgagagcaucgacagaaccgugauguacuacggccugcccuucauccaggaggccgacuuccccuucaacaacuaccugagcaugcuggacaccgugagcggcaacagcguguacgaggugaucaccagcuggauggagaacaugcccgagggcaaguggcccaacuggaugaucggcggccccgacagcagcagacugaccagcagacugggcaaccaguacgugaacgugaugaacaugcugcuguucacccugcccggcacccccaucaccuacuacggcgaggagaucggcaugggcaacaucguggccgccaaccugaacgagagcuacgacaucaacacccugagaagcaagagccccaugcagugggacaacagcagcaacgccggcuucagcgaggccagcaacaccuggcugcccaccaacagcgacuaccacaccgugaacguggacgugcagaagacccagcccagaagcgcccugaagcuguaccaggaccugagccugcugcacgccaacgagcugcugcugaacagaggcugguucugccaccugagaaacgacagccacuacgugguguacaccagagagcuggacggcaucgacagaaucuucaucguggugcugaacuucggcgagagcacccugcugaaccugcacaacaugaucagcggccugcccgccaagaugagaaucagacugagcaccaacagcgccgacaagggcagcaagguggacaccagcggcaucuuccuggacaagggcgagggccugaucuucgagcacaacaccaagaaccugcugcacagacagaccgccuucagagacagaugcuucgugagcaacagagccugcuacagcagcgugcugaacauccuguacaccagcugcuaa

SEQ ID NO: 23590 - RNA, 1896 nt, Artificial Sequence
  SLC3A2__Homo_sapiens__NP_001012680
auggagcugcagccccccgaggccagcaucgccguggugagcauccccagacagcugcccggcagccacagcgaggccggcgugcagggccugagcgccggcgacgacagcgagaccggcagcgacugcgugacccaggccggccugcagcugcuggccagcagcgacccccccgcccuggccagcaagaacgccgaggugaccguggagaccggcuuccaccacgugagccaggccgacaucgaguuccugaccagcaucgaccccaccgccagcgccagcggcagcgccggcaucaccggcaccaugagccaggacaccgagguggacaugaaggagguggagcugaacgagcuggagcccgagaagcagcccaugaacgccgccagcggcgccgccaugagccuggccggcgccgagaagaacggccuggugaagaucaagguggccgaggacgaggccgaggccgccgccgccgccaaguucaccggccugagcaaggaggagcugcugaagguggccggcagccccggcugggugagaaccagaugggcccugcugcugcuguucuggcugggcuggcugggcaugcuggccggcgccguggugaucaucgugagagcccccagaugcagagagcugcccgcccagaagugguggcacaccggcgcccuguacagaaucggcgaccugcaggccuuccagggccacggcgccggcaaccuggccggccugaagggcagacuggacuaccugagcagccugaaggugaagggccuggugcugggccccauccacaagaaccagaaggacgacguggcccagaccgaccugcugcagaucgaccccaacuucggcagcaaggaggacuucgacagccugcugcagagcgccaagaagaagagcaucagagugauccuggaccugacccccaacuacagaggcgagaacagcugguucagcacccagguggacaccguggccaccaaggugaaggacgcccuggaguucuggcugcaggccggcguggacggcuuccaggugagagacaucgagaaccugaaggacgccagcagcuuccuggccgaguggcagaacaucaccaagggcuucagcgaggacagacugcugaucgccggcaccaacagcagcgaccugcagcagauccugagccugcuggagagcaacaaggaccugcugcugaccagcagcuaccugagcgacagcggcagcaccggcgagcacaccaagagccuggugacccaguaccugaacgccaccggcaacagauggugcagcuggagccugagccaggccagacugcugaccagcuuccugcccgcccagcugcugagacuguaccagcugaugcuguucacccugcccggcacccccguguucagcuacggcgacgagaucggccuggacgccgccgcccugcccggccagcccauggaggcccccgugaugcugugggacgagagcagcuuccccgacauccccggcgccgugagcgccaacaugaccgugaagggccagagcgaggaccccggcagccugcugagccuguucagaagacugagcgaccagagaagcaaggagagaagccugcugcacggcgacuuccacgccuucagcgccggccccggccuguucagcuacaucagacacugggaccagaacgagagauuccugguggugcugaacuucggcgacgugggccugagcgccggccugcaggccagcgaccugcccgccagcgccagccugcccgccaaggccgaccugcugcugagcacccagcccggcagagaggagggcagcccccuggagcuggagagacugaagcuggagccccacgagggccugcugcugagauuccccuacgccgccuaa

SEQ ID NO: 23591 - RNA, 1716 nt, Artificial Sequence
  SLC40A1__Homo_sapiens__NP_055400
augaccagagccggcgaccacaacagacagagaggcugcugcggcagccuggccgacuaccugaccagcgccaaguuccugcuguaccugggccacagccugagcaccuggggcgacagaauguggcacuucgccgugagcguguuccugguggagcuguacggcaacagccugcugcugaccgccguguacggccuggugguggccggcagcgugcuggugcugggcgccaucaucggcgacuggguggacaagaacgccagacugaagguggcccagaccagccugguggugcagaacgugagcgugauccugugcggcaucauccugaugaugguguuccugcacaagcacgagcugcugaccauguaccacggcugggugcugaccagcugcuacauccugaucaucaccaucgccaacaucgccaaccuggccagcaccgccaccgccaucaccauccagagagacuggaucguggugguggccggcgaggacagaagcaagcuggccaacaugaacgccaccaucagaagaaucgaccagcugaccaacauccuggcccccauggccgugggccagaucaugaccuucggcagccccgugaucggcugcggcuucaucagcggcuggaaccuggugagcaugugcguggaguacgugcugcuguggaagguguaccagaagacccccgcccuggccgugaaggccggccugaaggaggaggagaccgagcugaagcagcugaaccugcacaaggacaccgagcccaagccccuggagggcacccaccugaugggcgugaaggacagcaacauccacgagcuggagcacgagcaggagcccaccugcgccagccagauggccgagcccuucagaaccuucagagacggcugggugagcuacuacaaccagcccguguuccuggccggcaugggccuggccuuccuguacaugaccgugcugggcuucgacugcaucaccaccggcuacgccuacacccagggccugagcggcagcauccugagcauccugaugggcgccagcgccaucaccggcaucaugggcaccguggccuucaccuggcugagaagaaagugcggccuggugagaaccggccugaucagcggccuggcccagcugagcugccugauccugugcgugaucagcguguucaugcccggcagcccccuggaccugagcgugagccccuucgaggacaucagaagcagauucauccagggcgagagcaucacccccaccaagauccccgagaucaccaccgagaucuacaugagcaacggcagcaacagcgccaacaucgugcccgagaccagccccgagagcgugcccaucaucagcgugagccugcuguucgccggcgugaucgccgccagaaucggccuguggagcuucgaccugaccgugacccagcugcugcaggagaacgugaucgagagcgagagaggcaucaucaacggcgugcagaacagcaugaacuaccugcuggaccugcugcacuucaucauggugauccuggcccccaaccccgaggccuucggccugcuggugcugaucagcgugagcuucguggccaugggccacaucauguacuucagauucgcccagaacacccugggcaacaagcuguucgccugcggccccgacgccaaggaggugagaaaggagaaccaggccaacaccagcgugguguaa

SEQ ID NO: 23592 - RNA, 1542 nt, Artificial Sequence
  SLC41A1__Homo_sapiens__XP_005245126
augagcagcaagcccgagcccaaggacgugcaccagcugaacggcaccggccccagcgccagccccugcagcagcgacggccccggcagagagccccuggccggcaccagcgaguuccugggccccgacggcgccggcguggagguggugaucgagagcagagccaacgccaagggcgugagagaggaggacgcccugcuggagaacggcagccagagcaacgagagcgacgacgugagcaccgacagaggccccgccccccccagcccccugaaggagaccagcuucagcaucggccugcaggugcuguuccccuuccugcuggccggcuucggcaccguggccgccggcauggugcuggacaucgugcagcacugggagguguuccagaaggugaccgagguguucauccuggugcccgcccugcugggccugaagggcaaccuggagaugacccuggccagcagacugagcaccgccgccaacaucggccacauggacacccccaaggagcuguggagaaugaucaccggcaacauggcccugauccaggugcaggccaccguggugggcuuccuggccagcaucgccgccgugguguucggcuggauccccgacggccacuucagcaucccccacgccuuccugcugugcgccagcagcguggccaccgccuucaucgccagccuggugcugggcaugaucaugaucggcgugaucaucggcagcagaaagaucggcaucaaccccgacaacguggccacccccaucgccgccagccugggcgaccugaucacccuggcccugcugagcggcaucagcuggggccuguaccuggagcugaaccacuggagauacaucuacccccuggugugcgccuucuucguggcccugcugcccguguggguggugcuggccagaagaagccccgccaccagagaggugcuguacagcggcugggagcccgugaucaucgccauggccaucagcagcgugggcggccugauccuggacaagaccgugagcgaccccaacuucgccggcauggccguguucacccccgugaucaacggcgugggcggcaaccugguggccgugcaggccagcagaaucagcaccuuccugcacaugaacggcaugcccggcgagaacagcgagcaggcccccagaagaugccccagccccugcaccaccuucuucagccccgacgugaacagcagaagcgccagagugcuguuccugcugguggugcccggccaccugguguuccuguacaccaucagcugcaugcagggcggccacaccacccugacccugaucuucaucaucuucuacaugaccgccgcccugcugcaggugcugauccugcuguacaucgccgacuggauggugcacuggauguggggcagaggccuggaccccgacaacuucagcauccccuaccugaccgcccugggcgaccugcugggcaccggccugcuggcccugagcuuccacgugcuguggcugaucggcgacagagacaccgacgugggcgacuaa

SEQ ID NO: 23593 - RNA, 1680 nt, Artificial Sequence
  SLC43A1__Homo_sapiens__NP_001185739
auggcccccacccugcagcaggccuacagaagaagaugguggauggccugcaccgccgugcuggagaaccuguucuucagcgccgugcugcugggcuggggcagccugcugaucauccugaagaacgagggcuucuacagcagcaccugccccgccgagagcagcaccaacaccacccaggacgagcagagaagauggcccggcugcgaccagcaggacgagaugcugaaccugggcuucaccaucggcagcuucgugcugagcgccaccacccugccccugggcauccugauggacagauucggccccagacccgugagacuggugggcagcgccugcuucaccgccagcugcacccugauggcccuggccagcagagacguggaggcccugagcccccugaucuuccuggcccugagccugaacggcuucggcggcaucugccugaccuucaccagccugacccugcccaacauguucggcaaccugagaagcacccugauggcccugaugaucggcagcuacgccagcagcgccaucaccuuccccggcaucaagcugaucuacgacgccggcguggccuucguggugaucauguucaccuggagcggccuggccugccugaucuuccugaacugcacccugaacuggcccaucgaggccuuccccgcccccgaggaggugaacuacaccaagaagaucaagcugagcggccuggcccuggaccacaaggugaccggcgaccuguucuacacccacgugaccaccaugggccagagacugagccagaaggcccccagccuggaggacggcagcgacgccuucaugagcccccaggacgugagaggcaccagcgagaaccugcccgagagaagcgugccccugagaaagagccugugcagccccaccuuccuguggagccugcugaccaugggcaugacccagcugagaaucaucuucuacauggccgccgugaacaagaugcuggaguaccuggugaccggcggccaggagcacgagaccaacgagcagcagcagaagguggccgagaccgugggcuucuacagcagcguguucggcgccaugcagcugcugugccugcugaccugcccccugaucggcuacaucauggacuggagaaucaaggacugcguggacgcccccacccagggcaccgugcugggcgacgccagagacggcguggccaccaagagcaucagacccagauacugcaagauccagaagcugaccaacgccaucagcgccuucacccugaccaaccugcugcuggugggcuucggcaucaccugccugaucaacaaccugcaccugcaguucgugaccuucgugcugcacaccaucgugagaggcuucuuccacagcgccugcggcagccuguacgccgccguguuccccagcaaccacuucggcacccugaccggccugcagagccugaucagcgccguguucgcccugcugcagcagccccuguucauggccauggugggcccccugaagggcgagcccuucugggugaaccugggccugcugcuguucagccugcugggcuuccugcugcccagcuaccuguucuacuacagagccagacugcagcaggaguacgccgccaacggcaugggcccccugaaggugcugagcggcagcgaggugaccgccuaa

SEQ ID NO: 23594 - RNA, 1299 nt, Artificial Sequence
  SLC43A2__Homo_sapiens__NP_001271428
augaccuacggcagcccccaggccaacgccagccccagcgacgccguggcccuggaccacggcgaggugagcagaagacagcagcaggagcugcccaacauguucggcgaccugagaagcaccuucaucgcccugaugaucggcagcuacgccagcagcgccgugaccuuccccggcaucaagcugaucuacgacgccggcgugagcuucaucguggugcugguggugugggccggcugcagcggccugguguuccugaacugcuucuucaacuggccccuggagcccuuccccggccccgaggacauggacuacagcgugaagaucaaguucagcuggcugggcuucgaccacaagaucaccggcaagcaguucuacaagcaggugaccaccgugggcagaagacugagcgugggcagcagcaugagaagcgccaaggagcagguggcccugcaggagggccacaagcugugccugagcaccguggaccuggaggugaagugccagcccgacgccgccguggcccccagcuucaugcacagcguguucagccccauccugcugcugagccuggugaccaugugcgugacccagcugagacugaucuucuacaugggcgccaugaacaacauccugaaguuccuggugagcggcgaccagaagaccgugggccuguacaccagcaucuucggcgugcugcagcugcugugccugcugaccgcccccgugaucggcuacaucauggacuggagacugaaggagugcgaggacgccagcgaggagcccgaggagaaggacgccaaccagggcgagaagaagaagaagaagagagacagacagauccagaagaucaccaacgccaugagagccuucgccuucaccaaccugcugcuggugggcuucggcgugaccugccugauccccaaccugccccugcagauccugagcuucauccugcacaccaucgugagaggcuucauccacagcgccgugggcggccuguacgccgccguguaccccagcacccaguucggcagccugaccggccugcagagccugaucagcgcccuguucgcccugcugcagcagccccuguuccuggccaugaugggcccccugcagggcgacccccugugggugaacgugggccugcugcugcugagccugcugggcuucugccugccccuguaccugaucugcuacagaagacagcuggagagacagcugcagcagagacaggaggacgacaagcuguuccugaagaucaacggcagcagcaaccaggaggccuucguguaa

SEQ ID NO: 23595 - RNA, 1515 nt, Artificial Sequence
  SLC43A3__Homo_sapiens__NP_001265135
auggccggccagggccugccccugcacguggccacccugcugaccggccugcuggagugccugggcuucgccggcgugcuguucggcuggcccagccugguguucguguucaagaacgaggacuacuucaaggaccugugcggccccgacgccggccccaucggcaacgccaccggccaggccggcagacugggcugcaugggcgaccuguucagcacccccgacugcaaggcccaggacgagagauucagccugaucuucacccugggcagcuucaugaacaacuucaugaccuuccccaccggcuacaucuucgacagauucaagaccaccguggccagacugaucgccaucuucuucuacaccaccgccacccugaucaucgccuucaccagcgccggcagcgccgugcugcuguuccuggccaugcccaugcugaccaucggcggcauccuguuccugaucaccaaccugcagaucggcaaccuguucggccagcacagaagcaccaucaucacccuguacaacggcgccuucgacagcagcagcgccguguuccugaucaucaagcugcuguacgagaagggcaucagccugagagccagcuucaucuucaucagcgugugcagcaccuggcacguggccagaaccuuccugcugaugcccagaggccacauccccuacccccugccccccaacuacagcuacggccugugccccggcaacggcaccaccaaggaggagaaggagaccgccgagcacgagaacagagagcugcagagcaaggaguuccugagcgccaaggaggagacccccggcgccggccagaagcaggagcugagaagcuucuggagcuacgccuucagcagaagauucgccuggcaccugguguggcugagcgugauccagcuguggcacuaccuguucaucggcacccugaacagccugcugaccaacauggccggcggcgacauggccagagugagcaccuacaccaacgccuucgccuucacccaguucggcgugcugugcgcccccuggaacggccugcugauggacagacugaagcagaaguaccagaaggaggccagaaagaccggcagcagcacccuggccguggcccugugcagcaccgugcccagccuggcccugaccagccugcugugccugggcuucgcccugugcgccagcgugcccauccugccccugcaguaccugaccuucauccugcaggugaucagcagaagcuuccuguacggcagcaacgccgccuuccugacccuggccuuccccagcgagcacuucggcaagcuguucggccuggugauggcccugagcgccguggugagccugcugcaguuccccaucuucacccugaucaagggcagccugcagaacgaccccuucuacgugaacgugauguucaugcuggccauccugcugaccuucuuccaccccuuccugguguacagagagugcagaaccuggaaggagagccccagcgccaucgccuaa

SEQ ID NO: 23596 - RNA, 1959 nt, Artificial Sequence
  SLC44A1__Homo_sapiens__NP_001273659
augggcugcugcagcagcgccagcagcgccgcccagagcagcaagagagaguggaagccccuggaggacagaagcugcaccgacauccccuggcugcugcuguucauccuguucugcaucggcaugggcuucaucugcggcuucagcaucgccaccggcgccgccgccagacuggugagcggcuacgacagcuacggcaacaucugcggccagaagaacaccaagcuggaggccauccccaacagcggcauggaccacacccagagaaaguacguguucuuccuggaccccugcaaccuggaccugaucaacagaaagaucaagagcguggcccugugcguggccgccugccccagacaggagcugaagacccugagcgacgugcagaaguucgccgagaucaacggcagcgcccugugcagcuacaaccugaagcccagcgaguacaccaccagccccaagagcagcgugcugugccccaagcugcccgugcccgccagcgcccccauccccuucuuccacagaugcgcccccgugaacaucagcugcuacgccaaguucgccgaggcccugaucaccuucgugagcgacaacagcgugcugcacagacugaucagcggcgugaugaccagcaaggagaucauccugggccugugccugcugagccuggugcugagcaugauccugauggugaucaucagauacaucagcagagugcugguguggauccugaccauccuggugauccugggcagccugggcggcaccggcgugcugugguggcuguacgccaagcagagaagaagccccaaggagaccgugacccccgagcagcugcagaucgccgaggacaaccugagagcccugcugaucuacgccaucagcgccaccguguucaccgugauccuguuccugaucaugcuggugaugagaaagagaguggcccugaccaucgcccuguuccacguggccggcaagguguucauccaccugccccugcugguguuccagcccuucuggaccuucuucgcccuggugcuguucuggguguacuggaucaugacccugcuguuccugggcaccaccggcagccccgugcagaacgagcagggcuucguggaguucaagaucagcggcccccugcaguacauguggugguaccacguggugggccugaucuggaucagcgaguucauccuggccugccagcagaugaccguggccggcgccguggugaccuacuacuucaccagagacaagagaaaccugcccuucacccccauccuggccagcgugaacagacugaucagauaccaccugggcaccguggccaagggcagcuucaucaucacccuggugaagauccccagaaugauccugauguacauccacagccagcugaagggcaaggagaacgccugcgccagaugcgugcugaagagcugcaucugcugccuguggugccuggagaagugccugaacuaccugaaccagaacgccuacaccgccaccgccaucaacagcaccaacuucugcaccagcgccaaggacgccuucgugauccugguggagaacgcccugagaguggccaccaucaacaccgugggcgacuucaugcuguuccugggcaaggugcugaucgugugcagcaccggccuggccggcaucaugcugcugaacuaccagcaggacuacaccgugugggugcugccccugaucaucgugugccuguucgccuuccugguggcccacugcuuccugagcaucuacgagauggugguggacgugcuguuccugugcuucgccaucgacaccaaguacaacgacggcagccccggcagagaguucuacauggacaaggugcugauggaguucguggagaacagcagaaaggccaugaaggaggccggcaagggcggcguggccgacagcagagagcugaagcccaugaucaaguaa

SEQ ID NO: 23597 - RNA, 2115 nt, Artificial Sequence
  SLC44A2__Homo_sapiens__NP_001138528
auggaggacgagagaaagaacggcgccuacggcaccccccagaaguacgaccccaccuucaagggccccaucuacaacagaggcugcaccgacaucaucugcugcguguuccugcugcuggccaucgugggcuacguggccgugggcaucaucgccuggacccacggcgaccccagaaaggugaucuaccccaccgacagcagaggcgaguucugcggccagaagggcaccaagaacgagaacaagcccuaccuguucuacuucaacaucgugaagugcgccagcccccuggugcugcuggaguuccagugccccaccccccagaucugcguggagaagugccccgacagauaccugaccuaccugaacgccagaagcagcagagacuucgaguacuacaagcaguucugcgugcccggcuucaagaacaacaagggcguggccgaggugcugcaggacggcgacugccccgccgugcugauccccagcaagccccuggccagaagaugcuuccccgccauccacgccuacaagggcgugcugauggugggcaacgagaccaccuacgaggacggccacggcagcagaaagaacaucaccgaccugguggagggcgccaagaaggccaacggcgugcuggaggccagacagcuggccaugagaaucuucgaggacuacaccgugagcugguacuggaucaucaucggccuggugaucgccauggccaugagccugcuguucaucauccugcugagauuccuggccggcaucauggugugggugaugaucaucauggugauccuggugcugggcuacggcaucuuccacugcuacauggaguacagcagacugagaggcgaggccggcagcgacgugagccugguggaccugggcuuccagaccgacuucagaguguaccugcaccugagacagaccuggcuggccuucaugaucauccugagcauccuggaggugaucaucauccugcugcugaucuuccugagaaagagaauccugaucgccaucgcccugaucaaggaggccagcagagccgugggcuacgugaugugcagccugcuguacccccuggugaccuucuuccugcugugccugugcaucgccuacugggccagcaccgccguguuccugagcaccagcaacgaggccguguacaagaucuucgacgacagccccugccccuucaccgccaagaccugcaaccccgagaccuuccccagcagcaacgagagcagacagugccccaacgccagaugccaguucgccuucuacggcggcgagagcggcuaccacagagcccugcugggccugcagaucuucaacgccuucauguucuucuggcuggccaacuucgugcuggcccugggccaggugacccuggccggcgccuucgccagcuacuacugggcccugagaaagcccgacgaccugcccgccuucccccuguucagcgccuucggcagagcccugagauaccacaccggcagccuggccuucggcgcccugauccuggccaucgugcagaucaucagagugauccuggaguaccuggaccagagacugaaggccgccgagaacaaguucgccaagugccugaugaccugccugaagugcugcuucuggugccuggagaaguucaucaaguuccugaacagaaacgccuacaucaugaucgccaucuacggcaccaacuucugcaccagcgccagaaacgccuucuuccugcugaugagaaacaucaucagaguggccgugcuggacaaggugaccgacuuccuguuccugcugggcaagcugcugaucgugggcagcgugggcauccuggccuucuucuucuucacccacagaaucagaaucgugcaggacaccgcccccccccugaacuacuacugggugcccauccugaccgugaucgugggcagcuaccugaucgcccacggcuucuucagcguguacggcaugugcguggacacccuguuccugugcuuccuggaggaccuggagagaaacgacggcagcgccgagagacccuacuucaugagcagcacccugaagaagcugcugaacaagaccaacaagaaggccgccgagagcuaa

SEQ ID NO: 23598 - RNA, 2007 nt, Artificial Sequence
  SLC44A4__Homo_sapiens__NP_001171515
augggcggcaagcagagagacgaggacgacgaggccuacggcaagcccgugaaguacgaccccagcuucagaggccccaucaagaacagaagcugcaccgacgugaucugcugcgugcuguuccugcuguucauccugggcuacaucguggugggcaucguggccuggcuguacggcgaccccagacaggugcuguaccccagaaacagcaccggcgccuacugcggcaugggcgagaacaaggacaagcccuaccugcuguacuucaacaucuucagcugcauccugagcagcaacaucaucagcguggccgagaacggccugcagugccccaccccccagaccgugaucaccagccugcagcaggagcugugccccagcuuccugcugcccagcgcccccgcccugggcagaugcuuccccuggaccaacgugaccccccccgcccugcccggcaucaccaacgacaccaccauccagcagggcaucagcggccugaucgacagccugaacgccagagacaucagcgugaagaucuucgaggacuucgcccagagcugguacuggauccugguggcccugggcguggcccuggugcugagccugcuguucauccugcugcugagacugguggccggcccccuggugcuggugcugauccugggcgugcugggcgugcuggccuacggcaucuacuacugcugggaggaguacagagugcugagagacaagggcgccagcaucagccagcugggcuucaccaccaaccugagcgccuaccagagcgugcaggagaccuggcuggccgcccugaucgugcuggccgugcuggaggccauccugcugcugaugcugaucuuccugagacagagaaucagaaucgccaucgcccugcugaaggaggccagcaaggccgugggccagaugaugagcaccauguucuacccccuggugaccuucgugcugcugcugaucugcaucgccuacugggccaugaccgcccuguaccuggccaccagcggccagccccaguacgugcugugggccagcaacaucagcagccccggcugcgagaaggugcccaucaacaccagcugcaaccccaccgcccaccuggugaacagcagcugccccggccugaugugcguguuccagggcuacagcagcaagggccugauccagagaagcguguucaaccugcagaucuacggcgugcugggccuguucuggacccugaacugggugcuggcccugggccagugcgugcuggccggcgccuucgccagcuucuacugggccuuccacaagccccaggacauccccaccuucccccugaucagcgccuucaucagaacccugagauaccacaccggcagccuggccuucggcgcccugauccugacccuggugcagaucgccagagugauccuggaguacaucgaccacaagcugagaggcgugcagaaccccguggccagaugcaucaugugcugcuucaagugcugccuguggugccuggagaaguucaucaaguuccugaacagaaacgccuacaucaugaucgccaucuacggcaagaacuucugcgugagcgccaagaacgccuucaugcugcugaugagaaacaucgugagagugguggugcuggacaaggugaccgaccugcugcuguucuucggcaagcugcugguggugggcggcgugggcgugcugagcuucuucuucuucagcggcagaauccccggccugggcaaggacuucaagagcccccaccugaacuacuacuggcugcccaucaugaccagcauccugggcgccuacgugaucgccagcggcuucuucagcguguucggcaugugcguggacacccuguuccugugcuuccuggaggaccuggagagaaacaacggcagccuggacagacccuacuacaugagcaagagccugcugaagauccugggcaagaagaacgaggccccccccgacaacaagaagagaaagaaguaa

SEQ ID NO: 23599 - RNA, 2169 nt, Artificial Sequence
  SLC44A5__Homo_sapiens__XP_011539285
augggccugcaggcccugagcgagaagcccgccgacacccccagcgaggaggaggacuucggcgaccccagaaccuacgaccccgacuucaagggccccguggccaacagaagcugcaccgacgugcugugcugcaugaucuuccugcugugcaucaucggcuacaucgugcugggccugguggccugggugcacggcgaccccagaagagccgccuaccccaccgacagccagggccacuucugcggccagaagggcacccccaacgagaacaagaccauccuguucuacuucaaccugcugagaugcaccagccccagcgugcugcugaaccugcagugccccaccacccagaucugcgugagcaagugccccgagaaguuccugaccuacguggagaugcagcugcuguacaccaaggacaagagcuacugggaggacuacagacaguucugcaagaccaccgccaagcccgugaagagccugacccagcugcugcuggacgacgacugccccaccgccaucuuccccagcaagcccuuccugcagagaugcuuccccgacuucagcaccaagaacggcacccugaccaucggcagcaagaugauguuccaggacggcaacggcggcaccagaagcgugguggagcugggcaucgccgccaacggcaucaacaagcugcuggacgccaagagccugggccugaagguguucgaggacuacgccagaaccugguacuggauccugaucggccugaccaucgccauggugcugagcuggaucuuccugauccugcugagauucaucgccggcugccuguucuggguguucaugaucggcgugaucggcaucaucggcuacggcaucuggcacugcuaccagcaguacaccaaccugcaggagagacccagcagcgugcugaccaucuacgacaucggcauccagaccaacaucagcauguacuucgagcugcagcagaccugguucaccuucaugaucauccugugcaucaucgaggugaucgugauccugaugcugaucuuccugagaaacagaaucagaguggccaucauccugcugaaggagggcagcaaggccaucggcuacgugcccagcacccugguguaccccgcccugaccuucauccugcugagcaucugcaucugcuacuggguggugaccgccguguuccuggccaccagcggcgugcccguguacaaggugaucgcccccggcggccacugcauccacgagaaccagaccugcgaccccgagaucuucaacaccaccgagaucgccaaggccugccccggcgcccugugcaacuucgccuucuacggcggcaagagccuguaccaccaguacauccccaccuuccacguguacaaccuguucguguuccuguggcugaucaacuucgugaucgcccugggccagugcgcccuggccggcgccuucgccaccuacuacugggccaugaagaagcccgacgacauccccagauacccccuguucaccgccuucggcagagccaucagauaccacaccggcagccuggccuucggcagccugaucaucgcccugauccagauguucaagaucgugcuggaguaccuggaccacagacugaagagaacccagaacacccugagcaaguuccugcagugcugccugagaugcugcuucuggugccuggagaacgccaucaaguuccugaacagaaacgccuacaucaugaucgccaucuacggcagaaacuucugcagaagcgccaaggacgccuucaaccugcugaugagaaacgugcugaagguggccgugaccgacgaggugaccuacuucgugcuguuccugggcaagcugcugguggccggcagcaucggcgugcuggccuuccuguucuucacccagagacugcccgugaucgcccagggccccgccagccugaacuacuacugggugccccugcugaccgugaucuucggcagcuaccugaucgcccacggcuucuucagcguguacgccaugugcguggagaccaucuucaucugcuucugcgaggaccuggagagaaacgacggcagcaccgagaagcccuacuucgugacccccaaccugcacggcauccugaucaagaagcagcuggugccccagaagcagaaggaguaa

SEQ ID NO: 23600 - RNA, 1383 nt, Artificial Sequence
  SLC45A2__Homo_sapiens__NP_001012527
augggcagcaacagcggccaggccggcagacacaucuacaagagccuggccgacgacggccccuucgacagcguggagccccccaagagacccaccagcagacugaucaugcacagcauggccauguucggcagagaguucugcuacgccguggaggccgccuacgugacccccgugcugcugagcgugggccugcccagcagccuguacagcaucgugugguuccugagccccauccugggcuuccugcugcagcccguggugggcagcgccagcgaccacugcagaagcagauggggcagaagaagacccuacauccugacccugggcgugaugaugcuggugggcauggcccuguaccugaacggcgccaccgugguggccgcccugaucgccaaccccagaagaaagcuggugugggccaucagcgugaccaugaucggcguggugcuguucgacuucgccgccgacuucaucgacggccccaucaaggccuaccuguucgacgugugcagccaccaggacaaggagaagggccugcacuaccacgcccuguucaccggcuucggcggcgcccugggcuaccugcugggcgccaucgacugggcccaccuggagcugggcagacugcugggcaccgaguuccaggugauguucuucuucagcgcccuggugcugacccugugcuucaccgugcaccugugcagcaucagcgaggccccccugaccgagguggccaagggcauccccccccagcagaccccccaggaccccccccugagcagcgacggcauguacgaguacggcagcaucgagaaggugaagaacggcuacgugaaccccgagcuggccaugcagggcgccaagaacaagaaccacgccgagcagaccagaagagccaugacccugaagagccugcugagagcccuggugaacaugcccccccacuacagauaccugugcaucagccaccugaucggcuggaccgccuuccugagcaacaugcuguucuucaccgacuucaugggccagaucguguacagaggcgaccccuacagcgcccacaacagcaccgaguuccugaucuacgagagaggcguggaggugggcugcuggggcuucugcaucaacagcguguucagcagccuguacagcuacuuccagaaggugcuggugagcuacaucggccugaagggccuguacuucaccggcuaccugcuguucggccugggcaccggcuucaucggccuguuccccaacguguacagcacccuggugcugugcagccuguucggcgugaugagcagcacccuguacaccgugcccuucaaccugaucaccgaguaccacagagaggaggagaaggaggugugcugccacuaa

SEQ ID NO: 23601 - RNA, 1662 nt, Artificial Sequence
  SLC45A3__Homo_sapiens__NP_149093
auggugcagagacugugggugagcagacugcugagacacagaaaggcccagcugcugcuggugaaccugcugaccuucggccuggaggugugccuggccgccggcaucaccuacgugcccccccugcugcuggaggugggcguggaggagaaguucaugaccauggugcugggcaucggccccgugcugggccuggugugcgugccccugcugggcagcgccagcgaccacuggagaggcagauacggcagaagaagacccuucaucugggcccugagccugggcauccugcugagccuguuccugauccccagagccggcuggcuggccggccugcugugccccgaccccagaccccuggagcuggcccugcugauccugggcgugggccugcuggacuucugcggccaggugugcuucaccccccuggaggcccugcugagcgaccuguucagagaccccgaccacugcagacaggccuacagcguguacgccuucaugaucagccugggcggcugccugggcuaccugcugcccgccaucgacugggacaccagcgcccuggcccccuaccugggcacccaggaggagugccuguucggccugcugacccugaucuuccugaccugcguggccgccacccugcugguggccgaggaggccgcccugggccccaccgagcccgccgagggccugagcgcccccagccugagcccccacugcugccccugcagagccagacuggccuucagaaaccugggcgcccugcugcccagacugcaccagcugugcugcagaaugcccagaacccugagaagacuguucguggccgagcugugcagcuggauggcccugaugaccuucacccuguucuacaccgacuucgugggcgagggccuguaccagggcgugcccagagccgagcccggcaccgaggccagaagacacuacgacgagggcgugagaaugggcagccugggccuguuccugcagugcgccaucagccugguguucagccuggugauggacagacuggugcagagauucggcaccagagccguguaccuggccagcguggccgccuuccccguggccgccggcgccaccugccugagccacagcguggccguggugaccgccagcgccgcccugaccggcuucaccuucagcgcccugcagauccugcccuacacccuggccagccuguaccacagagagaagcagguguuccugcccaaguacagaggcgacaccggcggcgccagcagcgaggacagccugaugaccagcuuccugcccggccccaagcccggcgcccccuuccccaacggccacgugggcgccggcggcagcggccugcugccccccccccccgcccugugcggcgccagcgccugcgacgugagcgugagagugguggugggcgagcccaccgaggccagaguggugcccggcagaggcaucugccuggaccuggccauccuggacagcgccuuccugcugagccagguggcccccagccuguucaugggcagcaucgugcagcugagccagagcgugaccgccuacauggugagcgccgccggccugggccugguggccaucuacuucgccacccaggugguguucgacaagagcgaccuggccaaguacagcgccuaa

SEQ ID NO: 23602 - RNA, 2397 nt, Artificial Sequence
  SLC45A4__Homo_sapiens__NP_001073900
augggcaaggccagccccgccagcggccugagcagacccaagacccuggugagcccccugagaagcaaccaguggagccugcagaagggccugcccgagcaguacuacagccugaccugguuccugagccccauccugggccugaucuucaccccccugaucggcagcgccagcgacagaugcacccugagcuggggcagaagaagacccuucauccuggcccugugcgugggcgugcuguucggcguggcccuguuccugaacggcagcgccaucggccuggcccugggcgacgugcccaacagacagcccaucggcaucgugcugaccgugcugggcgugguggugcuggacuucagcgccgacgccaccgagggccccaucagagccuaccugcuggacgugguggacagcgaggagcaggacauggcccugaacauccacgccuucagcgccggccugggcggcgccaucggcuacgugcugggcggccuggacuggacccagaccuuccugggcagcugguucagaacccagaaccaggugcuguucuucuucgccgccaucaucuucaccgugagcguggcccugcaccuguucagcaucgacgaggagcaguacagcccccagcaggagagaagcgccgaggagcccggcgcccuggacggcggcgagccccacggcgugcccgccuuccccgacgaggugcagagcgagcacgagcuggcccuggacuaccccgacguggacaucaugagaagcaagagcgacagcgcccugcacgugcccgacaccgcccuggaccuggagcccgagcugcuguuccugcacgacaucgagcccagcaucuuccacgacgccagcuaccccgccacccccagaagcaccagccaggagcuggccaagaccaagcugcccagacuggccaccuuccugaaggaggccgccaaggaggacgagacccugcuggacaaccaccugaacgaggccaaggugcccaacggcagcggcagccccaccaaggacgcccugggcggcuacaccagaguggacaccaagcccagcgccaccagcagcagcaugagaagaagaagacacgccuucagaagacaggccagcagcaccuucagcuacuacggcaagcugggcagccacugcuacagauacagaagagccaacgccguggugcugaucaagcccagcagaagcaugagcgaccuguacgacaugcagaagagacagagacagcacagacacagaaaccagagcggcgccaccaccagcagcggcgacaccgagagcgaggagggcgagggcgagaccaccgugagacugcuguggcugagcaugcugaagaugcccagagagcugaugagacugugccugugccaccugcugaccugguucagcgugaucgccgaggccguguucuacaccgacuucaugggccaggugaucuucgagggcgaccccaaggcccccagcaacagcaccgccuggcaggccuacaacgccggcgugaagaugggcugcuggggccuggugaucuacgccgccaccggcgccaucugcagcgcccugcugcagaaguaccuggacaacuacgaccugagcgugagagugaucuacgugcugggcacccugggcuucagcgugggcaccgccgugauggccauguuccccaacguguacguggccauggugaccaucagcaccaugggcaucgugagcaugagcaucagcuacugccccuacgcccugcugggccaguaccacgacaucaagcaguacauccaccacagccccggcaacagcaagagaggcuucggcaucgacugcgccauccugagcugccagguguacaucagccagauccugguggccagcgcccugggcggcgugguggacgccgugggcaccgugagagugauccccaugguggccagcgugggcagcuuccugggcuuccugaccgccaccuuccuggugaucuaccccaacgugagcgaggaggccaaggaggagcagaagggccugagcagcccccuggccggcgagggcagagccggcggcaacagcgagaagcccaccgugcugaagcugaccagaaaggagggccugcagggccccguggagaccgagagacugcaggugcugaccagcgugagaagcagacacaucggcuggugcagaagcugcuggagaguguucuucuucaugaucauccuggagaagaaguucagcuucccccagugcggcagccugagaagaaugaccuaccugcuguuccugagcgagcuggacacccugugccccggccagcccugccccugggccgccaccgcccaccagagcugggaggaggccggccccggcggccugggcagaagacaguaa

SEQ ID NO: 23603 - RNA, 1296 nt, Artificial Sequence
  SLC46A1__Homo_sapiens__NP_001229295
auggagggcagcgccagcccccccgagaagcccagagccagacccgccgccgccgugcugugcagaggccccguggagccccugguguuccuggccaacuucgcccuggugcugcagggcccccugaccacccaguaccuguggcacagauucagcgccgaccugggcuacaacggcaccagacagagaggcggcugcagcaacagaagcgccgaccccaccaugcaggagguggagacccugaccagccacuggacccuguacaugaacgugggcggcuuccuggugggccuguucagcagcacccugcugggcgccuggagcgacagcgugggcagaagaccccugcuggugcuggccagccugggccugcugcugcaggcccuggugagcguguucguggugcagcugcagcugcacgugggcuacuucgugcugggcagaauccugugcgcccugcugggcgacuucggcggccugcuggccgccagcuucgccagcguggccgacgugagcagcagcagaagcagaaccuucagaauggcccugcuggaggccagcaucggcguggccggcaugcuggccagccugcugggcggccacuggcugagagcccagggcuacgccaaccccuucuggcuggcccuggcccugcugaucgccaugacccuguacgccgccuucugcuucggcgagacccugaaggagcccaagagcaccagacuguucaccuucagacaccacagaagcaucgugcagcuguacguggcccccgcccccgagaagagcagaaagcaccuggcccuguacagccuggccaucuucguggugaucaccgugcacuucggcgcccaggacauccugacccuguacgagcugagcaccccccugugcugggacagcaagcugaucggcuacggcagcgccgcccagcaccugcccuaccugaccagccugcuggcccugaagcugcugcaguacugccuggccgacgccuggguggccgagaucggccuggccuucaacauccugggcauggugguguucgccuucgccaccaucaccccccugauguucaccggcgcccuguucagcgccguggccugcgugaacagccuggccaugcugaccgccagcggcaucuucaacagccuguaccccgccacccugaacuucaugaagggcuuccccuuccugcugggcgccggccugcugcugauccccgccgugcugaucggcaugcuggagaaggccgacccccaccuggaguuccagcaguucccccagagccccuaa

SEQ ID NO: 23604 - RNA, 1428 nt, Artificial Sequence
  SLC46A2__Homo_sapiens__NP_149040
augagccccgaggugaccugccccagaagaggccaccugcccagauuccaccccagaaccuggguggagcccgugguggccagcagccagguggccgccagccuguacgacgccggccugcugcugguggugaaggccagcuacggcaccggcggcagcagcaaccacagcgccagccccagccccagaggcgcccuggaggaccagcagcagagagccaucagcaacuucuacaucaucuacaaccugguggugggccugagcccccugcugagcgccuacggccugggcuggcugagcgacagauaccacagaaagaucagcaucugcaugagccugcugggcuuccugcugagcagacugggccugcugcugaaggugcugcuggacuggcccguggaggugcuguacggcgccgccgcccugaacggccuguucggcggcuucagcgccuucuggagcggcgugauggcccugggcagccugggcagcagcgagggcagaagaagcgugagacugauccugaucgaccugaugcugggccuggccggcuucugcggcagcauggccagcggccaccuguucaagcagauggccggccacagcggccagggccugauccugaccgccugcagcgugagcugcgccagcuucgcccugcuguacagccugcuggugcugaaggugcccgagagcguggccaagcccagccaggagcugcccgccguggacaccgugagcggcaccgugggcaccuacagaacccuggaccccgaccagcuggaccagcaguacgccgugggccacccccccagccccggcaaggccaagccccacaagaccaccaucgcccugcuguucgugggcgccaucaucuacgaccuggccguggugggcaccguggacgugaucccccuguucgugcugagagagccccugggcuggaaccaggugcaggugggcuacggcauggccgccggcuacaccaucuucaucaccagcuuccugggcgugcugguguucagcagaugcuucagagacaccaccaugaucaugaucggcauggugagcuucggcagcggcgcccugcugcuggccuucgugaaggagaccuacauguucuacaucgccagagccgugaugcuguucgcccugauccccgugaccaccaucagaagcgccaugagcaagcugaucaagggcagcagcuacggcaagguguucgugauccugcagcugagccuggcccugaccggcguggugaccagcacccuguacaacaagaucuaccagcugaccauggacauguucgugggcagcugcuucgcccugagcagcuuccugagcuuccuggccaucauccccaucagcaucguggccuacaagcaggugccccugagccccuacggcgacaucaucgagaaguaa

SEQ ID NO: 23605 - RNA, 1713 nt, Artificial Sequence
  SLC47A1__Homo_sapiens__NP_060712
auggaggcccccgaggagcccgcccccgugagaggcggccccgaggccacccuggaggugagaggcagcagaugccugagacugagcgccuucagagaggagcugagagcccugcuggugcuggccggccccgccuuccuggugcagcugaugguguuccugaucagcuucaucagcagcguguucugcggccaccugggcaagcuggagcuggacgccgugacccuggccaucgccgugaucaacgugaccggcgugagcgugggcuucggccugagcagcgccugcgacacccugaucagccagaccuacggcagccagaaccugaagcacgugggcgugauccugcagagaagcgcccuggugcugcugcugugcugcuuccccugcugggcccuguuccugaacacccagcacauccugcugcuguucagacaggaccccgacgugagcagacugacccagaccuacgugaccaucuucauccccgcccugcccgccaccuuccuguacaugcugcaggugaaguaccugcugaaccagggcaucgugcugccccagaucgugaccggcguggccgccaaccuggugaacgcccuggccaacuaccuguuccugcaccagcugcaccugggcgugaucggcagcgcccuggccaaccugaucagccaguacacccuggcccugcugcuguuccuguacauccugggcaagaagcugcaccaggccaccuggggcggcuggagccuggagugccugcaggacugggccagcuuccugagacuggccauccccagcaugcugaugcugugcauggaguggugggccuacgaggugggcagcuuccugagcggcauccugggcaugguggagcugggcgcccagagcaucguguacgagcuggccaucaucguguacauggugcccgccggcuucagcguggccgccagcgugagagugggcaacgcccugggcgccggcgacauggagcaggccagaaagagcagcaccgugagccugcugaucaccgugcuguucgccguggccuucagcgugcugcugcugagcugcaaggaccacgugggcuacaucuucaccaccgacagagacaucaucaaccugguggcccagguggugcccaucuacgccgugagccaccuguucgaggcccuggccugcaccagcggcggcgugcugagaggcagcggcaaccagaaggugggcgccaucgugaacaccaucggcuacuacguggugggccugcccaucggcaucgcccugauguucgccaccacccugggcgugaugggccuguggagcggcaucaucaucugcaccguguuccaggccgugugcuuccugggcuucaucauccagcugaacuggaagaaggccugccagcaggcccaggugcacgccaaccugaaggugaacaacgugcccagaagcggcaacagcgcccugccccaggacccccugcaccccggcugccccgagaaccuggagggcauccugaccaacgacgugggcaagaccggcgagccccagagcgaccagcagaugagacaggaggagccccugcccgagcacccccaggacggcgccaagcugagcagaaagcagcuggugcugagaagaggccugcugcugcugggcguguuccugauccugcuggugggcauccuggugagauucuacgugagaauccaguaa

SEQ ID NO: 23606 - RNA, 441 nt, Artificial Sequence
  SLC48A1__Homo_sapiens__NP_060312
auggcccccagcagacugcagcugggccugagagccgccuacagcggcaucagcagcguggccggcuucagcaucuuccugguguggaccgugguguacagacagcccggcaccgccgccaugggcggccuggccggcgugcuggcccugugggugcuggugacccacgugauguacaugcaggacuacuggagaaccuggcugaagggccugagaggcuucuucuucgugggcgugcuguucagcgccgugagcaucgccgccuucugcaccuuccuggugcuggccaucaccagacaccagagccugaccgaccccaccagcuacuaccugagcagcguguggagcuucaucagcuucaagugggccuuccugcugagccuguacgcccacagauacagagccgacuucgccgacaucagcauccugagcgacuucuaa

SEQ ID NO: 23607 - RNA, 3357 nt, Artificial Sequence
  SLC4A10__Homo_sapiens__NP_001171486
auggagaucaaggaccagggcgcccagauggagccccugcugcccaccagaaacgacgaggaggccgugguggacagaggcggcaccagaagcauccugaagacccacuucgagaaggaggaccuggagggccacagaacccuguucaucggcgugcacgugccccugggcggcagaaagagccacagaagacacagacacagaggccacaagcacagaaagagagacagagagagagacagcggccuggaggacggcagagagagccccagcuucgacacccccagccagagagugcaguucauccugggcaccgaggacgacgacgaggagcacaucccccacgaccuguucaccgagcuggacgagaucugcuggagagagggcgaggacgccgaguggagagagaccgccagauggcugaaguucgaggaggacguggaggacggcggcgagagauggagcaagcccuacguggccacccugagccugcacagccuguucgagcugagaagcugcauccugaacggcaccgugcugcuggacaugcacgccaacacccuggaggagaucgccgacauggugcuggaccagcaggugagcagcggccagcugaacgaggacgugagacacagagugcacgaggcccugaugaagcagcaccaccaccagaaccagaagaagcugaccaacagaauccccaucgugagaagcuucgccgacaucggcaagaagcagagcgagcccaacagcauggacaagaacgccggccagguggugagcccccagagcgcccccgccugcguggagaacaagaacgacgugagcagagagaacagcaccguggacuucagcaagggccugggcggccagcagaagggccacaccagccccugcggcaugaagcagagacacgagaagggccccccccaccagcaggagagagagguggaccugcacuucaugaagaagaucccccccggcgccgaggccagcaacauccuggugggcgagcuggaguuccuggacagaaccgugguggccuucgugagacugagccccgccgugcugcugcagggccuggccgaggugcccauccccaccagauuccuguucauccugcugggcccccugggcaagggccagcaguaccacgagaucggcagaagcaucgccacccugaugaccgacgagguguuccacgacguggccuacaaggccaaggacagaaacgaccuggugagcggcaucgacgaguuccuggaccaggugaccgugcugccccccggcgagugggaccccagcaucagaaucgagccccccaagaacgugcccagccaggagaagagaaagauccccgccgugcccaacggcaccgccgcccacggcgaggccgagccccacggcggccacagcggccccgagcugcagagaaccggcagaaucuucggcggccugauccuggacaucaagagaaaggcccccuacuucuggagcgacuucagagacgccuucagccugcagugccuggccagcuuccuguuccuguacugcgccugcaugagccccgugaucaccuucggcggccugcugggcgaggccaccgagggcagaaucagcgccaucgagagccuguucggcgccagcaugaccggcaucgccuacagccuguucggcggccagccccugaccauccugggcagcaccggccccgugcugguguucgagaagauccuguucaaguucugcaaggaguacggccugagcuaccugagccugagagccagcaucggccuguggaccgccacccugugcaucauccugguggccaccgacgccagcagccuggugugcuacaucaccagauucaccgaggaggccuucgccagccugaucugcaucaucuucaucuacgaggcccuggagaagcuguucgagcugagcgaggccuaccccaucaacaugcacaacgaccuggagcugcugacccaguacagcugcaacugcguggagccccacaaccccagcaacggcacccugaaggaguggagagagagcaacaucagcgccagcgacaucaucugggagaaccugaccgugagcgagugcaagagccugcacggcgaguacgugggcagagccugcggccacgaccaccccuacgugcccgacgugcuguucuggagcgugauccuguucuucagcaccgugacccugagcgccacccugaagcaguucaagaccagcagauacuuccccaccaaggugagaagcaucgugagcgacuucgccguguuccugaccauccugugcauggugcugaucgacuacgccaucggcauccccagccccaagcugcaggugcccagcguguucaagcccaccagagacgacagaggcugguucgugaccccccugggccccaaccccugguggaccgugaucgccgccaucauccccgcccugcugugcaccauccugaucuucauggaccagcagaucaccgccgugaucaucaacagaaaggagcacaagcugaagaagggcugcggcuaccaccuggaccugcugaugguggccgugaugcugggcgugugcagcaucaugggccugcccugguucguggccgccaccgugcugagcaucacccacgugaacagccugaagcuggagagcgagugcagcgcccccggcgagcagcccaaguuccugggcaucagagagcagagagugaccggccugaugaucuucauccugaugggcagcagcguguucaugaccagcauccugaaguucauccccaugcccgugcuguacggcguguuccuguacaugggcgccagcagccugaagggcauccaguucuucgacagaaucaagcuguucuggaugcccgccaagcaccagcccgacuucaucuaccugagacacgugccccugagaaaggugcaccuguucaccaucauccagaugagcugccugggccugcuguggaucaucaaggugagcagagccgccaucguguuccccaugauggugcuggcccugguguucgugagaaagcugauggaccugcuguucaccaagagagagcugagcuggcuggacgaccugaugcccgagagcaagaagaagaagcuggaggacgccgagaaggaggaggagcagagcaugcuggccauggaggacgagggcaccgugcagcugccccuggagggccacuacagagacgaccccagcgugaucaacaucagcgacgagaugagcaagaccgcccuguggagaaaccugcugaucaccgccgacaacagcaaggacaaggagagcagcuuccccagcaagagcagccccagcuaa

SEQ ID NO: 23608 - RNA, 2628 nt, Artificial Sequence
  SLC4A11__Homo_sapiens__NP_001167560
auggccgccgccaccagaagaguguuccaccugcagcccugcgagaacagccccaccaugagccagaacggcuacuucgaggacagcagcuacuacaagugcgacaccgacgacaccuucgaggccagagaggagauccugggcgacgaggccuucgacaccgccaacagcagcaucgugagcggcgagagcaucagauucuucgugaacgugaaccuggagaugcaggccaccaacaccgagaacgaggccaccagcggcggcugcgugcugcugcacaccagcagaaaguaccugaagcugaagaacuucaaggaggagaucagagcccacagagaccuggacggcuuccuggcccaggccagcaucgugcugaacgagaccgccaccagccuggacaacgugcugagaaccaugcugagaagauucgccagagaccccgacaacaacgagcccaacugcaaccuggaccugcugauggccaugcuguucaccgacgccggcgcccccaugagaggcaaggugcaccugcugagcgacaccauccagggcgugaccgccaccgugaccggcgugagauaccagcagagcuggcugugcaucaucugcaccaugaaggcccugcagaagagacacgugugcaucagcagacuggugagaccccagaacuggggcgagaacagcugcgaggugagauucgugauccuggugcuggccccccccaagaugaagagcaccaagaccgccauggagguggccagaaccuucgccaccauguucagcgacaucgccuucagacagaagcugcuggagaccagaaccgaggaggaguucaaggaggcccuggugcaccagagacagcugcugaccauggugagccacggccccguggcccccagaaccaaggagagaagcaccgugagccugcccgcccacagacaccccgagccccccaagugcaaggacuucgugcccuucggcaagggcaucagagaggacaucgccagaagauucccccuguacccccuggacuucaccgacggcaucaucggcaagaacaaggccgugggcaaguacaucaccaccacccuguuccuguacuucgccugccugcugcccaccaucgccuucggcagccugaacgacgagaacaccgacggcgccaucgacgugcagaagaccaucgccggccagagcaucggcggccugcuguacgcccuguucagcggccagccccuggugauccugcugaccaccgccccccuggcccuguacauccaggugaucagagugaucugcgacgacuacgaccuggacuucaacagcuucuacgccuggaccggccuguggaacagcuucuuccuggcccuguacgccuucuucaaccugagccuggugaugagccuguucaagagaagcaccgaggagaucaucgcccuguucaucagcaucaccuucgugcuggacgccgugaagggcaccgugaagaucuucuggaaguacuacuacggccacuaccuggacgacuaccacaccaagagaaccagcagccuggugagccugagcggccugggcgccagccugaacgccagccugcacaccgcccugaacgccagcuuccuggccagccccaccgagcugcccagcgccacccacagcggccaggccaccgccgugcugagccugcugaucaugcugggcacccuguggcugggcuacacccuguaccaguucaagaagagccccuaccugcaccccugcgugagagagauccugagcgacugcgcccugcccaucgccgugcuggccuucagccugaucagcagccacggcuucagagagaucgagaugagcaaguucagauacaaccccagcgagagccccuucgccauggcccagauccagagccugagccugagagccgugagcggcgccaugggccugggcuuccugcugagcaugcuguucuucaucgagcagaaccugguggccgcccuggugaacgcccccgagaacagacuggugaagggcaccgccuaccacugggaccugcugcugcuggccaucaucaacaccggccugagccuguucggccugcccuggauccacgccgccuacccccacagcccccugcacgugagagcccuggcccugguggaggagagaguggagaacggccacaucuacgacaccaucgugaacgugaaggagaccagacugaccagccugggcgccagcgugcuggugggccugagccugcugcugcugcccgugccccugcaguggauccccaagcccgugcuguacggccuguuccuguacaucgcccugaccagccuggacggcaaccagcuggugcagagaguggcccugcugcugaaggagcagaccgccuacccccccacccacuacaucagaagagugccccagagaaagauccacuacuucaccggccugcaggugcugcagcugcugcugcugugcgccuucggcaugagcagccugcccuacaugaagaugaucuucccccugaucaugaucgccaugauccccaucagauacauccugcugcccagaaucaucgaggccaaguaccuggacgugauggacgccgagcacagacccuaa

SEQ ID NO: 23609 - RNA, 2391 nt, Artificial Sequence
  SLC4A1AP__Homo_sapiens__NP_060628
augcuggccccccugagaaacgcccccggcagagagggcgccaccagccccagcccccccaccgacgccaccggcagccugggcgagugggacguggacagaaacgugaagaccgagggcugggugagcaaggagagaaucagcaagcugcacagacugagaauggccgacauccugagccagagcgagacccuggccagccaggaccugagcggcgacuucaagaagcccgcccugcccgugagccccgccgccagaagcaaggcccccgccagcagcagcagcaaccccgaggaggugcagaaggagggccccaccgcccugcaggacagcaacagcggcgagcccgacaucccccccccccagcccgacugcggcgacuucagaagccugcaggaggagcagagcagaccccccaccgccgugagcagccccggcggccccgccagagccccccccuaccaggagccccccuggggcggccccgccaccgcccccuacagccuggagacccugaagggcggcaccauccugggcaccagaagccugaagggcaccagcuacugccuguucggcagacugagcggcugcgacgugugccuggagcaccccagcgugagcagauaccacgccgugcugcagcacagagccagcggccccgacggcgagugcgacagcaacggccccggcuucuaccuguacgaccugggcagcacccacggcaccuuccugaacaagaccagaaucccccccagaaccuacugcagagugcacgugggccacguggugagauucggcggcagcaccagacuguucauccugcagggccccgaggaggacagagaggccgagagcgagcugaccgugacccagcugaaggagcugagaaagcagcagcagauccugcuggagaagaagaugcugggcgaggacagcgacgaggaggaggagauggacaccagcgagagaaagaucaacgccggcagccaggacgacgagaugggcugcaccuggggcaugggcgaggacgccguggaggacgacgccgaggagaaccccaucgugcuggaguuccagcaggagagagaggccuucuacaucaaggaccccaagaaggcccugcagggcuucuucgacagagagggcgaggagcuggaguacgaguucgacgagcagggccacagcaccuggcugugcagagugagacugcccguggacgacagcaccggcaagcagcugguggccgaggccauccacagcggcaagaagaaggaggccaugauccagugcagccuggaggccugcagaauccuggacacccugggccugcugagacaggaggccgugagcagaaagagaaaggccaagaacugggaggacgaggacuucuacgacagcgacgacgacaccuuccuggacagaaccggccugaucgagaagaagagacugaacagaaugaagaaggccggcaagaucgacgagaagcccgagaccuucgagagccugguggccaagcugaacgacgccgagagagagcugagcgagaucagcgagagacugaaggccagcagccaggugcugagcgagagccccagccaggacagccuggacgccuucaugagcgagaugaagagcggcagcacccuggacggcgugagcagaaagaagcugcaccugagaaccuucgagcugagaaaggagcagcagagacugaagggccugaucaagaucgugaagcccgccgagauccccgagcugaagaagaccgagacccagaccaccggcgccgagaacaaggccaagaagcugacccugccccuguucggcgccaugaagggcggcagcaaguucaagcugaagaccggcaccgugggcaagcugccccccaagagacccgagcugccccccacccugaugagaaugaaggacgagcccgagguggaggaggaggaggaggaggaggaggaggaggagaaggagaaggaggagcacgagaagaagaagcuggaggacggcagccugagcagaccccagcccgagaucgagcccgaggccgccgugcaggagaugagaccccccaccgaccugacccacuucaaggagacccagacccacgagaacaugagccagcugagcgaggaggagcagaacaaggacuaccaggacugcagcaagaccaccagccugugcgccggccccagcgccagcaagaacgaguacgagaagagcagaggcgagcugaagaagaagaagacccccggccccggcaagcugccccccacccugagcagcaaguaccccgaggacgaccccgacuacugcgugugggugccccccgagggccagagcggcgacggcagaacccaccugaacgacaaguacggcuacuaa

SEQ ID NO: 23610 - RNA, 2736 nt, Artificial Sequence
  SLC4A1__Homo_sapiens__NP_000333
auggaggagcugcaggacgacuacgaggacaugauggaggagaaccuggagcaggaggaguacgaggaccccgacauccccgagagccagauggaggagcccgccgcccacgacaccgaggccaccgccaccgacuaccacaccaccagccaccccggcacccacaagguguacguggagcugcaggagcuggugauggacgagaagaaccaggagcugagauggauggaggccgccagaugggugcagcuggaggagaaccugggcgagaacggcgccuggggcagaccccaccugagccaccugaccuucuggagccugcuggagcugagaagaguguucaccaagggcaccgugcugcuggaccugcaggagaccagccuggccggcguggccaaccagcugcuggacagauucaucuucgaggaccagaucagaccccaggacagagaggagcugcugagagcccugcugcugaagcacagccacgccggcgagcuggaggcccugggcggcgugaagcccgccgugcugaccagaagcggcgaccccagccagccccugcugccccagcacagcagccuggagacccagcuguucugcgagcagggcgacggcggcaccgagggccacagccccagcggcauccuggagaagaucccccccgacagcgaggccacccuggugcuggugggcagagccgacuuccuggagcagcccgugcugggcuucgugagacugcaggaggccgccgagcuggaggccguggagcugcccgugcccaucagauuccuguucgugcugcugggccccgaggccccccacaucgacuacacccagcugggcagagccgccgccacccugaugagcgagagaguguucagaaucgacgccuacauggcccagagcagaggcgagcugcugcacagccuggagggcuuccuggacugcagccuggugcugccccccaccgacgcccccagcgagcaggcccugcugagccuggugcccgugcagagagagcugcugagaagaagauaccagagcagccccgccaagcccgacagcagcuucuacaagggccuggaccugaacggcggccccgacgacccccugcagcagaccggccagcuguucggcggccuggugagagacaucagaagaagauaccccuacuaccugagcgacaucaccgacgccuucagcccccaggugcuggccgccgugaucuucaucuacuucgccgcccugagccccgccaucaccuucggcggccugcugggcgagaagaccagaaaccagaugggcgugagcgagcugcugaucagcaccgccgugcagggcauccuguucgcccugcugggcgcccagccccugcugguggugggcuucagcggcccccugcugguguucgaggaggccuucuucagcuucugcgagaccaacggccuggaguacaucgugggcagaguguggaucggcuucuggcugauccugcugguggugcuggugguggccuucgagggcagcuuccuggugagauucaucagcagauacacccaggagaucuucagcuuccugaucagccugaucuucaucuacgagaccuucagcaagcugaucaagaucuuccaggaccacccccugcagaagaccuacaacuacaacgugcugauggugcccaagccccagggcccccugcccaacaccgcccugcugagccuggugcugauggccggcaccuucuucuucgccaugaugcugagaaaguucaagaacagcagcuacuuccccggcaagcugagaagagugaucggcgacuucggcgugcccaucagcauccugaucauggugcugguggacuucuucauccaggacaccuacacccagaagcugagcgugcccgacggcuucaaggugagcaacagcagcgccagaggcugggugauccacccccugggccugagaagcgaguuccccaucuggaugauguucgccagcgcccugcccgcccugcugguguucauccugaucuuccuggagagccagaucaccacccugaucgugagcaagcccgagagaaagauggugaagggcagcggcuuccaccuggaccugcugcugguggugggcaugggcggcguggccgcccuguucggcaugcccuggcugagcgccaccaccgugagaagcgugacccacgccaacgcccugaccgugaugggcaaggccagcacccccggcgccgccgcccagauccaggaggugaaggagcagagaaucagcggccugcugguggccgugcuggugggccugagcauccugauggagcccauccugagcagaaucccccuggccgugcuguucggcaucuuccuguacaugggcgugaccagccugagcggcauccagcuguucgacagaauccugcugcuguucaagccccccaaguaccaccccgacgugcccuacgugaagagagugaagaccuggagaaugcaccuguucaccggcauccagaucaucugccuggccgugcuguggguggugaagagcacccccgccagccuggcccugcccuucgugcugauccugaccgugccccugagaagagugcugcugccccugaucuucagaaacguggagcugcagugccuggacgccgacgacgccaaggccaccuucgacgaggaggagggcagagacgaguacgacgagguggccaugcccguguaa

SEQ ID NO: 23611 - RNA, 3699 nt, Artificial Sequence
  SLC4A2__Homo_sapiens__NP_001186622
auggacuuccugcugagaccccagcccgagcccgagagccugggccccggcacccccggcuuccccgagcaggaggaggacgagcugcacagaacccugggcguggagagauucgaggagauccugcaggaggccggcagcagaggcggcgaggagcccggcagaagcuacggcgaggaggacuucgaguaccacagacagagcagccaccacauccaccacccccugagcacccaccugccccccgacgccagaagaagaaagaccccccagggccccggcagaaagcccagaagaagacccggcgccagccccaccggcgagacccccaccaucgaggagggcgaggaggacgaggacgaggccagcgaggccgagggcgccagagcccugacccagcccagccccgugagcacccccagcagcgugcaguucuuccugcaggaggacgacagcgccgacagaaaggccgagagaaccagccccagcagccccgccccccugccccaccaggaggccacccccagagccagcaagggcgcccaggccggcacccagguggaggaggccgaggccgaggccguggccguggccagcggcaccgccggcggcgacgacggcggcgccagcggcagaccccugcccaaggcccagcccggccacagaagcuacaaccugcaggagagaagaagaaucggcagcaugaccggcgccgagcaggcccugcugcccagagugcccaccgacgagaucgaggcccagacccuggccaccgccgaccuggaccugaugaagagccacagauucgaggacgugcccggcgugagaagacaccuggugagaaagaacgccaagggcagcacccagagcggcagagagggcagagagcccggccccacccccagagccagacccagagccccccacaagccccacgagguguucguggagcugaacgagcugcugcuggacaagaaccaggagccccaguggagagagaccgccagauggaucaaguucgaggaggacguggaggaggagaccgagagauggggcaagccccacguggccagccugagcuucagaagccugcuggagcugagaagaacccuggcccacggcgccgugcugcuggaccuggaccagcagacccugcccggcguggcccaccaggugguggagcagauggugaucagcgaccagaucaaggccgaggacagagccaacgugcugagagcccugcugcugaagcacagccaccccagcgacgagaaggacuucagcuuccccagaaacaucagcgccggcagccugggcagccugcugggccaccaccacggccagggcgccgagagcgacccccacgugaccgagccccugaugggcggcgugcccgagaccagacuggagguggagagagagagagagcugcccccccccgccccccccgccggcaucaccagaagcaagagcaagcacgagcugaagcugcuggagaagauccccgagaacgccgaggccaccguggugcuggugggcugcguggaguuccugagcagacccaccauggccuucgugagacugagagaggccguggagcuggacgccgugcuggaggugcccgugcccgugagauuccuguuccugcugcugggccccagcagcgccaacauggacuaccacgagaucggcagaagcaucagcacccugaugagcgacaagcaguuccacgaggccgccuaccuggccgacgagagagaggaccugcugaccgccaucaacgccuuccuggacugcagcguggugcugccccccagcgaggugcagggcgaggagcugcugagaagcguggcccacuuccagagacagaugcugaagaagagagaggagcagggcagacugcugcccaccggcgccggccuggagcccaagagcgcccaggacaaggcccugcugcagaugguggaggccgccggcgccgccgaggacgacccccugagaagaaccggcagacccuucggcggccugaucagagacgugagaagaagauacccccacuaccugagcgacuucagagacgcccuggacccccagugccuggccgccgugaucuucaucuacuucgccgcccugagccccgccaucaccuucggcggccugcugggcgagaagacccaggaccugaucggcgugagcgagcugaucaugagcaccgcccugcagggcgugguguucugccugcugggcgcccagccccugcuggugaucggcuucagcggcccccugcugguguucgaggaggccuucuucagcuucugcagcagcaaccaccuggaguaccuggugggcagaguguggaucggcuucuggcugguguuccuggcccugcugaugguggcccuggagggcagcuuccuggugagauucgugagcagauucacccaggagaucuucgccuuccugaucagccugaucuucaucuacgagaccuucuacaagcuggugaagaucuuccaggagcacccccugcacggcugcagcgccagcaacagcagcgagguggacggcggcgagaacaugaccugggccggcgccagacccacccugggccccggcaacagaagccuggccggccagagcggccagggcaagcccagaggccagcccaacaccgcccugcugagccuggugcugauggccggcaccuucuucaucgccuucuuccugagaaaguucaagaacagcagauucuuccccggcagaaucagaagagugaucggcgacuucggcgugcccaucgccauccugaucauggugcugguggacuacagcaucgaggacaccuacacccagaagcugagcgugcccagcggcuucagcgugaccgcccccgagaagagaggcugggugaucaacccccugggcgagaagagccccuuccccguguggaugaugguggccagccugcugcccgccauccugguguucauccugaucuucauggagacccagaucaccacccugaucaucagcaagaaggagagaaugcugcagaagggcagcggcuuccaccuggaccugcugcugaucguggccaugggcggcaucugcgcccuguucggccugcccuggcuggccgccgccaccgugagaagcgugacccacgccaacgcccugaccgugaugagcaaggccguggcccccggcgacaagcccaagauccaggaggugaaggagcagagagugaccggccugcugguggcccugcuggugggccugagcaucgugaucggcgaccugcugagacagaucccccuggccgugcuguucggcaucuuccuguacaugggcgugaccagccugaacggcauccaguucuacgagagacugcaccugcugcugaugccccccaagcaccaccccgacgugaccuacgugaagaaggugagaacccugagaaugcaccuguucaccgcccugcagcugcugugccuggcccugcugugggccgugaugagcaccgccgccagccuggccuuccccuucauccugauccugaccgugccccugagaaugguggugcugaccagaaucuucaccgacagagagaugaagugccuggacgccaacgaggccgagcccguguucgacgagagagagggcguggacgaguacaacgagaugcccaugcccguguaa

SEQ ID NO: 23612 - RNA, 3699 nt, Artificial Sequence
  SLC4A3__Homo_sapiens__NP_005061
auggccaacggcgugauccccccccccggcggcgccagcccccugccccaggugagagugccccuggaggagcccccccugagccccgacguggaggaggaggacgacgaccugggcaagacccuggccgugagcagauucggcgaccugaucagcaagccccccgccugggaccccgagaagcccagcagaagcuacagcgagagagacuucgaguuccacagacacaccagccaccacacccaccacccccugagcgccagacugccccccccccacaagcugagaagacugccccccaccagcgccagacacaccagaagaaagagaaagaaggagaagaccagcgccccccccagcgagggcaccccccccauccaggaggagggcggcgccggcguggacgaggaggaggaggaggaggaggaggaggagggcgagagcgaggccgagcccguggagcccccccccagcggcaccccccagaaggccaaguucagcaucggcagcgacgaggacgacagccccggccugcccggcagagccgccgugaccaagccccugcccagcgugggcccccacaccgacaagagcccccagcacagcagcagcagccccagccccagagccagagccagcagacuggccggcgagaagagcagacccuggagccccagcgccagcuacgaccugagagagagacugugccccggcagcgcccugggcaaccccggcggccccgagcagcaggugcccaccgacgaggccgaggcccagaugcugggcagcgccgaccuggacgacaugaagagccacagacuggaggacaaccccggcgugagaagacaccuggugaagaagcccagcagaacccagggcggcagaggcagccccagcggccuggcccccauccugagaagaaagaagaagaagaagaagcuggacagaagaccccacgagguguucguggagcugaacgagcugaugcuggacagaagccaggagccccacuggagagagaccgccagauggaucaaguucgaggaggacguggaggaggagaccgagagauggggcaagccccacguggccagccugagcuucagaagccugcuggagcugagaagaaccaucgcccacggcgccgcccugcuggaccuggagcagaccacccugcccggcaucgcccaccuggugguggagaccaugaucgugagcgaccagaucagacccgaggacagagccagcgugcugagaacccugcugcugaagcacagccaccccaacgacgacaaggacagcggcuucuuccccagaaaccccagcagcagcagcaugaacagcgugcugggcaaccaccaccccacccccagccacggccccgacggcgccgugcccaccauggccgacgaccugggcgagcccgccccccuguggccccacgaccccgacgccaaggagaagccccugcacaugcccggcggcgacggccacagaggcaagagccugaagcugcuggagaagauccccgaggacgccgaggccaccguggugcuggugggcugcgugcccuuccuggagcagcccgccgccgccuucgugagacugaacgaggccgugcugcuggagagcgugcuggaggugcccgugcccgugagauuccuguucgugaugcugggccccagccacaccagcaccgacuaccacgagcugggcagaagcaucgccacccugaugagcgacaagcuguuccacgaggccgccuaccaggccgacgacagacaggaccugcugagcgccaucagcgaguuccuggacggcagcaucgugaucccccccagcgagguggagggcagagaccugcugagaagcguggccgccuuccagagagagcugcugagaaagagaagagagagagagcagaccaagguggagaugaccaccagaggcggcuacaccgcccccggcaaggagcugagccuggagcugggcggcagcgaggccacccccgaggacgacccccugcugagaaccggcagcguguucggcggccuggugagagacgugagaagaagauacccccacuaccccagcgaccugagagacgcccugcacagccagugcguggccgccgugcuguucaucuacuucgccgcccugagccccgccaucaccuucggcggccugcugggcgagaagaccgagggccugaugggcgugagcgagcugaucgugagcaccgccgugcugggcgugcuguucagccugcugggcgcccagccccugcugguggugggcuucagcggcccccugcugguguucgaggaggccuucuucaaguucugcagagcccaggaccuggaguaccugaccggcagagugugggugggccuguggcuggugguguucgugcuggcccugguggccgccgagggcagcuuccuggugagauacaucagccccuucacccaggagaucuucgccuuccugaucagccugaucuucaucuacgagaccuucuacaagcuguacaagguguucaccgagcacccccugcugcccuucuacccccccgagggcgcccuggagggcagccuggacgccggccuggagcccaacggcagcgcccugccccccaccgagggcccccccagccccagaaaccagcccaacaccgcccugcugagccugauccugaugcugggcaccuucuucaucgccuucuuccugagaaaguucagaaacagcagauuccugggcggcaaggccagaagaaucaucggcgacuucggcauccccaucagcauccuggugauggugcugguggacuacagcaucaccgacaccuacacccagaagcugaccgugcccaccggccugagcgugaccagccccgacaagagaagcugguucauccccccccugggcagcgccagacccuucccccccuggaugaugguggccgccgccgugcccgcccugcuggugcugauccugaucuucauggagacccagaucaccgcccugaucgugagccagaaggccagaagacugcugaagggcagcggcuuccaccuggaccugcugcugaucggcagccugggcggccugugcggccuguucggccugcccuggcugaccgccgccaccgugagaagcgugacccacgugaacgcccugaccgugaugagaaccgccaucgcccccggcgacaagccccagauccaggaggugagagagcagagagugaccggcgugcugaucgccagccuggugggccugagcaucgugaugggcgccgugcugagaagaaucccccuggccgugcuguucggcaucuuccuguacaugggcgugaccagccugagcggcauccagcugagccagagacugcugcugauccugaugcccgccaagcaccaccccgagcagcccuacgugaccaaggugaagaccuggagaaugcaccuguucaccugcauccagcugggcugcaucgcccugcuguggguggugaagagcaccgccgccagccuggccuuccccuuccugcugcugcugaccgugccccugagacacugccugcugcccagacuguuccaggacagagagcugcaggcccuggacagcgaggacgccgagcccaacuucgacgaggacggccaggacgaguacaacgagcugcacaugcccguguaa

SEQ ID NO: 23613 - RNA, 3240 nt, Artificial Sequence
  SLC4A4__Homo_sapiens__NP_001091954
auggaggacgaggccgugcuggacagaggcgccagcuuccugaagcacgugugcgacgaggaggagguggagggccaccacaccaucuacaucggcgugcacgugcccaagagcuacagaagaagaagaagacacaagagaaagaccggccacaaggagaagaaggagaaggagagaaucagcgagaacuacagcgacaagagcgacaucgagaacgccgacgagagcagcagcagcauccugaagccccugaucagccccgccgccgagagaaucagauucauccugggcgaggaggacgacagccccgcccccccccagcuguucaccgagcuggacgagcugcuggccguggacggccaggagauggaguggaaggagaccgccagauggaucaaguucgaggagaagguggagcagggcggcgagagauggagcaagccccacguggccacccugagccugcacagccuguucgagcugagaaccugcauggagaagggcagcaucaugcuggacagagaggccagcagccugccccagcugguggagaugaucguggaccaccagaucgagaccggccugcugaagcccgagcugaaggacaaggugaccuacacccugcugagaaagcacagacaccagaccaagaagagcaaccugagaagccuggccgacaucggcaagaccgugagcagcgccagcagaauguucaccaaccccgacaacggcagccccgccaugacccacagaaaccugaccagcagcagccugaacgacaucagcgacaagcccgagaaggaccagcugaagaacaaguucaugaagaagcugcccagagacgccgaggccagcaacgugcuggugggcgagguggacuuccuggacacccccuucaucgccuucgugagacugcagcaggccgugaugcugggcgcccugaccgaggugcccgugcccaccagauuccuguucauccugcugggccccaagggcaaggccaagagcuaccacgagaucggcagagccaucgccacccugaugagcgacgagguguuccacgacaucgccuacaaggccaaggacagacacgaccugaucgccggcaucgacgaguuccuggacgaggugaucgugcugccccccggcgagugggaccccgccaucagaaucgagccccccaagagccugcccagcagcgacaagagaaagaacauguacagcggcggcgagaacgugcagaugaacggcgacaccccccacgacggcggccacggcggcggcggccacggcgacugcgaggagcugcagagaaccggcagauucugcggcggccugaucaaggacaucaagagaaaggcccccuucuucgccagcgacuucuacgacgcccugaacauccaggcccugagcgccauccuguucaucuaccuggccaccgugaccaacgccaucaccuucggcggccugcugggcgacgccaccgacaacaugcagggcgugcuggagagcuuccugggcaccgccgugagcggcgccaucuucugccuguucgccggccagccccugaccauccugagcagcaccggccccgugcugguguucgagagacugcuguucaacuucagcaaggacaacaacuucgacuaccuggaguucagacuguggaucggccuguggagcgccuuccugugccugauccugguggccaccgacgccagcuuccuggugcaguacuucaccagauucaccgaggagggcuucagcagccugaucagcuucaucuucaucuacgacgccuucaagaagaugaucaagcuggccgacuacuaccccaucaacagcaacuucaaggugggcuacaacacccuguucagcugcaccugcgugccccccgaccccgccaacaucagcaucagcaacgacaccacccuggcccccgaguaccugcccaccaugagcagcaccgacauguaccacaacaccaccuucgacugggccuuccugagcaagaaggagugcagcaaguacggcggcaaccuggugggcaacaacugcaacuucgugcccgacaucacccugaugagcuucauccuguuccugggcaccuacaccagcagcauggcccugaagaaguucaagaccagccccuacuuccccaccaccgccagaaagcugaucagcgacuucgccaucauccugagcauccugaucuucugcgugaucgacgcccuggugggcguggacacccccaagcugaucgugcccagcgaguucaagcccaccagccccaacagaggcugguucgugccccccuucggcgagaaccccuggugggugugccuggccgccgccauccccgcccugcuggugaccauccugaucuucauggaccagcagaucaccgccgugaucgugaacagaaaggagcacaagcugaagaagggcgccggcuaccaccuggaccuguucuggguggccauccugauggugaucugcagccugauggcccugcccugguacguggccgccaccgugaucagcaucgcccacaucgacagccugaagauggagaccgagaccagcgcccccggcgagcagcccaaguuccugggcgugagagagcagagagugaccggcacccugguguucauccugaccggccugagcguguucauggcccccauccugaaguucauccccaugcccgugcuguacggcguguuccuguacaugggcguggccagccugaacggcgugcaguucauggacagacugaagcugcugcugaugccccugaagcaccagcccgacuucaucuaccugagacacgugccccugagaagagugcaccuguucaccuuccugcaggugcugugccuggcccugcuguggauccugaagagcaccguggccgccaucaucuuccccgugaugauccuggcccugguggccgugagaaagggcauggacuaccuguucagccagcacgaccugagcuuccuggacgacgugauccccgagaaggacaagaagaagaaggaggacgagaagaagaagaagaagaagaagggcagccuggacagcgacaacgacgacagcgacugccccuacagcgagaaggugcccagcaucaagauccccauggacaucauggagcagcagcccuuccugagcgacagcaagcccagcgacagagagagaagccccaccuuccuggagagacacaccagcugcuaa

SEQ ID NO: 23614 - RNA, 3414 nt, Artificial Sequence
  SLC4A5__Homo_sapiens__NP_067019
augaaggugaaggaggagaaggccggcgugggcaagcuggaccacaccaaccacagaagaagauuccccgaccagaaggagugcccccccauccacaucggccugcccgugcccaccuacccccagagaaagaccgaccagaagggccaccugagcggccugcagaaggugcacuggggccugagacccgaccagccccagcaggagcugaccggccccggcagcggcgccagcagccaggacagcagcauggaccugaucagcagaaccagaagccccgccgccgagcagcugcaggacauccugggcgaggaggacgaggcccccaaccccacccuguucaccgagauggacacccugcagcacgacggcgaccagauggaguggaaggagagcgccagauggaucaaguucgaggagaagguggaggagggcggcgagagauggagcaagccccacgugagcacccugagccugcacagccuguucgagcugagaaccugccugcagaccggcaccgugcugcuggaccuggacagcggcagccugccccagaucaucgacgacgugaucgagaagcagaucgaggacggccugcugagacccgagcugagagagagagugagcuacgugcugcugagaagacacagacaccagaccaagaagcccauccacagaagccuggccgacaucggcaagagcgugagcaccaccaacagaagccccgccagaagccccggcgccggccccagccugcaccacagcaccgaggaccugagaaugagacagagcgccaacuacggcagacugugccacgcccagagcagaagcaugaacgacaucagccugacccccaacaccgaccagagaaagaacaaguucaugaagaagauccccaaggacagcgaggccagcaacgugcuggugggcgagguggacuuccuggaccagcccuucaucgccuucgugagacugauccagagcgccaugcugggcggcgugaccgaggugcccgugcccaccagauuccuguucauccugcugggccccagcggcagagccaagagcuacaacgagaucggcagagccaucgccacccugaugguggacgaccuguucagcgacguggccuacaaggccagaaacagagaggaccugaucgccggcaucgacgaguuccuggacgaggugaucgugcugccccccggcgagugggaccccaacaucagaaucgagccccccaagaaggugcccagcgccgacaagagaaagagcguguucagccuggccgagcugggccagaugaacggcagcgugggcggcggcggcggcgcccccggcggcggcaacggcggcggcggcggcggcggcagcggcggcggcgccggcagcggcggcgccggcggcaccagcagcggcgacgacggcgagaugcccgccaugcacgagaucggcgaggagcugaucuggaccggcagauucuucggcggccugugccuggacaucaagagaaagcugcccugguuccccagcgacuucuacgacggcuuccacauccagagcaucagcgccauccuguucaucuaccugggcugcaucaccaacgccaucaccuucggcggccugcugggcgacgccaccgacaacuaccagggcgugauggagagcuuccugggcaccgccauggccggcagccuguucugccuguucagcggccagccccugaucauccugagcagcaccggccccauccugaucuucgagaagcugcuguucgacuucagcaagggcaacggccuggacuacauggaguucagacuguggaucggccugcacagcgccgugcagugccugauccugguggccaccgacgccagcuucaucaucaaguacaucaccagauucaccgaggagggcuucagcacccugaucagcuucaucuucaucuacgacgccaucaagaagaugaucggcgccuucaaguacuaccccaucaacauggacuucaagcccaacuucaucaccaccuacaagugcgagugcguggcccccgacaccgugaacaccaccguguucaacgccagcgccccccuggcccccgacaccaacgccagccuguacaaccugcugaaccugaccgcccuggacuggagccugcugagcaagaaggagugccugagcuacggcggcagacugcugggcaacagcugcaaguucauccccgaccuggcccugaugagcuucauccuguucuucggcaccuacagcaugacccugacccugaagaaguucaaguucagcagauacuuccccaccaaggugagagcccugguggccgacuucagcaucguguucagcauccugauguucugcggcaucgacgccugcuucggccuggagacccccaagcugcacgugcccagcgugaucaagcccaccagacccgacagaggcugguucguggcccccuucggcaagaaccccugguggguguaccccgccagcauccugcccgcccugcuggugaccauccugaucuucauggaccagcagaucaccgccgugaucgugaacagaaaggagaacaagcugaagaaggccgccggcuaccaccuggaccuguucugggugggcauccugauggcccugugcagcuucaugggccugcccugguacguggccgccaccgugaucagcaucgcccacaucgacagccugaagauggagaccgagaccagcgcccccggcgagcagccccaguuccugggcgugagagagcagagagugaccggcaucaucguguucauccugaccggcaucagcguguuccuggcccccauccugaagugcaucccccugcccgugcuguacggcguguuccuguacaugggcguggccagccugaacggcauccagaugggcaccggcggcagcgaguucaagauccagaagaagcugacccccuucugggagagaugcaagcuguuccugaugcccgccaagcaccagcccgaccacgccuuccugagacacgugccccugagaagaauccaccuguucacccuggugcagauccugugccuggccgugcuguggauccugaagagcaccguggccgccaucaucuuccccgugaugauccugggccugaucaucgugagaagacugcuggacuucaucuucagccagcacgaccuggccuggaucgacaacauccugcccgagaaggagaagaaggagaccgacaagaagagaaagagaaagaagggcgcccacgaggacugcgacgaggagccccaguuccccccccccagcgugaucaagauccccauggagagcgugcagagcgacccccagaacggcauccacugcaucgccagaaagagaagcagcagcuggagcuacagccuguaa

SEQ ID NO: 23615 - RNA, 3396 nt, Artificial Sequence
  SLC4A7__Homo_sapiens__NP_001245308
auggaggccgacggcgccggcgagcagaugagaccccugcugaccagaggccccgacgaggaggccgugguggaccugggcaagaccagcagcaccgugaacaccaaguucgagaaggaggagcuggagagccacagagccguguacaucggcgugcacgugcccuucagcaaggagagcagaagaagacacagacacagaggccacaagcaccaccacagaagaagaaaggacaaggagagcgacaaggaggacggcagagagagccccagcuacgacacccccagccagagagugcaguucauccugggcaccgaggacgacgacgaggagcacaucccccacgaccuguucaccgagauggacgagcugugcuacagagacggcgaggaguacgaguggaaggagaccgccagauggcugaaguucgaggaggacguggaggacggcggcgacagauggagcaagcccuacguggccacccugagccugcacagccuguucgagcugagaagcugcauccugaacggcaccgugaugcuggacaugagagccagcacccuggacgagaucgccgacauggugcuggacaacaugaucgccagcggccagcuggacgagagcaucagagagaacgugagagaggcccugcugaagagacaccaccaccagaacgagaagagauucaccagcagaaucccccuggugagaagcuucgccgacaucggcaagaagcacagcgacccccaccugcuggagagaaacggcauccuggccagcccccagagcgcccccggcaaccuggacaacagcaagagcggcgagaucaagggcaacggcagcggcggcagcagagagaacagcaccguggacuucagcaagguggacaugaacuucaugagaaagauccccaccggcgccgaggccagcaacgugcuggugggcgagguggacuuccuggagagacccaucaucgccuucgugagacuggcccccgccgugcugcugaccggccugaccgaggugcccgugcccaccagauuccuguuccugcugcugggccccgccggcaaggccccccaguaccacgagaucggcagaagcaucgccacccugaugaccgacgagaucuuccacgacguggccuacaaggccaaggacagaaacgaccugcugagcggcaucgacgaguuccuggaccaggugaccgugcugccccccggcgagugggaccccagcaucagaaucgagccccccaagagcgugcccagccaggagaagagaaagauccccguguuccacaacggcagcacccccacccugggcgagacccccaaggaggccgcccaccacgccggccccgagcugcagagaaccggcagacuguucggcggccugauccuggacaucaagagaaaggcccccuucuuccugagcgacuucaaggacgcccugagccugcagugccuggccagcauccuguuccuguacugcgccugcaugagccccgugaucaccuucggcggccugcugggcgaggccaccgagggcagaaucagcgccaucgagagccuguucggcgccagccugaccggcaucgccuacagccuguucgccggccagccccugaccauccugggcagcaccggccccgugcugguguucgagaagauccuguacaaguucugcagagacuaccagcugagcuaccugagccugagaaccagcaucggccuguggaccagcuuccugugcaucgugcugguggccaccgacgccagcagccuggugugcuacaucaccagauucaccgaggaggccuucgccgcccugaucugcaucaucuucaucuacgaggcccuggagaagcuguucgaccugggcgagaccuacgccuucaacaugcacaacaaccuggacaagcugaccagcuacagcugcgugugcaccgagccccccaaccccagcaacgagacccuggcccaguggaagaaggacaacaucaccgcccacaacaucagcuggagaaaccugaccgugagcgagugcaagaagcugagaggcguguuccugggcagcgccugcggccaccacggccccuacauccccgacgugcuguucuggugcgugauccuguucuucaccaccuucuuccugagcagcuuccugaagcaguucaagaccaagagauacuuccccaccaaggugagaagcaccaucagcgacuucgccguguuccugaccaucgugaucauggugaccaucgacuaccuggugggcgugcccagccccaagcugcacgugcccgagaaguucgagcccacccaccccgagagaggcuggaucaucagcccccugggcgacaaccccugguggacccugcugaucgccgccauccccgcccugcugugcaccauccugaucuucauggaccagcagaucaccgccgugaucaucaacagaaaggagcacaagcugaagaagggcgccggcuaccaccuggaccugcugauggugggcgugaugcugggcgugugcagcgugaugggccugcccugguucguggccgccaccgugcugagcaucagccacgugaacagccugaagguggagagcgagugcagcgcccccggcgagcagcccaaguuccugggcaucagagagcagagagugaccggccugaugaucuucauccugaugggccugagcguguucaugaccagcgugcugaaguucauccccaugcccgugcuguacggcguguuccuguacaugggcgugagcagccugaagggcauccagcuguucgacagaaucaagcuguucggcaugcccgccaagcaccagcccgaccugaucuaccugagauacgugccccuguggaaggugcacaucuucaccgugauccagcugaccugccuggugcugcugugggugaucaaggugagcgccgccgccgugguguuccccaugauggugcuggcccugguguucgugagaaagcugauggaccugugcuucaccaagagagagcugagcuggcuggacgaccugaugcccgagagcaagaagaagaaggaggacgacaagaagaagaaggagaaggaggaggccgagagaaugcugcaggacgacgacgacaccgugcaccugcccuucgagggcggcagccugcugcagauccccgugaaggcccugaaguacagcguggaccccagcaucgugaacaucagcgacgagauggccaagaccgcccaguggaaggcccugagcaugaacaccgagaacgccaaggugaccagaagcaacaugagccccgacaagcccgugagcgugaagaucagcuucgaggacgagcccagaaagaaguacguggacgccgagaccagccuguaa

SEQ ID NO: 23616 - RNA, 2838 nt, Artificial Sequence
  SLC4A9__Homo_sapiens__NP_001245355
auggagaugaagcugcccggccaggagggcuucgaggccagcagcgcccccagaaacauccccagcggcgagcuggacagcaaccccgaccccggcaccggccccagccccgacggccccagcgacaccgagagcaaggagcugggcgugcccaaggacccccugcuguucauccagcugaacgagcugcugggcuggccccaggcccuggaguggagagagaccggcagaugggugcuguucgaggagaagcuggagguggccgccggcagauggagcgccccccacgugcccacccuggcccugcccagccugcagaagcugagaagccugcuggccgagggccuggugcugcuggacugccccgcccagagccugcuggagcugguggagcaggugaccagaguggagagccugagccccgagcugagaggccagcugcaggcccugcugcugcagagaccccagcacuacaaccagaccaccggcaccagacccugcuggggcagcacccaccccagaaaggccagcgacaacgaggaggccccccugagagagcagugccagaacccccugagacagaagcugccccccggcgccgaggccggcaccgugcuggccggcgagcugggcuuccuggcccagccccugggcgccuucgugagacugagaaaccccguggugcugggcagccugaccgaggugagccugcccagcagauucuucugccugcugcugggccccugcaugcugggcaagggcuaccacgagaugggcagagccgccgccgugcugcugagcgacccccaguuccaguggagcgugagaagagccagcaaccugcacgaccugcuggccgcccuggacgccuuccuggaggaggugaccgugcugccccccggcagaugggaccccaccgccagaauccccccccccaagugccugcccagccagcacaagagacugcccagccagcagagagagaucagaggccccgccgugcccagacugaccagcgccgaggacagacacagacacggcccccacgcccacagccccgagcugcagagaaccggcagaaaggugcccugguaccccagcgacuuccuggacgcccugcaccugcagugcuucagcgccgugcuguacaucuaccuggccaccgugaccaacgccaucaccuucggcggccugcugggcgacgccaccgacggcgcccagggcgugcuggagagcuuccugggcaccgccguggccggcgccgccuucugccugauggccggccagccccugaccauccugagcagcaccggccccgugcugguguucgagagacugcuguucagcuucagcagagacuacagccuggacuaccugcccuucagacugugggugggcaucuggguggccaccuucugccuggugcugguggccaccgaggccagcgugcuggugagauacuucaccagauucaccgaggagggcuucugcgcccugaucagccugaucuucaucuacgacgccgugggcaagaugcugaaccugacccacaccuaccccauccagaagcccggcagcagcgccuacggcugccugugccaguaccccggccccggcggcaacgagagccaguggaucagaaccagacccaaggacagagacgacaucgaccugggccugaucaacgccagccugcugcccccccccgagugcaccagacagggcggccaccccagaggccccggcugccacaccgugcccgacaucgccuucuucagccugcugcuguuccugaccagcuucuucuucgccauggcccugaagugcgugaagaccagcagauucuuccccagcguggugagaaagggccugagcgacuucagcagcgugcuggccauccugcugggcugcggccuggacgccuuccugggccuggccacccccaagcugauggugcccagagaguucaagcccacccugcccggcagaggcuggcuggugagccccuucggcgccaaccccuggugguggagcguggccgccgcccugcccgcccugcugcugagcauccugaucuucauggaccagcagaucaccgccgugauccugaacagaauggaguacagacugcagaagggcgccggcuuccaccuggaccuguucugcguggccgugcugaugcugcugaccagcgcccugggccugcccugguacgugagcgccaccgugaucagccuggcccacauggacagccugagaagagagagcagagccugcgcccccggcgagagacccaacuuccugggcaucagagagcagagacugaccggccuggugguguucauccugaccggcgccagcaucuuccuggcccccgugcugaaguucauccccaugcccgugcuguacggcaucuuccuguacaugggcguggccgcccugagcagcauccaguucaccaacagagugaagcugcugcugaugcccgccaagcaccagcccgaccugcugcugcugagacacgugccccugaccagagugcaccuguucaccgccauccagcuggccugccugggccugcuguggaucaucaagagcacccccgccgccaucaucuucccccugaugcugcugggccuggugggcgugagaaaggcccuggagagaguguucagcccccaggagcugcuguggcuggacgagcugaugcccgaggaggagagaagcauccccgagaagggccuggagcccgagcacagcuucagcggcagcgacagcgaggacagcgagcugauguaccagcccaaggcccccgagaucaacaucagcgugaacuaa

SEQ ID NO: 23617 - RNA, 501 nt, Artificial Sequence
  SLC50A1__Homo_sapiens__NP_001116309
augagaggccugcaccccuggcacgugcugagaagaccccugggcccccaggcccacgccaacgaccccgagugcggccagagacccgugcccgcccugagccaccacggcagccagagaguggugcugcugcagaccgccacccugcugggcgugcugcugcugggcuacggcuacuucuggcugcuggugcccaaccccgaggccagacugcagcagcugggccuguucugcagcguguucaccaucagcauguaccugagcccccuggccgaccuggccaaggugauccagaccaagagcacccagugccugagcuacccccugaccaucgccacccugcugaccagcgccagcuggugccuguacggcuucagacugagagaccccuacaucauggugagcaacuuccccggcaucgugaccagcuucaucagauucuggcuguucuggaaguacccccaggagcaggacagaaacuacuggcugcugcagaccuaa

SEQ ID NO: 23618 - RNA, 1023 nt, Artificial Sequence
  SLC51A__Homo_sapiens__NP_689885
auggagcccggcagaacccagaucaagcuggaccccagauacaccgccgaccugcuggaggugcugaagaccaacuacggcauccccagcgccugcuucagccagccccccaccgccgcccagcugcugagagcccugggccccguggagcuggcccugaccagcauccugacccugcuggcccugggcagcaucgccaucuuccuggaggacgccguguaccuguacaagaacacccugugccccaucaagagaagaacccugcuguggaagagcagcgcccccaccguggugagcgugcugugcugcuucggccuguggauccccagaagccuggugcugguggagaugaccaucaccagcuucuacgccgugugcuucuaccugcugaugcuggugaugguggagggcuucggcggcaaggaggccgugcugagaacccugagagacacccccaugauggugcacaccggccccugcugcugcugcugccccugcugccccagacugcugcugaccagaaagaagcugcagcugcugaugcugggccccuuccaguacgccuuccugaagaucacccugacccuggugggccuguuccuggugcccgacggcaucuacgaccccgccgacaucagcgagggcagcaccgcccuguggaucaacaccuuccugggcgugagcacccugcuggcccuguggacccugggcaucaucagcagacaggccagacugcaccugggcgagcagaacaugggcgccaaguucgcccuguuccaggugcugcugauccugaccgcccugcagcccagcaucuucagcgugcuggccaacggcggccagaucgccugcagcccccccuacagcagcaagaccagaagccaggugaugaacugccaccugcugauccuggagaccuuccugaugaccgugcugaccagaauguacuacagaagaaaggaccacaaggugggcuacgagaccuucagcagccccgaccuggaccugaaccugaaggccuaa

SEQ ID NO: 23619 - RNA, 387 nt, Artificial Sequence
  SLC51B__Homo_sapiens__NP_849190
auggagcacagcgagggcgcccccggcgaccccgccggcaccguggugccccaggagcugcuggaggagaugcugugguucuucagaguggaggacgccagccccuggaaccacagcauccuggcccuggccgccgugguggugaucaucagcauggugcugcugggcagaagcauccaggccagcagaaaggagaagaugcagccccccgagaaggagacccccgaggugcugcaccuggacgaggccaaggaccacaacagccugaacaaccugagagagacccugcugagcgagaagcccaaccuggcccagguggagcuggagcugaaggagagagacgugcugagcguguuccugcccgacgugcccgagaccgagagcuaa

SEQ ID NO: 23620 - RNA, 1347 nt, Artificial Sequence
  SLC52A1__Homo_sapiens__NP_060456
auggccgcccccacccugggcagacuggugcugacccaccugcugguggcccuguucggcaugggcagcugggccgccgugaacggcaucuggguggagcugcccgugguggugaaggaccugcccgagggcuggagccugcccagcuaccugagcguggugguggcccugggcaaccugggccugcugguggugacccuguggagacagcuggcccccggcaagggcgagcaggugcccauccagguggugcaggugcugagcguggugggcaccgcccugcuggccccccuguggcaccacguggcccccguggccggccagcugcacagcguggccuuccugacccuggcccuggugcuggccauggccugcugcaccagcaacgugaccuuccugcccuuccugagccaccugcccccccccuuccugagaagcuucuuccugggccagggccugagcgcccugcugcccugcgugcuggcccuggugcagggcgugggcagacuggagugcccccccgcccccaccaacggcaccagcggccccccccuggacuuccccgagagauuccccgccagcaccuucuucugggcccugaccgcccugcuggugaccagcgccgccgccuucagaggccugcugcugcugcugcccagccugcccagcgugaccaccggcggcagcggccccgagcugcagcugggcagccccggcgccgaggaggaggagaaggaggaggaggaggcccugccccugcaggagccccccagccaggccgccggcaccauccccggccccgaccccgaggcccaccagcuguucagcgcccacggcgccuuccugcugggccugauggccuucaccagcgccgugaccaacggcgugcugcccagcgugcagagcuucagcugccugcccuacggcagacuggccuaccaccuggccguggugcugggcagcgccgccaacccccuggccugcuuccuggccaugggcgugcugugcagaagccuggccggccuggugggccugagccugcugggcaugcuguucggcgccuaccugauggcccuggccauccugagccccugccccccccuggugggcaccaccgccggcguggugcugguggugcugagcugggugcugugccugugcguguucagcuacgugaagguggccgccagcagccugcugcacggcggcggcagacccgcccugcuggccgccggcguggccauccaggugggcagccugcugggcgccggcgccauguucccccccaccagcaucuaccacguguuccagagcagaaaggacugcguggaccccugcggccccuaa

SEQ ID NO: 23621 - RNA, 1338 nt, Artificial Sequence
  SLC52A2__Homo_sapiens__NP_001240745
auggccgcccccacccccgccagacccgugcugacccaccugcugguggcccuguucggcaugggcagcugggccgccgugaacggcaucuggguggagcugcccgugguggugaaggagcugcccgagggcuggagccugcccagcuacgugagcgugcugguggcccugggcaaccugggccugcugguggugacccuguggagaagacuggcccccggcaaggacgagcaggugcccaucagaguggugcaggugcugggcauggugggcaccgcccugcuggccagccuguggcaccacguggcccccguggccggccagcugcacagcguggccuuccuggcccuggccuucgugcuggcccuggccugcugcgccagcaacgugaccuuccugcccuuccugagccaccugccccccagauuccugagaagcuucuuccugggccagggccugagcgcccugcugcccugcgugcuggcccuggugcagggcgugggcagacuggagugcccccccgcccccaucaacggcacccccggccccccccuggacuuccuggagagauuccccgccagcaccuucuucugggcccugaccgcccugcugguggccagcgccgccgccuuccagggccugcugcugcugcugccccccccccccagcgugcccaccggcgagcugggcagcggccugcaggugggcgcccccggcgccgaggaggagguggaggagagcagcccccugcaggagccccccagccaggccgccggcaccacccccggccccgaccccaaggccuaccagcugcugagcgccagaagcgccugccugcugggccugcuggccgccaccaacgcccugaccaacggcgugcugcccgccgugcagagcuucagcugccugcccuacggcagacuggccuaccaccuggccguggugcugggcagcgccgccaacccccuggccugcuuccuggccaugggcgugcugugcagaagccuggccggccugggcggccugagccugcugggcguguucugcggcggcuaccugauggcccuggccgugcugagccccugccccccccuggugggcaccagcgccggcguggugcugguggugcugagcugggugcugugccugggcguguucagcuacgugaagguggccgccagcagccugcugcacggcggcggcagacccgcccugcuggccgccggcguggccauccaggugggcagccugcugggcgccguggccauguucccccccaccagcaucuaccacguguuccacagcagaaaggacugcgccgaccccugcgacagcuaa

SEQ ID NO: 23622 - RNA, 1410 nt, Artificial Sequence
  SLC52A3__Homo_sapiens__XP_011527450
auggccuuccugaugcaccugcuggugugcguguucggcaugggcagcugggugaccaucaacggccuguggguggagcugccccugcuggugauggagcugcccgagggcugguaccugcccagcuaccugaccguggugauccagcuggccaacaucggcccccugcuggugacccugcugcaccacuucagacccagcugccugagcgaggugcccaucaucuucacccugcugggcgugggcaccgugaccugcaucaucuucgccuuccuguggaacaugaccagcugggugcuggacggccaccacagcaucgccuuccuggugcugaccuucuuccuggcccugguggacugcaccagcagcgugaccuuccugcccuucaugagcagacugcccaccuacuaccugaccaccuucuucgugggcgagggccugagcggccugcugcccgcccugguggcccuggcccagggcagcggccugaccaccugcgugaacgugaccgagaucagcgacagcgugcccagccccgugcccaccagagagaccgacaucgcccagggcgugcccagagcccuggugagcgcccugcccggcauggaggccccccugagccaccuggagagcagauaccugcccgcccacuucagcccccugguguucuuccugcugcugagcaucaugauggccugcugccugguggccuucuucgugcugcagagacagcccagaugcugggaggccagcguggaggaccugcugaacgaccaggugacccugcacagcaucagacccagagaggagaacgaccugggccccgccggcaccguggacagcagccagggccagggcuaccuggaggagaaggccgcccccugcugccccgcccaccuggccuucaucuacacccugguggccuucgugaacgcccugaccaacggcaugcugcccagcgugcagaccuacagcugccugagcuacggccccguggccuaccaccuggccgccacccugagcaucguggccaacccccuggccagccuggugagcauguuccugcccaacagaagccugcuguuccugggcgugcugagcgugcugggcaccugcuucggcggcuacaacauggccauggccgugaugagccccugcccccugcugcagggccacuggggcggcgaggugcugaucguggccagcugggugcuguucagcggcugccugagcuacgugaaggugaugcugggcguggugcugagagaccugagcagaagcgcccugcuguggugcggcgccgccgugcagcugggcagccugcugggcgcccugcugauguucccccuggugaacgugcugagacuguucagcagcgccgacuucugcaaccugcacugccccgccuaa

SEQ ID NO: 23623 - RNA, 1923 nt, Artificial Sequence
  SLC5A11__Homo_sapiens__NP_001245340
auggagagcggcaccagcagcccccagcccccccagcuggacccccuggacgccuucccccagaagggccuggagcccggcgacaucgccgugcuggugcuguacuuccuguucgugcuggccgugggccuguggagcaccgugaagaccaagagagacaccgugaagggcuacuuccuggccggcggcgacauggugugguggcccgugggcgccagccuguucgccagcaacgugggcagcggccacuucaucggccuggccggcagcggcgccgccaccggcaucagcgugagcgccuacgagcugaacggccuguucagcgugcugaugcuggccuggaucuuccugcccaucuacaucgccggccagguggacauguacgccggcgccaucuucauccagcagagccugcaccuggaccuguaccuggccaucgugggccugcuggccaucaccgccguguacaccguggccggcggccuggccgccgugaucuacaccgacgcccugcagacccugaucaugcugaucggcgcccugacccugaugggcuacagcuucgccgccgugggcggcauggagggccugaaggagaaguacuuccuggcccuggccagcaacagaagcgagaacagcagcugcggccugcccagagaggacgccuuccacaucuucagagacccccugaccagcgaccugcccuggcccggcgugcuguucggcaugagcauccccagccugugguacuggugcaccgaccaggugaucgugcagagaacccuggccgccaagaaccugagccacgccaagggcggcgcccugauggccgccuaccugaaggugcugccccuguucaucaugguguuccccggcauggugagcagaauccuguuccccgaccagguggccugcgccgaccccgagaucugccagaagaucugcagcaaccccagcggcugcagcgacaucgccuaccccaagcuggugcuggagcugcugcccaccggccugagaggccugaugauggccgugaugguggccgcccugaugagcagccugaccagcaucuucaacagcgccagcaccaucuucaccauggaccuguggaaccaccugagacccagagccagcgagaaggagcugaugaucgugggcagaguguucgugcugcugcuggugcuggugagcauccuguggauccccguggugcaggccagccagggcggccagcuguucaucuacauccagagcaucagcagcuaccugcagccccccguggccgugguguucaucaugggcugcuucuggaagagaaccaacgagaagggcgccuucuggggccugaucagcggccugcugcugggccuggugagacuggugcuggacuucaucuacgugcagcccagaugcgaccagcccgacgagagacccgugcuggugaagagcauccacuaccuguacuucagcaugauccugagcaccgugacccugaucaccgugagcaccgugagcugguucaccgagccccccagcaaggagauggugagccaccugaccugguucaccagacacgaccccguggugcagaaggagcaggccccccccgccgccccccugagccugacccugagccagaacggcaugcccgaggccagcagcagcagcagcgugcaguucgagauggugcaggagaacaccagcaagacccacagcugcgacaugacccccaagcagagcaagguggugaaggccauccuguggcugugcggcauccaggagaagggcaaggaggagcugcccgccagagccgaggccaucaucgugagccuggaggagaacccccuggugaagacccugcuggacgugaaccugaucuucugcgugagcugcgccaucuucaucuggggcuacuucgccuaa

SEQ ID NO: 23624 - RNA, 1857 nt, Artificial Sequence
  SLC5A12__Homo_sapiens__NP_848593
auggaggugaagaacuucgccgugugggacuacgugguguucgccgcccuguucuucaucagcagcggcaucggcguguucuucgccaucaaggagagaaagaaggccaccagcagagaguuccuggugggcggcagacagaugagcuucggccccgugggccugagccugaccgccagcuucaugagcgccgugaccgugcugggcacccccagcgagguguacagauucggcgccagcuuccugguguucuucaucgccuaccuguucgugauccugcugaccagcgagcuguuccugcccguguucuacagaagcggcaucaccagcaccuacgaguaccugcagcugagauucaacaagcccgugagauacgccgccaccgugaucuacaucgugcagaccauccuguacaccggcguggugguguacgcccccgcccuggcccugaaccaggugaccggcuucgaccuguggggcagcguguucgccaccggcaucgugugcaccuucuacugcacccugggcggccugaaggccgugguguggaccgacgccuuccagaugguggugaugaucgugggcuuccugaccgugcugauccagggcagcacccacgccggcggcuuccacaacgugcuggagcagagcaccaacggcagcagacugcacaucuucgacuucgacguggacccccugagaagacacaccuucuggaccaucaccgugggcggcaccuucaccuggcugggcaucuacggcgugaaccagagcaccauccagagaugcaucagcugcaagaccgagaagcacgccaagcuggcccuguacuucaaccugcugggccuguggaucauccuggugugcgccguguucagcggccugaucauguacagccacuucaaggacugcgaccccuggaccagcggcaucaucagcgcccccgaccagcugaugcccuacuucgugauggagaucuucgccaccaugcccggccugcccggccuguucguggccugcgccuucagcggcacccugagcaccguggccagcagcaucaacgcccuggccaccgugaccuucgaggacuucgugaagagcugcuucccccaccugagcgacaagcugagcaccuggaucagcaagggccugugccugcuguucggcgugaugugcaccagcauggccguggccgccagcgugaugggcggcguggugcaggccagccugagcauccacggcaugugcggcggccccaugcugggccuguucagccugggcaucguguuccccuucgugaacuggaagggcgcccugggcggccugcugaccggcaucacccugagcuucuggguggccaucggcgccuucaucuaccccgcccccgccagcaagaccuggccccugccccugagcaccgaccagugcaucaagagcaacgugaccgccaccggcccccccgugcugagcagcagacccggcaucgccgacaccugguacagcaucagcuaccuguacuacagcgccgugggcugccugggcugcaucguggccggcgugaucaucagccugaucaccggcagacagagaggcgaggacauccagccccugcugaucagacccgugugcaaccuguucugcuucuggagcaagaaguacaagacccugugcuggugcggcgugcagcacgacagcggcaccgagcaggagaaccuggagaacggcagcgccagaaagcagggcgccgagagcgugcugcagaacggccugagaagagagagccuggugcacgugcccggcuacgaccccaaggacaagagcuacaacaacauggccuucgagaccacccacuucuaa

SEQ ID NO: 23625 - RNA, 1995 nt, Artificial Sequence
  SLC5A1__Homo_sapiens__NP_000334
auggacagcagcaccuggagccccaagaccaccgccgugaccagacccguggagacccacgagcugaucagaaacgccgccgacaucagcaucaucgugaucuacuucgugguggugauggccgugggccugugggccauguucagcaccaacagaggcaccgugggcggcuucuuccuggccggcagaagcauggugugguggcccaucggcgccagccuguucgccagcaacaucggcagcggccacuucgugggccuggccggcaccggcgccgccagcggcaucgccaucggcggcuucgaguggaacgcccuggugcuggugguggugcugggcuggcuguucgugcccaucuacaucaaggccggcguggugaccaugcccgaguaccugagaaagagauucggcggccagagaauccagguguaccugagccugcugagccugcugcuguacaucuucaccaagaucagcgccgacaucuucagcggcgccaucuucaucaaccuggcccugggccugaaccuguaccuggccaucuuccugcugcuggccaucaccgcccuguacaccaucaccggcggccuggccgccgugaucuacaccgacacccugcagaccgugaucaugcuggugggcagccugauccugaccggcuucgccuuccacgaggugggcggcuacgacgccuucauggagaaguacaugaaggccauccccaccaucgugagcgacggcaacaccaccuuccaggagaagugcuacacccccagagccgacagcuuccacaucuucagagacccccugaccggcgaccugcccuggcccggcuucaucuucggcaugagcauccugacccugugguacuggugcaccgaccaggugaucgugcagagaugccugagcgccaagaacaugagccacgugaagggcggcugcauccugugcggcuaccugaagcugaugcccauguucaucauggugaugcccggcaugaucagcagaauccuguacaccgagaagaucgccugcguggugcccagcgagugcgagaaguacugcggcaccaaggugggcugcaccaacaucgccuaccccacccuggugguggagcugaugcccaacggccugagaggccugaugcugagcgugaugcuggccagccugaugagcagccugaccagcaucuucaacagcgccagcacccuguucaccauggacaucuacgccaaggugagaaagagagccagcgagaaggagcugaugaucgccggcagacuguucauccuggugcugaucggcaucagcaucgccugggugcccaucgugcagagcgcccagagcggccagcuguucgacuacauccagagcaucaccagcuaccugggcccccccaucgccgccguguuccugcuggccaucuucuggaagagagugaacgagcccggcgccuucuggggccugauccugggccugcugaucggcaucagcagaaugaucaccgaguucgccuacggcaccggcagcugcauggagcccagcaacugccccaccaucaucugcggcgugcacuaccuguacuucgccaucauccuguucgccaucagcuucaucaccaucguggugaucagccugcugaccaagcccauccccgacgugcaccuguacagacugugcuggagccugagaaacagcaaggaggagagaaucgaccuggacgccgaggaggagaacauccaggagggccccaaggagaccaucgagaucgagacccaggugcccgagaagaagaagggcaucuucagaagagccuacgaccuguucugcggccuggagcagcacggcgcccccaagaugaccgaggaggaggagaaggccaugaagaugaagaugaccgacaccagcgagaagccccuguggagaaccgugcugaacgugaacggcaucauccuggugaccguggccguguucugccacgccuacuucgccuaa

SEQ ID NO: 23626 - RNA, 2019 nt, Artificial Sequence
  SLC5A2__Homo_sapiens__NP_003032
auggaggagcacaccgaggccggcagcgcccccgagaugggcgcccagaaggcccugaucgacaaccccgccgacauccuggugaucgccgccuacuuccugcuggugaucggcgugggccuguggagcaugugcagaaccaacagaggcaccgugggcggcuacuuccuggccggcagaagcauggugugguggcccgugggcgccagccuguucgccagcaacaucggcagcggccacuucgugggccuggccggcaccggcgccgccagcggccuggccguggccggcuucgaguggaacgcccuguucguggugcugcugcugggcuggcuguucgcccccguguaccugaccgccggcgugaucaccaugccccaguaccugagaaagagauucggcggcagaagaaucagacuguaccugagcgugcugagccuguuccuguacaucuucaccaagaucagcguggacauguucagcggcgccguguucauccagcaggcccugggcuggaacaucuacgccagcgugaucgcccugcugggcaucaccaugaucuacaccgugaccggcggccuggccgcccugauguacaccgacaccgugcagaccuucgugauccugggcggcgccugcauccugaugggcuacgccuuccacgaggugggcggcuacagcggccuguucgacaaguaccugggcgccgccaccagccugaccgugagcgaggaccccgccgugggcaacaucagcagcuucugcuacagacccagacccgacagcuaccaccugcugagacaccccgugaccggcgaccugcccuggcccgcccugcugcugggccugaccaucgugagcggcugguacuggugcagcgaccaggugaucgugcagagaugccuggccggcaagagccugacccacaucaaggccggcugcauccugugcggcuaccugaagcugacccccauguuccugauggugaugcccggcaugaucagcagaauccuguaccccgacgagguggccugcguggugcccgaggugugcagaagagugugcggcaccgaggugggcugcagcaacaucgccuaccccagacugguggugaagcugaugcccaacggccugagaggccugaugcuggccgugaugcuggccgcccugaugagcagccuggccagcaucuucaacagcagcagcacccuguucaccauggacaucuacaccagacugagacccagagccggcgacagagagcugcugcuggugggcagacugugggugguguucaucgugguggugagcguggccuggcugcccguggugcaggccgcccagggcggccagcuguucgacuacauccaggccgugagcagcuaccuggccccccccgugagcgccguguucgugcuggcccuguucgugcccagagugaacgagcagggcgccuucuggggccugaucggcggccugcugaugggccuggccagacugauccccgaguucagcuucggcagcggcagcugcgugcagcccagcgccugccccgccuuccugugcggcgugcacuaccuguacuucgccaucgugcuguucuucugcagcggccugcugacccugaccgugagccugugcaccgcccccauccccagaaagcaccugcacagacugguguucagccugagacacagcaaggaggagagagaggaccuggacgccgacgagcagcagggcagcagccugcccgugcagaacggcugccccgagagcgccauggagaugaacgagccccaggcccccgcccccagccuguucagacagugccugcugugguucugcggcaugagcagaggcggcgugggcagcccccccccccugacccaggaggaggccgccgccgccgccagaagacuggaggacaucagcgaggaccccagcugggccagaguggugaaccugaacgcccugcugaugauggccguggccguguuccuguggggcuucuacgccuaa

SEQ ID NO: 23627 - RNA, 2157 nt, Artificial Sequence
  SLC5A3__Homo_sapiens__NP_008864
augagagccgugcuggacaccgccgacaucgccaucguggcccuguacuucauccuggugaugugcaucggcuucuucgccauguggaagagcaacagaagcaccgugagcggcuacuuccuggccggcagaagcaugaccuggguggccaucggcgccagccuguucgugagcaacaucggcagcgagcacuucaucggccuggccggcagcggcgccgccagcggcuucgccgugggcgccugggaguucaacgcccugcugcugcugcagcugcugggcuggguguucauccccaucuacaucagaagcggcguguacaccaugcccgaguaccugagcaagagauucggcggccacagaauccagguguacuucgccgcccugagccugauccuguacaucuucaccaagcugagcguggaccuguacagcggcgcccuguucauccaggagagccugggcuggaaccuguacgugagcgugauccugcugaucggcaugaccgcccugcugaccgugaccggcggccugguggccgugaucuacaccgacacccugcaggcccugcugaugaucaucggcgcccugacccugaugaucaucagcaucauggagaucggcggcuucgaggaggugaagagaagauacaugcuggccagccccgacgugaccagcauccugcugaccuacaaccugagcaacaccaacagcugcaacgugagccccaagaaggaggcccugaagaugcugagaaaccccaccgacgaggacgugcccuggcccggcuucauccugggccagacccccgccagcgugugguacuggugcgccgaccaggugaucgugcagagagugcuggccgccaagaacaucgcccacgccaagggcagcacccugauggccggcuuccugaagcugcugcccauguucaucaucguggugcccggcaugaucagcagaauccuguucaccgacgacaucgccugcaucaaccccgagcacugcaugcuggugugcggcagcagagccggcugcagcaacaucgccuaccccagacuggugaugaagcuggugcccgugggccugagaggccugaugauggccgugaugaucgccgcccugaugagcgaccuggacagcaucuucaacagcgccagcaccaucuucacccuggacguguacaagcugaucagaaagagcgccagcagcagagagcugaugaucgugggcagaaucuucguggccuucaugguggugaucagcaucgccugggugcccaucaucguggagaugcagggcggccagauguaccuguacauccaggagguggccgacuaccugaccccccccguggccgcccuguuccugcuggccaucuucuggaagagaugcaacgagcagggcgccuucuacggcggcauggccggcuucgugcugggcgccgugagacugauccuggccuucgccuacagagcccccgagugcgaccagcccgacaacagacccggcuucaucaaggacauccacuacauguacguggccaccggccuguucugggugaccggccugaucaccgugaucgugagccugcugacccccccccccaccaaggagcagaucagaaccaccaccuucuggagcaagaagaaccugguggugaaggagaacugcagccccaaggaggagcccuacaagaugcaggagaagagcauccugagaugcagcgagaacaacgagaccaucaaccacaucauccccaacggcaagagcgaggacagcaucaagggccugcagcccgaggacgugaaccugcuggugaccugcagagaggagggcaaccccguggccagccugggccacagcgaggccgagacccccguggacgccuacagcaacggccaggccgcccugaugggcgagaaggagagaaagaaggagaccgacgacggcggcagauacuggaaguucaucgacugguucugcggcuucaagagcaagagccugagcaagagaagccugagagaccugauggaggaggaggccgugugccugcagaugcuggaggagaccagacaggugaaggugauccugaacaucggccuguucgccgugugcagccugggcaucuucauguucguguacuucagccuguaa

SEQ ID NO: 23628 - RNA, 1980 nt, Artificial Sequence
  SLC5A4__Homo_sapiens__NP_055042
auggccagcaccgugagccccagcaccaucgccgagacccccgagccccccccccugagcgaccacaucagaaacgccgccgacaucagcgugaucgugaucuacuuccugguggugauggccgugggccugugggccaugcugaagaccaacagaggcaccaucggcggcuucuuccuggccggcagagacauggccugguggcccaugggcgccagccuguucgccagcaacaucggcagcaaccacuacgugggccuggccggcaccggcgccgccagcggcguggccaccgugaccuucgaguggaccagcagcgugaugcugcugauccugggcuggaucuucgugcccaucuacaucaagagcggcgugaugaccaugcccgaguaccugaagaagagauucggcggcgagagacugcagguguaccugagcauccugagccuguucaucugcguggugcugcugaucagcgccgacaucuucgccggcgccaucuucaucaagcuggcccugggccuggaccuguaccuggccaucuucauccugcuggccaugaccgccguguacaccaccaccggcggccuggccagcgugaucuacaccgacacccugcagaccaucaucaugcugaucggcagcuucauccugaugggcuucgccuucaacgaggugggcggcuacgagagcuucaccgagaaguacgugaacgccacccccagcgugguggagggcgacaaccugaccaucagcgccagcugcuacacccccagagccgacagcuuccacaucuucagagacgccgugaccggcgacauccccuggcccggcaucaucuucggcaugcccaucaccgcccugugguacuggugcaccaaccaggugaucgugcagagaugccugugcggcaaggacaugagccacgugaaggccgccugcaucaugugcgccuaccugaagcugcugcccauguuccugauggugaugcccggcaugaucagcagaauccuguacaccgacaugguggccugcguggugcccagcgagugcgugaagcacugcggcguggacgugggcugcaccaacuacgccuaccccaccauggugcuggagcugaugccccagggccugagaggccugaugcugagcgugaugcuggccagccugaugagcagccugaccagcaucuucaacagcgccagcacccuguucaccaucgaccuguacaccaagaugagaaagcaggccagcgagaaggagcugcugaucgccggcagaaucuucgugcugcugcugaccguggugagcaucgugugggugccccuggugcaggugagccagaacggccagcugauccacuacaccgagagcaucagcagcuaccugggcccccccaucgccgccguguucgugcuggccaucuucugcaagagagugaacgagcagggcgccuucuggggccugauggugggccuggccaugggccugaucagaaugaucaccgaguucgccuacggcaccggcagcugccuggcccccagcaacugccccaagaucaucugcggcgugcacuaccuguacuucagcaucgugcuguucuucggcagcaugcuggugacccugggcaucagccugcugaccaagcccauccccgacgugcaccuguacagacugugcugggugcugagaaacagcaccgaggagagaaucgacaucgacgccgaggagaagagccaggaggagaccgacgacggcguggaggaggacuaccccgagaagagcagaggcugccugaagaaggccuacgaccuguucugcggccugcagaagggccccaagcugaccaaggaggaggaggaggcccugagcaagaagcugaccgacaccagcgagagacccagcuggagaaccaucgugaacaucaacgccauccugcugcuggccguggugguguucauccacggcuacuacgccuaa

SEQ ID NO: 23629 - RNA, 1932 nt, Artificial Sequence
  SLC5A5__Homo_sapiens__NP_000444
auggaggccguggagaccggcgagagacccaccuucggcgccugggacuacggcguguucgcccugaugcugcuggugagcaccggcaucggccugugggugggccuggccagaggcggccagagaagcgccgaggacuucuucaccggcggcagaagacuggccgcccugcccgugggccugagccugagcgccagcuucaugagcgccgugcaggugcugggcgugcccagcgaggccuacagauacggccugaaguuccuguggaugugccugggccagcugcugaacagcgugcugaccgcccugcuguucaugcccguguucuacagacugggccugaccagcaccuacgaguaccuggagaugagauucagcagagccgugagacugugcggcacccugcaguacaucguggccaccaugcuguacaccggcaucgugaucuacgcccccgcccugauccugaaccaggugaccggccuggacaucugggccagccugcugagcaccggcaucaucugcaccuucuacaccgccgugggcggcaugaaggccgugguguggaccgacguguuccaggugguggugaugcugagcggcuucuggguggugcuggccagaggcgugaugcuggugggcggccccagacaggugcugacccuggcccagaaccacagcagaaucaaccugauggacuucaaccccgaccccagaagcagauacaccuucuggaccuucguggugggcggcacccugguguggcugagcauguacggcgugaaccaggcccaggugcagagauacguggccugcagaaccgagaagcaggccaagcuggcccugcugaucaaccaggugggccuguuccugaucgugagcagcgccgccugcugcggcaucgugauguucguguucuacaccgacugcgacccccugcugcugggcagaaucagcgcccccgaccaguacaugccccugcuggugcuggacaucuucgaggaccugcccggcgugcccggccuguuccuggccugcgccuacagcggcacccugagcaccgccagcaccagcaucaacgccauggccgccgugaccguggaggaccugaucaagcccagacugagaagccuggcccccagaaagcuggugaucaucagcaagggccugagccugaucuacggcagcgccugccugaccguggccgcccugagcagccugcugggcggcggcgugcugcagggcagcuucaccgugaugggcgugaucagcggcccccugcugggcgccuucauccugggcauguuccugcccgccugcaacacccccggcgugcuggccggccugggcgccggccuggcccugagccuguggguggcccugggcgccacccuguacccccccagcgagcagaccaugagagugcugcccagcagcgccgccagaugcguggcccugagcgugaacgccagcggccugcuggaccccgcccugcugcccgccaacgacagcagcagagcccccagcagcggcauggacgccagcagacccgcccuggccgacagcuucuacgccaucagcuaccuguacuacggcgcccugggcacccugaccaccgugcugugcggcgcccugaucagcugccugaccggccccaccaagagaagcacccuggcccccggccugcuguggugggaccuggccagacagaccgccagcguggcccccaaggaggagguggccauccuggacgacaaccuggugaagggccccgaggagcugcccaccggcaacaagaagccccccggcuuccugcccaccaacgaggacagacuguucuuccugggccagaaggagcuggagggcgccggcagcuggacccccugcgugggccacgacggcggcagagaccagcaggagaccaaccuguaa

SEQ ID NO: 23630 - RNA, 1908 nt, Artificial Sequence
  SLC5A6__Homo_sapiens__XP_006712193
augagcgugggcgugagcaccagcgccccccugagccccaccagcggcaccagcgugggcaugagcaccuucagcaucauggacuacgugguguucgugcugcugcuggugcugagccuggccaucggccuguaccacgccugcagaggcuggggcagacacaccgugggcgagcugcugauggccgacagaaagaugggcugccugcccguggcccugagccugcuggccaccuuccagagcgccguggccauccugggcgugcccagcgagaucuacagauucggcacccaguacugguuccugggcugcugcuacuuccugggccugcugauccccgcccacaucuucauccccguguucuacagacugcaccugaccagcgccuacgaguaccuggagcugagauucaacaagaccgugagagugugcggcaccgugaccuucaucuuccagauggugaucuacaugggcguggugcuguacgcccccagccuggcccugaacgccgugaccggcuucgaccuguggcugagcgugcuggcccugggcaucgugugcaccguguacaccgcccugggcggccugaaggccgugaucuggaccgacguguuccagacccuggugauguuccugggccagcuggccgugaucaucgugggcagcgccaaggugggcggccugggcagagugugggccguggccagccagcacggcagaaucagcggcuucgagcuggaccccgaccccuucgugagacacaccuucuggacccuggccuucggcggcguguucaugaugcugagccuguacggcgugaaccaggcccaggugcagagauaccugagcagcagaaccgagaaggccgccgugcugagcugcuacgccguguuccccuuccagcaggugagccugugcgugggcugccugaucggccuggugauguucgccuacuaccaggaguaccccaugagcauccagcaggcccaggccgcccccgaccaguucgugcuguacuucgugauggaccugcugaagggccugcccggccugcccggccuguucaucgccugccuguucagcggcagccugagcaccaucagcagcgccuucaacagccuggccaccgugaccauggaggaccugaucagacccugguuccccgaguucagcgaggccagagccaucaugcugagcagaggccuggccuucggcuacggccugcugugccugggcauggccuacaucagcagccagaugggccccgugcugcaggccgccaucagcaucuucggcauggugggcggcccccugcugggccuguucugccugggcauguucuuccccugcgccaacccccccggcgccguggugggccugcuggccggccuggugauggccuucuggaucggcaucggcagcaucgugaccagcaugggcagcagcaugccccccagccccagcaacggcagcagcuucagccugcccaccaaccugaccguggccaccgugaccacccugaugccccugaccaccuucagcaagcccaccggccugcagagauucuacagccugagcuaccugugguacagcgcccacaacagcaccaccgugaucguggugggccugaucgugagccugcugaccggcagaaugagaggcagaagccugaaccccgccaccaucuaccccgugcugcccaagcugcugagccugcugccccugagcugccagaagagacugcacugcagaagcuacggccaggaccaccuggacaccggccuguuccccgagaagcccagaaacggcgugcugggcgacagcagagacaaggaggccauggcccuggacggcaccgccuaccagggcagcagcagcaccugcauccugcaggagaccagccuguaa

SEQ ID NO: 23631 - RNA, 1743 nt, Artificial Sequence
  SLC5A7__Homo_sapiens__NP_001291934
auggccuuccacguggagggccugaucgccaucaucguguucuaccugcugauccugcuggugggcaucugggccgccuggagaaccaagaacagcggcagcgccgaggagagaagcgaggccaucaucgugggcggcagagacaucggccugcuggugggcggcuucaccaugaccgccaccugggugggcggcggcuacaucaacggcaccgccgaggccguguacgugcccggcuacggccuggccugggcccaggcccccaucggcuacagccugagccugauccugggcggccuguucuucgccaagcccaugagaagcaagggcuacgugaccaugcuggaccccuuccagcagaucuacggcaagagaaugggcggccugcuguucauccccgcccugaugggcgagauguucugggccgccgccaucuucagcgcccugggcgccaccaucagcgugaucaucgacguggacaugcacaucagcgugaucaucagcgcccugaucgccacccuguacacccuggugggcggccuguacagcguggccuacaccgacguggugcagcuguucugcaucuucgugggccuguggaucagcgugcccuucgcccugagccaccccgccguggccgacaucggcuucaccgccgugcacgccaaguaccagaagcccuggcugggcaccguggacagcagcgagguguacagcuggcuggacagcuuccugcugcugaugcugggcggcauccccuggcaggccuacuuccagagagugcugagcagcagcagcgccaccuacgcccaggugcugagcuuccuggccgccuucggcugccuggugauggccauccccgccauccugaucggcgccaucggcgccagcaccgacuggaaccagaccgccuacggccugcccgaccccaagaccaccgaggaggccgacaugauccugcccaucgugcugcaguaccugugccccguguacaucagcuucuucggccugggcgccgugagcgccgccgugaugagcagcgccgacagcagcauccugagcgccagcagcauguucgccagaaacaucuaccagcugagcuucagacagaacgccagcgacaaggagaucgugugggugaugagaaucaccguguucguguucggcgccagcgccaccgccauggcccugcugaccaagaccguguacggccugugguaccugagcagcgaccugguguacaucgugaucuucccccagcugcugugcgugcuguucgugaagggcaccaacaccuacggcgccguggccggcuacgugagcggccuguuccugagaaucaccggcggcgagcccuaccuguaccugcagccccugaucuucuaccccggcuacuaccccgacgacaacggcaucuacaaccagaaguuccccuucaagacccuggccauggugaccagcuuccugaccaacaucugcaucagcuaccuggccaaguaccuguucgagagcggcacccugccccccaagcuggacguguucgacgccgugguggccagacacagcgaggagaacauggacaagaccauccuggugaagaacgagaacaucaagcuggacgagcuggcccuggugaagcccagacagagcaugacccugagcagcaccuucaccaacaaggaggccuuccuggacguggacagcagccccgagggcagcggcaccgaggacaaccugcaguaa

SEQ ID NO: 23632 - RNA, 1833 nt, Artificial Sequence
  SLC5A8__Homo_sapiens__NP_666018
auggacacccccagaggcaucggcaccuucguggugugggacuacgugguguucgccggcaugcuggugaucagcgccgccaucggcaucuacuacgccuucgccggcggcggccagcagaccagcaaggacuuccugaugggcggcagaagaaugaccgccgugcccguggcccugagccugaccgccagcuucaugagcgccgugaccgugcugggcacccccagcgagguguacagauucggcgccaucuucagcaucuucgccuucaccuacuucuucgugguggugaucagcgccgagguguuccugcccguguucuacaagcugggcaucaccagcaccuacgaguaccuggagcugagauucaacaagugcgugagacugugcggcaccgugcuguucaucgugcagaccauccuguacaccggcaucgugaucuacgcccccgcccuggcccugaaccaggugaccggcuucgaccuguggggcgccgugguggccaccggcguggugugcaccuucuacugcacccugggcggccugaaggccgugaucuggaccgacguguuccaggugggcaucaugguggccggcuucgccagcgugaucauccaggccguggugaugcagggcggcaucagcaccauccugaacgacgccuacgacggcggcagacugaacuucuggaacuucaaccccaacccccugcagagacacaccuucuggaccaucaucaucggcggcaccuucaccuggaccagcaucuacggcgugaaccagagccaggugcagagauacaucagcugcaagagcagauuccaggccaagcugagccuguacaucaaccuggugggccugugggccauccugaccugcagcguguucugcggccuggcccuguacagcagauaccacgacugcgaccccuggaccgccaagaaggugagcgcccccgaccagcugaugcccuaccuggugcuggacauccugcaggacuaccccggccugcccggccuguucguggccugcgccuacagcggcacccugagcaccgugagcagcagcaucaacgcccuggccgccgugaccguggaggaccugaucaagcccuacuucagaagccugagcgagagaagccugagcuggaucagccagggcaugagcgugguguacggcgcccugugcaucggcauggccgcccuggccagccugaugggcgcccugcugcaggccgcccugagcguguucggcauggugggcggcccccugaugggccuguucgcccugggcauccuggugcccuucgccaacagcaucggcgcccuggugggccugauggccggcuucgccaucagccugugggugggcaucggcgcccagaucuaccccccccugcccgagagaacccugccccugcaccuggacauccagggcugcaacagcaccuacaacgagaccaaccugaugaccaccaccgagaugcccuucaccaccagcguguuccagaucuacaacgugcagagaaccccccugauggacaacugguacagccugagcuaccuguacuucagcaccgugggcacccuggugacccugcuggugggcauccuggugagccugagcaccggcggcagaaagcagaaccuggaccccagauacauccugaccaaggaggacuuccugagcaacuucgacaucuucaagaagaagaagcacgugcugagcuacaagagccaccccguggaggacggcggcaccgacaaccccgccuucaaccacaucgagcugaacagcgaccagagcggcaagagcaacggcaccagacuguaa

SEQ ID NO: 23633 - RNA, 1899 nt, Artificial Sequence
  SLC6A11__Homo_sapiens__NP_055044
augaccgccgagaaggcccugccccugggcaacggcaaggccgccgaggaggccagagagagcgaggcccccggcggcggcugcagcagcggcggcgccgcccccgccagacaccccagagugaagagagacaaggccgugcacgagagaggccacuggaacaacaagguggaguucgugcugagcguggccggcgagaucaucggccugggcaacguguggagauuccccuaccugugcuacaagaacggcggcggcgccuuccugauccccuacgugguguucuucaucugcugcggcauccccguguucuuccuggagaccgcccugggccaguucaccagcgagggcggcaucaccugcuggagaaaggugugcccccuguucgagggcaucggcuacgccacccaggugaucgaggcccaccugaacguguacuacaucaucauccuggccugggccaucuucuaccugagcaacugcuucaccaccgagcugcccugggccaccugcggccacgaguggaacaccgagaacugcguggaguuccagaagcugaacgugagcaacuacagccacgugagccugcagaacgccaccagccccgugauggaguucugggagcacagagugcuggccaucagcgacggcaucgagcacaucggcaaccugagaugggagcuggcccugugccugcuggccgccuggaccaucugcuacuucugcaucuggaagggcaccaagagcaccggcaaggugguguacgugaccgccaccuuccccuacaucaugcugcugauccugcugaucagaggcgugacccugcccggcgccagcgagggcaucaaguucuaccuguaccccgaccugagcagacugagcgacccccagguguggguggacgccggcacccagaucuucuucagcuacgccaucugccugggcugccugaccgcccugggcagcuacaacaacuacaacaacaacugcuacagagacugcaucaugcugugcugccugaacagcggcaccagcuucguggccggcuucgccaucuucagcgugcugggcuucauggccuacgagcagggcgugcccaucgccgagguggccgagagcggccccggccuggccuucaucgccuaccccaaggccgugaccaugaugccccugagcccccugugggccacccuguucuucaugaugcugaucuuccugggccuggacagccaguucgugugcguggagagccuggugaccgccgugguggacauguaccccaagguguucagaagaggcuacagaagagagcugcugauccuggcccugagcgugaucagcuacuuccugggccuggugaugcugaccgagggcggcauguacaucuuccagcuguucgacagcuacgccgccagcggcaugugccugcuguucguggccaucuucgagugcaucugcaucggcuggguguacggcagcaacagauucuacgacaacaucgaggacaugaucggcuacagaccccccagccugaucaaguggugcuggaugaucaugacccccggcaucugcgccggcaucuucaucuucuuccugaucaaguacaagccccugaaguacaacaacaucuacaccuaccccgccuggggcuacggcaucggcuggcugauggcccugagcagcaugcugugcaucccccuguggaucugcaucaccguguggaagaccgagggcacccugcccgagaagcugcagaagcugaccacccccagcaccgaccugaagaugagaggcaagcugggcgugagccccagaauggugaccgugaacgacugcgacgccaagcugaagagcgacggcaccaucgccgccaucaccgagaaggagacccacuucuaa

SEQ ID NO: 23634 - RNA, 1845 nt, Artificial Sequence
  SLC6A12__Homo_sapiens__XP_005253803
auggacggcaagguggccgugcaggagugcggcccccccgccgugagcugggugcccgaggagggcgagaagcuggaccaggaggacgaggaccaggugaaggacagaggccaguggaccaacaagauggaguucgugcugagcguggccggcgagaucaucggccugggcaacguguggagauuccccuaccugugcuacaagaacggcggcggcgccuucuucauccccuacuucaucuucuucuucgugugcggcauccccguguucuuccuggagguggcccugggccaguacaccagccagggcagcgugaccgccuggagaaagaucugcccccuguuccagggcaucggccuggccagcguggugaucgagagcuaccugaacguguacuacaucaucauccuggccugggcccuguucuaccuguucagcagcuucaccagcgagcugcccuggaccaccugcaacaacuucuggaacaccgagcacugcaccgacuuccugaaccacagcggcgccggcaccgugacccccuucgagaacuucaccagccccgugauggaguucugggagagaagagugcugggcaucaccagcggcauccacgaccugggcagccugagaugggagcuggcccugugccugcugcuggccugggugaucugcuacuucugcaucuggaagggcgugaagagcaccggcaaggugguguacuucaccgccaccuuccccuaccugaugcuggugauccugcugaucagaggcgugacccugcccggcgccuaccagggcaucaucuacuaccugaagcccgaccuguucagacugaaggacccccagguguggauggacgccggcacccagaucuucuucagcuucgccaucugccagggcugccugaccgcccugggcagcuacaacaaguaccacaacaacugcuacaaggacugcaucgcccugugcuuccugaacagcgccaccagcuucguggccggcuucgugguguucagcauccugggcuucaugagccaggagcagggcgugcccaucagcgagguggccgagagcggccccggccuggccuucaucgccuuccccaaggccgugaccaugaugccccugagccagcuguggagcugccuguucuucaucaugcugaucuuccugggccuggacagccaguucgugugcguggagugccuggugaccgccagcaucgacauguuccccagacagcugagaaagagcggcagaagagagcugcugauccugaccaucgccgugaugugcuaccugaucggccuguuccuggugaccgagggcggcauguacaucuuccagcuguucgacuacuacgccagcagcggcaucugccugcuguuccugagccuguucgagguggugugcaucagcuggguguacggcgccgacagauucuacgacaacaucgaggacaugaucggcuacagacccuggccccuggugaagaucagcuggcuguuccugacccccggccugugccuggccaccuuccuguucagccugagcaaguacaccccccugaaguacaacaacguguacguguacccccccuggggcuacagcaucggcugguuccuggcccugagcagcauggugugcgugccccuguucguggugaucacccugcugaagaccagaggccccuucagaaagagacugagacagcugaucacccccgacagcagccugccccagcccaagcagcaccccugccuggacggcagcgccggcagaaacuucggccccagccccaccagagagggccugaucgccggcgagaaggagacccaccuguaa

SEQ ID NO: 23635 - RNA, 1533 nt, Artificial Sequence
  SLC6A13__Homo_sapiens__NP_001177926
auggacagcagagugagcggcaccaccagcaacggcgagaccaagcccguguaccccgugauggagaagaaggaggaggacggcacccuggagagaggccacuggaacaacaagauggaguucgugcugagcguggccggcgagaucaucggccugggcaacguguggagauuccccuaccugugcuacaagaacggcggcgagcacugcauggaguuccagaagaccaacggcagccugaacggcaccagcgagaacgccaccagccccgugaucgaguucugggagagaagagugcugaagaucagcgacggcauccagcaccugggcgcccugagaugggagcuggcccugugccugcugcuggccugggugaucugcuacuucugcaucuggaagggcgugaagagcaccggcaaggugguguacuucaccgccaccuuccccuaccugaugcugguggugcugcugaucagaggcgugacccugcccggcgccgcccagggcauccaguucuaccuguaccccaaccugaccagacugugggacccccagguguggauggacgccggcacccagaucuucuucagcuucgccaucugccugggcugccugaccgcccugggcagcuacaacaaguaccacaacaacugcuacagagacugcaucgcccugugcuuccugaacagcggcaccagcuucguggccggcuucgccaucuucagcauccugggcuucaugagccaggagcagggcgugcccaucagcgagguggccgagagcggccccggccuggccuucaucgccuaccccagagccguggugaugcugcccuucagcccccugugggccugcugcuucuucuucaugguggugcugcugggccuggacagccaguucgugugcguggagagccuggugaccgcccugguggacauguacccccacguguucagaaagaagaacagaagagaggugcugauccugggcgugagcguggugagcuuccuggugggccugaucaugcugaccgagggcggcauguacguguuccagcuguucgacuacuacgccgccagcggcaugugccugcuguucguggccaucuucgagagccugugcguggccuggguguacggcgccaagagauucuacgacaacaucgaggacaugaucggcuacagacccuggccccugaucaaguacugcuggcuguuccugacccccgccgugugcaccgccaccuuccuguucagccugaucaaguacaccccccugaccuacaacaagaaguacaccuaccccugguggggcgacgcccugggcuggcugcuggcccugagcagcauggugugcauccccgccuggagccuguacagacugggcacccugaagggccccuucagagagagaaucagacagcugaugugccccgccgaggaccugccccagagaaaccccgccggccccagcgcccccgccacccccagaaccagccugcugagacugaccgagcuggagagccacugcuaa

SEQ ID NO: 23636 - RNA, 1929 nt, Artificial Sequence
  SLC6A14__Homo_sapiens__NP_009162
auggacaagcugaagugccccagcuucuucaagugcagagagaaggagaaggugagcgccagcagcgagaacuuccacgugggcgagaacgacgagaaccaggacagaggcaacuggagcaagaagagcgacuaccugcugagcaugaucggcuacgccgugggccugggcaacguguggagauuccccuaccugaccuacagcaacggcggcggcgccuuccugauccccuacgccaucaugcuggcccuggccggccugccccuguucuuccuggagugcagccugggccaguucgccagccugggccccgugagcguguggagaauccugccccuguuccagggcgugggcaucaccauggugcugaucagcaucuucgugaccaucuacuacaacgugaucaucgccuacagccuguacuacauguucgccagcuuccagagcgagcugcccuggaagaacugcagcagcuggagcgacaagaacugcagcagaagccccaucgugacccacugcaacgugagcaccgugaacaagggcauccaggagaucauccagaugaacaagagcuggguggacaucaacaacuucaccugcaucaacggcagcgagaucuaccagcccggccagcugcccagcgagcaguacuggaacaagguggcccugcagagaagcagcggcaugaacgagaccggcgugaucgugugguaccuggcccugugccugcugcuggccuggcugaucgugggcgccgcccuguucaagggcaucaagagcagcggcaaggugguguacuucaccgcccuguuccccuacguggugcugcugauccugcuggugagaggcgccacccuggagggcgccagcaagggcaucagcuacuacaucggcgcccagagcaacuucaccaagcugaaggaggccgagguguggaaggacgccgccacccagaucuucuacagccugagcguggccuggggcggccugguggcccugagcagcuacaacaaguucaagaacaacugcuucagcgacgccaucguggugugccugaccaacugccugaccagcguguucgccggcuucgccaucuucagcauccugggccacauggcccacaucagcggcaaggaggugagccagguggugaagagcggcuucgaccuggccuucaucgccuaccccgaggcccuggcccagcugcccggcggccccuucuggagcauccuguucuucuucaugcugcugacccugggccuggacagccaguucgccagcaucgagaccaucaccaccaccauccaggaccuguuccccaaggugaugaagaagaugagagugcccaucacccugggcugcugccuggugcuguuccugcugggccuggugugcgugacccaggccggcaucuacugggugcaccugaucgaccacuucugcgccggcuggggcauccugaucgccgccauccuggagcuggugggcaucaucuggaucuacggcggcaacagauucaucgaggacaccgagaugaugaucggcgccaagagauggaucuucuggcugugguggagagccugcugguucgugaucacccccauccugcugaucgccaucuucaucuggagccuggugcaguuccacagacccaacuacggcgccauccccuaccccgacuggggcguggcccugggcuggugcaugaucguguucugcaucaucuggauccccaucauggccaucaucaagaucauccaggccaagggcaacaucuuccagagacugaucagcugcugcagacccgccagcaacuggggccccuaccuggagcagcacagaggcgagagauacaaggacaugguggaccccaagaaggaggccgaccacgagauccccaccgugagcggcagcagaaagcccgaguaa

SEQ ID NO: 23637 - RNA, 870 nt, Artificial Sequence
  SLC6A15__Homo_sapiens__NP_060527
augcccaagaacagcaagguggugaagagagagcuggacgacgacgugaccgagagcgugaaggaccugcugagcaacgaggacgccgccgacgacgccuucaagaccagcgagcugaucguggacggccaggaggagaaggacaccgacguggaggagggcagcgagguggaggacgagagacccgccuggaacagcaagcugcaguacauccuggcccaggugggcuucagcgugggccugggcaacguguggagauuccccuaccugugccagaagaacggcggcggcgccuaccugcugcccuaccugauccugcugauggugaucggcaucccccuguucuuccuggagcugagcgugggccagagaaucagaagaggcagcaucggcguguggaacuacaucagccccaagcugggcggcaucggcuucgccagcugcguggugugcuacuucguggcccuguacuacaacgugaucaucggcuggagccuguucuacuucagccagagcuuccagcagccccugcccugggaccagugcccccuggugaagaacgccagccacaccuucguggagcccgagugcgagcagagcagcgccaccaccuacuacugguacagagaggcccugaacaucagcagcagcaucagcgagagcggcggccugaacuggaagaugaccaucugccugcuggccgccugggugauggugugccuggccaugaucaagggcauccagagcagcggcaaggugagcaugcuggagcccuuccugauccugcugaucaccaucagcggcuucaucccccugagcaacagcgugaccgacuucugcggccagaucacccacaacaccagcuucuaa

SEQ ID NO: 23638 - RNA, 1887 nt, Artificial Sequence
  SLC6A18__Homo_sapiens__NP_872438
auggcccacgcccccgagcccgaccccgccgccugcgaccugggcgacgagagacccaagugggacaacaaggcccaguaccugcugagcugcaccggcuucgccgugggccugggcaacaucuggagauuccccuaccugugccagaccuacggcggcggcgccuuccugauccccuacgugaucgcccugguguucgagggcauccccaucuuccacguggagcuggccaucggccagagacugagaaagggcagcgugggcguguggaccgccaucagccccuaccugagcggcgugggccugggcugcgugacccugagcuuccugaucagccuguacuacaacaccaucguggccugggugcugugguaccugcugaacagcuuccagcacccccugcccuggagcagcugcccccccgaccugaacagaaccggcuucguggaggagugccagggcagcagcgccgugagcuacuucugguacagacagacccugaacaucaccgccgacaucaacgacagcggcagcauccagugguggcugcugaucugccuggccgccagcugggccgugguguacaugugcgugaucagaggcaucgagaccaccggcaaggugaucuacuucaccgcccuguuccccuaccuggugcugaccaucuuccugaucagaggccugacccugcccggcgccaccaagggccugaucuaccuguucacccccaacaugcacauccugcagaaccccagaguguggcuggacgccgccacccagaucuucuucagccugagccuggccuucggcggccacaucgccuucgccagcuacaacagccccagaaacgacugccagaaggacgccguggugaucgcccuggugaacagaaugaccagccuguacgccagcaucgccguguucagcgugcugggcuucaaggccaccaacgacuacgagcacugccuggacagaaacauccugagccugaucaacgacuucgacuuccccgagcagagcaucagcagagacgacuaccccgccgugcugaugcaccugaacgccaccuggcccaagagaguggcccagcugccccugaaggccugccugcuggaggacuuccuggacaagagcgccagcggccccggccuggccuucgugguguucaccgagaccgaccugcacaugcccggcgcccccgugugggccaugcuguucuucggcaugcuguucacccugggccugagcaccauguucggcaccguggaggccgugaucaccccccugcuggacgugggcgugcugcccagaugggugcccaaggaggcccugaccggccuggugugccuggugugcuuccugagcgccaccugcuucacccugcagagcggcaacuacuggcuggagaucuucgacaacuucgccgccagccccaaccugcugaugcuggccuuccuggagguggugggcgugguguacguguacggcaugaagagauucugcgacgacaucgccuggaugaccggcagaagacccagccccuacuggagacugaccuggagaguggugagcccccugcugcugaccaucuucguggccuacaucauccugcuguucuggaagccccugagauacaaggccuggaaccccaaguacgagcuguuccccagcagacaggagaagcuguaccccggcugggccagagccgccugcgugcugcugagccugcugcccgugcugugggugcccguggccgcccuggcccagcugcugaccagaagaagaagaaccuggagagacagagacgccagacccgacaccgacaugagacccgacaccgacaccagacccgacaccgacaugagacccgacaccgacaugagauaa

SEQ ID NO: 23639 - RNA, 1905 nt, Artificial Sequence
  SLC6A19__Homo_sapiens__NP_001003841
auggugagacuggugcugcccaaccccggccuggacgccagaauccccagccuggccgagcuggagaccaucgagcaggaggaggccagcagcagacccaagugggacaacaaggcccaguacaugcugaccugccugggcuucugcgugggccugggcaacguguggagauuccccuaccugugccagagccacggcggcggcgccuucaugauccccuuccugauccugcuggugcuggagggcaucccccugcuguaccuggaguucgccaucggccagagacugagaagaggcagccugggcguguggagcagcauccaccccgcccugaagggccugggccuggccagcaugcugaccagcuucauggugggccuguacuacaacaccaucaucagcuggaucaugugguaccuguucaacagcuuccaggagccccugcccuggagcgacugcccccugaacgagaaccagaccggcuacguggacgagugcgccagaagcagccccguggacuacuucugguacagagagacccugaacaucagcaccagcaucagcgacagcggcagcauccagugguggaugcugcugugccuggccugcgccuggagcgugcuguacaugugcaccaucagaggcaucgagaccaccggcaaggccguguacaucaccagcacccugcccuacguggugcugaccaucuuccugaucagaggccugacccugaagggcgccaccaacggcaucguguuccuguucacccccaacgugaccgagcuggcccagcccgacaccuggcuggacgccggcgcccagguguucuucagcuucagccuggccuucggcggccugaucagcuucagcagcuacaacagcgugcacaacaacugcgagaaggacagcgugaucgugagcaucaucaacggcuucaccagcguguacguggccaucgugguguacagcgugaucggcuucagagccacccagagauacgacgacugcuucagcaccaacauccugacccugaucaacggcuucgaccugcccgagggcaacgugacccaggagaacuucguggacaugcagcagagaugcaacgccagcgaccccgccgccuacgcccagcugguguuccagaccugcgacaucaacgccuuccugagcgaggccguggagggcaccggccuggccuucaucguguucaccgaggccaucaccaagaugccccugagcccccuguggagcgugcuguucuucaucaugcuguucugccugggccugagcagcauguucggcaacauggagggcgugguggugccccugcaggaccugagagugaucccccccaaguggcccaaggaggugcugaccggccugaucugccugggcaccuuccugaucggcuucaucuucacccugaacagcggccaguacuggcugagccugcuggacagcuacgccggcagcaucccccugcugaucaucgccuucugcgagauguucagcgugguguacguguacggcguggacagauucaacaaggacaucgaguucaugaucggccacaagcccaacaucuucuggcaggugaccuggagaguggugagcccccugcugaugcugaucaucuuccuguucuucuucgugguggaggugagccaggagcugaccuacagcaucugggaccccggcuacgaggaguuccccaagagccagaagaucagcuaccccaacuggguguacguggugguggugaucguggccggcgugcccagccugaccauccccggcuacgccaucuacaagcugaucagaaaccacugccagaagcccggcgaccaccagggccuggugagcacccugagcaccgccagcaugaacggcgaccugaaguacuaa

SEQ ID NO: 23640 - RNA, 1800 nt, Artificial Sequence
  SLC6A1__Homo_sapiens__NP_003033
auggccaccaacggcagcaagguggccgacggccagaucagcaccgaggugagcgaggcccccguggccaacgacaagcccaagacccugguggugaaggugcagaagaaggccgccgaccugcccgacagagacaccuggaagggcagauucgacuuccugaugagcugcgugggcuacgccaucggccugggcaacguguggagauuccccuaccugugcggcaagaacggcggcggcgccuuccugauccccuacuuccugacccugaucuucgccggcgugccccuguuccugcuggagugcagccugggccaguacaccagcaucggcggccugggcguguggaagcuggcccccauguucaagggcgugggccuggccgccgccgugcugagcuucuggcugaacaucuacuacaucgugaucaucagcugggccaucuacuaccuguacaacagcuucaccaccacccugcccuggaagcagugcgacaaccccuggaacaccgacagaugcuucagcaacuacagcauggugaacaccaccaacaugaccagcgccgugguggaguucugggagagaaacaugcaccagaugaccgacggccuggacaagcccggccagaucagauggccccuggccaucacccuggccaucgccuggauccugguguacuucugcaucuggaagggcgugggcuggaccggcaaggugguguacuucagcgccaccuaccccuacaucaugcugaucauccuguucuucagaggcgugacccugcccggcgccaaggagggcauccuguucuacaucacccccaacuucagaaagcugagcgacagcgagguguggcuggacgccgccacccagaucuucuucagcuacggccugggccugggcagccugaucgcccugggcagcuacaacagcuuccacaacaacguguacagagacagcaucaucgugugcugcaucaacagcugcaccagcauguucgccggcuucgugaucuucagcaucgugggcuucauggcccacgugaccaagagaagcaucgccgacguggccgccagcggccccggccuggccuuccuggccuaccccgaggccgugacccagcugcccaucagcccccugugggccauccuguucuucagcaugcugcugaugcugggcaucgacagccaguucugcaccguggagggcuucaucaccgcccugguggacgaguaccccagacugcugagaaacagaagagagcuguucaucgccgccgugugcaucaucagcuaccugaucggccugagcaacaucacccagggcggcaucuacguguucaagcuguucgacuacuacagcgccagcggcaugagccugcuguuccugguguucuucgagugcgugagcaucagcugguucuacggcgugaacagauucuacgacaacauccaggagauggugggcagcagacccugcaucugguggaagcugugcuggagcuucuucacccccaucaucguggccggcguguucaucuucagcgccgugcagaugaccccccugaccaugggcaacuacguguuccccaaguggggccagggcgugggcuggcugauggcccugagcagcauggugcugauccccggcuacauggccuacauguuccugacccugaagggcagccugaagcagagaauccaggugauggugcagcccagcgaggacaucgugagacccgagaacggccccgagcagccccaggccggcagcagcaccagcaaggaggccuacaucuaa

SEQ ID NO: 23641 - RNA, 1779 nt, Artificial Sequence
  SLC6A20__Homo_sapiens__NP_064593
auggagaaggccagaccccugugggccaacagccugcaguucguguucgccugcaucagcuacgccgugggccugggcaacguguggagauuccccuaccugugccagauguacggcggcggcagcuuccuggugcccuacaucaucaugcugaucguggagggcaugccccugcuguaccuggagcuggccgugggccagagaaugagacagggcagcaucggcgccuggagaaccaucagccccuaccugagcggcgugggcguggccagcgugguggugagcuucuuccugagcauguacuacaacgugaucaacgccugggccuucugguaccuguuccacagcuuccaggacccccugcccuggagcgugugcccccugaacggcaaccacaccggcuacgacgaggagugcgagaaggccagcagcacccaguacuucugguacagaaagacccugaacaucagccccagccugcaggagaacggcggcgugcagugggagcccgcccugugccugcugcuggccuggcuggugguguaccugugcauccugagaggcaccgagagcaccggcaaggugguguacuucaccgccagccugcccuacugcgugcugaucaucuaccugaucagaggccugacccugcacggcgccaccaacggccugauguacauguucacccccaagaucgagcagcuggccaaccccaaggccuggaucaacgccgccacccagaucuucuucagccugggccugggcuucggcagccugaucgccuucgccagcuacaacgagcccagcaacaacugccagaagcacgccaucaucgugagccugaucaacagcuucaccagcaucuucgccagcaucgugaccuucagcaucuacggcuucaaggccaccuucaacuacgagaacugccugaagaaggugagccugcugcugaccaacaccuucgaccuggaggacggcuuccugaccgccagcaaccuggagcaggugaagggcuaccuggccagcgccuaccccagcaaguacagcgagauguucccccagaucaagaacugcagccuggagagcgagcuggacaccgccgugcagggcaccggccuggccuucaucguguacaccgaggccaucaagaacauggaggugagccagcuguggagcgugcuguacuucuucaugcugcugaugcugggcaucggcagcaugcugggcaacaccgccgccauccugaccccccugaccgacagcaagaucaucagcagccaccugcccaaggaggccaucagcggccuggugugccuggugaacugcgccaucggcaugguguucaccauggaggccggcaacuacugguucgacaucuucaacgacuacgccgccacccugagccugcugcugaucgugcugguggagaccaucgccgugugcuacguguacggccugagaagauucgagagcgaccugaaggccaugaccggcagagccgugagcugguacuggaaggugaugugggccggcgugagcccccugcugaucgugagccuguucguguucuaccugagcgacuacauccugaccggcacccugaaguaccaggccugggacgccagccagggccagcuggugaccaaggacuaccccgccuacgcccuggccgugaucggccugcugguggccagcagcaccaugugcaucccccuggccgcccugggcaccuucgugcagagaagacugaagagaggcgacgccgaccccguggccuaa

SEQ ID NO: 23642 - RNA, 1854 nt, Artificial Sequence
  SLC6A2__Homo_sapiens__NP_001165972
augcugcuggccagaaugaacccccaggugcagcccgagaacaacggcgccgacaccggccccgagcagccccugagagccagaaagaccgccgagcugcugguggugaaggagagaaacggcgugcagugccugcuggcccccagagacggcgacgcccagcccagagagaccuggggcaagaagaucgacuuccugcugagcguggugggcuucgccguggaccuggccaacguguggagauuccccuaccugugcuacaagaacggcggcggcgccuuccugauccccuacacccuguuccugaucaucgccggcaugccccuguucuacauggagcuggcccugggccaguacaacagagagggcgccgccaccguguggaagaucugccccuucuucaagggcgugggcuacgccgugauccugaucgcccuguacgugggcuucuacuacaacgugaucaucgccuggagccuguacuaccuguucagcagcuucacccugaaccugcccuggaccgacugcggccacaccuggaacagccccaacugcaccgaccccaagcugcugaacggcagcgugcugggcaaccacaccaaguacagcaaguacaaguucacccccgccgccgaguucuacgagagaggcgugcugcaccugcacgagagcagcggcauccacgacaucggccugccccaguggcagcugcugcugugccugauggugguggugaucgugcuguacuucagccuguggaagggcgugaagaccagcggcaaggugguguggaucaccgccacccugcccuacuucgugcuguucgugcugcuggugcacggcgugacccugcccggcgccagcaacggcaucaacgccuaccugcacaucgacuucuacagacugaaggaggccaccguguggaucgacgccgccacccagaucuucuucagccugggcgccggcuucggcgugcugaucgccuucgccagcuacaacaaguucgacaacaacugcuacagagacgcccugcugaccagcagcaucaacugcaucaccagcuucgugagcggcuucgccaucuucagcauccugggcuacauggcccacgagcacaaggugaacaucgaggacguggccaccgagggcgccggccugguguucauccuguaccccgaggccaucagcacccugagcggcagcaccuucugggccgugguguucuucgugaugcugcuggcccugggccuggacagcagcaugggcggcauggaggccgugaucaccggccuggccgacgacuuccaggugcugaagagacacagaaagcuguucaccuucggcgugaccuucagcaccuuccugcuggcccuguucugcaucaccaagggcggcaucuacgugcugacccugcuggacaccuucgccgccggcaccagcauccuguucgccgugcugauggaggccaucggcgugagcugguucuacggcguggacagauucagcaacgacauccagcagaugaugggcuucagacccggccuguacuggagacugugcuggaaguucgugagccccgccuuccugcuguucguggugguggugagcaucaucaacuucaagccccugaccuacgacgacuacaucuucccccccugggccaacugggugggcuggggcaucgcccugagcagcauggugcuggugcccaucuacgugaucuacaaguuccugagcacccagggcagccugugggagagacuggccuacggcaucacccccgagaacgagcaccaccugguggcccagagagacaucagacaguuccagcugcagcacuggcuggccaucuaa

SEQ ID NO: 23643 - RNA, 1893 nt, Artificial Sequence
  SLC6A4__Homo_sapiens__NP_001036
auggagaccaccccccugaacagccagaagcagcugagcgccugcgaggacggcgaggacugccaggagaacggcgugcugcagaagguggugcccacccccggcgacaagguggagagcggccagaucagcaacggcuacagcgccgugcccagccccggcgccggcgacgacaccagacacagcauccccgccaccaccaccacccugguggccgagcugcaccagggcgagagagagaccuggggcaagaagguggacuuccugcugagcgugaucggcuacgccguggaccugggcaacguguggagauuccccuacaucugcuaccagaacggcggcggcgccuuccugcugcccuacaccaucauggccaucuucggcggcaucccccuguucuacauggagcuggcccugggccaguaccacagaaacggcugcaucagcaucuggagaaagaucugccccaucuucaagggcaucggcuacgccaucugcaucaucgccuucuacaucgccagcuacuacaacaccaucauggccugggcccuguacuaccugaucagcagcuucaccgaccagcugcccuggaccagcugcaagaacagcuggaacaccggcaacugcaccaacuacuucagcgaggacaacaucaccuggacccugcacagcaccagccccgccgaggaguucuacaccagacacgugcugcagauccacagaagcaagggccugcaggaccugggcggcaucagcuggcagcuggcccugugcaucaugcugaucuucaccgugaucuacuucagcaucuggaagggcgugaagaccagcggcaagguggugugggugaccgccaccuuccccuacaucauccugagcgugcugcuggugagaggcgccacccugcccggcgccuggagaggcgugcuguucuaccugaagcccaacuggcagaagcugcuggagaccggcguguggaucgacgccgccgcccagaucuucuucagccugggccccggcuucggcgugcugcuggccuucgccagcuacaacaaguucaacaacaacugcuaccaggacgcccuggugaccagcguggugaacugcaugaccagcuucgugagcggcuucgugaucuucaccgugcugggcuacauggccgagaugagaaacgaggacgugagcgagguggccaaggacgccggccccagccugcuguucaucaccuacgccgaggccaucgccaacaugcccgccagcaccuucuucgccaucaucuucuuccugaugcugaucacccugggccuggacagcaccuucgccggccuggagggcgugaucaccgccgugcuggacgaguucccccacgugugggccaagagaagagagagauucgugcuggccguggugaucaccugcuucuucggcagccuggugacccugaccuucggcggcgccuacguggugaagcugcuggaggaguacgccaccggccccgccgugcugaccguggcccugaucgaggccguggccgugagcugguucuacggcaucacccaguucugcagagacgugaaggagaugcugggcuucagccccggcugguucuggagaaucugcuggguggccaucagcccccuguuccugcuguucaucaucugcagcuuccugaugagccccccccagcugagacuguuccaguacaacuaccccuacuggagcaucauccugggcuacugcaucggcaccagcagcuucaucugcauccccaccuacaucgccuacagacugaucaucacccccggcaccuucaaggagagaaucaucaagagcaucacccccgagacccccaccgagauccccugcggcgacaucagacugaacgccguguaa

SEQ ID NO: 23644 - RNA, 2394 nt, Artificial Sequence
  SLC6A5__Homo_sapiens__XP_011518775
auggacugcagcgcccccaaggagaugaacaagcugcccgccaacagccccgaggccgccgccgcccagggccaccccgacggccccugcgcccccagaaccagccccgagcaggagcugcccgccgccgccgccccccccccccccagagugcccagaagcgccagcaccggcgcccagaccuuccagagcgccgacgccagagccugcgaggccgagagacccggcgugggcagcugcaagcugagcagccccagagcccaggccgccagcgccgcccugagagaccugagagaggcccagggcgcccaggccagccccccccccggcagcagcggccccggcaacgcccugcacugcaagauccccuuccugagaggccccgagggcgacgccaacgugagcgugggcaagggcacccuggagagaaacaacacccccguggugggcugggugaacaugagccagagcaccguggugcuggccaccgacggcaucaccagcgugcugcccggcagcguggccaccguggccacccaggaggacgagcagggcgacgagaacaaggccagaggcaacuggagcagcaagcuggacuucauccugagcauggugggcuacgccgugggccugggcaacguguggagauuccccuaccuggccuuccagaacggcggcggcgccuuccugauccccuaccugaugaugcuggcccuggccggccugcccaucuucuuccuggaggugagccugggccaguucgccagccagggccccgugagcguguggaaggccauccccgcccugcagggcugcggcaucgccaugcugaucaucagcgugcugaucgccaucuacuacaacgugaucaucugcuacacccuguucuaccuguucgccagcuucgugagcgugcugcccuggggcagcugcaacaaccccuggaacacccccgagugcaaggacaagaccaagcugcugcuggacagcugcgugaucagcgaccaccccaagauccagaucaagaacagcaccuucugcaugaccgccuaccccaacgugaccauggugaacuucaccagccaggccaacaagaccuucgugagcggcagcgaggaguacuucaaguacuucgugcugaagaucagcgccggcaucgaguaccccggcgagaucagauggccccuggcccugugccuguuccuggccugggugaucguguacgccagccuggccaagggcaucaagaccagcggcaaggugguguacuucaccgccaccuuccccuacguggugcuggugauccugcugaucagaggcgugacccugcccggcgccggcgccggcaucugguacuucaucacccccaagugggagaagcugaccgacgccaccguguggaaggacgccgccacccagaucuucuucagccugagcgccgccuggggcggccugaucacccugagcagcuacaacaaguuccacaacaacugcuacagagacacccugaucgugaccugcaccaacagcgccaccagcaucuucgccggcuucgugaucuucagcgugaucggcuucauggccaacgagagaaaggugaacaucgagaacguggccgaccagggccccggcaucgccuucgugguguaccccgaggcccugaccagacugccccugagccccuucugggccaucaucuucuuccugaugcugcugacccugggccuggacaccauguucgccaccaucgagaccaucgugaccagcaucagcgacgaguuccccaaguaccugagaacccacaagcccguguucacccugggcugcugcaucugcuucuucaucaugggcuuccccaugaucacccagggcggcaucuacauguuccagcugguggacaccuacgccgccagcuacgcccuggugaucaucgccaucuucgagcuggugggcaucagcuacguguacggccugcagagauucugcgaggacaucgagaugaugaucggcuuccagcccaacaucuucuggaaggugugcugggccuucgugacccccaccauccugaccuucauccugugcuucagcuucuaccagugggagcccaugaccuacggcagcuacagauaccccaacuggagcauggugcugggcuggcugaugcuggccugcagcgugaucuggauccccaucauguucgugaucaagaugcaccuggcccccggcagauucaucgagagacugaagcuggugugcagcccccagcccgacuggggccccuuccuggcccagcacagaggcgagagauacaagaacaugaucgacccccugggcaccagcagccugggccugaagcugcccgugaaggaccuggagcugggcacccagugcuaa

SEQ ID NO: 23645 - RNA, 2166 nt, Artificial Sequence
  SLC6A6__Homo_sapiens__NP_001127839
augggcgacgccgagagcugccugcugagacagcagaccagagaggugagaaagaagccccugaucaacuacagauuccugagagccgccgccaacgccgagcccagaggcccccaggcccagagaaccagcugcgccaagagagagugcggcgccuucacccagagagugagagagagagccggcagacagccccccgccggcggcaccagacacagcagagccgagagaggcagaagaagaagccaccccagaagcagaaccagaaccaccgcccugcugagaagcagccagaccaaggagauggccaccaaggagaagcugcagugccugaaggacuuccacaaggacauccugaagcccagccccggcaagagccccggcaccagacccgaggacgaggccgagggcaagcccccccagagagagaaguggagcagcaagaucgacuucgugcugagcguggccggcggcuucgugggccugggcaacguguggagauuccccuaccugugcuacaagaacggcggcggcgccuuccugauccccuacuucaucuuccuguucggcagcggccugcccguguucuuccuggagaucaucaucggccaguacaccagcgagggcggcaucaccugcugggagaagaucugcccccuguucagcggcaucggcuacgccagcguggugaucgugagccugcugaacguguacuacaucgugauccuggccugggccaccuacuaccuguuccagagcuuccagaaggagcugcccugggcccacugcaaccacagcuggaacaccccccacugcauggaggacaccaugagaaagaacaagagcguguggaucaccaucagcagcaccaacuucaccagccccgugaucgaguucugggagagaaacgugcugagccugagccccggcaucgaccaccccggcagccugaagugggaccuggcccugugccugcugcugguguggcuggugugcuucuucugcaucuggaagggcgugagaagcaccggcaaggugguguacuucaccgccaccuuccccuucgccaugcugcuggugcugcuggugagaggccugacccugcccggcgccggcgccggcaucaaguucuaccuguaccccgacaucaccagacuggaggacccccagguguggaucgacgccggcacccagaucuucuucagcuacgccaucugccugggcgccaugaccagccugggcagcuacaacaaguacaaguacaacagcuacagagacugcaugcugcugggcugccugaacagcggcaccagcuucgugagcggcuucgccaucuucagcauccugggcuucauggcccaggagcagggcguggacaucgccgacguggccgagagcggccccggccuggccuucaucgccuaccccaaggccgugaccaugaugccccugcccaccuucuggagcauccuguucuucaucaugcugcugcugcugggccuggacagccaguucguggagguggagggccagaucaccagccugguggaccuguaccccagcuuccugagaaagggcuacagaagagagaucuucaucgccuucgugugcagcaucagcuaccugcugggccugaccauggugaccgagggcggcauguacguguuccagcuguucgacuacuacgccgccagcggcgugugccugcuguggguggccuucuucgagugcuucgugaucgccuggaucuacggcggcgacaaccuguacgacggcaucgaggacaugaucggcuacagacccggccccuggaugaaguacagcugggccgugaucacccccgugcugugcgugggcugcuucaucuucagccuggugaaguacgugccccugaccuacaacaagaccuacguguaccccaacugggccaucggccugggcuggagccuggcccugagcagcaugcugugcgugccccuggugaucgugaucagacugugccagaccgagggccccuuccuggugagagugaaguaccugcugacccccagagagcccaacagaugggccguggagagagagggcgccacccccuacaacagcagaaccgugaugaacggcgcccuggugaagcccacccacaucaucguggagaccaugauguaa

SEQ ID NO: 23646 - RNA, 1911 nt, Artificial Sequence
  SLC6A7__Homo_sapiens__NP_055043
augaagaagcugcagggcgcccaccugagaaagcccgugacccccgaccugcugaugacccccagcgaccagggcgacguggaccuggacguggacuucgccgcccacagaggcaacuggaccggcaagcuggacuuccugcugagcugcaucggcuacugcgugggccugggcaacguguggagauuccccuacagagccuacaccaacggcggcggcgccuuccuggugcccuacuuccugaugcuggccaucugcggcaucccccuguucuuccuggagcugagccugggccaguucagcagccugggcccccuggccguguggaagaucagcccccuguucaagggcgccggcgccgccaugcugcugaucgugggccugguggccaucuacuacaacaugaucaucgccuacgugcuguucuaccuguucgccagccugaccagcgaccugcccugggagcacugcggcaacugguggaacaccgagcugugccuggagcacagagugagcaaggacggcaacggcgcccugccccugaaccugaccugcaccgugagccccagcgaggaguacuggagcagauacgugcugcacauccagggcagccagggcaucggcagccccggcgagaucagauggaaccugugccugugccugcugcuggccugggugaucguguuccugugcauccugaagggcgugaagagcagcggcaaggugguguacuucaccgccaccuuccccuaccugauccugcugaugcugcuggugagaggcgugacccugcccggcgccuggaagggcauccaguucuaccugaccccccaguuccaccaccugcugagcagcaagguguggaucgaggccgcccugcagaucuucuacagccugggcgugggcuucggcggccugcugaccuucgccagcuacaacaccuuccaccagaacaucuacagagacaccuucaucgugacccugggcaacgccaucaccagcauccuggccggcuucgccaucuucagcgugcugggcuacaugagccaggagcugggcgugcccguggaccagguggccaaggccggccccggccuggccuucgugguguacccccaggccaugaccaugcugccccugagccccuucuggagcuuccuguucuucuucaugcugcugacccugggccuggacagccaguucgccuuccuggagaccaucgugaccgccgugaccgacgaguuccccuacuaccugagacccaagaaggccguguucagcggccugaucugcguggccauguaccugaugggccugauccugaccaccgacggcggcauguacuggcuggugcugcuggacgacuacagcgccagcuucggccugauggugguggugaucaccaccugccuggccgugaccagaguguacggcauccagagauucugcagagacauccacaugaugcugggcuucaagcccggccuguacuucagagccugcuggcuguuccugagccccgccacccugcuggcccugaugguguacagcaucgugaaguaccagcccagcgaguacggcagcuacagauucccccccugggccgagcugcugggcauccugaugggccugcugagcugccugaugauccccgccggcaugcugguggccgugcugagagaggagggcagccugugggagagacugcagcaggccagcagacccgccauggacuggggccccagccuggaggagaacagaaccggcauguacguggccacccuggccggcagccagagccccaagccccugauggugcacaugagaaaguacggcggcaucaccagcuucgagaacaccgccaucgagguggacagagagaucgccgaggaggaggagagcaugauguaa

SEQ ID NO: 23647 - RNA, 1878 nt, Artificial Sequence
  SLC6A8__Homo_sapiens__NP_001136277
auggccaagaagagcgccgagaacggcaucuacagcgugagcggcgacgagaagaagggcccccugaucgcccccggccccgacggcgcccccgccaagggcgacggccccgugggccugggcacccccggcggcagacuggccgugccccccagagagaccuggaccagacagauggacuucaucaugagcugcgugggcuucgccgugggccugggcaacguguggagauuccccuaccugugcuacaagaacggcggcggcguguuccugauccccuacgugcugaucgcccuggugggcggcauccccaucuucuuccuggagaucagccugggccaguucaugaaggccggcagcaucaacguguggaacaucugcccccuguucaagggccugggcuacgccagcauggugaucguguucuacugcaacaccuacuacaucauggugcuggccuggggcuucuacuaccuggugaagagcuucaccaccacccugcccugggccaccugcggccacaccuggaacacccccgacugcguggagaucuucagacacgaggacugcgccaacgccagccuggccaaccugaccugcgaccagcuggccgacagaagaagccccgugaucgaguucugggagaacaaggugcugagacugagcggcggccuggaggugcccggcgcccugaacugggaggugacccugugccugcuggccugcugggugcugguguacuucugcguguggaagggcgugaagagcaccggcaagaucguguacuucaccgccaccuuccccuacguggugcugguggugcugcuggugagaggcgugcugcugcccggcgcccuggacggcaucaucuacuaccugaagcccgacuggagcaagcugggcagcccccagguguggaucgacgccggcacccagaucuucuucagcuacgccaucggccugggcgcccugaccgcccugggcagcuacaacagauucaacaacaacugcuacaacggcaccagcuucuucgccggcuucgugguguucagcauccugggcuucauggccgccgagcagggcgugcacaucagcaagguggccgagagcggccccggccuggccuucaucgccuaccccagagccgugacccugaugcccguggccccccugugggccgcccuguucuucuucaugcugcugcugcugggccuggacagccaguucgugggcguggagggcuucaucaccggccugcuggaccugcugcccgccagcuacuacuucagauuccagagagagaucagcguggcccugugcugcgcccugugcuucgugaucgaccugagcauggugaccgacggcggcauguacguguuccagcuguucgacuacuacagcgccagcggcaccacccugcuguggcaggccuucugggagugcguggugguggccuggguguacggcgccgacagauucauggacgacaucgccugcaugaucggcuacagacccugccccuggaugaaguggugcuggagcuucuucaccccccuggugugcaugggcaucuucaucuucaacgugguguacuacgagccccugguguacaacaacaccuacguguaccccugguggggcgaggccaugggcugggccuucgcccugagcagcaugcugugcgugccccugcaccugcugggcugccugcugagagccaagggcaccauggccgagagauggcagcaccugacccagcccaucuggggccugcaccaccuggaguacagagcccaggacgccgacgugagaggccugaccacccugacccccgugagcgagagcagcaaggugguggugguggagagcgugauguaa

SEQ ID NO: 23648 - RNA, 1857 nt, Artificial Sequence
  SLC6A9__Homo_sapiens__XP_011540319
augagcggcggcgacaccagagccgccaucgccagacccagaauggccgccgcccacggccccguggcccccagcagccccgagcaggugacccugcugcccgugcagagaagcuucuuccugccccccuucagcggcgccacccccagcaccagccuggccgagagcgugcugaagguguggcacggcgccuacaacagcggccugcugccccagcugauggcccagcacagccuggccauggcccagaacggcgccgugcccagcgaggccaccaagagagaccagaaccugaagagaggcaacuggggcaaccagaucgaguucgugcugaccagcgugggcuacgccgugggccugggcaacguguggagauuccccuaccugugcuacagaaacggcggcggcgccuucauguuccccuacuucaucaugcugaucuucugcggcaucccccuguucuucauggagcugagcuucggccaguucgccagccagggcugccugggcguguggagaaucagccccauguucaagggcgugggcuacggcaugaugguggugagcaccuacaucggcaucuacuacaacguggugaucugcaucgccuucuacuacuucuucagcagcaugacccacgugcugcccugggccuacugcaacaaccccuggaacacccacgacugcgccggcgugcuggacgccagcaaccugaccaacggcagcagacccgccgcccugcccagcaaccugagccaccugcugaaccacagccugcagagaaccagccccagcgaggaguacuggagacuguacgugcugaagcugagcgacgacaucggcaacuucggcgaggugagacugccccugcugggcugccugggcgugagcuggcuggugguguuccugugccugaucagaggcgugaagagcagcggcaaggugguguacuucaccgccaccuuccccuacguggugcugaccauccuguucgugagaggcgugacccuggagggcgccuucgacggcaucauguacuaccugaccccccagugggacaagauccuggaggccaagguguggggcgacgccgccagccagaucuucuacagccugggcugcgccuggggcggccugaucaccauggccagcuacaacaaguuccacaacaacugcuacagagacagcgugaucaucagcaucaccaacugcgccaccagcguguacgccggcuucgugaucuucagcauccugggcuucauggccaaccaccugggcguggacgugagcagaguggccgaccacggccccggccuggccuucguggccuaccccgaggcccugacccugcugcccaucagcccccuguggagccugcuguucuucuucaugcugauccugcugggccugggcacccaguucugccugcuggagacccuggugaccgccaucguggacgaggugggcaacgaguggauccugcagaagaagaccuacgugacccugggcguggccguggccggcuuccugcugggcaucccccugaccagccaggccggcaucuacuggcugcugcugauggacaacuacgccgccagcuucagccugguggugaucagcugcaucaugugcguggccaucauguacaucuacggccacagaaacuacuuccaggacauccagaugaugcugggcuucccccccccccuguucuuccagaucugcuggagauucgugagccccgccaucaucuucagccugcccacccacagagcccccgcccccggccccgccugcuucuuccacggccccgacguggacagcugccccugcagcgcccccaacgcccuguucuaa

SEQ ID NO: 23649 - RNA, 1572 nt, Artificial Sequence
  SLC7A10__Homo_sapiens__NP_062823
auggccggccacacccagcagcccagcggcagaggcaaccccagacccgcccccagccccagccccgugcccggcaccgugcccggcgccagcgagagaguggcccugaagaaggagaucggccugcugagcgccugcaccaucaucaucggcaacaucaucggcagcggcaucuucaucagccccaagggcgugcuggagcacagcggcagcgugggccuggcccuguucgugugggugcugggcggcggcgugaccgcccugggcagccugugcuacgccgagcugggcguggccauccccaagagcggcggcgacuacgccuacgugaccgagaucuucggcggccuggccggcuuccugcugcuguggagcgccgugcugaucauguaccccaccagccuggccgugaucagcaugaccuucagcaacuacgugcugcagcccguguuccccaacugcaucccccccaccaccgccagcagagugcugagcauggccugccugaugcugcugaccugggugaacagcagcagcgugagaugggccaccagaauccaggacauguucaccggcggcaagcugcuggcccugagccugaucaucggcgugggccugcugcagaucuuccagggccacuucgaggagcugagacccagcaacgccuucgccuucuggaugacccccagcgugggccaccuggcccuggccuuccugcagggcagcuucgccuucagcggcuggaacuuccugaacuacgugaccgaggagaugguggacgccagaaagaaccugcccagagccaucuucaucagcaucccccuggugaccuucguguacaccuucaccaacaucgccuacuucaccgccaugagcccccaggagcugcugagcagcaacgccguggccgugaccuucggcgagaagcugcugggcuacuucagcugggugaugcccgugagcguggcccugagcaccuucggcggcaucaacggcuaccuguucaccuacagcagacugugcuucagcggcgccagagagggccaccugcccagccugcuggccaugauccacgugagacacugcacccccauccccgcccugcuggugugcugcggcgccaccgccgugaucaugcuggugggcgacaccuacacccugaucaacuacgugagcuucaucaacuaccugugcuacggcgugaccauccugggccugcugcugcugagauggagaagacccgcccugcacagacccaucaaggugaaccugcugauccccguggccuaccugguguucugggccuuccugcugguguucagcuucaucagcgagcccauggugugcggcgugggcgugaucaucauccugaccggcgugcccaucuucuuccugggcguguucuggagaagcaagcccaagugcgugcacagacugaccgagagcaugacccacuggggccaggagcugugcuucgugguguacccccaggacgcccccgaggaggaggagaacggccccugcccccccagccugcugcccgccaccgacaagcccagcaagccccaguaa

SEQ ID NO: 23650 - RNA, 1506 nt, Artificial Sequence
  SLC7A11__Homo_sapiens__NP_055146
auggugagaaagcccguggugagcaccaucagcaagggcggcuaccugcagggcaacgugaacggcagacugcccagccugggcaacaaggagccccccggccaggagaaggugcagcugaagagaaaggugacccugcugagaggcgugagcaucaucaucggcaccaucaucggcgccggcaucuucaucagccccaagggcgugcugcagaacaccggcagcgugggcaugagccugaccaucuggaccgugugcggcgugcugagccuguucggcgcccugagcuacgccgagcugggcaccaccaucaagaagagcggcggccacuacaccuacauccuggagguguucggcccccugcccgccuucgugagaguguggguggagcugcugaucaucagacccgccgccaccgccgugaucagccuggccuucggcagauacauccuggagcccuucuucauccagugcgagauccccgagcuggccaucaagcugaucaccgccgugggcaucaccguggugauggugcugaacagcaugagcgugagcuggagcgccagaauccagaucuuccugaccuucugcaagcugaccgccauccugaucaucaucgugcccggcgugaugcagcugaucaagggccagacccagaacuucaaggacgccuucagcggcagagacagcagcaucaccagacugccccuggccuucuacuacggcauguacgccuacgccggcugguucuaccugaacuucgugaccgaggagguggagaaccccgagaagaccaucccccuggccaucugcaucagcauggccaucgugaccaucggcuacgugcugaccaacguggccuacuucaccaccaucaacgccgaggagcugcugcugagcaacgccguggccgugaccuucagcgagagacugcugggcaacuucagccuggccgugcccaucuucguggcccugagcugcuucggcagcaugaacggcggcguguucgccgugagcagacuguucuacguggccagcagagagggccaccugcccgagauccugagcaugauccacgugagaaagcacaccccccugcccgccgugaucgugcugcacccccugaccaugaucaugcuguucagcggcgaccuggacagccugcugaacuuccugagcuucgccagauggcuguucaucggccuggccguggccggccugaucuaccugagauacaagugccccgacaugcacagacccuucaaggugccccuguucauccccgcccuguucagcuucaccugccuguucaugguggcccugagccuguacagcgaccccuucagcaccggcaucggcuucgugaucacccugaccggcgugcccgccuacuaccuguucaucaucugggacaagaagcccagaugguucagaaucaugagcgagaagaucaccagaacccugcagaucauccuggagguggugcccgaggaggacaagcuguaa

SEQ ID NO: 23651 - RNA, 1413 nt, Artificial Sequence
  SLC7A13__Homo_sapiens__NP_620172
auggacagaggcgagaagauccagcugaagagaguguucggcuacugguggggcaccagcuuccugcugaucaacaucaucggcgccggcaucuucgugagccccaagggcgugcuggccuacagcugcaugaacgugggcgugagccugugcgugugggccggcugcgccauccuggccaugaccagcacccugugcagcgccgagaucagcaucagcuuccccugcagcggcgcccaguacuacuuccugaagagauacuucggcagcaccguggccuuccugaaccuguggaccagccuguuccugggcagcggcgugguggccggccaggcccugcugcuggccgaguacagcauccagcccuucuuccccagcugcagcgugcccaagcugcccaagaagugccuggcccuggccaugcuguggaucgugggcauccugaccagcagaggcgugaaggaggugaccuggcugcagaucgccagcagcgugcugaaggugagcauccugagcuucaucagccugaccggcgugguguuccugaucagaggcaagaaggagaacguggagagauuccagaacgccuucgacgccgagcugcccgacaucagccaccugauccaggccaucuuccagggcuacuucgccuacagcggcggcgccugcuucacccugaucgccggcgagcugaagaagcccagaaccaccauccccaagugcaucuucaccgcccugccccuggugaccgugguguaccugcuggugaacaucagcuaccugaccgugcugacccccagagagauccugagcagcgacgccguggccaucaccugggccgacagagccuuccccagccuggccuggaucaugcccuucgccaucagcaccagccuguucagcaaccugcugaucagcaucuucaagagcagcagacccaucuaccuggccagccaggagggccagcugccccugcuguucaacacccugaacagccacagcagccccuucaccgccgugcugcugcuggugacccugggcagccuggccaucauccugaccagccugaucgaccugaucaacuacaucuucuucaccggcagccuguggagcauccugcugaugaucggcauccugagaagaagauaccaggagcccaaccugagcauccccuacaagguguuccugagcuucccccuggccaccaucgugaucgacgugggccugguggugaucccccuggugaagagccccaacgugcacuacguguacgugcugcugcuggugcugagcggccugcuguucuacaucccccugauccacuucaagaucagacuggccugguucgagaagaugaccugcuaccugcagcugcuguucaacaucugccugcccgacgugagcgaggaguaa

SEQ ID NO: 23652 - RNA, 2316 nt, Artificial Sequence
  SLC7A14__Homo_sapiens__NP_066000
augagcggcuucuucaccagccuggaccccagaagagugcaguggggcgccgccugguacgccaugcacagcagaauccugagaaccaagcccguggagagcaugcuggagggcaccggcaccaccaccgcccacggcaccaagcuggcccaggugcugaccaccguggaccugaucagccugggcgugggcagcugcgugggcaccggcauguacguggugagcggccugguggccaaggagauggccggccccggcgugaucgugagcuucaucaucgccgccguggccagcauccugagcggcgugugcuacgccgaguucggcgugagagugcccaagaccaccggcagcgccuacaccuacagcuacgugaccgugggcgaguucguggccuucuucaucggcuggaaccugauccuggaguaccugaucggcaccgccgccggcgccagcgcccugagcagcauguucgacagccuggccaaccacaccaucagcagauggauggccgacagcgugggcacccugaacggccugggcaagggcgaggagagcuaccccgaccugcuggcccugcugaucgccgugaucgugaccaucaucguggcccugggcgugaagaacagcaucggcuucaacaacgugcugaacgugcugaaccuggccguguggguguucaucaugaucgccggccuguucuucaucaacggcaaguacugggccgagggccaguuccugccccacggcuggagcggcgugcugcagggcgccgccaccugcuucuacgccuucaucggcuucgacaucaucgccaccaccggcgaggaggccaagaaccccaacaccagcauccccuacgccaucaccgccagccuggugaucugccugaccgccuacgugagcgugagcgugauccugacccugauggugcccuacuacaccaucgacaccgagagcccccugauggagauguucguggcccacggcuucuacgccgccaaguucgugguggccaucggcagcguggccggccugaccgugagccugcugggcagccuguuccccaugcccagagugaucuacgccauggccggcgacggccugcuguucagauuccuggcccacgugagcagcuacaccgagacccccgugguggccugcaucgugagcggcuuccuggccgcccugcuggcccugcuggugagccugagagaccugaucgagaugaugagcaucggcacccugcuggccuacacccuggugagcgugugcgugcugcugcugagauaccagcccgagagcgacaucgacggcuucgugaaguuccugagcgaggagcacaccaagaagaaggagggcauccuggccgacugcgagaaggaggccugcagccccgugagcgagggcgacgaguucagcggccccgccaccaacaccugcggcgccaagaaccugcccagccugggcgacaacgagaugcugaucggcaagagcgacaagagcaccuacaacgugaaccaccccaacuacggcaccguggacaugaccaccggcaucgaggccgacgagagcgagaacaucuaccugaucaagcugaagaagcugaucggcccccacuacuacaccaugagaaucagacugggccugcccggcaagauggacagacccaccgccgccaccggccacaccgugaccaucugcgugcugcugcuguucauccugauguucaucuucugcagcuucaucaucuucggcagcgacuacaucagcgagcagagcuggugggccauccugcugguggugcugauggugcugcugaucagcacccugguguucgugauccugcagcagcccgagaaccccaagaagcugcccuacauggcccccugccugcccuucgugcccgccuucgccaugcuggugaacaucuaccugaugcugaagcugagcaccaucaccuggaucagauucgccguguggugcuucgugggccugcugaucuacuucggcuacggcaucuggaacagcacccuggagaucagcgccagagaggaggcccugcaccagagcaccuaccagagauacgacguggacgaccccuucagcguggaggagggcuucagcuacgccaccgagggcgagagccaggaggacuggggcggccccaccgaggacaagggcuucuacuaccagcagaugagcgacgccaaggccaacggcagaaccagcagcaaggccaagagcaagagcaagcacaagcagaacagcgaggcccugaucgccaacgacgagcuggacuacagccccgaguaa

SEQ ID NO: 23653 - RNA, 1890 nt, Artificial Sequence
  SLC7A1__Homo_sapiens__XP_005266564
augggcugcaaggugcugcugaacaucggccagcagaugcugagaagaaaggugguggacugcagcagagaggagaccagacugagcagaugccugaacaccuucgaccugguggcccugggcgugggcagcacccugggcgccggcguguacgugcuggccggcgccguggccagagagaacgccggccccgccaucgugaucagcuuccugaucgccgcccuggccagcgugcuggccggccugugcuacggcgaguucggcgccagagugcccaagaccggcagcgccuaccuguacagcuacgugaccgugggcgagcugugggccuucaucaccggcuggaaccugauccugagcuacaucaucggcaccagcagcguggccagagccuggagcgccaccuucgacgagcugaucggcagacccaucggcgaguucagcagaacccacaugacccugaacgcccccggcgugcuggccgagaaccccgacaucuucgccgugaucaucauccugauccugaccggccugcugacccugggcgugaaggagagcgccauggugaacaagaucuucaccugcaucaacgugcuggugcugggcuucaucauggugagcggcuucgugaagggcagcgugaagaacuggcagcugaccgaggaggacuucggcaacaccagcggcagacugugccugaacaacgacaccaaggagggcaagcccggcgugggcggcuucaugcccuucggcuucagcggcgugcugagcggcgccgccaccugcuucuacgccuucgugggcuucgacugcaucgccaccaccggcgaggaggugaagaacccccagaaggccauccccgugggcaucguggccagccugcugaucugcuucaucgccuacuucggcgugagcgccgcccugacccugaugaugcccuacuucugccuggacaacaacagcccccugcccgacgccuucaagcacgugggcugggagggcgccaaguacgccguggccgugggcagccugugcgcccugagcgccagccugcugggcagcauguuccccaugcccagagugaucuacgccauggccgaggacggccugcuguucaaguuccuggccaacgugaacgacagaaccaagacccccaucaucgccacccuggccagcggcgccguggccgccgugauggccuuccuguucgaccugaaggaccugguggaccugaugagcaucggcacccugcuggccuacagccugguggccgccugcgugcuggugcugagauaccagcccgagcagcccaaccugguguaccagauggccagcaccagcgacgagcuggaccccgccgaccagaacgagcuggccagcaccaacgacagccagcugggcuuccugcccgaggccgagauguucagccugaagaccauccugagccccaagaacauggagcccagcaagaucagcggccugaucgugaacaucagcaccagccugaucgccgugcugaucaucaccuucugcaucgugaccgugcugggcagagaggcccugaccaagggcgcccugugggccguguuccugcuggccggcagcgcccugcugugcgccguggugaccggcgugaucuggagacagcccgagagcaagaccaagcugagcuucaaggugcccuuccugcccgugcugcccauccugagcaucuucgugaacguguaccugaugaugcagcuggaccagggcaccugggugagauucgccguguggaugcugaucggcuucaucaucuacuucggcuacggccuguggcacagcgaggaggccagccuggacgccgaccaggccagaacccccgacggcaaccuggaccagugcaaguaa

SEQ ID NO: 23654 - RNA, 2097 nt, Artificial Sequence
  SLC7A2__Homo_sapiens__NP_001158243
augaagaucgagaccagcggcuacaacagcgacaagcugaucugcagaggcuucaucggcacccccgccccccccgugugcgacagcaaguuccugcugagccccagcagcgacgugagaaugauccccugcagagccgcccugaccuucgccagaugccugaucagaagaaagaucgugacccuggacagccuggaggacaccaagcugugcagaugccugagcaccauggaccugaucgcccugggcgugggcagcacccugggcgccggcguguacgugcuggccggcgagguggccaaggccgacagcggccccagcaucguggugagcuuccugaucgccgcccuggccagcgugauggccggccugugcuacgccgaguucggcgccagagugcccaagaccggcagcgccuaccuguacaccuacgugaccgugggcgagcugugggccuucaucaccggcuggaaccugauccugagcuacgugaucggcaccagcagcguggccagagccuggagcggcaccuucgacgagcugcugagcaagcagaucggccaguuccugagaaccuacuucagaaugaacuacaccggccuggccgaguaccccgacuucuucgccgugugccugauccugcugcuggccggccugcugagcuucggcgugaaggagagcgccugggugaacaagguguucaccgccgugaacauccuggugcugcuguucgugaugguggccggcuucgugaagggcaacguggccaacuggaagaucagcgaggaguuccugaagaacaucagcgccagcgccagagagccccccagcgagaacggcaccagcaucuacggcgccggcggcuucaugcccuacggcuucaccggcacccuggccggcgccgccaccugcuucuacgccuucgugggcuucgacugcaucgccaccaccggcgaggaggugagaaacccccagaaggccauccccaucggcaucgugaccagccugcuggugugcuucauggccuacuucggcgugagcgccgcccugacccugaugaugcccuacuaccugcuggacgagaagagcccccugcccguggccuucgaguacgugggcuggggccccgccaaguacgugguggccgccggcagccugugcgcccugagcaccagccugcugggcagcaucuuccccaugcccagagugaucuacgccauggccgaggacggccugcuguucaagugccuggcccagaucaacagcaagaccaagacccccaucaucgccacccugagcagcggcgccguggccgcccugauggccuuccuguucgaccugaaggcccugguggacaugaugagcaucggcacccugauggccuacagccugguggccgccugcgugcugauccugagauaccagcccggccugagcuacgaccagcccaagugcagccccgagaaggacggccugggcagcagccccagagugaccagcaagagcgagagccaggugaccaugcugcagagacagggcuucagcaugagaacccuguucugccccagccugcugcccacccagcagagcgccagccuggugagcuuccuggugggcuuccuggccuuccuggugcugggccugagcgugcugaccaccuacggcgugcacgccaucaccagacuggaggccuggagccuggcccugcuggcccuguuccuggugcuguucguggccaucgugcugaccaucuggagacagccccagaaccagcagaagguggccuucauggugcccuuccugcccuuccugcccgccuucagcauccuggugaacaucuaccugauggugcagcugagcgccgacaccugggugagauucagcaucuggauggccaucggcuuccugaucuacuucagcuacggcaucagacacagccuggagggccaccugagagacgagaacaacgaggaggacgccuaccccgacaacgugcacgccgccgccgaggagaagagcgccauccaggccaacgaccaccaccccagaaaccugagcagccccuucaucuuccacgagaagaccagcgaguucuaa

SEQ ID NO: 23655 - RNA, 1860 nt, Artificial Sequence
  SLC7A3__Homo_sapiens__NP_001041629
augcccuggcaggccuucagaagauucggccagaagcuggugagaagaagaacccuggagagcggcauggccgagaccagacuggccagaugccugagcacccuggaccugguggcccugggcgugggcagcacccugggcgccggcguguacgugcuggccggcgagguggccaaggacaaggccggccccagcaucgugaucugcuuccugguggccgcccugagcagcgugcuggccggccugugcuacgccgaguucggcgccagagugcccagaagcggcagcgccuaccuguacagcuacgugaccgugggcgagcugugggccuucaccaccggcuggaaccugauccugagcuacgugaucggcaccgccagcguggccagagccuggagcagcgccuucgacaaccugaucggcaaccacaucagcaagacccugcagggcagcaucgcccugcacgugccccacgugcuggccgaguaccccgacuucuucgcccugggccuggugcugcugcugaccggccugcuggcccugggcgccagcgagagcgcccuggugaccaagguguucaccggcgugaaccugcuggugcugggcuucgugaugaucagcggcuucgugaagggcgacgugcacaacuggaagcugaccgaggaggacuacgagcuggccauggccgagcugaacgacaccuacagccugggcccccugggcagcggcggcuucgugcccuucggcuucgagggcauccugagaggcgccgccaccugcuucuacgccuucgugggcuucgacugcaucgccaccaccggcgaggaggcccagaacccccagagaagcauccccaugggcaucgugaucagccugagcgugugcuuccuggccuacuucgccgugagcagcgcccugacccugaugaugcccuacuaccagcugcagcccgagagcccccugcccgaggccuuccuguacaucggcugggcccccgccagauacgugguggccgugggcagccugugcgcccugagcaccagccugcugggcagcauguuccccaugcccagagugaucuacgccauggccgaggacggccugcuguucagagugcuggccagaauccacaccggcaccagaacccccaucaucgccaccguggugagcggcaucaucgccgccuucauggccuuccuguucaagcugaccgaccugguggaccugaugagcaucggcacccugcuggccuacagccuggugagcaucugcgugcugauccugagauaccagcccgaccaggagaccaagaccggcgaggagguggagcugcaggaggaggccaucaccaccgagagcgagaagcugacccuguggggccuguucuucccccugaacagcauccccaccccccugagcggccagaucguguacgugugcagcagccugcuggccgugcugcugaccgcccugugccuggugcuggcccaguggagcgugccccugcugagcggcgaccugcuguggaccgccgugguggugcugcugcugcugcugaucaucggcaucaucguggugaucuggagacagccccagagcagcaccccccugcacuucaaggugcccgcccugccccugcugccccugaugagcaucuucgugaacaucuaccugaugaugcagaugaccgccggcaccugggccagauucggcguguggaugcugaucggcuucgccaucuacuucggcuacggcauccagcacagccuggaggagaucaagagcaaccagcccagcagaaagagcagagccaagaccguggaccuggaccccggcacccuguacgugcacagcguguaa

SEQ ID NO: 23656 - RNA, 1908 nt, Artificial Sequence
  SLC7A4__Homo_sapiens__NP_004164
auggccagaggccugcccaccaucgccagccuggccagacugugccagaagcugaacagacugaagccccuggaggacagcaccauggagaccagccugagaagaugccugagcacccuggaccugacccugcugggcgugggcggcauggugggcagcggccuguacgugcugaccggcgccguggccaaggagguggccggccccgccgugcugcugagcuucggcguggccgccguggccagccugcuggccgcccugugcuacgccgaguucggcgccagagugcccagaaccggcagcgccuaccuguucaccuacgugagcaugggcgagcugugggccuuccugaucggcuggaacgugcugcuggaguacaucaucggcggcgccgccguggccagagccuggagcggcuaccuggacagcauguucagccacagcaucagaaacuucaccgagacccacgugggcagcuggcaggugccccugcugggccacuaccccgacuuccuggccgccggcaucauccugcuggccagcgccuucgugagcugcggcgccagagugagcagcuggcugaaccacaccuucagcgccaucagccugcuggugauccuguucaucgugauccugggcuucauccuggcccagccccacaacuggagcgccgacgagggcggcuucgcccccuucggcuucagcggcgugauggccggcaccgccagcugcuucuacgccuucgugggcuucgacgugaucgccgccagcagcgaggaggcccagaaccccagaagaagcgugccccuggccaucgccaucagccuggccaucgccgccggcgccuacauccuggugagcaccgugcugacccugauggugcccuggcacagccuggaccccgacagcgcccuggccgacgccuucuaccagagaggcuacagaugggccggcuucaucguggccgccggcagcaucugcgccaugaacaccgugcugcugagccugcuguucagccugcccagaaucguguacgccauggccgccgacggccuguucuuccagguguucgcccacgugcaccccagaacccaggugcccguggccggcacccuggccuucggccugcugaccgccuuccuggcccugcugcuggaccuggagagccuggugcaguuccugagccugggcacccugcuggccuacaccuucguggccaccagcaucaucgugcugagauuccagaagagcagcccccccagcagccccggccccgccagccccggcccccugaccaagcagcagagcagcuucagcgaccaccugcagcuggugggcaccgugcacgccagcgugcccgagcccggcgagcugaagcccgcccugagacccuaccugggcuuccuggacggcuacagccccggcgccguggugaccugggcccugggcgugaugcuggccagcgccaucaccaucggcugcgugcugguguucggcaacagcacccugcaccugccccacuggggcuacauccugcugcugcugcugaccagcgugauguuccugcugagccugcuggugcugggcgcccaccagcagcaguacagagaggaccuguuccagauccccauggugccccugauccccgcccugagcaucgugcugaacaucugccugaugcugaagcugagcuaccugaccugggugagauucagcaucuggcugcugaugggccuggccguguacuucggcuacggcaucagacacagcaaggagaaccagagagagcugcccggccugaacagcacccacuacgugguguuccccagaggcagccuggaggagaccgugcaggccaugcagccccccagccaggcccccgcccaggaccccggccacauggaguaa

SEQ ID NO: 23657 - RNA, 1524 nt, Artificial Sequence
  SLC7A5__Homo_sapiens__NP_003477
auggccggcgccggccccaagagaagagcccuggccgcccccgccgccgaggagaaggaggaggccagagagaagaugcuggccgccaagagcgccgacggcagcgcccccgccggcgagggcgagggcgugacccugcagagaaacaucacccugcugaacggcguggccaucaucgugggcaccaucaucggcagcggcaucuucgugacccccaccggcgugcugaaggaggccggcagccccggccuggcccugguggugugggccgccugcggcguguucagcaucgugggcgcccugugcuacgccgagcugggcaccaccaucagcaagagcggcggcgacuacgccuacaugcuggagguguacggcagccugcccgccuuccugaagcuguggaucgagcugcugaucaucagacccagcagccaguacaucguggcccugguguucgccaccuaccugcugaagccccuguuccccaccugccccgugcccgaggaggccgccaagcugguggccugccugugcgugcugcugcugaccgccgugaacugcuacagcgugaaggccgccaccagagugcaggacgccuucgccgccgccaagcugcuggcccuggcccugaucauccugcugggcuucgugcagaucggcaagggcgacgugagcaaccuggaccccaacuucagcuucgagggcaccaagcuggacgugggcaacaucgugcuggcccuguacagcggccuguucgccuacggcggcuggaacuaccugaacuucgugaccgaggagaugaucaaccccuacagaaaccugccccuggccaucaucaucagccugcccaucgugacccugguguacgugcugaccaaccuggccuacuucaccacccugagcaccgagcagaugcugagcagcgaggccguggccguggacuucggcaacuaccaccugggcgugaugagcuggaucauccccguguucgugggccugagcugcuucggcagcgugaacggcagccuguucaccagcagcagacuguucuucgugggcagcagagagggccaccugcccagcauccugagcaugauccacccccagcugcugacccccgugcccagccugguguucaccugcgugaugacccugcuguacgccuucagcaaggacaucuucagcgugaucaacuucuucagcuucuucaacuggcugugcguggcccuggccaucaucggcaugaucuggcugagacacagaaagcccgagcuggagagacccaucaaggugaaccuggcccugcccguguucuucauccuggccugccuguuccugaucgccgugagcuucuggaagacccccguggagugcggcaucggcuucaccaucauccugagcggccugcccguguacuucuucggcgugugguggaagaacaagcccaaguggcugcugcagggcaucuucagcaccaccgugcugugccagaagcugaugcagguggugccccaggagaccuaa

SEQ ID NO: 23658 - RNA, 1548 nt, Artificial Sequence
  SLC7A6__Homo_sapiens__NP_003974
auggaggccagagagcccggcagacccacccccaccuaccaccuggugcccaacaccagccagagccagguggaggaggacgugagcagccccccccagagaagcagcgagaccaugcagcugaagaaggagaucagccugcugaacggcgugagccugguggugggcaacaugaucggcagcggcaucuucgugagccccaagggcgugcuggugcacaccgccagcuacggcaugagccugaucgugugggccaucggcggccuguucagcguggugggcgcccugugcuacgccgagcugggcaccaccaucaccaagagcggcgccagcuacgccuacauccuggaggccuucggcggcuucaucgccuucaucagacugugggugagccugcuggugguggagcccaccggccaggccaucaucgccaucaccuucgccaacuacaucauccagcccagcuuccccagcugcgacccccccuaccuggccugcagacugcuggccgccgccugcaucugccugcugaccuucgugaacugcgccuacgugaaguggggcaccagagugcaggacaccuucaccuacgccaaggugguggcccugaucgccaucaucgugaugggccuggugaagcugugccagggccacagcgagcacuuccaggacgccuucgagggcagcagcugggacaugggcaaccugagccuggcccuguacagcgcccuguucagcuacagcggcugggacacccugaacuucgugaccgaggagaucaagaaccccgagagaaaccugccccuggccaucggcaucagcaugcccaucgugacccugaucuacauccugaccaacguggccuacuacaccgugcugaacaucagcgacgugcugagcagcgacgccguggccgugaccuucgccgaccagaccuucggcauguucagcuggaccauccccaucgccguggcccugagcugcuucggcggccugaacgccagcaucuucgccagcagcagacuguucuucgugggcagcagagagggccaccugcccgaccugcugagcaugauccacaucgagagauucacccccauccccgcccugcuguucaacugcaccauggcccugaucuaccugaucguggaggacguguuccagcugaucaacuacuucagcuucagcuacugguucuucgugggccugagcguggugggccagcuguaccugagauggaaggagcccaagagacccagaccccugaagcugagcguguucuuccccaucguguucugcaucugcagcguguuccuggugaucgugccccuguucaccgacaccaucaacagccugaucggcaucggcaucgcccugagcggcgugcccuucuacuucaugggcguguaccugcccgagagcagaagaccccuguucaucagaaacgugcuggccgccaucaccagaggcacccagcagcugugcuucugcgugcugaccgagcuggacguggccgaggagaagaaggacgagagaaagaccgacuaa

SEQ ID NO: 23659 - RNA, 1536 nt, Artificial Sequence
  SLC7A7__Homo_sapiens__XP_011535601
augguggacagcaccgaguacgagguggccagccagcccgagguggagaccagcccccugggcgacggcgccagccccggccccgagcaggugaagcugaagaaggagaucagccugcugaacggcgugugccugaucgugggcaacaugaucggcagcggcaucuucgugagccccaagggcgugcugaucuacagcgccagcuucggccugagccuggugaucugggccgugggcggccuguucagcguguucggcgcccugugcuacgccgagcugggcaccaccaucaagaagagcggcgccagcuacgccuacauccuggaggccuucggcggcuuccuggccuucaucagacuguggaccagccugcugaucaucgagcccaccagccaggccaucaucgccaucaccuucgccaacuacauggugcagccccuguuccccagcugcuucgcccccuacgccgccagcagacugcuggccgccgccugcaucugccugcugaccuucaucaacugcgccuacgugaaguggggcacccuggugcaggacaucuucaccuacgccaaggugcuggcccugaucgccgugaucguggccggcaucgugagacugggccagggcgccagcacccacuucgagaacagcuucgagggcagcagcuucgccgugggcgacaucgcccuggcccuguacagcgcccuguucagcuacagcggcugggacacccugaacuacgugaccgaggagaucaagaaccccgagagaaaccugccccugagcaucggcaucagcaugcccaucgugaccaucaucuacauccugaccaacguggccuacuacaccgugcuggacaugagagacauccuggccagcgacgccguggccgugaccuucgccgaccagaucuucggcaucuucaacuggaucaucccccugagcguggcccugagcugcuucggcggccugaacgccagcaucguggccgccagcagacuguucuucgugggcagcagagagggccaccugcccgacgccaucugcaugauccacguggagagauucacccccgugcccagccugcuguucaacggcaucauggcccugaucuaccugugcguggaggacaucuuccagcugaucaacuacuacagcuucagcuacugguucuucgugggccugagcaucgugggccagcuguaccugagauggaaggagcccgacagacccagaccccugaagcugagcguguucuuccccaucguguucugccugugcaccaucuuccugguggccgugccccuguacagcgacaccaucaacagccugaucggcaucgccaucgcccugagcggccugcccuucuacuuccugaucaucagagugcccgagcacaagagaccccuguaccugagaagaaucgugggcagcgccaccagauaccugcaggugcugugcaugagcguggccgccgagauggaccuggaggacggcggcgagaugcccaagcagagagaccccaagagcaacuaa

SEQ ID NO: 23660 - RNA, 1293 nt, Artificial Sequence
  SLC7A8__Homo_sapiens__NP_001253965
augggccaguacggccaggagcugagcuggaagugccuggugaaggccgugugccugcaggagcacagccagcccagccagcugcugugcacccugcugcugugcuggugcgugcugggcagagagagacccuucagaaaggcccagagcaccagcagcccccuggagggcgugcccagauuccugaagagacugcugcugaccugggugaacugcagcagcgugagaugggccaccagagugcaggacaucuucaccgccggcaagcugcuggcccuggcccugaucaucaucaugggcaucgugcagaucugcaagggcgaguacuucuggcuggagcccaagaacgccuucgagaacuuccaggagcccgacaucggccugguggcccuggccuuccugcagggcagcuucgccuacggcggcuggaacuuccugaacuacgugaccgaggagcugguggaccccuacaagaaccugcccagagccaucuucaucagcaucccccuggugaccuucguguacguguucgccaacguggccuacgugaccgccaugagcccccaggagcugcuggccagcaacgccguggccgugaccuucggcgagaagcugcugggcgugauggccuggaucaugcccaucagcguggcccugagcaccuucggcggcgugaacggcagccuguucaccagcagcagacuguucuucgccggcgccagagagggccaccugcccagcgugcuggccaugauccacgugaagagaugcacccccauccccgcccugcuguucaccugcaucagcacccugcugaugcuggugaccagcgacauguacacccugaucaacuacgugggcuucaucaacuaccuguucuacggcgugaccguggccggccagaucgugcugagauggaagaagcccgacauccccagacccaucaagaucaaccugcuguuccccaucaucuaccugcuguucugggccuuccugcugguguucagccuguggagcgagcccguggugugcggcaucggccuggccaucaugcugaccggcgugcccguguacuuccugggcguguacuggcagcacaagcccaagugcuucagcgacuucaucgagcugcugacccuggugagccagaagaugugcguggugguguaccccgagguggagagaggcagcggcaccgaggaggccaacgaggacauggaggagcagcagcagcccauguaccagcccacccccaccaaggacaaggacguggccggccagccccagcccuaa

SEQ ID NO: 23661 - RNA, 1464 nt, Artificial Sequence
  SLC7A9__Homo_sapiens__XP_011524704
augggcgacaccggccugagaaagagaagagaggacgagaagagcauccagagccaggagcccaagaccaccagccugcagaaggagcugggccugaucagcggcaucagcaucaucgugggcaccaucaucggcagcggcaucuucgugagccccaagagcgugcugagcaacaccgaggccgugggccccugccugaucaucugggccgccugcggcgugcuggccacccugggcgcccugugcuucgccgagcugggcaccaugaucaccaagagcggcggcgaguaccccuaccugauggaggccuacggccccauccccgccuaccuguucagcugggccagccugaucgugaucaagcccaccagcuucgccaucaucugccugagcuucagcgaguacgugugcgcccccuucuacgugggcugcaagcccccccagaucguggugaagugccuggccgccgccgccauccuguucaucagcaccgugaacagccugagcgugagacugggcagcuacgugcagaacaucuucaccgccgccaagcuggugaucguggccaucaucaucaucagcggccuggugcugcuggcccagggcaacaccaagaacuucgacaacagcuucgagggcgcccagcugagcgugggcgccaucagccuggccuucuacaacggccugugggccuacgacggcuggaaccagcugaacuacaucaccgaggagcugagaaaccccuacagaaaccugccccuggccaucaucaucggcaucccccuggugaccgccugcuacauccugaugaacgugagcuacuucaccgugaugaccgccaccgagcugcugcagagccaggccguggccgugaccuucggcgacagagugcuguaccccgccagcuggaucgugccccuguucguggccuucagcaccaucggcgccgccaacggcaccugcuucaccgccggcagacugaucuacguggccggcagagagggccacaugcugaaggugcugagcuacaucagcgugagaagacugacccccgcccccgccaucaucuucuacggcaucaucgccaccaucuacaucauccccggcgacaucaacagccuggugaacuacuucagcuucgccgccuggcuguucuacggccugaccauccugggccugaucgugaugagauucaccagaaaggagcuggagagacccaucaaggugcccguggugauccccgugcugaugacccugaucagcguguuccuggugcuggcccccaucaucagcaagcccaccugggaguaccuguacugcgugcuguucauccugagcggccugcuguucuacuuccuguucgugcacuacaaguucggcugggcccagaagaucagcaagcccaucaccaugcaccugcagaugcugauggagguggugccccccgaggaggaccccgaguaa

SEQ ID NO: 23662 - RNA, 2907 nt, Artificial Sequence
  SLC8A1__Homo_sapiens__NP_001106271
auguacaacaugagaagacugagccugagccccaccuucagcaugggcuuccaccugcuggugaccgugagccugcuguucagccacguggaccacgugaucgccgagaccgagauggagggcgagggcaacgagaccggcgagugcaccggcagcuacuacugcaagaagggcgugauccugcccaucugggagccccaggaccccagcuucggcgacaagaucgccagagccaccguguacuucguggccaugguguacauguuccugggcgugagcaucaucgccgacagauucaugagcagcaucgaggugaucaccagccaggagaaggagaucaccaucaagaagcccaacggcgagaccaccaagaccaccgugagaaucuggaacgagaccgugagcaaccugacccugauggcccugggcagcagcgcccccgagauccugcugagcgugaucgaggugugcggccacaacuucaccgccggcgaccugggccccagcaccaucgugggcagcgccgccuucaacauguucaucaucaucgcccugugcguguacguggugcccgacggcgagaccagaaagaucaagcaccugagaguguucuucgugaccgccgccuggagcaucuucgccuacaccuggcuguacaucauccugagcgugaucagccccggcgugguggaggugugggagggccugcugaccuucuucuucuuccccaucugcgugguguucgccuggguggccgacagaagacugcuguucuacaaguacguguacaagagauacagagccggcaagcagagaggcaugaucaucgagcacgagggcgacagacccagcagcaagaccgagaucgagauggacggcaagguggugaacagccacguggagaacuuccuggacggcgcccuggugcuggagguggacgagagagaccaggacgacgaggaggccagaagagagauggccagaauccugaaggagcugaagcagaagcaccccgacaaggagaucgagcagcugaucgagcuggccaacuaccaggugcugagccagcagcagaagagcagagccuucuacagaauccaggccaccagacugaugaccggcgccggcaacauccugaagagacacgccgccgaccaggccagaaaggccgugagcaugcacgaggugaacaccgaggugaccgagaacgaccccgugagcaagaucuucuucgagcagggcaccuaccagugccuggagaacugcggcaccguggcccugaccaucaucagaagaggcggcgaccugaccaacaccguguucguggacuucagaaccgaggacggcaccgccaacgccggcagcgacuacgaguucaccgagggcaccgugguguucaagcccggcgacacccagaaggagaucagagugggcaucaucgacgacgacaucuucgaggaggacgagaacuuccuggugcaccugagcaacgugaaggugagcagcgaggccagcgaggacggcauccuggaggccaaccacgugagcacccuggccugccugggcagccccagcaccgccaccgugaccaucuucgacgacgaccacgccggcaucuucaccuucgaggagcccgugacccacgugagcgagagcaucggcaucauggaggugaaggugcugagaaccagcggcgccagaggcaacgugaucgugcccuacaagaccaucgagggcaccgccagaggcggcggcgaggacuucgaggacaccugcggcgagcuggaguuccagaacgacgagaucgugaagaccaucagcgugaaggugaucgacgacgaggaguacgagaagaacaagaccuucuuccuggagaucggcgagcccagacugguggagaugagcgagaagaaggcccugcugcugaacgagcugggcggcuucaccaucaccggccagcccguguucagaaaggugcacgccagagagcaccccauccugagcaccgugaucaccaucgccgacgaguacgacgacaagcagccccugaccagcaaggaggaggaggagagaagaaucgccgagaugggcagacccauccugggcgagcacaccaagcuggaggugaucaucgaggagagcuacgaguucaagagcaccguggacaagcugaucaagaagaccaaccuggcccugguggugggcaccaacagcuggagagagcaguucaucgaggccaucaccgugagcgccggcgaggacgacgacgacgacgagugcggcgaggagaagcugcccagcugcuucgacuacgugaugcacuuccugaccguguucuggaaggugcuguucgccuucgugccccccaccgaguacuggaacggcugggccugcuucaucgugagcauccugaugaucggccugcugaccgccuucaucggcgaccuggccagccacuucggcugcaccaucggccugaaggacagcgugaccgccgugguguucguggcccugggcaccagcgugcccgacaccuucgccagcaagguggccgccacccaggaccaguacgccgacgccagcaucggcaacgugaccggcagcaacgccgugaacguguuccugggcaucggcguggccuggagcaucgccgccaucuaccacgccgccaacggcgagcaguucaaggugagccccggcacccuggccuucagcgugacccuguucaccaucuucgccuucaucaacgugggcgugcugcuguacagaagaagacccgagaucggcggcgagcugggcggccccagaaccgccaagcugcugaccagcugccuguucgugcugcuguggcugcuguacaucuucuucagcagccuggaggccuacugccacaucaagggcuucuaa

SEQ ID NO: 23663 - RNA, 2766 nt, Artificial Sequence
  SLC8A2__Homo_sapiens__NP_055878
auggccccccuggcccuggugggcgugacccugcugcuggccgccccccccugcagcggcgccgccacccccacccccagccugccccccccccccgccaacgacagcgacaccagcaccggcggcugccagggcagcuacagaugccagcccggcgugcugcugcccgugugggagcccgacgaccccagccugggcgacaaggccgccagagccgugguguacuucguggccaugguguacauguuccugggcgugagcaucaucgccgacagauucauggccgccaucgaggugaucaccagcaaggagaaggagaucaccaucaccaaggccaacggcgagaccagcgugggcaccgugagaaucuggaacgagaccgugagcaaccugacccugauggcccugggcagcagcgcccccgagauccugcugagcgugaucgaggugugcggccacaacuuccaggccggcgagcugggccccggcaccaucgugggcagcgccgccuucaacauguucguggugaucgccgugugcaucuacgugauccccgccggcgagagcagaaagaucaagcaccugagaguguucuucgugaccgccagcuggagcaucuucgccuacguguggcuguaccugauccuggccguguucagccccggcguggugcaggugugggaggcccugcugacccugguguucuuccccgugugcgugguguucgccuggauggccgacaagagacugcuguucuacaaguacguguacaagagauacagaaccgaccccagaagcggcaucaucaucggcgccgagggcgacccccccaagagcaucgagcuggacggcaccuucgugggcgccgaggcccccggcgagcugggcggccugggccccggccccgccgaggccagagagcuggacgccagcagaagagaggugauccagauccugaaggaccugaagcagaagcaccccgacaaggaccuggagcagcuggugggcaucgccaacuacuacgcccugcugcaccagcagaagagcagagccuucuacagaauccaggccaccagacugaugaccggcgccggcaacgugcugagaagacacgccgccgacgccagcagaagagccgcccccgccgagggcgccggcgaggacgaggacgacggcgccagcagaaucuucuucgagcccagccuguaccacugccuggagaacugcggcagcgugcugcugagcgugaccugccagggcggcgagggcaacagcaccuucuacguggacuacagaaccgaggacggcagcgccaaggccggcagcgacuacgaguacagcgagggcacccugguguucaagcccggcgagacccagaaggagcugagaaucggcaucaucgacgacgacaucuucgaggaggacgagcacuucuucgugagacugcugaaccugagagugggcgacgcccagggcauguucgagcccgacggcggcggcagacccaagggcagacugguggccccccugcuggccaccgugaccauccuggacgacgaccacgccggcaucuucagcuuccaggacagacugcugcacgugagcgagugcaugggcaccguggacgugagaguggugagaagcagcggcgccagaggcaccgugagacugcccuacagaaccguggacggcaccgccagaggcggcggcgugcacuacgaggacgccugcggcgagcuggaguucggcgacgacgagaccaugaagacccugcaggugaagaucguggacgacgaggaguacgagaagaaggacaacuucuucaucgagcugggccagccccaguggcugaagagaggcaucagcgcccugcugcugaaccagggcgacggcgacagaaagcugaccgccgaggaggaggaggccagaagaaucgccgagaugggcaagcccgugcugggcgagaacugcagacuggaggugaucaucgaggagagcuacgacuucaagaacaccguggacaagcugaucaagaagaccaaccuggcccuggugaucggcacccacagcuggagagagcaguuccuggaggccaucaccgugagcgccggcgacgaggaggaggaggaggacggcagcagagaggagagacugcccagcugcuucgacuacgugaugcacuuccugaccguguucuggaaggugcuguucgccugcgugccccccaccgaguacugccacggcugggccugcuucggcgugagcauccuggugaucggccugcugaccgcccugaucggcgaccuggccagccacuucggcugcaccgugggccugaaggacagcgugaacgccgugguguucguggcccugggcaccagcauccccgacaccuucgccagcaagguggccgcccugcaggaccagugcgccgacgccagcaucggcaacgugaccggcagcaacgccgugaacguguuccugggccugggcguggccuggagcguggccgccguguacugggccgugcagggcagacccuucgaggugagaaccggcacccuggccuucagcgugacccuguucaccguguucgccuucgugggcaucgccgugcugcuguacagaagaagaccccacaucggcggcgagcugggcggccccagaggccccaagcuggccaccaccgcccuguuccugggccuguggcugcuguacauccuguucgccagccuggaggccuacugccacaucagaggcuucuaa

SEQ ID NO: 23664 - RNA, 897 nt, Artificial Sequence
  SLC8A3__Homo_sapiens__NP_001123889
auggagagaggcaucagcgacgugaccgacagaaagcugaccauggaggaggaggaggccaagagaaucgccgagaugggcaagcccgugcugggcgagcaccccaagcuggaggugaucaucgaggagagcuacgaguucaagaccaccguggacaagcugaucaagaagaccaaccuggcccugguggugggcacccacagcuggagagaccaguucauggaggccaucaccgugagcgccgccggcgacgaggacgaggacgagagcggcgaggagagacugcccagcugcuucgacuacgugaugcacuuccugaccguguucuggaaggugcuguucgccugcgugccccccaccgaguacugccacggcugggccugcuucgccgugagcauccugaucaucggcaugcugaccgccaucaucggcgaccuggccagccacuucggcugcaccaucggccugaaggacagcgugaccgccgugguguucguggccuucggcaccagcgugcccgacaccuucgccagcaaggccgccgcccugcaggacguguacgccgacgccagcaucggcaacgugaccggcagcaacgccgugaacguguuccugggcaucggccuggccuggagcguggccgccaucuacugggcccugcagggccaggaguuccacgugagcgccggcacccuggccuucagcgugacccuguucaccaucuucgccuucgugugcaucagcgugcugcuguacagaagaagaccccaccugggcggcgagcugggcggccccagaggcugcaagcuggccaccaccuggcuguucgugagccuguggcugcuguacauccuguucgccacccuggaggccuacugcuacaucaagggcuucuaa

SEQ ID NO: 23665 - RNA, 2118 nt, Artificial Sequence
  SLC9A1__Homo_sapiens__XP_011540323
augggcaaggacgccugccccggcuuccacgugauccccaccaucagcagcaucgugcccgagagcugccugcugaucguggugggccugcuggugggcggccugaucaagggcgugggcgagaccccccccuuccugcagagcgacguguucuuccuguuccugcugccccccaucauccuggacgccggcuacuuccugccccugagacaguucaccgagaaccugggcaccauccugaucuucgccguggugggcacccuguggaacgccuucuuccugggcggccugauguacgccgugugccuggugggcggcgagcagaucaacaacaucggccugcuggacaaccugcuguucggcagcaucaucagcgccguggaccccguggccgugcuggccguguucgaggagauccacaucaacgagcugcugcacauccugguguucggcgagagccugcugaacgacgccgugaccguggugcuguaccaccuguucgaggaguucgccaacuacgagcacgugggcaucguggacaucuuccugggcuuccugagcuucuucgugguggcccugggcggcgugcuggugggcgugguguacggcgugaucgccgccuucaccagcagauucaccagccacaucagagugaucgagccccuguucguguuccuguacagcuacauggccuaccugagcgccgagcuguuccaccugagcggcaucauggcccugaucgccagcggcguggugaugagacccuacguggaggccaacaucagccacaagagccacaccaccaucaaguacuuccugaagauguggagcagcgugagcgagacccugaucuucaucuuccugggcgugagcaccguggccggcagccaccacuggaacuggaccuucgugaucagcacccugcuguucugccugaucgccagagugcugggcgugcugggccugaccugguucaucaacaaguucagaaucgugaagcugacccccaaggaccaguucaucaucgccuacggcggccugagaggcgccaucgccuucagccugggcuaccugcuggacaagaagcacuuccccaugugcgaccuguuccugaccgccaucaucaccgugaucuucuucaccguguucgugcagggcaugaccaucagaccccugguggaccugcuggccgugaagaagaagcaggagaccaagagaagcaucaacgaggagauccacacccaguuccuggaccaccugcugaccggcaucgaggacaucugcggccacuacggccaccaccacuggaaggacaagcugaacagauucaacaagaaguacgugaagaagugccugaucgccggcgagagaagcaaggagccccagcugaucgccuucuaccacaagauggagaugaagcaggccaucgagcugguggagagcggcggcaugggcaagauccccagcgccgugagcaccgugagcaugcagaacauccaccccaagagccugcccagcgagagaauccugcccgcccugagcaaggacaaggaggaggagaucagaaagauccugagaaacaaccugcagaagaccagacagagacugagaagcuacaacagacacacccugguggccgaccccuacgaggaggccuggaaccagaugcugcugagaagacagaaggccagacagcuggagcagaagaucaacaacuaccugaccgugcccgcccacaagcuggacagccccaccaugagcagagccagaaucggcagcgacccccuggccuacgagcccaaggaggaccugcccgugaucaccaucgaccccgccagcccccagagccccgagagcguggaccuggugaacgaggagcugaagggcaaggugcugggccugagcagagaccccgccaagguggccgaggaggacgaggacgacgacggcggcaucaugaugagaagcaaggagaccagcagccccggcaccgacgacguguucacccccgcccccagcgacagccccagcagccagagaauccagagaugccugagcgaccccggcccccaccccgagcccggcgagggcgagcccuucuuccccaagggccaguaa

SEQ ID NO: 23666 - RNA, 2439 nt, Artificial Sequence
  SLC9A2__Homo_sapiens__NP_003039
auggagccccugggcaacuggagaagccugagagccccccugccccccaugcugcugcugcugcugcugcagguggccggccccgugggcgcccuggccgagacccugcugaacgcccccagagccaugggcaccagcagcagcccccccagccccgccagcgugguggcccccggcaccacccuguucgaggagagcagacugcccguguucacccuggacuacccccacgugcagauccccuucgagaucacccuguggauccugcuggccagccuggccaagaucggcuuccaccuguaccacaagcugcccaccaucgugcccgagagcugccugcugaucauggugggccugcugcugggcggcaucaucuucggcguggacgagaagagcccccccgccaugaagaccgacguguucuuccuguaccugcugccccccaucgugcuggacgccggcuacuucaugcccaccagacccuucuucgagaacaucggcaccaucuucugguacgccguggugggcacccuguggaacagcaucggcaucggcgugagccuguucggcaucugccagaucgaggccuucggccugagcgacaucacccugcugcagaaccugcuguucggcagccugaucagcgccguggaccccguggccgugcuggccguguucgagaacauccacgugaacgagcagcuguacauccugguguucggcgagagccugcugaacgacgccgugaccguggugcuguacaaccuguucaagagcuucugccagaugaagaccaucgagaccaucgacguguucgccggcaucgccaacuucuucguggugggcaucggcggcgugcugaucggcaucuuccugggcuucaucgccgccuucaccaccagauucacccacaacaucagagugaucgagccccuguucguguuccuguacagcuaccugagcuacaucaccgccgagauguuccaccugagcggcaucauggccaucaccgccugcgccaugaccaugaacaaguacguggaggagaacgugagccagaagagcuacaccaccaucaaguacuucaugaagaugcugagcagcgugagcgagacccugaucuucaucuucaugggcgugagcaccgugggcaagaaccacgaguggaacugggccuucgugugcuucacccuggccuucugccugauguggagagcccugggcguguucgugcugacccaggugaucaacagauucagaaccaucccccugaccuucaaggaccaguucaucaucgccuacggcggccugagaggcgccaucugcuucgcccugguguuccugcugcccgccgccguguuccccagaaagaagcuguucaucaccgccgccaucguggugaucuucuucaccguguucauccugggcaucaccaucagaccccugguggaguuccuggacgugaagagaagcaacaagaagcagcaggccgugagcgaggagaucuacugcagacuguucgaccacgugaagaccggcaucgaggacgugugcggccacuggggccacaacuucuggagagacaaguucaagaaguucgacgacaaguaccugagaaagcugcugaucagagagaaccagcccaagagcagcaucgugagccuguacaagaagcuggagaucaagcacgccaucgagauggccgagaccggcaugaucagcaccgugcccaccuucgccagccugaacgacugcagagaggagaagaucagaaaggugaccagcagcgagaccgacgagaucagagagcugcugagcagaaaccuguaccagaucagacagagaacccugagcuacaacagacacagccugaccgccgacaccagcgagagacaggccaaggagauccugaucagaagaagacacagccugagagagagcaucagaaaggacagcagccugaacagagagcacagagccagcaccagcaccagcagauaccugagccugcccaagaacaccaagcugcccgagaagcugcagaagagaagaaccaucagcaucgccgacggcaacagcagcgacagcgacgccgacgccggcaccaccgugcugaaccugcagcccagagccagaagauuccugcccgagcaguucagcaagaagagcccccagagcuacaagauggaguggaagaacgagguggacguggacagcggcagagacaugcccagcaccccccccaccccccacagcagagagaagggcacccagaccagcggccugcugcagcagccccugcugagcaaggaccagagcggcagcgagagagaggacagccugaccgagggcaucccccccaagcccccccccagacugguguggagagccagcgagcccggcagcagaaaggccagauucggcagcgagaagcccuaa

SEQ ID NO: 23667 - RNA, 2505 nt, Artificial Sequence
  SLC9A3__Homo_sapiens__NP_004165
auguggggccugggcgccagaggccccgacagaggccugcugcuggcccuggcccugggcggccuggccagagccggcggcguggagguggagcccggcggcgcccacggcgagagcggcggcuuccagguggugaccuucgagugggcccacgugcaggaccccuacgugaucgcccuguggauccugguggccagccuggccaagaucggcuuccaccugagccacaaggugaccagcguggugcccgagagcgcccugcugaucgugcugggccuggugcugggcggcaucgugugggccgccgaccacaucgccagcuucacccugacccccaccguguucuucuucuaccugcugccccccaucgugcuggacgccggcuacuucaugcccaacagacuguucuucggcaaccugggcaccauccugcuguacgccguggugggcaccguguggaacgccgccaccaccggccugagccuguacggcguguuccugagcggccugaugggcgaccugcagaucggccugcuggacuuccugcuguucggcagccugauggccgccguggaccccguggccgugcuggccguguucgaggaggugcacgugaacgaggugcuguucaucaucguguucggcgagagccugcugaacgacgccgugaccguggugcuguacaacguguucgagagcuucguggcccugggcggcgacaacgugaccggcguggacugcgugaagggcaucgugagcuucuucguggugagccugggcggcacccuggugggcgugguguucgccuuccugcugagccuggugaccagauucaccaagcacgugagaaucaucgagcccggcuucguguucaucaucagcuaccugagcuaccugaccagcgagaugcugagccugagcgccauccuggccaucaccuucugcggcaucugcugccagaaguacgugaaggccaacaucagcgagcagagcgccaccaccgugagauacaccaugaagaugcuggccagcagcgccgagaccaucaucuucauguuccugggcaucagcgccgugaaccccuucaucuggaccuggaacaccgccuucgugcugcugacccugguguucaucagcguguacagagccaucggcguggugcugcagaccuggcugcugaacagauacagaauggugcagcuggagcccaucgaccagguggugcugagcuacggcggccugagaggcgccguggccuucgcccugguggugcugcuggacggcgacaaggugaaggagaagaaccuguucgugagcaccaccaucaucgugguguucuucaccgugaucuuccagggccugaccaucaagccccuggugcaguggcugaaggugaagagaagcgagcacagagagcccagacugaacgagaagcugcacggcagagccuucgaccacauccugagcgccaucgaggacaucagcggccagaucggccacaacuaccugagagacaaguggagccacuucgacagaaaguuccugagcagagugcugaugagaagaagcgcccagaagagcagagacagaauccugaacguguuccacgagcugaaccugaaggacgccaucagcuacguggccgagggcgagagaagaggcagccuggccuucaucagaagccccagcaccgacaacguggugaacguggacuucacccccagaagcagcaccguggaggccagcgugagcuaccugcugagagagaacgugagcgccgugugccuggacaugcagagccuggagcagagaagaagaagcaucagagacgccgaggacauggugacccaccacacccugcagcaguaccuguacaagcccagacaggaguacaagcaccuguacagcagacacgagcugacccccaccgaggacgagaagcaggacagagagaucuuccacagaaccaugagaaagagacuggagagcuucaagagcaccaagcugggccugaaccagaacaagaaggccgccaagcuguacaagagagagagagcccagaagagaagaaacagcagcauccccaacggcaagcugcccauggagagccccgcccagaacuucaccaucaaggagaaggaccuggagcugagcgacaccgaggagccccccaacuacgacgaggagaugagcggcggcaucgaguuccuggccagcgugaccaaggacaccgccagcgacagccccgccggcaucgacaaccccguguucagccccgacgaggcccuggacagaagccugcuggccagacugccccccuggcugagccccggcgagaccguggugcccagccagagagccagaacccagauccccuacagccccggcaccuucugcagacugaugcccuucagacugagcagcaagagcguggacagcuuccugcaggccgacggccccgaggagagaccccccgccgcccugcccgagagcacccacauguaa

SEQ ID NO: 23668 - RNA, 1077 nt, Artificial Sequence
  SLC9A3R1__Homo_sapiens__NP_004243
augagcgccgacgccgccgccggcgccccccugcccagacugugcugccuggagaagggccccaacggcuacggcuuccaccugcacggcgagaagggcaagcugggccaguacaucagacugguggagcccggcagccccgccgagaaggccggccugcuggccggcgacagacugguggaggugaacggcgagaacguggagaaggagacccaccagcagguggugagcagaaucagagccgcccugaacgccgugagacugcuggugguggaccccgagaccgacgagcagcugcagaagcugggcgugcaggugagagaggagcugcugagagcccaggaggcccccggccaggccgagccccccgccgccgccgaggugcagggcgccggcaacgagaacgagcccagagaggccgacaagagccaccccgagcagagagagcugagacccagacugugcaccaugaagaagggccccagcggcuacggcuucaaccugcacagcgacaagagcaagcccggccaguucaucagaagcguggaccccgacagccccgccgaggccagcggccugagagcccaggacagaaucguggaggugaacggcgugugcauggagggcaagcagcacggcgacguggugagcgccaucagagccggcggcgacgagaccaagcugcuggugguggacagagagaccgacgaguucuucaagaagugcagagugauccccagccaggagcaccugaacggcccccugcccgugcccuucaccaacggcgagauccagaaggagaacagcagagaggcccuggccgaggccgcccuggagagccccagacccgcccuggugagaagcgccagcagcgacaccagcgaggagcugaacagccaggacagcccccccaagcaggacagcaccgcccccagcagcaccagcagcagcgaccccauccuggacuucaacaucagccuggccauggccaaggagagagcccaccagaagagaagcagcaagagagccccccagauggacuggagcaagaagaacgagcuguucagcaaccuguaa

SEQ ID NO: 23669 - RNA, 1014 nt, Artificial Sequence
  SLC9A3R2__Homo_sapiens__NP_001123484
auggccgcccccgagccccugagacccagacugugcagacuggugagaggcgagcagggcuacggcuuccaccugcacggcgagaagggcagaagaggccaguucaucagaagaguggagcccggcagccccgccgaggccgccgcccugagagccggcgacagacugguggaggugaacggcgugaacguggagggcgagacccaccaccagguggugcagagaaucaaggccguggagggccagaccagacugcuggugguggaccaggagaccgacgaggagcugagaagaagacagcugaccugcaccgaggagauggcccagagaggccugccccccgcccacgaccccugggagcccaagcccgacugggcccacaccggcagccacagcagcgaggccggcaagaaggacgugagcggcccccugagagagcugagacccagacugugccaccugagaaagggcccccagggcuacggcuucaaccugcacagcgacaagagcagacccggccaguacaucagaagcguggaccccggcagccccgccgccagaagcggccugagagcccaggacagacugaucgaggugaacggccagaacguggagggccugagacacgccgaggugguggccagcaucaaggccagagaggacgaggccagacugcuggugguggaccccgagaccgacgagcacuucaagagacugagagugacccccaccgaggagcacguggagggcccccugcccagccccgugaccaacggcaccagccccgcccagcugaacggcggcagcgccugcagcagcagaagcgaccugcccggcagcgacaaggacaccgaggacggcagcgccuggaagcaggaccccuuccaggagagcggccugcaccugagccccaccgccgccgaggccaaggagaaggccagagccaugagagugaacaagagagccccccagauggacuggaacagaaagagagagaucuucagcaacuucuaa

SEQ ID NO: 23670 - RNA, 2397 nt, Artificial Sequence
  SLC9A4__Homo_sapiens__NP_001011552
auggcccugcagauguucgugaccuacagccccuggaacugccugcugcugcugguggcccuggagugcagcgaggccagcagcgaccugaacgagagcgccaacagcaccgcccaguacgccagcaacgccugguucgccgccgccagcagcgagcccgaggagggcaucagcguguucgagcuggacuacgacuacgugcagauccccuacgaggugacccuguggauccugcuggccagccuggccaagaucggcuuccaccuguaccacagacugcccggccugaugcccgagagcugccugcugauccuggugggcgcccuggugggcggcaucaucuucggcaccgaccacaagagcccccccgugauggacagcagcaucuacuuccuguaccugcugccccccaucgugcuggagggcggcuacuucaugcccaccagacccuucuucgagaacaucggcagcauccuguggugggccgugcugggcgcccugaucaacgcccugggcaucggccugagccuguaccugaucugccaggugaaggccuucggccugggcgacgugaaccugcugcagaaccugcuguucggcagccugaucagcgccguggaccccguggccgugcuggccguguucgaggaggccagagugaacgagcagcuguacaugaugaucuucggcgaggcccugcugaacgacggcaucaccguggugcuguacaacaugcugaucgccuucaccaagaugcacaaguucgaggacaucgagaccguggacauccuggccggcugcgccagauucaucguggugggccugggcggcgugcuguucggcaucguguucggcuucaucagcgccuucaucaccagauucacccagaacaucagcgccaucgagccccugaucguguucauguucagcuaccugagcuaccuggccgccgagacccuguaccugagcggcauccuggccaucaccgccugcgccgugaccaugaagaaguacguggaggagaacgugagccagaccagcuacaccaccaucaaguacuucaugaagaugcugagcagcgugagcgagacccugaucuucaucuucaugggcgugagcaccgugggcaagaaccacgaguggaacugggccuucaucugcuucacccuggccuucugccagaucuggagagccaucagcguguucgcccuguucuacaucagcaaccaguucagaaccuuccccuucagcaucaaggaccagugcaucaucuucuacagcggcgugagaggcgccggcagcuucagccuggccuuccugcugccccugagccuguuccccagaaagaagauguucgugaccgccacccugguggugaucuacuucaccguguucauccagggcaucaccgugggcccccuggugagauaccuggacgugaagaagaccaacaagaaggagagcaucaacgaggagcugcacaucagacugauggaccaccugaaggccggcaucgaggacgugugcggccacuggagccacuaccaggugagagacaaguucaagaaguucgaccacagauaccugagaaagauccugaucagaaagaaccugcccaagagcagcaucgugagccuguacaagaagcuggagaugaagcaggccaucgagaugguggagaccggcauccugagcagcaccgccuucagcaucccccaccaggcccagagaauccagggcaucaagagacugagccccgaggacguggagagcaucagagacauccugaccagcaacauguaccaggugagacagagaacccugagcuacaacaaguacaaccugaagccccagaccagcgagaagcaggccaaggagauccugaucagaagacagaacacccugagagagagcaugagaaagggccacagccugcccuggggcaagcccgccggcaccaagaacaucagauaccugagcuaccccuacggcaacccccagagcgccggcagagacaccagagccgccggcuucagcgacgacgacagcagcgaccccggcagccccagcaucaccuucagcgccugcagcagaaucggcagccugcagaagcaggaggcccaggagaucauccccaugaagagccugcacagaggcagaaaggccuucagcuucggcuaccagagaaacaccagccaggaggaguaccugggcggcgugagaagaguggcccugagacccaagccccuguuccacgccguggacgaggagggcgagagcggcggcgagagcgagggcaaggccagccugguggaggugagaagcagauggaccgccgaccacggccacggcagagaccaccacagaagccacagcccccugcugcagaagaaguaa

SEQ ID NO: 23671 - RNA, 2691 nt, Artificial Sequence
  SLC9A5__Homo_sapiens__NP_004585
augcugagagccgcccugagccugcuggcccugccccuggccggcgccgccgaggagcccacccagaagcccgagagccccggcgagcccccccccggccuggagcuguucagauggcaguggcacgagguggaggcccccuaccugguggcccuguggauccugguggccagccuggccaagaucguguuccaccugagcagaaaggugaccagccuggugcccgagagcugccugcugauccugcugggccuggugcugggcggcaucgugcuggccguggccaagaaggccgaguaccagcuggagcccggcaccuucuuccuguuccugcugccccccaucgugcuggacagcggcuacuucaugcccagcagacuguucuucgacaaccugggcgccauccugaccuacgccguggugggcacccuguggaacgccuucaccaccggcgccgcccuguggggccugcagcaggccggccugguggcccccagagugcaggccggccugcuggacuuccugcuguucggcagccugaucagcgccguggaccccguggccgugcuggccguguucgaggaggugcacgugaacgagacccuguucaucaucguguucggcgagagccugcugaacgacgccgugaccguggugcuguacaaggugugcaacagcuucguggagaugggcagcgccaacgugcaggccaccgacuaccugaagggcguggccagccuguucguggugagccugggcggcgccgccgugggccugguguucgccuuccugcuggcccugaccaccagauucaccaagagagugagaaucaucgagccccugcugguguuccugcuggccuacgccgccuaccugaccgccgagauggccagccugagcgccauccuggccgugaccaugugcggccugggcugcaagaaguacguggaggccaacaucagccacaagagcagaaccaccgugaaguacaccaugaagacccuggccagcugcgccgagaccgugaucuucaugcugcugggcaucagcgccguggacagcagcaagugggccugggacagcggccuggugcugggcacccugaucuucauccuguucuucagagcccugggcguggugcugcagaccugggugcugaaccaguucagacuggugccccuggacaagaucgaccagguggugaugagcuacggcggccugagaggcgccguggccuucgcccuggugauccugcuggacagaaccaaggugcccgccaaggacuacuucguggccaccaccaucguggugguguucuucaccgugaucgugcagggccugaccaucaagccccuggugaaguggcugaaggugaagagaagcgagcaccacaagcccacccugaaccaggagcugcacgagcacaccuucgaccacauccuggccgccguggaggacguggugggccaccacggcuaccacuacuggagagacagaugggagcaguucgacaagaaguaccugagccagcugcugaugagaagaagcgccuacagaaucagagaccagaucugggacguguacuacagacugaacaucagagacgccaucagcuucguggaccagggcggccacgugcugagcagcaccggccugacccugcccagcaugcccagcagaaacagcguggccgagaccagcgugaccaaccugcugagagagagcggcagcggcgccugccuggaccugcaggugaucgacaccgugagaagcggcagagacagagaggacgccgugaugcaccaccugcugugcggcggccuguacaagcccagaagaagauacaaggccagcugcagcagacacuucaucagcgaggacgcccaggagagacaggacaaggagguguuccagcagaacaugaagagaagacuggagagcuucaagagcaccaagcacaacaucugcuucaccaagagcaagcccagacccagaaagaccggcagaagaaagaaggacggcguggccaacgccgaggccaccaacggcaagcacagaggccugggcuuccaggacaccgccgccgugauccugaccguggagagcgaggaggaggaggaggagagcgacagcagcgagaccgagaaggaggacgacgagggcaucaucuucguggccagagccaccagcgaggugcugcaggagggcaaggugagcggcagccuggaggugugccccagccccagaaucaucccccccagccccaccugcgccgagaaggagcugcccuggaagagcggccagggcgaccuggccguguacgugagcagcgagaccaccaagaucgugcccguggacaugcagaccggcuggaaccagagcaucagcagccuggagagccuggccagcccccccugcaaccaggcccccauccugaccugccugcccccccaccccagaggcaccgaggagccccaggugccccugcaccugcccagcgaccccagaagcagcuucgccuucccccccagccuggccaaggccggcagaagcagaagcgagagcagcgccgaccugccccagcagcaggagcugcagccccugaugggccacaaggaccacacccaccugagccccggcaccgccaccagccacuggugcauccaguucaacagaggcagcagacuguaa

SEQ ID NO: 23672 - RNA, 2106 nt, Artificial Sequence
  SLC9A6__Homo_sapiens__NP_001036002
auggccagaagaggcuggagaagagccccccugagaagaggcgugggcagcagccccagagccagaagacugaugagaccccuguggcugcugcuggccgugggcguguucgacugggccggcgccagcgacggcggcggcggcgaggccagagccauggacgaggagaucgugagcgagaagcaggccgaggagagccacagacaggacagcgccaaccugcugaucuucauccugcugcugacccugaccauccugaccaucuggcuguucaagcacagaagagccagauuccugcacgagaccggccuggccaugaucuacggccugcuggugggccuggugcugagauacggcauccacgugcccagcgacgugaacaacgugacccugagcugcgaggugcagagcagccccaccacccugcuggugaacgugagcggcaaguucuacgaguacaugcugaagggcgagaucagcagccacgagcugaacaacgugcaggacaacgagaugcugagaaaggugaccuucgaccccgagguguucuucaacauccugcugccccccaucaucuucuacgccggcuacagccugaagagaagacacuucuucagaaaccugggcagcauccuggccuacgccuuccugggcaccgccaucagcugcuucgugaucggcagcaucauguacggcugcgugacccugaugaaggugaccggccagcuggccggcgacuucuacuucaccgacugccugcuguucggcgccaucgugagcgccaccgaccccgugaccgugcuggccaucuuccacgagcugcagguggacguggagcuguacgcccugcuguucggcgagagcgugcugaacgacgccguggccaucgugcugagcagcagcaucguggccuaccagcccgccggcgacaacagccacaccuucgacgugaccgccauguucaagagcaucggcaucuuccugggcaucuucagcggcagcuucgccaugggcgccgccaccggcguggugaccgcccuggugaccaaguucaccaagcugagagaguuccagcugcuggagaccggccuguucuuccugaugagcuggagcaccuuccugcuggccgaggccuggggcuucaccggcgugguggccgugcuguucugcggcaucacccaggcccacuacaccuacaacaaccugagcaccgagagccagcacagaaccaagcagcuguucgagcugcugaacuuccuggccgagaacuucaucuucagcuacaugggccugacccuguucaccuuccagaaccacguguucaaccccaccuucguggugggcgccuucguggccaucuuccugggcagagccgccaacaucuacccccugagccugcugcugaaccugggcagaagaagcaagaucggcagcaacuuccagcacaugaugauguucgccggccugagaggcgccauggccuucgcccuggccaucagagacaccgccaccuacgccagacagaugauguucagcaccacccugcugaucguguucuucaccguguggguguucggcggcggcaccaccgccaugcugagcugccugcacaucagagugggcguggacagcgaccaggagcaccugggcgugcccgagaacgagagaagaaccaccaaggccgagagcgccuggcuguucagaaugugguacaacuucgaccacaacuaccugaagccccugcugacccacagcggccccccccugaccaccacccugcccgccugcugcggccccaucgccagaugccugaccagcccccaggccuacgagaaccaggagcagcugaaggacgacgacagcgaccugauccugaacgacggcgacaucagccugaccuacggcgacagcaccgugaacaccgagcccgccaccagcagcgcccccagaagauucaugggcaacagcagcgaggacgcccuggacagagagcuggccuucggcgaccacgagcuggugaucagaggcaccagacuggugcugcccauggacgacagcgagcccccccugaaccugcuggacaacaccagacacggccccgccuaa

SEQ ID NO: 23673 - RNA, 2178 nt, Artificial Sequence
  SLC9A7__Homo_sapiens__NP_115980
auggagcccggcgacgccgccagacccggcagcggcagagccaccggcgcccccccccccagacugcugcugcugccccugcugcugggcuggggccugagaguggccgccgccgccagcgccagcagcagcggcgccgccgccgaggacagcagcgccauggaggagcuggccaccgagaaggaggccgaggagagccacagacaggacagcgugagccugcugaccuucauccugcugcugacccugaccauccugaccaucuggcuguucaagcacagaagagugagauuccugcacgagaccggccuggccaugaucuacggccugaucgugggcgugauccugagauacggcacccccgccaccagcggcagagacaagagccugagcugcacccaggaggacagagccuucagcacccugcuggugaacgugagcggcaaguucuucgaguacacccugaagggcgagaucagccccggcaagaucaacagcguggagcagaacgacaugcugagaaaggugaccuucgaccccgagguguucuucaacauccugcugccccccaucaucuuccacgccggcuacagccugaagaagagacacuucuucagaaaccugggcagcauccuggccuacgccuuccugggcaccgccgugagcugcuucaucaucggcaaccugauguacggcguggugaagcugaugaagaucaugggccagcugagcgacaaguucuacuacaccgacugccuguucuucggcgccaucaucagcgccaccgaccccgugaccgugcuggccaucuucaacgagcugcacgccgacguggaccuguacgcccugcuguucggcgagagcgugcugaacgacgccguggccaucgugcugagcagcagcaucguggccuaccagcccgccggccugaacacccacgccuucgacgccgccgccuucuucaagagcgugggcaucuuccugggcaucuucagcggcagcuucaccaugggcgccgugaccggcgugaacgccaacgugaccaaguucaccaagcugcacugcuucccccugcuggagaccgcccuguucuuccugaugagcuggagcaccuuccugcuggccgaggccugcggcuucaccggcgugguggccgugcuguucugcggcaucacccaggcccacuacaccuacaacaaccugagcguggagagcagaagcagaaccaagcagcuguucgaggugcugcacuuccuggccgagaacuucaucuucagcuacaugggccuggcccuguucaccuuccagaagcacguguucagccccaucuucaucaucggcgccuucguggccaucuuccugggcagagccgcccacaucuacccccugagcuucuuccugaaccugggcagaagacacaagaucggcuggaacuuccagcacaugaugauguucagcggccugagaggcgccauggccuucgcccuggccaucagagacaccgccagcuacgccagacagaugauguucaccaccacccugcugaucguguucuucaccguguggaucaucggcggcggcaccacccccaugcugagcuggcugaacaucagagugggcguggaggagcccagcgaggaggaccagaacgagcaccacuggcaguacuucagagugggcguggaccccgaccaggaccccccccccaacaacgacagcuuccaggugcugcagggcgacggccccgacagcgccagaggcaacagaaccaagcaggagagcgccuggaucuucagacugugguacagcuucgaccacaacuaccugaagcccauccugacccacagcggccccccccugaccaccacccugcccgccuggugcggccugcuggccagaugccugaccagcccccagguguacgacaaccaggagccccugagagaggaggacagcgacuucauccugaccgagggcgaccugacccugaccuacggcgacagcaccgugaccgccaacggcagcagcagcagccacaccgccagcaccagccuggagggcagcagaagaaccaagagcagcagcgaggaggugcuggagagagaccugggcaugggcgaccagaaggugagcagcagaggcaccagacugguguucccccuggaggacaacgccuaa

SEQ ID NO: 23674 - RNA, 1794 nt, Artificial Sequence
  SLC9A8__Homo_sapiens__NP_001247420
augggcgagaagauggccgaggaggagagauuccccaacaccacccacgagggcuucaacgugacccugcacaccacccugguggugaccaccaagcuggugcugcccacccccggcaagcccauccugcccgugcagaccggcgagcaggcccagcaggaggagcagagcagcggcaugaccaucuucuucagccugcuggugcuggccaucugcaucauccuggugcaccugcugaucagauacagacugcacuuccugcccgagagcguggccguggugagccugggcauccugaugggcgccgugaucaagaucaucgaguucaagaagcuggccaacuggaaggaggaggagauguucagacccaacauguucuuccugcugcugcugccccccaucaucuucgagagcggcuacagccugcacaagggcaacuucuuccagaacaucggcagcaucacccuguucgccguguucggcaccgccaucagcgccuucguggugggcggcggcaucuacuuccugggccagggcuucuucuucgugugcgugugcguguucgugugcuucauccugcaggccgacgugaucagcaagcugaacaugaccgacagcuucgccuucggcagccugaucagcgccguggaccccguggccaccaucgccaucuucaacgcccugcacguggaccccgugcugaacaugcugguguucggcgagagcauccugaacgacgccgugagcaucgugcugaccaacaccgccgagggccugaccagaaagaacaugagcgacgugagcggcuggcagaccuuccugcaggcccuggacuacuuccugaagauguucuucggcagcgccgcccugggcacccugaccggccugaucagcgcccuggugcugaagcacaucgaccugagaaagacccccagccuggaguucggcaugaugaucaucuucgccuaccugcccuacggccuggccgagggcaucagccugagcggcaucauggccauccuguucagcggcaucgugaugagccacuacacccaccacaaccugagccccgugacccagauccugaugcagcagacccugagaaccguggccuuccugugcgagaccugcguguucgccuuccugggccugagcaucuucagcuucccccacaaguucgagaucagcuucgugaucuggugcaucgugcuggugcuguucggcagagccgugaacaucuucccccugagcuaccugcugaacuucuucagagaccacaagaucacccccaagaugauguucaucaugugguucagcggccugagaggcgccauccccuacgcccugagccugcaccuggaccuggagcccauggagaagagacagcugaucggcaccaccaccaucgugaucgugcuguucaccauccugcugcugggcggcagcaccaugccccugaucagacugauggacaucgaggacgccaaggcccacagaagaaacaagaaggacgugaaccugagcaagaccgagaagaugggcaacaccguggagagcgagcaccugagcgagcugaccgaggaggaguacgaggcccacuacaucagaagacaggaccugaagggcuucguguggcuggacgccaaguaccugaaccccuucuucaccagaagacugacccaggaggaccugcaccacggcagaauccagaugaagacccugaccaacaagugguacgaggaggugagacagggccccagcggcagcgaggacgacgagcaggagcugcuguaa

SEQ ID NO: 23675 - RNA, 1938 nt, Artificial Sequence
  SLC9A9__Homo_sapiens__NP_775924
auggagagacagagcagagugaugagcgagaaggacgaguaccaguuccagcaccagggcgccguggagcugcugguguucaacuuccugcugauccugaccauccugaccaucuggcuguucaagaaccacagauucagauuccugcacgagaccggcggcgccaugguguacggccugaucaugggccugauccugagauacgccaccgcccccaccgacaucgagagcggcaccguguacgacugcgugaagcugaccuucagccccagcacccugcuggugaacaucaccgaccagguguacgaguacaaguacaagagagagaucagccagcacaacaucaacccccaccagggcaacgccauccuggagaagaugaccuucgaccccgagaucuucuucaacgugcugcugccccccaucaucuuccacgccggcuacagccugaagaagagacacuucuuccagaaccugggcagcauccugaccuacgccuuccugggcaccgccaucagcugcaucgugaucggccugaucauguacggcuucgugaaggccaugauccacgccggccagcugaagaacggcgacuuccacuucaccgacugccuguucuucggcagccugaugagcgccaccgaccccgugaccgugcuggccaucuuccacgagcugcacguggaccccgaccuguacacccugcuguucggcgagagcgugcugaacgacgccguggccaucgugcugaccuacagcaucagcaucuacagccccaaggagaaccccaacgccuucgacgccgccgccuucuuccagagcgugggcaacuuccugggcaucuucgccggcagcuucgccaugggcagcgccuacgccaucaucaccgcccugcugaccaaguucaccaagcugugcgaguuccccaugcuggagaccggccuguucuuccugcugagcuggagcgccuuccugagcgccgaggccgccggccugaccggcaucguggccgugcuguucugcggcgugacccaggcccacuacaccuacaacaaccugagcagcgacagcaagaucagaaccaagcagcuguucgaguucaugaacuuccuggccgagaacgugaucuucugcuacaugggccuggcccuguucaccuuccagaaccacaucuucaacgcccuguucauccugggcgccuuccuggccaucuucguggccagagccugcaacaucuacccccugagcuuccugcugaaccugggcagaaagcagaagauccccuggaacuuccagcacaugaugauguucagcggccugagaggcgccaucgccuucgcccuggccaucagaaacaccgagagccagcccaagcagaugauguucaccaccacccugcugcugguguucuucaccguguggguguucggcggcggcaccacccccaugcugaccuggcugcagaucagagugggcguggaccuggacgagaaccugaaggaggaccccagcagccagcaccaggaggccaacaaccuggacaagaacaugaccaaggccgagagcgccagacuguucagaaugugguacagcuucgaccacaaguaccugaagcccauccugacccacagcggccccccccugaccaccacccugcccgaguggugcggccccaucagcagacugcugaccagcccccaggccuacggcgagcagcugaaggaggacgacguggagugcaucgugaaccaggacgagcuggccaucaacuaccaggagcaggccagcagccccugcagcccccccgccagacugggccuggaccagaaggccagcccccagacccccggcaaggagaacaucuacgagggcgaccugggccugggcggcuacgagcugaagcuggagcagacccugggccagagccagcugaacuaa

SEQ ID NO: 23676 - RNA, 1428 nt, Artificial Sequence
  SLC9B1__Homo_sapiens__NP_001094344
augcacaccaccgagagcaagaacgagcaccuggaggacgagaacuuccagaccagcaccaccccccagagccugaucgaccccaacaacaccgcccacgaggagaccaagaccgugcugagcgacaccgaggagaucaagccccagaccaagaaggagaccuacaucagcugcccccugagaggcgugcugaacgugaucaucaccaacggcgugauccuguucgugaucuggugcaugaccuggagcauccugggcagcgaggcccugcccggcggcaaccuguucggccuguucaucaucuucuacagcgccaucaucggcggcaagauccugcagcugaucagaaucccccuggugcccccccugcccccccugcugggcaugcugcuggccggcuucaccaucagaaacgugcccuucaucaacgagcacgugcacgugcccaacaccuggagcagcauccugagaagcaucgcccugaccaucauccugaucagagccggccugggccuggacccccaggcccugagacaccugaagguggugugcuucagacuggccgugggccccugccugauggaggccagcgccgccgccguguucagccacuucaucaugaaguuccccuggcagugggccuuccugcugggcuucgugcugggcgccgugagccccgccgugguggugcccuacaugauggugcugcaggagaacggcuacggcguggaggagggcauccccacccugcugauggccgccagcagcauggacgacauccuggccaucaccggcuucaacaccugccugagcaucguguucagcagcggcggcauccugaacaacgccaucgccagcaucagaaacgugugcaucagccugcuggccggcaucgugcugggcuucuucgugagauacuuccccagcgaggaccagaagaagcugacccugaagagaggcuuccuggugcugaccaugugcgugagcgccgugcugggcagccagagaaucggccugcacggcagcggcggccugugcacccuggugcugagcuucaucgccggcaccaaguggagccaggagaagaugaaggugcagaagaucaucaccaccgugugggacaucuuccagccccugcuguucggccuggugggcgccgaggugagcgugagcagccuggagagcaacaucgugggcaucagcguggccacccugagccuggcccugugcgugagaauccugaccaccuaccugcugaugugcuucgccggcuucagcuucaaggagaagaucuucaucgcccuggccuggaugcccaaggccaccgugcagaucaaccaggccauccugcugcuguuccugcugagagaggaguggaccaacugcaagguggccaagaagugcgaguacaccaaggagagacaguaa

SEQ ID NO: 23677 - RNA, 1254 nt, Artificial Sequence
  SLC9B2__Homo_sapiens__NP_001287685
augggcgacgaggacaagagaaucaccuacgaggacagcgagcccagcaccggcaugaacuacacccccagcaugcaccaggaggcccaggaggagaccgugaugaagcugaagggcaucgacgccaacgagcccaccgagggcagcauccugcugaagagcagcgagaagaagcugcaggagacccccaccgaggccaaccacgugcagagacugagacagaugcuggccugccccccccacggccugcuggacagagugaucaccaacggcaugcugcuggccggcuuccugaucagaaacauccccgugaucaacgacaacgugcagaucaagcacaaguggagcagcagccugagaagcaucgcccugagcaucauccuggugagagccggccugggccuggacagcaaggcccugaagaagcugaagggcgugugcgugagacugagcaugggccccugcaucguggaggccugcaccagcgcccugcuggcccacuaccugcugggccugcccuggcaguggggcuucauccugggcuucgugcugggcgccgugagccccgccgugguggugcccagcaugcugcugcugcagggcggcggcuacggcguggagaagggcgugcccacccugcugauggccgccggcagcuucgacgacauccuggccaucaccggcuucaacaccugccugggcaucgccuucagcaccggcagcaccguguucaacgugcugagaggcgugcuggagguggugaucggcguggccaccggcagcgugcugggcuucuucauccaguacuuccccagcagagaccaggacaagcuggugugcaagagaaccuuccuggugcugggccugagcgugcuggccguguucagcagcgugcacuucggcuuccccggcagcggcggccugugcacccuggugauggccuuccuggccggcaugggcuggaccagcgagaaggccgagguggagaagaucaucgccguggccugggacaucuuccagccccugcuguucggccugaucggcgccgaggugagcaucgccagccugagacccgagaccgugggcugcaacagaaucugcggcuucggccacagcaaggugaccuggagagagaccaucagaagacuguggaacggcugcguggacagcggcaucuucgugcacccccaccacagccccaacuggaagagcgccuacugguucaccggcccccaggccagcgccgagagcuaa

SEQ ID NO: 23678 - RNA, 3534 nt, Artificial Sequence
  SLC9C1__Homo_sapiens__NP_898884
auggccggcaucuucaaggaguucuucuucagcaccgaggaccugcccgaggugauccugacccugagccugaucagcagcaucggcgccuuccugaacagacaccuggaggacuuccccauccccgugcccgugauccuguuccugcugggcugcagcuucgaggugcugagcuucaccagcagccaggugcagagauacgccaacgccauccaguggaugagccccgaccuguucuucagaaucuucacccccgugguguucuucaccaccgccuucgacauggacaccuacaugcugcagaagcuguucuggcagauccugcugaucagcauccccggcuuccuggugaacuacauccuggugcuguggcaccuggccagcgugaaccagcugcugcugaagcccacccaguggcugcuguucagcgccauccuggugagcagcgaccccaugcugaccgccgccgccaucagagaccugggccugagcagaagccugaucagccugaucaacggcgagagccugaugaccagcgugaucagccugaucaccuucaccagcaucauggacuucgaccagagacugcagagcaagagaaaccacacccuggccgaggagaucgugggcggcaucugcagcuacaucaucgccagcuuccuguucggcauccugagcagcaagcugauccaguucuggaugagcaccguguucggcgacgacgugaaccacaucagccugaucuucagcauccuguaccugaucuucuacaucugcgagcuggugggcaugagcggcaucuucacccuggccaucgugggccugcugcugaacagcaccagcuucaaggccgccaucgaggagacccugcugcuggaguucuggaccuuccugagcagaaucgccuuccugaugguguucaccuucuucggccugcugauccccgcccacaccuaccuguacaucgaguucguggacaucuacuacagccugaacaucuaccugacccugaucgugcugagauuccugacccugcugcugaucagccccgugcugagcagagugggccacgaguucagcuggagauggaucuucaucauggugugcagcgagaugaagggcaugcccaacaucaacauggcccugcugcuggccuacagcgaccuguacuucggcagcgacaaggagaagagccagauccuguuccacggcgugcuggugugccugaucacccugguggugaacagauucauccugcccguggccgugaccauccugggccugagagacgccaccagcaccaaguacaagagcgugugcugcaccuuccagcacuuccaggagcugaccaagagcgccgccagcgcccugaaguucgacaaggaccuggccaacgccgacuggaacaugaucgagaaggccaucacccuggagaaccccuacaugcugaacgaggaggagaccaccgagcaccagaaggugaagugcccccacugcaacaaggagaucgacgagaucuucaacaccgaggccauggagcuggccaacagaagacugcugagcgcccagaucgccagcuaccagagacaguacagaaacgagauccugagccagagcgccgugcaggugcuggugggcgccgccgagagcuucggcgagaagaagggcaagugcaugagccuggacaccaucaagaacuacagcgagagccagaagaccgugaccuucgccagaaagcugcugcugaacuggguguacaacaccagaaaggagaaggagggccccagcaaguacuucuucuucagaaucugccacaccaucguguucaccgaggaguucgagcacgugggcuaccuggugauccugaugaacaucuuccccuucaucaucagcuggaucagccagcugaacgugaucuaccacagcgagcugaagcacaccaacuacugcuuccugacccuguacauccuggaggcccugcugaagaucgccgccaugagaaaggacuucuucagccacgccuggaacaucuucgagcuggccaucacccugaucggcauccugcacgugauccugaucgagaucgacaccaucaaguacaucuucaacgagaccgaggugaucguguucaucaagguggugcaguucuucagaauccugagaaucuucaagcugaucgcccccaagcugcugcagaucaucgacaagagaaugagccaccagaagaccuucugguacggcauccugaagggcuacgugcagggcgaggccgacaucaugaccaucaucgaccagaucaccagcagcaagcagaucaagcagaugcugcugaagcaggugaucagaaacauggagcacgccaucaaggagcugggcuaccuggaguacgaccaccccgagaucgccgugaccgugaagaccaaggaggagaucaacgugaugcugaacauggccaccgagauccugaaggccuucggccugaagggcaucaucagcaagaccgagggcgccggcaucaacaagcugaucauggccaagaagaaggaggugcuggacagccagagcaucaucagaccccugaccguggaggaggugcuguaccacauccccuggcuggacaagaacaaggacuacaucaacuucauccaggagaaggccaagguggugaccuucgacugcggcaacgacaucuucgaggagggcgacgagcccaagggcaucuacaucaucaucagcggcauggugaagcuggagaagagcaagcccggccugggcaucgaccagaugguggagagcaaggagaaggacuuccccaucaucgacaccgacuacaugcugagcggcgagaucaucggcgagaucaacugccugaccaacgagcccaugaaguacagcgccaccugcaagaccgugguggagaccugcuucauccccaagacccaccuguacgacgccuucgagcagugcagcccccugaucaagcagaagauguggcugaagcugggccuggccaucaccgccagaaagaucagagagcaccugagcuacgaggacuggaacuacaacaugcagcugaagcugagcaacaucuacgugguggacauccccaugagcaccaagaccgacaucuacgacgagaaccugaucuacgugauccugauccacggcgccguggaggacugccugcugagaaagaccuacagagcccccuuccugauccccaucaccugccaccagauccagagcaucgaggacuucaccaagguggugaucauccagacccccaucaacaugaagaccuucagaagaaacaucagaaaguucgugcccaagcacaagagcuaccugacccccggccugaucggcagcgugggcacccuggaggagggcauccaggaggagagaaacgugaaggaggacggcgcccacagcgccgccaccgccagaagcccccagcccugcagccugcugggcaccaaguucaacugcaaggagagccccagaaucaaccugagaaaggugagaaaggaguaa

SEQ ID NO: 23679 - RNA, 3375 nt, Artificial Sequence
  SLC9C2__Homo_sapiens__NP_848622
augagcagcuacuucugggcccagaacgagagcaacagacccgaccugcugugcggccagcccgccgacuaccugguggaggagaagcacuucaccacccuggugugcuucaucguggugcugggcggccugcugaagaugugccugaagaacugcgaggugaucgugcugaccauccugagccugagcggcuucgugaucggccacauggccuacaacagcguggaggugcaccagaucguguacccccugcugagaaccagcagcuucagccuguacagcuacuucagcccccugaucaucuucaugguggcccuggacguggaguucuacacccugaagaagauguucuggcaggugcugcugaccggccugaucagcuucagcaccgccagcaucaucaucggcuacguggugaucaaguucaacaaggacagcugggaccugcagagcugccugcuguucagcaucacccugggcaucaucgacccccugagaagcgugaacagccugaagaccaucggcaucagcaagaucuacaucgaccugaucagaggcgagagccugaucaucugcagcaucgccagcaucuucuucggcaacuucagaggcaacagaauccacuucagcaucuucagagaccugcacgugggcaucgagcugagcuacgacauccugggcagcaucaucuucggcuacuggugcgccaagaucauccagugcauccuggccgacguguucagcaacaugcugaccaacaucauccugugcuucagcaugguguacaugaccuucuacaucguggaguuccugggcaugagcggcacccuggcccuggccgccgugggccugaaccuggacagccugaccuucaagcccaagaucgagcuggugaucaccaaguuccugagaaucuucagcagcguguacgagcaccugaucuacgccuucuucggcaucgugaucggcugcggcgagcugagccacuacgaguuccacaccauccccuucaucuucauccuguucaccaccgugaaccuggugagacugcugaccauccugcuggugagccccauccugaugcacagcaacuacgaguacaacuggagauggggcguggugaucaccuggagcggcaucaagggcguguucaaccugcugugggcccccgacguguacaaccuggccgagagaaagguggaggugccccagauguucauccuguacgugcaggugaucagccugcugaccaugggcaucaacagcuacgugaugacccagagcgccagaaagcuggaccugugcgugcugagccugcccagacagaugauccugcagaacgccacccagcacauccaggagaucgugcagaacaccaucacccuguucaagaccgagaagauccugaccaacgugaacuggacccugguggaggacaagaccagaaucgaguacauccccuucagccacgugagccacaacgacaugaagaccgagagcaccaccgacgaggcccugauggaggaggccagacugcacguggccgccauccagaugagcagcuucgagaagcagagaaacaacggcauccuggagaucgaggccgccagaauccugaucggcgccgccaagugcuacuacagcauccagggcaaguucaugagcaucuacgacgugagcaccuacaugagaaccagaagcuggcugaucaaguucaagaacgugcugaccuuccuggaguacugcaucgagaagauccacuucaucccccccgagagcaacaccuuccugaccuucaucuuccacaucguguucagcgaggaguucgaguacaccggccagaucaucaaccugaucuacaucuaccccaugaucauccaccuguggcccauggccagaggccugaacgugagcgcccugaucagcaucaacuacuacuucauguuccuguacgugcuggagagcacccugaagaucaucauccugaagagaaaguacuuccagcagugcuggaacacccuggaguucuucauccuggugaucggcaucaucgacaucuucugcguguacuucgugaagcugagacccgacaaccuggcccugauccagcugaccgugaucaugggcuaccugagaaucaucagauuccugccccuguucaagaucaucgugcccauccugaucagaaucgccgacgugcagaucaagaagagacugagccugauguacagcaucaccaagggcuacaucaagagccaggaggacgccaagcugcugaucaagcagaucgccgugugcgagagcaucuaccagaagcugugcgagauccuggagaccaacaagcaggacgccgugaaggagcuggugcugauggagcacgagggcagagacguggugaucgcccugaagaccaagcaggccaucagaaacgugaucgccaaggcccugaagaaccugaccuuccugugcagcagaggcaucaucgacaagcacgaggugaucgagaucaacaaggugcugcugaagaagcugaaggcccugaacaacuuccccaaggccauccccccccccacccccgacaucuaccugcacaacaucaucuggcuggagggcaaggacgugcugaucgacuucuucaaggagagagccaagcuggccugcuucgacagcggcgacaccaucugcaagggcggcgagaugccccagggcaucuaccugaucaucagcggcauggccauccugcacagccugagccccaccuucggcaucgagagcaaccagagaugcgacagaggcagcagagacauguucaccgaguucugcaccaccggcgacaucaucggcgagcugagcugccugcugaagagagagaucgaguacaccgugaucugcgagaccagccugcaggccugcuucaucagccuggaggaccuguacgagggcuucgacgccuucuggcccagccuggaguacaagaucuggcugaagcuggcccugagcaccgccuaccaguacuucgagagcagccugaucgacgaggaccugagauuccagaacugcgugauguucaaccaggccuacguggagacccugagcagcuacagcgacaugaucaucgacaacaugaccaugaaguucgugaucaucguguacggcagcgugaucgacaccaagaccgaggagcccuacuucgcccccugcaucauccccaccaccugcgagcaggugcagggcaccagcgaccugagcaagcugcugaucauccaggccagcgagcugacccagagaaacagcaacaccaacgugauggccagcgugaacaccguguucgagcagcccggcaagaacaucaacggcagacagaagaugagcuaa

SEQ ID NO: 23680 - RNA, 2013 nt, Artificial Sequence
  SLCO1A2__Homo_sapiens__NP_602307
augggcgagaccgagaagagaaucgagacccacagaaucagaugccugagcaagcugaagauguuccugcuggccaucaccugcgccuucgugagcaagacccugagcggcagcuacaugaacagcaugcugacccagaucgagagacaguucaacauccccaccagccuggugggcuucaucaacggcagcuucgagaucggcaaccugcugcugaucaucuucgugagcuacuucggcaccaagcugcacagacccaucaugaucggcaucggcugcguggugaugggccugggcugcuuccugaagagccugccccacuuccugaugaaccaguacgaguacgagagcaccgugagcgugagcggcaaccugagcagcaacagcuuccugugcauggagaacggcacccagauccugagacccacccaggaccccagcgagugcaccaaggaggugaagagccugauguggguguacgugcuggugggcaacaucgugagaggcaugggcgagacccccauccugccccugggcaucagcuacaucgaggacuucgccaaguucgagaacagcccccuguacaucggccugguggagaccggcgccaucaucggcccccugaucggccugcugcuggccagcuucugcgccaacguguacguggacaccggcuucgugaacaccgacgaccugaucaucacccccaccgacaccagaugggugggcgccuggugguucggcuuccugaucugcgccggcgugaacgugcugaccgccauccccuucuucuuccugcccaacacccugcccaaggagggccuggagaccaacgccgacaucaucaagaacgagaacgaggacaagcagaaggaggaggugaagaaggagaaguacggcaucaccaaggacuuccugcccuucaugaagagccugagcugcaaccccaucuacaugcuguucauccuggugagcgugauccaguucaacgccuucgugaacaugaucagcuucaugcccaaguaccuggagcagcaguacggcaucagcagcagcgacgccaucuuccugaugggcaucuacaaccugccccccaucugcaucggcuacaucaucggcggccugaucaugaagaaguucaagaucaccgugaagcaggccgcccacaucggcugcuggcugagccugcuggaguaccugcuguacuuccugagcuuccugaugaccugcgagaacagcagcguggugggcaucaacaccagcuacgagggcaucccccaggaccuguacguggagaacgacaucuucgccgacugcaacguggacugcaacugccccagcaagaucugggaccccgugugcggcaacaacggccugagcuaccugagcgccugccuggccggcugcgagaccagcaucggcaccggcaucaacaugguguuccagaacugcagcugcauccagaccagcggcaacagcagcgccgugcugggccugugcgacaagggccccgacugcagccugaugcugcaguacuuccugauccugagcgccaugagcagcuucaucuacagccuggccgccauccccggcuacauggugcugcugagaugcaugaagagcgaggagaagagccugggcgugggccugcacaccuucugcaccagaguguucgccggcauccccgcccccaucuacuucggcgcccugauggacagcaccugccugcacuggggcacccugaagugcggcgagagcggcgccugcagaaucuacgacagcaccaccuucagauacaucuaccugggccugcccgccgcccugagaggcagcagcuucgugcccgcccugaucauccugauccugcugagaaagugccaccugcccggcgagaacgccagcagcggcaccgagcugaucgagaccaaggugaagggcaaggagaacgagugcaaggacaucuaccagaagagcaccgugcugaaggacgacgagcugaagaccaagcuguaa

SEQ ID NO: 23681 - RNA, 2076 nt, Artificial Sequence
  SLCO1B1__Homo_sapiens__NP_006437
auggaccagaaccagcaccugaacaagaccgccgaggcccagcccagcgagaacaagaagaccagauacugcaacggccugaagauguuccuggccgcccugagccugagcuucaucgccaagacccugggcgccaucaucaugaagagcagcaucauccacaucgagagaagauucgagaucagcagcagccuggugggcuucaucgacggcagcuucgagaucggcaaccugcuggugaucguguucgugagcuacuucggcagcaagcugcacagacccaagcugaucggcaucggcugcuucaucaugggcaucggcggcgugcugaccgcccugccccacuucuucaugggcuacuacagauacagcaaggagaccaacaucaacagcagcgagaacagcaccagcacccugagcaccugccugaucaaccagauccugagccugaacagagccagccccgagaucgugggcaagggcugccugaaggagagcggcagcuacauguggaucuacguguucaugggcaacaugcugagaggcaucggcgagacccccaucgugccccugggccugagcuacaucgacgacuucgccaaggagggccacagcagccuguaccugggcauccugaacgccaucgccaugaucggccccaucaucggcuucacccugggcagccuguucagcaagauguacguggacaucggcuacguggaccugagcaccaucagaaucacccccaccgacagcagaugggugggcgccugguggcugaacuuccuggugagcggccuguucagcaucaucagcagcauccccuucuucuuccugccccagacccccaacaagccccagaaggagagaaaggccagccugagccugcacgugcuggagaccaacgacgagaaggaccagaccgccaaccugaccaaccagggcaagaacaucaccaagaacgugaccggcuucuuccagagcuucaagagcauccugaccaacccccuguacgugauguucgugcugcugacccugcugcaggugagcagcuacaucggcgccuucaccuacguguucaaguacguggagcagcaguacggccagcccagcagcaaggccaacauccugcugggcgugaucaccauccccaucuucgccagcggcauguuccugggcggcuacaucaucaagaaguucaagcugaacaccgugggcaucgccaaguucagcugcuucaccgccgugaugagccugagcuucuaccugcuguacuucuucauccugugcgagaacaagagcguggccggccugaccaugaccuacgacggcaacaaccccgugaccagccacagagacgugccccugagcuacugcaacagcgacugcaacugcgacgagagccagugggagcccgugugcggcaacaacggcaucaccuacaucagccccugccuggccggcugcaagagcagcagcggcaacaagaagcccaucguguucuacaacugcagcugccuggaggugaccggccugcagaacagaaacuacagcgcccaccugggcgagugccccagagacgacgccugcaccagaaaguucuacuucuucguggccauccaggugcugaaccuguucuucagcgcccugggcggcaccagccacgugaugcugaucgugaagaucgugcagcccgagcugaagagccuggcccugggcuuccacagcauggugaucagagcccugggcggcauccuggcccccaucuacuucggcgcccugaucgacaccaccugcaucaaguggagcaccaacaacugcggcaccagaggcagcugcagaaccuacaacagcaccagcuucagcagaguguaccugggccugagcagcaugcugagagugagcagccuggugcuguacaucauccugaucuacgccaugaagaagaaguaccaggagaaggacaucaacgccagcgagaacggcagcgugauggacgaggccaaccuggagagccugaacaagaacaagcacuucgugcccagcgccggcgccgacagcgagacccacugcuaa

SEQ ID NO: 23682 - RNA, 2109 nt, Artificial Sequence
  SLCO1B3__Homo_sapiens__NP_062818
auggaccagcaccagcaccugaacaagaccgccgagagcgccagcagcgagaagaagaagaccagaagaugcaacggcuucaagauguuccuggccgcccugagcuucagcuacaucgccaaggcccugggcggcaucaucaugaagaucagcaucacccagaucgagagaagauucgacaucagcagcagccuggccggccugaucgacggcagcuucgagaucggcaaccugcuggugaucguguucgugagcuacuucggcagcaagcugcacagacccaagcugaucggcaucggcugccugcugaugggcaccggcagcauccugaccagccugccccacuucuucaugggcuacuacagauacagcaaggagacccacaucaaccccagcgagaacagcaccagcagccugagcaccugccugaucaaccagacccugagcuucaacggcaccagccccgagaucguggagaaggacugcgugaaggagagcggcagccacauguggaucuacguguucaugggcaacaugcugagaggcaucggcgagacccccaucgugccccugggcaucagcuacaucgacgacuucgccaaggagggccacagcagccuguaccugggcagccugaacgccaucggcaugaucggccccgugaucggcuucgcccugggcagccuguucgccaagauguacguggacaucggcuacguggaccugagcaccaucagaaucacccccaaggacagcagaugggugggcgccugguggcugggcuuccuggugagcggccuguucagcaucaucagcagcauccccuucuucuuccugcccaagaaccccaacaagccccagaaggagagaaagaucagccugagccugcacgugcugaagaccaacgacgacagaaaccagaccgccaaccugaccaaccagggcaagaacgugaccaagaacgugaccggcuucuuccagagccugaagagcauccugaccaacccccuguacgugaucuuccugcugcugacccugcugcaggugagcagcuucaucggcagcuucaccuacguguucaaguacauggagcagcaguacggccagagcgccagccacgccaacuuccugcugggcaucaucaccauccccaccguggccaccggcauguuccugggcggcuucaucaucaagaaguucaagcugagccuggugggcaucgccaaguucagcuuccugaccagcaugaucagcuuccuguuccagcugcuguacuucccccugaucugcgagagcaagagcguggccggccugacccugaccuacgacggcaacaacagcguggccagccacguggacgugccccugagcuacugcaacagcgagugcaacugcgacgagagccagugggagcccgugugcggcaacaacggcaucaccuaccugagccccugccuggccggcugcaagagcagcagcggcaucaagaagcacaccguguucuacaacugcagcugcguggaggugaccggccugcagaacagaaacuacagcgcccaccugggcgagugccccagagacaacaccugcaccagaaaguucuucaucuacguggccauccaggugaucaacagccuguucagcgccaccggcggcaccaccuucauccugcugaccgugaagaucgugcagcccgagcugaaggcccuggccaugggcuuccagagcauggugaucagaacccugggcggcauccuggcccccaucuacuucggcgcccugaucgacaagaccugcaugaaguggagcaccaacagcugcggcgcccagggcgccugcagaaucuacaacagcguguucuucggcagaguguaccugggccugagcaucgcccugagauuccccgcccuggugcuguacaucguguucaucuucgccaugaagaagaaguuccagggcaaggacaccaaggccagcgacaacgagagaaaggugauggacgaggccaaccuggaguuccugaacaacggcgagcacuucgugcccagcgccggcaccgacagcaagaccugcaaccuggacaugcaggacaacgccgccgccaacuaa

SEQ ID NO: 23683 - RNA, 1923 nt, Artificial Sequence
  SLCO1B7__Homo_sapiens__NP_001009562
augaagaucagcaccacccagaucgagagaagauucgagaucagcagcagccuggugggccugaucgacggcagcuucgagaucggcaaccuguucgugaucguguucgugagcuacuucggcagcaagcugcacagacccaagcugaucggcaucggcugcuuccugaugggcaccggcagcauccugauggcccugccccacuucuucaugggcuacuacagauacagcaaggagaccaacaucgaccccagcgagaacagcaccagcaaccugcccaacugccugaucaaccagaugcugagccugaacagaacccccagcgagaucaucgagagaggcugcgugaaggagagcggcagccacauguggaucuacguguucaugggcaacaugcugagaggcaucggcgagacccccaucgugccccugggcaucagcuacaucgacgacuucgccaaggagggccacagcagccuguaccugggcaccgugaacgugaugggcaugaccggccugguguucgccuucaugcugggcagccuguucgccaagauguacguggacaucggcuacguggaccugagcaccaucagaaucacccccaaggacagcagaugggugggcgccugguggcugggcuuccuggugagcggcaucgugagcaucaucagcagcauccccuucuucuuccugccccugaaccccaacaagccccagaaggagagaaaggugagccuguuccugcacgugcugaagaccaacgacaagagaaaccagaucgccaaccugaccaacagaagaaaguacaucaccaagaacgugaccggcuucuuccagagccugaagagcauccugaccaacccccuguacgugaucuucgugaucuucacccugcugcacaugagcagcuacaucgccagccugaccuacaucaucaagaugguggagcagcaguacggcuggagcgccagcaagaccaacuuccugcugggcgugcuggcccugcccgccguggccaucggcauguucagcggcggcuacaucaucaagaaguucaagcugagccuggugggccuggccaagcuggccuucugcagcgccaccgugcaccugcugagccaggugcuguacuucuuccugaucugcgagagcaagagcguggccggccugacccugaccuacgacggcaacagccccgugagaagccacguggacgugccccugagcuacugcaacagcgagugcaacugcgacgagagccagugggagcccgugugcggcaacaacggcaucaccuaccugagccccugccuggccggcugcaagagcagcagcggcaacaaggagcccaucguguucuacaacugcagcugcguggaggugaucggccugcagaacaagaacuacagcgcccaccugggcgagugccccagagacgacgccugcaccagaaagagcuacguguacuucgugauccaggugcuggacgccuuccugugcgccgugggccugaccagcuacagcgugcuggugaucagaaucgugcagcccgagcugaaggcccuggccaucggcuuccacagcaugaucaugagaagccugggcggcauccuggugcccaucuacuucggcgcccugaucgacaccaccugcaugaaguggagcaccaacagcugcggcgccagaggcgccugcagaaucuacaacagcaccuaccugggcagagccuucuucggccugaagguggcccugaucuuccccgugcuggugcugcugaccguguucaucuucguggugagaaagaagagccacggcaaggacaccaaggugcuggagaacgagagacaggugauggacgaggccaaccuggaguuccugaacgacagcgagcacuucgugcccagcgccgaggagcaguaa

SEQ ID NO: 23684 - RNA, 1992 nt, Artificial Sequence
  SLCO1C1__Homo_sapiens__NP_001139417
auggacaccagcagcaaggagaacauccagcuguucugcaagaccagcgugcagcccgugggcagacccagcuucaagaccgaguaccccagcagcgaggagaagcagcccugcugcggcgagcugaagguguuccugugcgcccugagcuucguguacuucgccaaggcccuggccgagggcuaccugaagagcaccaucacccagaucgagagaagauucgacauccccagcagccuggugggcgugaucgacggcagcuucgagaucggcaaccugcuggugaucaccuucgugagcuacuucggcgccaagcugcacagacccaagaucaucggcgccggcugcgugaucaugggcgugggcacccugcugaucgccaugccccaguucuucauggagcaguacaaguacgagagauacagccccagcagcaacagcacccugagcaucagccccugccugcuggagagcagcagccagcugcccgugagcgugauggagaagagcaagagcaagaucagcaacggcugcgugcagaccguggccaucaucggccccaucuucggcuuccugcugggcagccugugcgccaagcuguacguggacaucggcuucgugaaccuggaccacaucaccaucacccccaaggacccccagugggugggcgccugguggcugggcuaccugaucgccggcaucaucagccugcuggccgccgugcccuucugguaccugcccaagagccugcccagaagccagagcagagaggacagcaacagcagcagcgagaagagcaaguucaucaucgacgaccacaccgacuaccagaccccccagggcgagaacgccaagaucauggagauggccagagacuuccugcccagccugaagaaccuguucggcaaccccguguacuuccuguaccugugcaccagcaccgugcaguucaacagccuguucggcauggugaccuacaagcccaaguacaucgagcagcaguacggccagagcagcagcagagccaacuucgugaucggccugaucaacauccccgccguggcccugggcaucuucagcggcggcaucgugaugaagaaguucagaaucagcgugugcggcgccgccaagcuguaccugggcagcagcguguucggcuaccugcuguuccugagccuguucgcccugggcugcgagaacagcgacguggccggccugaccgugagcuaccagggcaccaagcccgugagcuaccacgagagagcccuguucagcgacugcaacagcagaugcaagugcagcgagaccaagugggagcccaugugcggcgagaacggcaucaccuacgugagcgccugccuggccggcugccagaccagcaacagaagcggcaagaacaucaucuucuacaacugcaccugcgugggcaucgccgccagcaagagcggcaacagcagcggcaucgugggcagaugccagaaggacaacggcugcccccagauguuccuguacuuccuggugaucagcgugaucaccagcuacacccugagccugggcggcauccccggcuacauccugcugcugagaugcaucaagccccagcugaagagcuucgcccugggcaucuacacccuggccaucagagugcuggccggcauccccgcccccguguacuucggcgugcugaucgacaccagcugccugaaguggggcuucaagagaugcggcagcagaggcagcugcagacuguacgacagcaacguguucagacacaucuaccugggccugaccgugauccugggcaccgugagcauccugcugagcaucgccgugcuguucauccugaagaagaacuacgugagcaagcacagaagcuucaucaccaagagagagagaaccauggugagcaccagauuccagaaggagaacuacaccaccagcgaccaccugcugcagcccaacuacuggcccggcaaggagacccagcuguaa

SEQ ID NO: 23685 - RNA, 1932 nt, Artificial Sequence
  SLCO2A1__Homo_sapiens__NP_005621
augggccugcugcccaagcugggcgccagccagggcagcgacaccagcaccagcagagccggcagaugcgccagaagcguguucggcaacaucaagguguucgugcugugccagggccugcugcagcugugccagcugcuguacagcgccuacuucaagagcagccugaccaccaucgagaagagauucggccugagcagcagcagcagcggccugaucagcagccugaacgagaucagcaacgccauccugaucaucuucgugagcuacuucggcagcagagugcacagacccagacugaucggcaucggcggccuguuccuggccgccggcgccuucauccugacccugccccacuuccugagcgagcccuaccaguacacccuggccagcaccggcaacaacagcagacugcaggccgagcugugccagaagcacuggcaggaccugccccccagcaagugccacagcaccacccagaacccccagaaggagaccagcagcauguggggccugauggugguggcccagcugcuggccggcaucggcaccgugcccauccagcccuucggcaucagcuacguggacgacuucagcgagcccagcaacagcccccuguacaucagcauccuguucgccaucagcguguucggccccgccuucggcuaccugcugggcagcgugaugcugcagaucuucguggacuacggcagagugaacaccgccgccgugaaccuggugcccggcgaccccagauggaucggcgccugguggcugggccugcugaucagcagcgcccugcuggugcugaccagcuuccccuucuucuucuuccccagagccaugcccaucggcgccaagagagcccccgccaccgccgacgaggccagaaagcuggaggaggccaagagcagaggcagccugguggacuucaucaagagauuccccugcaucuuccugagacugcugaugaacagccuguucgugcugguggugcuggcccagugcaccuucagcagcgugaucgccggccugagcaccuuccugaacaaguuccuggagaagcaguacggcaccagcgccgccuacgccaacuuccugaucggcgccgugaaccugcccgccgccgcccugggcaugcuguucggcggcauccugaugaagagauucguguucagccugcaggccauccccagaaucgccaccaccaucaucaccaucagcaugauccugugcgugccccuguucuucaugggcugcagcacccccaccguggccgagguguacccccccagcaccagcagcagcauccacccccagagccccgccugcagaagagacugcagcugccccgacagcaucuuccaccccgugugcggcgacaacggcaucgaguaccugagccccugccacgccggcugcagcaacaucaacaugagcagcgccaccagcaagcagcugaucuaccugaacugcagcugcgugaccggcggcagcgccagcgccaagaccggcagcugccccgugcccugcgcccacuuccugcugcccgccaucuuccugaucagcuucgugagccugaucgccugcaucagccacaacccccuguacaugauggugcugagaguggugaaccaggaggagaagagcuucgccaucggcgugcaguuccugcugaugagacugcuggccuggcugcccagccccgcccuguacggccugaccaucgaccacagcugcaucagauggaacagccugugccugggcagaagaggcgccugcgccuacuacgacaacgacgcccugagagacagauaccugggccugcagaugggcuacaaggcccugggcaugcugcugcugugcuucaucagcuggagagugaagaagaacaaggaguacaacgugcagaaggccgccggccugaucuaa

SEQ ID NO: 23686 - RNA, 2064 nt, Artificial Sequence
  SLCO2B1__Homo_sapiens__NP_001138683
augggcaccgagaacacccccggcggcaaggccagccccgacccccaggacgugagacccagcguguuccacaacaucaagcuguucgugcugugccacagccugcugcagcuggcccagcugaugaucagcggcuaccugaagagcagcaucagcaccguggagaagagauucggccugagcagccagaccagcggccugcuggccagcuucaacgaggugggcaacaccgcccugaucguguucgugagcuacuucggcagcagagugcacagacccagaaugaucggcuacggcgccauccugguggcccuggccggccugcugaugacccugccccacuucaucagcgagcccuacagauacgacaacaccagccccgaggacaugccccaggacuucaaggccagccugugccugcccaccaccagcgcccccgccagcgcccccagcaacggcaacugcagcagcuacaccgagacccagcaccugagcguggugggcaucauguucguggcccagacccugcugggcgugggcggcgugcccauccagcccuucggcaucagcuacaucgacgacuucgcccacaacagcaacagcccccuguaccugggcauccuguucgccgugaccaugaugggccccggccuggccuucggccugggcagccugaugcugagacuguacguggacaucaaccagaugcccgagggcggcaucagccugaccaucaaggaccccagaugggugggcgccugguggcugggcuuccugaucgccgccggcgccguggcccuggccgccauccccuacuucuucuuccccaaggagaugcccaaggagaagagagagcugcaguucagaagaaaggugcuggccgugaccgacagccccgccagaaagggcaaggacagccccagcaagcagagccccggcgagagcaccaagaagcaggacggccuggugcagaucgcccccaaccugaccgugauccaguucaucaagguguuccccagagugcugcugcagacccugagacaccccaucuuccugcugguggugcugagccaggugugccugagcagcauggccgccggcauggccaccuuccugcccaaguuccuggagagacaguucagcaucaccgccagcuacgccaaccugcugaucggcugccugagcuuccccagcgugaucgugggcaucguggugggcggcgugcuggugaagagacugcaccugggccccgugggcugcggcgcccugugccugcugggcaugcugcugugccuguucuucagccugccccuguucuucaucggcugcagcagccaccagaucgccggcaucacccaccagaccagcgcccaccccggccuggagcugagccccagcugcauggaggccugcagcugcccccuggacggcuucaaccccgugugcgaccccagcaccagaguggaguacaucacccccugccacgccggcugcagcagcuggguggugcaggacgcccuggacaacagccagguguucuacaccaacugcagcugcgugguggagggcaaccccgugcuggccggcagcugcgacagcaccugcagccaccugguggugcccuuccugcugcuggugagccugggcagcgcccuggccugccugacccacacccccagcuucaugcugauccugagaggcgugaagaaggaggacaagacccuggccgugggcauccaguucauguuccugagaauccuggccuggaugcccagccccgugauccacggcagcgccaucgacaccaccugcgugcacugggcccugagcugcggcagaagagccgugugcagauacuacaacaacgaccugcugagaaacagauucaucggccugcaguucuucuucaagaccggcagcgugaucugcuucgcccuggugcuggccgugcugagacagcaggacaaggaggccagaaccaaggagagcagaagcagccccgccguggagcagcagcugcuggugagcggccccggcaagaagcccgaggacagcagaguguaa

SEQ ID NO: 23687 - RNA, 2079 nt, Artificial Sequence
  SLCO3A1__Homo_sapiens__NP_001138516
augcagggcaagaagcccggcggcagcagcggcggcggcagaagcggcgagcugcagggcgacgaggcccagagaaacaagaagaagaagaagaaggugagcugcuucagcaacaucaagaucuuccuggugagcgagugcgcccugaugcuggcccagggcaccgugggcgccuaccuggugagcgugcugaccacccuggagagaagauucaaccugcagagcgccgacgugggcgugaucgccagcagcuucgagaucggcaaccuggcccugauccuguucgugagcuacuucggcgccagaggccacagacccagacugaucggcugcggcggcaucgugauggcccugggcgcccugcugagcgcccugcccgaguuccugacccaccaguacaaguacgaggccggcgagaucagauggggcgccgagggcagagacgugugcgccgccaacggcagcggcggcgacgagggccccgaccccgaccugaucugcagaaacagaaccgccaccaacaugauguaccugcugcugaucggcgcccaggugcugcugggcaucggcgccacccccgugcagccccugggcgugagcuacaucgacgaccacgugagaagaaaggacagcagccuguacaucggcauccuguucaccaugcugguguucggccccgccugcggcuucauccugggcagcuucugcaccaagaucuacguggacgccguguucaucgacaccagcaaccuggacaucacccccgacgaccccagauggaucggcgccugguggggcggcuuccugcugugcggcgcccugcuguucuucagcagccugcugauguucggcuucccccagagccugcccccccacagcgagcccgccauggagagcgagcaggccaugcugagcgagagagaguacgagagacccaagcccagcaacggcgugcugagacacccccuggagcccgacagcagcgccagcugcuuccagcagcugagagugauccccaaggugaccaagcaccugcugagcaaccccguguucaccugcaucauccuggccgccugcauggagaucgccgugguggccggcuucgccgccuuccugggcaaguaccuggagcagcaguucaaccugaccaccagcagcgccaaccagcugcugggcaugaccgccauccccugcgccugccugggcaucuuccugggcggccugcuggugaagaagcugagccugagcgcccugggcgccaucagaauggccaugcuggugaaccuggugagcaccgccugcuacgugagcuuccuguuccugggcugcgacaccggccccguggccggcgugaccgugcccuacggcaacagcaccgcccccggcagcgcccuggaccccuacagccccugcaacaacaacugcgagugccagaccgacagcuucacccccgugugcggcgccgacggcaucaccuaccugagcgccugcuucgccggcugcaacagcaccaaccugaccggcugcgccugccugaccaccgugcccgccgagaacgccaccguggugcccggcaagugccccagccccggcugccaggaggccuuccugaccuuccugugcgugaugugcaucugcagccugaucggcgccauggcccagacccccagcgugaucauccugaucagaaccgugagccccgagcugaagagcuacgcccugggcgugcuguuccugcugcugagacugcugggcuucaucccccccccccugaucuucggcgccggcaucgacagcaccugccuguucuggagcaccuucugcggcgagcagggcgccugcgugcuguacgacaacgugguguacagauaccuguacgugagcaucgccaucgcccugaagagcuucgccuucauccuguacaccaccaccuggcagugccugagaaagaacuacaagagauacaucaagaaccacgagggcggccugagcaccagcaccgaguaccaggacaucgagaccgagaagaccugccccgagagccacagccccagcgaggacagcuucgugagaagcuaa

SEQ ID NO: 23688 - RNA, 2169 nt, Artificial Sequence
  SLCO4A1__Homo_sapiens__NP_057438
augccccugcaccagcugggcgacaagccccugaccuuccccagccccaacagcgccauggagaacggccuggaccacaccccccccagcagaagagccagccccggcaccccccugagccccggcagccugagaagcgccgcccacagcccccuggacaccagcaagcagccccugugccagcugugggccgagaagcacggcgccagaggcacccacgaggugagauacgugagcgccggccagagcguggccugcggcuggugggccuucgccccccccugccugcaggugcugaacacccccaagggcauccuguucuuccugugcgccgccgccuuccugcagggcaugaccgugaacggcuucaucaacaccgugaucaccagccuggagagaagauacgaccugcacagcuaccagagcggccugaucgccagcagcuacgacaucgccgccugccugugccugaccuucgugagcuacuucggcggcagcggccacaagcccagauggcugggcuggggcgugcugcugaugggcaccggcagccugguguucgcccugccccacuucaccgccggcagauacgagguggagcuggacgccggcgugagaaccugccccgccaaccccggcgccgugugcgccgacagcaccagcggccugagcagauaccagcugguguucaugcugggccaguuccugcacggcgugggcgccaccccccuguacacccugggcgugaccuaccuggacgagaacgugaagagcagcugcagccccguguacaucgccaucuucuacaccgccgccauccugggccccgccgccggcuaccugaucggcggcgcccugcugaacaucuacaccgagaugggcagaagaaccgagcugaccaccgagagcccccugugggugggcgccuggugggugggcuuccugggcagcggcgccgccgccuucuucaccgccgugcccauccugggcuaccccagacagcugcccggcagccagagauacgccgugaugagagccgccgagaugcaccagcugaaggacagcagcagaggcgaggccagcaaccccgacuucggcaagaccaucagagaccugccccugagcaucuggcugcugcugaagaaccccaccuucauccugcugugccuggccggcgccaccgaggccacccugaucaccggcaugagcaccuucagccccaaguuccuggagagccaguucagccugagcgccagcgaggccgccacccuguucggcuaccugguggugcccgccggcggcggcggcaccuuccugggcggcuucuucgugaacaagcugagacugagaggcagcgccgugaucaaguucugccuguucugcaccguggugagccugcugggcauccugguguucagccugcacugccccagcgugcccauggccggcgugaccgccagcuacggcggcagccugcugcccgagggccaccugaaccugaccgcccccugcaacgccgccugcagcugccagcccgagcacuacagccccgugugcggcagcgacggccugauguacuucagccugugccacgccggcugccccgccgccaccgagaccaacguggacggccagaagguguacagagacugcagcugcaucccccagaaccugagcagcggcuucggccacgccaccgccggcaagugcaccagcaccugccagagaaagccccugcugcugguguucaucuucguggugaucuucuucaccuuccugagcagcauccccgcccugaccgccacccugagaugcgugagagacccccagagaagcuucgcccugggcauccaguggaucguggugagaauccugggcggcauccccggccccaucgccuucggcugggugaucgacaaggccugccugcuguggcaggaccagugcggccagcagggcagcugccugguguaccagaacagcgccaugagcagauacauccugaucaugggccugcuguacaaggugcugggcgugcuguucuucgccaucgccugcuuccuguacaagccccugagcgagagcagcgacggccuggagaccugccugcccagccagagcagcgcccccgacagcgccaccgacagccagcugcagagcagcguguaa

SEQ ID NO: 23689 - RNA, 2175 nt, Artificial Sequence
  SLCO4C1__Homo_sapiens__NP_851322
augaagagcgccaagggcaucgagaaccuggccuucgugcccagcagccccgacauccugagaagacugagcgccagccccagccagaucgaggugagcgcccugagcagcgacccccagagagagaacagccagccccaggagcugcagaagccccaggagccccagaagagccccgagcccagccugcccagcgccccccccaacgugagcgaggagaagcugagaagccugagccugagcgaguucgaggagggcagcuacggcuggagaaacuuccacccccagugccugcagagaugcaacacccccggcggcuuccugcugcacuacugccugcuggccgugacccagggcaucguggugaacggccuggugaacaucagcaucagcaccguggagaagagauacgagaugaagagcagccugaccggccugaucagcagcagcuacgacaucagcuucugccugcugagccuguucgugagcuucuucggcgagagaggccacaagcccagauggcuggccuucgccgccuucaugaucggccugggcgcccugguguucagccugccccaguucuucagcggcgaguacaagcugggcagccuguucgaggacaccugcgugaccaccagaaacagcaccagcugcaccagcagcaccagcagccugagcaacuaccuguacguguucauccugggccagcugcugcugggcgccggcggcaccccccuguacacccugggcaccgccuuccuggacgacagcgugcccacccacaagagcagccuguacaucggcaccggcuacgccaugagcauccugggccccgccaucggcuacgugcugggcggccagcugcugaccaucuacaucgacguggccaugggcgagagcaccgacgugaccgaggacgaccccagauggcugggcgccugguggaucggcuuccugcugagcuggaucuucgccuggagccugaucauccccuucagcugcuuccccaagcaccugcccggcaccgccgagauccaggccggcaagaccagccaggcccaccagagcaacagcaacgccgacgugaaguucggcaagagcaucaaggacuuccccgccgcccugaagaaccugaugaagaacgccguguucaugugccuggugcugagcaccagcagcgaggcccugaucaccaccggcuucgccaccuuccugcccaaguucaucgagaaccaguucggccugaccagcagcuucgccgccacccugggcggcgccgugcugauccccggcgccgcccugggccagauccugggcggcuuccuggugagcaaguucagaaugaccugcaagaacaccaugaaguucgcccuguucaccagcggcguggcccugacccugagcuucguguucauguacgccaagugcgagaacgagcccuucgccggcgugagcgagagcuacaacggcaccggcgagcugggcaaccugaucgcccccugcaacgccaacugcaacugcagcagaagcuacuacuaccccgugugcggcgacggcgugcaguacuucagccccugcuucgccggcugcagcaaccccguggcccacagaaagcccaagguguacuacaacugcagcugcaucgagagaaagaccgagaucaccagcaccgccgagaccuucggcuucgaggccaaggccggcaagugcgagacccacugcgccaagcugcccaucuuccugugcaucuucuucaucgugaucaucuucaccuucauggccggcacccccaucaccgugagcauccugagaugcgugaaccacagacagagaagccuggcccugggcauccaguucauggugcugagacugcugggcaccauccccggccccaucaucuucggcuucaccaucgacagcaccugcauccugugggacaucaacgacugcggcaucaagggcgccugcuggaucuacgacaacaucaagauggcccacaugcugguggccaucagcgugaccugcaaggugaucaccauguucuucaacggcuucgccaucuuccuguacaagcccccccccagcgccaccgacgugagcuuccacaaggagaacgccguggugaccaacgugcuggccgagcaggaccugaacaagaucgugaaggagggcuaa

SEQ ID NO: 23690 - RNA, 2064 nt, Artificial Sequence
  SLCO5A1__Homo_sapiens__NP_001139480
auggacgagggcaccggccugcagcccggcgccggcgagcagcuggaggcccccgccaccgccgaggccgugcaggagagaugcgagcccgagacccugagaagcaagagccugcccgugcugagcagcgccagcugcagacccagccugagccccaccagcggcgacgccaaccccgccuucggcugcguggacagcagcggccaccaggagcugaagcagggccccaacccccuggcccccagccccagcgcccccagcaccagcgccggccugggcgacugcaaccacagaguggaccugagcaagaccuucagcgugagcagcgcccuggccaugcugcaggagagaagaugccuguacguggugcugaccgacagcagaugcuuccuggugugcaugugcuuccugaccuucauccaggcccugauggugagcggcuaccugagcagcgugaucaccaccaucgagagaagauacagccugaagagcagcgagagcggccugcuggugagcugcuucgacaucggcaaccuggugguggugguguucgugagcuacuucggcggcagaggcagaagaccccuguggcuggccgugggcggccugcugaucgccuucggcgccgcccuguucgcccugccccacuucaucagcccccccuaccagauccaggagcugaacgccagcgcccccaacgacggccugugccagggcggcaacagcaccgccacccuggagccccccgccugccccaaggacagcggcggcaacaaccacuggguguacguggcccuguucaucugcgcccagauccugaucggcaugggcagcacccccaucuacacccugggccccaccuaccuggacgacaacgugaagaaggagaacagcagccuguaccuggccaucauguacgugaugggcgcccugggccccgccgugggcuaccugcugggcggccugcugaucggcuucuacguggaccccagaaaccccgugcaccuggaccagaacgaccccagauucaucggcaacugguggagcggcuuccugcugugcgccaucgccauguuccuggugaucuuccccauguucaccuuccccaagaagcugccccccagacacaagaagaagaagaagaagaaguucagcguggacgccgugagcgacgacgacgugcugaaggagaagagcaacaacagcgagcaggccgacaagaaggugagcagcaugggcuucggcaaggacgugagagaccugcccagagccgccgugagaauccugagcaacaugaccuuccuguucgugagccugagcuacaccgccgagagcgccaucgugaccgccuucaucaccuucauccccaaguucaucgagagccaguucggcauccccgccagcaacgccagcaucuacaccggcgugaucaucgugcccagcgccggcgugggcaucgugcugggcggcuacaucaucaagaagcugaagcugggcgccagagagagcgccaagcuggccaugaucugcagcggcgugagccugcugugcuucagcacccuguucaucgugggcugcgagagcaucaaccugggcggcaucaacauccccuacaccaccggccccagccugaccaugccccacagaaaccugaccggcagcugcaacgugaacugcggcugcaagauccacgaguacgagcccgugugcggcagcgacggcaucaccuacuucaaccccugccuggccggcugcgugaacagcggcaaccugagcaccggcaucagaaacuacaccgagugcaccugcgugcagagcagacaggugaucaccccccccaccgugggccagagaagccagcugagaguggugaucgugaagaccuaccugaacgagaacggcuacgccgugagcggcaagugcaagagaaccugcaacacccugauccccuuccugguguuccuguucaucgugaccuucaucaccgccugcgcccagcccagcgccaucaucgugacccugagcauccacagcuacagcaaccugcuguggagcagccacuaa

SEQ ID NO: 23691 - RNA, 2160 nt, Artificial Sequence
  SLCO6A1__Homo_sapiens__NP_001275931
auguucgugggcguggccagacacagcggcagccaggacgaggugagcagaggcguggagccccuggaggccgccagagcccagcccgccaaggacagaagagccaagggcacccccaagagcagcaagcccggcaagaagcacagauaccugagacugcugcccgaggcccugaucagauucggcggcuucagaaagagaaagaaggccaagagcagcgugagcaagaagcccggcgagguggacgacagccuggagcagcccugcggccugggcugccuggugagcaccugcugcgagugcugcaacaacaucagaugcuucaugaucuucuacugcauccugcugaucugccagggcgugguguucggccugaucgacgugagcaucggcgacuuccagaaggaguaccagcugaagaccaucgagaagcuggcccuggagaagagcuacgacaucagcagcggccugguggccaucuucaucgccuucuacggcgacagaaagaaggugaucugguucguggccagcagcuuccugaucggccugggcagccugcugugcgccuuccccagcaucaacgaggagaacaagcagagcaaggugggcaucgaggacaucugcgaggagaucaagguggugagcggcugccagagcagcggcaucagcuuccagagcaaguaccugagcuucuucauccugggccagaccgugcagggcaucgccggcaugccccuguacauccugggcaucaccuucaucgacgagaacguggccacccacagcgccggcaucuaccugggcaucgccgagugcaccagcaugaucggcuacgcccugggcuacgugcugggcgccccccuggugaaggugcccgagaacaccaccagcgccaccaacaccaccgugaacaacggcagccccgaguggcuguggaccugguggaucaacuuccuguucgccgccgugguggccuggugcacccugaucccccugagcugcuuccccaacaacaugcccggcagcaccagaaucaaggccagaaagagaaagcagcugcacuucuucgacagcagacugaaggaccugaagcugggcaccaacaucaaggaccugugcgccgcccuguggauccugaugaagaaccccgugcugaucugccuggcccugagcaaggccaccgaguaccuggugaucaucggcgccagcgaguuccugcccaucuaccuggagaaccaguucauccugacccccaccguggccaccacccuggccggccuggugcugauccccggcggcgcccugggccagcugcugggcggcgugaucgugagcacccuggagaugagcugcaaggcccugaugagauucaucauggugaccagcgugaucagccugauccugcugguguucaucaucuucgugagaugcaaccccgugcaguucgccggcaucaacgaggacuacgacggcaccggcaagcugggcaaccugaccgcccccugcaacgagaagugcagaugcagcagcagcaucuacagcagcaucugcggcagagacgacaucgaguacuucagccccugcuucgccggcugcaccuacagcaaggcccagaaccagaagaagauguacuacaacugcagcugcaucaaggagggccugaucaccgccgacgccgagggcgacuucaucgacgccagacccggcaagugcgacgccaagugcuacaagcugccccuguucaucgccuucaucuucagcacccugaucuucagcggcuucagcggcgugcccaucgugcuggccaugaccagaguggugcccgacaagcugagaagccuggcccugggcgugagcuacgugauccugagaaucuucggcaccauccccggccccagcaucuucaagaugagcggcgagaccagcugcauccugagagacgugaacaagugcggccacaccggcagaugcuggaucuacaacaagaccaagauggccuuccugcuggugggcaucugcuuccugugcaagcugugcaccaucaucuucaccaccaucgccuucuucaucuacaagagaagacugaacgagaacaccgacuuccccgacgugaccgugaagaaccccaaggugaagaagaaggaggagaccgaccuguaa

SEQ ID NO: 23692 - RNA, 1737 nt, Artificial Sequence
  SLFN12__Homo_sapiens__NP_001275938
augaacaucagcguggaccuggagaccaacuacgccgagcuggugcuggacgugggcagagugacccugggcgagaacagcagaaagaagaugaaggacugcaagcugagaaagaagcagaacgagagcgugagcagagccaugugcgcccugcugaacagcggcggcggcgugaucaaggccgagaucgagaacgaggacuacagcuacaccaaggacggcaucggccuggaccuggagaacagcuucagcaacauccugcuguucgugcccgaguaccuggacuucaugcagaacggcaacuacuuccugaucuucgugaagagcuggagccugaacaccagcggccugagaaucaccacccugagcagcaaccuguacaagagagacaucaccagcgccaaggugaugaacgccaccgccgcccuggaguuccugaaggacaugaagaagaccagaggcagacuguaccugagacccgagcugcuggccaagagacccugcguggacauccaggaggagaacaacaugaaggcccuggccggcguguucuucgacagaaccgagcuggacagaaaggagaagcugaccuucaccgagagcacccacguggagaucaagaacuucagcaccgagaagcugcugcagagaaucaaggagauccugccccaguacgugagcgccuucgccaacaccgacggcggcuaccuguucaucggccugaacgaggacaaggagaucaucggcuucaaggccgagaugagcgaccuggacgaccuggagagagagaucgagaagagcaucagaaagaugcccgugcaccacuucugcauggagaagaagaagaucaacuacagcugcaaguuccugggcguguacgacaagggcagccugugcggcuacgugugcgcccugagaguggagagauucugcugcgccguguucgccaaggagcccgacagcuggcacgugaaggacaacagagugaugcagcugaccagaaaggaguggauccaguucaugguggaggccgagcccaaguucagcagcagcuacgaggaggugaucagccagaucaacaccagccugcccgccccccacagcuggccccugcuggaguggcagagacagagacaccacugccccggccugagcggcagaaucaccuacacccccgagaaccugugcagaaagcuguuccugcagcacgagggccugaagcagcugaucugcgaggagauggacagcgugagaaagggcagccugaucuucagcagaagcuggagcguggaccugggccugcaggagaaccacaaggugcugugcgacgcccugcugaucagccaggacagcccccccgugcuguacaccuuccacauggugcaggacgaggaguucaagggcuacagcacccagaccgcccugacccugaagcagaagcuggccaagaucggcggcuacaccaagaaggugugcgugaugaccaagaucuucuaccugagccccgagggcaugaccagcugccaguacgaccugagaagccaggugaucuaccccgagagcuacuacuucaccagaagaaaguaccugcugaaggcccuguucaaggcccugaagagacugaagagccugagagaccaguucagcuucgccgagaaccuguaccagaucaucggcaucgacugcuuccagaagaacgacaagaagauguucaagagcugcagaagacugaccuaa

SEQ ID NO: 23693 - RNA, 1767 nt, Artificial Sequence
  SLFN12L__Homo_sapiens__XP_011522471
auggaccuggccagaaaggaguuccugagaggcaacggccuggccgccggcaagaugaacaucagcaucgaccuggacaccaacuacgccgagcuggugcugaacgugggcagagugacccugggcgagaacaacagaaagaagaugaaggacugccagcugagaaagcagcagaacgagaacgugagcagagccgugugcgcccugcugaacagcggcggcggcgugaucaaggccgagguggagaacaagggcuacagcuacaagaaggacggcaucggccuggaccuggagaacagcuucagcaacaugcugcccuucgugcccaacuuccuggacuucaugcagaacggcaacuacuuccacaucuucgugaagagcuggagccuggagaccagcggcccccagaucgccacccugagcagcagccuguacaagagagacgugaccagcgccaaggugaugaacgccagcgccgcccuggaguuccugaaggacauggagaagaccggcggcagagccuaccugagacccgaguuccccgccaagagagccugcguggacgugcaggaggagagcaacauggaggcccuggccgccgacuucuucaacagaaccgagcugggcuacaaggagaagcugaccuucaccgagagcacccacguggagaucaagaacuucagcaccgagaagcugcugcagagaaucaccgagauccugccccaguacgugagcgccuucgccaacaccgacggcggcuaccuguucgugggccugaacgaggacaaggaggugaucggcuucaaggccgagaagagcuaccugaccaagcuggaggaggugaccaagaacagcaucggcaagcugcccgugcaccacuucugcguggagaagggcaccaucaacuaccugugcaaguuccugggcguguacgacaagggcagacugugcggcuacguguacgcccugagaguggagagauucugcugcgccguguucgccaagaagcccgacagcuggcacgugaaggacaacagagugaagcagcugaccgagaaggaguggauccaguucaugguggacagcgagcccgugugcgaggagcugcccagccccgccagcaccagcagccccgugagccagagcuacccccugagagaguacaucaacuucaagauccagccccugagauaccaccugcccggccugagcgagaagaucaccugcgcccccaagaccuucugcagaaaccuguucagccagcacgagggccugaagcagcugaucugcgaggagaugggcagcgugaacaagggcagccugaucuucagcagaagcuggagccuggaccugggccugcaggagaaccacaaggugcugugcgacgcccugcugaucagccaggacaagccccccgugcuguacaccuuccacauggugcaggacgaggaguucaaggacuacagcacccagaccgcccagacccugaagcagaagcuggccaagaucggcggcuacaccaagaaggugugcgugaugaccaagaucuucuaccugagccccgagggcaagaccagcugccaguacgaccugaacagccaggugaucuaccccgagagcuacuacuggaccaccgcccagaccaugaaggaccuggagaaggcccugagcaacauccugcccaaggagaaccagaucuuccuguucgugugccuguucagauucugccuguucgugugcugguucgugugcuucuuccugagauaa

SEQ ID NO: 23694 - RNA, 2739 nt, Artificial Sequence
  SLFN14__Homo_sapiens__NP_001123292
auggagagccugaagaccgacaccgagaugcccuaccccgaggugaucguggacgugggcagagugaucuucggcgaggagaacagaaagaagaugaccaacagcugccugaagagaagcgagaacagcagaaucaucagagccaucugcgcccugcugaacagcggcggcggcgugaucaaggccgagaucgacgacaagaccuacagcuaccagugccacggccugggccaggaccuggagaccagcuuccagaagcugcugcccagcggcagccagaaguaccuggacuacaugcagcagggccacaaccugcugaucuucgugaagagcuggagccccgacguguucagccugccccugagaaucugcagccugagaagcaaccuguacagaagagacgugaccagcgccaucaaccugagcgccagcagcgcccuggagcugcugagagagaagggcuucagagcccagagaggcagacccagagugaagaagcugcacccccagcaggugcugaacagaugcauccaggaggaggaggacaugagaauccuggccagcgaguucuucaagaaggacaagcugauguacaaggagaagcugaacuucaccgagagcacccacguggaguucaagagauucaccaccaagaaggugauccccagaaucaaggagaugcugccccacuacgugagcgccuucgccaacacccagggcggcuacgugcugaucggcguggacgacaagagcaaggagguggugggcugcaagugggagaaggugaaccccgaccugcugaagaaggagaucgagaacugcaucgagaagcugcccaccuuccacuucugcugcgagaagcccaaggugaacuucaccaccaagauccugaacguguaccagaaggacgugcuggacggcuacgugugcgugauccagguggagcccuucugcugcgugguguucgccgaggcccccgacagcuggaucaugaaggacaacagcgugaccagacugaccgccgagcaguggguggugaugaugcuggacacccagagcgccccccccagccuggugaccgacuacaacagcugccugaucagcagcgccagcagcgccagaaagagccccggcuaccccaucaaggugcacaaguucaaggaggcccugcagagacaccuguuccccgugacccaggaggaggugcaguucaagcccgagagccugugcaagaagcuguucagcgaccacaaggagcuggagggccugaugaagacccugauccaccccugcagccagggcaucgugaucuucagcagaagcugggccggcgacgugggcuucagaaaggagcagaacgugcugugcgacgcccugcugaucgccgugaacagccccguggugcuguacaccauccugaucgaccccaacuggcccggcggccuggaguacgccagaaacaccgcccaccagcugaagcagaagcugcagaccgugggcggcuacaccggcaaggugugcaucauccccagacugauccaccugagcagcacccagagcagacccggcgagaucccccugagauaccccagaagcuacagacuggccgacgaggaggagauggaggaccugcugcaggcccuggugguggugagccugagcagcagaagccugcugagcgaccagaugggcugcgaguucuucaaccugcugaucauggagcagagccagcugcugagcgagagccugcagaagaccagagagcuguucaucuacugcuuccccggcgugagaaagaccgcccuggccaucaagaucauggagaagaucaaggaccuguuccacugcaagcccaaggagauccuguacgugugcgagagcgacagccugaaggacuucgugacccagcagaccaccugccaggccgugaccagaaagaccuucaugcagggcgaguuccugaagaucaagcacaucgugauggacgagaccgagaacuucugcagcaaguacggcaacugguacaugaaggccaagaacaucacccaccccaaggccaagggcaccggcagcgagaaccugcaccacggcauccuguggcuguuccuggaccccuuccagauccaccacgccgacgugaacggccugcccccccccagcgcccaguuccccagaaagaccaucaccagcggcauccacugcgcccuggagaucgccaaggugaugaaggaggagaugaagagaaucaaggagaacccccccagcaacaugagccccgacacccuggcccuguucagcgagaccgccuacgaggaggccaccugcgcccaggcccugcccggcgugugcgagaccaagaccaaccugaccaccgagcagaucgccaacuacguggccagaaagugccacagccuguuccagugcggcuaccugcccaaggacaucgccauccugugcagaagaggcgaggacagaggcagauacagacuggcccugcugaaggccauggagcugaucgagacccacagacccagcgaggugguguucagccccgccaccggcguguggggcagccacaucgugcuggacagcauccagcaguucagcggccuggagagaaccgugguguucggccugagccccgagugcgaccagagcgaggaguuccacaagcugugcuucgccagcagagccaucaagcaccuguaccugcuguacgagaagagagccgccuacuaa

SEQ ID NO: 23695 - RNA, 2676 nt, Artificial Sequence
  SLFN5__Homo_sapiens__NP_659412
augagccugagaaucgacguggacaccaacuuccccgagugcgugguggacgccggcaaggugacccugggcacccagcagagacaggagauggaccccagacugagagagaagcagaacgagaucauccugagagccgugugcgcccugcugaacagcggcggcggcaucaucaaggccgagaucgagaacaagggcuacaacuacgagagacacggcgugggccuggacgugccccccaucuucagaagccaccuggacaagaugcagaaggagaaccacuuccugaucuucgugaagagcuggaacaccgaggccggcgugccccuggccacccugugcagcaaccuguaccacagagagagaaccagcaccgacgugauggacagccaggaggcccuggccuuccugaagugcagaacccagacccccaccaacaucaacgugagcaacagccugggcccccaggccgcccagggcagcgugcaguacgagggcaacaucaacgugagcgccgccgcccuguucgacagaaagagacugcaguaccuggagaagcugaaccugcccgagagcacccacguggaguucgugauguucagcaccgacgugagccacugcgugaaggacagacugcccaagugcgugagcgccuucgccaacaccgagggcggcuacguguucuucggcgugcacgacgagaccugccaggugaucggcugcgagaaggagaagaucgaccugaccagccugagagccagcaucgacggcugcaucaagaagcugcccgugcaccacuucugcacccagagacccgagaucaaguacgugcugaacuuccuggaggugcacgacaagggcgcccugagaggcuacgugugcgccaucaagguggagaaguucugcugcgccguguucgccaaggugcccagcagcuggcaggugaaggacaacagagugagacagcugcccaccagagaguggaccgccuggaugauggaggccgaccccgaccugagcagaugccccgagauggugcugcagcugagccugagcagcgccacccccagaagcaagcccgugugcauccacaagaacagcgagugccugaaggagcagcagaagagauacuuccccguguucagcgacagagugguguacacccccgagagccuguacaaggagcuguucagccagcacaagggccugagagaccugaucaacaccgagaugagacccuucagccagggcauccugaucuucagccagagcugggccguggaccugggccugcaggagaagcagggcgugaucugcgacgcccugcugaucagccagaacaacacccccauccuguacaccaucuucagcaagugggacgccggcugcaagggcuacagcaugaucguggccuacagccugaagcagaagcuggugaacaagggcggcuacaccggcagacugugcaucaccccccuggugugcgugcugaacagcgacagaaaggcccagagcguguacagcagcuaccugcagaucuaccccgagagcuacaacuucaugaccccccagcacauggaggcccugcugcagagccuggugaucgugcugcugggcuucaagagcuuccugagcgaggagcugggcagcgaggugcugaaccugcugaccaacaagcaguacgagcugcugagcaagaaccugagaaagaccagagagcuguucgugcacggccugcccggcagcggcaagaccauccuggcccugagaaucauggagaagaucagaaacguguuccacugcgagcccgccaacauccuguacaucugcgagaaccagccccugaagaagcuggugagcuucagcaagaagaacaucugccagcccgugaccagaaagaccuucaugaagaacaacuucgagcacauccagcacaucaucaucgacgacgcccagaacuucagaaccgaggacggcgacugguacggcaaggccaaguucaucacccagaccgccagagacggccccggcgugcuguggaucuuccuggacuacuuccagaccuaccaccugagcugcagcggccugcccccccccagcgaccaguaccccagagaggagaucaacagaguggugagaaacgccggccccaucgccaacuaccugcagcaggugaugcaggaggccagacagaaccccccccccaaccugccccccggcagccuggugaugcuguacgagcccaagugggcccagggcgugcccggcaaccuggagaucaucgaggaccugaaccuggaggagauccugaucuacguggccaacaagugcagauuccugcugagaaacggcuacagccccaaggacaucgccgugcuguucaccaaggccagcgagguggagaaguacaaggacagacugcugaccgccaugagaaagagaaagcugagccagcugcacgaggagagcgaccugcugcugcagaucggcgacgccagcgacgugcugaccgaccacaucgugcuggacagcgugugcagauucagcggccuggagagaaacaucguguucggcaucaaccccggcguggccccccccgccggcgccuacaaccugcugcugugccuggccagcagagccaagagacaccuguacauccugaaggccagcguguaa

SEQ ID NO: 23696 - RNA, 4605 nt, Artificial Sequence
  SLIT1__Homo_sapiens__NP_003052
auggcccugacccccggcuggggcagcagcgccggccccgugagacccgagcuguggcugcugcugugggccgccgccuggagacugggcgccagcgccugccccgcccugugcaccugcaccggcaccaccguggacugccacggcaccggccugcaggccauccccaagaacauccccagaaacaccgagagacuggagcugaacggcaacaacaucaccagaauccacaagaacgacuucgccggccugaagcagcugagagugcugcagcugauggagaaccagaucggcgccguggagagaggcgccuucgacgacaugaaggagcuggagagacugagacugaacagaaaccagcugcacaugcugcccgagcugcuguuccagaacaaccaggcccugagcagacuggaccugagcgagaacgccauccaggccauccccagaaaggccuucagaggcgccaccgaccugaagaaccugcagcuggacaagaaccagaucagcugcaucgaggagggcgccuucagagcccugagaggccuggaggugcugacccugaacaacaacaacaucaccaccauccccgugagcagcuucaaccacaugcccaagcugagaaccuucagacugcacagcaaccaccuguucugcgacugccaccuggccuggcugagccaguggcugagacagagacccaccaucggccuguucacccagugcagcggccccgccagccugagaggccugaacguggccgaggugcagaagagcgaguucagcugcagcggccagggcgaggccggcagagugcccaccugcacccugagcagcggcagcugccccgccaugugcaccugcagcaacggcaucguggacugcagaggcaagggccugaccgccauccccgccaaccugcccgagaccaugaccgagaucagacuggagcugaacggcaucaagagcaucccccccggcgccuucagccccuacagaaagcugagaagaaucgaccugagcaacaaccagaucgccgagaucgcccccgacgccuuccagggccugagaagccugaacagccuggugcuguacggcaacaagaucaccgaccugcccagaggcguguucggcggccuguacacccugcagcugcugcugcugaacgccaacaagaucaacugcaucagacccgacgccuuccaggaccugcagaaccugagccugcugagccuguacgacaacaagauccagagccuggccaagggcaccuucaccagccugagagccauccagacccugcaccuggcccagaaccccuucaucugcgacugcaaccugaaguggcuggccgacuuccugagaaccaaccccaucgagaccagcggcgccagaugcgccagccccagaagacuggccaacaagagaaucggccagaucaagagcaagaaguucagaugcagcgccaaggagcaguacuucauccccggcaccgaggacuaccagcugaacagcgagugcaacagcgacguggugugcccccacaagugcagaugcgaggccaacgugguggagugcagcagccugaagcugaccaagauccccgagagaaucccccagagcaccgccgagcugagacugaacaacaacgagaucagcauccuggaggccaccggcauguucaagaagcugacccaccugaagaagaucaaccugagcaacaacaaggugagcgagaucgaggacggcgccuucgagggcgccgccagcgugagcgagcugcaccugaccgccaaccagcuggagagcaucagaagcggcauguucagaggccuggacggccugagaacccugaugcugagaaacaacagaaucagcugcauccacaacgacagcuucaccggccugagaaacgugagacugcugagccuguacgacaaccagaucaccaccgugagccccggcgccuucgacacccugcagagccugagcacccugaaccugcuggccaaccccuucaacugcaacugccagcuggccuggcugggcggcuggcugagaaagagaaagaucgugaccggcaaccccagaugccagaaccccgacuuccugagacagaucccccugcaggacguggccuuccccgacuucagaugcgaggagggccaggaggagggcggcugccugcccagaccccagugcccccaggagugcgccugccuggacaccguggugagaugcagcaacaagcaccugagagcccugcccaagggcauccccaagaacgugaccgagcuguaccuggacggcaaccaguucacccuggugcccggccagcugagcaccuucaaguaccugcagcugguggaccugagcaacaacaagaucagcagccugagcaacagcagcuucaccaacaugagccagcugaccacccugauccugagcuacaacgcccugcagugcauccccccccuggccuuccagggccugagaagccugagacugcugagccugcacggcaacgacaucagcacccugcaggagggcaucuucgccgacgugaccagccugagccaccuggccaucggcgccaacccccuguacugcgacugccaccugagauggcugagcagcugggugaagaccggcuacaaggagcccggcaucgccagaugcgccggcccccaggacauggagggcaagcugcugcugaccacccccgccaagaaguucgagugccagggcccccccacccuggccgugcaggccaagugcgaccugugccugagcagccccugccagaaccagggcaccugccacaacgacccccuggagguguacagaugcgccugccccagcggcuacaagggcagagacugcgaggugagccuggacagcugcagcagcggccccugcgagaacggcggcaccugccacgcccaggagggcgaggacgcccccuucaccugcagcugccccaccggcuucgagggccccaccugcggcgugaacaccgacgacugcguggaccacgccugcgccaacggcggcgugugcguggacggcgugggcaacuacaccugccagugcccccugcaguacgagggcaaggccugcgagcagcugguggaccugugcagccccgaccugaaccccugccagcacgaggcccagugcgugggcacccccgacggccccagaugcgagugcaugcccggcuacgccggcgacaacugcagcgagaaccaggacgacugcagagaccacagaugccagaacggcgcccagugcauggacgaggugaacagcuacagcugccugugcgccgagggcuacagcggccagcugugcgagauccccccccaccugcccgcccccaagagccccugcgagggcaccgagugccagaacggcgccaacugcguggaccagggcaacagacccgugugccagugccugcccggcuucggcggccccgagugcgagaagcugcugagcgugaacuucguggacagagacaccuaccugcaguucaccgaccugcagaacuggcccagagccaacaucacccugcaggugagcaccgccgaggacaacggcauccugcuguacaacggcgacaacgaccacaucgccguggagcuguaccagggccacgugagagugagcuacgaccccggcagcuaccccagcagcgccaucuacagcgccgagaccaucaacgacggccaguuccacaccguggagcugguggccuucgaccagauggugaaccugagcaucgacggcggcagccccaugaccauggacaacuucggcaagcacuacacccugaacagcgaggccccccuguacgugggcggcaugcccguggacgugaacagcgccgccuucagacuguggcagauccugaacggcaccggcuuccacggcugcaucagaaaccuguacaucaacaacgagcugcaggacuucaccaagacccagaugaagcccggcguggugcccggcugcgagcccugcagaaagcuguacugccugcacggcaucugccagcccaacgccacccccggccccaugugccacugcgaggccggcugggugggccugcacugcgaccagcccgccgacggccccugccacggccacaagugcgugcacggccagugcgugccccuggacgcccugagcuacagcugccagugccaggacggcuacagcggcgcccugugcaaccaggccggcgcccuggccgagcccugcagaggccugcagugccugcacggccacugccaggccagcggcaccaagggcgcccacugcgugugcgaccccggcuucagcggcgagcugugcgagcaggagagcgagugcagaggcgaccccgugagagacuuccaccaggugcagagaggcuacgccaucugccagaccaccagaccccugagcuggguggagugcagaggcagcugccccggccagggcugcugccagggccugagacugaagagaagaaaguucaccuucgagugcagcgacggcaccagcuucgccgaggagguggagaagcccaccaagugcggcugcgcccugugcgccuaa

SEQ ID NO: 23697 - RNA, 4578 nt, Artificial Sequence
  SLIT2__Homo_sapiens__NP_001276064
augagaggcgugggcuggcagaugcugagccugagccugggccuggugcuggccauccugaacaagguggccccccaggccugccccgcccagugcagcugcagcggcagcaccguggacugccacggccuggcccugagaagcgugcccagaaacauccccagaaacaccgagagacuggaccugaacggcaacaacaucaccagaaucaccaagaccgacuucgccggccugagacaccugagagugcugcagcugauggagaacaagaucagcaccaucgagagaggcgccuuccaggaccugaaggagcuggagagacugagacugaacagaaaccaccugcagcuguuccccgagcugcuguuccugggcaccgccaagcuguacagacuggaccugagcgagaaccagauccaggccauccccagaaaggccuucagaggcgccguggacaucaagaaccugcagcuggacuacaaccagaucagcugcaucgaggacggcgccuucagagcccugagagaccuggaggugcugacccugaacaacaacaacaucaccagacugagcguggccagcuucaaccacaugcccaagcugagaaccuucagacugcacagcaacaaccuguacugcgacugccaccuggccuggcugagcgacuggcugagacagagacccagagugggccuguacacccagugcaugggccccagccaccugagaggccacaacguggccgaggugcagaagagagaguucgugugcagcgacgaggaggagggccaccagagcuucauggcccccagcugcagcgugcugcacugccccgccgccugcaccugcagcaacaacaucguggacugcagaggcaagggccugaccgagauccccaccaaccugcccgagaccaucaccgagaucagacuggagcagaacaccaucaaggugaucccccccggcgccuucagccccuacaagaagcugagaagaaucgaccugagcaacaaccagaucagcgagcuggcccccgacgccuuccagggccugagaagccugaacagccuggugcuguacggcaacaagaucaccgagcugcccaagagccuguucgagggccuguucagccugcagcugcugcugcugaacgccaacaagaucaacugccugagaguggacgccuuccaggaccugcacaaccugaaccugcugagccuguacgacaacaagcugcagaccaucgccaagggcaccuucagcccccugagagccauccagaccaugcaccuggcccagaaccccuucaucugcgacugccaccugaaguggcuggccgacuaccugcacaccaaccccaucgagaccagcggcgccagaugcaccagccccagaagacuggccaacaagagaaucggccagaucaagagcaagaaguucagaugcagcggcaccgaggacuacagaagcaagcugagcggcgacugcuucgccgaccuggccugccccgagaagugcagaugcgagggcaccaccguggacugcagcaaccagaagcugaacaagauccccgagcacaucccccaguacaccgccgagcugagacugaacaacaacgaguucaccgugcuggaggccaccggcaucuucaagaagcugccccagcugagaaagaucaacuucagcaacaacaagaucaccgacaucgaggagggcgccuucgagggcgccagcggcgugaacgagauccugcugaccagcaacagacuggagaacgugcagcacaagauguucaagggccuggagagccugaagacccugaugcugagaagcaacagaaucaccugcgugggcaacgacagcuucaucggccugagcagcgugagacugcugagccuguacgacaaccagaucaccaccguggcccccggcgccuucgacacccugcacagccugagcacccugaaccugcuggccaaccccuucaacugcaacugcuaccuggccuggcugggcgaguggcugagaaagaagagaaucgugaccggcaaccccagaugccagaagcccuacuuccugaaggagauccccauccaggacguggccauccaggacuucaccugcgacgacggcaacgacgacaacagcugcagcccccugagcagaugccccaccgagugcaccugccuggacaccguggugagaugcagcaacaagggccugaaggugcugcccaagggcauccccagagacgugaccgagcuguaccuggacggcaaccaguucacccuggugcccaaggagcugagcaacuacaagcaccugacccugaucgaccugagcaacaacagaaucagcacccugagcaaccagagcuucagcaacaugacccagcugcugacccugauccugagcuacaacagacugagaugcaucccccccagaaccuucgacggccugaagagccugagacugcugagccugcacggcaacgacaucagcguggugcccgagggcgccuucaacgaccugagcgcccugagccaccuggccaucggcgccaacccccuguacugcgacugcaacaugcaguggcugagcgacugggugaagagcgaguacaaggagcccggcaucgccagaugcgccggccccggcgagauggccgacaagcugcugcugaccacccccagcaagaaguucaccugccagggccccguggacgugaacauccuggccaagugcaaccccugccugagcaaccccugcaagaacgacggcaccugcaacagcgaccccguggacuucuacagaugcaccugccccuacggcuucaagggccaggacugcgacgugcccauccacgccugcaucagcaaccccugcaagcacggcggcaccugccaccugaaggagggcgaggaggacggcuucuggugcaucugcgccgacggcuucgagggcgagaacugcgaggugaacguggacgacugcgaggacaacgacugcgagaacaacagcaccugcguggacggcaucaacaacuacaccugccugugcccccccgaguacaccggcgagcugugcgaggagaagcuggacuucugcgcccaggaccugaaccccugccagcacgacagcaagugcauccugacccccaagggcuucaagugcgacugcacccccggcuacgugggcgagcacugcgacaucgacuucgacgacugccaggacaacaagugcaagaacggcgcccacugcaccgacgccgugaacggcuacaccugcaucugccccgagggcuacagcggccuguucugcgaguucagcccccccauggugcugcccagaaccagccccugcgacaacuucgacugccagaacggcgcccagugcaucgugagaaucaacgagcccaucugccagugccugcccggcuaccagggcgagaagugcgagaagcuggugagcgugaacuucaucaacaaggagagcuaccugcagauccccagcgccaaggugagaccccagaccaacaucacccugcagaucgccaccgacgaggacagcggcauccugcuguacaagggcgacaaggaccacaucgccguggagcuguacagaggcagagugagagccagcuacgacaccggcagccaccccgccagcgccaucuacagcguggagaccaucaacgacggcaacuuccacaucguggagcugcuggcccuggaccagagccugagccugagcguggacggcggcaaccccaagaucaucaccaaccugagcaagcagagcacccugaacuucgacagcccccuguacgugggcggcaugcccggcaagagcaacguggccagccugagacaggcccccggccagaacggcaccagcuuccacggcugcaucagaaaccuguacaucaacagcgagcugcaggacuuccagaaggugcccaugcagaccggcauccugcccggcugcgagcccugccacaagaaggugugcgcccacggcaccugccagcccagcagccaggccggcuucaccugcgagugccaggagggcuggaugggcccccugugcgaccagagaaccaacgaccccugccugggcaacaagugcgugcacggcaccugccugcccaucaacgccuucagcuacagcugcaagugccuggagggccacggcggcgugcugugcgacgaggaggaggaccuguucaaccccugccaggccaucaagugcaagcacggcaagugcagacugagcggccugggccagcccuacugcgagugcagcagcggcuacaccggcgacagcugcgacagagagaucagcugcagaggcgagagaaucagagacuacuaccagaagcagcagggcuacgccgccugccagaccaccaagaaggugagcagacuggagugcagaggcggcugcgccggcggccagugcugcggcccccugagaagcaagagaagaaaguacagcuucgagugcaccgacggcagcagcuucguggacgagguggagaagguggugaagugcggcugcaccagaugcgugagcuaa

SEQ ID NO: 23698 - RNA, 4572 nt, Artificial Sequence
  SLIT3__Homo_sapiens__NP_003053
auggcccccggcugggccggcgugggcgccgccgugagagccagacuggcccuggcccuggcccuggccagcgugcugagcggcccccccgccguggccugccccaccaagugcaccugcagcgccgccagcguggacugccacggccugggccugagagccgugcccagaggcauccccagaaacgccgagagacuggaccuggacagaaacaacaucaccagaaucaccaagauggacuucgccggccugaagaaccugagagugcugcaccuggaggacaaccaggugagcgugaucgagagaggcgccuuccaggaccugaagcagcuggagagacugagacugaacaagaacaagcugcaggugcugcccgagcugcuguuccagagcacccccaagcugaccagacuggaccugagcgagaaccagauccagggcauccccagaaaggccuucagaggcaucaccgacgugaagaaccugcagcuggacaacaaccacaucagcugcaucgaggacggcgccuucagagcccugagagaccuggagauccugacccugaacaacaacaacaucagcagaauccuggugaccagcuucaaccacaugcccaagaucagaacccugagacugcacagcaaccaccuguacugcgacugccaccuggccuggcugagcgacuggcugagacagagaagaaccgugggccaguucacccugugcauggcccccgugcaccugagaggcuucaacguggccgacgugcagaagaaggaguacgugugccccgccccccacagcgagccccccagcugcaacgccaacagcaucagcugccccagccccugcaccugcagcaacaacaucguggacugcagaggcaagggccugauggagauccccgccaaccugcccgagggcaucguggagaucagacuggagcagaacagcaucaaggccauccccgccggcgccuucacccaguacaagaagcugaagagaaucgacaucagcaagaaccagaucagcgacaucgcccccgacgccuuccagggccugaagagccugaccagccuggugcuguacggcaacaagaucaccgagaucgccaagggccuguucgacggccuggugagccugcagcugcugcugcugaacgccaacaagaucaacugccugagagugaacaccuuccaggaccugcagaaccugaaccugcugagccuguacgacaacaagcugcagaccaucagcaagggccuguucgccccccugcagagcauccagacccugcaccuggcccagaaccccuucgugugcgacugccaccugaaguggcuggccgacuaccugcaggacaaccccaucgagaccagcggcgccagaugcagcagccccagaagacuggccaacaagagaaucagccagaucaagagcaagaaguucagaugcagcggcagcgaggacuacagaagcagauucagcagcgagugcuucauggaccuggugugccccgagaagugcagaugcgagggcaccaucguggacugcagcaaccagaagcuggugagaauccccagccaccugcccgaguacgugaccgaccugagacugaacgacaacgaggugagcgugcuggaggccaccggcaucuucaagaagcugcccaaccugagaaagaucaaccugagcaacaacaagaucaaggaggugagagagggcgccuucgacggcgccgccagcgugcaggagcugaugcugaccggcaaccagcuggagaccgugcacggcagaguguucagaggccugagcggccugaagacccugaugcugagaagcaaccugaucggcugcgugagcaacgacaccuucgccggccugagcagcgugagacugcugagccuguacgacaacagaaucaccaccaucacccccggcgccuucaccacccuggugagccugagcaccaucaaccugcugagcaaccccuucaacugcaacugccaccuggccuggcugggcaaguggcugagaaagagaagaaucgugagcggcaaccccagaugccagaagcccuucuuccugaaggagauccccauccaggacguggccauccaggacuucaccugcgacggcaacgaggagagcagcugccagcugagccccagaugccccgagcagugcaccugcauggagaccguggugagaugcagcaacaagggccugagagcccugcccagaggcaugcccaaggacgugaccgagcuguaccuggagggcaaccaccugaccgccgugcccagagagcugagcgcccugagacaccugacccugaucgaccugagcaacaacagcaucagcaugcugaccaacuacaccuucagcaacaugagccaccugagcacccugauccugagcuacaacagacugagaugcauccccgugcacgccuucaacggccugagaagccugagagugcugacccugcacggcaacgacaucagcagcgugcccgagggcagcuucaacgaccugaccagccugagccaccuggcccugggcaccaacccccugcacugcgacugcagccugagauggcugagcgagugggugaaggccggcuacaaggagcccggcaucgccagaugcagcagccccgagcccauggccgacagacugcugcugaccacccccacccacagauuccagugcaagggccccguggacaucaacaucguggccaagugcaacgccugccugagcagccccugcaagaacaacggcaccugcacccaggaccccguggagcuguacagaugcgccugccccuacagcuacaagggcaaggacugcaccgugcccaucaacaccugcauccagaaccccugccagcacggcggcaccugccaccugagcgacagccacaaggacggcuucagcugcagcugcccccugggcuucgagggccagagaugcgagaucaaccccgacgacugcgaggacaacgacugcgagaacaacgccaccugcguggacggcaucaacaacuacgugugcaucugcccccccaacuacaccggcgagcugugcgacgaggugaucgaccacugcgugcccgagcugaaccugugccagcacgaggccaagugcaucccccuggacaagggcuucagcugcgagugcgugcccggcuacagcggcaagcugugcgagaccgacaacgacgacugcguggcccacaagugcagacacggcgcccagugcguggacaccaucaacggcuacaccugcaccugcccccagggcuucagcggccccuucugcgagcaccccccccccauggugcugcugcagaccagccccugcgaccaguacgagugccagaacggcgcccagugcaucguggugcagcaggagcccaccugcagaugcccccccggcuucgccggccccagaugcgagaagcugaucaccgugaacuucgugggcaaggacagcuacguggagcuggccagcgccaaggugagaccccaggccaacaucagccugcagguggccaccgacaaggacaacggcauccugcuguacaagggcgacaacgacccccuggcccuggagcuguaccagggccacgugagacugguguacgacagccugagcagcccccccaccaccguguacagcguggagaccgugaacgacggccaguuccacagcguggagcuggugacccugaaccagacccugaaccuggugguggacaagggcacccccaagagccugggcaagcugcagaagcagcccgccgugggcaucaacagcccccuguaccugggcggcauccccaccagcaccggccugagcgcccugagacagggcaccgacagaccccugggcggcuuccacggcugcauccacgaggugagaaucaacaacgagcugcaggacuucaaggcccugcccccccagagccugggcgugagccccggcugcaagagcugcaccgugugcaagcacggccugugcagaagcguggagaaggacagcguggugugcgagugcagacccggcuggaccggcccccugugcgaccaggaggccagagaccccugccugggccacagaugccaccacggcaagugcguggccaccggcaccagcuacaugugcaagugcgccgagggcuacggcggcgaccugugcgacaacaagaacgacagcgccaacgccugcagcgccuucaagugccaccacggccagugccacaucagcgaccagggcgagcccuacugccugugccagcccggcuucagcggcgagcacugccagcaggagaaccccugccugggccagguggugagagaggugaucagaagacagaagggcuacgccagcugcgccaccgccagcaaggugcccaucauggagugcagaggcggcugcggcccccagugcugccagcccaccagaagcaagagaagaaaguacguguuccagugcaccgacggcagcagcuucguggaggagguggagagacaccuggagugcggcugccuggccugcagcuaa

SEQ ID NO: 23699 - RNA, 2091 nt, Artificial Sequence
  SLITRK1__Homo_sapiens__NP_001268432
augcugcuguggauccugcugcuggagaccagccugugcuucgccgccggcaacgugaccggcgacgugugcaaggagaagaucugcagcugcaacgagaucgagggcgaccugcacguggacugcgagaagaagggcuucaccagccugcagagauucaccgcccccaccagccaguucuaccaccuguuccugcacggcaacagccugaccagacuguuccccaacgaguucgccaacuucuacaacgccgugagccugcacauggagaacaacggccugcacgagaucgugcccggcgccuuccugggccugcagcuggugaagagacugcacaucaacaacaacaagaucaagagcuucagaaagcagaccuuccugggccuggacgaccuggaguaccugcaggccgacuucaaccugcugagagacaucgaccccggcgccuuccaggaccugaacaagcuggaggugcugauccugaacgacaaccugaucagcacccugcccgccaacguguuccaguacgugcccaucacccaccuggaccugagaggcaacagacugaagacccugcccuacgaggaggugcuggagcagauccccggcaucgccgagauccugcuggaggacaaccccugggacugcaccugcgaccugcugagccugaaggaguggcuggagaacauccccaagaacgcccugaucggcagaguggugugcgaggcccccaccagacugcagggcaaggaccugaacgagaccaccgagcaggaccugugcccccugaagaacagaguggacagcagccugcccgccccccccgcccaggaggagaccuucgcccccggcccccugcccacccccuucaagaccaacggccaggaggaccacgccacccccggcagcgcccccaacggcggcaccaagauccccggcaacuggcagaucaagaucagacccaccgccgccaucgccaccggcagcagcagaaacaagccccuggccaacagccugcccugccccggcggcugcagcugcgaccacauccccggcagcggccugaagaugaacugcaacaacagaaacgugagcagccuggccgaccugaagcccaagcugagcaacgugcaggagcuguuccugagagacaacaagauccacagcaucagaaagagccacuucguggacuacaagaaccugauccugcuggaccugggcaacaacaacaucgccaccguggagaacaacaccuucaagaaccugcuggaccugagauggcuguacauggacagcaacuaccuggacacccugagcagagagaaguucgccggccugcagaaccuggaguaccugaacguggaguacaacgccauccagcugauccugcccggcaccuucaacgccaugcccaagcugagaauccugauccugaacaacaaccugcugagaagccugcccguggacguguucgccggcgugagccugagcaagcugagccugcacaacaacuacuucauguaccugcccguggccggcgugcuggaccagcugaccagcaucauccagaucgaccugcacggcaaccccugggagugcagcugcaccaucgugcccuucaagcagugggccgagagacugggcagcgaggugcugaugagcgaccugaagugcgagacccccgugaacuucuucagaaaggacuucaugcugcugagcaacgacgagaucugcccccagcuguacgccagaaucagccccacccugaccagccacagcaagaacagcaccggccuggccgagaccggcacccacagcaacagcuaccuggacaccagcagagugagcaucagcgugcuggugcccggccugcugcugguguucgugaccagcgccuucaccguggugggcaugcugguguucauccugagaaacagaaagagaagcaagagaagagacgccaacagcagcgccagcgagaucaacagccugcagaccgugugcgacagcagcuacuggcacaacggccccuacaacgccgacggcgcccacagaguguacgacugcggcagccacagccugagcgacuaa

SEQ ID NO: 23700 - RNA, 2538 nt, Artificial Sequence
  SLITRK2__Homo_sapiens__NP_115928
augcugagcggcgugugguuccugagcgugcugaccguggccggcauccugcagaccgagagcagaaagaccgccaaggacaucugcaagaucagaugccugugcgaggagaaggagaacgugcugaacaucaacugcgagaacaagggcuucaccaccgugagccugcugcagcccccccaguacagaaucuaccagcuguuccugaacggcaaccugcugaccagacuguaccccaacgaguucgugaacuacagcaacgccgugacccugcaccugggcaacaacggccugcaggagaucagaaccggcgccuucagcggccugaagacccugaagagacugcaccugaacaacaacaagcuggagauccugagagaggacaccuuccugggccuggagagccuggaguaccugcaggccgacuacaacuacaucagcgccaucgaggccggcgccuucagcaagcugaacaagcugaaggugcugauccugaacgacaaccugcugcugagccugcccagcaacguguucagauucgugcugcugacccaccuggaccugagaggcaacagacugaaggugaugcccuucgccggcgugcuggagcacaucggcggcaucauggagauccagcuggaggagaaccccuggaacugcaccugcgaccugcugccccugaaggccuggcuggacaccaucaccguguucgugggcgagaucgugugcgagacccccuucagacugcacggcaaggacgugacccagcugaccagacaggaccugugccccagaaagagcgccagcgacagcagccagagaggcagccacgccgacacccacgugcagagacugagccccaccaugaaccccgcccugaaccccaccagagcccccaaggccagcagaccccccaagaugagaaacagacccacccccagagugaccgugagcaaggacagacagagcuucggccccaucaugguguaccagaccaagagccccgugccccugaccugccccagcagcugcgugugcaccagccagagcagcgacaacggccugaacgugaacugccaggagagaaaguucaccaacaucagcgaccugcagcccaagcccaccagccccaagaagcuguaccugaccggcaacuaccugcagaccguguacaagaacgaccugcuggaguacagcagccuggaccugcugcaccugggcaacaacagaaucgccgugauccaggagggcgccuucaccaaccugaccagccugagaagacuguaccugaacggcaacuaccuggaggugcuguaccccagcauguucgacggccugcagagccugcaguaccuguaccuggaguacaacgugaucaaggagaucaagccccugaccuucgacgcccugaucaaccugcagcugcuguuccugaacaacaaccugcugagaagccugcccgacaacaucuucggcggcaccgcccugaccagacugaaccugagaaacaaccacuucagccaccugcccgugaagggcgugcuggaccagcugcccgccuucauccagaucgaccugcaggagaaccccugggacugcaccugcgacaucaugggccugaaggacuggaccgagcacgccaacagccccgugaucaucaacgaggugaccugcgagagccccgccaagcacgccggcgagauccugaaguuccugggcagagaggccaucugccccgacagccccaaccugagcgacggcaccgugcugagcaugaaccacaacaccgacacccccagaagccugagcgugagccccagcagcuaccccgagcugcacaccgaggugccccugagcgugcugauccugggccugcuggugguguucauccugagcgugugcuucggcgccggccuguucguguucgugcugaagagaagaaagggcgugcccagcgugcccagaaacaccaacaaccuggacgugagcagcuuccagcugcaguacggcagcuacaacaccgagacccacgacaagaccgacggccacguguacaacuacauccccccccccgugggccagaugugccagaaccccaucuacaugcagaaggagggcgaccccguggccuacuacagaaaccugcaggaguucagcuacagcaaccuggaggagaagaaggaggagcccgccacccccgccuacaccaucagcgccaccgagcugcuggagaagcaggccacccccagagagcccgagcugcuguaccagaacaucgccgagagagugaaggagcugcccagcgccggccuggugcacuacaacuucugcacccugcccaagagacaguucgcccccagcuacgagagcagaagacagaaccaggacagaaucaacaagaccgugcuguacggcacccccagaaagugcuucgugggccagagcaagcccaaccacccccugcugcaggccaagccccagagcgagcccgacuaccuggaggugcuggagaagcagaccgccaucagccagcuguaa

SEQ ID NO: 23701 - RNA, 2934 nt, Artificial Sequence
  SLITRK3__Homo_sapiens__NP_055741
augaagcccagcaucgccgagaugcugcacagaggcagaaugcuguggaucauccugcugagcaccaucgcccugggcuggaccacccccaucccccugaucgaggacagcgaggagaucgacgagcccugcuucgaccccugcuacugcgaggugaaggagagccuguuccacauccacugcgacagcaagggcuucaccaacaucagccagaucaccgaguucuggagcagacccuucaagcuguaccugcagagaaacagcaugagaaagcuguacaccaacagcuuccugcaccugaacaacgccgugagcaucaaccugggcaacaacgcccugcaggacauccagaccggcgccuucaacggccugaagauccugaagagacuguaccugcacgagaacaagcuggacguguucagaaacgacaccuuccugggccuggagagccuggaguaccugcaggccgacuacaacgugaucaagagaaucgagagcggcgccuucagaaaccugagcaagcugagagugcugauccugaacgacaaccugauccccaugcugcccaccaaccuguucaaggccgugagccugacccaccuggaccugagaggcaacagacugaaggugcuguucuacagaggcaugcuggaccacaucggcagaagccugauggagcugcagcuggaggagaaccccuggaacugcaccugcgagaucgugcagcugaagagcuggcuggagagaauccccuacaccgcccuggugggcgacaucaccugcgagacccccuuccacuuccacggcaaggaccugagagagaucagaaagaccgagcugugcccccugcugagcgacagcgagguggaggccagccugggcaucccccacagcagcagcagcaaggagaacgccuggcccaccaagcccagcagcaugcugagcagcgugcacuucaccgccagcagcguggaguacaagagcagcaacaagcagcccaagcccaccaagcagcccagaacccccagaccccccagcaccagccaggcccuguaccccggccccaaccagccccccaucgcccccuaccagaccagaccccccauccccaucaucugccccaccggcugcaccugcaaccugcacaucaacgaccugggccugaccgugaacugcaaggagagaggcuucaacaacaucagcgagcugcugcccagaccccugaacgccaagaagcuguaccugagcagcaaccugauccagaagaucuacagaagcgacuucuggaacuucagcagccuggaccugcugcaccugggcaacaacagaaucagcuacgugcaggacggcgccuucaucaaccugcccaaccugaagagccuguuccugaacggcaacgacaucgagaagcugacccccggcauguucagaggccugcagagccugcacuaccuguacuucgaguucaacgugaucagagagauccagcccgccgccuucagccugaugcccaaccugaagcugcuguuccugaacaacaaccugcugagaacccugcccaccgacgccuucgccggcaccagccuggccagacugaaccugagaaagaacuacuuccuguaccugcccguggccggcgugcuggagcaccugaacgccaucgugcagaucgaccugaacgagaaccccugggacugcaccugcgaccuggugcccuucaagcaguggaucgagaccaucagcagcgugagcguggugggcgacgugcugugcagaagccccgagaaccugacccacagagacgugagaaccaucgagcuggaggugcugugccccgagaugcugcacguggcccccgccggcgagagccccgcccagcccggcgacagccaccugaucggcgcccccaccagcgccagccccuacgaguucagcccccccggcggccccgugccccugagcgugcugauccugagccugcuggugcuguucuucagcgccguguucguggccgccggccuguucgccuacgugcugagaagaagaagaaagaagcugcccuucagaagcaagagacaggagggcguggaccugaccggcauccagaugcagugccacagacuguucgaggacggcggcggcggcggcggcggcagcggcggcggcggcagacccacccugagcagccccgagaaggccccccccgugggccacguguacgaguacaucccccaccccgugacccagaugugcaacaaccccaucuacaagcccagagaggaggaggagguggccgugagcagcgcccaggaggccggcagcgccgagagaggcggccccggcacccagccccccggcaugggcgaggcccugcugggcagcgagcaguucgccgagacccccaaggagaaccacagcaacuacagaacccugcuggagaaggagaaggagugggcccuggccgugagcagcagccagcugaacaccaucgugaccgugaaccaccaccacccccaccaccccgccgugggcggcgugagcggcguggugggcggcaccggcggcgaccuggccggcuucagacaccacgagaagaacggcggcguggugcuguucccccccggcggcggcugcggcagcggcagcaugcugcuggacagagagagaccccagcccgcccccugcaccgugggcuucguggacugccuguacggcaccgugcccaagcugaaggagcugcacgugcacccccccggcaugcaguaccccgaccugcagcaggacgccagacugaaggagacccugcuguucagcgccggcaagggcuucaccgaccaccagacccagaagagcgacuaccuggagcugagagccaagcugcagaccaagcccgacuaccuggaggugcuggagaagaccaccuacagauucuaa

SEQ ID NO: 23702 - RNA, 2877 nt, Artificial Sequence
  SLITRK5__Homo_sapiens__NP_056382
augcacaccugcugcccccccgugacccuggagcaggaccugcacagaaagaugcacagcuggaugcugcagacccuggccuucgccgugaccagccuggugcugagcugcgccgagaccaucgacuacuacggcgagaucugcgacaacgccugccccugcgaggagaaggacggcauccugaccgugagcugcgagaacagaggcaucaucagccugagcgagaucagcccccccagauuccccaucuaccaccugcugcugagcggcaaccugcugaacagacuguaccccaacgaguucgugaacuacaccggcgccagcauccugcaccugggcagcaacgugauccaggacaucgagaccggcgccuuccacggccugagaggccugagaagacugcaccugaacaacaacaagcuggagcugcugagagacgacaccuuccugggccuggagaaccuggaguaccugcagguggacuacaacuacaucagcgugaucgagcccaacgccuucggcaagcugcaccugcugcaggugcugauccugaacgacaaccugcugagcagccugcccaacaaccuguucagauucgugccccugacccaccuggaccugagaggcaacagacugaagcugcugcccuacgugggccugcugcagcacauggacaaggugguggagcugcagcuggaggagaaccccuggaacugcagcugcgagcugaucagccugaaggacuggcuggacagcaucagcuacagcgcccuggugggcgacguggugugcgagacccccuucagacugcacggcagagaccuggacgaggugagcaagcaggagcugugccccagaagacugaucagcgacuacgagaugagaccccagaccccccugagcaccaccggcuaccugcacaccacccccgccagcgugaacagcguggccaccagcagcagcgccguguacaagcccccccugaagccccccaagggcaccagacagcccaacaagcccagagugagacccaccagcagacagcccagcaaggaccugggcuacagcaacuacggccccagcaucgccuaccagaccaagagccccgugccccuggagugccccaccgccugcagcugcaaccugcagaucagcgaccugggccugaacgugaacugccaggagagaaagaucgagagcaucgccgagcugcagcccaagcccuacaaccccaagaagauguaccugaccgagaacuacaucgccguggugagaagaaccgacuuccuggaggccaccggccuggaccugcugcaccugggcaacaacagaaucagcaugauccaggacagagccuucggcgaccugaccaaccugagaagacuguaccugaacggcaacagaaucgagagacugagccccgagcuguucuacggccugcagagccugcaguaccuguuccugcaguacaaccugaucagagagauccagagcggcaccuucgaccccgugcccaaccugcagcugcuguuccugaacaacaaccugcugcaggccaugcccagcggcguguucagcggccugacccugcugagacugaaccugagaagcaaccacuucaccagccugcccgugagcggcgugcuggaccagcugaagagccugauccagaucgaccugcacgacaaccccugggacugcaccugcgacaucgugggcaugaagcuguggguggagcagcugaaggugggcgugcugguggacgaggugaucugcaaggcccccaagaaguucgccgagaccgacaugagaagcaucaagagcgagcugcugugccccgacuacagcgacgugguggugagcacccccacccccagcagcauccaggugcccgccagaaccagcgccgugacccccgccgugagacugaacagcaccggcgcccccgccagccugggcgccggcggcggcgccagcagcgugccccugagcgugcugauccugagccugcugcugguguucaucaugagcguguucguggccgccggccuguucgugcuggugaugaagagaagaaagaagaaccagagcgaccacaccagcaccaacaacagcgacgugagcagcuucaacaugcaguacagcguguacggcggcggcggcggcaccggcggccacccccacgcccacgugcaccacagaggccccgcccugcccaaggugaagacccccgccggccacguguacgaguacaucccccacccccugggccacaugugcaagaaccccaucuacagaagcagagagggcaacagcguggaggacuacaaggaccugcacgagcugaaggugaccuacagcagcaaccaccaccugcagcagcagcagcagccccccccccccccccagcagccccagcagcagccccccccccagcugcagcugcagcccggcgaggaggagagaagagagagccaccaccugagaagccccgccuacagcgugagcaccaucgagcccagagaggaccugcugagccccgugcaggacgccgacagauucuacagaggcauccuggagcccgacaagcacugcagcaccacccccgccggcaacagccugcccgaguaccccaaguuccccugcagccccgccgccuacaccuucagccccaacuacgaccugagaagaccccaccaguaccugcaccccggcgccggcgacagcagacugagagagcccgugcuguacagcccccccagcgccguguucguggagcccaacagaaacgaguaccuggagcugaaggccaagcugaacguggagcccgacuaccuggaggugcuggagaagcagaccaccuucagccaguucuaa

SEQ ID NO: 23703 - RNA, 2526 nt, Artificial Sequence
  SLITRK6__Homo_sapiens__NP_115605
augaagcuguggauccaccuguucuacagcagccugcuggccugcaucagccugcacagccagacccccgugcugagcagcagaggcagcugcgacagccugugcaacugcgaggagaaggacggcaccaugcugaucaacugcgaggccaagggcaucaagauggugagcgagaucagcgugccccccagcagacccuuccagcugagccugcugaacaacggccugaccaugcugcacaccaacgacuucagcggccugaccaacgccaucagcauccaccugggcuucaacaacaucgccgacaucgagaucggcgccuucaacggccugggccugcugaagcagcugcacaucaaccacaacagccuggagauccugaaggaggacaccuuccacggccuggagaaccuggaguuccugcaggccgacaacaacuucaucaccgugaucgagcccagcgccuucagcaagcugaacagacugaaggugcugauccugaacgacaacgccaucgagagccugccccccaacaucuucagauucgugccccugacccaccuggaccugagaggcaaccagcugcagacccugcccuacgugggcuuccuggagcacaucggcagaauccuggaccugcagcuggaggacaacaagugggccugcaacugcgaccugcugcagcugaagaccuggcuggagaacaugcccccccagagcaucaucggcgacguggugugcaacagcccccccuucuucaagggcagcauccugagcagacugaagaaggagagcaucugccccaccccccccguguacgaggagcacgaggaccccagcggcagccugcaccuggccgccaccagcagcaucaacgacagcagaaugagcaccaagaccaccagcauccugaagcugcccaccaaggcccccggccugauccccuacaucaccaagcccagcacccagcugcccggccccuacugccccauccccugcaacugcaaggugcugagccccagcggccugcugauccacugccaggagagaaacaucgagagccugagcgaccugagaccccccccccagaaccccagaaagcugauccuggccggcaacaucauccacagccugaugaagagcgaccugguggaguacuucacccuggagaugcugcaccugggcaacaacagaaucgaggugcuggaggagggcagcuucaugaaccugaccagacugcagaagcuguaccugaacggcaaccaccugaccaagcugagcaagggcauguuccugggccugcacaaccuggaguaccuguaccuggaguacaacgccaucaaggagauccugcccggcaccuucaaccccaugcccaagcugaaggugcuguaccugaacaacaaccugcugcaggugcugcccccccacaucuucagcggcgugccccugaccaaggugaaccugaagaccaaccaguucacccaccugcccgugagcaacauccuggacgaccuggaccugcugacccagaucgaccuggaggacaaccccugggacugcagcugcgaccuggugggccugcagcaguggauccagaagcugagcaagaacaccgugaccgacgacauccugugcaccagccccggccaccuggacaagaaggagcugaaggcccugaacagcgagauccugugccccggccuggugaacaaccccagcaugcccacccagaccagcuaccugauggugaccacccccgccaccaccaccaacaccgccgacaccauccugagaagccugaccgacgccgugccccugagcgugcugauccugggccugcugaucauguucaucaccaucguguucugcgccgccggcaucguggugcuggugcugcacagaagaagaagauacaagaagaagcagguggacgagcagaugagagacaacagccccgugcaccugcaguacagcauguacggccacaagaccacccaccacaccaccgagagacccagcgccagccuguacgagcagcacauggugagccccauggugcacguguacagaagccccagcuucggccccaagcaccuggaggaggaggaggagagaaacgagaaggagggcagcgacgccaagcaccugcagagaagccugcuggagcaggagaaccacagcccccugaccggcagcaacaugaaguacaagaccaccaaccagagcaccgaguuccugagcuuccaggacgccagcagccuguacagaaacauccuggagaaggagagagagcugcagcagcugggcaucaccgaguaccugagaaagaacaucgcccagcugcagcccgacauggaggcccacuaccccggcgcccacgaggagcugaagcugauggagacccugauguacagcagacccagaaaggugcugguggagcagaccaagaacgaguacuucgagcugaaggccaaccugcacgccgagcccgacuaccuggaggugcuggagcagcagaccuaa

SEQ ID NO: 23704 - RNA, 3615 nt, Artificial Sequence
  SLK__Homo_sapiens__NP_001291672
augagcuucuucaacuucagaaagaucuucaagcugggcagcgagaagaagaagaagcaguacgagcacgugaagagagaccugaaccccgaggacuucugggagaucaucggcgagcugggcgacggcgccuucggcaagguguacaaggcccagaacaaggagaccagcgugcuggccgccgccaaggugaucgacaccaagagcgaggaggagcuggaggacuacaugguggagaucgacauccuggccagcugcgaccaccccaacaucgugaagcugcuggacgccuucuacuacgagaacaaccuguggauccugaucgaguucugcgccggcggcgccguggacgccgugaugcuggagcuggagagaccccugaccgagagccagauccagguggugugcaagcagacccuggacgcccugaacuaccugcacgacaacaagaucauccacagagaccugaaggccggcaacauccuguucacccuggacggcgacaucaagcuggccgacuucggcgugagcgccaagaacaccagaaccauccagagaagagacagcuucaucggcacccccuacuggauggcccccgagguggugaugugcgagaccagcaaggacagacccuacgacuacaaggccgacguguggagccugggcaucacccugaucgagauggccgagaucgagcccccccaccacgagcugaaccccaugagagugcugcugaagaucgccaagagcgagccccccacccuggcccagcccagcagauggagcagcaacuucaaggacuuccugaagaagugccuggagaagaacguggacgccagauggaccaccagccagcugcugcagcaccccuucgugaccguggacagcaacaagcccaucagagagcugaucgccgaggccaaggccgaggugaccgaggagguggaggacggcaaggaggaggacgaggaggaggagaccgagaacagccugcccauccccgccagcaagagagccagcagcgaccugagcaucgccagcagcgaggaggacaagcugagccagaacgccugcauccuggagagcgugagcgagaagaccgagagaagcaacagcgaggacaagcugaacagcaagauccugaacgagaagcccaccaccgacgagcccgagaaggccguggaggacaucaacgagcacaucaccgacgcccagcuggaggccaugaccgagcugcacgacagaaccgccgugaucaaggagaacgagagagagaagagacccaagcuggagaaccugcccgacaccgaggaccaggagaccguggacaucaacagcgugagcgagggcaaggagaacaacaucaugaucacccuggagaccaacaucgagcacaaccugaagagcgaggaggagaaggaccaggagaagcagcagauguucgagaacaagcugaucaagagcgaggagaucaaggacaccauccugcagaccguggaccuggugagccaggagaccggcgagaaggaggccaacauccaggccguggacagcgaggugggccugaccaaggaggacacccaggagaagcugggcgaggacgacaagacccagaaggacgugaucagcaacaccagcgacgugaucggcaccugcgaggccgccgacguggcccagaagguggacgaggacagcgccgaggacacccagagcaacgacggcaaggaggugguggaggugggccagaagcugaucaacaagcccauggugggccccgaggccggcggcaccaaggaggugcccaucaaggagaucguggagaugaacgagaucgaggagggcaagaacaaggagcaggccaucaacagcagcgagaacaucauggacaucaacgaggagcccggcaccaccgagggcgaggagaucaccgagagcagcagcaccgaggagauggaggugagaagcgugguggccgacaccgaccagaaggcccugggcagcgaggugcaggacgccagcaaggugaccacccagaucgacaaggagaagaaggagauccccgugagcaucaagaaggagcccgaggugaccguggugagccagcccaccgagccccagcccgugcugauccccagcaucaacaucaacagcgacagcggcgagaacaaggaggagaucggcagccugagcaagaccgagaccauccugccccccgagagcgagaaccccaaggagaacgacaacgacagcggcaccggcagcaccgccgacaccagcagcaucgaccugaaccugagcaucagcagcuuccugagcaagaccaaggacagcggcagcaucagccugcaggagaccagaagacagaagaagacccugaagaagaccagaaaguucaucguggacggcguggaggugagcgugaccaccagcaagaucgugaccgacagcgacagcaagaccgaggagcugagauuccugagaagacaggagcugagagagcugagauuccugcagaaggaggagcagagagcccagcagcagcugaacagcaagcugcagcagcagagagagcagaucuucagaagauucgagcaggagaugaugagcaagaagagacaguacgaccaggagaucgagaaccuggagaagcagcagaagcagaccaucgagagacuggagcaggagcacaccaacagacugagagacgaggccaagagaaucaagggcgagcaggagaaggagcugagcaaguuccagaacaugcugaagaacagaaagaaggaggagcaggaguucgugcagaagcagcagcaggagcuggacggcagccugaagaagaucauccagcagcagaaggccgagcuggccaacaucgagagagagugccugaacaacaagcagcagcugaugagagccagagaggccgccaucugggagcuggaggagagacaccugcaggagaagcaccagcugcugaagcagcagcugaaggaccaguacuucaugcagagacaccagcugcugaagagacacgagaaggagaccgagcagaugcagagauacaaccagagacugaucgaggagcugaagaacagacagacccaggagagagccagacugcccaagauccagagaagcgaggccaagaccagaauggccauguucaagaagagccugagaaucaacagcaccgccacccccgaccaggacagagacaagaucaagcaguucgccgcccaggaggagaagagacagaagaacgagagaauggcccagcaccagaagcacgagaaccagaugagagaccugcagcugcagugcgaggccaacgugagagagcugcaccagcugcagaacgagaagugccaccugcugguggagcacgagacccagaagcugaaggagcuggacgaggagcacagccaggagcugaaggaguggagagagaagcugagacccagaaagaagacccuggaggaggaguucgccagaaagcugcaggagcaggagguguucuucaagaugaccggcgagagcgagugccugaaccccagcacccagagcagaaucagcaaguucuaccccauccccagccugcacagcaccggcagcuaa

SEQ ID NO: 23705 - RNA, 2487 nt, Artificial Sequence
  SLMAP__Homo_sapiens__NP_001291349
augcccagcgcccuggccaucuucaccugcagacccaacagccaccccuuccaggagagacacguguaccuggacgagcccaucaagaucggcagaagcguggccagaugcagacccgcccagaacaacgccaccuucgacugcaaggugcugagcagaaaccacgcccuggugugguucgaccacaagaccggcaaguucuaccugcaggacaccaagagcagcaacggcaccuucaucaacagccagagacugagcagaggcagcgaggagagcccccccugcgagauccugagcggcgacaucauccaguucggcguggacgugaccgagaacaccagaaaggugacccacggcugcaucgugagcaccaucaagcuguuccugcccgacggcauggaggccagacugagaagcgacgugauccacgccccccugcccagccccguggacaagguggccgccaacacccccagcauguacagccaggagcuguuccagcugagccaguaccugcaggaggcccugcacagagagcagaugcuggagcagaagcuggccacccugcagagacugcuggccaucacccaggaggccagcgacaccagcuggcaggcccugaucgacgaggacagacugcugagcagacuggaggugaugggcaaccagcugcaggccugcagcaagaaccagaccgaggacagccugagaaaggagcugaucgcccugcaggaggacaagcacaacuacgagaccaccgccaaggagagccugagaagagugcugcaggagaagaucgagguggugagaaagcugagcgagguggagagaagccugagcaacaccgaggacgagugcacccaccugaaggagaugaacgagagaacccaggaggagcugagagagcuggccaacaaguacaacggcgccgugaacgagaucaaggaccugagcgacaagcugaagguggccgagggcaagcaggaggagauccagcagaagggccaggccgagaagaaggagcugcagcacaagaucgacgagauggaggagaaggagcaggagcugcaggccaagaucgaggcccugcaggccgacaacgacuucaccaacgagagacugaccgcccugcaggugagacuggagcaccugcaggagaagacccugaaggagugcagcagccuggagcaccugcugagcaagagcggcggcgacugcaccuucauccaccaguucaucgagugccagaagaagcugaucguggagggccaccugaccaaggccguggaggagaccaagcugagcaaggagaaccagaccagagccaaggagagcgacuucagcgacacccugagccccagcaaggagaagagcagcgacgacaccaccgacgcccagauggacgagcaggaccugaacgagccccuggccaaggugagccugcugaaggacgaccugcagggcgcccagagcgagaucgaggccaagcaggagauccagcaccugagaaaggagcugaucgaggcccaggagcuggccagaaccagcaagcagaagugcuucgagcugcaggcccugcuggaggaggagagaaaggccuacagaaaccagguggaggagagcaccaagcagauccaggugcugcaggcccagcugcagagacugcacaucgacaccgagaaccugagagaggagaaggacagcgagaucaccagcaccagagacgagcugcugagcgccagagacgagauccugcugcugcaccaggccgccgccaagguggccagcgagagagacaccgacaucgccagccugcaggaggagcugaagaaggugagagccgagcuggagagauggagaaaggccgccagcgaguacgagaaggagaucaccagccugcagaacagcuuccagcugagaugccagcagugcgaggaccagcagagagaggaggccaccagacugcagggcgagcuggagaagcugagaaaggaguggaacgcccuggagaccgagugccacagccugaagagagagaacgugcugcugagcagcgagcugcagagacaggagaaggagcugcacaacagccagaagcagagccuggagcugaccagcgaccugagcauccugcagaugagcagaaaggagcuggagaaccaggugggcagccugaaggagcagcaccugagagacagcgccgaccugaagacccugcugagcaaggccgagaaccaggccaaggacgugcagaaggaguacgagaagacccagaccgugcugagcgagcugaagcugaaguucgagaugaccgagcaggagaagcagagcaucaccgacgagcugaagcagugcaagaacaaccugaagcugcugagagagaagggcaacaacaagcccuggcccuggaugcccaugcuggccgcccugguggccgugaccgccaucgugcuguacgugcccggccuggccagagccagccccuaa

SEQ ID NO: 23706 - RNA, 585 nt, Artificial Sequence
  SLMO2__Homo_sapiens__NP_057129
augaagaucuggaccagcgagcacguguucgaccaccccugggagaccgugaccaccgccgccaugcagaaguaccccaaccccaugaaccccagcguggugggcguggacgugcuggacagacacaucgaccccagcggcaagcugcacagccacagacugcugagcaccgaguggggccugcccagcaucgugaagagccugaucggcgccgccagaaccaagaccuacgugcaggagcacagcgugguggaccccguggagaagaccauggagcugaagagcaccaacaucagcuucaccaacauggugagcguggacgagagacugaucuacaagccccacccccaggaccccgagaagaccgugcugacccaggaggccaucaucaccgugaagggcgugagccugagcagcuaccuggagggccugauggccagcaccaucagcagcaacgccagcaagggcagagaggccauggagugggugauccacaagcugaacgccgagaucgaggagcugaccgccagcgccagaggcaccaucagaacccccauggccgccgccgccuucgccgagaaguaa

SEQ ID NO: 23707 - RNA, 96 nt, Artificial Sequence
  SLN__Homo_sapiens__NP_003054
augggcaucaacaccagagagcuguuccugaacuucaccaucgugcugaucaccgugauccugauguggcugcuggugagaagcuaccaguacuaa

SEQ ID NO: 23708 - RNA, 399 nt, Artificial Sequence
  SLPI__Homo_sapiens__NP_003055
augaagagcagcggccuguuccccuuccuggugcugcuggcccugggcacccuggcccccugggccguggagggcagcggcaagagcuucaaggccggcgugugcccccccaagaagagcgcccagugccugagauacaagaagcccgagugccagagcgacuggcagugccccggcaagaagagaugcugccccgacaccugcggcaucaagugccuggaccccguggacacccccaaccccaccagaagaaagcccggcaagugccccgugaccuacggccagugccugaugcugaacccccccaacuucugcgagauggacggccagugcaagagagaccugaagugcugcaugggcaugugcggcaagagcugcgugagccccgugaaggccuaa

SEQ ID NO: 23709 - RNA, 3051 nt, Artificial Sequence
  SLTM__Homo_sapiens__NP_001013865
auggccgccgccaccggcgccguggccgccagcgccgccagcggccaggccgagggcaagaagaucaccgaccugagagugaucgaccugaagagcgagcugaagagaagaaaccuggacaucaccggcgugaagaccgugcugaucagcagacugaagcaggccaucgaggaggagggcggcgaccccgacaacaucgagcugaccgugagcaccgacacccccaacaagaagcccaccaagggcaagggcaagaagcacgaggccgacgagcugagcggcgacgccagcguggaggacgacgccuucaucaaggacugcgagcuggagaaccaggaggcccacgagcaggacggcaacgacgagcugaaggacagcgaggaguucggcgagaacgaggaggagaacgugcacagcaaggagcugcugagcgccgaggagaacaagagagcccacgagcugaucgaggccgagggcaucgaggacaucgagaaggaggacaucgagagccaggagaucgaggcccaggagggcgaggacgacaccuuccugaccgcccaggacggcgaggaggaggagaacgagaaggagggcagccuggccgaggccgaccacaccgcccacgaggagauggaggcccacaccaccgugaaggaggccgaggacgacaacaucagcgugaccauccaggccgaggacgccaucacccuggacuucgacggcgacgaccugcuggagaccggcaagaacgugaagaucaccgacagcgaggccagcaagcccaaggacggccaggacgccaucgcccagagccccgagaaggagagcaaggacuacgagaugaacgccaaccacaaggacggcaagaaggaggacugcgugaagggcgaccccguggagaaggaggccagagagagcagcaagaaggccgagagcggcgacaaggagaaggacacccugaagaagggccccagcagcaccggcgccagcggccaggccaagagcagcagcaaggagagcaaggacagcaagaccagcagcaaggacgacaagggcagcaccagcagcaccagcggcagcagcggcagcagcaccaagaacaucugggugagcggccugagcagcaacaccaaggccgccgaccugaagaaccuguucggcaaguacggcaaggugcugagcgccaagguggugaccaacgccagaagccccggcgccaagugcuacggcaucgugaccaugagcagcagcaccgaggugagcagaugcaucgcccaccugcacagaaccgagcugcacggccagcugaucagcguggagaaggugaagggcgaccccagcaagaaggagaugaagaaggagaacgacgagaagagcagcagcagaagcagcggcgacaagaagaacaccagcgacagaagcagcaagacccaggccagcgugaagaaggaggagaagagaagcagcgagaagagcgagaagaaggagagcaaggacaccaagaagaucgagggcaaggacgagaagaacgacaacggcgccagcggccagaccagcgagagcaucaagaagagcgaggagaagaagagaaucagcagcaagagccccggccacauggugauccuggaccagaccaagggcgaccacugcagacccagcagaagaggcagauacgagaagauccacggcagaagcaaggagaaggagagagccagccuggacaagaagagagacaaggacuacagaagaaaggagauccugcccuucgagaagaugaaggagcagagacugagagagcaccuggugagauucgagagacugagaagagccauggagcugagaagaagaagagagaucgccgagagagagagaagagagagagagagaaucagaaucaucagagagagagaggagagagagagacugcagagagagagagagagacuggagaucgagagacagaagcuggagagagagagaauggagagagagagacuggagagagagagaaucagaaucgagcaggagagaagaaaggaggccgagagaaucgccagagagagagaggagcugagaagacagcagcagcagcugagauacgagcaggagaagagaaacagccugaagagacccagagacguggaccacagaagagacgaccccuacuggagcgagaacaagaagcugagccuggacaccgacgccagauucggccacggcagcgacuacagcagacagcagaacagauucaacgacuucgaccacagagagagaggcagauuccccgagagcagcgccgugcagagcagcagcuucgagagaagagacagauucgugggccagagcgagggcaagaaggccagacccaccgccagaagagaggaccccagcuucgagagauaccccaagaacuucagcgacagcagaagaaacgagccccccccccccagaaacgagcugagagagagcgacagaagagaggugagaggcgagagagacgagagaagaaccgugaucauccacgacagacccgacaucacccaccccagacaccccagagaggccggccccaaccccagcagacccaccagcuggaagagcgagggcagcaugagcaccgacaagagagagaccagaguggagagacccgagagaagcggcagagaggugagcggccacagcgugagaggcgccccccccggcaacagaagcagcgccagcggcuacggcagcagagagggcgacagaggcgugaucaccgacagaggcggcggcagccagcacuaccccgaggagagacacgugguggagagacacggcagagacaccagcggccccagaaaggaguggcacggcccccccagccagggccccagcuaccacgacaccagaagaaugggcgacggcagagccggcgccggcaugaucacccagcacagcagcaacgccagccccaucaacagaaucgugcagaucagcggcaacagcaugcccagaggcagcggcagcggcuucaagcccuucaagggcggcccccccagaagauucuaa

SEQ ID NO: 23710 - RNA, 1761 nt, Artificial Sequence
  SLU7__Homo_sapiens__NP_006416
augagcgccaccgugguggacgccgugaacgccgccccccugagcggcagcaaggagaugagccuggaggagcccaagaagaugaccagagaggacuggagaaagaagaaggagcuggaggagcagagaaagcugggcaacgcccccgccgagguggacgaggagggcaaggacaucaacccccacaucccccaguacaucagcagcgugcccugguacaucgaccccagcaagagacccacccugaagcaccagagaccccagcccgagaagcagaagcaguucagcagcagcggcgagugguacaagagaggcgugaaggagaacagcaucaucaccaaguacagaaagggcgccugcgagaacugcggcgccaugacccacaagaagaaggacugcuucgagagacccagaagagugggcgccaaguucaccggcaccaacaucgcccccgacgagcacgugcagccccagcugauguucgacuacgacggcaagagagacagauggaacggcuacaaccccgaggagcacaugaagaucguggaggaguacgccaagguggaccuggccaagagaacccugaaggcccagaagcugcaggaggagcuggccagcggcaagcugguggagcaggccaacagccccaagcaccaguggggcgaggaggagcccaacagccagauggagaaggaccacaacagcgaggacgaggacgaggacaaguacgccgacgacaucgacaugcccggccagaacuucgacagcaagagaagaaucaccgugagaaaccugagaaucagagaggacaucgccaaguaccugagaaaccuggaccccaacagcgccuacuacgaccccaagaccagagccaugagagagaaccccuacgccaacgccggcaagaaccccgacgaggugagcuacgccggcgacaacuucgugagauacaccggcgacaccaucagcauggcccagacccagcuguucgccugggaggccuacgacaagggcagcgaggugcaccugcaggccgaccccaccaagcuggagcugcuguacaagagcuucaaggugaagaaggaggacuucaaggagcagcagaaggagagcauccuggagaaguacggcggccaggagcaccuggacgccccccccgccgagcugcugcuggcccagaccgaggacuacguggaguacagcagacacggcaccgugaucaagggccaggagagagccguggccugcagcaaguacgaggaggacgugaagauccacaaccacacccacaucuggggcagcuacuggaaggagggcagauggggcuacaagugcugccacagcuucuucaaguacagcuacugcaccggcgaggccggcaaggagaucgugaacagcgaggagugcaucaucaacgagaucaccggcgaggagagcgugaagaagccccagacccugauggagcugcaccaggagaagcugaaggaggagaagaagaagaagaagaagaagaagaagaagcacagaaagagcagcagcgacagcgacgacgaggagaagaagcacgagaagcugaagaaggcccugaacgccgaggaggccagacugcugcacgugaaggagaccaugcagaucgacgagagaaagagacccuacaacagcauguacgagaccagagagcccaccgaggaggagauggaggccuacagaaugaagagacagagacccgacgaccccauggccagcuuccugggccaguaa

SEQ ID NO: 23711 - RNA, 312 nt, Artificial Sequence
  SLURP1__Homo_sapiens__NP_065160
auggccagcagaugggccgugcagcugcugcugguggccgccuggagcaugggcugcggcgaggcccugaagugcuacaccugcaaggagcccaugaccagcgccagcugcagaaccaucaccagaugcaagcccgaggacaccgccugcaugaccacccuggugaccguggaggccgaguaccccuucaaccagagccccguggugaccagaagcugcagcagcagcugcguggccaccgaccccgacagcaucggcgccgcccaccugaucuucugcugcuucagagaccugugcaacagcgagcuguaa

SEQ ID NO: 23712 - RNA, 5505 nt, Artificial Sequence
  SLX4__Homo_sapiens__NP_115820
augaagcugagcgugaacgaggcccagcugggcuucuaccugggcagccugagccaccugagcgccugccccggcaucgaccccagaagcagcgaggaccagcccgagagccugaagaccggccagaugauggacgagagcgacgaggacuucaaggagcugugcgccagcuucuuccagagagugaagaagcacggcaucaaggaggugagcggcgagagaaagacccagaaggccgccagcaacggcacccagaucagaagcaagcugaagagaaccaagcagaccgccaccaagaccaagacccugcagggccccgccgagaagaagccccccagcggcagccaggcccccagaaccaagaagcagagagugaccaaguggcaggccagcgagcccgcccacagcgugaacggcgagggcggcgugcuggccagcgcccccgacccccccgugcugagagagaccgcccagaacacccagaccggcaaccagcaggagcccagccccaaccugagcagagagaagaccagagagaacgugcccaacagcgacagccagcccccccccagcugccugaccaccgccgugcccagccccagcaagcccagaaccgcccagcuggugcugcagagaaugcagcaguucaagagagccgaccccgagagacugagacacgccagcgaggagugcagccuggaggccgccagagaggagaacgugcccaaggacccccaggaggagaugauggccggcaacguguacggccugggcccccccgcccccgagagcgacgccgccguggcccugacccugcagcaggaguucgccagagugggcgccagcgcccacgacgacagccuggaggagaagggccuguucuucugccagaucugccagaagaaccugagcgccaugaacgugaccagaagagagcagcacgugaacagaugccuggacgaggccgagaagacccugagacccagcgugccccagauccccgagugccccaucugcggcaagcccuuccugacccugaagagcagaaccagccaccugaagcagugcgccgugaagauggaggugggcccccagcugcugcugcaggccgugagacugcagaccgcccagcccgagggcagcagcagcccccccauguucagcuucagcgaccacagcagaggccugaagagaagaggccccaccagcaagaaggagcccagaaagagaagaaagguggacgaggcccccagcgaggaccugcugguggccauggcccugagcagaagcgagauggagcccggcgccgccgugcccgcccugagacuggagagcgccuucagcgagagaaucagacccgaggccgagaacaagagcagaaagaagaagccccccgugagccccccccugcugcuggugcaggacagcgagaccaccggcagacagaucgaggacagaguggcccugcugcugagcgaggagguggagcugagcagcacccccccccugcccgccagcagaauccugaaggagggcugggagagagccggccagugcccccccccccccgagagaaagcagagcuuccugugggagggcagcgcccugaccggcgccugggccauggaggacuucuacaccgccagacuggugcccccccuggugccccagagacccgcccagggccugaugcaggagcccgugcccccccuggugccccccgagcacagcgagcugagcgagagaagaagccccgcccugcacggcacccccaccgccggcugcggcagcagaggccccagccccagcgccagccagagagagcaccaggcccugcaggaccugguggaccuggccagagagggccugagcgccagccccuggcccggcagcggcggccuggccggcagcgagggcaccgccggccuggacguggugcccggcggccugccccugaccggcuucguggugcccagccaggacaagcaccccgacagaggcggcagaacccugcugagccugggccugcugguggccgacuucggcgccauggugaacaacccccaccugagcgacgugcaguuccagaccgacagcggcgaggugcuguacgcccacaaguucgugcuguacgccagaugcccccugcugauccaguacgugaacaacgagggcuucagcgccguggaggacggcgugcugacccagagagugcugcugggcgacgugagcaccgaggccgccagaaccuuccugcacuaccuguacaccgccgacaccggccugccccccggccugagcagcgagcugagcagccuggcccacagauucggcgugagcgagcuggugcaccugugcgagcaggugcccaucgccaccgacagcgagggcaagcccugggaggagaaggaggccgagaacugcgagagcagagccgagaacuuccaggagcugcugagaagcaugugggccgacgaggaggaggaggccgagacccugcugaagagcaaggaccacgaggaggaccaggagaacgugaacgaggccgagauggaggagaucuacgaguucgccgccacccagagaaagcugcugcaggaggagagagccgccggcgccggcgaggacgccgacuggcuggagggcggcagccccgugagcggccagcugcuggccggcgugcaggugcagaagcagugggacaagguggaggagauggagccccuggagcccggcagagacgaggccgccaccaccugggagaagaugggccagugcgcccugccccccccccagggccagcacagcggcgccagaggcgccgaggcccccgagcaggaggcccccgaggaggcccugggccacagcagcugcagcagccccagcagagacugccaggccgagagaaaggagggcagccugccccacagcgacgacgccggcgacuacgagcagcuguucagcagcacccagggcgagaucagcgagcccagccagaucaccagcgagcccgaggagcagagcggcgccgugagagagagaggccuggaggugagccacagacuggcccccuggcaggccagccccccccaccccugcagauuccugcugggccccccccagggcggcagccccagaggcagccaccacaccagcggcagcagccugagcacccccagaagcagaggcggcaccagccaggugggcagccccacccugcugagccccgccgugcccagcaagcagaagagagacagaagcauccugacccugagcaaggagcccggccaccagaagggcaaggagagaagaagcgugcuggagugcagaaacaagggcgugcugauguuccccgagaagagccccagcaucgaccugacccagagcaaccccgaccacagcagcagcagaagccagaagagcagcagcaagcugaacgaggaggacgaggugauccugcugcuggacagcgacgaggagcuggagcuggagcagaccaagaugaagagcaucagcagcgacccccuggaggagaagaaggcccuggagaucagccccagaagcugcgagcuguucagcaucaucgacguggacgccgaccaggagcccagccagagcccccccagaagcgaggccgugcugcagcaggaggacgagggcgcccugcccgagaacagaggcagccugggcagaagaggcgcccccuggcuguucugcgacagagagagcagccccagcgaggccagcaccaccgacaccagcuggcuggugcccgccaccccccuggccagcagaagcagagacugcagcagccagacccagaucagcagccugagaagcggccuggccgugcaggccgugacccagcacacccccagagccagcgugggcaacagagagggcaacgagguggcccagaaguucagcgugaucagaccccagaccccccccccccagacccccagcagcugccugacccccgugagccccggcaccagcgacggcagaagacagggccacagaagccccagcagaccccaccccggcggccacccccacagcagcccccuggccccccaccccaucagcggcgacagagcccacuucagcagaagauuccugaagcacagcccccccggccccagcuuccugaaccagacccccgccggcgaggugguggaggugggcgacagcgacgacgagcaggagguggccagccaccaggccaacagaagccccccccuggacagcgacccccccauccccaucgacgacugcugcuggcacauggagccccugagccccauccccaucgaccacuggaaccuggagagaaccggcccccugagcaccagcagccccagcagaagaaugaacgaggccgccgacagcagagacugcagaagccccggccugcuggacaccacccccaucagaggcagcugcaccacccagagaaagcugcaggagaagagcagcggcgccggcagccugggcaacagcagacccagcuuccugaacagcgcccugugggacgugugggacggcgaggagcagagaccccccgagacccccccccccgcccagaugcccagcgccggcggcgcccagaagcccgagggccuggagacccccaagggcgccaacagaaagaagaaccugccccccaaggugcccaucacccccaugccccaguacagcaucauggagacccccgugcugaagaaggagcuggacagauucggcgugagaccccugcccaagagacagauggugcugaagcugaaggagaucuuccaguacacccaccagacccuggacagcgacagcgaggacgagagccagagcagccagccccugcugcaggccccccacugccagacccuggccagccagaccuacaagcccagcagagccggcgugcacgcccagcaggaggccaccaccggccccggcgcccacagacccaagggccccgccaagaccaagggccccagacaccagagaaagcaccacgagagcaucaccccccccagcagaagccccaccaaggaggccccccccggccugaacgacgacgcccagauccccgccagccaggagagcguggccaccagcguggacggcagcgacagcagccugagcagccagagcagcagcagcugcgaguucggcgccgccuucgagagcgccggcgaggaggagggcgagggcgaggugagcgccagccaggccgccgugcaggccgccgacaccgacgaggcccugagaugcuacaucagaagcaagcccgcccuguaccagaaggugcugcuguaccagcccuucgagcugagagagcugcaggccgagcugagacagaacggccugagagugagcagcagaagacugcuggacuuccuggacacccacugcaucaccuucaccaccgccgccaccagaagagagaagcugcagggcagaagaagacagcccagaggcaagaagaagguggagagaaacuaa

SEQ ID NO: 23713 - RNA, 1227 nt, Artificial Sequence
  SLX4IP__Homo_sapiens__NP_001009608
auggccagcaagaaguucgccgugaagugcggcaacuucgccgugcugguggaccugcacauccugccccagggcagcaacaaggacaccagcugguucagcgagcagaagaaggaggaggugugccugcugcugaaggagaccaucgacagcagagugcaggaguaccuggaggugagaaagcagcacagacccagcaacgccgaguucaccagaagcaacccccugagccugaagggcuacggcuuccagaucaccgccuacuuccugaagagaggcaucagacugagaugcaucagaagcacccagaacgccgagcugugcguguuccccgacagauucguggugugcgugagccagcuggccuucagcagagaccugcuggccagccagaacgaggaccugaccgagagagugcugcacggcgugagcgacuacuucgccgagugcgccgagagcagccugccccccagcgccaagcugagaagaaacgcccugaaggagaucgugaagagaaccgagaccaagagcagcgugaccagcaagagccagaccagaagagacaccguggagaccagcagcgacagcgugaucgccgagaucgccagaagaagaaacgacggccaggccagcagcagcccccccagcgagagcaugggccaggccaaggacagcaucaaggccgccgagagccacuggggccugcccgugcagaagcuggagaaggugaaccagacccagcccgaggacaccagcggccagcagaagccccaccccggcgagagacugaagaccggccugcugagcagaagccccgugugcagcugcgagagcgccagccccugccccaagcagagccccagaguggccaagacccagcagaagagaagaaacugcagcagcgccgaggacuucgaccaccacggcagagugagccugggcagcgacagacuggugcccagagagaucaucguggagaagagcaaggccgugagagugcugcccgccagcgagcugagcgaccccggccugcugcugaagcaggaccuggccaagaccaccagcaaggaggagcugcacgugcuggagagccugagcagcagacaccugaugaagaacaaccccggccaggcccagcagaccggccuggccaccaacaccgagagacugagcaccauccagaacagccccaccaagaagagaaagaaguacgagagaggccacuaa

SEQ ID NO: 23714 - RNA, 1398 nt, Artificial Sequence
  SMAD1__Homo_sapiens__NP_005891
augaacgugaccagccuguucagcuucaccagccccgccgugaagagacugcugggcuggaagcagggcgacgaggaggagaagugggccgagaaggccguggacgcccuggugaagaagcugaagaagaagaagggcgccauggaggagcuggagaaggcccugagcugccccggccagcccagcaacugcgugaccauccccagaagccuggacggcagacugcaggugagccacagaaagggccugccccacgugaucuacugcagaguguggagauggcccgaccugcagagccaccacgagcugaagccccuggagugcugcgaguuccccuucggcagcaagcagaaggaggugugcaucaaccccuaccacuacaagagaguggagagccccgugcugccccccgugcuggugcccagacacagcgaguacaacccccagcacagccugcuggcccaguucagaaaccugggccagaacgagccccacaugccccugaacgccaccuuccccgacagcuuccagcagcccaacagccaccccuucccccacagccccaacagcagcuaccccaacagccccggcagcagcagcagcaccuacccccacagccccaccagcagcgaccccggcagccccuuccagaugcccgccgacacccccccccccgccuaccugccccccgaggaccccaugacccaggacggcagccagcccauggacaccaacaugauggcccccccccugcccagcgagaucaacagaggcgacgugcaggccguggccuacgaggagcccaagcacuggugcagcaucguguacuacgagcugaacaacagagugggcgaggccuuccacgccagcagcaccagcgugcugguggacggcuucaccgaccccagcaacaacaagaacagauucugccugggccugcugagcaacgugaacagaaacagcaccaucgagaacaccagaagacacaucggcaagggcgugcaccuguacuacgugggcggcgagguguacgccgagugccugagcgacagcagcaucuucgugcagagcagaaacugcaacuaccaccacggcuuccaccccaccaccgugugcaagauccccagcggcugcagccugaagaucuucaacaaccaggaguucgcccagcugcuggcccagagcgugaaccacggcuucgagaccguguacgagcugaccaagaugugcaccaucagaaugagcuucgugaagggcuggggcgccgaguaccacagacaggacgugaccagcacccccugcuggaucgagauccaccugcacggcccccugcaguggcuggacaaggugcugacccagaugggcagcccccacaaccccaucagcagcgugagcuaa

SEQ ID NO: 23715 - RNA, 1404 nt, Artificial Sequence
  SMAD2__Homo_sapiens__XP_006722514
augagcagcauccugcccuucaccccccccguggugaagagacugcugggcuggaagaagagcgccggcggcagcggcggcgccggcggcggcgagcagaacggccaggaggagaaguggugcgagaaggccgugaagagccuggugaagaagcugaagaagaccggcagacuggacgagcuggagaaggccaucaccacccagaacugcaacaccaagugcgugaccauccccagcaccugcagcgagaucuggggccugagcacccccaacaccaucgaccagugggacaccaccggccuguacagcuucagcgagcagaccagaagccuggacggcagacugcaggugagccacagaaagggccugccccacgugaucuacugcagacuguggagauggcccgaccugcacagccaccacgagcugaaggccaucgagaacugcgaguacgccuucaaccugaagaaggacgaggugugcgugaaccccuaccacuaccagagaguggagacccccgugcugccccccgugcuggugcccagacacaccgagauccugaccgagcugcccccccuggacgacuacacccacagcauccccgagaacaccaacuuccccgccggcaucgagccccagagcaacuacauccccgagacccccccccccggcuacaucagcgaggacggcgagaccagcgaccagcagcugaaccagagcauggacaccggcagccccgccgagcugagccccaccacccugagccccgugaaccacagccuggaccugcagcccgugaccuacagcgagcccgccuucuggugcagcaucgccuacuacgagcugaaccagagagugggcgagaccuuccacgccagccagcccagccugaccguggacggcuucaccgaccccagcaacagcgagagauucugccugggccugcugagcaacgugaacagaaacgccaccguggagaugaccagaagacacaucggcagaggcgugagacuguacuacaucggcggcgagguguucgccgagugccugagcgacagcgccaucuucgugcagagccccaacugcaaccagagauacggcuggcaccccgccaccgugugcaagaucccccccggcugcaaccugaagaucuucaacaaccaggaguucgccgcccugcuggcccagagcgugaaccagggcuucgaggccguguaccagcugaccagaaugugcaccaucagaaugagcuucgugaagggcuggggcgccgaguacagaagacagaccgugaccagcacccccugcuggaucgagcugcaccugaacggcccccugcaguggcuggacaaggugcugacccagaugggcagccccagcgugagaugcagcagcaugagcuaa

SEQ ID NO: 23716 - RNA, 963 nt, Artificial Sequence
  SMAD3__Homo_sapiens__NP_001138574
auggagcugugcgaguucgccuucaacaugaagaaggacgaggugugcgugaaccccuaccacuaccagagaguggagacccccgugcugccccccgugcuggugcccagacacaccgagauccccgccgaguuccccccccuggacgacuacagccacagcauccccgagaacaccaacuuccccgccggcaucgagccccagagcaacauccccgagacccccccccccggcuaccugagcgaggacggcgagaccagcgaccaccagaugaaccacagcauggacgccggcagccccaaccugagccccaaccccaugagccccgcccacaacaaccuggaccugcagcccgugaccuacugcgagcccgccuucuggugcagcaucagcuacuacgagcugaaccagagagugggcgagaccuuccacgccagccagcccagcaugaccguggacggcuucaccgaccccagcaacagcgagagauucugccugggccugcugagcaacgugaacagaaacgccgccguggagcugaccagaagacacaucggcagaggcgugagacuguacuacaucggcggcgagguguucgccgagugccugagcgacagcgccaucuucgugcagagccccaacugcaaccagagauacggcuggcaccccgccaccgugugcaagaucccccccggcugcaaccugaagaucuucaacaaccaggaguucgccgcccugcuggcccagagcgugaaccagggcuucgaggccguguaccagcugaccagaaugugcaccaucagaaugagcuucgugaagggcuggggcgccgaguacagaagacagaccgugaccagcacccccugcuggaucgagcugcaccugaacggcccccugcaguggcuggacaaggugcugacccagaugggcagccccagcaucagaugcagcagcgugagcuaa

SEQ ID NO: 23717 - RNA, 1659 nt, Artificial Sequence
  SMAD4__Homo_sapiens__NP_005350
auggacaacaugagcaucaccaacacccccaccagcaacgacgccugccugagcaucgugcacagccugaugugccacagacagggcggcgagagcgagaccuucgccaagagagccaucgagagccuggugaagaagcugaaggagaagaaggacgagcuggacagccugaucaccgccaucaccaccaacggcgcccaccccagcaagugcgugaccauccagagaacccuggacggcagacugcagguggccggcagaaagggcuucccccacgugaucuacgccagacuguggagauggcccgaccugcacaagaacgagcugaagcacgugaaguacugccaguacgccuucgaccugaagugcgacagcgugugcgugaaccccuaccacuacgagagaguggugagccccggcaucgaccugagcggccugacccugcagagcaacgcccccagcagcaugauggugaaggacgaguacgugcacgacuucgagggccagcccagccugagcaccgagggccacagcauccagaccauccagcacccccccagcaacagagccagcaccgagaccuacagcacccccgcccugcuggcccccagcgagagcaacgccaccagcaccgccaacuuccccaacauccccguggccagcaccagccagcccgccagcauccugggcggcagccacagcgagggccugcugcagaucgccagcggcccccagcccggccagcagcagaacggcuucaccggccagcccgccaccuaccaccacaacagcaccaccaccuggaccggcagcagaaccgcccccuacacccccaaccugccccaccaccagaacggccaccugcagcaccacccccccaugcccccccaccccggccacuacuggcccgugcacaacgagcuggccuuccagccccccaucagcaaccaccccgcccccgaguacuggugcagcaucgccuacuucgagauggacgugcaggugggcgagaccuucaaggugcccagcagcugccccaucgugaccguggacggcuacguggaccccagcggcggcgacagauucugccugggccagcugagcaacgugcacagaaccgaggccaucgagagagccagacugcacaucggcaagggcgugcagcuggagugcaagggcgagggcgacgugugggugagaugccugagcgaccacgccguguucgugcagagcuacuaccuggacagagaggccggcagagcccccggcgacgccgugcacaagaucuaccccagcgccuacaucaagguguucgaccugagacagugccacagacagaugcagcagcaggccgccaccgcccaggccgccgccgccgcccaggccgccgccguggccggcaacauccccggccccggcagcgugggcggcaucgcccccgccaucagccugagcgccgccgccggcaucggcguggacgaccugagaagacugugcauccugagaaugagcuucgugaagggcuggggccccgacuaccccagacagagcaucaaggagacccccugcuggaucgagauccaccugcacagagcccugcagcugcuggacgaggugcugcacaccaugcccaucgccgacccccagccccuggacuaa

SEQ ID NO: 23718 - RNA, 1398 nt, Artificial Sequence
  SMAD5__Homo_sapiens__NP_001001420
augaccagcauggccagccuguucagcuucaccagccccgccgugaagagacugcugggcuggaagcagggcgacgaggaggagaagugggccgagaaggccguggacgcccuggugaagaagcugaagaagaagaagggcgccauggaggagcuggagaaggcccugagcagccccggccagcccagcaagugcgugaccauccccagaagccuggacggcagacugcaggugagccacagaaagggccugccccacgugaucuacugcagaguguggagauggcccgaccugcagagccaccacgagcugaagccccuggacaucugcgaguuccccuucggcagcaagcagaaggaggugugcaucaaccccuaccacuacaagagaguggagagccccgugcugccccccgugcuggugcccagacacaacgaguucaacccccagcacagccugcuggugcaguucagaaaccugagccacaacgagccccacaugccccagaacgccaccuuccccgacagcuuccaccagcccaacaacacccccuucccccugagccccaacagccccuacccccccagccccgccagcagcaccuaccccaacagccccgccagcagcggccccggcagccccuuccagcugcccgccgacacccccccccccgccuacaugccccccgacgaccagaugggccaggacaacagccagcccauggacaccagcaacaacaugaucccccagaucaugcccagcaucagcagcagagacgugcagcccguggccuacgaggagcccaagcacuggugcagcaucguguacuacgagcugaacaacagagugggcgaggccuuccacgccagcagcaccagcgugcugguggacggcuucaccgaccccagcaacaacaagagcagauucugccugggccugcugagcaacgugaacagaaacagcaccaucgagaacaccagaagacacaucggcaagggcgugcaccuguacuacgugggcggcgagguguacgccgagugccugagcgacagcagcaucuucgugcagagcagaaacugcaacuuccaccacggcuuccaccccaccaccgugugcaagauccccagcagcugcagccugaagaucuucaacaaccaggaguucgcccagcugcuggcccagagcgugaaccacggcuucgaggccguguacgagcugaccaagaugugcaccaucagaaugagcuucgugaagggcuggggcgccgaguaccacagacaggacgugaccagcacccccugcuggaucgagauccaccugcacggcccccugcaguggcuggacaaggugcugacccagaugggcagcccccugaaccccaucagcagcgugagcuaa

SEQ ID NO: 23719 - RNA, 1491 nt, Artificial Sequence
  SMAD6__Homo_sapiens__NP_005576
auguucagaagcaagagaagcggccuggugagaagacuguggagaagcagaguggugcccgacagagaggagggcggcagcggcggcggcggcggcggcgacgaggacggcagccugggcagcagagccgagcccgcccccagagccagagagggcggcggcugcggcagaagcgaggugagacccguggcccccagaagacccagagacgccgugggccagagaggcgcccagggcgccggcagaagaagaagagccggcggcccccccagacccaugagcgagcccggcgccggcgccggcagcagccugcuggacguggccgagcccggcggccccggcuggcugcccgagagcgacugcgagaccgugaccugcugccuguucagcgagagagacgccgccggcgcccccagagacgccagcgacccccuggccggcgccgcccuggagcccgccggcggcggcagaagcagagaggccagaagcagacugcugcugcuggagcaggagcugaagaccgugaccuacagccugcugaagagacugaaggagagaagccuggacacccugcuggaggccguggagagcagaggcggcgugcccggcggcugcgugcuggugcccagagccgaccugagacugggcggccagcccgcccccccccagcugcugcugggcagacuguucagauggcccgaccugcagcacgccguggagcugaagccccugugcggcugccacagcuucgccgccgccgccgacggccccaccgugugcugcaaccccuaccacuucagcagacugugcggccccgagagcccccccccccccuacagcagacugagccccagagacgaguacaagccccuggaccugagcgacagcacccugagcuacaccgagaccgaggccaccaacagccugaucaccgcccccggcgaguucagcgacgccagcaugagccccgacgccaccaagcccagccacuggugcagcguggccuacugggagcacagaaccagagugggcagacuguacgccguguacgaccaggccgugagcaucuucuacgaccugccccagggcagcggcuucugccugggccagcugaaccuggagcagagaagcgagagcgugagaagaaccagaagcaagaucggcuucggcauccugcugagcaaggagcccgacggcgugugggccuacaacagaggcgagcaccccaucuucgugaacagccccacccuggacgcccccggcggcagagcccugguggugagaaaggugccccccggcuacagcaucaagguguucgacuucgagagaagcggccugcagcacgcccccgagcccgacgccgccgacggccccuacgaccccaacagcgugagaaucagcuucgccaagggcuggggccccugcuacagcagacaguucaucaccagcugccccugcuggcuggagauccugcugaacaaccccagauaa

SEQ ID NO: 23720 - RNA, 636 nt, Artificial Sequence
  SMAD7__Homo_sapiens__NP_001177751
auggacuuccugaagcccaccgccgacugccccgacgccgugcccagcagcgccgagaccggcggcaccaacuaccuggcccccggcggccugagcgacagccagcugcugcuggagcccggcgacagaagccacuggugcgugguggccuacugggaggagaagaccagagugggcagacuguacugcgugcaggagcccagccuggacaucuucuacgaccugccccagggcaacggcuucugccugggccagcugaacagcgacaacaagagccagcuggugcagaaggugagaagcaagaucggcugcggcauccagcugaccagagagguggacggcguguggguguacaacagaagcagcuaccccaucuucaucaagagcgccacccuggacaaccccgacagcagaacccugcuggugcacaagguguuccccggcuucagcaucaaggccuucgacuacgagaaggccuacagccugcagagacccaacgaccacgaguucaugcagcagcccuggaccggcuucaccgugcagaucagcuucgugaagggcuggggccagugcuacaccagacaguucaucagcagcugccccugcuggcuggaggugaucuucaacagcagauaa

SEQ ID NO: 23721 - RNA, 1404 nt, Artificial Sequence
  SMAD9__Homo_sapiens__NP_001120689
augcacagcaccacccccaucagcagccuguucagcuucaccagccccgccgugaagagacugcugggcuggaagcagggcgacgaggaggagaagugggccgagaaggccguggacagccuggugaagaagcugaagaagaagaagggcgccauggacgagcuggagagagcccugagcugccccggccagcccagcaagugcgugaccauccccagaagccuggacggcagacugcaggugagccacagaaagggccugccccacgugaucuacugcagaguguggagauggcccgaccugcagagccaccacgagcugaagccccuggagugcugcgaguuccccuucggcagcaagcagaaggaggugugcaucaaccccuaccacuacagaagaguggagacccccgugcugccccccgugcuggugcccagacacagcgaguacaacccccagcugagccugcuggccaaguucagaagcgccagccugcacagcgagccccugaugccccacaacgccaccuaccccgacagcuuccagcagccccccugcagcgcccugccccccagccccagccacgccuucagccagagccccugcaccgccagcuacccccacagccccggcagccccagcgagcccgagagccccuaccagcacagcguggacacccccccccugcccuaccacgccaccgaggccagcgagacccagagcggccagcccguggacgccaccgccgacagacacguggugcugagcauccccaacggcgacuucagacccgugugcuacgaggagccccagcacuggugcagcguggccuacuacgagcugaacaacagagugggcgagaccuuccaggccagcagcagaagcgugcugaucgacggcuucaccgaccccagcaacaacagaaacagauucugccugggccugcugagcaacgugaacagaaacagcaccaucgagaacaccagaagacacaucggcaagggcgugcaccuguacuacgugggcggcgagguguacgccgagugcgugagcgacagcagcaucuucgugcagagcagaaacugcaacuaccagcacggcuuccaccccgccaccgugugcaagauccccagcggcugcagccugaagguguucaacaaccagcuguucgcccagcugcuggcccagagcgugcaccacggcuucgaggugguguacgagcugaccaagaugugcaccaucagaaugagcuucgugaagggcuggggcgccgaguaccacagacaggacgugaccagcacccccugcuggaucgagauccaccugcacggcccccugcaguggcuggacaaggugcugacccagaugggcagcccccacaaccccaucagcagcgugagcuaa

SEQ ID NO: 23722 - RNA, 294 nt, Artificial Sequence
  SMAGP__Homo_sapiens__NP_001029045
augaccagccugcugaccacccccagccccagagaggagcugaugaccacccccauccugcagcccaccgaggcccugagccccgaggacggcgccagcaccgcccugaucgccguggugaucaccgugguguuccugacccugcugagcguggugauccugaucuucuucuaccuguacaagaacaagggcagcuacgugaccuacgagcccaccgagggcgagcccagcgccaucgugcagauggagagcgaccuggccaagggcagcgagaaggaggaguacuucaucuaa

SEQ ID NO: 23723 - RNA, 1404 nt, Artificial Sequence
  SMAP1__Homo_sapiens__NP_001037770
auggccaccagaagcugcagagagaaggcccagaagcugaacgagcagcaccagcugauccugagcaagcugcugagagaggaggacaacaaguacugcgccgacugcgaggccaagggccccagaugggccagcuggaacaucggcguguucaucugcaucagaugcgccggcauccacagaaaccugggcgugcacaucagcagagugaagagcgugaaccuggaccaguggaccgccgagcagauccagugcaugcaggacaugggcaacaccaaggccagacugcuguacgaggccaaccugcccgagaacuucagaagaccccagaccgaccaggccguggaguucuucaucagagacaaguacgagaagaagaaguacuacgacaagaacgccaucgccaucaccaacaucagcagcagcgacgccccccugcagccccuggugagcagccccagccugcaggccgccguggacaagaacaagcuggagaaggagaaggagaagaagaaggaggagaagaagagagagaaggagcccgagaagcccgccaagccccugaccgccgagaagcugcagaagaaggaccagcagcuggagcccaagaagagcaccagccccaagaaggccgccgagcccaccguggaccugcugggccuggacggccccgccguggcccccgugaccaacggcaacaccaccgugcccccccugaacgacgaccuggacaucuucggccccaugaucagcaacccccugcccgccaccgugaugccccccgcccagggcacccccagcgcccccgccgccgccacccugagcaccgugaccagcggcgaccuggaccuguucaccgagcagaccaccaagagcgaggagguggccaagaagcagcugagcaaggacagcauccugagccuguacggcaccggcaccauccagcagcagagcacccccggcguguucaugggccccaccaacauccccuucaccagccaggcccccgccgccuuccagggcuuccccagcaugggcgugcccgugcccgccgcccccggccugaucggcaacgugaugggccagagccccagcaugauggugggcaugcccaugcccaacggcuucaugggcaacgcccagaccggcgugaugccccugccccagaacguggugggcccccagggcggcauggugggccagaugggcgccccccagagcaaguucggccugccccaggcccagcagccccaguggagccugagccagaugaaccagcagauggccggcaugagcaucagcagcgccacccccaccgccggcuucggccagcccagcagcaccaccgccggcuggagcggcagcagcagcggccagacccugagcacccagcuguggaaguaa

SEQ ID NO: 23724 - RNA, 3213 nt, Artificial Sequence
  SMARCA1__Homo_sapiens__NP_001269803
auggagcaggacaccgccgccguggccgccaccguggccgccgccgacgccaccgccaccaucguggugaucgaggacgagcagcccggccccagcaccagccaggaggagggcgccgccgccgccgccaccgaggccaccgccgccaccgagaagggcgagaagaagaaggagaagaacgugagcagcuuccagcugaagcuggccgccaaggcccccaagagcgagaaggagauggaccccgaguacgaggagaagaugaaggccgacagagccaagagauucgaguuccugcugaagcagaccgagcuguucgcccacuucauccagcccagcgcccagaagagccccaccagcccccugaacaugaagcugggcagacccagaaucaagaaggacgagaagcagagccugaucagcgccggcgacuacagacacagaagaaccgagcaggaggaggacgaggagcugcugagcgagagcagaaagaccagcaacgugugcaucagauucgaggugagccccagcuacgugaagggcggcccccugagagacuaccagaucagaggccugaacuggcugaucagccuguacgagaacggcgugaacggcauccuggccgacgagaugggccugggcaagacccugcagaccaucgcccugcugggcuaccugaagcacuacagaaacauccccggcccccacauggugcuggugcccaagagcacccugcacaacuggaugaacgaguucaagagaugggugcccagccugagagugaucugcuucgugggcgacaaggacgccagagccgccuucaucagagacgagaugaugcccggcgagugggacgugugcgugaccagcuacgagauggugaucaaggagaagagcguguucaagaaguuccacuggagauaccuggugaucgacgaggcccacagaaucaagaacgagaagagcaagcugagcgagaucgugagagaguucaagagcaccaacagacugcugcugaccggcaccccccugcagaacaaccugcacgagcugugggcccugcugaacuuccugcugcccgacguguucaacagcgccgacgacuucgacagcugguucgacaccaagaacugccugggcgaccagaagcugguggagagacugcacgccgugcugaagcccuuccugcugagaagaaucaagaccgacguggagaagagccugccccccaagaaggagaucaagaucuaccugggccugagcaagaugcagagagagugguacaccaagauccugaugaaggacaucgacgugcugaacagcagcggcaagauggacaagaugagacugcugaacauccugaugcagcugagaaagugcugcaaccaccccuaccuguucgacggcgccgagcccggcccccccuacaccaccgacgagcacaucgugagcaacagcggcaagaugguggugcuggacaagcugcuggccaagcugaaggagcagggcagcagagugcugaucuucagccagaugaccagacugcuggacauccuggaggacuacugcauguggagaggcuacgaguacugcagacuggacggccagaccccccacgaggagagagaggacaaguuccuggagguggaguuccugggccagagagaggccaucgaggccuucaacgcccccaacagcagcaaguucaucuucaugcugagcaccagagccggcggccugggcaucaaccuggccagcgccgacguggugauccuguacgacagcgacuggaacccccagguggaccugcaggccauggacagagcccacagaaucggccagaagaagcccgugagaguguucagacugaucaccgacaacaccguggaggagagaaucguggagagagccgagaucaagcugagacuggacagcaucgugauccagcagggcagacugaucgaccagcagagcaacaagcuggccaaggaggagaugcugcagaugaucagacacggcgccacccacguguucgccagcaaggagagcgagcugaccgacgaggacaucaccaccauccuggagagaggcgagaagaagaccgccgagaugaacgagagacugcagaagaugggcgagagcagccugagaaacuucagaauggacaucgagcagagccuguacaaguucgagggcgaggacuacagagagaagcagaagcugggcaugguggaguggaucgagccccccaagagagagagaaaggccaacuacgccguggacgccuacuucagagaggcccugagagugagcgagcccaagauccccaaggcccccagaccccccaagcagcccaacgugcaggacuuccaguucuucccccccagacuguucgagcugcuggagaaggagauccuguacuacagaaagaccaucggcuacaaggugcccagaaaccccgacauccccaaccccgcccuggcccagagagaggagcagaagaagaucgacggcgccgagccccugacccccgaggagaccgaggagaaggagaagcugcugacccagggcuucaccaacuggaccaagagagacuucaaccaguucaucaaggccaacgagaaguacggcagagacgacaucgacaacaucgccagagagguggagggcaagagccccgaggaggugauggaguacagcgccguguucugggagagaugcaacgagcugcaggacaucgagaagaucauggcccagaucgagagaggcgaggccagaauccagagaagaaucagcaucaagaaggcccuggacgccaagaucgccagauacaaggcccccuuccaccagcugagaauccaguacggcaccagcaagggcaagaacuacaccgaggaggaggacagauuccugaucugcaugcugcacaagaugggcuucgacagagagaacguguacgaggagcugagacagugcgugagaaacgccccccaguucagauucgacugguucaucaagagcagaaccgccauggaguuccagagaagaugcaacacccugaucagccugaucgagaaggagaacauggagaucgaggagagagagagagccgagaagaagaagagagccaccaagacccccaugagccagaagagaaaggccgagagcgccaccgagagcagcggcaagaaggacgugaagaaggugaagagcuaa

SEQ ID NO: 23725 - RNA, 4545 nt, Artificial Sequence
  SMARCA2__Homo_sapiens__NP_001276326
augagcacccccaccgaccccggcgccaugccccaccccggccccagccccggccccggccccagccccggccccauccugggccccagccccggccccggccccagccccggcagcgugcacagcaugaugggccccagccccggcccccccagcgugagccaccccaugcccaccaugggcagcaccgacuucccccaggagggcaugcaccagaugcacaagcccaucgacggcauccacgacaagggcaucguggaggacauccacugcggcagcaugaagggcaccggcaugagacccccccaccccggcaugggccccccccagagccccauggaccagcacagccagggcuacaugagcccccaccccagcccccugggcgcccccgagcacgugagcagccccaugagcggcggcggccccacccccccccagaugccccccagccagcccggcgcccugauccccggcgacccccaggccaugagccagcccaacagaggccccagccccuucagccccgugcagcugcaccagcugagagcccagauccuggccuacaagaugcuggccagaggccagccccugcccgagacccugcagcuggccgugcagggcaagagaacccugcccggccugcagcagcagcagcagcagcagcagcagcagcagcagcagcagcagcagcagcagcagcagcagcagcagccccagcagcagcccccccagccccagacccagcagcagcagcagcccgcccuggugaacuacaacagacccagcggccccggccccgagcugagcggccccagcaccccccagaagcugcccgugcccgcccccggcggcagacccagccccgccccccccgccgccgcccagccccccgccgccgccgugcccggccccagcgugccccagcccgcccccggccagcccagccccgugcugcagcugcagcagaagcagagcagaaucagccccauccagaagccccagggccuggaccccguggagauccugcaggagagagaguacagacugcaggccagaaucgcccacagaauccaggagcuggagaaccugcccggcagccugccccccgaccugagaaccaaggccaccguggagcugaaggcccugagacugcugaacuuccagagacagcugagacaggaggugguggccugcaugagaagagacaccacccuggagaccgcccugaacagcaaggccuacaagagaagcaagagacagacccugagagaggccagaaugaccgagaagcuggagaagcagcagaagaucgagcaggagagaaagagaagacagaagcaccaggaguaccugaacagcauccugcagcacgccaaggacuucaaggaguaccacagaagcguggccggcaagauccagaagcugagcaaggccguggccaccuggcacgccaacaccgagagagagcagaagaaggagaccgagagaaucgagaaggagagaaugagaagacugauggccgaggacgaggagggcuacagaaagcugaucgaccagaagaaggacagaagacuggccuaccugcugcagcagaccgacgaguacguggccaaccugaccaaccuggugugggagcacaagcaggcccaggccgccaaggagaagaagaagagaagaagaagaaagaagaaggccgaggagaacgccgagggcggcgagagcgcccugggccccgacggcgagcccaucgacgagagcagccagaugagcgaccugcccgugaaggugacccacaccgagaccggcaaggugcuguucggccccgaggcccccaaggccagccagcuggacgccuggcuggagaugaaccccggcuacgagguggcccccagaagcgacagcgaggagagcgacagcgacuacgaggaggaggacgaggaggaggagagcagcagacaggagaccgaggagaagauccugcuggaccccaacagcgaggaggugagcgagaaggacgccaagcagaucaucgagaccgccaagcaggacguggacgacgaguacagcaugcaguacagcgccagaggcagccagagcuacuacaccguggcccacgccaucagcgagagaguggagaagcagagcgcccugcugaucaacggcacccugaagcacuaccagcugcagggccuggaguggauggugagccuguacaacaacaaccugaacggcauccuggccgacgagaugggccugggcaagaccauccagaccaucgcccugaucaccuaccugauggagcacaagagacugaacggccccuaccugaucaucgugccccugagcacccugagcaacuggaccuacgaguucgacaagugggcccccagcguggugaagaucagcuacaagggcacccccgccaugagaagaagccuggugccccagcugagaagcggcaaguucaacgugcugcugaccaccuacgaguacaucaucaaggacaagcacauccuggccaagaucagauggaaguacaugaucguggacgagggccacagaaugaagaaccaccacugcaagcugacccagguggaccugaacgaggaggagaccauccugaucaucagaagacugcacaaggugcugagacccuuccugcugagaagacugaagaaggagguggagagccagcugcccgagaagguggaguacgugaucaagugcgacaugagcgcccugcagaagauccuguacagacacaugcaggccaagggcauccugcugaccgacggcagcgagaaggacaagaagggcaagggcggcgccaagacccugaugaacaccaucaugcagcugagaaagaucugcaaccaccccuacauguuccagcacaucgaggagagcuucgccgagcaccugggcuacagcaacggcgugaucaacggcgccgagcuguacagagccagcggcaaguucgagcugcuggacagaauccugcccaagcugagagccaccaaccacagagugcugcuguucugccagaugaccagccugaugaccaucauggaggacuacuucgccuucagaaacuuccuguaccugagacuggacggcaccaccaagagcgaggacagagccgcccugcugaagaaguucaacgagcccggcagccaguacuucaucuuccugcugagcaccagagccggcggccugggccugaaccugcaggccgccgacaccguggugaucuucgacagcgacuggaacccccaccaggaccugcaggcccaggacagagcccacagaaucggccagcagaacgaggugagagugcugagacugugcaccgugaacagcguggaggagaagauccuggccgccgccaaguacaagcugaacguggaccagaaggugauccaggccggcauguucgaccagaagagcagcagccacgagagaagagccuuccugcaggccauccuggagcacgaggaggagaacgaggaggaggacgaggugcccgacgacgagacccugaaccagaugaucgccagaagagaggaggaguucgaccuguucaugagaauggacauggacagaagaagagaggacgccagaaaccccaagagaaagcccagacugauggaggaggacgagcugcccagcuggaucaucaaggacgacgccgagguggagagacugaccugcgaggaggaggaggagaagaucuucggcagaggcagcagacagagaagagacguggacuacagcgacgcccugaccgagaagcaguggcugagagccaucgaggacggcaaccuggaggagauggaggaggaggugagacugaagaagagaaagagaagaagaaacguggacaaggaccccgccaaggaggacguggagaaggccaagaagagaagaggcagaccccccgccgagaagcugagccccaacccccccaagcugaccaagcagaugaacgccaucaucgacaccgugaucaacuacaaggacagcagcggcagacagcugagcgagguguucauccagcugcccagcagaaaggagcugcccgaguacuacgagcugaucagaaagcccguggacuucaagaagaucaaggagagaaucagaaaccacaaguacagaagccugggcgaccuggagaaggacgugaugcugcugugccacaacgcccagaccuucaaccuggagggcagccagaucuacgaggacagcaucgugcugcagagcguguucaagagcgccagacagaagaucgccaaggaggaggagagcgaggacgagagcaacgaggaggaggaggaggaggacgaggaggagagcgagagcgaggccaagagcgugaaggugaagaucaagcugaacaagaaggacgacaagggcagagacaagggcaagggcaagaagagacccaacagaggcaaggccaagcccguggugagcgacuucgacagcgacgaggagcaggacgagagagagcagagcgagggcagcggcaccgacgacgaguaa

SEQ ID NO: 23726 - RNA, 4944 nt, Artificial Sequence
  SMARCA4__Homo_sapiens__NP_001122316
augagcacccccgaccccccccugggcggcacccccagacccggccccagccccggccccggccccagccccggcgccaugcugggccccagccccggccccagccccggcagcgcccacagcaugaugggccccagccccggcccccccagcgccggccaccccauccccacccagggccccggcggcuacccccaggacaacaugcaccagaugcacaagcccauggagagcaugcacgagaagggcaugagcgacgaccccagauacaaccagaugaagggcaugggcaugagaagcggcggccacgccggcaugggccccccccccagccccauggaccagcacagccagggcuaccccagcccccugggcggcagcgagcacgccagcagccccgugcccgccagcggccccagcagcggcccccagaugagcagcggccccggcggcgccccccuggacggcgccgacccccaggcccugggccagcagaacagaggccccacccccuucaaccagaaccagcugcaccagcugagagcccagaucauggccuacaagaugcuggccagaggccagccccugcccgaccaccugcagauggccgugcagggcaagagacccaugcccggcaugcagcagcagaugcccacccugcccccccccagcgugagcgccaccggccccggccccggccccggccccggccccggccccggccccggccccgccccccccaacuacagcagaccccacggcaugggcggccccaacaugcccccccccggccccagcggcgugccccccggcaugcccggccagccccccggcggcccccccaagcccuggcccgagggccccauggccaacgccgccgcccccaccagcaccccccagaagcugauccccccccagcccaccggcagacccagccccgccccccccgccgugccccccgccgccagccccgugaugcccccccagacccagagccccggccagcccgcccagcccgcccccauggugccccugcaccagaagcagagcagaaucacccccauccagaagcccagaggccuggaccccguggagauccugcaggagagagaguacagacugcaggccagaaucgcccacagaauccaggagcuggagaaccugcccggcagccuggccggcgaccugagaaccaaggccaccaucgagcugaaggcccugagacugcugaacuuccagagacagcugagacaggaggugguggugugcaugagaagagacaccgcccuggagaccgcccugaacgccaaggccuacaagagaagcaagagacagagccugagagaggccagaaucaccgagaagcuggagaagcagcagaagaucgagcaggagagaaagagaagacagaagcaccaggaguaccugaacagcauccugcagcacgccaaggacuucaaggaguaccacagaagcgugaccggcaagauccagaagcugaccaaggccguggccaccuaccacgccaacaccgagagagagcagaagaaggagaacgagagaaucgagaaggagagaaugagaagacugauggccgaggacgaggagggcuacagaaagcugaucgaccagaagaaggacaagagacuggccuaccugcugcagcagaccgacgaguacguggccaaccugaccgagcuggugagacagcacaaggccgcccagguggccaaggagaagaagaagaagaagaagaagaagaaggccgagaacgccgagggccagacccccgccaucggccccgacggcgagccccuggacgagaccagccagaugagcgaccugcccgugaaggugauccacguggagagcggcaagauccugaccggcaccgacgcccccaaggccggccagcuggaggccuggcuggagaugaaccccggcuacgagguggcccccagaagcgacagcgaggagagcggcagcgaggaggaggaggaggaggaggaggaggagcagccccaggccgcccagccccccacccugcccguggaggagaagaagaagauccccgaccccgacagcgacgacgugagcgagguggacgccagacacaucaucgagaacgccaagcaggacguggacgacgaguacggcgugagccaggcccuggccagaggccugcagagcuacuacgccguggcccacgccgugaccgagagaguggacaagcagagcgcccugauggugaacggcgugcugaagcaguaccagaucaagggccuggaguggcuggugagccuguacaacaacaaccugaacggcauccuggccgacgagaugggccugggcaagaccauccagaccaucgcccugaucaccuaccugauggagcacaagagaaucaacggccccuuccugaucaucgugccccugagcacccugagcaacugggccuacgaguucgacaagugggcccccagcguggugaaggugagcuacaagggcagccccgccgccagaagagccuucgugccccagcugagaagcggcaaguucaacgugcugcugaccaccuacgaguacaucaucaaggacaagcacauccuggccaagaucagauggaaguacaugaucguggacgagggccacagaaugaagaaccaccacugcaagcugacccaggugcugaacacccacuacguggcccccagaagacugcugcugaccggcaccccccugcagaacaagcugcccgagcugugggcccugcugaacuuccugcugcccaccaucuucaagagcugcagcaccuucgagcagugguucaacgcccccuucgccaugaccggcgagaagguggaccugaacgaggaggagaccauccugaucaucagaagacugcacaaggugcugagacccuuccugcugagaagacugaagaaggagguggaggcccagcugcccgagaagguggaguacgugaucaagugcgacaugagcgcccugcagagagugcuguacagacacaugcaggccaagggcgugcugcugaccgacggcagcgagaaggacaagaagggcaagggcggcaccaagacccugaugaacaccaucaugcagcugagaaagaucugcaaccaccccuacauguuccagcacaucgaggagagcuucagcgagcaccugggcuucaccggcggcaucgugcagggccuggaccuguacagagccagcggcaaguucgagcugcuggacagaauccugcccaagcugagagccaccaaccacaaggugcugcuguucugccagaugaccagccugaugaccaucauggaggacuacuucgccuacagaggcuucaaguaccugagacuggacggcaccaccaaggccgaggacagaggcaugcugcugaagaccuucaacgagcccggcagcgaguacuucaucuuccugcugagcaccagagccggcggccugggccugaaccugcagagcgccgacaccgugaucaucuucgacagcgacuggaacccccaccaggaccugcaggcccaggacagagcccacagaaucggccagcagaacgaggugagagugcugagacugugcaccgugaacagcguggaggagaagauccuggccgccgccaaguacaagcugaacguggaccagaaggugauccaggccggcauguucgaccagaagagcagcagccacgagagaagagccuuccugcaggccauccuggagcacgaggagcaggacgagagcagacacugcagcaccggcagcggcagcgccagcuucgcccacaccgcccccccccccgccggcgugaaccccgaccuggaggagcccccccugaaggaggaggacgaggugcccgacgacgagaccgugaaccagaugaucgccagacacgaggaggaguucgaccuguucaugagaauggaccuggacagaagaagagaggaggccagaaaccccaagagaaagcccagacugauggaggaggacgagcugcccagcuggaucaucaaggacgacgccgagguggagagacugaccugcgaggaggaggaggagaagauguucggcagaggcagcagacacagaaaggagguggacuacagcgacagccugaccgagaagcaguggcugaaggccaucgaggagggcacccuggaggagaucgaggaggaggugagacagaagaagagcagcagaaagagaaagagagacagcgacgccggcagcagcacccccaccaccagcaccagaagcagagacaaggacgacgagagcaagaagcagaagaagagaggcagaccccccgccgagaagcugagccccaacccccccaaccugaccaagaagaugaagaagaucguggacgccgugaucaaguacaaggacagcagcagcggcagacagcugagcgagguguucauccagcugcccagcagaaaggagcugcccgaguacuacgagcugaucagaaagcccguggacuucaagaagaucaaggagagaaucagaaaccacaaguacagaagccugaacgaccuggagaaggacgugaugcugcugugccagaacgcccagaccuucaaccuggagggcagccugaucuacgaggacagcaucgugcugcagagcguguucaccagcgugagacagaagaucgagaaggaggacgacagcgagggcgaggagagcgaggaggaggaggagggcgaggaggagggcagcgagagcgagagcagaagcgugaaggugaagaucaagcugggcagaaaggagaaggcccaggacagacugaagggcggcagaagaagacccagcagaggcagcagagccaagcccguggugagcgacgacgacagcgaggaggagcaggaggaggacagaagcggcagcggcagcgaggaggacuaa

SEQ ID NO: 23727 - RNA, 3159 nt, Artificial Sequence
  SMARCA5__Homo_sapiens__NP_003592
augagcagcgccgccgagcccccccccccccccccccccgagagcgcccccagcaagcccgccgccagcaucgccagcggcggcagcaacagcagcaacaagggcggccccgagggcguggccgcccaggccguggccagcgccgccagcgccggccccgccgacgccgagauggaggagaucuucgacgacgccagccccggcaagcagaaggagauccaggagcccgaccccaccuacgaggagaagaugcagaccgacagagccaacagauucgaguaccugcugaagcagaccgagcuguucgcccacuucauccagcccgccgcccagaagacccccaccagcccccugaagaugaagcccggcagacccagaaucaagaaggacgagaagcagaaccugcugagcgugggcgacuacagacacagaagaaccgagcaggaggaggacgaggagcugcugaccgagagcagcaaggccaccaacgugugcaccagauucgaggacagccccagcuacgugaaguggggcaagcugagagacuaccaggugagaggccugaacuggcugaucagccuguacgagaacggcaucaacggcauccuggccgacgagaugggccugggcaagacccugcagaccaucagccugcugggcuacaugaagcacuacagaaacauccccggcccccacauggugcuggugcccaagagcacccugcacaacuggaugagcgaguucaagagaugggugcccacccugagaagcgugugccugaucggcgacaaggagcagagagccgccuucgugagagacgugcugcugcccggcgagugggacgugugcgugaccagcuacgagaugcugaucaaggagaagagcguguucaagaaguucaacuggagauaccuggugaucgacgaggcccacagaaucaagaacgagaagagcaagcugagcgagaucgugagagaguucaagaccaccaacagacugcugcugaccggcaccccccugcagaacaaccugcacgagcuguggagccugcugaacuuccugcugcccgacguguucaacagcgccgacgacuucgacagcugguucgacaccaacaacugccugggcgaccagaagcugguggagagacugcacauggugcugagacccuuccugcugagaagaaucaaggccgacguggagaagagccugccccccaagaaggaggugaagaucuacgugggccugagcaagaugcagagagagugguacaccagaauccugaugaaggacaucgacauccugaacagcgccggcaagauggacaagaugagacugcugaacauccugaugcagcugagaaagugcugcaaccaccccuaccuguucgacggcgccgagcccggcccccccuacaccaccgacaugcaccuggugaccaacagcggcaagaugguggugcuggacaagcugcugcccaagcugaaggagcagggcagcagagugcugaucuucagccagaugaccagagugcuggacauccuggaggacuacugcauguggagaaacuacgaguacugcagacuggacggccagaccccccacgacgagagacaggacagcaucaacgccuacaacgagcccaacagcaccaaguucguguucaugcugagcaccagagccggcggccugggcaucaaccuggccaccgccgacguggugauccuguacgacagcgacuggaacccccagguggaccugcaggccauggacagagcccacagaaucggccagaccaagaccgugagaguguucagauucaucaccgacaacaccguggaggagagaaucguggagagagccgagaugaagcugagacuggacagcaucgugauccagcagggcagacugguggaccagaaccugaacaagaucggcaaggacgagaugcugcagaugaucagacacggcgccacccacguguucgccagcaaggagagcgagaucaccgacgaggacaucgacggcauccuggagagaggcgccaagaagaccgccgagaugaacgagaagcugagcaagaugggcgagagcagccugagaaacuucaccauggacaccgagagcagcguguacaacuucgagggcgaggacuacagagagaagcagaagaucgccuucaccgaguggaucgagccccccaagagagagagaaaggccaacuacgccguggacgccuacuucagagaggcccugagagugagcgagcccaaggcccccaaggcccccagaccccccaagcagcccaacgugcaggacuuccaguucuucccccccagacuguucgagcugcuggagaaggagauccuguucuacagaaagaccaucggcuacaaggugcccagaaaccccgagcugcccaacgccgcccaggcccagaaggaggagcagcugaagaucgacgaggccgagagccugaacgacgaggagcuggaggagaaggagaagcugcugacccagggcuucaccaacuggaacaagagagacuucaaccaguucaucaaggccaacgagaaguggggcagagacgacaucgagaacaucgccagagagguggagggcaagacccccgaggaggugaucgaguacagcgccguguucugggagagaugcaacgagcugcaggacaucgagaagaucauggcccagaucgagagaggcgaggccagaauccagagaagaaucagcaucaagaaggcccuggacaccaagaucggcagauacaaggcccccuuccaccagcugagaaucagcuacggcaccaacaagggcaagaacuacaccgaggaggaggacagauuccugaucugcaugcugcacaagcugggcuucgacaaggagaacguguacgacgagcugagacagugcaucagaaacagcccccaguucagauucgacugguuccugaagagcagaaccgccauggagcugcagagaagaugcaacacccugaucacccugaucgagagagagaacauggagcuggaggagaaggagaaggccgagaagaagaagagaggccccaagcccagcacccagaagagaaagauggacggcgcccccgacggcagaggcagaaagaagaagcugaagcuguaa

SEQ ID NO: 23728 - RNA, 3087 nt, Artificial Sequence
  SMARCAD1__Homo_sapiens__NP_001121901
augaaccuguucaaccuggacagauucagauucgagaagagaaacaagaucgaggaggcccccgaggccaccccccagcccagccagcccggccccagcagccccaucagccugagcgccgaggaggagaacgccgagggcgaggugagcagagccaacacccccgacagcgacaucaccgagaagaccgaggacagcagcgugcccgagacccccgacaacgagagaaaggccagcaucagcuacuucaagaaccagagaggcauccaguacaucgaccugagcagcgacagcgaggacguggugagccccaacugcagcaacaccgugcaggagaagaccuucaacaaggacaccgugaucaucgugagcgagcccagcgaggacgaggagagccagggccugcccaccauggccagaagaaacgacgacaucagcgagcuggaggaccugagcgagcuggaggaccugaaggacgccaagcugcagacccugaaggagcuguucccccagagaagcgacaacgaccugcugaagcugaucgagagcaccagcaccauggacggcgccaucgccgccgcccugcugauguucggcgacgccggcggcggccccagaaagagaaagcugagcagcagcagcgagcccuacgaggaggacgaguucaacgacgaccagagcaucaagaagaccagacuggaccacggcgaggagagcaacgagagcgccgagagcagcagcaacugggagaagcaggagagcaucgugcugaagcugcagaaggaguuccccaacuucgacaagcaggagcugagagaggugcugaaggagcacgaguggauguacaccgaggcccuggagagccugaagguguucgccgaggaccaggacaugcaguacgugagccagagcgaggugcccaacggcaaggaggugagcagcagaagccagaacuaccccaagaacgccaccaagaccaagcugaagcagaaguucagcaugaaggcccagaacggcuucaacaagaagagaaagaagaacguguucaaccccaagagagugguggaggacagcgaguacgacagcggcagcgacgugggcagcagccuggacgaggacuacagcagcggcgaggaggugauggaggacggcuacaagggcaagauccugcacuuccugcaggacgccagcaucggcgagcugacccugaucccccagugcagccagaagaaggcccagaagaucaccgagcugagacccuucaacagcugggaggcccuguucaccaagaugagcaagaccaacggccugagcgaggaccugaucuggcacugcaagacccugauccaggagagagacguggugaucagacugaugaacaagugcgaggacaucagcaacaagcugaccaagcaggugaccaugcugaccggcaacggcggcggcuggaacaucgagcagcccagcauccugaaccagagccugagccugaagcccuaccagaaggugggccugaacuggcuggcccuggugcacaagcacggccugaacggcauccuggccgacgagaugggccugggcaagaccauccaggccaucgccuuccuggccuaccuguaccaggagggcaacaacggcccccaccugaucguggugcccgccagcaccaucgacaacuggcugagagaggugaaccuguggugccccacccugaaggugcugugcuacuacggcagccaggaggagagaaagcagaucagauucaacauccacagcagauacgaggacuacaacgugaucgugaccaccuacaacugcgccaucagcagcagcgacgacagaagccuguucagaagacugaagcugaacuacgccaucuucgacgagggccacaugcugaagaacaugggcagcaucagauaccagcaccugaugaccaucaacgccaacaacagacugcugcugaccggcacccccgugcagaacaaccugcuggagcugaugagccugcugaacuucgugaugccccacauguucagcagcagcaccagcgagaucagaagaauguucagcagcaagaccaagagcgccgacgagcagagcaucuacgagaaggagagaaucgcccacgccaagcagaucaucaagcccuucauccugagaagagugaaggaggaggugcugaagcagcugccccccaagaaggacagaaucgagcugugcgccaugagcgagaagcaggagcagcuguaccugggccuguucaacagacugaagaagagcaucaacaaccuggugaccgagaagaacaccgagaugugcaacgugaugaugcagcugagaaagauggccaaccacccccugcugcacagacaguacuacaccgccgagaagcugaaggagaugagccagcugaugcugaaggagcccacccacugcgaggccaaccccgaccugaucuucgaggacauggaggugaugaccgacuucgagcugcacgugcugugcaagcaguacagacacaucaacaacuuccagcuggacauggaccugauccuggacagcggcaaguucagagugcugggcugcauccugagcgagcugaagcagaagggcgacagaguggugcuguucagccaguucaccaugaugcuggacauccuggaggugcugcugaagcaccaccagcacagauaccugagacuggacggcaagacccagaucagcgagagaauccaccugaucgacgaguucaacaccgacauggacaucuucguguuccugcugagcaccaaggccggcggccugggcaucaaccugaccagcgccaacguggugauccugcacgacaucgacugcaaccccuacaacgacaagcaggccgaggacagaugccacagagugggccagaccaaggaggugcuggugaucaagcugaucagccagggcaccaucgaggagagcaugcugaagaucaaccagcagaagcugaagcuggagcaggacaugaccaccguggacgagggcgacgagggcagcaugcccgccgacaucgccacccugcugaagaccagcaugggccuguaa

SEQ ID NO: 23729 - RNA, 2865 nt, Artificial Sequence
  SMARCAL1__Homo_sapiens__XP_005246688
augagccugccccugaccgaggagcagagaaagaagaucgaggagaacagacagaaggcccuggccagaagagccgagaagcugcuggccgagcagcaccagagaaccagcagcggcaccagcaucgccggcaaccccuuccaggccaagcagggccccagccagaacuuccccagagagagcugcaagcccgugagccacggcgugaucuucaagcagcagaaccugagcagcagcagcaacgccgaccagagaccccacgacagccacagcuuccaggccaagggcaucuggaagaagcccgaggagaugcccaccgccugccccggccacagccccagaagccagauggcccugaccggcaucagccccccccuggcccagagcccccccgaggugcccaagcagcagcugcugagcuacgagcugggccagggccacgcccaggccagccccgagaucagauucacccccuucgccaaccccacccacaagccccuggccaagcccaagagcagccaggagacccccgcccacagcagcggccagccccccagagacgccaagcuggaggccaagaccgccaaggccagccccagcggccagaacaucagcuacauccacagcagcagcgagagcgugacccccagaaccgagggcagacugcagcagaagagcggcagcagcgugcagaagggcgugaacagccagaagggcaagugcgugagaaacggcgacagauuccaggugcugaucggcuacaacgccgagcugaucgccguguucaagacccugcccagcaagaacuacgaccccgacaccaagaccuggaacuucagcaugaacgacuacagcgcccugaugaaggccgcccagagccugcccaccgugaaccugcagccccuggagugggccuacggcagcagcgagagccccagcaccagcagcgagggccaggccggccugcccagcgcccccagccugagcuucgugaagggcagaugcaugcugaucagcagagccuacuucgaggccgacaucagcuacagccaggaccugaucgcccuguucaagcagauggacagcagaagauacgacgugaagaccagaaaguggagcuuccugcuggaggagcacagcaagcugaucgccaaggugagaugccugccccaggugcagcuggacccccugcccaccacccugacccuggccuucgccagccagcugaagaagaccagccugagccugacccccgacgugcccgaggccgaccugagcgagguggaccccaagcuggugagcaaccugaugcccuuccagagagccggcgugaacuucgccaucgccaagggcggcagacugcugcuggccgacgacaugggccugggcaagaccauccaggccaucugcaucgccgccuucuacagaaaggaguggccccugcuggugguggugcccagcagcgugagauucaccugggagcaggccuuccugagauggcugcccagccugagccccgacugcaucaacgugguggugaccggcaaggacagacugaccgccggccugaucaacaucgugagcuucgaccugcugagcaagcuggagaagcagcugaagacccccuucaagguggugaucaucgacgagagccacuuccugaagaacagcagaaccgccagaugcagagccgccaugcccgugcugaagguggccaagagagugauccugcugagcggcacccccgccaugagcagacccgccgagcuguacacccagaucaucgccgugaagcccaccuucuucccccaguuccacgccuucggccugagauacugcgacgccaagagaaugcccuggggcugggacuacagcggcagcagcaaccugggcgagcugaagcugcugcuggaggaggccgugaugcugagaagacugaagagcgacgugcugagccagcugcccgccaagcagagaaagaucguggugaucgcccccggcagaaucaacgccagaaccagagccgcccuggacgccgccgccaaggagaugaccaccaaggacaagaccaagcagcagcagaaggacgcccugauccuguucuucaacagaaccgccgaggccaagauccccagcgugaucgaguacauccuggaccugcuggagagcggcagagagaaguuccugguguucgcccaccacaagguggugcuggacgccaucacccaggagcuggagagaaagcacgugcagcacaucagaaucgacggcagcaccagcagcgccgagagagaggaccugugccagcaguuccagcugagcgagagacacgccguggccgugcugagcaucaccgccgccaacaugggccugaccuucagcagcgccgaccuggugguguucgccgagcuguucuggaaccccggcgugcugauccaggccgaggacagagugcacagaaucggccagaccagcagcgugggcauccacuaccugguggccaagggcaccgccgacgacuaccuguggccccugauccaggagaagaucaaggugcuggccgaggccggccugagcgagaccaacuucagcgagaugaccgagagcaccgacuaccuguacaaggaccccaagcagcagaagaucuacgaccuguuccagaagagcuucgagaaggagggcagcgacauggagcugcuggaggccgccgagagcuucgaccccggcagcgccagcggcaccagcggcagcagcagccagaacaugggcgacacccuggacgagagcagccugaccgccagcccccagaagaagagaagauucgaguucuucgacaacugggacagcuucaccagcccccuguaa

SEQ ID NO: 23730 - RNA, 1131 nt, Artificial Sequence
  SMARCB1__Homo_sapiens__NP_001007469
augaugaugauggcccugagcaagaccuucggccagaagcccgugaaguuccagcuggaggacgacggcgaguucuacaugaucggcagcgaggugggcaacuaccugagaauguucagaggcagccuguacaagagauaccccagccuguggagaagacuggccaccguggaggagagaaagaagaucguggccagcagccacgaccacggcuacaccacccuggccaccagcgugacccugcugaaggccagcgagguggaggagauccuggacggcaacgacgagaaguacaaggccgugagcaucagcaccgagccccccaccuaccugagagagcagaaggccaagagaaacagccagugggugcccacccugcccaacagcagccaccaccuggacgccgugcccugcagcaccaccaucaacagaaacagaaugggcagagacaagaagagaaccuucccccugugcuucgacgaccacgaccccgccgugauccacgagaacgccagccagcccgaggugcuggugcccaucagacuggacauggagaucgacggccagaagcugagagacgccuucaccuggaacaugaacgagaagcugaugacccccgagauguucagcgagauccugugcgacgaccuggaccugaacccccugaccuucgugcccgccaucgccagcgccaucagacagcagaucgagagcuaccccaccgacagcauccuggaggaccagagcgaccagagagugaucaucaagcugaacauccacgugggcaacaucagccugguggaccaguucgagugggacaugagcgagaaggagaacagccccgagaaguucgcccugaagcugugcagcgagcugggccugggcggcgaguucgugaccaccaucgccuacagcaucagaggccagcugagcuggcaccagaagaccuacgccuucagcgagaacccccugcccaccguggagaucgccaucagaaacaccggcgacgccgaccaguggugcccccugcuggagacccugaccgacgccgagauggagaagaagaucagagaccaggacagaaacaccagaagaaugagaagacuggccaacaccgcccccgccugguaa

SEQ ID NO: 23731 - RNA, 3318 nt, Artificial Sequence
  SMARCC1__Homo_sapiens__NP_003065
auggccgccgccgccggcggcggcggccccggcaccgccgugggcgccaccggcagcggcaucgccgccgccgccgccggccuggccguguacagaagaaaggacggcggccccgccaccaaguucugggagagccccgagaccgugagccagcuggacagcgugagaguguggcugggcaagcacuacaagaaguacgugcacgccgacgcccccaccaacaagacccuggccggccugguggugcagcugcugcaguuccaggaggacgccuucggcaagcacgugaccaaccccgccuucaccaagcugcccgccaagugcuucauggacuucaaggccggcggcgcccugugccacauccugggcgccgccuacaaguacaagaacgagcagggcuggagaagauucgaccugcagaaccccagcagaauggacagaaacguggagauguucaugaacaucgagaagacccuggugcagaacaacugccugaccagacccaacaucuaccugauccccgacaucgaccugaagcuggccaacaagcugaaggacaucaucaagagacaccagggcaccuucaccgacgagaagagcaaggccagccaccacaucuaccccuacagcagcagccaggacgacgaggaguggcugagacccgugaugagaaaggagaagcaggugcuggugcacuggggcuucuaccccgacagcuacgacaccugggugcacagcaacgacguggacgccgagaucgaggacccccccauccccgagaagcccuggaaggugcacgugaaguggauccuggacaccgacaucuucaacgaguggaugaacgaggaggacuacgagguggacgagaacagaaagcccgugagcuucagacagagaaucagcaccaagaacgaggagcccgugagaagccccgagagaagagacagaaaggccagcgccaacgccagaaagagaaagcacagccccagcccccccccccccacccccaccgagagcagaaagaagagcggcaagaagggccaggccagccuguacggcaagagaagaagccagaaggaggaggacgagcaggaggaccugaccaaggacauggaggaccccacccccgugcccaacaucgaggagguggugcugcccaagaacgugaaccugaagaaggacagcgagaacacccccgugaagggcggcaccguggccgaccuggacgagcaggacgaggagaccgugaccgccggcggcaaggaggacgaggaccccgccaagggcgaccagagcagaagcguggaccugggcgaggacaacgugaccgagcagaccaaccacaucaucauccccagcuacgccagcugguucgacuacaacugcauccacgugaucgagagaagagcccugcccgaguucuucaacggcaagaacaagagcaagacccccgagaucuaccuggccuacagaaacuucaugaucgacaccuacagacugaacccccaggaguaccugaccagcaccgccugcagaagaaaccugaccggcgacgugugcgccgugaugagagugcacgccuuccuggagcaguggggccuggugaacuaccagguggaccccgagagcagacccauggccaugggccccccccccaccccccacuucaacgugcuggccgacacccccagcggccuggugccccugcaccugagaagcccccaggugcccgccgcccagcagaugcugaacuuccccgagaagaacaaggagaagcccguggaccugcagaacuucggccugagaaccgacaucuacagcaagaagacccuggccaagagcaagggcgccagcgccggcagagaguggaccgagcaggagacccugcugcugcuggaggcccuggagauguacaaggacgacuggaacaaggugagcgagcacgugggcagcagaacccaggacgagugcauccugcacuuccugagacugcccaucgaggaccccuaccuggagaacagcgacgccagccugggcccccuggccuaccagcccgugcccuucagccagagcggcaaccccgugaugagcaccguggccuuccuggccagcgugguggaccccagaguggccagcgccgccgccaaggccgcccuggaggaguucagcagagugagagaggaggugccccuggagcugguggaggcccacgugaagaaggugcaggaggccgccagagccagcggcaagguggaccccaccuacggccuggagagcagcugcaucgccggcaccggccccgacgagcccgagaagcuggagggcgccgaggaggagaagauggaggccgaccccgacggccagcagcccgagaaggccgagaacaagguggagaacgagaccgacgagggcgacaaggcccaggacggcgagaacgagaagaacagcgagaaggagcaggacagcgaggugagcgaggacaccaagagcgaggagaaggagaccgaggagaacaaggagcugaccgacaccugcaaggagagagagagcgacaccggcaagaagaagguggagcacgagaucagcgagggcaacguggccaccgccgccgccgccgcccuggccagcgccgccaccaaggccaagcaccuggccgccguggaggagagaaagaucaagagccugguggcccugcugguggagacccagaugaagaagcuggagaucaagcugagacacuucgaggagcuggagaccaucauggacagagagaaggaggcccuggagcagcagagacagcagcugcugaccgagagacagaacuuccacauggagcagcugaaguacgccgagcugagagccagacagcagauggagcagcagcagcacggccagaacccccagcaggcccaccagcacagcggcggccccggccuggccccccugggcgccgccggccaccccggcaugaugccccaccagcagcccccccccuacccccugaugcaccaccagaugccccccccccaccccccccagcccggccagauccccggccccggcagcaugaugcccggccagcacaugcccggcagaaugauccccaccguggccgccaacauccaccccagcggcagcggccccaccccccccggcaugccccccaugcccggcaacauccugggccccagagugccccugaccgcccccaacggcauguaccccccccccccccagcagcagccccccccccccccccccgccgacggcgugccccccccccccgcccccggcccccccgccagcgccgcccccuaa

SEQ ID NO: 23732 - RNA, 3459 nt, Artificial Sequence
  SMARCC2__Homo_sapiens__NP_001123892
auggccgugagaaagaaggacggcggccccaacgugaaguacuacgaggccgccgacaccgugacccaguucgacaacgugagacuguggcugggcaagaacuacaagaaguacauccaggccgagccccccaccaacaagagccugagcagccugguggugcagcugcugcaguuccaggaggagguguucggcaagcacgugagcaacgccccccugaccaagcugcccaucaagugcuuccuggacuucaaggccggcggcagccugugccacauccuggccgccgccuacaaguucaagagcgaccagggcuggagaagauacgacuuccagaaccccagcagaauggacagaaacguggagauguucaugaccaucgagaagagccuggugcagaacaacugccugagcagacccaacaucuuccugugccccgagaucgagcccaagcugcugggcaagcugaaggacaucaucaagagacaccagggcaccgugaccgaggacaagaacaacgccagccacgugguguaccccgugcccggcaaccuggaggaggaggagugggugagacccgugaugaagagagacaagcaggugcugcugcacuggggcuacuaccccgacagcuacgacaccuggauccccgccagcgagaucgaggccagcguggaggacgcccccacccccgagaagcccagaaaggugcacgccaaguggauccuggacaccgacaccuucaacgaguggaugaacgaggaggacuacgaggugaacgacgacaagaaccccgugagcagaagaaagaagaucagcgccaagacccugaccgacgaggugaacagccccgacagcgacagaagagacaagaagggcggcaacuacaagaagagaaagagaagccccagccccagccccacccccgaggccaagaagaagaacgccaagaagggccccagcacccccuacaccaagagcaagagaggccacagagaggaggagcaggaggaccugaccaaggacauggacgagcccagccccgugcccaacguggaggaggugacccugcccaagaccgugaacaccaagaaggacagcgagagcgcccccgugaagggcggcaccaugaccgaccuggacgagcaggaggacgagagcauggagaccaccggcaaggacgaggacgagaacagcaccggcaacaagggcgagcagaccaagaaccccgaccugcacgaggacaacgugaccgagcagacccaccacaucaucauccccagcuacgccgccugguucgacuacaacagcgugcacgccaucgagagaagagcccugcccgaguucuucaacggcaagaacaagagcaagacccccgagaucuaccuggccuacagaaacuucaugaucgacaccuacagacugaacccccaggaguaccugaccagcaccgccugcagaagaaaccuggccggcgacgugugcgccaucaugagagugcacgccuuccuggagcaguggggccugaucaacuaccagguggacgccgagagcagacccacccccaugggccccccccccaccagccacuuccacgugcuggccgacacccccagcggccuggugccccugcagcccaagaccccccagggcagacagguggacgccgacaccaaggccggcagaaagggcaaggagcuggacgaccuggugcccgagaccgccaagggcaagcccgagcugcagaccagcgccagccagcagaugcugaacuuccccgacaagggcaaggagaagcccaccgacaugcagaacuucggccugagaaccgacauguacaccaagaagaacgugcccagcaagagcaaggccgccgccagcgccaccagagaguggaccgagcaggagacccugcugcugcuggaggcccuggagauguacaaggacgacuggaacaaggugagcgagcacgugggcagcagaacccaggacgagugcauccugcacuuccugagacugcccaucgaggaccccuaccuggaggacagcgaggccagccugggcccccuggccuaccagcccauccccuucagccagagcggcaaccccgugaugagcaccguggccuuccuggccagcgugguggaccccagaguggccagcgccgccgccaagagcgcccuggaggaguucagcaagaugaaggaggaggugcccaccgcccugguggaggcccacgugagaaagguggaggaggccgccaaggugaccggcaaggccgaccccgccuucggccuggagagcagcggcaucgccggcaccaccagcgacgagcccgagagaaucgaggagagcggcaacgacgaggccagaguggagggccaggccaccgacgagaagaaggagcccaaggagcccagagagggcggcggcgccaucgaggaggaggccaaggagaagaccagcgaggcccccaagaaggacgaggagaagggcaaggagggcgacagcgagaaggagagcgagaagagcgacggcgaccccaucguggaccccgagaaggagaaggagcccaaggagggccaggaggaggugcugaaggaggugguggagagcgagggcgagagaaagaccaagguggagagagacaucggcgagggcaaccugagcaccgccgccgccgccgcccuggccgccgccgccgugaaggccaagcaccuggccgccguggaggagagaaagaucaagagccugguggcccugcugguggagacccagaugaagaagcuggagaucaagcugagacacuucgaggagcuggagaccaucauggacagagagagagaggcccuggaguaccagagacagcagcugcuggccgacagacaggccuuccacauggagcagcugaaguacgccgagaugagagccagacagcagcacuuccagcagaugcaccagcagcagcagcagcccccccccgcccugccccccggcagccagcccaucccccccaccggcgccgccggcccccccgccgugcacggccuggccguggcccccgccagcguggugcccgcccccgccggcagcggcgccccccccggcagccugggccccagcgagcagaucggccaggccggcagcaccgccggcccccagcagcagcagcccgccggcgccccccagcccggcgccgugccccccggcgugcccccccccggcccccacggccccagccccuuccccaaccagcagaccccccccagcaugaugcccggcgccgugcccggcagcggccaccccggcguggccgcccagagccccgccaucguggccgccgugcagggcaaccugcugcccagcgccagcccccugcccgaccccggcaccccccugccccccgaccccaccgcccccagccccggcaccgugacccccgugccccccccccaguaa

SEQ ID NO: 23733 - RNA, 1548 nt, Artificial Sequence
  SMARCD1__Homo_sapiens__NP_003067
auggccgccagagccggcuuccagagcguggcccccagcggcggcgccggcgccagcggcggcgccggcgccgccgccgcccugggccccggcggcacccccggcccccccgugagaaugggccccgcccccggccagggccuguacagaagccccaugcccggcgccgccuaccccagacccggcaugcugcccggcagcagaaugaccccccagggccccagcaugggcccccccggcuacggcggcaaccccagcgugagacccggccuggcccagagcggcauggaccagagcagaaagagacccgccccccagcagauccagcaggugcagcagcaggccgugcagaacagaaaccacaacgccaagaagaagaagauggccgacaagauccugccccagagaaucagagagcuggugcccgagagccaggccuacauggaccugcuggccuucgagagaaagcuggaccagaccaucaugagaaagagacuggacauccaggaggcccugaagagacccaucaagcagaagagaaagcugagaaucuucaucagcaacaccuucaaccccgccaagagcgacgccgaggacggcgagggcaccguggccagcugggagcugagaguggagggcagacugcuggaggacagcgcccugagcaaguacgacgccaccaagcagaagagaaaguucagcagcuucuucaagagccuggugaucgagcuggacaaggaccuguacggccccgacaaccaccugguggaguggcacagaaccgccaccacccaggagaccgacggcuuccaggugaagagacccggcgacgugaacgugagaugcaccgugcugcugaugcuggacuaccagcccccccaguucaagcuggaccccagacuggccagacugcugggcauccacacccagaccagacccgugaucauccaggcccuguggcaguacaucaagacccacaagcugcaggacccccacgagagagaguucgugaucugcgacaaguaccugcagcagaucuucgagagccagagaaugaaguucagcgagaucccccagagacugcacgcccugcugaugccccccgagcccaucaucaucaaccacgugaucagcguggaccccaacgaccagaagaagaccgccugcuacgacaucgacguggagguggacgacacccugaagacccagaugaacagcuuccugcugagcaccgccagccagcaggagaucgccacccuggacaacaagauccacgagaccaucgagaccaucaaccagcugaagacccagagagaguucaugcugagcuucgccagagacccccagggcuucaucaacgacuggcugcagagccagugcagagaccugaagaccaugaccgacguggugggcaaccccgaggaggagagaagagccgaguucuacuuccagcccugggcccaggaggccgugugcagauacuucuacagcaaggugcagcagagaagacaggagcuggagcaggcccugggcaucagaaacaccuaa

SEQ ID NO: 23734 - RNA, 1452 nt, Artificial Sequence
  SMARCD3__Homo_sapiens__NP_001003801
auggccgccgacgagguggccggcggcgccagaaaggccaccaagagcaagcuguucgaguuccuggugcacggcgugagacccggcaugcccagcggcgccagaaugccccaccagggcgcccccaugggcccccccggcagccccuacaugggcagccccgccgugagacccggccuggcccccgccggcauggagcccgccagaaagagagccgcccccccccccggccagagccaggcccagagccagggccagcccgugcccaccgcccccgccagaagcagaagcgccaagagaagaaagauggccgacaagauccugccccagagaaucagagagcuggugcccgagagccaggccuacauggaccugcuggccuucgagagaaagcuggaccagaccaucaugagaaagagaguggacauccaggaggcccugaagagacccaugaagcagaagagaaagcugagacuguacaucagcaacaccuucaaccccgccaagcccgacgccgaggacagcgacggcagcaucgccagcugggagcugagaguggagggcaagcugcuggacgaccccagcaagcagaagagaaaguucagcagcuucuucaagagccuggugaucgagcuggacaaggaccuguacggccccgacaaccaccugguggaguggcacagaacccccaccacccaggagaccgacggcuuccaggugaagagacccggcgaccugagcgugagaugcacccugcugcugaugcuggacuaccagcccccccaguucaagcuggaccccagacuggccagacugcugggccugcacacccagagcagaagcgccaucgugcaggcccuguggcaguacgugaagaccaacagacugcaggacagccacgacaaggaguacaucaacggcgacaaguacuuccagcagaucuucgacugccccagacugaaguucagcgagaucccccagagacugaccgcccugcugcugccccccgaccccaucgugaucaaccacgugaucagcguggaccccagcgaccagaagaagaccgccugcuacgacaucgacguggagguggaggagccccugaagggccagaugagcagcuuccugcugagcaccgccaaccagcaggagaucagcgcccuggacagcaagauccacgagaccaucgagagcaucaaccagcugaagauccagagagacuucaugcugagcuucagcagagaccccaagggcuacgugcaggaccugcugagaagccagagcagagaccugaaggugaugaccgacguggccggcaaccccgaggaggagagaagagccgaguucuaccaccagcccuggagccaggaggccgugagcagauacuucuacugcaagauccagcagagaagacaggagcuggagcagagccugguggugagaaacaccuaa

SEQ ID NO: 23735 - RNA, 1236 nt, Artificial Sequence
  SMARCE1__Homo_sapiens__NP_003070
augagcaagagacccagcuacgcccccccccccacccccgcccccgccacccagaugcccagcacccccggcuucgugggcuacaaccccuacagccaccuggccuacaacaacuacagacugggcggcaaccccggcaccaacagcagagugaccgccagcagcggcaucaccauccccaagccccccaagccccccgacaagccccugaugcccuacaugagauacagcagaaaggugugggaccaggugaaggccagcaaccccgaccugaagcugugggagaucggcaagaucaucggcggcauguggagagaccugaccgacgaggagaagcaggaguaccugaacgaguacgaggccgagaagaucgaguacaacgagagcaugaaggccuaccacaacagccccgccuaccuggccuacaucaacgccaagagcagagccgaggccgcccuggaggaggagagcagacagagacagagcagaauggagaagggcgagcccuacaugagcauccagcccgccgaggaccccgacgacuacgacgacggcuucagcaugaagcacaccgccaccgccagauuccagagaaaccacagacugaucagcgagauccugagcgagagcguggugcccgacgugagaagcguggugaccaccgccagaaugcaggugcugaagagacaggugcagagccugauggugcaccagagaaagcuggaggccgagcugcugcagaucgaggagagacaccaggagaagaagagaaaguuccuggagagcaccgacagcuucaacaacgagcugaagagacugugcggccugaagguggagguggacauggagaagaucgccgccgagaucgcccaggccgaggagcaggccagaaagagacaggaggagagagagaaggaggccgccgagcaggccgagagaagccagagcagcaucgugcccgaggaggagcaggccgccaacaagggcgaggagaagaaggacgacgagaacauccccauggagaccgaggagacccaccuggaggagaccaccgagagccagcagaacggcgaggagggcaccagcacccccgaggacaaggagagcggccaggagggcguggacagcauggccgaggagggcaccagcgacagcaacaccggcagcgagagcaacagcgccaccguggaggagccccccaccgaccccauccccgaggacgagaagaaggaguaa

SEQ ID NO: 23736 - RNA, 3636 nt, Artificial Sequence
  SMC1A__Homo_sapiens__NP_001268392
augcuggaggugagcauccccaccccccacagauacgugagaggcaagagcaaccugauggacgccaucagcuucgugcugggcgagaagaccagcaaccugagagugaagacccugagagaccugauccacggcgcccccgugggcaagcccgccgccaacagagccuucgugagcaugguguacagcgaggagggcgccgaggacagaaccuucgccagagugaucgugggcggcagcagcgaguacaagaucaacaacaagguggugcagcugcacgaguacagcgaggagcuggagaagcugggcauccugaucaaggccagaaacuuccugguguuccagggcgccguggagagcaucgccaugaagaaccccaaggagagaaccgcccuguucgaggagaucagcagaagcggcgagcuggcccaggaguacgacaagagaaagaaggagauggugaaggccgaggaggacacccaguucaacuaccacagaaagaagaacaucgccgccgagagaaaggaggccaagcaggagaaggaggaggccgacagauaccagagacugaaggacgagguggugagagcccaggugcagcugcagcuguucaagcuguaccacaacgagguggagaucgagaagcugaacaaggagcuggccagcaagaacaaggagaucgagaaggacaagaagagaauggacaagguggaggacgagcugaaggagaagaagaaggagcugggcaagaugaugagagagcagcagcagaucgagaaggagaucaaggagaaggacagcgagcugaaccagaagagaccccaguacaucaaggccaaggagaacaccagccacaagaucaagaagcuggaggccgccaagaagagccugcagaacgcccagaagcacuacaagaagagaaagggcgacauggacgagcuggagaaggagaugcugagcguggagaaggccagacaggaguucgaggagagaauggaggaggagagccagagccagggcagagaccugacccuggaggagaaccaggugaagaaguaccacagacugaaggaggaggccagcaagagagccgccacccuggcccaggagcuggagaaguucaacagagaccagaaggccgaccaggacagacuggaccuggaggagagaaagaagguggagaccgaggccaagaucaagcagaagcugagagagaucgaggagaaccagaagagaaucgagaagcuggaggaguacaucaccaccagcaagcagagccuggaggagcagaagaagcuggagggcgagcugaccgaggagguggagauggccaagagaagaaucgacgagaucaacaaggagcugaaccaggugauggagcagcugggcgacgccagaaucgacagacaggagagcagcagacagcagagaaaggccgagaucauggagagcaucaagagacuguaccccggcagcguguacggcagacugaucgaccugugccagcccacccagaagaaguaccagaucgccgugaccaaggugcugggcaagaacauggacgccaucaucguggacagcgagaagaccggcagagacugcauccaguacaucaaggagcagagaggcgagcccgagaccuuccugccccuggacuaccuggaggugaagcccaccgacgagaagcugagagagcugaagggcgccaagcuggugaucgacgugaucagauacgagcccccccacaucaagaaggcccugcaguacgccugcggcaacgcccuggugugcgacaacguggaggacgccagaagaaucgccuucggcggccaccagagacacaagaccguggcccuggacggcacccuguuccagaagagcggcgugaucagcggcggcgccagcgaccugaaggccaaggccagaagaugggacgagaaggccguggacaagcugaaggagaagaaggagagacugaccgaggagcugaaggagcagaugaaggccaagagaaaggaggccgagcugagacaggugcagagccaggcccacggccugcagaugagacugaaguacagccagagcgaccuggagcagaccaagaccagacaccuggcccugaaccugcaggagaagagcaagcuggagagcgagcuggccaacuucggccccagaaucaacgacaucaagagaaucauccagagcagagagagagagaugaaggaccugaaggagaagaugaaccagguggaggacgagguguucgaggaguucugcagagagaucggcgugagaaacaucagagaguucgaggaggagaaggugaagagacagaacgagaucgccaagaagagacuggaguucgagaaccagaagaccagacugggcauccagcuggacuucgagaagaaccagcugaaggaggaccaggacaaggugcacaugugggagcagaccgugaagaaggacgagaacgagaucgagaagcugaagaaggaggagcagagacacaugaagaucaucgacgagaccauggcccagcugcaggaccugaagaaccagcaccuggccaagaagagcgaggugaacgacaagaaccacgagauggaggagaucagaaagaagcugggcggcgccaacaaggagaugacccaccugcagaaggaggugaccgccaucgagaccaagcuggagcagaagagaagcgacagacacaaccugcugcaggccugcaagaugcaggacaucaagcugccccugagcaagggcaccauggacgacaucagccaggaggagggcagcagccagggcgaggacagcgugagcggcagccagagaaucagcagcaucuacgccagagaggcccugaucgagaucgacuacggcgaccugugcgaggaccugaaggacgcccaggccgaggaggagaucaagcaggagaugaacacccugcagcagaagcugaacgagcagcagagcgugcugcagagaaucgccgcccccaacaugaaggccauggagaagcuggagagcgugagagacaaguuccaggagaccagcgacgaguucgaggccgccagaaagagagccaagaaggccaagcaggccuucgagcagaucaagaaggagagauucgacagauucaacgccugcuucgagagcguggccaccaacaucgacgagaucuacaaggcccugagcagaaacagcagcgcccaggccuuccugggccccgagaaccccgaggagcccuaccuggacggcaucaacuacaacugcguggcccccggcaagagauucagacccauggacaaccugagcggcggcgagaagaccguggccgcccuggcccugcuguucgccauccacagcuacaagcccgcccccuucuucgugcuggacgagaucgacgccgcccuggacaacaccaacaucggcaagguggccaacuacaucaaggagcagagcaccugcaacuuccaggccaucgugaucagccugaaggaggaguucuacaccaaggccgagagccugaucggcguguaccccgagcagggcgacugcgugaucagcaaggugcugaccuucgaccugaccaaguaccccgacgccaaccccaaccccaacgagcaguaa

SEQ ID NO: 23737 - RNA, 3486 nt, Artificial Sequence
  SMC1B__Homo_sapiens__NP_001278430
auggcccaccuggagcugcugcugguggagaacuucaagagcuggagaggcagacaggugaucggccccuucagaagauucaccugcaucaucggccccaacggcagcggcaagagcaacgugauggacgcccugagcuucgugaugggcgagaagaucgccaaccugagagugaagaacauccaggagcugauccacggcgcccacaucggcaagcccaucagcagcagcgccagcgugaagaucaucuacguggaggagagcggcgaggagaagaccuucgccagaaucaucagaggcggcugcagcgaguucagauucaacgacaaccuggugagcagaagcguguacaucgccgagcuggagaagaucggcaucaucgugaaggcccagaacugccugguguuccagggcaccguggagagcaucagcgugaagaagcccaaggagagaacccaguucuucgaggagaucagcaccagcggcgagcugaucggcgaguacgaggagaagaagagaaagcugcagaaggccgaggaggacgcccaguucaacuucaacaagaagaagaacaucgccgccgagagaagacaggccaagcuggagaaggaggaggccgagagauaccagagccugcuggaggagcugaagaugaacaagauccagcugcagcuguuccagcuguaccacaacgagaagaagauccaccugcugaacaccaagcuggagcacgugaacagagaccugagcgugaagagagagagccugagccaccacgagaacaucgugaaggccagaaagaaggagcacggcaugcugaccagacagcugcagcagaccgagaaggagcugaagagcguggagacccugcugaaccagaagagaccccaguacaucaaggccaaggagaacaccagccaccaccugaagaagcuggacguggccaagaagagcaucaaggacagcgagaagcagugcagcaagcaggaggacgacaucaaggcccuggagaccgagcuggccgaccuggacgccgccuggagaagcuucgagaagcagaucgaggaggagauccugcacaagaagagagacaucgagcuggaggccagccagcuggacagauacaaggagcugaaggagcaggugagaaagaagguggccaccaugacccagcagcuggagaagcugcagugggagcagaagaccgacgaggagagacuggccuucgagaagagaagacacggcgaggugcagggcaaccugaagcagaucaaggagcagaucgaggaccacaagaagagaaucgagaagcuggaggaguacaccaagaccugcauggacugccugaaggagaagaagcagcaggaggagacccugguggacgagaucgagaagaccaagagcagaaugagcgaggugaacgaggagcugaaccugaucagaagcgagcugcagaacgccggcaucgacacccacgagggcaagagacagcagaagagagccgaggugcuggagcaccugaagagacuguaccccgacagcguguucggcagacuguucgaccugugccaccccauccacaagaaguaccagcuggccgugaccaagguguucggcagauucaucaccgccaucgugguggccagcgagaagguggccaaggacugcaucagauuccugaaggaggagagagccgagcccgagaccuuccuggcccuggacuaccuggacaucaagcccaucaacgagagacugagagagcugaagggcugcaagauggugaucgacgugaucaagacccaguucccccagcugaagaaggugauccaguucgugugcggcaacggccuggugugcgagaccauggaggaggccagacacaucgcccugagcggccccgagagacagaagaccguggcccuggacggcacccuguuccugaagagcggcgugaucagcggcggcagcagcgaccugaaguacaaggccagaugcugggacgagaaggagcugaagaaccugagagacagaagaagccagaagauccaggagcugaagggccugaugaagacccugagaaaggagaccgaccugaagcagauccagacccugauccagggcacccagaccagacugaaguacagccagaacgagcuggagaugaucaagaagaagcaccugguggccuucuaccaggagcagagccagcugcagagcgagcugcugaacaucgagagccagugcaucaugcugagcgagggcaucaaggagagacagagaagaaucaaggaguuccaggagaagaucgacaagguggaggacgacaucuuccagcacuucugcgaggagaucggcguggagaacaucagagaguucgagaacaagcacgugaagagacagcaggagaucgaccagaagagacuggaguucgagaagcagaagaccagacugaacgugcagcuggaguacagcagaagccaccugaagaagaagcugaacaagaucaacacccugaaggagaccauccagaagggcagcgaggacaucgaccaccugaagaaggccgaggagaacugccugcagaccgugaacgagcugauggccaagcagcagcagcugaaggacaucagagugacccagaacagcagcgccgagaaggugcagacccagaucgaggaggagagaaagaaguuccuggccguggacagagaggugggcaagcugcagaaggagguggugagcauccagaccagccuggagcagaagagacuggagaagcacaaccugcugcuggacugcaaggugcaggacaucgagaucauccugcugagcggcagccuggacgacaucaucgagguggagaugggcaccgaggccgagagcacccaggccaccaucgacaucuacgagaaggaggaggccuucgagaucgacuacagcagccugaaggaggaccugaaggcccugcagagcgaccaggagaucgaggcccaccugagacugcugcugcagcagguggccagccaggaggacauccugcugaagaccgccgcccccaaccugagagcccuggagaaccugaagaccgugagagacaaguuccaggagagcaccgacgccuucgaggccagcagaaaggaggccagacugugcagacaggaguucgagcaggugaagaagagaagauacgaccuguucacccagugcuucgagcacgugagcaucagcaucgaccagaucuacaagaagcugugcagaaacaacagcgcccaggugagcagcuacaucaaggagcagacccaggaccaguuccagaugaucgugaucagccugaaggaggaguucuacagcagagccgacgcccugaucggcaucuaccccgaguacgacgacugcauguucagcagagugcugacccuggaccugagccaguaccccgacaccgagggccaggagagcagcaagagacacggcgagagcagauaa

SEQ ID NO: 23738 - RNA, 3594 nt, Artificial Sequence
  SMC2__Homo_sapiens__XP_011516451
augcacaucaagagcaucauccuggagggcuucaagagcuacgcccagagaaccgaggugaacggcuucgacccccuguucaacgccaucaccggccugaacggcagcggcaagagcaacauccuggacagcaucugcuuccugcugggcaucagcaaccugagccaggugagagccagcaaccugcaggaccugguguacaagaacggccaggccggcaucaccaaggccagcgugagcaucaccuucgacaacagcgacaagaagcagagcccccugggcuucgaggugcacgacgagaucaccgugaccagacagguggugaucggcggcagaaacaaguaccugaucaacggcgugaacgccaacaacaccagagugcaggaccuguucugcagcgugggccugaacgugaacaacccccacuuccugaucaugcagggcagaaucaccaaggugcugaacaugaagccccccgagauccugagcaugaucgaggaggccgccggcaccagaauguacgaguacaagaagaucgccgcccagaagaccaucgagaagaaggaggccaagcugaaggagaucaagaccauccuggaggaggagaucacccccaccauccagaagcugaaggaggagagaagcagcuaccuggaguaccagaaggugaugagagagaucgagcaccugagcagacuguacaucgccuaccaguuccugcuggccgaggacaccaaggugagaagcgccgaggagcugaaggagaugcaggacaaggugaucaagcugcaggaggagcugagcgagaacgacaagaagaucaaggcccugaaccacgagaucgaggagcuggagaagagaaaggacaaggagaccggcggcauccugagaagccuggaggacgcccuggccgaggcccagagagugaacaccaagagccagagcgccuucgaccugaagaagaagaaccuggccugcgaggagagcaagagaaaggagcuggagaagaacaugguggaggacagcaagacccuggccgccaaggagaaggaggugaagaagaucaccgacggccugcacgcccugcaggaggccagcaacaaggacgccgaggcccuggccgccgcccagcagcacuucaacgccgugagcgccggccugagcagcaacgaggacggcgccgaggccacccuggccggccagaugauggccugcaagaacgacaucagcaaggcccagaccgaggccaagcaggcccagaugaagcugaagcacgcccagcaggagcugaagaacaagcaggccgaggugaagaagauggacagcggcuacagaaaggaccaggaggcccuggaggccgugaagagacugaaggagaagcuggaggccgagaugaagaagcugaacuacgaggagaacaaggaggagagccugcuggagaagagaagacagcugagcagagacaucggcagacugaaggagaccuacgaggcccugcuggccagauuccccaaccugagauucgccuacaaggaccccgagaagaacuggaacagaaacugcgugaagggccugguggccagccugaucagcgugaaggacaccagcgccaccaccgcccuggagcugguggccggcgagagacuguacaacguggugguggacaccgaggugaccggcaagaagcugcuggagagaggcgagcugaagagaagauacaccaucaucccccugaacaagaucagcgccagaugcaucgcccccgagacccugagaguggcccagaaccuggugggccccgacaacgugcacguggcccugagccugguggaguacaagcccgagcugcagaaggccauggaguucguguucggcaccaccuucgugugcgacaacauggacaacgccaagaagguggccuucgacaagagaaucaugaccagaaccgugacccugggcggcgacguguucgacccccacggcacccugagcggcggcgccagaagccaggccgccagcauccugaccaaguuccaggagcugaaggacgugcaggacgagcugagaaucaaggagaacgagcugagagcccuggaggaggagcuggccggccugaagaacaccgccgagaaguacagacagcugaagcagcagugggagaugaagaccgaggaggccgaccugcugcagaccaagcugcagcagagcagcuaccacaagcagcaggaggagcuggacgcccugaagaagaccaucgaggagagcgaggagacccugaagaacaccaaggagauccagagaaaggccgaggagaaguacgaggugcuggagaacaagaugaagaacgccgaggccgagagagagagagagcugaaggacgcccagaagaagcuggacugcgccaagaccaaggccgacgccagcagcaagaagaugaaggagaagcagcaggagguggaggccaucacccuggagcuggaggagcugaagagagagcacaccagcuacaagcagcagcuggaggccgugaacgaggccaucaagagcuacgagagccagaucgaggugauggccgccgagguggccaagaacaaggagagcgugaacaaggcccaggaggaggugaccaagcagaaggaggugaucaccgcccaggacaccgugaucaaggccaaguacgccgagguggccaagcacaaggagcagaacaacgacagccagcugaagaucaaggagcuggaccacaacaucagcaagcacaagagagaggccgaggacggcgccgccaaggugagcaagaugcugaaggacuacgacuggaucaacgccgagagacaccuguucggccagcccaacagcgccuacgacuucaagaccaacaaccccaaggaggccggccagagacugcagaagcugcaggagaugaaggagaagcugggcagaaacgugaacaugagagccaugaacgugcugaccgaggccgaggagagauacaacgaccugaugaagaagaagagaaucguggagaacgacaagagcaagauccugaccaccaucgaggaccuggaccagaagaagaaccaggcccugaacaucgccuggcagaaggugaacaaggacuucggcagcaucuucagcacccugcugcccggcgccaacgccaugcuggccccccccgagggccagaccgugcuggacggccuggaguucaagguggcccugggcaacaccuggaaggagaaccugaccgagcugagcggcggccagagaagccugguggcccugagccugauccugagcaugcugcuguucaagcccgcccccaucuacauccuggacgagguggacgccgcccuggaccugagccacacccagaacaucggccagaugcugagaacccacuucacccacagccaguucaucguggugagccugaaggagggcauguucaacaacgccaacgugcuguucaagaccaaguucguggacggcgugagcaccguggccagauucacccagugccagaacggcaagaucagcaaggaggccaagagcaaggccaagccccccaagggcgcccacguggagguguaa

SEQ ID NO: 23739 - RNA, 3654 nt, Artificial Sequence
  SMC3__Homo_sapiens__NP_005436
auguacaucaagcaggugaucauccagggcuucagaagcuacagagaccagaccaucguggaccccuucagcagcaagcacaacgugaucgugggcagaaacggcagcggcaagagcaacuucuucuacgccauccaguucgugcugagcgacgaguucagccaccugagacccgagcagagacuggcccugcugcacgagggcaccggccccagagugaucagcgccuucguggagaucaucuucgacaacagcgacaacagacugcccaucgacaaggaggaggugagccugagaagagugaucggcgccaagaaggaccaguacuuccuggacaagaagauggugaccaagaacgacgugaugaaccugcuggagagcgccggcuucagcagaagcaaccccuacuacaucgugaagcagggcaagaucaaccagauggccaccgcccccgacagccagagacugaagcugcugagagagguggccggcaccagaguguacgacgagagaaaggaggagagcaucagccugaugaaggagaccgagggcaagagagagaagaucaacgagcugcugaaguacaucgaggagagacugcacacccuggaggaggagaaggaggagcuggcccaguaccagaagugggacaagaugagaagagcccuggaguacaccaucuacaaccaggagcugaacgagaccagagccaagcuggacgagcugagcgccaagagagagaccagcggcgagaagagcagacagcugagagacgcccagcaggacgccagagacaagauggaggacaucgagagacaggugagagagcugaagaccaagaucagcgccaugaaggaggagaaggagcagcugagcgccgagagacaggagcagaucaagcagagaaccaagcuggagcugaaggccaaggaccugcaggacgagcuggccggcaacagcgagcagagaaagagacugcugaaggagagacagaagcugcuggagaagaucgaggagaagcagaaggagcuggccgagaccgagcccaaguucaacagcgugaaggagaaggaggagagaggcaucgccagacuggcccaggccacccaggagagaaccgaccuguacgccaagcagggcagaggcagccaguucaccagcaaggaggagagagacaaguggaucaagaaggagcugaagagccuggaccaggccaucaacgacaagaagagacagaucgccgccauccacaaggaccuggaggacaccgaggccaacaaggagaagaaccuggagcaguacaacaagcuggaccaggaccugaacgaggugaaggccagaguggaggagcuggacagaaaguacuacgaggugaagaacaagaaggacgagcugcagagcgagagaaacuaccuguggagagaggagaacgccgagcagcaggcccuggccgccaagagagaggaccuggagaagaagcagcagcugcugagagccgccaccggcaaggccauccugaacggcaucgacagcaucaacaaggugcuggaccacuucagaagaaagggcaucaaccagcacgugcagaacggcuaccacggcaucgugaugaacaacuucgagugcgagcccgccuucuacaccugcguggaggugaccgccggcaacagacuguucuaccacaucguggacagcgacgaggugagcaccaagauccugauggaguucaacaagaugaaccugcccggcgaggugaccuuccugccccugaacaagcuggacgugagagacaccgccuaccccgagaccaacgacgccauccccaugaucagcaagcugagauacaaccccagauucgacaaggccuucaagcacguguucggcaagacccugaucugcagaagcauggaggugagcacccagcuggccagagccuucaccauggacugcaucacccuggagggcgaccaggugagccacagaggcgcccugaccggcggcuacuacgacaccagaaagagcagacuggagcugcagaaggacgugagaaaggccgaggaggagcugggcgagcuggaggccaagcugaacgagaaccugagaagaaacaucgagagaaucaacaacgagaucgaccagcugaugaaccagaugcagcagaucgagacccagcagagaaaguucaaggccagcagagacagcauccugagcgagaugaagaugcugaaggagaagagacagcagagcgagaagaccuucaugcccaagcagagaagccugcagagccuggaggccagccugcacgccauggagagcaccagagagagccugaaggccgagcugggcaccgaccugcugagccagcugagccuggaggaccagaagagaguggacgcccugaacgacgagaucagacagcugcagcaggagaacagacagcugcugaacgagagaaucaagcuggagggcaucaucaccagaguggagaccuaccugaacgagaaccugagaaagagacuggaccagguggagcaggagcugaacgagcugagagagaccgagggcggcaccgugcugaccgccaccaccagcgagcuggaggccaucaacaagagagugaaggacaccauggccagaagcgaggaccuggacaacagcaucgacaagaccgaggccggcaucaaggagcugcagaagagcauggagagauggaagaacauggagaaggagcacauggacgccaucaaccacgacaccaaggagcuggagaagaugaccaacagacagggcaugcugcugaagaagaaggaggagugcaugaagaagaucagagagcugggcagccugccccaggaggccuucgagaaguaccagacccugagccugaagcagcuguucagaaagcuggagcagugcaacaccgagcugaagaaguacagccacgugaacaagaaggcccuggaccaguucgugaacuucagcgagcagaaggagaagcugaucaagagacaggaggagcuggacagaggcuacaagagcaucauggagcugaugaacgugcuggagcugagaaaguacgaggccauccagcugaccuucaagcaggugagcaagaacuucagcgagguguuccagaagcuggugcccggcggcaaggccacccuggugaugaagaagggcgacguggagggcagccagagccaggacgagggcgagggcagcggcgagagcgagagaggcagcggcagccagagcagcgugcccagcguggaccaguucaccggcgugggcaucagagugagcuucaccggcaagcagggcgagaugagagagaugcagcagcugagcggcggccagaagagccugguggcccuggcccugaucuucgccauccagaagugcgaccccgcccccuucuaccuguucgacgagaucgaccaggcccuggacgcccagcacagaaaggccgugagcgacaugaucauggagcuggccgugcacgcccaguucaucaccaccaccuucagacccgagcugcuggagagcgccgacaaguucuacggcgugaaguucagaaacaaggugagccacaucgacgugaucaccgccgagauggccaaggacuucguggaggacgacaccacccacggcuaa

SEQ ID NO: 23740 - RNA, 3867 nt, Artificial Sequence
  SMC4__Homo_sapiens__NP_005487
augcccagaaagggcacccagcccagcaccgccagaagaagagaggagggcccccccccccccagccccgacggcgccagcagcgacgccgagcccgagccccccagcggcagaaccgagagccccgccaccgccgccgagaccgccagcgaggagcuggacaacagaagccuggaggagauccugaacagcaucccccccccccccccccccgccaugaccaacgaggccggcgcccccagacugaugaucacccacaucgugaaccagaacuucaagagcuacgccggcgagaagauccugggccccuuccacaagagauucagcugcaucaucggccccaacggcagcggcaagagcaacgugaucgacagcaugcuguucguguucggcuacagagcccagaagaucagaagcaagaagcugagcgugcugauccacaacagcgacgagcacaaggacauccagagcugcaccguggaggugcacuuccagaagaucaucgacaaggagggcgacgacuacgaggugauccccaacagcaacuucuacgugagcagaaccgccugcagagacaacaccagcguguaccacaucagcggcaagaagaagaccuucaaggacgugggcaaccugcugagaagccacggcaucgaccuggaccacaacagauuccugauccugcagggcgagguggagcagaucgccaugaugaagcccaagggccagaccgagcacgacgagggcaugcuggaguaccuggaggacaucaucggcugcggcagacugaacgagcccaucaaggugcugugcagaagaguggagauccugaacgagcacagaggcgagaagcugaacagagugaagaugguggagaaggagaaggacgcccuggagggcgagaagaacaucgccaucgaguuccugacccuggagaacgagaucuucagaaagaagaaccacgugugccaguacuacaucuacgagcugcagaagagaaucgccgagauggagacccagaaggagaagauccacgaggacaccaaggagaucaacgagaagagcaacauccugagcaacgagaugaaggccaagaacaaggacgugaaggacaccgagaagaagcugaacaagaucaccaaguucaucgaggagaacaaggagaaguucacccagcuggaccuggaggacgugcaggugagagagaagcugaagcacgccaccagcaaggccaagaagcuggagaagcagcugcagaaggacaaggagaagguggaggaguucaagagcauccccgccaagagcaacaacaucaucaacgagaccaccaccagaaacaacgcccuggagaaggagaaggagaaggaggagaagaagcugaaggaggugauggacagccugaagcaggagacccagggccugcagaaggagaaggagagcagagagaaggagcugaugggcuucagcaagagcgugaacgaggccagaagcaagauggacguggcccagagcgagcuggacaucuaccugagcagacacaacaccgccgugagccagcugaccaaggccaaggaggcccugaucgccgccagcgagacccugaaggagagaaaggccgccaucagagacaucgagggcaagcugccccagaccgagcaggagcugaaggagaaggagaaggagcugcagaagcugacccaggaggagaccaacuucaagagccuggugcacgaccuguuccagaagguggaggaggccaagagcagccuggccaugaacagaagcagaggcaaggugcuggacgccaucauccaggagaagaagagcggcagaauccccggcaucuacggcagacugggcgaccugggcgccaucgacgagaaguacgacguggccaucagcagcugcugccacgcccuggacuacaucgugguggacagcaucgacaucgcccaggagugcgugaacuuccugaagagacagaacaucggcguggccaccuucaucggccuggacaagauggccgugugggccaagaagaugaccgagauccagacccccgagaacacccccagacuguucgaccuggugaaggugaaggacgagaagaucagacaggccuucuacuucgcccugagagacacccugguggccgacaaccuggaccaggccaccagaguggccuaccagaaggacagaagauggagaguggugacccugcagggccagaucaucgagcagagcggcaccaugaccggcggcggcagcaaggugaugaagggcagaaugggcagcagccuggugaucgagaucagcgaggaggaggugaacaagauggagagccagcugcagaacgacagcaagaaggccaugcagauccaggagcagaaggugcagcuggaggagagaguggugaagcugagacacagcgagagagagaugagaaacacccuggagaaguucaccgccagcauccagagacugaucgagcaggaggaguaccugaacgugcaggugaaggagcuggaggccaacgugcuggccaccgcccccgacaagaagaagcagaagcugcuggaggagaacgugagcgccuucaagaccgaguacgacgccguggccgagaaggccggcaagguggaggccgaggugaagagacugcacaacaccaucguggagaucaacaaccacaagcugaaggcccagcaggacaagcuggacaagaucaacaagcagcuggacgagugcgccagcgccaucaccaaggcccagguggccaucaagaccgccgacagaaaccugcagaaggcccaggacagcgugcugagaaccgagaaggagaucaaggacaccgagaaggagguggacgaccugaccgccgagcugaagagccuggaggacaaggccgccgagguggugaagaacaccaacgccgccgaggagagccugcccgagauccagaaggagcacagaaaccugcugcaggagcugaaggugauccaggagaacgagcacgcccugcagaaggacgcccugagcaucaagcugaagcuggagcagaucgacggccacaucgccgagcacaacagcaagaucaaguacuggcacaaggagaucagcaagaucagccugcaccccaucgaggacaaccccaucgaggagaucagcgugcugagccccgaggaccuggaggccaucaagaaccccgacagcaucaccaaccagaucgcccugcuggaggccagaugccacgagaugaagcccaaccugggcgccaucgccgaguacaagaagaaggaggagcuguaccugcagagaguggccgagcuggacaagaucaccuacgagagagacagcuucagacaggccuacgaggaccugagaaagcagagacugaacgaguucauggccggcuucuacaucaucaccaacaagcugaaggagaacuaccagaugcugacccugggcggcgacgccgagcuggagcugguggacagccuggaccccuucagcgagggcaucauguucagcgugagaccccccaagaagagcuggaagaagaucuucaaccugagcggcggcgagaagacccugagcagccuggcccugguguucgcccugcaccacuacaagcccaccccccuguacuucauggacgagaucgacgccgcccuggacuucaagaacgugagcaucguggccuucuacaucuacgagcagaccaagaacgcccaguucaucaucaucagccugagaaacaacauguucgagaucagcgacagacugaucggcaucuacaagaccuacaacaucaccaagagcguggccgugaaccccaaggagaucgccagcaagggccugugcuaa

SEQ ID NO: 23741 - RNA, 3306 nt, Artificial Sequence
  SMC5__Homo_sapiens__NP_055925
auggccacccccagcaagaagaccagcacccccagcccccagcccagcaagagagcccugcccagagaccccagcagcgaggugcccagcaagagaaagaacagcgccccccagcugccccugcugcagagcagcggccccuucguggagggcagcaucgugagaaucagcauggagaacuuccugaccuacgacaucugcgaggugagccccggcccccaccugaacaugaucgugggcgccaacggcaccggcaagagcagcaucgugugcgccaucugccugggccuggccggcaagcccgccuucaugggcagagccgacaaggugggcuucuucgugaagagaggcugcagcagaggcaugguggagaucgagcuguucagagccagcggcaaccuggugaucaccagagagaucgacguggccaagaaccagagcuucugguucaucaacaagaagagcaccacccagaagaucguggaggagaagguggccgcccugaacauccaggugggcaaccugugccaguuccugccccaggacaaggugggcgaguucgccaagcugagcaagaucgagcugcuggaggccaccgagaagagcaucggcccccccgagaugcacaaguaccacugcgagcugaagaaccugagagagaaggagaagcagcuggagaccagcugcaaggagaagaccgaguaccugcagaagauggugcagagaaacgagagauacaagcaggacguggagagauucuacgagagaaagagacaccuggaccugaucgagaugcuggaggccaagagacccuggguggaguacgagaacgugagacaggaguacgaggaggugaagcuggugagagacagagugaaggaggaggugagaaagcugaaggagggccagauccccgugaccugcagaaucgaggagauggagaacgagagacacaaccuggaggccagaaucaaggagaaggccaccgacaucaaggaggccagccagaagugcaagcagaagcaggacgugaucgagagaaaggacaagcacaucgaggagcugcagcaggcccugaucgugaagcagaacgaggagcuggacagacagagaagaaucggcaacaccagaaagaugaucgaggaccugcagaacgagcugaagaccaccgagaacugcgagaaccugcagccccagaucgacgccaucaccaacgaccugagaagaauccaggacgagaaggcccugugcgagggcgagaucaucgacaagagaagagagagagagacccuggagaaggagaagaagagcguggacgaccacaucgugagauucgacaaccugaugaaccagaaggaggacaagcugagacagagauucagagacaccuacgacgccgugcuguggcugagaaacaacagagacaaguucaagcagagagugugcgagcccaucaugcugaccaucaacaugaaggacaacaagaacgccaaguacaucgagaaccacauccccagcaacgaccugagagccuucguguucgagagccaggaggacauggagguguuccugaaggaggugagagacaacaagaagcugagagugaacgccgugaucgcccccaagagcagcuacgccgacaaggcccccagcagaagccugaacgagcugaagcaguacggcuucuucagcuaccugagagagcuguucgacgcccccgaccccgugaugagcuaccugugcugccaguaccacauccacgaggugcccgugggcaccgagaagaccagagagagaaucgagagagugauccaggagaccagacugaagcagaucuacaccgccgaggagaaguacguggugaagaccagcuucuacagcaacaaggugaucagcagcaacaccagccugaagguggcccaguuccugaccgugaccguggaccuggagcagagaagacaccuggaggagcagcugaaggagauccacagaaagcugcaggccguggacagcggccugaucgcccugagagagaccagcaagcaccuggagcacaaggacaacgagcugagacagaagaagaaggagcugcuggagagaaagaccaagaagagacagcuggagcagaagaucagcagcaagcugggcagccugaagcugauggagcaggacaccugcaaccuggaggaggaggagagaaaggccagcaccaagaucaaggagaucaacgugcagaaggccaagcuggugaccgagcugaccaaccugaucaagaucugcaccagccugcacauccagaagguggaccugauccugcagaacaccaccgugaucagcgagaagaacaagcuggagagcgacuacauggccgccagcagccagcugagacugaccgagcagcacuucaucgagcuggacgagaacagacagagacugcugcagaagugcaaggagcugaugaagagagccagacaggugugcaaccugggcgccgagcagacccugccccaggaguaccagacccaggugcccaccauccccaacggccacaacagcagccugcccaugguguuccaggaccugcccaacacccuggacgagaucgacgcccugcugaccgaggagagaagcagagccagcugcuucaccggccugaaccccaccaucgugcaggaguacaccaagagagaggaggagaucgagcagcugaccgaggagcugaagggcaagaagguggagcuggaccaguacagagagaacaucagccaggugaaggagagauggcugaacccccugaaggagcugguggagaagaucaacgagaaguucagcaacuucuucagcagcaugcagugcgccggcgagguggaccugcacaccgagaacgaggaggacuacgacaaguacggcaucagaaucagagugaaguucagaagcagcacccagcugcacgagcugaccccccaccaccagagcggcggcgagagaagcgugagcaccaugcuguaccugauggcccugcaggagcugaacagaugccccuucagagugguggacgagaucaaccagggcauggaccccaucaacgagagaagaguguucgagaugguggugaacaccgccugcaaggagaacaccagccaguacuucuucaucacccccaagcugcugcagaaccugcccuacagcgagaagaugaccgugcuguucguguacaacggcccccacaugcuggagcccaacaccuggaaccugaaggccuuccagagaagaagaagaagaaucaccuucacccagcccagcuaa

SEQ ID NO: 23742 - RNA, 3276 nt, Artificial Sequence
  SMC6__Homo_sapiens__NP_001135758
auggccaagagaaaggaggagaacuucagcagccccaagaacgccaagagacccagacaggaggagcuggaggacuucgacaaggacggcgacgaggacgagugcaagggcaccacccugaccgccgccgaggugggcaucaucgagagcauccaccugaagaacuucaugugccacagcaugcugggccccuucaaguucggcagcaacgugaacuucguggugggcaacaacggcagcggcaagagcgccgugcugaccgcccugaucgugggccugggcggcagagccguggccaccaacagaggcagcagccugaagggcuucgugaaggacggccagaacagcgccgacaucagcaucacccugagaaacagaggcgacgacgccuucaaggccagcguguacggcaacagcauccugauccagcagcacaucagcaucgacggcagcagaagcuacaagcugaagagcgccaccggcagcguggugagcaccagaaaggaggagcugaucgccauccuggaccacuucaacauccagguggacaaccccgugagcgugcugacccaggagaugagcaagcaguuccugcagagcaagaacgagggcgacaaguacaaguucuucaugaaggccacccagcuggagcagaugaaggaggacuacagcuacaucauggagaccaaggagagaaccaaggagcagauccaccagggcgaggagagacugaccgagcugaagagacagugcguggagaaggaggagagauuccagagcaucgccggccugagcaccaugaagaccaaccuggagagccugaagcacgagauggccugggccguggugaacgagaucgagaagcagcugaacgccaucagagacaacaucaagaucggcgaggacagagccgccagacuggacagaaagauggaggagcagcaggugagacugaacgaggccgagcagaaguacaaggacauccaggacaagcuggagaagaucagcgaggagaccaacgccagagcccccgagugcauggcccugaaggccgacgugguggccaagaagagagccuacaacgaggccgaggugcuguacaacagaagccugaacgaguacaaggcccugaagaaggacgacgagcagcugugcaagagaaucgaggagcugaagaagagcaccgaccagagccuggagcccgagagacuggagagacagaagaagaucagcuggcugaaggagagagugaaggccuuccagaaccaggagaacagcgugaaccaggagaucgagcaguuccagcaggccaucgagaaggacaaggaggagcacggcaagaucaagagagaggagcuggacgugaagcacgcccugagcuacaaccagagacagcugaaggagcugaaggacagcaagaccgacagacugaagagauucggccccaacgugcccgcccugcuggaggccaucgacgacgccuacagacagggccacuucaccuacaagcccgugggcccccugggcgccugcauccaccugagagaccccgagcuggcccuggccaucgagagcugccugaagggccugcugcaggccuacugcugccacaaccacgccgacgagagagugcugcaggcccugaugaagagauucuaccugcccggcaccagcagaccccccaucaucgugagcgaguucagaaacgagaucuacgacgugagacacagagccgccuaccaccccgacuuccccaccgugcugaccgcccuggagaucgacaacgccgugguggccaacagccugaucgacaugagaggcaucgagaccgugcugcugaucaagaacaacagcguggccagagccgugaugcagagccagaagccccccaagaacugcagagaggccuucaccgccgacggcgaccagguguucgccggcagauacuacagcagcgagaacaccagacccaaguuccugagcagagacguggacagcgagaucagcgaccuggagaacgagguggagaacaagaccgcccagauccugaaccugcagcagcaccugagcgcccuggagaaggacaucaagcacaacgaggagcugcugaagagaugccagcugcacuacaaggagcugaagaugaagaucagaaagaacaucagcgagaucagagagcuggagaacaucgaggagcaccagagcguggacaucgccacccuggaggacgaggcccaggagaacaagagcaagaugaagaugguggaggagcacauggagcagcagaaggagaacauggagcaccugaagagccugaagaucgaggccgagaacaaguacgacgccaucaaguucaagaucaaccagcugagcgagcuggccgacccccugaaggacgagcugaaccuggccgacagcgagguggacaaccagaagagaggcaagagacacuacgaggagaagcagaaggagcaccuggacacccugaacaagaagaagagagagcuggacaugaaggagaaggagcuggaggagaagaugagccaggccagacagaucugccccgagagaaucgagguggagaagagcgccagcauccuggacaaggagaucaacagacugagacagaagauccaggccgagcacgccagccacggcgacagagaggagaucaugagacaguaccaggaggccagagagaccuaccuggaccuggacagcaaggugagaacccugaagaaguucaucaagcugcugggcgagaucauggagcacagauucaagaccuaccagcaguucagaagaugccugacccugagaugcaagcuguacuucgacaaccugcugagccagagagccuacugcggcaagaugaacuucgaccacaagaacgagacccugagcaucagcgugcagcccggcgagggcaacaaggccgccuucaacgacaugagagcccugagcggcggcgagagaagcuucagcaccgugugcuucauccugagccuguggagcaucgccgagagccccuucagaugccuggacgaguucgacguguacauggacauggugaacagaagaaucgccauggaccugauccugaagauggccgacagccagagauucagacaguucauccugcugaccccccagagcaugagcagccugcccagcagcaagcugaucagaauccugagaaugagcgaccccgagagaggccagaccacccugcccuucagacccgugacccaggaggaggacgacgaccagagauaa

SEQ ID NO: 23743 - RNA, 6018 nt, Artificial Sequence
  SMCHD1__Homo_sapiens__NP_056110
auggccgccgccgacggcggcggccccggcggcgccagcgugggcaccgaggaggacggcggcggcgugggccacagaaccguguaccuguucgacagaagagagaaggagagcgagcugggcgacagaccccugcaggugggcgagagaagcgacuacgccggcuucagagccugcgugugccagacccugggcaucagccccgaggagaaguucgugaucaccaccaccagcagaaaggagaucaccugcgacaacuucgacgagaccgugaaggacggcgugacccuguaccugcugcagagcgugaaccagcugcugcugaccgccaccaaggagagaaucgacuuccugccccacuacgacacccuggugaagagcggcauguacgaguacuacgccagcgagggccagaacccccugcccuucgcccuggccgagcugaucgacaacagccugagcgccaccagcagaaacaucggcgugagaagaauccagaucaagcugcuguucgacgagacccagggcaagcccgccguggccgugaucgacaacggcagaggcaugaccagcaagcagcugaacaacugggccguguacagacugagcaaguucaccagacagggcgacuucgagagcgaccacagcggcuacgugagacccgugcccgugcccagaagccugaacagcgacaucagcuacuucggcgugggcggcaagcaggccguguucuucgugggccagagcgccagaaugaucagcaagcccgccgacagccaggacgugcacgagcuggugcugagcaaggaggacuucgagaagaaggagaagaacaaggaggccaucuacagcggcuacaucagaaacagaaagcccagcgacagcgugcacaucaccaacgacgacgagagauuccugcaccaccugaucaucgaggagaaggagaaggacagcuucaccgccguggugaucaccggcgugcagcccgagcacauccaguaccugaagaacuacuuccaccuguggaccagacagcuggcccacaucuaccacuacuacauccacggccccaagggcaacgagaucagaaccagcaaggagguggagcccuucaacaacaucgacaucgagaucagcauguucgagaagggcaaggugcccaagaucgugaaccugagagagauccaggacgacaugcagacccuguacgugaacaccgccgccgacagcuucgaguucaaggcccacguggagggcgacggcgugguggagggcaucaucagauaccaccccuuccuguacgacagagagaccuaccccgacgaccccugcuuccccagcaagcugaaggacgaggacgacgaggacgacugcuucauccuggagaaggccgccagaggcaagagacccaucuucgagugcuucuggaacggcagacugauccccuacaccagcguggaggacuucgacuggugcaccccccccaagaagagaggccuggcccccaucgagugcuacaacagaaucagcggcgcccuguucaccaacgacaaguuccaggugagcaccaacaagcugaccuucauggaccuggagcugaagcugaaggacaagaacacccuguucaccagaauccugaacggccaggagcagagaaugaagaucgacagagaguucgcccuguggcugaaggacugccacgagaaguacgacaagcagaucaaguucacccuguucaagggcgugaucaccagacccgaccugcccagcaagaagcagggccccugggccaccuacgccgccaucgagugggacggcaagaucuacaaggccggccagcuggugaagaccaucaagacccugccccuguucuacggcagcaucgugagauucuuccuguacggcgaccacgacggcgagguguacgccaccggcggcgaggugcagaucgccauggagccccaggcccuguacgacgaggugagaaccgugcccaucgccaagcuggacagaaccguggccgagaaggccgugaagaaguacguggaggacgagauggccagacugcccgacagacugagcgugaccuggcccgagggcgacgagcugcugcccaacgaggugagacccgccggcacccccaucggcgcccugagaaucgagauccugaacaagaagggcgaggccaugcagaagcugcccggcaccagccacggcggcagcaagaagcugcugguggagcugaaggugauccugcacagcagcagcggcaacaaggagaucaucagccacaucagccagcacggcggcaaguggcccuacugguucaagaagauggagaacauccagaagcugggcaacuacacccugaagcugcagguggugcugaacgagagcaacgccgacaccuacgccggcagaccccugcccagcaaggccaucaaguucagcgugaaggagggcaagcccgagaaguucagcuucggccugcuggaccugcccuucagagugggcgugcccuucaacaucccccuggaguuccaggacgaguucggccacaccagccagcuggugaccgacauccagcccgugcuggaggccagcggccugagccugcacuacgaggagaucaccaagggccccaacugcgugaucagaggcgugaccgccaagggccccgugaacagcugccagggcaagaacuacaaccugaaggugacccugcccggccugaaggaggacagccagauccugaagaucagacugcugcccggccaccccagaagacugaaggugaagcccgacagcgagauccuggugaucgagaacggcaccgccuuccccuuccagguggaggugcuggacgagagcgacaacaucaccgcccagcccaagcugaucgugcacugcaaguucagcggcgcccccaaccugcccguguacgugguggacugcagcagcagcggcaccagcauccugaccggcagcgccauccaggugcagaacaucaagaaggaccagacccugaaggccagaaucgagauccccagcugcaaggacguggcccccguggagaagaccaucaagcugcugcccagcagccacguggccagacugcagaucuucagcguggagggccagaaggccauccagaucaagcaccaggacgaggugaacuggaucgccggcgacaucaugcacaaccugaucuuccagauguacgacgagggcgagagagagaucaacaucaccagcgcccuggccgagaagaucaaggugaacuggacccccgagaucaacaaggagcaccugcugcagggccugcugcccgacgugcaggugcccaccagcgugaaggacaugagauacugccaggugagcuuccaggacgaccacgugagccuggagagcgccuucaccgugagaccccugcccgacgagcccaagcaccugaagugcgagaugaagggcggcaagaccgugcagaugggccaggagcugcagggcgagguggugaucaucaucaccgaccaguacggcaaccagauccaggccuucagccccagcagccugagcagccugagcaucgccggcgugggccuggacagcagcaaccugaagaccaccuuccaggagaacacccagagcaucagcgugagaggcaucaaguucauccccggcccccccggcaacaaggaccugugcuucaccuggagagaguucagcgacuucaucagagugcagcugaucagcggcccccccgccaagcugcugcugaucgacuggcccgagcugaaggagagcauccccgugaucaacggcagagaccugcagaaccccaucaucgugcagcugugcgaccagugggacaaccccgcccccgugcagcacgugaagaucagccugaccaaggccagcaaccugaagcugaugcccagcaaccagcagcacaagaccgacgagaagggcagagccaaccugggcguguucagcguguucgcccccagaggcgagcacacccugcaggugaaggccaucuacaacaagagcaucaucgagggccccaucaucaagcugaugauccugcccgaccccgagaagcccgugagacugaacgugaaguacgacaaggacgccagcuuccuggccggcggccuguucaccgacuucaugaucagcgugaucagcgaggacgacagcaucaucaagaacaucaaccccgccagaaucagcaugaagauguggaagcugagcaccagcggcaacagaccccccgccaacgccgagaccuucagcugcaacaagaucaaggacaacgacaaggaggacggcugcuucuacuucagagacaaggugauccccaacaaggugggcaccuacugcauccaguucggcuucaugauggacaagaccaacauccugaacagcgagcaggugaucguggaggugcugcccaaccagcccgugaagcuggugcccaagaucaagccccccacccccgccgugagcaacgugagaagcguggccagcagaacccuggugagagaccugcaccugagcaucaccgacgacuacgacaaccacaccggcaucgaccuggugggcaccaucaucgccaccaucaagggcagcaacgaggaggacaccgacaccccccuguucaucggcaaggugagaacccuggaguuccccuucgugaacggcagcgccgagaucaugagccuggugcuggccgagagcagccccggcagagacagcaccgaguacuucaucguguucgagcccagacugccccugcugagcagaacccuggagcccuacauccugcccuucauguucuacaacgacgugaagaagcagcagcagauggccgcccugaccaaggagaaggaccagcugagccagagcaucgugauguacaagagccuguucgaggccagccagcagcugcugaacgagaugaagugccagguggaggaggccagacugaaggaggcccagcugagaaacgagcugaagauccacaacaucgacauccccaccacccagcaggugccccacaucgaggcccugcugaagagaaagcugagcgagcaggaggagcugaagaagaagcccagaagaagcugcacccugcccaacuacaccaagggcagcggcgacgugcugggcaagaucgcccaccuggcccagaucgaggacgacagagccgccauggugaucagcuggcaccuggccagcgacauggacugcguggugacccugaccaccgacgccgccagaagaaucuacgacgagacccagggcagacagcaggugcugccccuggacagcaucuacaagaagacccugcccgacuggaagagaagccugccccacuucagaaacggcaagcuguacuucaagcccaucggcgaccccguguucgccagagaccugcugaccuuccccgacaacguggagcacugcgagaccguguucggcaugcugcugggcgacaccaucauccuggacaaccuggacgccgccaaccacuacagaaaggagguggugaagaucacccacugccccacccugcugaccagagacggcgacagaaucagaagcaacggcaaguucggcggccugcagaacaaggccccccccauggacaagcugagaggcaugguguucggcgcccccgugcccaagcagugccugauccugggcgagcagaucgaccugcugcagcaguacagaagcgccgugugcaagcuggacagcgugaacaaggaccugaacagccagcuggaguaccugagaacccccgacaugagaaagaagaagcaggagcuggacgagcacgagaagaaccugaagcugaucgaggagaagcugggcaugacccccaucagaaagugcaacgacagccugagacacagccccaagguggagaccaccgacugccccgugccccccaagagaaugagaagagaggccaccagacagaacagaaucaucaccaagaccgacguguaa

SEQ ID NO: 23744 - RNA, 180 nt, Artificial Sequence
  SMCO4__Homo_sapiens__NP_064564
augagacagcugaagggcaagcccaagaaggagaccagcaaggacaagaaggagagaaagcaggccaugcaggaggccagacagcagaucaccaccguggugcugcccacccuggccgugguggugcugcugaucgugguguucguguacguggccaccagacccaccaucaccgaguaa

SEQ ID NO: 23745 - RNA, 351 nt, Artificial Sequence
  SMCP__Homo_sapiens__NP_109588
augugcgaccagaccaagcacagcaagugcugccccgccaagggcaaccagugcugccccccccagcagaaccagugcugccagagcaagggcaaccagugcugcccccccaagcagaaccagugcugccagcccaagggcagccagugcugcccccccaagcacaaccacugcugccagcccaagccccccugcugcauccaggccagaugcugcggccuggagaccaagcccgaggugagcccccugaacauggagagcgagcccaacagcccccagacccaggacaagggcugccagacccagcagcagccccacagcccccagaacgagagcagacccagcaaguaa

SEQ ID NO: 23746 - RNA, 2463 nt, Artificial Sequence
  SMEK1__Homo_sapiens__NP_001271209
augaccgacaccagaagaagagugaagguguacacccugaacgaggacagacagugggacgacagaggcaccggccacgugagcagcggcuacguggagagacugaagggcaugagccugcuggugagagccgagagcgacggcagccugcugcuggagagcaagaucaaccccaacaccgccuaccagaagcagcaggacacccugaucguguggagcgaggccgagaacuacgaccuggcccugagcuuccaggagaaggccggcugcgacgagaucugggagaagaucugccaggugcagggcaaggaccccagcguggacaucacccaggaccugguggacgagagcgaggaggagagauucgacgacaugagcagccccggccuggagcugcccagcugcgagcugagcagacuggaggagaucgccgagcugguggccagcagccugcccagcccccugagaagagagaagcuggcccuggcccuggagaacgagggcuacaucaagaagcugcuggagcuguuccacgugugcgaggaccuggagaacaucgagggccugcaccaccuguacgagaucaucaagggcaucuuccugcugaacagaaccgcccuguucgaggugauguucagcgaggagugcaucauggacgugaucggcugccuggaguacgaccccgcccugagccagcccagaaagcacagagaguuccugaccaagaccgccaaguucaaggaggugauccccaucagcgaccccgagcugaagcagaagauccaccagaccuacagagugcaguacauccaggacauggugcugcccacccccagcguguucgaggagaacaugcugagcacccugcacagcuucaucuucuucaacaagguggagaucgugggcaugcugcaggaggacgagaaguuccugaccgaccuguucgcccagcugaccgacgaggccaccgacgaggagaagagacaggagcuggugaacuuccugaaggaguucugcgccuucagccagacccugcagccccagaacagagacgccuucuucaagacccugagcaacaugggcauccugcccgcccuggaggugauccugggcauggacgacacccaggugagaagcgccgccaccgacaucuucagcuaccugguggaguacaaccccagcauggugagagaguucgugaugcaggaggcccagcagaacgacgacgacauccugcugaucaaccugaucaucgagcacaugaucugcgacaccgaccccgagcugggcggcgccgugcagcugaugggccugcugagaacccugguggaccccgagaacaugcuggccaccgccaacaagaccgagaagaccgaguuccugggcuucuucuacaagcacugcaugcacgugcugaccgccccccugcuggccaacaccaccgaggacaagcccagcaaggacgacuuccagaccgcccagcugcuggcccuggugcuggagcugcugaccuucugcguggagcaccacaccuaccacaucaagaacuacaucaucaacaaggacauccugagaagagugcuggugcugauggccagcaagcacgccuuccuggcccugugcgcccugagauucaagagaaagaucaucggccugaaggacgaguucuacaacagauacaucaugaagagcuuccuguucgagcccguggugaaggccuuccugaacaacggcagcagauacaaccugaugaacagcgccaucaucgagauguucgaguucaucagaguggaggacaucaagagccugaccgcccacgugaucgagaacuacuggaaggcccuggaggacguggacuacgugcagaccuucaagggccugaagcugagauucgagcagcagagagagagacaggacaaccccaagcuggacagcaugagaagcauccugagaaaccacagauacagaagagacgccagaacccuggaggacgaggaggagaugugguucaacaccgacgaggacgacauggaggacggcgaggccguggugagccccagcgacaagaccaagaacgacgacgacaucauggaccccaucagcaaguucauggagagaaagaagcugaaggagagcgaggagaaggaggugcugcugaagaccaaccugagcggcagacagagccccagcuucaagcugagccugagcagcggcaccaagaccaaccugaccagccagagcagcaccaccaaccugcccggcagccccggcagccccggcagccccggcagccccggcagccccggcagcgugcccaagaacaccagccagaccgccgccaucaccaccaagggcggccuggugggccugguggacuaccccgacgacgacgaggacgacgacgaggacgaggacaaggaggacacccugccccugagcaagaaggccaaguucgacagcuaa

SEQ ID NO: 23747 - RNA, 2550 nt, Artificial Sequence
  SMEK2__Homo_sapiens__NP_001116436
augagcgacaccagaagaagagugaagguguacacccugaacgaggacagacagugggacgacagaggcaccggccacgugagcagcaccuacguggaggagcugaagggcaugagccugcuggugagagccgagagcgacggcagccugcugcuggagagcaagaucaaccccaacaccgccuaccagaagcagcaggacacccugaucguguggagcgaggccgagaacuacgaccuggcccugagcuuccaggagaaggccggcugcgacgagaucugggagaagaucugccaggugcagggcaaggaccccagcguggaggugacccaggaccugaucgacgagagcgaggaggagagauucgaggagaugcccgagaccagccaccugaucgaccugcccaccugcgagcugaacaagcuggaggagaucgccgaccuggugaccagcgugcugagcagccccaucagaagagagaagcuggcccuggcccuggagaacgagggcuacaucaagaagcugcugcagcuguuccaggccugcgagaaccuggagaacaccgagggccugcaccaccuguacgagaucaucagaggcauccuguuccugaacaaggccacccuguucgaggugauguucagcgacgagugcaucauggacguggugggcugccuggaguacgaccccgcccuggcccagcccaagagacacagagaguuccugaccaagaccgccaaguucaaggaggugauccccaucaccgacagcgagcugagacagaagauccaccagaccuacagagugcaguacauccaggacaucauccugcccacccccagcguguucgaggagaacuuccugagcacccugaccagcuucaucuucuucaacaagguggagaucgugagcaugcugcaggaggacgagaaguuccugagcgagguguucgcccagcugaccgacgaggccaccgacgacgacaagagaagagagcuggugaacuucuucaaggaguucugcgccuucagccagacccugcagccccagaacagagacgccuucuucaagacccuggccaagcugggcauccugcccgcccuggagaucgugaugggcauggacgaccugcaggugagaagcgccgccaccgacaucuucagcuaccugguggaguucagccccagcauggugagagaguucgugaugcaggaggcccagcagagcgacgacgacauccugcugaucaacguggugaucgagcagaugaucugcgacaccgaccccgagcugggcggcgccgugcagcugaugggccugcugagaacccugaucgaccccgagaacaugcuggccaccaccaacaagaccgagaagagcgaguuccugaacuucuucuacaaccacugcaugcacgugcugaccgccccccugcugaccaacaccagcgaggacaagugcgagaaggacuucuuccugaagcacuacagauacagcuggagcuucgugugcacccccagccacagccacagccacagcacccccagcagcagcaucagccaggacaacaucgugggcagcaacaagaacaacaccaucugccccgacaacuaccagaccgcccagcugcuggcccugauccuggagcugcugaccuucugcguggagcaccacaccuaccacaucaagaacuacaucaugaacaaggaccugcugagaagagugcuggugcugaugaacagcaagcacaccuuccuggcccugugcgcccugagauucaugagaagaaucaucggccugaaggacgaguucuacaacagauacaucaccaagggcaaccuguucgagcccgugaucaacgcccugcuggacaacggcaccagauacaaccugcugaacagcgccgugaucgagcuguucgaguucaucagaguggaggacaucaagagccugaccgcccacaucguggagaacuucuacaaggcccuggagagcaucgaguacgugcagaccuucaagggccugaagaccaaguacgagcaggagaaggacagacagaaccagaagcugaacagcgugcccagcauccugagaagcaacagauucagaagagacgccaaggcccuggaggaggacgaggagaugugguucaacgaggacgaggaggaggagggcaaggccgugguggcccccguggagaagcccaagcccgaggacgacuuccccgacaacuacgagaaguucauggagaccaagaaggccaaggagagcgaggacaaggagaaccugcccaagagaaccagccccggcggcuucaaguucaccuucagccacagcgccagcgccgccaacggcaccaacagcaagagcgugguggcccagaucccccccgccaccagcaacggcagcagcagcaagaccaccaaccugcccaccagcgugaccgccaccaagggcagccuggugggccugguggacuaccccgacgacgaggaggaggacgaggaggaggagagcagccccagaaagagacccagacugggcagcuaa

SEQ ID NO: 23748 - RNA, 10986 nt, Artificial Sequence
  SMG1__Homo_sapiens__NP_055907
augagcagaagagcccccggcagcagacugagcagcggcggcggcggcggcggcaccaaguaccccagaagcuggaacgacuggcagcccagaaccgacagcgccagcgccgaccccgacaaccugaaguacagcagcagcagagacagaggcggcagcagcagcuacggccugcagcccagcaacagcgccguggugagcagacagagacacgacgacaccagagugcacgccgacauccagaacgacgagaagggcggcuacagcgugaacggcggcagcggcgagaacaccuacggcagaaagagccugggccaggagcugagagugaacaacgugaccagccccgaguucaccagcgugcagcacggcagcagagcccuggccaccaaggacaugagaaagagccaggagagaagcaugagcuacagcgacgagagcagacugagcaaccugcugagaagaaucaccagagaggacgacagagacagaagacuggccaccgugaagcagcugaaggaguucauccagcagcccgagaacaagcuggugcuggugaagcagcuggacaacauccuggccgccgugcacgacgugcugaacgagagcagcaagcugcugcaggagcugagacaggagggcgccugcugccugggccugcugugcgccagccugagcuacgaggccgagaagaucuucaaguggaucuucagcaaguucagcagcagcgccaaggacgaggugaagcugcuguaccugugcgccaccuacaaggcccuggagaccgugggcgagaagaaggccuucagcagcgugaugcagcuggugaugaccagccugcagagcauccuggagaacguggacacccccgagcugcugugcaagugcgugaagugcauccugcugguggccagaugcuacccccacaucuucagcaccaacuucagagacaccguggacauccuggugggcuggcacaucgaccacacccagaagcccagccugacccagcaggugagcggcuggcugcagagccuggagcccuucuggguggccgaccuggccuucagcaccacccugcugggccaguuccuggaggacauggaggccuacgccgaggaccugagccacguggccagcggcgagagcguggacgaggacgugcccccccccagcgugagccugcccaagcuggccgcccugcugagaguguucagcaccguggugagaagcaucggcgagagauucagccccaucagaggcccccccaucaccgaggccuacgugaccgacgugcuguacagagugaugagaugcgugaccgccgccaaccagguguucuucagcgaggccgugcugaccgccgccaacgagugcgugggcgugcugcugggcagccuggaccccagcaugaccauccacugcgacauggugaucaccuacggccuggaccagcuggagaacugccagaccugcggcaccgacuacaucaucagcgugcugaaccugcugacccugaucguggagcagaucaacaccaagcugcccagcagcuucguggagaagcuguucauccccagcagcaagcugcuguuccugagauaccacaaggagaaggaggugguggccguggcccacgccguguaccaggccgugcugagccugaagaacauccccgugcuggagaccgccuacaagcugauccugggcgagaugaccugcgcccugaacaaccugcugcacagccugcagcugcccgaggccugcagcgagaucaagcacgaggccuucaagaaccacguguucaacguggacaacgccaaguucguggugaucuucgaccugagcgcccugaccaccaucggcaacgccaagaacagccugaucggcaugugggcccugagccccaccguguucgcccugcugagcaagaaccugaugaucgugcacagcgaccuggccgugcacuuccccgccauccaguacgccgugcuguacacccuguacagccacugcaccagacacgaccacuucaucagcagcagccugagcagcagcagccccagccuguucgacggcgccgugaucagcaccgugaccaccgccaccaagaagcacuucagcaucauccugaaccugcugggcauccugcugaagaaggacaaccugaaccaggacaccagaaagcugcugaugaccugggcccuggaggccgccgugcugaugaagaagagcgagaccuacgccccccuguucagccugcccagcuuccacaaguucugcaagggccugcuggccaacacccugguggaggacgugaacaucugccugcaggccugcagcagccugcacgcccugagcagcagccugcccgacgaccugcugcagagaugcguggacgugugcagagugcagcuggugcacagcggcaccagaaucagacaggccuucggcaagcugcugaagagcaucccccuggacguggugcugagcaacaacaaccacaccgagauccaggagaucagccuggcccugagaagccacaugagcaaggcccccagcaacaccuuccacccccaggacuucagcgacgugaucagcuucauccuguacggcaacagccacagaaccggcaaggacaacuggcuggagagacuguucuacagcugccagagacuggacaagagagaccagagcaccauccccagaaaccugcugaagaccgacgccgugcuguggcagugggccaucugggaggccgcccaguucaccgugcugagcaagcugagaaccccccugggcagagcccaggacaccuuccagaccaucgagggcaucaucagaagccuggccgcccacacccugaaccccgaccaggacgugagccaguggaccaccgccgacaacgacgagggccacggcaacaaccagcugagacuggugcugcugcugcaguaccuggagaaccuggagaagcugauguacaacgccuacgagggcugcgccaacgcccugaccagcccccccaaggugaucagaaccuucuucuacaccaacagacagaccugccaggacuggcugaccagaaucagacugagcaucaugagagugggccugcuggccggccagcccgccgugaccgugagacacggcuucgaccugcugaccgagaugaagaccaccagccugagccagggcaacgagcuggaggugaccaucaugauggugguggaggcccugugcgagcugcacugccccgaggccauccagggcaucgccguguggagcagcagcaucgugggcaagaaccugcuguggaucaacagcguggcccagcaggccgagggcagauucgagaaggccagcguggaguaccaggagcaccugugcgccaugaccggcguggacugcugcaucagcagcuucgacaagagcgugcugacccuggccaacgccggcagaaacagcgccagccccaagcacagccugaacggcgagagcagaaagaccgugcugagcaagcccaccgacagcagccccgaggugaucaacuaccugggcaacaaggccugcgagugcuacaucagcaucgccgacugggccgccgugcaggaguggcagaacgccauccacgaccugaagaagagcaccagcagcaccagccugaaccugaaggccgacuucaacuacaucaagagccugagcagcuucgagagcggcaaguucguggagugcaccgagcagcuggagcugcugcccggcgagaacaucaaccugcuggccggcggcagcaaggagaagaucgacaugaagaagcugcugcccaacaugcugagccccgaccccagagagcugcagaagagcaucgaggugcagcugcugagaagcagcgugugccuggccaccgcccugaaccccaucgagcaggaccagaaguggcagagcaucaccgagaacguggugaaguaccugaagcagaccagcagaaucgccaucggcccccugagacugagcacccugaccgugagccagagccugcccgugcugagcacccugcagcuguacugcagcagcgcccuggagaacaccgugagcaacagacugagcaccgaggacugccugaucccccuguucagcgaggcccugagaagcugcaagcagcacgacgugagacccuggaugcaggcccugagauacaccauguaccagaaccagcugcuggagaagaucaaggagcagaccgugcccaucagaagccaccugauggagcugggccugaccgccgccaaguucgccagaaagagaggcaacgugagccuggccaccagacugcuggcccagugcagcgaggugcagcugggcaagaccaccaccgcccaggaccuggugcagcacuucaagaagcugagcacccagggccagguggacgagaaguggggccccgagcuggacaucgagaagaccaagcugcuguacaccgccggccagagcacccacgccauggagaugcugagcagcugcgccaucagcuucugcaagagcgugaaggccgaguacgccguggccaagagcauccugacccuggccaaguggauccaggccgaguggaaggagaucagcggccagcugaagcagguguacagagcccagcaccagcagaacuucaccggccugagcacccugagcaagaacauccugacccugaucgagcugcccagcgugaacaccauggaggaggaguaccccagaaucgagagcgagagcaccgugcacaucggcgugggcgagcccgacuucauccugggccagcuguaccaccugagcagcgugcaggcccccgagguggccaagagcugggccgcccuggccagcugggccuacagauggggcagaaaggugguggacaacgccagccagggcgagggcgugagacugcugcccagagagaagagcgaggugcagaaccugcugcccgacaccaucaccgaggaggagaaggagagaaucuacggcauccugggccaggccgugugcagacccgccggcauccaggacgaggacaucacccugcagaucaccgagagcgaggacaacgaggaggacgacaugguggacgugaucuggagacagcugaucagcagcugccccuggcugagcgagcuggacgagagcgccaccgagggcgugaucaagguguggagaaaggugguggacagaaucuucagccuguacaagcugagcugcagcgccuacuucaccuuccugaagcugaacgccggccagaucccccuggacgaggacgaccccagacugcaccugagccacagaguggagcagagcaccgacgacaugaucgugauggccacccugagacugcugagacugcuggugaagcacgccggcgagcugagacaguaccuggagcacggccuggagaccacccccaccgcccccuggagaggcaucaucccccagcuguucagcagacugaaccaccccgagguguacgugagacagagcaucugcaaccugcugugcagaguggcccaggacagcccccaccugauccuguaccccgccaucgugggcaccaucagccugagcagcgagagccaggccagcggcaacaaguucagcaccgccauccccacccugcugggcaacauccagggcgaggagcugcuggugagcgagugcgagggcggcagcccccccgccagccaggacagcaacaaggacgagcccaagagcggccugaacgaggaccaggccaugaugcaggacugcuacagcaagaucguggacaagcugagcagcgccaaccccaccauggugcugcaggugcagaugcugguggccgagcugagaagagugaccgugcugugggacgagcuguggcugggcgugcugcugcagcagcacauguacgugcugagaagaauccagcagcuggaggacgaggugaagagagugcagaacaacaacacccugagaaaggaggagaagaucgccaucaugagagagaagcacaccgcccugaugaagcccaucguguucgcccuggagcacgugagaagcaucaccgccgcccccgccgagaccccccacgagaagugguuccaggacaacuacggcgacgccaucgagaacgcccuggagaagcugaagaccccccugaaccccgccaagcccggcagcagcuggauccccuucaaggagaucaugcugagccugcagcagagagcccagaagagagccagcuacauccugagacuggaggagaucagccccuggcuggccgccaugaccaacaccgagaucgcccugcccggcgaggugagcgccagagacaccgugaccauccacagcgugggcggcaccaucaccauccugcccaccaagaccaagcccaagaagcugcuguuccugggcagcgacggcaagagcuaccccuaccuguucaagggccuggaggaccugcaccuggacgagagaaucaugcaguuccugagcaucgugaacaccauguucgccaccaucaacagacaggagacccccagauuccacgccagacacuacagcgugaccccccugggcaccagaagcggccugauccaguggguggacggcgccaccccccuguucggccuguacaagagauggcagcagagagaggccgcccugcaggcccagaaggcccaggacagcuaccagaccccccagaaccccggcaucgugcccagacccagcgagcuguacuacagcaagaucggccccgcccugaagaccgugggccugagccuggacgugagcagaagagacuggccccugcacgugaugaaggccgugcuggaggagcugauggaggccaccccccccaaccugcuggccaaggagcuguggagcagcugcaccacccccgacgagugguggagagugacccagagcuacgccagaagcaccgccgugaugagcauggugggcuacaucaucggccugggcgacagacaccuggacaacgugcugaucgacaugaccaccggcgagguggugcacaucgacuacaacgugugcuucgagaagggcaagagccugagagugcccgagaaggugcccuucagaaugacccagaacaucgagaccgcccugggcgugaccggcguggagggcguguucagacugagcugcgagcaggugcugcacaucaugagaagaggcagagagacccugcugacccugcuggaggccuucguguacgacccccugguggacuggaccgccggcggcgaggccggcuucgccggcgccguguacggcggcggcggccagcaggccgagagcaagcagagcaagagagagauggagagagagaucaccagaagccuguucagcagcagaguggccgagaucaaggugaacugguucaagaacagagacgagaugcugguggugcugcccaagcuggacggcagccuggacgaguaccugagccugcaggagcagcugaccgacguggagaagcugcagggcaagcugcuggaggagaucgaguuccuggagggcgccgagggcguggaccaccccagccacacccugcagcacagauacagcgagcacacccagcugcagacccagcagagagccgugcaggaggccauccaggugaagcugaacgaguucgagcaguggaucacccacuaccaggccgccuucaacaaccuggaggccacccagcuggccagccugcugcaggagaucagcacccagauggaccugggcccccccagcuacgugcccgccaccgccuuccugcagaacgccggccaggcccaccugaucagccagugcgagcagcuggagggcgaggugggcgcccugcugcagcagagaagaagcgugcugagaggcugccuggagcagcugcaccacuacgccaccguggcccugcaguaccccaaggccaucuuccagaagcacagaaucgagcaguggaagaccuggauggaggagcugaucugcaacaccaccguggagagaugccaggagcuguacagaaaguacgagaugcaguacgccccccagcccccccccaccgugugccaguucaucaccgccaccgagaugacccugcagagauacgccgccgacaucaacagcagacugaucagacagguggagagacugaagcaggaggccgugaccgugcccgugugcgaggaccagcugaaggagaucgagagaugcaucaagguguuccugcacgagaacggcgaggagggcagccugagccuggccagcgugaucaucagcgcccugugcacccugaccagaagaaaccugaugauggagggcgccgccagcagcgccggcgagcagcugguggaccugaccagcagagacggcgccugguuccuggaggagcugugcagcaugagcggcaacgugaccugccuggugcagcugcugaagcagugccaccuggugccccaggaccuggacauccccaaccccauggaggccagcgagaccgugcaccuggccaacggcguguacaccagccugcaggagcugaacagcaacuucagacagaucaucuuccccgaggcccugagaugccugaugaagggcgaguacacccuggagagcaugcugcacgagcuggacggccugaucgagcagaccaccgacggcgugccccugcagacccugguggagagccugcaggccuaccugagaaacgccgccaugggccuggaggaggagacccacgcccacuacaucgacguggccagacugcugcacgcccaguacggcgagcugauccagcccagaaacggcagcguggacgagacccccaagaugagcgccggccagaugcugcugguggccuucgacggcauguucgcccagguggagaccgccuucagccugcugguggagaagcugaacaagauggagauccccaucgccuggagaaagaucgacaucaucagagaggccagaagcacccaggugaacuucuucgacgacgacaaccacagacaggugcuggaggagaucuucuuccugaagagacugcagaccaucaaggaguucuucagacugugcggcaccuucagcaagacccugagcggcagcagcagccuggaggaccagaacaccgugaacggccccgugcagaucgugaacgugaagacccuguucagaaacagcugcuucagcgaggaccagauggccaagcccaucaaggccuucaccgccgacuucgugagacagcugcugaucggccugcccaaccaggcccugggccugacccugugcagcuucaucagcgcccugggcguggacaucaucgcccagguggaggccaaggacuucggcgccgagagcaaggugagcguggacgaccugugcaagaaggccguggagcacaacauccagaucggcaaguucagccagcuggugaugaacagagccaccgugcuggccagcagcuacgacaccgccuggaagaagcacgaccuggugagaagacuggagaccagcaucagcagcugcaagaccagccugcagagagugcagcugcacaucgccauguuccaguggcagcacgaggaccugcugaucaacagaccccaggccaugagcgugacccccccccccagaagcgccauccugaccagcaugaagaagaagcugcacacccugagccagaucgagaccagcaucgccaccgugcaggagaagcuggccgcccuggagagcagcaucgagcagagacugaagugggccggcggcgccaaccccgcccuggcccccgugcugcaggacuucgaggccaccaucgccgagagaagaaaccuggugcugaaggagagccagagagccagccaggugaccuuccugugcagcaacaucauccacuucgagagccugagaaccagaaccgccgaggcccugaaccuggacgccgcccuguucgagcugaucaagagaugccagcagaugugcagcuucgccagccaguucaacagcagcgugagcgagcuggagcugagacugcugcagagaguggacaccggccuggagcaccccaucggcagcagcgaguggcugcugagcgcccacaagcagcugacccaggacaugagcacccagagagccauccagaccgagaaggagcagcagaucgagaccgugugcgagaccauccagaaccugguggacaacaucaagaccgugcugaccggccacaacagacagcugggcgacgugaagcaccugcugaaggccauggccaaggacgaggaggccgcccuggccgacggcgaggacgugcccuacgagaacagcgugagacaguuccugggcgaguacaagagcuggcaggacaacauccagaccgugcuguucacccuggugcaggccaugggccaggugagaagccaggagcacguggagaugcugcaggagaucacccccacccugaaggagcugaagacccagagccagagcaucuacaacaaccuggugagcuucgccagcccccuggugaccgacgccaccaacgagugcagcagccccaccagcagcgccaccuaccagcccagcuucgccgccgccgugagaagcaacaccggccagaagacccagcccgacgugaugagccagaacgccagaaagcugauccagaagaaccuggccaccagcgccgacaccccccccagcaccgugcccggcaccggcaagagcguggccugcagccccaagaaggccgugagagaccccaagaccggcaaggccgugcaggagagaaacagcuacgccgugagcguguggaagagagugaaggccaagcuggagggcagagacguggaccccaacagaagaaugagcguggccgagcagguggacuacgugaucaaggaggccaccaaccuggacaaccuggcccagcuguacgagggcuggaccgccuggguguaa

SEQ ID NO: 23749 - RNA, 993 nt, Artificial Sequence
  SMG6__Homo_sapiens__NP_001269255
augagauucagacugugccaccagagaggcugcugcccccacgagagagagaacaccugcaccugcaagaugaucaucagcagccugcaggugaucgccgccgacugcaagagagugaccgugcugaaguacuuccuggaggcccugugcggccaggaggagccccugcuggccuucaagggcggcaaguacgugagcguggcccccgugcccgacaccaugggcaaggagaugggcagccaggagggcaccagacuggaggacgaggaggaggacguggugaucgaggacuucgaggaggacagcgaggccgagggcagcggcggcgaggacgacaucagagagcugagagccaagaagcuggcccuggccagaaagaucgccgagcagcagagaagacaggagaagauccaggccgugcuggaggaccacagccagaugagacagauggagcuggagaucagaccccuguuccuggugcccgacaccaacggcuucaucgaccaccuggccagccuggccagacugcuggagagcagaaaguacauccugguggugccccugaucgugaucaacgagcuggacggccuggccaagggccaggagaccgaccacagagccggcggcuacgccagaguggugcaggagaaggccagaaagagcaucgaguuccuggagcagagauucgagagcagagacagcugccugagagcccugaccagcagaggcaacgagcuggagagcaucgccuucagaagcgaggacaucaccggccagcugggcaacaacgacgaccugauccugagcugcugccugcacuacugcaaggacaaggccaaggacuucaugcccgccagcaaggaggagcccaucagacugcugagagagguggugcugcugaccgacgacagaaaccugagagugaaggcccugaccagaaacgugcccgugagagacauccccgccuuccugaccugggcccaggugggcuaa

SEQ ID NO: 23750 - RNA, 2976 nt, Artificial Sequence
  SMG8__Homo_sapiens__NP_060619
auggccggccccgugagccugagagaccugcugaugggcgccagcgccuggaugggcagcgagagccccggcggcagccccaccgagggcggcggcagcgccgccggcggccccgagccccccuggagagaggacgagaucugcguggugggcaucuucggcaagaccgcccugagacugaacagcgagaaguucagccuggugaacaccgugugcgacagacagguguucccccuguucagacaccaggaccccggcgaccccggccccggcaucagaaccgaggccggcgccgugggcgaggccggcggcgccgaggaccccggcgccgccgccggcggcagcgugagaggcagcggcgccguggccgagggcaacagaaccgaggccggcagccaggacuacagccugcugcaggccuacuacagccaggagagcaaggugcuguaccugcugcugaccagcaucugcgacaacagccagcugcugagagccugcagagcccugcagagcggcgaggccggcggcggccugagccugccccacgccgaggcccacgaguucuggaagcaccaggagaagcugcagugccugagccugcuguaccuguucagcgugugccacauccugcugcuggugcaccccaccugcagcuucgacaucaccuacgacagaguguucagagcccuggacggccugagacagaaggugcugccccugcugaagaccgccaucaaggacugccccgugggcaaggacuggaagcugaacugcagacccugcccccccagacugcuguuccuguuccagcugaacggcgcccugaagguggagccccccagaaaccaggaccccgcccaccccgacaagcccaagaagcacagccccaagagaagacugcagcacgcccuggaggaccagaucuacagaaucuucagaaagagcagagugcugaccaaccagagcaucaacugccuguucaccgugcccgccaaccaggccuucguguacaucgugcccggcagccaggaggaggaccccgugggcaugcugcuggaccagcugagaagccacugcaccgugaaggaccccgagagccugcuggugcccgccccccugagcggccccagaagauaccaggugaugagacagcacagcagacagcagcugagcuuccacaucgacagcagcagcagcagcagcagcggccagcugguggacuucacccugagagaguuccuguggcagcacguggagcuggugcugagcaagaagggcuucgacgacagcgugggcagaaacccccagcccagccacuucgagcugcccaccuaccagaaguggaucagcgccgccagcaagcuguacgagguggccaucgacggcaaggaggaggaccugggcagccccaccggcgagcugaccagcaagauccugagcagcaucaaggugcuggagggcuuccuggacaucgacaccaaguucagcgagaacagaugccagaaggcccugcccauggcccacagcgccuaccagagcaaccugccccacaacuacaccaugaccgugcacaagaaccagcuggcccaggcccugagaguguacagccagcacgccagaggccccgccuuccacaaguacgccaugcagcugcacgaggacugcuacaaguucuggagcaacggccaccagcugugcgaggagagaagccugaccgaccagcacugcgugcacaaguuccacagccugcccaagagcggcgagaagcccgaggccgacagaaacccccccgugcuguaccacaacagcagagccagaagcaccggcgccugcaacugcggcagaaagcaggcccccagagacgaccccuucgacaucaaggccgccaacuacgacuucuaccagcugcuggaggagaagugcugcggcaagcuggaccacaucaacuuccccguguucgagcccagcacccccgaccccgcccccgccaagaacgagagcagccccgccccccccgacagcgacgccgacaagcugaaggagaaggagccccagacccagggcgagagcaccagccugagccuggcccugagccugggccagagcaccgacagccugggcaccuaccccgccgacccccaggccggcggcgacaaccccgaggugcacggccagguggaggugaagaccgagaagagacccaacuucguggacagacaggccagcaccguggaguaccugcccggcaugcugcacagcaacugccccaagggccugcugcccaaguucagcagcuggagccuggugaagcugggccccgccaagagcuacaacuuccacaccggccuggaccagcagggcuucauccccggcaccaacuaccugaugcccugggacaucgugaucagaaccagagccgaggacgagggcgaccuggacaccaacagcuggcccgcccccaacaaggccauccccggcaagagaagcgccguggugaugggcagaggcagaagaagagacgacaucgccagagccuucgugggcuucgaguacgaggacagcagaggcagaagauucaugugcagcggccccgacaaggugaugaaggugaugggcagcggccccaaggagagcgcccugaaggcccugaacagcgacaugccccuguacauccugagcagcagccagggcagaggccugaagccccacuacgcccagcugaugagacuguucgugguggugcccgacgccccccugcagaucauccugaugccccaggugcagcccggccccccccccugccccguguucuaccccgagaagcaggagaucacccugccccccgacggccugugggugcugagauuccccuacgccuacgugaccgagagaggccccugcuucccccccaaggagaacgugcagcugaugagcuacaaggugcugagaggcgugcugaaggccgugacccaguaa

SEQ ID NO: 23751 - RNA, 225 nt, Artificial Sequence
  SMIM15__Homo_sapiens__NP_001041714
auguucgacaucaaggccugggccgaguacgugguggagugggccgccaaggaccccuacggcuuccugaccaccgugauccuggcccugaccccccuguuccuggccagcgccgugcugagcuggaagcuggccaagaugaucgaggccagagagaaggagcagaagaagaagcagaagagacaggagaacaucgccaaggccaagagacugaagaaggacuaa

SEQ ID NO: 23752 - RNA, 324 nt, Artificial Sequence
  SMIM19__Homo_sapiens__NP_001129148
auggccggcggcuacggcgugaugggcgacgacggcagcaucgacuacaccgugcacgaggccuggaacgaggccaccaacguguaccugaucgugauccuggugagcuucggccuguucauguacgccaagagaaacaagagaagaaucaugagaaucuucagcgugccccccaccgaggagacccugagcgagcccaacuucuacgacaccaucagcaagaucagacugagacagcagcuggagauguacagcaucagcagaaaguacgacuaccagcagccccagaaccaggccgacagcgugcagcugagccuggaguaa

SEQ ID NO: 23753 - RNA, 204 nt, Artificial Sequence
  SMIM20__Homo_sapiens__NP_001138904
augagcagaaaccugagaaccgcccugaucuucggcggcuucaucagccugaucggcgccgccuucuaccccaucuacuucagaccccugaugagacuggaggaguacaagaaggagcaggccaucaacagagccggcaucgugcaggaggacgugcagccccccggccugaagguguggagcgaccccuucggcagaaaguaa

SEQ ID NO: 23754 - RNA, 306 nt, Artificial Sequence
  SMIM21__Homo_sapiens__NP_001032408
auggaccaguacgugagcaccgccccccccagauuccccaucgcccagcugggcaccuucaagcaggacagcgccggcaugggcagaaucuucaagggcaaccugcugcagaagaaggcccugaccaccuucgagaacgagcaccacaucagauucuucacccugcuggugcuguuccacgugauggugcugcugagaaaccacagcagaauccagggcgugagcgaggacuggaagagagccaacagcaucuucagaaacuuccugagacugaagagcagcagaaacaccgccgaggccgaguaa

SEQ ID NO: 23755 - RNA, 519 nt, Artificial Sequence
  SMIM23__Homo_sapiens__NP_001276899
auggccacccagcagguggacagcagaagacagguggccgccgagcagguggccgcccagcugcuggagagaagaagaggcagccacugcgacgacgagaagcagacccugcuggcccugcugauccuggugcuguaccugagcaccgagaucuggggcagcagcugggaggugagcgagagaaucagagagugcaacuacuaccagaaccuggccgugccccagggccuggaguaccagaccaacgagcccagcgaggagcccaucaagaccaucagaaacuggcugaaggagaagcugcacguguucagcgagaagcuggaggaggaggugcagcagcuggagcagcuggccugggaccuggagcuguggcuggacgcccugcugggcgagccccaccaggaggagcacugcagcaccuacaagagccaccugugggagugggccugggcccugggcagagagcacaagggcggcgagggccugcuggagaucagccugagcggcgccgagcuguaa

SEQ ID NO: 23756 - RNA, 720 nt, Artificial Sequence
  SMIM5__Homo_sapiens__XP_011523418
augagaagacuggccggcagagccggccacagccaggugacccaggacagcaaguucagccccaagacccccagcgacgccgagagacacaagggccugcccagagacuggcugcagagccugcugcugagccugagaggcccccccgccccccacugccugcugcuguuccugagagaggccagaggcagagaccagcccggcagcggccagagagacagaagaggcggccugcccgagggcagagugggcgcccccgaccugagagcccugcaggacagccccccccaggcccagguggagcccccccagggcccccccggccaggagggcagagagcccaccagcuucuucagcagccagcccagacccagccccagaagaggcagcagaggcgagggcgaggaggaggagggcggcggcgagagagagcuggugcugagccugagcagcgcccugagagccgaggacgaccagcagcagaagagccaggccgagaccgccgccggcugccagcagagaagcugggccgaggcccccagaggcgccgccgcccccaccaaggaggugagaggccagcacguggaggcccccagauggggcaccgccgcccagccccccacccccgagcugcccggcgccuggcccacccacugcuggugcagccagcugaccgcccagcccggcagcagcagccugggccccagcagaacccccuaa

SEQ ID NO: 23757 - RNA, 885 nt, Artificial Sequence
  SMN2__Homo_sapiens__NP_059107
auggccaugagcagcggcggcagcggcggcggcgugcccgagcaggaggacagcgugcuguucagaagaggcaccggccagagcgacgacagcgacaucugggacgacaccgcccugaucaaggccuacgacaaggccguggccagcuucaagcacgcccugaagaacggcgacaucugcgagaccagcggcaagcccaagaccacccccaagagaaagcccgccaagaagaacaagagccagaagaagaacaccgccgccagccugcagcaguggaaggugggcgacaagugcagcgccaucuggagcgaggacggcugcaucuaccccgccaccaucgccagcaucgacuucaagagagagaccugcguggugguguacaccggcuacggcaacagagaggagcagaaccugagcgaccugcugagccccaucugcgagguggccaacaacaucgagcagaacgcccaggagaacgagaacgagagccaggugagcaccgacgagagcgagaacagcagaagccccggcaacaagagcgacaacaucaagcccaagagcgcccccuggaacagcuuccugcccccccccccccccaugcccggccccagacugggccccggcaagcccggccugaaguucaacggccccccccccccccccccccccccccccccccaccugcugagcugcuggcugccccccuuccccagcggcccccccaucauccccccccccccccccaucugccccgacagccuggacgacgccgacgcccugggcagcaugcugaucagcugguacaugagcggcuaccacaccggcuacuacaugggcuucagacagaaccagaaggagggcagaugcagccacagccugaacuaa

SEQ ID NO: 23758 - RNA, 1308 nt, Artificial Sequence
  SMOC1__Homo_sapiens__NP_001030024
augcugcccgccagaugcgccagacugcugaccccccaccugcugcuggugcuggugcagcugagccccgccagaggccacagaaccaccggccccagauuccugaucagcgacagagacccccagugcaaccugcacugcagcagaacccagcccaagcccaucugcgccagcgacggcagaagcuacgagagcaugugcgaguaccagagagccaagugcagagaccccacccugggcguggugcacagaggcagaugcaaggacgccggccagagcaagugcagacuggagagagcccaggcccuggagcaggccaagaagccccaggaggccguguucgugcccgagugcggcgaggacggcagcuucacccaggugcagugccacaccuacaccggcuacugcuggugcgugacccccgacggcaagcccaucagcggcagcagcgugcagaacaagacccccgugugcagcggcagcgugaccgacaagccccugagccagggcaacagcggcagaaaggacgacggcagcaagcccacccccaccauggagacccagcccguguucgacggcgacgagaucaccgcccccacccuguggaucaagcaccuggugaucaaggacagcaagcugaacaacaccaacaucagaaacagcgagaagguguacagcugcgaccaggagagacagagcgcccuggaggaggcccagcagaaccccagagagggcaucgugauccccgagugcgcccccggcggccuguacaagcccgugcagugccaccagagcaccggcuacugcuggugcgugcugguggacaccggcagaccccugcccggcaccagcaccagauacgugaugcccagcugcgagagcgacgccagagccaagaccaccgaggccgacgaccccuucaaggacagagagcugcccggcugccccgagggcaagaagauggaguucaucaccagccugcuggacgcccugaccaccgacauggugcaggccaucaacagcgccgcccccaccggcggcggcagauucagcgagcccgaccccagccacacccuggaggagagaguggugcacugguacuucagccagcuggacagcaacagcagcaacgacaucaacaagagagagaugaagcccuucaagagauacgugaagaagaaggccaagcccaagaagugcgccagaagauucaccgacuacugcgaccugaacaaggacaaggugaucagccugcccgagcugaagggcugccugggcgugagcaaggaggugggcagacugguguaa

SEQ ID NO: 23759 - RNA, 1341 nt, Artificial Sequence
  SMOC2__Homo_sapiens__NP_001159884
augcugcugccccagcugugcuggcugccccugcuggccggccugcugccccccgugcccgcccagaaguucagcgcccugaccuuccugagaguggaccaggacaaggacaaggacugcagccuggacugcgccggcagcccccagaagccccugugcgccagcgacggcagaaccuuccugagcagaugcgaguuccagagagccaagugcaaggacccccagcuggagaucgccuacagaggcaacugcaaggacgugagcagaugcguggccgagagaaaguacacccaggagcaggccagaaaggaguuccagcagguguucauccccgagugcaacgacgacggcaccuacagccaggugcagugccacagcuacaccggcuacugcuggugcgugacccccaacggcagacccaucagcggcaccgccguggcccacaagacccccagaugccccggcagcgugaacgagaagcugccccagagagagggcaccggcaagaccgacgacgccgccgcccccgcccuggagacccagccccagggcgacgaggaggacaucgccagcagauaccccacccuguggaccgagcaggugaagagcagacagaacaagaccaacaagaacagcgugagcagcugcgaccaggagcaccagagcgcccuggaggaggccaagcagcccaagaacgacaacguggugauccccgagugcgcccacggcggccuguacaagcccgugcagugccaccccagcaccggcuacugcuggugcgugcugguggacaccggcagacccauccccggcaccagcaccagauacgagcagcccaagugcgacaacaccgccagagcccaccccgccaaggccagagaccuguacaagggcagacagcugcagggcugccccggcgccaagaagcacgaguuccugaccagcgugcuggacgcccugagcaccgacauggugcacgccgccagcgaccccagcagcagcagcggcagacugagcgagcccgaccccagccacacccuggaggagagaguggugcacugguacuucaagcugcuggacaagaacagcagcggcgacaucggcaagaaggagaucaagcccuucaagagauuccugagaaagaagagcaagcccaagaagugcgugaagaaguucguggaguacugcgacgugaacaacgacaagagcaucagcgugcaggagcugaugggcugccugggcguggccaaggaggacggcaaggccgacaccaagaagagacacacccccagaggccacgccgagagcaccagcaacagacagcccagaaagcagggcuaa

SEQ ID NO: 23760 - RNA, 2364 nt, Artificial Sequence
  SMO__Homo_sapiens__NP_005622
auggccgccgccagacccgccagaggccccgagcugccccugcugggccugcugcugcugcugcugcugggcgaccccggcagaggcgccgccagcagcggcaacgccaccggccccggccccagaagcgccggcggcagcgccagaagaagcgccgccgugaccggccccccccccccccugagccacugcggcagagccgcccccugcgagccccugagauacaacgugugccugggcagcgugcugcccuacggcgccaccagcacccugcuggccggcgacagcgacagccaggaggaggcccacggcaagcuggugcuguggagcggccugagaaacgcccccagaugcugggccgugauccagccccugcugugcgccguguacaugcccaagugcgagaacgacagaguggagcugcccagcagaacccugugccaggccaccagaggccccugcgccaucguggagagagagagaggcuggcccgacuuccugagaugcacccccgacagauuccccgagggcugcaccaacgaggugcagaacaucaaguucaacagcagcggccagugcgaggugccccuggugagaaccgacaaccccaagagcugguacgaggacguggagggcugcggcauccagugccagaacccccuguucaccgaggccgagcaccaggacaugcacagcuacaucgccgccuucggcgccgugaccggccugugcacccuguucacccuggccaccuucguggccgacuggagaaacagcaacagauaccccgccgugauccuguucuacgugaacgccugcuucuucgugggcagcaucggcuggcuggcccaguucauggacggcgccagaagagagaucgugugcagagccgacggcaccaugagacugggcgagcccaccagcaacgagacccugagcugcgugaucaucuucgugaucguguacuacgcccugauggccggcguggugugguucguggugcugaccuacgccuggcacaccagcuucaaggcccugggcaccaccuaccagccccugagcggcaagaccagcuacuuccaccugcugaccuggagccugcccuucgugcugaccguggccauccuggccguggcccagguggacggcgacagcgugagcggcaucugcuucgugggcuacaagaacuacagauacagagccggcuucgugcuggcccccaucggccuggugcugaucgugggcggcuacuuccugaucagaggcgugaugacccuguucagcaucaagagcaaccaccccggccugcugagcgagaaggccgccagcaagaucaacgagaccaugcugagacugggcaucuucggcuuccuggccuucggcuucgugcugaucaccuucagcugccacuucuacgacuucuucaaccaggccgagugggagagaagcuucagagacuacgugcugugccaggccaacgugaccaucggccugcccaccaagcagcccauccccgacugcgagaucaagaacagacccagccugcugguggagaagaucaaccuguucgccauguucggcaccggcaucgccaugagcaccuggguguggaccaaggccacccugcugaucuggagaagaaccuggugcagacugaccggccagagcgacgacgagcccaagagaaucaagaagagcaagaugaucgccaaggccuucagcaagagacacgagcugcugcagaaccccggccaggagcugagcuucagcaugcacaccgugagccacgacggccccguggccggccuggccuucgaccugaacgagcccagcgccgacgugagcagcgccugggcccagcacgugaccaagaugguggccagaagaggcgccauccugccccaggacaucagcgugacccccguggccacccccgugccccccgaggagcaggccaaccuguggcugguggaggccgagaucagccccgagcugcagaagagacugggcagaaagaagaagagaagaaagagaaagaaggaggugugcccccuggcccccccccccgagcugcacccccccgcccccgcccccagcaccauccccagacugccccagcugcccagacagaagugccugguggccgccggcgccuggggcgccggcgacagcugcagacagggcgccuggacccuggugagcaaccccuucugccccgagcccagccccccccaggaccccuuccugcccagcgcccccgcccccguggccugggcccacggcagaagacagggccugggccccauccacagcagaaccaaccugauggacaccgagcugauggacgccgacagcgacuucuaa

SEQ ID NO: 23761 - RNA, 1668 nt, Artificial Sequence
  SMOX__Homo_sapiens__NP_787033
augcagagcugcgagagcagcggcgacagcgccgacgacccccugagcagaggccugagaagaagaggccagcccagagugguggugaucggcgccggccuggccggccuggccgccgccaaggcccugcuggagcagggcuucaccgacgugaccgugcuggaggccagcagccacaucggcggcagagugcagagcgugaagcugggccacgccaccuucgagcugggcgccaccuggauccacggcagccacggcaaccccaucuaccaccuggccgaggccaacggccugcuggaggagaccaccgacggcgagagaagcgugggcagaaucagccuguacagcaagaacggcguggccugcuaccugaccaaccacggcagaagaauccccaaggacgugguggaggaguucagcgaccuguacaacgagguguacaaccugacccaggaguucuucagacacgacaagcccgugaacgccgagagccagaacagcgugggcguguucaccagagaggaggugagaaacagaaucagaaacgaccccgacgaccccgaggccaccaagagacugaagcuggccaugauccagcaguaccugaagguggagagcugcgagagcagcagccacagcauggacgaggugagccugagcgccuucggcgaguggaccgagauccccggcgcccaccacaucauccccagcggcuucaugagagugguggagcugcuggccgagggcauccccgcccacgugauccagcugggcaagcccgugagaugcauccacugggaccaggccagcgccagacccagaggccccgagaucgagcccagaggcgagggcgaccacaaccacgacaccggcgagggcggccagggcggcgaggagcccagaggcggcagaugggacgaggacgagcaguggagcguggugguggagugcgaggacugcgagcugauccccgccgaccacgugaucgugaccgugagccugggcgugcugaagagacaguacaccagcuucuucagacccggccugcccaccgagaagguggccgccauccacagacugggcaucggcaccaccgacaagaucuuccuggaguucgaggagcccuucuggggccccgagugcaacagccugcaguucgugugggaggacgaggccgagagccacacccugaccuacccccccgagcugugguacagaaagaucugcggcuucgacgugcuguacccccccgagagauacggccacgugcugagcggcuggaucugcggcgaggaggcccuggugauggagaagugcgacgacgaggccguggccgagaucugcaccgagaugcugagacaguucaccggcaaccccaacauccccaagcccagaagaauccugagaagcgccuggggcagcaaccccuacuucagaggcagcuacagcuacacccaggugggcagcagcggcgccgacguggagaagcuggccaagccccugcccuacaccgagagcagcaagaccgcccccaugcaggugcuguucagcggcgaggccacccacagaaaguacuacagcaccacccacggcgcccugcugagcggccagagagaggccgccagacugaucgagauguacagagaccuguuccagcagggcaccuaa

SEQ ID NO: 23762 - RNA, 1896 nt, Artificial Sequence
  SMPD1__Homo_sapiens__NP_000534
augcccagauacggcgccagccugagacagagcugccccagaagcggcagagagcagggccaggacggcaccgccggcgcccccggccugcuguggaugggccuggugcuggcccuggcccuggcccuggcccuggcccuggcccugagcgacagcagagugcugugggcccccgccgaggcccacccccugagcccccagggccaccccgccagacugcacagaaucgugcccagacugagagacguguucggcuggggcaaccugaccugccccaucugcaagggccuguucaccgccaucaaccugggccugaagaaggagcccaacguggccagagugggcagcguggccaucaagcugugcaaccugcugaagaucgccccccccgccgugugccagagcaucgugcaccuguucgaggacgacaugguggagguguggagaagaagcgugcugagccccagcgaggccugcggccugcugcugggcagcaccugcggccacugggacaucuucagcagcuggaacaucagccugcccaccgugcccaagcccccccccaagccccccagcccccccgcccccggcgcccccgugagcagaauccuguuccugaccgaccugcacugggaccacgacuaccuggagggcaccgaccccgacugcgccgacccccugugcugcagaagaggcagcggccugccccccgccagcagacccggcgccggcuacuggggcgaguacagcaagugcgaccugccccugagaacccuggagagccugcugagcggccugggccccgccggccccuucgacaugguguacuggaccggcgacauccccgcccacgacguguggcaccagaccagacaggaccagcugagagcccugaccaccgugaccgcccuggugagaaaguuccugggccccgugcccguguaccccgccgugggcaaccacgagagcacccccgugaacagcuuccccccccccuucaucgagggcaaccacagcagcagauggcuguacgaggccauggccaaggccugggagcccuggcugcccgccgaggcccugagaacccugagaaucggcggcuucuacgcccugagccccuaccccggccugagacugaucagccugaacaugaacuucugcagcagagagaacuucuggcugcugaucaacagcaccgaccccgccggccagcugcaguggcuggugggcgagcugcaggccgccgaggacagaggcgacaaggugcacaucaucggccacaucccccccggccacugccugaagagcuggagcuggaacuacuacagaaucguggccagauacgagaacacccuggccgcccaguucuucggccacacccacguggacgaguucgagguguucuacgacgaggagacccugagcagaccccuggccguggccuuccuggcccccagcgccaccaccuacaucggccugaaccccggcuacagaguguaccagaucgacggcaacuacagcggcagcagccacguggugcuggaccacgagaccuacauccugaaccugacccaggccaacauccccggcgccaucccccacuggcagcugcuguacagagccagagagaccuacggccugcccaacacccugcccaccgccuggcacaaccugguguacagaaugagaggcgacaugcagcuguuccagaccuucugguuccuguaccacaagggccacccccccagcgagcccugcggcacccccugcagacuggccacccugugcgcccagcugagcgccagagccgacagccccgcccugugcagacaccugaugcccgacggcagccugcccgaggcccagagccuguggcccagaccccuguucugcuaa

SEQ ID NO: 23763 - RNA, 1272 nt, Artificial Sequence
  SMPD2__Homo_sapiens__NP_003071
augaagcccaacuucagccugagacugagaaucuucaaccugaacugcuggggcauccccuaccugagcaagcacagagccgacagaaugagaagacugggcgacuuccugaaccaggagagcuucgaccuggcccugcuggaggagguguggagcgagcaggacuuccaguaccugagacagaagcugagccccaccuaccccgccgcccaccacuucagaagcggcaucaucggcagcggccugugcguguucagcaagcaccccauccaggagcugacccagcacaucuacacccugaacggcuaccccuacaugauccaccacggcgacugguucagcggcaaggccgugggccugcuggugcugcaccugagcggcauggugcugaacgccuacgugacccaccugcacgccgaguacaacagacagaaggacaucuaccuggcccacagaguggcccaggccugggagcuggcccaguucauccaccacaccagcaagaaggccgacguggugcugcugugcggcgaccugaacaugcaccccgaggaccugggcugcugccugcugaaggaguggaccggccugcacgacgccuaccuggagaccagagacuucaagggcagcgaggagggcaacaccauggugcccaagaacugcuacgugagccagcaggagcugaagcccuuccccuucggcgugagaaucgacuacgugcuguacaaggccgugagcggcuucuacaucagcugcaagagcuucgagaccaccaccggcuucgacccccacagaggcaccccccugagcgaccacgaggcccugauggccacccuguucgugagacacagccccccccagcagaaccccagcagcacccacggccccgccgagagaagcccccugaugugcgugcugaaggaggccuggaccgagcugggccugggcauggcccaggccagauggugggccaccuucgccagcuacgugaucggccugggccugcugcugcuggcccugcugugcgugcuggccgccggcggcggcgccggcgaggccgccauccugcuguggacccccagcgugggccuggugcugugggccggcgccuucuaccuguuccacgugcaggaggugaacggccuguacagagcccaggccgagcugcagcacgugcugggcagagccagagaggcccaggaccugggccccgagccccagcccgcccugcugcugggccagcaggagggcgacagaaccaaggagcaguaa

SEQ ID NO: 23764 - RNA, 1968 nt, Artificial Sequence
  SMPD3__Homo_sapiens__NP_061137
auggugcuguacaccacccccuuccccaacagcugccugagcgcccugcacugcgugagcugggcccugaucuuccccugcuacuggcugguggacagacuggccgccagcuucauccccaccaccuacgagaagagacagagagccgacgaccccugcugccugcagcugcugugcaccgcccuguucacccccaucuaccuggcccugcugguggccagccugcccuucgccuuccugggcuuccuguucuggagcccccugcagagcgccagaagacccuacaucuacagcagacuggaggacaagggccuggccggcggcgccgcccugcugagcgaguggaagggcaccggccccggcaagagcuucugcuucgccaccgccaacgugugccugcugcccgacagccuggccagagugaacaaccuguucaacacccaggccagagccaaggagaucggccagagaaucagaaacggcgccgccagaccccagaucaagaucuacaucgacagccccaccaacaccagcaucagcgccgccagcuucagcagccuggugagcccccagggcggcgacggcguggccagagccgugcccggcagcaucaagagaaccgccagcguggaguacaagggcgacggcggcagacaccccggcgacgaggccgccaacggccccgccagcggcgaccccguggacagcagcagccccgaggacgccugcaucgugagaaucggcggcgaggagggcggcagaccccccgaggccgacgaccccgugcccggcggccaggccagaaacggcgccggcggcggccccagaggccagacccccaaccacaaccagcaggacggcgacagcggcagccugggcagccccagcgccagcagagagagccuggugaagggcagagccggccccgacaccagcgccagcggcgagcccggcgccaacagcaagcugcuguacaaggccagcguggugaagaaggccgccgccagaagaagaagacaccccgacgaggccuucgaccacgaggugagcgccuucuuccccgccaaccuggacuuccugugccugcaggagguguucgacaagagagccgccaccaagcugaaggagcagcugcacggcuacuucgaguacauccuguacgacgugggcguguacggcugccagggcugcugcagcuucaagugccugaacagcggccugcuguucgccagcagauaccccaucauggacguggccuaccacugcuaccccaacaagugcaacgacgacgcccuggccagcaagggcgcccuguuccugaaggugcaggugggcagcaccccccaggaccagagaaucgugggcuacaucgccugcacccaccugcacgccccccaggaggacagcgccaucagaugcggccagcuggaccugcugcaggacuggcuggccgacuucagaaagagcaccagcagcagcagcgccgccaaccccgaggagcugguggccuucgacguggugugcggcgacuucaacuucgacaacugcagcagcgacgacaagcuggagcagcagcacagccuguucacccacuacagagaccccugcagacugggccccggcgaggagaagcccugggccaucggcacccugcuggacaccaacggccuguacgacgaggacgugugcacccccgacaaccugcagaaggugcuggagagcgaggagggcagaagagaguaccuggccuuccccaccagcaagagcagcggccagaagggcagaaaggagcugcugaagggcaacggcagaagaaucgacuacaugcugcacgccgaggagggccugugccccgacuggaaggccgagguggaggaguucagcuucaucacccagcugagcggccugaccgaccaccugcccguggccaugagacugauggugagcagcggcgaggaggaggccuaa

SEQ ID NO: 23765 - RNA, 969 nt, Artificial Sequence
  SMPDL3A__Homo_sapiens__NP_001273067
augaccaccaccauccagagccuguuccccaaccugcagguguuccccgcccugggcaaccacgacuacuggccccaggaccagcugcccguggugaccagcaagguguacaacgccguggccaaccuguggaagcccuggcuggacgaggaggccaucagcacccugagaaagggcggcuucuacagccagaaggugaccaccaaccccaaccugagaaucaucagccugaacaccaaccuguacuacggccccaacaucaugacccugaacaagaccgaccccgccaaccaguucgaguggcuggagagcacccugaacaacagccagcagaacaaggagaagguguacaucaucgcccacgugcccgugggcuaccugcccagcagccagaacaucaccgccaugagagaguacuacaacgagaagcugaucgacaucuuccagaaguacagcgacgugaucgccggccaguucuacggccacacccacagagacagcaucauggugcugagcgacaagaagggcagccccgugaacagccuguucguggcccccgccgugacccccgugaagagcgugcuggagaagcagaccaacaaccccggcaucagacuguuccaguacgaccccagagacuacaagcugcuggacaugcugcaguacuaccugaaccugaccgaggccaaccugaagggcgagagcaucuggaagcuggaguacauccugacccagaccuacgacaucgaggaccugcagcccgagagccuguacggccuggccaagcaguucaccauccuggacagcaagcaguucaucaaguacuacaacuacuucuucgugagcuacgacagcagcgugaccugcgacaagaccugcaaggccuuccagaucugcgccaucaugaaccuggacaacaucagcuacgccgacugccugaagcagcuguacaucaagcacaacuacuaa

SEQ ID NO: 23766 - RNA, 1458 nt, Artificial Sequence
  SMPDL3B__Homo_sapiens__XP_011539561
augagacugcuggccuggcugaucuuccuggccaacuggggcggcgccagagccgagcccgaggaggcccagggccccugcgcccaggagaagggcaagggccccccccccaccagcauccuggccagccuggcccccggccuggaggccggcaaguucuggcacaucgccgaccugcaccuggaccccgacuacaaggugagcaaggaccccuuccaggugugccccagcgccggcagccagcccgugcccgacgccggccccuggggcgacuaccugugcgacagccccugggcccugaucaacagcagcaucuacgccaugaaggagaucgagcccgagcccgacuucauccuguggaccggcgacgacaccccccacgugcccgacgagaagcugggcgaggccgccgugcuggagaucguggagagacugaccaagcugaucagagagguguuccccgacaccaagguguacgccgcccugggcaaccacgacuuccaccccaagaaccaguuccccgccggcagcaacaacaucuacaaccagaucgccgagcuguggaagcccuggcugagcaacgagagcaucgcccuguucaagaagggcgccuucuacugcgagaagcugcccggccccagcggcgccggcagaaucguggugcugaacaccaaccuguacuacaccagcaacgcccugaccgccgacauggccgaccccggccagcaguuccaguggcuggaggacgugcugaccgacgccagcaaggccggcgacaugguguacaucgugggccacgugccccccggcuucuucgagaagacccagaacaaggccugguucagagagggcuucaacgagaaguaccugaagguggugagaaagcaccacagagugaucgccggccaguucuucggccaccaccacaccgacagcuucagaaugcuguacgacgacgccggcgugcccaucagcgccauguucaucacccccggcgugacccccuggaagaccacccugcccggcguggugaacggcgccaacaaccccgccaucagaguguucgaguacgacagagccacccugagccugaaggacauggugaccuacuucaugaaccugagccaggccaacgcccagggcacccccagaugggagcuggaguaccagcugaccgaggccuacggcgugcccgacgccagcgcccacagcaugcacaccgugcuggacagaaucgccggcgaccagagcacccugcagagauacuacguguacaacagcgugagcuacagcgccggcgugugcgacgaggccugcagcaugcagcacgugugcgccaugagacagguggacaucgacgccuacaccaccugccuguacgccagcggcaccacccccgugccccagcugccccugcugcugauggcccugcugggccugugcacccuggugcuguaa

SEQ ID NO: 23767 - RNA, 267 nt, Artificial Sequence
  SMPX__Homo_sapiens__NP_055147
augaacaugagcaagcagcccgugagcaacgugagagccauccaggccaacaucaacauccccaugggcgccuucagacccggcgccggccagccccccagaagaaaggagugcacccccgagguggaggagggcgugccccccaccagcgacgaggagaagaagcccauccccggcgccaagaagcugcccggccccgccgugaaccugagcgagauccagaacaucaagagcgagcugaaguacgugcccaaggccgagcaguaa

SEQ ID NO: 23768 - RNA, 240 nt, Artificial Sequence
  SMR3B__Homo_sapiens__NP_006676
augaagagccugaccuggauccugggccugugggcccuggccgccugcuucacccccggcgagagccagagaggccccagaggccccuacccccccggcccccuggcccccccccagcccuucggccccggcuucgugcccccccccccccccccccccuacggccccggcagaauccccccccccccccccgcccccuacggccccggcaucuucccccccccccccccccagcccuaa

SEQ ID NO: 23769 - RNA, 942 nt, Artificial Sequence
  SMS__Homo_sapiens__NP_001245352
auggccgccgccagacacagcacccuggacuucaugcugggcgccaaggccgacggcgagaccauccugaagggccugcagagcaucuuccaggagcagggcauggccgagagcgugcacaccuggcaggaccacggcuaccuggccaccuacaccaacaagaacggcagacugccccccaucgugagaggcggcgccaucgacagauacuggcccaccgccgacggcagacugguggaguacgacaucgacgaggugguguacgacgaggacagccccuaccagaacaucaagauccugcacagcaagcaguucggcaacauccugauccugagcggcgacgugaaccuggccgagagcgaccuggccuacaccagagccaucaugggcagcggcaaggaggacuacaccggcaaggacgugcugauccugggcggcggcgacggcggcauccugugcgagaucgugaagcugaagcccaagauggugaccaugguggagaucgaccagauggugaucgacggcugcaagaaguacaugagaaagaccugcggcgacgugcuggacaaccugaagggcgacugcuaccaggugcugaucgaggacugcauccccgugcugaagagauacgccaaggagggcagagaguucgacuacgugaucaacgaccugaccgccgugcccaucagcaccagccccgaggaggacagcaccugggaguuccugagacugauccuggaccugagcaugaaggugcugaagcaggacggcaaguacuucacccagggcaacugcgugaaccugaccgaggcccugagccuguacgaggagcagcugggcagacuguacugccccguggaguucagcaaggagaucgugugcgugcccagcuaccuggagcuguggguguucuacaccguguggaagaaggccaagcccuaa

SEQ ID NO: 23770 - RNA, 2754 nt, Artificial Sequence
  SMTN__Homo_sapiens__NP_008863
auggccgacgaggcccuggccggccuggacgagggcgcccugagaaagcugcuggaggugaccgccgaccuggccgagagaagaagaaucagaagcgccaucagagagcugcagagacaggagcuggagagagaggaggaggcccuggccagcaagagauucagagccgagagacaggacaacaaggagaacuggcugcacagccagcagagagaggccgagcagagagccgcccuggccagacuggccggccagcuggagagcaugaacgacguggaggagcugaccgcccugcugagaagcgccggcgaguacgaggagagaaagcugaucagagccgccaucagaagagugagagcccaggagaucgaggccgccacccuggccggcagacuguacagcggcagacccaacagcggcagcagagaggacagcaagggccuggccgcccacagacuggagcagugcgaggugcccgagagagaggagcaggagcagcaggccgaggugagcaagcccacccccacccccgagggcaccagccaggacgugaccaccgugacccugcugcugagagccccccccggcagcaccagcagcagccccgccagccccagcagcagccccacccccgccagccccgagcccccccuggagcccgccgaggcccagugccugaccgccgaggugcccggcagccccgagcccccccccagcccccccaagaccaccagccccgagccccaggagagccccacccugcccagcaccgagggccagguggugaacaagcugcugagcggccccaaggagacccccgccgcccagagccccaccagaggccccagcgacaccaagagagccgacguggccggccccagacccugccagagaagccugagcgugcugagccccagacagcccgcccagaacagagagagcaccccccuggccagcggccccagcagcuuccagagagccggcagcgugagagacagagugcacaaguucaccagcgacagccccauggccgccagacugcaggacggcaccccccaggccgcccugagcccccugacccccgccagacugcugggccccagccugaccagcaccacccccgccagcagcagcagcggcagcagcagcagaggccccagcgacaccagcagcagauucagcaaggagcagagaggcguggcccagccccuggcccagcugagaagcugcccccaggaggagggccccagaggcagaggccuggccgccagaccccuggagaacagagccggcggccccguggccagaagcgaggagcccggcgccccccugcccguggccgugggcaccgccgagcccggcggcagcaugaagaccaccuucaccaucgagaucaaggacggcagaggccaggccagcaccggcagagugcugcugcccaccggcaaccagagagccgagcugacccugggccugagagccccccccacccugcugagcaccagcagcggcggcaagagcaccaucaccagagugaacagccccggcacccuggccagacugggcagcgugacccacgugaccagcuucagccacgccccccccagcagcagaggcggcugcagcaucaagauggaggccgagcccgccgagccccuggccgccgccguggaggccgccaacggcgccgagcagaccagagugaacaaggcccccgagggcagaagcccccugagcgccgaggagcugaugaccaucgaggacgagggcgugcuggacaagaugcuggaccagagcaccgacuucgaggagagaaagcugaucagagccgcccugagagagcugagacagagaaagagagaccagagagacaaggagagagagagaagacugcaggaggccagaggcagacccggcgagggcagaggcaacaccgccaccgagaccaccaccagacacagccagagagccgccgacggcagcgccgugagcaccgugaccaagaccgagagacuggugcacagcaacgacggcaccagaaccgccagaaccaccaccguggagagcagcuucgugagaagaagcgagaacggcagcggcagcaccaugaugcagaccaagaccuucagcagcagcagcagcagcaagaagaugggcagcaucuucgacagagaggaccaggccagccccagagccggcagccuggccgcccuggagaagagacaggccgagaagaagaaggagcugaugaaggcccagagccugcccaagaccagcgccagccaggccagaaaggccaugaucgagaagcuggagaaggagggcgccgccggcagccccggcggccccagagccgccgugcagagaagcaccagcuucggcgugcccaacgccaacagcaucaagcagaugcugcuggacuggugcagagccaagaccagaggcuacgagcacguggacauccagaacuucagcagcagcuggagcgacggcauggccuucugcgcccuggugcacaacuucuuccccgaggccuucgacuacggccagcugagcccccagaacagaagacagaacuucgagguggccuucagcagcgccgagaugcugguggacugcgugccccugguggagguggacgacaugaugaucaugggcaagaagcccgaccccaagugcguguucaccuacgugcagagccuguacaaccaccugagaagacacgagcugagacugagaggcaagaacguguaa

SEQ ID NO: 23771 - RNA, 1485 nt, Artificial Sequence
  SMTNL1__Homo_sapiens__NP_001099035
auggagcagaaggagggcaagcugagcgaggacggcaccaccgugagccccgccgccgacaaccccgagaugagcggcggcggcgcccccgccgaggagaccaagggcaccgccggcaaggccaucaacgagggcccccccaccgagagcggcaagcaggagaaggcccccgccgaggacggcaugagcgccgagcugcagggcgaggccaacggccuggacgaggugaagguggagagccagagagaggccggcggcaaggaggacgccgaggccgagcugaagaaggaggacggcgagaaggaggagaccaccgugggcagccaggagaugaccggcagaaaggaggagaccaagagcgagcccaaggaggccgaggagaaggagagcacccuggccagcgagaagcagaaggccgaggagaaggaggccaagcccgagagcggccagaaggccgacgccaacgacagagacaagcccgagcccaaggccaccguggaggaggaggacgccaagaccgccagccaggaggagaccggccagagaaaggagugcagcaccgagcccaaggagaaggccaccgacgaggaggccaaggccgagagccagaaggccgugguggaggacgaggccaaggccgagcccaaggagcccgacggcaaggaggaggccaagcacggcgccaaggaggaggccgacgccaaggaggaggccgaggacgccgaggaggccgagcccggcagccccagcgaggagcaggagcaggacguggagaaggagcccgagggcggcgccggcgugauccccagcagccccgaggaguggcccgagagccccaccggcgagggccacaaccugagcaccgacggccugggccccgacugcguggccagcggccagaccagccccagcgccagcgagagcagccccagcgacgugccccagagcccccccgagagccccagcagcggcgagaagaaggagaaggcccccgagagaagagugagcgcccccgccagacccagaggccccagagcccagaacagaaaggccaucguggacaaguucggcggcgccgccagcggccccaccgcccuguucagaaacaccaaggccgccggcgccgccaucggcggcgugaagaacaugcugcuggaguggugcagagccaugaccaagaaguacgagcacguggacauccagaacuucagcagcagcuggagcagcggcauggccuucugcgcccugauccacaaguucuuccccgacgccuucgacuacgccgagcuggaccccgccaagagaagacacaacuucacccuggccuucagcaccgccgagaagcuggccgacugcgcccagcugcuggacguggacgacauggugagacuggccgugcccgacagcaagugcguguacaccuacauccaggagcuguacagaagccuggugcagaagggccuggugaagaccaagaagaaguaa

SEQ ID NO: 23772 - RNA, 1542 nt, Artificial Sequence
  SMU1__Homo_sapiens__NP_060695
augagcaucgagaucgagagcagcgacgugaucagacugaucaugcaguaccugaaggagaacagccugcacagagcccuggccacccugcaggaggagaccaccgugagccugaacaccguggacagcaucgagagcuucguggccgacaucaacagcggccacugggacaccgugcugcaggccauccagagccugaagcugcccgacaagacccugaucgaccuguacgagcagguggugcuggagcugaucgagcugagagagcugggcgccgccagaagccugcugagacagaccgaccccaugaucaugcugaagcagacccagcccgagagauacauccaccuggagaaccugcuggccagaagcuacuucgaccccagagaggccuaccccgacggcagcagcaaggagaagagaagagccgccaucgcccaggcccuggccggcgaggugagcguggugccccccagcagacugauggcccugcugggccaggcccugaaguggcagcagcaccagggccugcugccccccggcaugaccaucgaccuguucagaggcaaggccgccgugaaggacguggaggaggagaaguuccccacccagcugagcagacacaucaaguucggccagaagagccacguggagugcgccagauucagccccgacggccaguaccuggugaccggcagcguggacggcuucaucgagguguggaacuucaccaccggcaagaucagaaaggaccugaaguaccaggcccaggacaacuucaugaugauggacgacgccgugcugugcaugugcuucagcagagacaccgagaugcuggccaccggcgcccaggacggcaagaucaagguguggaagauccagagcggccagugccugagaagauucgagagagcccacagcaagggcgugaccugccugagcuucagcaaggacagcagccagauccugagcgccagcuucgaccagaccaucagaauccacggccugaagagcggcaagacccugaaggaguucagaggccacagcagcuucgugaacgaggccaccuucacccaggacggccacuacaucaucagcgccagcagcgacggcaccgugaagaucuggaacaugaagaccaccgagugcagcaacaccuucaagagccugggcagcaccgccggcaccgacaucaccgugaacagcgugauccugcugcccaagaaccccgagcacuucguggugugcaacagaagcaacaccguggugaucaugaacaugcagggccagaucgugagaagcuucagcagcggcaagagagagggcggcgacuucgugugcugcgcccugagccccagaggcgaguggaucuacugcgugggcgaggacuucgugcuguacugcuucagcaccgugaccggcaagcuggagagaacccugaccgugcacgagaaggacgugaucggcaucgcccaccacccccaccagaaccugaucgccaccuacagcgaggacggccugcugaagcuguggaagcccuaa

SEQ ID NO: 23773 - RNA, 534 nt, Artificial Sequence
  SMUG1__Homo_sapiens__XP_006719385
augccccaggccuuccugcugggcagcauccacgagcccgccggcgcccugauggagccccagcccugccccggcagccuggccgagagcuuccuggaggaggagcugagacugaacgccgagcugagccagcugcaguucagcgagcccgugggcaucaucuacaaccccguggaguacgccugggagccccacagaaacuacgugaccagauacugccagggccccaaggaggugcuguuccugggcaugaaccccggccccuucggcauggcccagaccggcgugcccuucggcgaggugagcauggugagagacuggcugggcaucgugggccccgugcugacccccccccaggagcaccccaagagacccgugcugggccuggagugcccccagagcgagggccccagacagagcaugggccacgagaucaagagcgagcugcugaugggcggcugcagcuggaucagaggcaagauccagugcgacagagugcaggugagaagacccggcuucagcagccagcuguaa

SEQ ID NO: 23774 - RNA, 2274 nt, Artificial Sequence
  SMURF1__Homo_sapiens__NP_065162
augagcaaccccggcaccagaagaaacggcagcagcaucaagaucagacugaccgugcugugcgccaagaaccuggccaagaaggacuucuucagacugcccgaccccuucgccaagaucgugguggacggcagcggccagugccacagcaccgacaccgugaagaacacccuggaccccaaguggaaccagcacuacgaccuguacgugggcaagaccgacagcaucaccaucagcguguggaaccacaagaagauccacaagaagcagggcgccggcuuccugggcugcgugagacugcugagcaacgccaucagcagacugaaggacaccggcuaccagagacuggaccugugcaagcugaaccccagcgacaccgacgccgugagaggccagaucguggugagccugcagaccagagacagaaucggcaccggcggcagcgugguggacugcagaggccugcuggagaacgagggcaccguguacgaggacagcggccccggcagaccccugagcugcuucauggaggagcccgcccccuacaccgacagcaccggcgccgccgccggcggcggcaacugcagauucguggagagccccagccaggaccagagacugcaggcccagagacugagaaaccccgacgugagaggcagccugcagaccccccagaacagaccccacggccaccagagccccgagcugcccgagggcuacgagcagagaaccaccgugcagggccagguguacuuccugcacacccagaccggcgugagcaccuggcacgaccccagaauccccagccccagcggcaccauccccggcggcgacgccgccuuccuguacgaguuccugcugcagggccacaccagcgagcccagagaccugaacagcgugaacugcgacgagcugggcccccugccccccggcugggaggugagaagcaccgugagcggcagaaucuacuucguggaccacaacaacagaaccacccaguucaccgaccccagacugcaccacaucaugaaccaccagugccagcugaaggagcccagccagccccugccccugcccagcgagggcagccuggaggacgaggagcugcccgcccagagauacgagagagaccuggugcagaagcugaaggugcugagacacgagcugagccugcagcagccccaggccggccacugcagaaucgaggugagcagagaggagaucuucgaggagagcuacagacagaucaugaagaugagacccaaggaccugaagaagagacugauggugaaguucagaggcgaggagggccuggacuacggcggcguggccagagaguggcuguaccugcugugccacgagaugcugaaccccuacuacggccuguuccaguacagcaccgacaacaucuacaugcugcagaucaaccccgacagcagcaucaaccccgaccaccugagcuacuuccacuucgugggcagaaucaugggccuggccguguuccacggccacuacaucaacggcggcuucaccgugcccuucuacaagcagcugcugggcaagcccauccagcugagcgaccuggagagcguggaccccgagcugcacaagagccugguguggauccuggagaacgacaucacccccgugcuggaccacaccuucugcguggagcacaacgccuucggcagaauccugcagcacgagcugaagcccaacggcagaaacgugcccgugaccgaggagaacaagaaggaguacgugagacuguacgugaacuggagauucaugagaggcaucgaggcccaguuccuggcccugcagaagggcuucaacgagcugaucccccagcaccugcugaagcccuucgaccagaaggagcuggagcugaucaucggcggccuggacaagaucgaccugaacgacuggaagagcaacaccagacugaagcacugcguggccgacagcaacaucgugagaugguucuggcaggccguggagaccuucgacgaggagagaagagccagacugcugcaguucgugaccggcagcaccagagugccccugcagggcuucaaggcccugcagggcagcaccggcgccgccggccccagacuguucaccauccaccugaucgacgccaacaccgacaaccugcccaaggcccacaccugcuucaacagaaucgacaucccccccuacgagagcuacgagaagcuguacgagaagcugcugaccgccguggaggagaccugcggcuucgccguggaguaa

SEQ ID NO: 23775 - RNA, 2247 nt, Artificial Sequence
  SMURF2__Homo_sapiens__NP_073576
augagcaaccccggcggcagaagaaacggccccgugaagcugagacugaccgugcugugcgccaagaaccuggugaagaaggacuucuucagacugcccgaccccuucgccaagguggugguggacggcagcggccagugccacagcaccgacaccgugaagaacacccuggaccccaaguggaaccagcacuacgaccuguacaucggcaagagcgacagcgugaccaucagcguguggaaccacaagaagauccacaagaagcagggcgccggcuuccugggcugcgugagacugcugagcaacgccaucaacagacugaaggacaccggcuaccagagacuggaccugugcaagcugggccccaacgacaacgacaccgugagaggccagaucguggugagccugcagagcagagacagaaucggcaccggcggccaggugguggacugcagcagacuguucgacaacgaccugcccgacggcugggaggagagaagaaccgccagcggcagaauccaguaccugaaccacaucaccagaaccacccagugggagagacccaccagacccgccagcgaguacagcagccccggcagaccccugagcugcuucguggacgagaacacccccaucagcggcaccaacggcgccaccugcggccagagcagcgaccccagacuggccgagagaagagugagaagccagagacacagaaacuacaugagcagaacccaccugcacaccccccccgaccugcccgagggcuacgagcagagaaccacccagcagggccagguguacuuccugcacacccagaccggcgugagcaccuggcacgaccccagagugcccagagaccugagcaacaucaacugcgaggagcugggcccccugccccccggcugggagaucagaaacaccgccaccggcagaguguacuucguggaccacaacaacagaaccacccaguucaccgaccccagacugagcgccaaccugcaccuggugcugaacagacagaaccagcugaaggaccagcagcagcagcagguggugagccugugccccgacgacaccgagugccugaccgugcccagauacaagagagaccuggugcagaagcugaagauccugagacaggagcugagccagcagcagccccaggccggccacugcagaaucgaggugagcagagaggagaucuucgaggagagcuacagacaggugaugaagaugagacccaaggaccuguggaagagacugaugaucaaguucagaggcgaggagggccuggacuacggcggcguggccagagaguggcuguaccugcugagccacgagaugcugaaccccuacuacggccuguuccaguacagcagagacgacaucuacacccugcagaucaaccccgacagcgccgugaaccccgagcaccugagcuacuuccacuucgugggcagaaucaugggcauggccguguuccacggccacuacaucgacggcggcuucacccugcccuucuacaagcagcugcugggcaagagcaucacccuggacgacauggagcugguggaccccgaccugcacaacagccugguguggauccuggagaacgacaucaccggcgugcuggaccacaccuucugcguggagcacaacgccuacggcgagaucauccagcacgagcugaagcccaacggcaagagcauccccgugaacgaggagaacaagaaggaguacgugagacuguacgugaacuggagauuccugagaggcaucgaggcccaguuccuggcccugcagaagggcuucaacgaggugaucccccagcaccugcugaagaccuucgacgagaaggagcuggagcugaucaucugcggccugggcaagaucgacgugaacgacuggaaggugaacaccagacugaagcacugcacccccgacagcaacaucgugaagugguucuggaaggccguggaguucuucgacgaggagagaagagccagacugcugcaguucgugaccggcagcagcagagugccccugcagggcuucaaggcccugcagggcgccgccggccccagacuguucaccauccaccagaucgacgccugcaccaacaaccugcccaaggcccacaccugcuucaacagaaucgacaucccccccuacgagagcuacgagaagcuguacgagaagcugcugaccgccaucgaggagaccugcggcuucgccguggaguaa

SEQ ID NO: 23776 - RNA, 1473 nt, Artificial Sequence
  SMYD1__Homo_sapiens__NP_938015
augaccaucggcagaauggagaacguggagguguucaccgccgagggcaagggcagaggccugaaggccaccaaggaguucugggccgccgacaucaucuucgccgagagagccuacagcgccgugguguucgacagccuggugaacuucgugugccacaccugcuucaagagacaggagaagcugcacagaugcggccagugcaaguucgcccacuacugcgacagaaccugccagaaggacgccuggcugaaccacaagaacgagugcagcgccaucaagagauacggcaaggugcccaacgagaacaucagacuggccgccagaaucauguggagaguggagagagagggcaccggccugaccgagggcugccuggugagcguggacgaccugcagaaccacguggagcacuucggcgaggaggagcagaaggaccugagaguggacguggacaccuuccugcaguacuggcccccccagagccagcaguucagcaugcaguacaucagccacaucuucggcgugaucaacugcaacggcuucacccugagcgaccagagaggccugcaggccgugggcgugggcaucuuccccaaccugggccuggugaaccacgacugcuggcccaacugcaccgugaucuucaacaacggcaaccacgaggccgugaagagcauguuccacacccagaugagaaucgagcugagagcccugggcaagaucagcgagggcgaggagcugaccgugagcuacaucgacuuccugaacgugagcgaggagagaaagagacagcugaagaagcaguacuacuucgacugcaccugcgagcacugccagaagaagcugaaggacgaccuguuccugggcgugaaggacaaccccaagcccagccaggagguggugaaggagaugauccaguucagcaaggacacccuggagaagaucgacaaggccagaagcgagggccuguaccacgagguggugaagcugugcagagagugccuggagaagcaggagcccguguucgccgacaccaacaucuacaugcugagaaugcugagcaucgugagcgaggugcugagcuaccugcaggccuucgaggaggccagcuucuacgccagaagaaugguggacggcuacaugaagcuguaccaccccaacaacgcccagcugggcauggccgugaugagagccggccugaccaacuggcacgccggcaacaucgaggugggccacggcaugaucugcaaggccuacgccauccugcuggugacccacggccccagccaccccaucaccaaggaccuggaggccaugagagugcagaccgagauggagcugagaauguucagacagaacgaguucauguacuacaagaugagagaggccgcccugaacaaccagcccaugcaggugauggccgagcccagcaacgagcccagccccgcccuguuccacaagaagcaguaa

SEQ ID NO: 23777 - RNA, 1302 nt, Artificial Sequence
  SMYD2__Homo_sapiens__NP_064582
augagagccgagggccugggcggccuggagagauucugcagccccggcaagggcagaggccugagagcccugcagcccuuccaggugggcgaccugcuguucagcugccccgccuacgccuacgugcugaccgugaacgagagaggcaaccacugcgaguacugcuucaccagaaaggagggccugagcaagugcggcagaugcaagcaggccuucuacugcaacguggagugccagaaggaggacuggcccaugcacaagcuggagugcagccccauggugguguucggcgagaacuggaaccccagcgagaccgugagacugaccgccagaauccuggccaagcagaagauccaccccgagagaacccccagcgagaagcugcuggccgugaaggaguucgagagccaccuggacaagcuggacaacgagaagaaggaccugauccagagcgacaucgccgcccugcaccacuucuacagcaagcaccugggcuuccccgacaacgacagccugguggugcuguucgcccaggugaacugcaacggcuucaccaucgaggacgaggagcugagccaccugggcagcgccaucuuccccgacguggcccugaugaaccacagcugcugccccaacgugaucgugaccuacaagggcacccuggccgaggugagagccgugcaggagaucaagcccggcgaggagguguucaccagcuacaucgaccugcuguaccccaccgaggacagaaacgacagacugagagacagcuacuucuucaccugcgagugccaggagugcaccaccaaggacaaggacaaggccaagguggagaucagaaagcugagcgacccccccaaggccgaggccaucagagacauggugagauacgccagaaacgugaucgaggaguucagaagagccaagcacuacaagagccccagcgagcugcuggagaucugcgagcugagccaggagaagaugagcagcguguucgaggacagcaacguguacaugcugcacaugauguaccaggccaugggcgugugccuguacaugcaggacugggagggcgcccugcaguacggccagaagaucaucaagcccuacagcaagcacuacccccuguacagccugaacguggccagcauguggcugaagcugggcagacuguacaugggccuggagcacaaggccgccggcgagaaggcccugaagaaggccaucgccaucauggagguggcccacggcaaggaccaccccuacaucagcgagaucaagcaggagaucgagagccacuaa

SEQ ID NO: 23778 - RNA, 1287 nt, Artificial Sequence
  SMYD3__Homo_sapiens__NP_001161212
auggagccccugaagguggagaaguucgccaccgccaagagaggcaacggccugagagccgugaccccccugagacccggcgagcugcuguucagaagcgacccccuggccuacaccgugugcaagggcagcagaggcguggugugcgacagaugccugcugggcaaggagaagcugaugagaugcagccagugcagaguggccaaguacugcagcgccaagugccagaagaaggccuggcccgaccacaagagagagugcaagugccugaagagcugcaagcccagauacccccccgacagcgugagacugcugggcagagugguguucaagcugauggacggcgcccccagcgagagcgagaagcuguacagcuucuacgaccuggagagcaacaucaacaagcugaccgaggacaagaaggagggccugagacagcuggugaugaccuuccagcacuucaugagagaggagauccaggacgccagccagcugccccccgccuucgaccuguucgaggccuucgccaaggugaucugcaacagcuucaccaucugcaacgccgagaugcaggaggugggcgugggccuguaccccagcaucagccugcugaaccacagcugcgaccccaacugcagcaucguguucaacggcccccaccugcugcugagagccgugagagacaucgaggugggcgaggagcugaccaucugcuaccuggacaugcugaugaccagcgaggagagaagaaagcagcugagagaccaguacugcuucgagugcgacugcuucagaugccagacccaggacaaggacgccgacaugcugaccggcgacgagcagguguggaaggaggugcaggagagccugaagaagaucgaggagcugaaggcccacuggaagugggagcaggugcuggccaugugccaggccaucaucagcagcaacagcgagagacugcccgacaucaacaucuaccagcugaaggugcuggacugcgccauggacgccugcaucaaccugggccugcuggaggaggcccuguucuacggcaccagaaccauggagcccuacagaaucuucuuccccggcagccaccccgugagaggcgugcaggugaugaaggugggcaagcugcagcugcaccagggcauguucccccaggccaugaagaaccugagacuggccuucgacaucaugagagugacccacggcagagagcacagccugaucgaggaccugauccugcugcuggaggagugcgacgccaacaucagagccagcuaa

SEQ ID NO: 23779 - RNA, 2415 nt, Artificial Sequence
  SMYD4__Homo_sapiens__NP_443160
auggaccugcccguggacgaguggaagagcuaccugcugcagaagugggccagccugcccaccagcgugcaggugaccaucagcaccgccgagacccugagagacaucuuccugcacagcagcagccugcugcagcccgaggacgagcuguuccugaagagacugagcaagggcuaccuggugggcaaggacagcgacgccccccuguucuacagagaggagggcaacaagaaguuccaggagaaggacuacaccggcgccgccgugcuguacagcaagggcgugagccacagcagacccaacaccgaggacaugagccugugccacgccaacagaagcgccgcccuguuccaccugggccaguacgagaccugccugaaggacaucaacagagcccagacccacggcuaccccgagagacugcagcccaagaucaugcugagaaaggccgagugccugguggcccugggcagacugcaggaggccagccagaccaucagcgaccuggagagaaacuucaccgccacccccgcccuggccgacgugcugccccagacccugcagagaaaccugcacagacugaagaugaagaugcaggagaaggacagccugaccgagagcuuccccgccgcccuggccaagacccuggaggacgccgcccugagagaggagaacgagcagcugagcaacgccagcagcagcaucggccugugcguggacccccugaagggcagaugccugguggccaccaaggacauccugcccggcgagcugcuggugcaggaggacgccuucgugagcgugcugaaccccggcgagcugccccccccccaccacggccuggacagcaagugggacaccagagugaccaacggcgaccuguacugccacagaugccugaagcacacccuggccaccgugcccugcgacggcugcagcuacgccaaguacugcagccaggagugccugcagcaggccugggagcuguaccacagaaccgagugcccccugggcggccugcugcugacccugggcguguucugccacaucgcccugagacugacccugcuggugggcuucgaggacgugagaaagaucaucaccaagcugugcgacaagaucagcaacaaggacaucugccugcccgagagcaacaaccaggugaagacccugaacuacggccugggcgagagcgagaagaacggcaacaucguggagacccccauccccggcugcgacaucaacggcaaguacgagaacaacuacaacgccguguucaaccugcugccccacaccgagaaccacagccccgagcacaaguuccugugcgcccugugcgugagcgcccugugcagacagcuggaggccgccagccugcaggccauccccaccgagagaaucgugaacagcagccagcugaaggccgccgugacccccgagcugugccccgacgugaccaucuggggcguggccaugcugagacacaugcugcagcugcagugcaacgcccaggccaugaccaccauccagcacaccggccccaagggcagcaucgugaccgacagcagacaggugagacuggccaccggcaucuuccccgugaucagccugcugaaccacagcugcagccccaacaccagcgugagcuucaucagcaccguggccaccaucagagccagccagagaaucagaaagggccaggagauccugcacugcuacggcccccacaagagcagaaugggcguggccgagagacagcagaagcugagaagccaguacuucuucgacugcgccugccccgccugccagaccgaggcccacagaauggccgccggccccagaugggaggccuucugcugcaacagcugcggcgcccccaugcagggcgacgacgugcugagaugcggcagcagaagcugcgccgagagcgccgugagcagagaccaccuggugagcagacugcaggaccugcagcagcaggugagaguggcccagaagcugcugagagacggcgagcuggagagagccgugcagagacugagcggcugccagagagacgccgagagcuuccugugggccgagcacgccguggugggcgagaucgccgacggccuggccagagccugcgccgcccugggcgacuggcagaagagcgccacccaccugcagagaagccuguacgugguggaggugagacacggccccagcagcguggagaugggccacgagcuguucaagcuggcccagaucuucuucaacggcuucgccgugcccgaggcccugagcaccauccagaaggccgaggaggugcugagccugcacugcggccccugggacgacgagauccaggagcugcagaagaugaagagcugccugcuggaccugccccccacccccgugggccccgcccuguaa

SEQ ID NO: 23780 - RNA, 1257 nt, Artificial Sequence
  SMYD5__Homo_sapiens__NP_006053
auggccgccagcaugugcgacguguucagcuucugcgugggcguggccggcagagccagagugagcguggaggugagauucgugagcagcgccaagggcaagggccuguucgccacccagcugaucagaaagggcgagaccaucuucguggagagaccccugguggccgcccaguuccuguggaacgcccuguacagauacagagccugcgaccacugccugagagcccuggagaaggccgaggagaacgcccagagacugaccggcaagcccggccaggugcugccccaccccgagcugugcaccgugagaaaggaccugcaccagaacugcccccacugccaggugauguacugcagcgccgagugcagacuggccgccaccgagcaguaccaccaggugcugugccccggccccagccaggacgacccccugcacccccugaacaagcugcaggaggccuggagaagcauccacuacccccccgagaccgccagcaucaugcugauggccagaaugguggccaccgugaagcaggccaaggacaaggacagauggaucagacuguucagccaguucugcaacaagaccgccaacgaggaggaggagaucgugcacaagcugcugggcgacaaguucaagggccagcuggagcugcugagaagacuguucaccgaggcccuguacgaggaggccgugagccagugguucacccccgacggcuucagaagccuguucgcccuggugggcaccaacggccagggcaucggcaccagcagccugagccagugggugcacgccugcgacacccuggagcugaagccccaggacagagagcagcuggacgccuucaucgaccagcuguacaaggacaucgaggccgccaccggcgaguuccugaacugcgagggcagcggccuguucgugcugcagagcugcugcaaccacagcugcgugcccaacgccgagaccagcuuccccgagaacaacuuccugcugcacgugaccgcccuggaggacaucaagcccggcgaggagaucugcaucagcuaccuggacugcugccagagagagagaagcagacacagcagacacaagauccugagagagaacuaccuguucgugugcagcugccccaagugccuggccgaggccgacgagcccaacgugaccagcgaggaggaggaggaggaggaggaggaggaggagggcgagcccgaggacgccgagcugggcgacgagaugaccgacguguaa

SEQ ID NO: 23781 - RNA, 795 nt, Artificial Sequence
  SNAI1__Homo_sapiens__NP_005976
augcccagaagcuuccuggugagaaagcccagcgaccccaacagaaagcccaacuacagcgagcugcaggacagcaaccccgaguucaccuuccagcagcccuacgaccaggcccaccugcuggccgccauccccccccccgagauccugaaccccaccgccagccugcccaugcugaucugggacagcgugcuggccccccaggcccagcccaucgccugggccagccugagacugcaggagagccccagaguggccgagcugaccagccugagcgacgaggacagcggcaagggcagccagccccccagcccccccagccccgcccccagcagcuucagcagcaccagcgugagcagccuggaggccgaggccuacgccgccuuccccggccugggccaggugcccaagcagcuggcccagcugagcgaggccaaggaccugcaggccagaaaggccuucaacugcaaguacugcaacaaggaguaccugagccugggcgcccugaagaugcacaucagaagccacacccugcccugcgugugcggcaccugcggcaaggccuucagcagacccuggcugcugcagggccacgugagaacccacaccggcgagaagcccuucagcugcccccacugcagcagagccuucgccgacagaagcaaccugagagcccaccugcagacccacagcgacgugaagaaguaccagugccaggccugcgccagaaccuucagcagaaugagccugcugcacaagcaccaggagagcggcugcagcggcugccccagauaa

SEQ ID NO: 23782 - RNA, 807 nt, Artificial Sequence
  SNAI2__Homo_sapiens__NP_003059
augcccagaagcuuccuggugaagaagcacuucaacgccagcaagaagcccaacuacagcgagcuggacacccacaccgugaucaucagccccuaccuguacgagagcuacagcaugcccgugaucccccagcccgagauccugagcagcggcgccuacagccccaucaccguguggaccaccgccgcccccuuccacgcccagcugcccaacggccugagcccccugagcggcuacagcagcagccugggcagagugagcccccccccccccagcgacaccagcagcaaggaccacagcggcagcgagagccccaucagcgacgaggaggagagacugcagagcaagcugagcgacccccacgccaucgaggccgagaaguuccagugcaaccugugcaacaagaccuacagcaccuucagcggccuggccaagcacaagcagcugcacugcgacgcccagagcagaaagagcuucagcugcaaguacugcgacaaggaguacgugagccugggcgcccugaagaugcacaucagaacccacacccugcccugcgugugcaagaucugcggcaaggccuucagcagacccuggcugcugcagggccacaucagaacccacaccggcgagaagcccuucagcugcccccacugcaacagagccuucgccgacagaagcaaccugagagcccaccugcagacccacagcgacgugaagaaguaccagugcaagaacugcagcaagaccuucagcagaaugagccugcugcacaagcacgaggagagcggcugcugcguggcccacuaa

SEQ ID NO: 23783 - RNA, 879 nt, Artificial Sequence
  SNAI3__Homo_sapiens__NP_840101
augcccagaagcuuccuggugaagacccacagcagccacagagugcccaacuacagaagacuggagacccagagagagaucaacggcgccugcagcgccugcggcggccugguggugccccugcugcccagagacaaggaggcccccagcgugcccggcgaccugccccagcccugggacagaagcagcgccguggccugcaucagccugccccugcugcccagaaucgaggaggcccugggcgccagcggccuggacgcccuggaggugagcgagguggaccccagagccagcagagccgccaucgugccccugaaggacagccugaaccaccugaaccugcccccccugcuggugcugcccaccagauggagccccacccugggccccgacagacacggcgcccccgagaagcugcugggcgccgagagaaugcccagagcccccggcggcuucgagugcuuccacugccacaagcccuaccacacccuggccggccuggccagacacagacagcugcacugccaccugcaggugggcagaguguucaccugcaaguacugcgacaaggaguacaccagccugggcgcccugaagaugcacaucagaacccacacccugcccugcaccugcaagaucugcggcaaggccuucagcagacccuggcugcugcagggccacgugagaacccacaccggcgagaagcccuacgccugcagccacugcagcagagccuucgccgacagaagcaaccugagagcccaccugcagacccacagcgacgccaagaaguacagaugcagaagaugcaccaagaccuucagcagaaugagccugcuggccagacacgaggagagcggcugcugccccggccccuaa

SEQ ID NO: 23784 - RNA, 636 nt, Artificial Sequence
  SNAP23__Homo_sapiens__NP_003816
auggacaaccugagcagcgaggagauccagcagagagcccaccagaucaccgacgagagccuggagagcaccagaagaauccugggccuggccaucgagagccaggacgccggcaucaagaccaucaccaugcuggacgagcagaaggagcagcugaacagaaucgaggagggccuggaccagaucaacaaggacaugagagagaccgagaagacccugaccgagcugaacaagugcugcggccugugcgugugccccugcaacagaaccaagaacuucgagagcggcaaggccuacaagaccaccuggggcgacggcggcgagaacagccccugcaacguggugagcaagcagcccggccccgugaccaacggccagcugcagcagcccaccaccggcgccgccagcggcggcuacaucaagagaaucaccaacgacgccagagaggacgagauggaggagaaccugacccaggugggcagcauccugggcaaccugaaggacauggcccugaacaucggcaacgagaucgacgcccagaacccccagaucaagagaaucaccgacaaggccgacaccaacagagacagaaucgacaucgccaacgccagagccaagaagcugaucgacagcuaa

SEQ ID NO: 23785 - RNA, 621 nt, Artificial Sequence
  SNAP25__Homo_sapiens__NP_003072
auggccgaggacgccgacaugagaaacgagcuggaggagaugcagagaagagccgaccagcuggccgacgagagccuggagagcaccagaagaaugcugcagcugguggaggagagcaaggacgccggcaucagaacccuggugaugcuggacgagcagggcgagcagcuggacagaguggaggagggcaugaaccacaucaaccaggacaugaaggaggccgagaagaaccugaaggaccugggcaagugcugcggccuguucaucugccccugcaacaagcugaagagcagcgacgccuacaagaaggccuggggcaacaaccaggacggcgugguggccagccagcccgccagagugguggacgagagagagcagauggccaucagcggcggcuucaucagaagagugaccaacgacgccagagagaacgagauggacgagaaccuggagcaggugagcggcaucaucggcaaccugagacacauggcccuggacaugggcaacgagaucgacacccagaacagacagaucgacagaaucauggagaaggccgacagcaacaagaccagaaucgacgaggccaaccagagagccaccaagaugcugggcagcggcuaa

SEQ ID NO: 23786 - RNA, 777 nt, Artificial Sequence
  SNAP29__Homo_sapiens__NP_004773
augagcgccuaccccaagagcuacaaccccuucgacgacgacggcgaggacgagggcgccagacccgcccccuggagagacgccagagaccugcccgacggccccgacgcccccgccgacagacagcaguaccugagacaggaggugcugagaagagccgaggccaccgccgccagcaccagcagaagccuggcccugauguacgagagcgagaaggugggcguggccagcagcgaggagcuggccagacagagaggcgugcuggagagaaccgagaagaugguggacaagauggaccaggaccugaagaucagccagaagcacaucaacagcaucaagagcguguucggcggccuggugaacuacuucaagagcaagcccguggagaccccccccgagcagaacggcacccugaccagccagcccaacaacagacugaaggaggccaucagcaccagcaaggagcaggaggccaaguaccaggccagccaccccaaccugagaaagcuggacgacaccgaccccgugcccagaggcgccggcagcgccaugagcaccgacgccuaccccaagaacccccaccugagagccuaccaccagaagaucgacagcaaccuggacgagcugagcaugggccugggcagacugaaggacaucgcccugggcaugcagaccgagaucgaggagcaggacgacauccuggacagacugaccaccaagguggacaagcuggacgugaacaucaagagcaccgagagaaaggugagacagcuguaa

SEQ ID NO: 23787 - RNA, 1395 nt, Artificial Sequence
  SNAP47__Homo_sapiens__NP_444280
augagagccgccagaagaggccugcacugcgccggcgccgagagacccagaagaagaggcagacugugggacagcagcggcgugccccagagacagaagagacccggccccuggagaacccagacccaggagcagaugagcagagacgugugcauccacaccuggcccugcaccuacuaccuggagcccaagagaagaugggugaccggccagcugagccugaccagccugagccugagauucaugaccgacagcaccggcgagauccuggugagcuucccccugagcagcaucguggagaucaagaaggaggccagccacuucaucuucagcagcaucaccauccuggagaagggccacgccaagcacugguucagcagccugagacccagcagaaacgugguguucagcaucaucgagcacuucuggagagagcugcugcugagccagcccggcgccguggccgacgccagcgugcccagaaccagaggcgaggagcugaccggccugauggccggcagccagaagagacuggaggacaccgccagagugcugcaccaccagggccagcagcuggacagcgugaugagaggccuggacaagauggagagcgaccuggagguggccgacagacugcugaccgagcuggagagccccgccugguggcccuucagcagcaagcuguggaagaccccccccgagaccaagcccagagaggacgugagcaugaccagcugcgagcccuucggcaaggagggcauccugaucaagauccccgccgugaucagccacagaaccgagagccacgugaagcccggcagacugaccgugcuggugagcggccuggagauccacgacagcagcagccugcugaugcacagauucgagagagaggacguggacgacaucaaggugcacagccccuacgagaucagcaucagacagagauucaucggcaagcccgacauggccuacagacugaucagcgccaagaugcccgaggugauccccauccuggaggugcaguucagcaagaagauggagcugcuggaggacgcccuggugcugagaagcgccagaaccagcagccccgccgagaagagcugcagcguguggcacgccgccagcggccugaugggcagaacccugcacagagagccccccgccggcgaccaggagggcaccgcccugcaccugcagaccagccugcccgcccugagcgaggccgacacccaggagcugacccagauccugagaagaaugaagggccuggcccuggaggccgagagcgagcuggagagacaggacgaggcccuggacggcguggccgccgccguggacagagccacccugaccaucgacaagcacaacagaagaaugaagagacugaccuaa

SEQ ID NO: 23788 - RNA, 2724 nt, Artificial Sequence
  SNAP91__Homo_sapiens__NP_001229721
augagcggccagacccugaccgacagaaucgccgccgcccaguacagcgugaccggcagcgccguggccagagccgugugcaaggccaccacccacgaggugaugggccccaagaagaagcaccuggacuaccugauccaggccaccaacgagaccaacgugaacaucccccagauggccgacacccuguucgagagagccaccaacagcagcuggguggugguguucaaggcccuggugaccacccaccaccugauggugcacggcaacgagagauucauccaguaccuggccagcagaaacacccuguucaaccugagcaacuuccuggacaagagcggcagccacggcuacgacaugagcaccuucaucagaagauacagcagauaccugaacgagaaggccuucagcuacagacagauggccuucgacuucgccagagugaagaagggcgccgacggcgugaugagaaccauggcccccgagaagcugcugaagagcaugcccauccugcagggccagaucgacgcccugcuggaguucgacgugcaccccaacgagcugaccaacggcgugaucaacgccgccuucaugcugcuguucaaggaccugaucaagcuguucgccugcuacaacgacggcgugaucaaccugcuggagaaguucuucgagaugaagaagggccagugcaaggacgcccuggagaucuacaagagauuccugaccagaaugaccagagugagcgaguuccugaagguggccgagcaggugggcaucgacaagggcgacauccccgaccugacccaggcccccagcagccugauggagacccuggagcagcaccugaacacccuggagggcaagaagcccggcaacaacgagggcagcggcgcccccagcccccugagcaagagcagccccgccaccaccgugaccagccccaacagcacccccgccaagaccaucgacaccagcccccccguggaccuguucgccaccgccagcgccgccgugcccgugagcaccagcaagcccagcagcgaccugcuggaccugcagcccgacuucagcagcggcggcgccgccgccgccgccgcccccgccccccccccccccgccggcggcgccaccgccuggggcgaccugcugggcgaggacagccuggccgcccugagcagcgugcccagcgaggcccagaucagcgaccccuucgcccccgagcccaccccccccaccaccaccgccgagaucgccaccgccagcgccagcgccagcaccaccaccaccgugaccgccgugaccgccgagguggaccuguucggcgacgccuucgccgccagccccggcgaggcccccgccgccagcgagggcgccgccgcccccgccacccccacccccguggccgccgcccuggacgccugcagcggcaacgaccccuucgcccccagcgagggcagcgccgaggccgcccccgagcuggaccuguucgccaugaagccccccgagaccagcgugcccguggugacccccaccgccagcaccgccccccccgugcccgccaccgcccccagccccgcccccgccguggccgccgccgccgccgccaccaccgccgccaccgccgccgccaccaccaccaccaccaccagcgccgccaccgccaccaccgccccccccgcccuggacaucuucggcgaccuguucgagagcacccccgagguggccgccgcccccaagcccgacgccgcccccagcaucgaccuguucagcaccgacgccuucagcagccccccccagggcgccagccccgugcccgagagcagccugaccgccgaccugcugagcguggacgccuucgccgcccccagccccgccaccaccgccagccccgccaagguggacagcagcggcgugaucgaccuguucggcgacgccuucggcagcagcgccagcgagccccagcccgccagccaggccgccagcagcagcagcgccagcgccgaccugcuggccggcuucggcggcagcuucauggcccccagccccagccccgugacccccgcccagaacaaccugcugcagcccaacuucgaggccgccuucggcaccacccccagcaccagcagcagcagcagcuucgaccccagcguguucgacggccugggcgaccugcugaugcccaccauggcccccgccggccagcccgcccccgugagcauggugccccccagccccgccauggccgccagcaaggcccugggcagcgaccuggacagcagccuggccagccuggugggcaaccugggcaucagcggcaccaccaccaagaagggcgaccugcaguggaacgccggcgagaagaagcugaccggcggcgccaacuggcagcccaagguggcccccgccaccuggagcgccggcgugccccccagcgccccccugcagggcgccgugccccccaccagcagcgugccccccguggccggcgcccccagcgugggccagcccggcgccggcuucggcaugccccccgccggcaccggcaugcccaugaugccccagcagcccgugauguucgcccagcccaugaugagaccccccuucggcgccgccgccgugcccggcacccagcugagccccagccccacccccgccagccagagccccaagaagccccccgccaaggacccccuggccgaccugaacaucaaggacuuccuguaa

SEQ ID NO: 23789 - RNA, 1107 nt, Artificial Sequence
  SNAPC1__Homo_sapiens__NP_003073
augggcaccccccccggccugcagaccgacugcgaggcccugcugagcagauuccaggagaccgacagcgugagauucgaggacuucaccgagcuguggagaaacaugaaguucggcaccaucuucugcggcagaaugagaaaccuggagaagaacauguucaccaaggaggcccuggcccuggccuggagauacuuccugccccccuacaccuuccagaucagagugggcgcccuguaccugcuguacggccuguacaacacccagcugugccagcccaagcagaagaucagaguggcccugaaggacugggacgaggugcugaaguuccagcaggaccuggugaacgcccagcacuucgacgccgccuacaucuucagaaagcugagacuggacagagccuuccacuucaccgccaugcccaagcugcugagcuacagaaugaagaagaagauccacagagccgaggugaccgaggaguucaaggaccccagcgacagagugaugaagcugaucaccagcgacgugcuggaggagaugcugaacgugcacgaccacuaccagaacaugaagcacgugaucagcguggacaagagcaagcccgacaaggcccugagccugaucaaggacgacuucuucgacaacaucaagaacaucgugcuggagcaccagcaguggcacaaggacagaaagaaccccagccugaagagcaagaccaacgacggcgaggagaagauggagggcaacagccaggagaccgagagaugcgagagagccgagagccuggccaagaucaagagcaaggccuucagcguggugauccaggccagcaagagcagaagacacagacaggugaagcuggacagcagcgacagcgacagcgccagcggccagggccaggugaaggccaccagaaagaaggagaagaaggagagacugaagcccgccggcagaaagaugagccugagaaacaagggcaacgugcagaacauccacaaggaggacaagccccugagccugagcaugcccgugaucaccgaggaggaggagaacgagagccugagcggcaccgaguucaccgccagcaagaagagaagaaagcacuaa

SEQ ID NO: 23790 - RNA, 4410 nt, Artificial Sequence
  SNAPC4__Homo_sapiens__NP_003077
auggacguggacgccgagagagagaagaucacccaggagaucaaggagcuggagagaauccuggaccccggcagcagcggcagccacguggagaucagcgagagcagccuggagagcgacagcgaggccgacagccugcccagcgaggaccuggaccccgccgacccccccaucagcgaggaggagagauggggcgaggccagcaacgacgaggacgaccccaaggacaagacccugcccgaggaccccgagaccugccugcagcugaacaugguguaccaggaggugauccaggagaagcuggccgaggccaaccugcugcuggcccagaacagagagcagcaggaggagcugaugagagaccuggccggcagcaagggcaccaaggugaaggacggcaagagccugccccccagcaccuacaugggccacuucaugaagcccuacuucaaggacaaggugaccggcgugggcccccccgccaacgaggacaccagagagaaggccgcccagggcaucaaggccuucgaggagcugcuggugaccaaguggaagaacugggagaaggcccugcugagaaagagcguggugagcgacagacugcagagacugcugcagcccaagcugcugaagcuggaguaccugcaccagaagcagagcaaggugagcagcgagcuggagagacaggcccuggagaagcagggcagagaggccgagaaggagauccaggacaucaaccagcugcccgaggaggcccugcugggcaacagacuggacagccacgacugggagaagaucagcaacaucaacuucgagggcagcagaagcgccgaggagaucagaaaguucuggcagaacagcgagcaccccagcaucaacaagcaggaguggagcagagaggaggaggagagacugcaggccaucgccgccgcccacggccaccuggaguggcagaagaucgccgaggagcugggcaccagcagaagcgccuuccagugccugcagaaguuccagcagcacaacaaggcccugaagagaaaggaguggaccgaggaggaggacagaaugcugacccagcuggugcaggagaugagagugggcagccacauccccuacagaagaaucguguacuacauggagggcagagacagcaugcagcugaucuacagauggaccaagagccuggaccccggccugaagaagggcuacugggcccccgaggaggacgccaagcugcugcaggccguggccaaguacggcgagcaggacugguucaagaucagagaggaggugcccggcagaagcgacgcccagugcagagacagauaccugagaagacugcacuucagccugaagaagggcagauggaaccugaaggaggaggagcagcugaucgagcugaucgagaaguacggcgugggccacugggccaagaucgccagcgagcugccccacagaagcggcagccagugccugagcaaguggaagaucaugaugggcaagaagcagggccugagaagaagaagaagaagagccagacacagcgugagauggagcagcaccagcagcagcggcagcagcagcggcagcagcggcggcagcagcagcagcagcagcagcagcagcgaggaggacgagcccgagcaggcccaggccggcgagggcgacagagcccugcugagcccccaguacauggugcccgacauggaccugugggugcccgccagacagagcaccagccagcccuggagaggcggcgccggcgccuggcugggcggccccgccgccagccugagcccccccaagggcagcagcgccagccagggcggcagcaaggaggccagcaccaccgccgccgcccccggcgaggagaccagccccgugcaggugcccgccagagcccacggccccgugcccagaagcgcccaggccagccacagcgccgacaccagacccgccggcgccgagaagcaggcccuggagggcggcagaagacugcugaccgugcccguggagaccgugcugagagugcugagagccaacaccgccgccagaagcugcacccagaaggagcagcugagacagcccccccugcccaccagcagccccggcgugagcagcggcgacagcguggccagaagccacgugcaguggcugagacacagagccacccagagcggccagagaagauggagacacgcccugcacagaagacugcugaacagaagacugcugcuggccgugacccccugggugggcgacgugguggugcccugcacccaggccagccagagacccgccguggugcagacccaggccgacggccugagagagcagcugcagcaggccagacuggccagcacccccguguucacccuguucacccagcuguuccacaucgacaccgccggcugccuggagguggugagagagagaaaggcccugccccccagacugccccaggccggcgccagagacccccccgugcaccugcugcaggccagcagcagcgcccagagcacccccggccaccuguuccccaacgugcccgcccaggaggccagcaagagcgccagccacaagggcagcagaagacuggccagcagcagaguggagagaacccugccccaggccagccugcuggccagcaccggccccagacccaagcccaagaccgugagcgagcugcugcaggagaagagacugcaggaggccagagccagagaggccaccagaggccccguggugcugcccagccagcugcuggugagcagcagcgugauccugcagcccccccugccccacaccccccacggcagacccgcccccggccccaccgugcugaacgugccccugagcggccccggcgcccccgccgccgccaagcccggcaccagcggcagcuggcaggaggccggcaccagcgccaaggacaagagacugagcaccaugcaggcccugccccuggcccccguguucagcgaggccgagggcaccgcccccgccgccagccaggcccccgcccugggccccggccagaucagcgugagcugccccgagagcggccugggccagagccaggcccccgccgccagcagaaagcagggccugcccgaggccccccccuuccugcccgccgcccccagccccaccccccugcccgugcagccccugagccugacccacaucggcggcccccacguggccaccagcgugccccugcccgugaccugggugcugaccgcccagggccugcugcccgugcccgugcccgccguggugagccugcccagacccgccggcacccccggccccgccggccugcuggccacccugcugcccccccugaccgagaccagagccgcccagggccccagagcccccgcccugagcagcagcuggcagccccccgccaacaugaacagagagcccgagcccagcugcagaaccgacacccccgccccccccacccacgcccugagccagagccccgccgaggccgacggcagcguggccuucgugcccggcgaggcccagguggccagagagauccccgagcccagaaccagcagccacgccgacccccccgaggccgagccccccuggagcggcagacugcccgccuucggcggcgugauccccgccaccgagcccagaggcacccccggcagccccagcggcacccaggagcccagaggcccccugggccuggagaagcugccccugagacagcccggccccgagaagggcgcccuggaccuggagaagcccccccugccccagcccggccccgagaagggcgcccuggaccugggccugcugagccaggagggcgaggccgccacccagcaguggcugggcggccagagaggcgugagagugccccugcugggcagcagacugcccuaccagccccccgcccugugcagccugagagcccugagcggccugcugcugcacaagaaggcccuggagcacaaggccaccagccugguggugggcggcgaggccgagagacccgccggcgcccugcaggccagccugggccuggugagaggccagcugcaggacaaccccgccuaccugcugcugagagccagauuccuggccgccuucacccugcccgcccugcuggccacccuggccccccagggcgugagaaccacccugagcgugcccagcagagugggcagcgagagcgaggacgaggaccugcugagcgagcuggagcuggccgacagagacggccagcccggcugcaccaccgccaccugccccauccagggcgcccccgacagcggcaagugcagcgccagcagcugccuggacaccagcaacgaccccgacgaccuggacgugcugagaaccagacacgccagacacaccagaaagagaagaagacugguguaa

SEQ ID NO: 23791 - RNA, 297 nt, Artificial Sequence
  SNAPC5__Homo_sapiens__NP_006040
augcugagcagacugcaggagcugagaaaggaggaggagacccugcugagacugaaggccgcccugcacgaccagcugaacagacugaagguggaggagcuggcccugcagagcaugaucagcagcagaagaggcgacgagaugcugagcagccacaccgugcccgagcagagccacgacaugcuggugcacguggacaacgaggccagcaucaaccagaccacccuggagcugagcaccaagagccacgugaccgaggaggaggaggaggaggaggaggaggagagcgacagcuaa

SEQ ID NO: 23792 - RNA, 339 nt, Artificial Sequence
  SNCA__Homo_sapiens__NP_009292
auggacguguucaugaagggccugagcaaggccaaggagggcgugguggccgccgccgagaagaccaagcagggcguggccgaggccgccggcaagaccaaggagggcgugcuguacgugggcagcaagaccaaggagggcguggugcacggcguggccaccguggccgagaagaccaaggagcaggugaccaacgugggcggcgccguggugaccggcgugaccgccguggcccagaagaccguggagggcgccggcagcaucgccgccgccaccggcuucgugaagaaggaccagcugggcaaggagggcuaccaggacuacgagcccgaggccuaa

SEQ ID NO: 23793 - RNA, 1812 nt, Artificial Sequence
  SNCAIP__Homo_sapiens__NP_001229864
augaccuaccugauccagagccaccacagcagaagaagccagaacugcgccgaggacgugaucagaaagaccaagaccgaccagaacggccagcuggagugcgugagauggauggugagcgagaccgaggccaucgccgagcugagcugcagcaaggacuuccccagccugauccacuacgccggcugcuacggccaggagaagauccugcuguggcugcugcaguucaugcaggagcagggcaucagccuggacgagguggaccaggacggcaacagcgccgugcacguggccagccagcacggcuaccugggcugcauccagacccugguggaguacggcgccaacgugaccaugcagaaccacgccggcgagaagcccagccagagcgccgagagacagggccacacccugugcagcagauaccugguggugguggagaccugcaugagccuggccagccagguggugaagcugaccaagcagcugaaggagcagaccguggagagagugacccugcagaaccagcugcagcaguuccuggaggcccagaagagcgagggcaagagccugcccagcagccccagcagccccagcagccccgccagcagaaagagccaguggaagagccccgacgccgacgacgacagcguggccaagagcaagcccggcgugcaggagggcauccaggugcugggcagccugagcgccagcagcagagccagacccaaggccaaggacgaggacagcgacaagauccugagacagcugcugggcaaggagaucagcgagaacgugugcacccaggagaagcugagccuggaguuccaggacgcccaggccagcagcagaaacagcaagaagaucccccuggagaagagagagcugaagcuggccagacugagacagcugaugcagagaagccugagcgagagcgacaccgacagcaacaacagcgaggaccccaagaccacccccgugagaaaggccgacagacccagaccccagcccaucguggagagcguggagagcauggacagcgccgagagccugcaccugaugaucaagaagcacacccuggccagcggcggcagaagauuccccuucagcaucaaggccagcaagagccuggacggccacagccccagccccaccagcgagagcagcgagcccgaccuggagagccaguaccccggcagcggcagcaucccccccaaccagcccagcggcgacccccagcagcccagccccgacagcaccgccgcccagaagguggccaccagccccaagagcgcccugaagagccccagcagcaagagaagaaccagccagaaccugaagcugagagugaccuucgaggagcccguggugcagauggagcagcccagccuggagcugaacggcgagaaggacaaggacaagggcagaacccugcagagaaccagcaccagcaacgagagcggcgaccagcugaagagacccuucggcgccuucagaagcaucauggagacccugagcggcaaccagaacaacaacaacaacuaccaggccgccaaccagcugaagaccagcacccugccccugaccagccugggcagaaagaccgacgccaagggcaaccccgccagcagcgccagcaagggcaagaacaaggccgagauguacagcagcugcaucaaccugagcagcaacaugcugaucgaggagcaccugugcaacgacaccagacacaacgacaucaacagaaagaugaagaagagcuacagcaucaagcacaucgccgagcccgagagcaaggagcuguuccuguaa

SEQ ID NO: 23794 - RNA, 405 nt, Artificial Sequence
  SNCB__Homo_sapiens__NP_003076
auggacguguucaugaagggccugagcauggccaaggagggcgugguggccgccgccgagaagaccaagcagggcgugaccgaggccgccgagaagaccaaggagggcgugcuguacgugggcagcaagaccagagagggcguggugcagggcguggccagcguggccgagaagaccaaggagcaggccagccaccugggcggcgccguguucagcggcgccggcaacaucgccgccgccaccggccuggugaagagagaggaguuccccaccgaccugaagcccgaggagguggcccaggaggccgccgaggagccccugaucgagccccugauggagcccgagggcgagagcuacgaggaccccccccaggaggaguaccaggaguacgagcccgaggccuaa

SEQ ID NO: 23795 - RNA, 384 nt, Artificial Sequence
  SNCG__Homo_sapiens__NP_003078
auggacguguucaagaagggcuucagcaucgccaaggagggcguggugggcgccguggagaagaccaagcagggcgugaccgaggccgccgagaagaccaaggagggcgugauguacgugggcgccaagaccaaggagaacguggugcagagcgugaccagcguggccgagaagaccaaggagcaggccaacgccgugagcgaggccguggugagcagcgugaacaccguggccaccaagaccguggaggaggccgagaacaucgccgugaccagcggcguggugagaaaggaggaccugagacccagcgccccccagcaggagggcgaggccagcaaggagaaggaggagguggccgaggaggcccagagcggcggcgacuaa

SEQ ID NO: 23796 - RNA, 2733 nt, Artificial Sequence
  SND1__Homo_sapiens__NP_055205
auggccagcagcgcccagagcggcggcagcagcggcggccccgccgugcccaccgugcagagaggcaucaucaagauggugcugagcggcugcgccaucaucgugagaggccagcccagaggcggccccccccccgagagacagaucaaccugagcaacaucagagccggcaaccuggccagaagagccgccgccacccagcccgacgccaaggacacccccgacgagcccugggccuuccccgccagagaguuccugagaaagaagcugaucggcaaggaggugugcuucaccaucgagaacaagaccccccagggcagagaguacggcaugaucuaccugggcaaggacaccaacggcgagaacaucgccgagagccugguggccgagggccuggccaccagaagagagggcaugagagccaacaaccccgagcagaacagacugagcgagugcgaggagcaggccaaggccgccaagaagggcauguggagcgagggcaacggcagccacaccaucagagaccugaaguacaccaucgagaaccccagacacuucguggacagccaccaccagaagcccgugaacgccaucaucgagcacgugagagacggcagcguggugagagcccugcugcugcccgacuacuaccuggugaccgugaugcugagcggcaucaagugccccaccuucagaagagaggccgacggcagcgagacccccgagcccuucgccgccgaggccaaguucuucaccgagagcagacugcugcagagagacgugcagaucauccuggagagcugccacaaccagaacauccugggcaccauccugcaccccaacggcaacaucaccgagcugcugcugaaggagggcuucgccagaugcguggacuggagcaucgccguguacaccagaggcgccgagaagcugagagccgccgagagauucgccaaggagagaagacugagaaucuggagagacuacguggcccccaccgccaaccuggaccagaaggacaagcaguucguggccaaggugaugcaggugcugaacgccgacgccaucguggugaagcugaacagcggcgacuacaagaccauccaccugagcagcaucagaccccccagacuggagggcgagaacacccaggacaagaacaagaagcugagaccccuguacgacauccccuacauguucgaggccagagaguuccugagaaagaagcugaucggcaagaaggugaacgugaccguggacuacaucagacccgccagccccgccaccgagaccgugcccgccuucagcgagagaaccugcgccaccgugaccaucggcggcaucaacaucgccgaggcccuggugagcaagggccuggccaccgugaucagauacagacaggacgacgaccagagaagcagccacuacgacgagcugcuggccgccgaggccagagccaucaagaacggcaagggccugcacagcaagaaggaggugcccauccacagaguggccgacaucagcggcgacacccagaaggccaagcaguuccugcccuuccugcagagagccggcagaagcgaggccgugguggaguacguguucagcggcagcagacugaagcuguaccugcccaaggagaccugccugaucaccuuccugcuggccggcaucgagugccccagaggcgccagaaaccugcccggccuggugcaggagggcgagcccuucagcgaggaggccacccuguucaccaaggagcuggugcugcagagagagguggagguggagguggagagcauggacaaggccggcaacuucaucggcuggcugcacaucgacggcgccaaccugagcgugcugcugguggagcacgcccugagcaaggugcacuucaccgccgagagaagcagcuacuacaagagccugcugagcgccgaggaggccgccaagcagaagaaggagaaggugugggcccacuacgaggagcagcccguggaggaggugaugcccgugcuggaggagaaggagagaagcgccagcuacaagcccguguucgugaccgagaucaccgacgaccugcacuucuacgugcaggacguggagaccggcacccagcuggagaagcugauggagaacaugagaaacgacaucgccagccacccccccguggagggcagcuacgcccccagaagaggcgaguucugcaucgccaaguucguggacggcgagugguacagagccagaguggagaagguggagagccccgccaagauccacguguucuacaucgacuacggcaacagagaggugcugcccagcaccagacugggcacccugagccccgccuucagcaccagagugcugcccgcccaggccaccgaguacgccuucgccuucauccaggugccccaggacgacgacgccagaaccgacgccguggacagcguggugagagacauccagaacacccagugccugcugaacguggagcaccugagcgccggcugcccccacgugacccugcaguucgccgacagcaagggcgacgugggccugggccuggugaaggagggccuggugaugguggaggugagaaaggagaagcaguuccagaaggugaucaccgaguaccugaacgcccaggagagcgccaagagcgccagacugaaccuguggagauacggcgacuucagagccgacgacgccgacgaguucggcuacagcagauaa

SEQ ID NO: 23797 - RNA, 4242 nt, Artificial Sequence
  SNED1__Homo_sapiens__NP_001073906
augagacacggcguggccugggcccugcugguggccgccgcccugggccugggcgccagaggcgugagaggcgccguggcccuggccgacuucuaccccuucggcgccgagagaggcgacgccgugacccccaagcaggacgacggcggcagcggccugagaccccugagcgugcccuuccccuucuucggcgccgagcacagcggccuguacgugaacaacaacggcaucaucagcuuccugaaggaggugagccaguucacccccguggccuuccccaucgccaaggacagaugcgugguggccgccuucugggccgacguggacaacagaagagccggcgacguguacuacagagaggccaccgaccccgccaugcugagaagagccaccgaggacgugagacacuacuuccccgagcugcuggacuucaacgccaccuggguguucguggccaccugguacagagugaccuucuucggcggcagcagcagcagccccgugaacaccuuccagaccgugcugaucaccgacggcaagcugagcuucaccaucuucaacuacgagagcaucguguggaccaccggcacccacgccagcagcggcggcaacgccaccggccugggcggcaucgccgcccaggccggcuucaacgccggcgacggccagagauacuucagcauccccggcagcagaaccgccgacauggccgagguggagaccaccaccaacgugggcgugcccggcagaugggccuucagaaucgacgacgcccaggugagagugggcggcugcggccacaccaccagcgugugccuggcccugagacccugccugaacggcggcaagugcaucgacgacugcgugaccggcaaccccagcuacaccugcagcugccugagcggcuucaccggcagaagaugccaccuggacgugaacgagugcgccagccagcccugccagaacggcggcaccugcacccacggcaucaacagcuucagaugccagugccccgccggcuucggcggccccaccugcgagaccgcccagagccccugcgacaccaaggagugccagcacggcggccagugccagguggagaacggcagcgccgugugcgugugccaggccggcuacaccggcgccgccugcgagauggacguggacgacugcagccccgaccccugccugaacggcggcagcugcguggaccuggugggcaacuacaccugccugugcgccgagcccuucaagggccugagaugcgagaccggcgaccaccccgugcccgacgccugccugagcgcccccugccacaacggcggcaccugcguggacgccgaccagggcuacgugugcgagugccccgagggcuucaugggccuggacugcagagagagagugcccgacgacugcgagugcagaaacggcggcagaugccugggcgccaacaccacccugugccagugcccccugggcuucuucggccugcugugcgaguucgagaucaccgccaugcccugcaacaugaacacccagugccccgacggcggcuacugcauggagcacggcggcagcuaccugugcgugugccacaccgaccacaacgccagccacagccugcccagccccugcgacagcgaccccugcuucaacggcggcagcugcgacgcccacgacgacagcuacaccugcgagugccccagaggcuuccacggcaagcacugcgagaaggccagaccccaccugugcagcagcggccccugcagaaacggcggcaccugcaaggaggccggcggcgaguaccacugcagcugccccuacagauucaccggcagacacugcgagaucggcaagcccgacagcugcgccagcggccccugccacaacggcggcaccugcuuccacuacaucggcaaguacaagugcgacugcccccccggcuucagcggcagacacugcgagaucgcccccagccccugcuucagaagccccugcgugaacggcggcaccugcgaggacagagacaccgacuucuucugccacugccaggccggcuacaugggcagaagaugccaggccgagguggacugcggcccccccgaggaggugaagcacgccacccugagauucaacggcaccagacugggcgccguggcccuguacgccugcgacagaggcuacagccugagcgcccccagcagaaucagagugugccagccccacggcguguggagcgagcccccccagugccuggagaucgacgagugcagaagccagcccugccugcacggcggcagcugccaggacagaguggccggcuaccugugccugugcagcaccggcuacgagggcgcccacugcgagcuggagagagacgagugcagagcccaccccugcagaaacggcggcagcugcagaaaccugcccggcgccuacgugugcagaugccccgccggcuucgugggcgugcacugcgagaccgagguggacgccugcgacagcagccccugccagcacggcggcagaugcgagagcggcggcggcgccuaccugugcgugugccccgagagcuucuucggcuaccacugcgagaccgugagcgaccccugcuucagcagccccugcggcggcagaggcuacugccuggccagcaacggcagccacagcugcaccugcaaggugggcuacaccggcgaggacugcgccaaggagcuguucccccccaccgcccugaagauggagagaguggaggagagcggcgugagcaucagcuggaacccccccaacggccccgccgccagacagaugcuggacggcuacgccgugaccuacgugagcagcgacggcagcuacagaagaaccgacuucguggacagaaccagaagcagccaccagcugcaggcccuggccgccggcagagccuacaacaucagcguguucagcgugaagagaaacagcaacaacaagaacgacaucagcagacccgccgugcugcuggccagaaccagacccagacccguggagggcuucgaggugaccaacgugaccgccagcaccaucagcgugcagugggcccugcacagaaucagacacgccaccgugagcggcgugagagugagcaucagacaccccgaggcccugagagaccaggccaccgacguggacagaagcguggacagauucaccuucagagcccugcugcccggcaagagauacaccauccagcugaccacccugagcggccugagaggcgaggagcaccccaccgagagccuggccaccgcccccacccacguguggaccagaccccugccccccgccaaccugaccgccgccagagugaccgccaccagcgcccacguggugugggacgcccccacccccggcagccugcuggaggccuacgugaucaacgugaccaccagccagagcaccaagagcagauacgugcccaacggcaagcuggccagcuacaccgugagagaccugcugcccggcagaagauaccagcugagcgugaucgccgugcagagcaccgagcugggcccccagcacagcgagcccgcccaccuguacaucaucaccagccccagagacggcgccgacagaagauggcaccagggcggccaccaccccagagugcugaagaacagacccccccccgccagacugcccgagcugagacugcugaacgaccacagcgcccccgagacccccacccagccccccagauucagcgagcugguggacggcagaggcagagugagcgccagauucggcggcagccccagcaaggccgccaccgugagaagccagcccaccgccagcgcccagcuggagaacauggaggaggcccccaagagagugagccuggcccugcagcugcccgagcacggcagcaaggacaucggcaacgugcccggcaacugcagcgagaaccccugccagaacggcggcaccugcgugcccggcgccgacgcccacagcugcgacugcggccccggcuucaagggcagaagaugcgagcuggccugcaucaaggugagcagacccugcaccagacuguucagcgagaccaaggccuuccccgugugggagggcggcgugugccaccacguguacaagagaguguacagagugcaccaggacaucugcuucaaggagagcugcgagagcaccagccugaagaagacccccaacagaaagcagagcaagagccagacccuggagaagagcuaa

SEQ ID NO: 23798 - RNA, 777 nt, Artificial Sequence
  SNF8__Homo_sapiens__NP_009172
augcacagaagaggcgugggcgccggcgccaucgccaagaagaagcuggccgaggccaaguacaaggagagaggcaccgugcuggccgaggaccagcuggcccagaugagcaagcagcuggacauguucaagaccaaccuggaggaguucgccagcaagcacaagcaggagaucagaaagaaccccgaguucagagugcaguuccaggacaugugcgccaccaucggcguggacccccuggccagcggcaagggcuucuggagcgagaugcugggcgugggcgacuucuacuacgagcugggcgugcagaucaucgaggugugccuggcccugaagcacagaaacggcggccugaucacccuggaggagcugcaccagcaggugcugaagggcagaggcaaguucgcccaggacgugagccaggacgaccugaucagagccaucaagaagcugaaggcccugggcaccggcuucggcaucauccccgugggcggcaccuaccugauccagagcgugcccgccgagcugaacauggaccacaccguggugcugcagcuggccgagaagaacggcuacgugaccgugagcgagaucaaggccagccugaagugggagaccgagagagccagacaggugcuggagcaccugcugaaggagggccuggccuggcuggaccugcaggcccccggcgaggcccacuacuggcugcccgcccuguucaccgaccuguacagccaggagaucaccgccgaggaggccagagaggcccugcccuaa

SEQ ID NO: 23799 - RNA, 948 nt, Artificial Sequence
  SNIP1__Homo_sapiens__XP_011540462
auggaccugcaguuccacauggccggcgaggccagccagagcuggugggaggccagaagaagcaagagccacggcuggagacaggagagagaggaccaccccagaagaggcagagaggacagacagcacagagagcccagcgagcaggagcacagaagagccagaaacagcgacagagacagacacagaggccacagccaccagagaagaaccagcaacgagagacccggcagcggccagggccagggcagagacagagacacccagaaccugcaggcccaggaggaggagagagaguucuacaacgccagaagaagagagcacagacagagaaacgacgugggcggcggcggcagcgagagccaggagcuggugcccagacccggcggcaacaacaaggagaaggaggugcccgccaaggagaagcccagcuucgagcugagcggcgcccugcuggaggacaccaacaccuucagaggcguggugaucaaguacagcgagccccccgaggccagaauccccaagaagagauggagacuguaccccuucaagaacgacgaggugcugcccgugauguacauccacagacagagcgccuaccugcugggcagacacagaagaaucgccgacauccccaucgaccaccccagcugcagcaagcagcacgccguguuccaguacagacugguggaguacaccagagccgacggcaccgugggcagaagagugaagcccuacaucaucgaccugggcagcggcaacggcaccuuccugaacaacaagagaaucgagccccagagauacuacgagcugaaggagaaggacgugcugaaguucggcuucagcagcagagaguacgugcugcugcacgagagcagcgacaccagcgagaucgacagaaaggacgacgaggacgaggaggaggaggaggaggugagcgacagcuaa

SEQ ID NO: 23800 - RNA, 2298 nt, Artificial Sequence
  SNRK__Homo_sapiens__NP_001094064
auggccggcuucaagagaggcuacgacggcaagaucgccggccuguacgaccuggacaagacccugggcagaggccacuucgccguggugaagcuggccagacacguguucaccggcgagaagguggccgugaaggugaucgacaagaccaagcuggacacccuggccaccggccaccuguuccaggaggugagaugcaugaagcuggugcagcaccccaacaucgugagacuguacgaggugaucgacacccagaccaagcuguaccugauccuggagcugggcgacggcggcgacauguucgacuacaucaugaagcacgaggagggccugaacgaggaccuggccaagaaguacuucgcccagaucgugcacgccaucagcuacugccacaagcugcacguggugcacagagaccugaagcccgagaacgugguguucuucgagaagcagggccuggugaagcugaccgacuucggcuucagcaacaaguuccagcccggcaagaagcugaccaccagcugcggcagccuggccuacagcgcccccgagauccugcugggcgacgaguacgacgcccccgccguggacaucuggagccugggcgugauccuguucaugcuggugugcggccagccccccuuccaggaggccaacgacagcgagacccugaccaugaucauggacugcaaguacaccgugcccagccacgugagcaaggagugcaaggaccugaucaccagaaugcugcagagagaccccaagagaagagccagccuggaggagaucgagaaccaccccuggcugcagggcguggaccccagccccgccaccaaguacaacaucccccuggugagcuacaagaaccugagcgaggaggagcacaacagcaucauccagagaauggugcugggcgacaucgccgacagagacgccaucguggaggcccuggagaccaacagauacaaccacaucaccgccaccuacuuccugcuggccgagagaauccugagagagaagcaggagaaggagauccagaccagaagcgccagccccagcaacaucaaggcccaguucagacagagcuggcccaccaagaucgacgugccccaggaccuggaggacgaccugaccgccaccccccugagccacgccaccgugccccagagccccgccagagccgccgacagcgugcugaacggccacagaagcaagggccugugcgacagcgccaagaaggacgaccugcccgagcuggccggccccgcccugagcaccgugccccccgccagccugaagcccaccgccagcggcagaaagugccuguucagaguggaggaggacgaggaggaggacgaggaggacaagaagcccaugagccugagcacccagguggugcugagaagaaagcccagcgugaccaacagacugaccagcagaaagagcgcccccgugcugaaccagaucuucgaggagggcgagagcgacgacgaguucgacauggacgagaaccugccccccaagcugagcagacugaagaugaacaucgccagccccggcaccgugcacaagagauaccacagaagaaagagccagggcagaggcagcagcugcagcagcagcgagaccagcgacgacgacagcgagagcagaagaagacuggacaaggacagcggcuucaccuacagcuggcacagaagagacagcagcgagggcccccccggcagcgagggcgacggcggcggccagagcaagcccagcaacgccagcggcggcguggacaaggccagccccagcgagaacaacgccggcggcggcagccccagcagcggcagcggcggcaaccccaccaacaccagcggcaccaccagaagaugcgccggccccagcaacagcaugcagcuggccagcagaagcgccggcgagcugguggagagccugaagcugaugagccugugccugggcagccagcugcacggcagcaccaaguacaucaucgacccccagaacggccugagcuucagcagcgugaaggugcaggagaagagcaccuggaagaugugcaucagcagcaccggcaacgccggccaggugcccgccgugggcggcaucaaguucuucagcgaccacauggccgacaccaccaccgagcuggagagaaucaagagcaagaaccugaagaacaacgugcugcagcugccccugugcgagaagaccaucagcgugaacauccagagaaaccccaaggagggccugcugugcgccagcagccccgccagcugcugccacgugaucuaa

SEQ ID NO: 23801 - RNA, 6411 nt, Artificial Sequence
  SNRNP200__Homo_sapiens__NP_054733
auggccgacgugaccgccagaagccugcaguacgaguacaaggccaacagcaaccuggugcugcaggccgacagaagccugaucgacagaaccagaagagacgagcccaccggcgaggugcugagccuggugggcaagcuggagggcaccagaaugggcgacaaggcccagagaaccaagccccagaugcaggaggagagaagagccaagagaagaaagagagacgaggacagacacgacaucaacaagaugaagggcuacacccugcugagcgagggcaucgacgagauggugggcaucaucuacaagcccaagaccaaggagaccagagagaccuacgaggugcugcugagcuucauccaggccgcccugggcgaccagcccagagacauccugugcggcgccgccgacgaggugcuggccgugcugaagaacgagaagcugagagacaaggagagaagaaaggagaucgaccugcugcugggccagaccgacgacaccagauaccacgugcuggugaaccugggcaagaagaucaccgacuacggcggcgacaaggagauccagaacauggacgacaacaucgacgagaccuacggcgugaacgugcaguucgagagcgacgaggaggagggcgacgaggacguguacggcgaggugagagaggaggccagcgacgacgacauggagggcgacgaggccguggugagaugcacccugagcgccaaccugguggccagcggcgagcugaugagcagcaagaagaaggaccugcaccccagagacaucgacgccuucuggcugcagagacagcugagcagauucuacgacgacgccaucgugagccagaagaaggccgacgaggugcuggagauccugaagaccgccagcgacgacagagagugcgagaaccagcuggugcugcugcugggcuucaacaccuucgacuucaucaaggugcugagacagcacagaaugaugauccuguacugcacccugcuggccagcgcccagagcgaggccgagaaggagagaaucaugggcaagauggaggccgaccccgagcugagcaaguuccuguaccagcugcacgagaccgagaaggaggaccugaucagagaggagagaagcagaagagagagagugagacagagcagaauggacaccgaccuggagaccauggaccuggaccagggcggcgaggcccuggcccccagacaggugcuggaccuggaggaccugguguucacccagggcagccacuucauggccaacaagagaugccagcugcccgacggcagcuucagaagacagagaaagggcuacgaggaggugcacgugcccgcccugaagcccaagcccuucggcagcgaggagcagcugcugcccguggagaagcugcccaaguacgcccaggccggcuucgagggcuucaagacccugaacagaauccagagcaagcuguacagagccgcccuggagaccgacgagaaccugcugcugugcgcccccaccggcgccggcaagaccaacguggcccugaugugcaugcugagagagaucggcaagcacaucaacauggacggcaccaucaacguggacgacuucaagaucaucuacaucgcccccaugagaagccuggugcaggagauggugggcagcuucggcaagagacuggccaccuacggcaucaccguggccgagcugaccggcgaccaccagcugugcaaggaggagaucagcgccacccagaucaucgugugcacccccgagaagugggacaucaucaccagaaagggcggcgagagaaccuacacccagcuggugagacugaucauccuggacgagauccaccugcugcacgacgacagaggccccgugcuggaggcccugguggccagagccaucagaaacaucgagaugacccaggaggacgugagacugaucggccugagcgccacccugcccaacuacgaggacguggccaccuuccugagaguggaccccgccaagggccuguucuacuucgacaacagcuucagacccgugccccuggagcagaccuacgugggcaucaccgagaagaaggccaucaagagauuccagaucaugaacgagaucguguacgagaagaucauggagcacgccggcaagaaccaggugcugguguucgugcacagcagaaaggagaccggcaagaccgccagagccaucagagacaugugccuggagaaggacacccugggccuguuccugagagagggcagcgccagcaccgaggugcugagaaccgaggccgagcagugcaagaaccuggagcugaaggaccugcugcccuacggcuucgccauccaccacgccggcaugaccagaguggacagaacccugguggaggaccuguucgccgacaagcacauccaggugcuggugagcaccgccacccuggccuggggcgugaaccugcccgcccacaccgugaucaucaagggcacccagguguacagccccgagaagggcagauggaccgagcugggcgcccuggacauccugcagaugcugggcagagccggcagaccccaguacgacaccaagggcgagggcauccugaucaccagccacggcgagcugcaguacuaccugagccugcugaaccagcagcugcccaucgagagccagauggugagcaagcugcccgacaugcugaacgccgagaucgugcugggcaacgugcagaacgccaaggacgccgugaacuggcugggcuacgccuaccuguacaucagaaugcugagaagccccacccuguacggcaucagccacgacgaccugaagggcgacccccugcuggaccagagaagacuggaccuggugcacaccgccgcccugaugcuggacaagaacaaccuggugaaguacgacaagaagaccggcaacuuccaggugaccgagcugggcagaaucgccagccacuacuacaucaccaacgacaccgugcagaccuacaaccagcugcugaagcccacccugagcgagaucgagcuguucagaguguucagccugagcagcgaguucaagaacaucaccgugagagaggaggagaagcuggagcugcagaagcugcuggagagagugcccauccccgugaaggagagcaucgaggagcccagcgccaagaucaacgugcugcugcaggccuucaucagccagcugaagcuggagggcuucgcccugauggccgacaugguguacgugacccagagcgccggcagacugaugagagccaucuucgagaucgugcugaacagaggcugggcccagcugaccgacaagacccugaaccugugcaagaugaucgacaagagaauguggcagagcaugugcccccugagacaguucagaaagcugcccgaggagguggugaagaagaucgagaagaagaacuuccccuucgagagacuguacgaccugaaccacaacgagaucggcgagcugaucagaaugcccaagaugggcaagaccauccacaaguacgugcaccuguuccccaagcuggagcugagcgugcaccugcagcccaucaccagaagcacccugaagguggagcugaccaucacccccgacuuccagugggacgagaaggugcacggcagcagcgaggccuucuggauccugguggaggacguggacagcgaggugauccugcaccacgaguacuuccugcugaaggccaaguacgcccaggacgagcaccugaucaccuucuucgugcccguguucgagccccugcccccccaguacuucaucagaguggugagcgacagauggcugagcugcgagacccagcugcccgugagcuucagacaccugauccugcccgagaaguaccccccccccaccgagcugcuggaccugcagccccugcccgugagcgcccugagaaacagcgccuucgagagccuguaccaggacaaguuccccuucuucaaccccauccagacccagguguucaacaccguguacaacagcgacgacaacguguucgugggcgcccccaccggcagcggcaagaccaucugcgccgaguucgccauccugagaaugcugcugcagagcagcgagggcagaugcguguacaucacccccauggaggcccuggccgagcagguguacauggacugguacgagaaguuccaggacagacugaacaagaagguggugcugcugaccggcgagaccagcaccgaccugaagcugcugggcaagggcaacaucaucaucagcacccccgagaagugggacauccugagcagaagauggaagcagagaaagaacgugcagaacaucaaccuguucgugguggacgaggugcaccugaucggcggcgagaacggccccgugcuggaggugaucugcagcagaaugagauacaucagcagccagaucgagagacccaucagaaucguggcccugagcagcagccugagcaacgccaaggacguggcccacuggcugggcugcagcgccaccagcaccuucaacuuccaccccaacgugagacccgugccccuggagcugcacauccagggcuucaacaucagccacacccagaccagacugcugagcauggccaagcccguguaccacgccaucaccaagcacagccccaagaagcccgugaucguguucgugcccagcagaaagcagaccagacugaccgccaucgacauccugaccaccugcgccgccgacauccagagacagagauuccugcacugcaccgagaaggaccugauccccuaccuggagaagcugagcgacagcacccugaaggagacccugcugaacggcgugggcuaccugcacgagggccugagccccauggagagaagacugguggagcagcuguucagcagcggcgccauccagguggugguggccagcagaagccugugcuggggcaugaacguggccgcccaccuggugaucaucauggacacccaguacuacaacggcaagauccacgccuacguggacuaccccaucuacgacgugcugcagauggugggccacgccaacagaccccugcaggacgacgagggcagaugcgugaucaugugccagggcagcaagaaggacuucuucaagaaguuccuguacgagccccugcccguggagagccaccuggaccacugcaugcacgaccacuucaacgccgagaucgugaccaagaccaucgagaacaagcaggacgccguggacuaccugaccuggaccuuccuguacagaagaaugacccagaaccccaacuacuacaaccugcagggcaucagccacagacaccugagcgaccaccugagcgagcugguggagcagacccugagcgaccuggagcagagcaagugcaucagcaucgaggacgagauggacguggccccccugaaccugggcaugaucgccgccuacuacuacaucaacuacaccaccaucgagcuguucagcaugagccugaacgccaagaccaaggugagaggccugaucgagaucaucagcaacgccgccgaguacgagaacauccccaucagacaccacgaggacaaccugcugagacagcuggcccagaaggugccccacaagcugaacaaccccaaguucaacgacccccacgugaagaccaaccugcugcugcaggcccaccugagcagaaugcagcugagcgccgagcugcagagcgacaccgaggagauccugagcaaggccaucagacugauccaggccugcguggacgugcugagcagcaacggcuggcugagccccgcccuggccgccauggagcuggcccagauggugacccaggccauguggagcaaggacagcuaccugaagcagcugccccacuucaccagcgagcacaucaagagaugcaccgacaagggcguggagagcguguucgacaucauggagauggaggacgaggagagaaacgcccugcugcagcugaccgacagccagaucgccgacguggccagauucugcaacagauaccccaacaucgagcugagcuacgaggugguggacaaggacagcaucagaagcggcggccccgugguggugcuggugcagcuggagagagaggaggaggugaccggccccgugaucgccccccuguucccccagaagagagaggagggcugguggguggugaucggcgacgccaagagcaacagccugaucagcaucaagagacugacccugcagcagaaggccaaggugaagcuggacuucguggcccccgccaccggcgcccacaacuacacccuguacuucaugagcgacgccuacaugggcugcgaccaggaguacaaguucagcguggacgugaaggaggccgagaccgacagcgacagcgacuaa

SEQ ID NO: 23802 - RNA, 468 nt, Artificial Sequence
  SNRNP27__Homo_sapiens__NP_006848
augggcagaagcagaagcagaagccccagaagagagagaagaagaagcagaagcaccagcagagagagagagagaagaagaagagagagaagcagaagcagagagagagacagaagaagaagcagaagcagaagcccccacagaagaagaagcagaagccccagaagacacagaagcaccagccccagccccagcagacugaaggagagaagagacgaggagaagaaggagaccaaggagaccaagagcaaggagagacagaucaccgaggaggaccuggagggcaagaccgaggaggagaucgagaugaugaagcugaugggcuucgccagcuucgacagcaccaagggcaagaagguggacggcagcgugaacgccuacgccaucaacgugagccagaagagaaaguacagacaguacaugaacagaaagggcggcuucaacagaccccuggacuucaucgccuaa

SEQ ID NO: 23803 - RNA, 1287 nt, Artificial Sequence
  SNRNP70__Homo_sapiens__NP_001287998
augacccaguuccugccccccaaccugcuggcccuguucgcccccagagaccccauccccuaccugcccccccuggagaagcugccccacgagaagcaccacaaccagcccuacugcggcaucgcccccuacaucagagaguucgaggaccccagagacgcccccccccccaccagagccgagaccagagaggagagaauggagagaaagagaagagagaagaucgagagaagacagcaggagguggagaccgagcugaagaugugggacccccacaacgaccccaacgcccagggcgacgccuucaagacccuguucguggccagagugaacuacgacaccaccgagagcaagcugagaagagaguucgagguguacggccccaucaagagaauccacaugguguacagcaagagaagcggcaagcccagaggcuacgccuucaucgaguacgagcacgagagagacaugcacagcgccuacaagcacgccgacggcaagaagaucgacggcagaagagugcugguggacguggagagaggcagaaccgugaagggcuggagacccagaagacugggcggcggccugggcggcaccagaagaggcggcgccgacgugaacaucagacacagcggcagagacgacaccagcagauacgacgagagagacagagacagagacagagagagagagagaagagagagaagcagagagagagacaaggagagagagagaagaagaagcagaagcagagacagaagaagaagaagcagaagcagagacaaggaggagagaagaagaagcagagagagaagcaaggacaaggacagagacagaaagagaagaagcagcagaagcagagagagagccagaagagagagagagagaaaggaggagcugagaggcggcggcggcgacauggccgagcccagcgaggccggcgacgccccccccgacgacggcccccccggcgagcugggccccgacggccccgacggccccgaggagaagggcagagacagagacagagagagaagaagaagccacagaagcgagagagagagaagaagagacagagacagagacagagacagagacagagagcacaagagaggcgagagaggcagcgagagaggcagagacgaggccagaggcggcggcggcggccaggacaacggccuggagggccugggcaacgacagcagagacauguacauggagagcgagggcggcgacggcuaccuggcccccgagaacggcuaccugauggaggccgcccccgaguaa

SEQ ID NO: 23804 - RNA, 849 nt, Artificial Sequence
  SNRPA__Homo_sapiens__NP_004587
auggccgugcccgagaccagacccaaccacaccaucuacaucaacaaccugaacgagaagaucaagaaggacgagcugaagaagagccuguacgccaucuucagccaguucggccagauccuggacauccuggugagcagaagccugaagaugagaggccaggccuucgugaucuucaaggaggugagcagcgccaccaacgcccugagaagcaugcagggcuuccccuucuacgacaagcccaugagaauccaguacgccaagaccgacagcgacaucaucgccaagaugaagggcaccuucguggagagagacagaaagagagagaagagaaagcccaagagccaggagacccccgccaccaagaaggccgugcagggcggcggcgccacccccguggugggcgccgugcagggccccgugcccggcaugccccccaugacccaggcccccagaaucaugcaccacaugcccggccagccccccuacaugcccccccccggcaugauccccccccccggccuggcccccggccagaucccccccggcgccaugcccccccagcagcugaugcccggccagaugccccccgcccagccccugagcgagaacccccccaaccacauccuguuccugaccaaccugcccgaggagaccaacgagcugaugcugagcaugcuguucaaccaguuccccggcuucaaggaggugagacuggugcccggcagacacgacaucgccuucguggaguucgacaacgaggugcaggccggcgccgccagagacgcccugcagggcuucaagaucacccagaacaacgccaugaagaucagcuucgccaagaaguaa

SEQ ID NO: 23805 - RNA, 696 nt, Artificial Sequence
  SNRPB__Homo_sapiens__NP_003082
augaccgugggcaagagcagcaagaugcugcagcacaucgacuacagaaugagaugcauccugcaggacggcagaaucuucaucggcaccuucaaggccuucgacaagcacaugaaccugauccugugcgacugcgacgaguucagaaagaucaagcccaagaacagcaagcaggccgagagagaggagaagagagugcugggccuggugcugcugagaggcgagaaccuggugagcaugaccguggagggccccccccccaaggacaccggcaucgccagagugccccuggccggcgccgccggcggccccggcaucggcagagccgccggcagaggcauccccgccggcgugcccaugccccaggcccccgccggccuggccggccccgugagaggcgugggcggccccagccagcaggugaugaccccccagggcagaggcaccguggccgccgccgccgccgccgccaccgccagcaucgccggcgcccccacccaguacccccccggcagaggcggcccccccccccccaugggcagaggcgcccccccccccggcaugaugggccccccccccggcaugagaccccccaugggcccccccaugggcaucccccccggcagaggcacccccaugggcaugcccccccccggcaugagaccccccccccccggcaugagaggccugcuguaa

SEQ ID NO: 23806 - RNA, 480 nt, Artificial Sequence
  SNRPC__Homo_sapiens__NP_003084
augcccaaguucuacugcgacuacugcgacaccuaccugacccacgacagccccagcgugagaaagacccacugcagcggcagaaagcacaaggagaacgugaaggacuacuaccagaaguggauggaggagcaggcccagagccugaucgacaagaccaccgccgccuuccagcagggcaagaucccccccacccccuucagcgcccccccccccgccggcgccaugaucccccccccccccagccugcccggcccccccagacccggcaugaugcccgccccccacaugggcggcccccccaugaugcccaugaugggcccccccccccccggcaugaugcccgugggccccgcccccggcaugagaccccccaugggcggccacaugcccaugaugcccggcccccccaugaugagaccccccgccagacccaugauggugcccaccagacccggcaugaccagacccgacagauaa

SEQ ID NO: 23807 - RNA, 360 nt, Artificial Sequence
  SNRPD1__Homo_sapiens__NP_008869
augaagcuggugagauuccugaugaagcugagccacgagaccgugaccaucgagcugaagaacggcacccaggugcacggcaccaucaccggcguggacgugagcaugaacacccaccugaaggccgugaagaugacccugaagaacagagagcccgugcagcuggagacccugagcaucagaggcaacaacaucagauacuucauccugcccgacagccugccccuggacacccugcugguggacguggagcccaaggugaagagcaagaagagagaggccguggccggcagaggcagaggcagaggcagaggcagaggcagaggcagaggcagaggcagaggcggccccagaagauaa

SEQ ID NO: 23808 - RNA, 381 nt, Artificial Sequence
  SNRPD3__Homo_sapiens__NP_004166
augagcaucggcgugcccaucaaggugcugcacgaggccgagggccacaucgugaccugcgagaccaacaccggcgagguguacagaggcaagcugaucgaggccgaggacaacaugaacugccagaugagcaacaucaccgugaccuacagagacggcagaguggcccagcuggagcagguguacaucagaggcagcaagaucagauuccugauccugcccgacaugcugaagaacgcccccaugcugaagagcaugaagaacaagaaccagggcagcggcgccggcagaggcaaggccgccauccugaaggcccagguggccgccagaggcagaggcagaggcaugggcagaggcaacaucuuccagaagagaagauaa

SEQ ID NO: 23809 - RNA, 255 nt, Artificial Sequence
  SNRPE__Homo_sapiens__NP_001291393
augagcggccugggcgccaccguggugcagaaccugaucuucagauaccugcagaacagaagcagaauccagguguggcuguacgagcaggugaacaugagaaucgagggcugcaucaucggcuucgacgaguacaugaaccuggugcuggacgacgccgaggagauccacagcaagaccaagagcagaaagcagcugggcagaaucaugcugaagggcgacaacaucacccugcugcagagcgugagcaacuaa

SEQ ID NO: 23810 - RNA, 261 nt, Artificial Sequence
  SNRPF__Homo_sapiens__NP_003086
augagccugccccugaaccccaagcccuuccugaacggccugaccggcaagcccgugauggugaagcugaaguggggcauggaguacaagggcuaccuggugagcguggacggcuacaugaacaugcagcuggccaacaccgaggaguacaucgacggcgcccugagcggccaccugggcgaggugcugaucagaugcaacaacgugcuguacaucagaggcguggaggaggaggaggaggacggcgagaugagagaguaa

SEQ ID NO: 23811 - RNA, 723 nt, Artificial Sequence
  SNRPN__Homo_sapiens__NP_073719
augaccgugggcaagagcagcaagaugcugcagcacaucgacuacagaaugagaugcauccugcaggacggcagaaucuucaucggcaccuucaaggccuucgacaagcacaugaaccugauccugugcgacugcgacgaguucagaaagaucaagcccaagaacgccaagcagcccgagagagaggagaagagagugcugggccuggugcugcugagaggcgagaaccuggugagcaugaccguggagggccccccccccaaggacaccggcaucgccagagugccccuggccggcgccgccggcggccccggcgugggcagagccgccggcagaggcgugcccgccggcgugcccaucccccaggcccccgccggccuggccggccccgugagaggcgugggcggccccagccagcaggugaugaccccccagggcagaggcaccguggccgccgccgccguggccgccaccgccagcaucgccggcgcccccacccaguacccccccggcagaggcaccccccccccccccgugggcagagccacccccccccccggcaucauggcccccccccccggcaugagaccccccaugggcccccccaucggccugccccccgccagaggcacccccaucggcaugcccccccccggcaugagaccccccccccccggcaucagaggcccccccccccccggcaugagaccccccagacccuaa

SEQ ID NO: 23812 - RNA, 1518 nt, Artificial Sequence
  SNTA1__Homo_sapiens__NP_003089
auggccagcggcagaagagcccccagaaccggccugcuggagcugagagccggcgccggcagcggcgccggcggcgagagauggcagagagugcugcugagccuggccgaggacgugcugaccgugagccccgccgacggcgaccccggccccgagcccggcgcccccagagagcaggagcccgcccagcugaacggcgccgccgagcccggcgccggccccccccagcugcccgaggcccugcugcugcagagaagaagagugaccgugagaaaggccgacgccggcggccugggcaucagcaucaagggcggcagagagaacaagaugcccauccugaucagcaagaucuucaagggccuggccgccgaccagaccgaggcccuguucgugggcgacgccauccugagcgugaacggcgaggaccugagcagcgccacccacgacgaggccgugcaggugcugaagaagaccggcaaggagguggugcuggaggugaaguacaugaaggacgugagccccuacuucaagaacagcaccggcggcaccagcgugggcugggacagcccccccgccagcccccugcagagacagcccagcagccccggccccacccccagaaacuucagcgaggccaagcacaugagccugaagauggccuacgugagcaagagaugcacccccaacgaccccgagcccagauaccuggagaucugcagcgccgacggccaggacacccuguuccugagagccaaggacgaggccagcgccagaagcugggccaccgccauccaggcccaggugaacacccugacccccagagugaaggacgagcugcaggcccugcuggccgccaccagcaccgccggcagccaggacaucaagcagaucggcuggcugaccgagcagcugcccagcggcggcaccgcccccacccuggcccugcugaccgagaaggagcugcugcuguaccugagccugcccgagaccagagaggcccugagcagacccgccagaaccgccccccugaucgccaccagacuggugcacagcggccccagcaagggcagcgugcccuacgacgccgagcugagcuucgcccugagaaccggcaccagacacggcguggacacccaccuguucagcguggagagcccccaggagcuggccgccuggaccagacagcugguggacggcugccacagagccgccgagggcgugcaggaggugagcaccgccugcaccuggaacggcagacccugcagccugagcgugcacaucgacaagggcuucacccugugggccgccgagcccggcgccgccagagccgugcugcugagacagcccuucgagaagcugcagaugagcagcgacgacggcgccagccugcuguuccuggacuucggcggcgccgagggcgagauccagcuggaccugcacagcugccccaagaccaucguguucaucauccacagcuuccugagcgccaaggugaccagacugggccugcuggccuaa

SEQ ID NO: 23813 - RNA, 1617 nt, Artificial Sequence
  SNTB1__Homo_sapiens__NP_066301
auggccguggccgccgccgccgccgccgccggccccgccggcgccggcggcggcagagcccagagaagcggccugcuggaggugcuggugagagacagauggcacaaggugcuggugaaccugagcgaggacgcccuggugcugagcagcgaggagggcgccgccgccuacaacggcaucggcaccgccaccaacggcagcuucugcagaggcgccggcgccggccaccccggcgccggcggcgcccagccccccgacagccccgccggcgugagaaccgccuucaccgaccugcccgagcaggugcccgagagcaucagcaaccagaagagaggcgugaaggugcugaagcaggagcugggcggccugggcaucagcaucaagggcggcaaggagaacaagaugcccauccugaucagcaagaucuucaagggccuggccgccgaccagacccaggcccuguacgugggcgacgccauccugagcgugaacggcgccgaccugagagacgccacccacgacgaggccgugcaggcccugaagagagccggcaaggaggugcugcuggaggugaaguacaugagagaggccacccccuacgugaagaagggcagccccgugagcgagaucggcugggagacccccccccccgagagccccagacugggcggcagcaccagcgacccccccagcagccagagcuucagcuuccacagagacagaaagagcaucccccugaagaugugcuacgugaccagaagcauggcccuggccgaccccgagaacagacagcuggagauccacagccccgacgccaagcacaccgugauccugagaagcaaggacagcgccaccgcccaggccugguucagcgccauccacagcaacgugaacgaccugcugaccagagugaucgccgaggugagagagcagcugggcaagaccggcaucgccggcagcagagagaucagacaccugggcuggcuggccgagaaggugcccggcgagagcaagaagcaguggaagcccgcccugguggugcugaccgagaaggaccugcugaucuacgacagcaugcccagaagaaaggaggccugguucagccccgugcacaccuacccccugcuggccaccagacuggugcacagcggccccggcaagggcagcccccaggccggcguggaccugagcuucgccaccagaaccggcaccagacagggcaucgagacccaccuguucagagccgagaccagcagagaccugagccacuggaccagaagcaucgugcagggcugccacaacagcgccgagcugaucgccgagaucagcaccgccugcaccuacaagaaccaggagugcagacugaccauccacuacgagaacggcuucagcaucaccaccgagccccaggagggcgccuuccccaagaccaucauccagagccccuacgagaagcugaagaugagcagcgacgacggcaucagaaugcuguaccuggacuucggcggcaaggacggcgagauccagcuggaccugcacagcugccccaagcccaucguguucaucauccacagcuuccugagcgccaagaucaccagacugggccugguggccuaa

SEQ ID NO: 23814 - RNA, 1443 nt, Artificial Sequence
  SNTG1__Homo_sapiens__NP_001274743
auggacuucagaaccgccugcgaggagaccaagaccggcaucugccugcugcaggacggcaaccaggagcccuucaaggugagacugcaccuggccaaggacauccugaugauccaggagcaggacgugaucugcgugagcggcgagcccuucuacagcggcgagagaaccgugaccaucagaagacagaccgugggcggcuucggccugagcaucaagggcggcgccgagcacaacauccccgugguggugagcaagaucagcaaggagcagagagccgagcugagcggccugcuguucaucggcgacgccauccugcagaucaacggcaucaacgugagaaagugcagacacgaggagguggugcaggugcugagaaacgccggcgaggaggugacccugaccgugagcuuccugaagagagcccccgccuuccugaagcugccccugaacgaggacugcgccugcgcccccagcgaccagagcagcggcaccagcagcccccugugcgacagcggccugcaccugaacuaccaccccaacaacaccgacacccugagcugcagcagcuggcccaccagccccggccugagaugggagaagagauggugcgaccugagacugaucccccugcugcacagcagauucagccaguacgugcccggcaccgaccugagcagacagaacgccuuccaggugaucgccguggacggcgugugcaccggcaucauccagugccugagcgccgaggacugcguggacuggcugcaggccaucgccaccaacaucagcaaccugaccaagcacaacaucaagaagaucaacagaaacuuccccgugaaccagcagaucguguacaugggcuggugcgaggccagagagcaggacccccugcaggacagaguguacagccccaccuuccuggcccugagaggcagcugccuguacaaguuccuggccccccccgugaccaccugggacuggaccagagccgagaagaccuucagcguguacgagaucaugugcaagauccugaaggacagcgaccugcuggacagaagaaagcagugcuucaccgugcagagcgagagcggcgaggaccuguacuucagcguggagcuggagagcgaccuggcccagugggagagagccuuccagaccgccaccuuccuggagguggagagaauccagugcaagaccuacgccugcgugcuggagagccaccugaugggccugaccaucgacuucagcaccggcuucaucugcuucgacgccgccaccaaggagcuggaguucagcaaccuguucgccgugcugcacugcauccacagcuucuucgccgccaagguggccugccuggacccccuguuccugggcaaccaggccaccgccagcaccgccgccagcagcgccaccaccagcaaggccaaguacaccaccuaa

SEQ ID NO: 23815 - RNA, 1620 nt, Artificial Sequence
  SNTG2__Homo_sapiens__NP_061841
augggcaccgagggcccccccccccccgccgccagcagaggcagacagggcugccugcuggugcccgccagaaccaagaccaccaucgcccugcuguacgacgaggagagcgagaacgccuacgacaucagacugaagcugaccaaggaggugcugaccauccagaagcaggacguggugugcgugggcggcagccaccagggcagaaacagaagaaccgugacccugagaagacagcccgugggcggccugggccugagcaucaagggcggcagcgagcacaacgugcccguggugaucagcaagaucuucgaggaccaggccgccgaccagaccggcaugcuguucgugggcgacgccgugcugcaggugaacggcauccacguggagaacgccacccacgaggagguggugcaccugcugagaaacgccggcgacgaggugaccaucaccguggaguaccugagagaggcccccgccuuccugaagcugccccugggcagccccggccccagcagcgaccacagcagcggcgccagcagcccccuguucgacagcggccugcaccugaacggcaacagcagcaccaccgcccccagcagccccagcagccccaucgccaaggaccccagauacgagaagagauggcuggacacccugagcgugccccugagcauggccagaaucagcagauacaaggccggcaccgagaagcugagauggaacgccuucgaggugcuggcccuggacggcgugagcagcggcauccugagauucuacaccgcccaggacggcaccgacuggcugagagccgugagcgccaacaucagagagcugacccugcagaacaugaagauggccaacaagugcugcagccccagcgaccagguggugcacaugggcugggugaacgagaagcugcagggcgccgacagcagccagaccuucagacccaaguuccuggcccugaagggccccagcuucuacguguucagcaccccccccgugagcaccuucgacugggugagagccgagagaaccuaccaccugugcgaggugcuguucaaggugcacaaguucuggcugaccgaggacugcuggcugcaggccaaccuguaccugggccugcaggacuucgacuucgaggaccagagacccuacugcuucagcaucguggccggccacggcaagagccacguguucaacguggagcugggcagcgagcuggccaugugggagaagagcuuccagagagccaccuucauggaggugcagagaaccggcagcagaaccuacaugugcagcuggcagggcgagaugcugugcuucaccguggacuucgcccugggcuucaccugcuucgagagcaagaccaagaacgugcuguggagauucaaguucagccagcugaagggcagcagcgacgacggcaagaccagagugaagcugcuguuccagaaccuggacaccaagcagaucgagaccaaggagcuggaguuccaggaccugagagccgugcugcacugcauccacagcuucaucgccgccaagguggccagcguggaccccggcuucauggacagccagagccuggccagaaaguacauguacagcagcuaa

SEQ ID NO: 23816 - RNA, 1083 nt, Artificial Sequence
  SNUPN__Homo_sapiens__NP_005692
auggaggagcugagccaggcccuggccagcagcuucagcgugagccaggaccugaacagcaccgccgccccccaccccagacugagccaguacaagagcaaguacagcagccuggagcagagcgagagaagaagaagacugcuggagcugcagaagagcaagagacuggacuacgugaaccacgccagaagacuggccgaggacgacuggaccggcauggagagcgaggaggagaacaagaaggacgacgaggagauggacaucgacaccgugaagaagcugcccaagcacuacgccaaccagcugaugcugagcgaguggcugaucgacgugcccagcgaccugggccaggaguggaucgugguggugugccccgugggcaagagagcccugaucguggccagcagaggcagcaccagcgccuacaccaagagcggcuacugcgugaacagauucagcagccugcugcccggcggcaacagaagaaacagcaccgccaaggacuacaccauccuggacugcaucuacaacgaggugaaccagaccuacuacgugcuggacgugaugugcuggagaggccaccccuucuacgacugccagaccgacuucagauucuacuggaugcacagcaagcugcccgaggaggagggccugggcgagaagaccaagcugaaccccuucaaguucgugggccugaagaacuuccccugcacccccgagagccugugcgacgugcugagcauggacuuccccuucgagguggacggccugcuguucuaccacaagcagacccacuacagccccggcagcaccccccuggugggcuggcugagacccuacauggugagcgacgugcugggcguggccgugcccgccggcccccugaccaccaagcccgacuacgccggccaccagcugcagcagaucauggagcacaagaagagccagaaggagggcaugaaggagaagcugacccacaaggccagcgagaacggccacuacgagcuggagcaccugagcacccccaagcugaagggcagcagccacagccccgaccaccccggcugccugauggagaacuaa

SEQ ID NO: 23817 - RNA, 216 nt, Artificial Sequence
  SNURF__Homo_sapiens__NP_005669
auggagagagccagagacagacugcaccugagaagaaccaccgagcagcacgugcccgagguggaggugcaggugaagagaagaagaaccgccagccugagcaaccaggagugccagcuguaccccagaagaagccagcagcagcaggugcccgugguggacuuccaggccgagcugagacaggccuuccuggccgagacccccagaggcggcuaa

SEQ ID NO: 23818 - RNA, 1611 nt, Artificial Sequence
  SNW1__Homo_sapiens__NP_036377
auggcccugaccagcuuccugcccgcccccacccagcugagccaggaccagcuggaggccgaggagaaggccagaagccagagaagcagacagaccagccuggugagcagcagaagagagcccccccccuacggcuacagaaagggcuggauccccagacugcuggaggacuucggcgacggcggcgccuuccccgagauccacguggcccaguacccccuggacaugggcagaaagaagaagaugagcaacgcccuggccauccagguggacagcgagggcaagaucaaguacgacgccaucgccagacagggccagagcaaggacaaggugaucuacagcaaguacaccgaccuggugcccaaggaggugaugaacgccgacgaccccgaccugcagagacccgacgaggaggccaucaaggagaucaccgagaagaccagaguggcccuggagaagagcgugagccagaagguggccgccgccaugcccgugagagccgccgacaagcuggcccccgcccaguacaucagauacacccccagccagcagggcguggccuucaacagcggcgccaagcagagagugaucagaaugguggagaugcagaaggaccccauggagccccccagauucaagaucaacaagaagauccccagaggcccccccagcccccccgcccccgugaugcacagccccagcagaaagaugaccgugaaggagcagcaggaguggaagaucccccccugcaucagcaacuggaagaacgccaagggcuacaccaucccccuggacaagagacuggccgccgacggcagaggccugcagaccgugcacaucaacgagaacuucgccaagcuggccgaggcccuguacaucgccgacagaaaggccagagaggccguggagaugagagcccagguggagagaaagauggcccagaaggagaaggagaagcacgaggagaagcugagagagauggcccagaaggccagagagagaagagccggcaucaagacccacguggagaaggaggacggcgaggccagagagagagacgagaucagacacgacagaagaaaggagagacagcacgacagaaaccugagcagagccgcccccgacaagagaagcaagcugcagagaaacgagaacagagacaucagcgaggugaucgcccugggcgugcccaaccccagaaccagcaacgaggugcaguacgaccagagacuguucaaccagagcaagggcauggacagcggcuucgccggcggcgaggacgagaucuacaacguguacgaccaggccuggagaggcggcaaggacauggcccagagcaucuacagacccagcaagaaccuggacaaggacauguacggcgacgaccuggaggccagaaucaagaccaacagauucgugcccgacaaggaguucagcggcagcgacagaagacagagaggcagagagggccccgugcaguucgaggaggaccccuucggccuggacaaguuccuggaggaggccaagcagcacggcggcagcaagagacccagcgacagcagcagacccaaggagcacgagcacgagggcaagaagagaagaaaggaguaa

SEQ ID NO: 23819 - RNA, 606 nt, Artificial Sequence
  SNX10__Homo_sapiens__NP_001186764
auguuccccgagcagcagaaggaggaguucgugagcgugugggugagagaccccagaauccagaaggaggacuucuggcacagcuacaucgacuacgagaucugcauccacaccaacagcaugugcuucaccaugaagaccagcugcgugagaagaagauacagagaguucguguggcugagacagagacugcagagcaacgcccugcuggugcagcugcccgagcugcccagcaagaaccuguucuucaacaugaacaacagacagcacguggaccagagaagacagggccuggaggacuuccugagaaaggugcugcagaacgcccugcugcugagcgacagcagccugcaccuguuccugcagagccaccugaacagcgaggacaucgaggccugcgugagcggccagaccaaguacagcguggaggaggccauccacaaguucgcccugaugaacagaagauuccccgaggaggacgaggagggcaagaaggagaacgacaucgacuacgacagcgagagcagcagcagcggccugggccacagcagcgacgacagcagcagccacggcugcaaggugaacaccgccccccaggagagcuaa

SEQ ID NO: 23820 - RNA, 477 nt, Artificial Sequence
  SNX12__Homo_sapiens__NP_001243117
augagcgacaccgccguggccgacaccagaagacugaacagcaagccccaggaccugaccgacgccuacggcccccccagcaacuuccuggagaucgacaucuucaacccccagaccgugggcgugggcagagccagauucaccaccuacgagaccaaccugcccaucuucaagcugaaggagagcugcgugagaagaagauacagcgacuucgaguggcugaagaacgagcuggagagagacagcaagaucguggugcccccccugcccggcaaggcccugaagagacagcugcccuucagaggcgacgagggcaucuucgaggagagcuucaucgaggagagaagacagggccuggagcaguucaucaacaagaucgccggccacccccuggcccagaacgagagaugccugcacauguuccugcaggaggaggccaucgacagaaacuacgugcccggcaaggugagacaguaa

SEQ ID NO: 23821 - RNA, 2814 nt, Artificial Sequence
  SNX14__Homo_sapiens__NP_001284543
auggugcccugggugagaaccaugggccagaagcugaagcagagacugagacuggacgugggcagagagaucugcagacaguacccccuguucugcuuccugcugcugugccugagcgccgccagccugcugcugaacagauacauccacauccugaugaucuucuggagcuucguggccggcguggugaccuucuacugcagccugggccccgacagccugcugcccaacaucuucuucaccaucaaguacaagcccaagcagcugggccugcaggagcuguucccccagggccacagcugcgccgugugcggcaaggugaagugcaagagacacagacccagccugcugcuggagaacuaccagcccuggcuggaccugaagaucagcagcaagguggacgccagccugagcgaggugcuggagcuggugcuggagaacuucguguaccccugguacagagacgugaccgacgacgagagcuucguggacgagcugagaaucacccugagauucuucgccagcgugcugaucagaagaauccacaagguggacauccccagcaucaucaccaagaagcugcugaaggccgccaugaagcacaucgaggugaucgugaaggccagacagaaggugaagaacaccgaguuccugcagcaggccgcccuggaggaguacggccccgagcugcacguggcccugagaagcagaagagacgagcugcacuaccugagaaagcugaccgagcugcuguuccccuacauccugccccccaaggccaccgacugcagaagccugacccugcugaucagagagauccugagcggcagcguguuccugcccagccuggacuuccuggccgaccccgacaccgugaaccaccugcugaucaucuucaucgacgacagcccccccgagaaggccaccgagcccgccagcccccuggugcccuuccugcagaaguucgccgagcccagaaacaagaagcccagcgugcugaagcuggagcugaagcagaucagagagcagcaggaccugcuguucagauucaugaacuuccugaagcaggagggcgccgugcacgugcugcaguucugccugaccguggaggaguucaacgacagaauccugagacccgagcugagcaacgacgagaugcugagccugcacgaggagcugcagaagaucuacaagaccuacugccuggacgagagcaucgacaagaucagauucgaccccuucaucguggaggagauccagagaaucgccgagggccccuacaucgacguggugaagcugcagaccaugagaugccuguucgaggccuacgagcacgugcugagccugcuggagaacguguucacccccauguucugccacagcgacgaguacuucagacagcugcugagaggcgccgagagccccaccagaaacagcaagcugaacagaaacacccagaagagaggcgagagcuucggcaucagcagaaucggcagcaagaucaagggcguguucaagagcaccaccauggagggcgccaugcugcccaacuacggcguggccgagggcgaggacgacuucaucgaggagggcaucguggugauggaggacgacagccccguggaggccgugagcacccccaacacccccagaaaccuggccgccuggaagaucagcauccccuacguggacuucuucgaggaccccagcagcgagagaaaggagaagaaggagagaauccccguguucugcaucgacguggagagaaacgacagaagagccgugggccacgagcccgagcacuggagcguguacagaagauaccuggaguucuacgugcuggagagcaagcugaccgaguuccacggcgccuuccccgacgcccagcugcccagcaagagaaucaucggccccaagaacuacgaguuccugaagagcaagagagaggaguuccaggaguaccugcagaagcugcugcagcaccccgagcugagcaacagccagcugcuggccgacuuccugagccccaacggcggcgagacccaguuccuggacaagauccugcccgacgugaaccugggcaagaucaucaagagcgugcccggcaagcugaugaaggagaagggccagcaccuggagcccuucaucaugaacuucaucaacagcugcgagagccccaagcccaagcccagcagacccgagcugaccauccugagccccaccagcgagaacaacaagaagcuguucaacgaccuguucaagaacaacgccaacagagccgagaacaccgagagaaagcagaaccagaacuacuucauggaggugaugaccguggagggcguguacgacuaccugauguacgugggcagagugguguuccaggugcccgacuggcugcaccaccugcugaugggcaccagaauccuguucaagaacacccuggagauguacaccgacuacuaccugcagugcaagcuggagcagcuguuccaggagcacagacuggugagccugaucacccugcugagagacgccaucuucugcgagaacaccgagcccagaagccugcaggacaagcagaagggcgccaagcagaccuucgaggagaugaugaacuacauccccgaccugcuggugaagugcaucggcgaggagaccaaguacgagagcaucagacugcuguucgacggccugcagcagcccgugcugaacaagcagcugaccuacgugcugcuggacaucgugauccaggagcuguuccccgagcugaacaaggugcagaaggaggugaccagcgugaccagcuggauguaa

SEQ ID NO: 23822 - RNA, 1035 nt, Artificial Sequence
  SNX16__Homo_sapiens__NP_690049
auggccacccccuacgugcccgugcccaugcccaucggcaacagcgccagcagcuucaccaccaacagaaaccagagaagcagcagcuucggcagcgugagcaccagcagcaacagcagcaagggccagcuggaggacagcaacaugggcaacuucaagcagaccagcgugcccgaccagauggacaacaccagcagcgugugcagcagcccccugaucagaaccaaguucaccggcaccgccagcagcaucgaguacagcaccagacccagagacaccgaggagcagaaccccgagaccgugaacugggaggacagacccagcacccccaccauccugggcuacgaggugauggaggagagagccaaguucaccguguacaagauccuggugaagaagacccccgaggagagcugggugguguucagaagauacaccgacuucagcagacugaacgacaagcugaaggagauguuccccggcuucagacuggcccugccccccaagagaugguucaaggacaacuacaacgccgacuuccuggaggacagacagcugggccugcaggccuuccugcagaaccugguggcccacaaggacaucgccaacugccuggccgugagagaguuccugugccuggacgacccccccggccccuucgacagccuggaggagagcagagccuucugcgagacccuggaggagaccaacuacagacugcagaaggagcugcuggagaagcagaaggagauggagagccugaagaagcugcugagcgagaagcagcugcacaucgacacccuggagaacagaaucagaacccugagccuggagcccgaggagagccuggacgugagcgagaccgagggcgagcagauccugaagguggagagcagcgcccuggagguggaccaggacgugcuggacgaggagagcagagccgacaacaagcccugccugagcuucagcgagcccgagaacgccgugagcgagaucgagguggccgagguggccuacgacgccgaggaggacuaa

SEQ ID NO: 23823 - RNA, 1875 nt, Artificial Sequence
  SNX18__Homo_sapiens__NP_001096045
auggcccugagagccagagcccuguacgacuucagaagcgagaaccccggcgagaucagccugagagagcacgaggugcugagccugugcagcgagcaggacaucgagggcuggcuggagggcgugaacagcagaggcgacagaggccuguuccccgccagcuacgugcaggugaucagagcccccgagcccggccccgccggcgacggcggccccggcgcccccgccagauacgccaacgugccccccggcggcuucgagccccugcccguggccccccccgccagcuucaagcccccccccgacgccuuccaggcccugcugcagccccagcaggcccccccccccagcaccuuccagccccccggcgccggcuuccccuacggcggcggcgcccugcagcccagcccccagcagcuguacggcggcuaccaggccagccagggcagcgacgacgacugggacgacgagugggacgacagcagcaccguggccgacgagcccggcgcccugggcagcggcgccuaccccgaccuggacggcagcagcagcgccggcgugggcgccgccggcagauacagacugagcaccagaagcgaccugagccugggcagcagaggcggcagcgugcccccccagcaccaccccagcggccccaagagcagcgccaccgugagcagaaaccugaacagauucagcaccuucgugaagagcggcggcgaggccuucgugcugggcgaggccagcggcuucgugaaggacggcgacaagcugugcguggugcugggccccuacggccccgaguggcaggagaaccccuaccccuuccagugcaccaucgacgaccccaccaagcagaccaaguucaagggcaugaagagcuacaucagcuacaagcuggugcccacccacacccaggugcccgugcacagaagauacaagcacuucgacuggcuguacgccagacuggccgagaaguuccccgugaucagcgugccccaccugcccgagaagcaggccaccggcagauucgaggaggacuucaucagcaagagaagaaagggccugaucugguggaugaaccacauggccagccaccccgugcuggcccagugcgacguguuccagcacuuccugaccugccccagcagcaccgacgagaaggccuggaagcagggcaagagaaaggccgagaaggacgagauggugggcgccaacuucuuccugacccugagcaccccccccgccgccgcccuggaccugcaggagguggagagcaagaucgacggcuucaagugcuucaccaagaagauggacgacagcgcccugcagcugaaccacaccgccaacgaguucgccagaaagcaggugaccggcuucaagaaggaguaccagaaggugggccagagcuucagaggccugagccaggccuucgagcuggaccagcaggccuucagcgugggccugaaccaggccaucgccuucaccggcgacgccuacgacgccaucggcgagcuguucgccgagcagcccagacaggaccuggaccccgugauggaccugcuggcccuguaccagggccaccuggccaacuuccccgacaucauccacgugcagaagggcgcccugaccaaggugaaggagagcagaagacacguggaggagggcaagauggaggugcagaaggccgacggcauccaggacagaugcaacaccaucagcuucgccacccuggccgagauccaccacuuccaccagaucagagugagagacuucaagagccagaugcagcacuuccugcagcagcagaucaucuucuuccagaaggugacccagaagcuggaggaggcccugcacaaguacgacagcguguaa

SEQ ID NO: 23824 - RNA, 1119 nt, Artificial Sequence
  SNX19__Homo_sapiens__NP_001288018
auggacagcgacagaguggaggccagaaagagccugcuggagagcuuccugaagcagcugugcgccauccccgagaucgccaacagcgaggaggugcaggaguuccuggcccugaacaccgacgccagaaucgccuucgugaagaagcccuucauggugagcagaaucgacaagaugguggugagcgccaucguggacacccugaagaccgccuuccccagaagcgagccccagagccccaccgaggagcugagcgaggccgagaccgagagcaagccccagaccgagggcaagaaggccagcaagagcagacugagauucagcagcagcaagaucagccccgcccugagcgugaccgaggcccaggacaagauccuguacugccugcaggagggcaacguggagagcgagacccugagcaugagcgccauggagagcuucaucgagaagcagaccaagcugcuggagaugcagcccaccaaggcccccgagaaggaccccgagcagccccccaagggcagaguggacagcugcgugagcgacgccgccgugcccgcccaggaccccagcaacagcgaccccggcaccgagaccgagcuggccgacaccgcccuggaccugcugcugcugcugcugaccgagcaguggaaguggcugugcaccgagaacaugcagaaguuccugagacugaucuucggcacccuggugcagagauggcuggaggugcagguggccaaccugaccagcccccagagaugggugcaguaccugcugcugcugcaggagagcaucuggcccggcggcgugcugcccaaguuccccagacccgugagaacccaggagcagaagcuggccgccgagaagcaggcccugcagagccugaugggcgugcugcccgaccuggugguggagauccugggcgugaacaagugcagacugagcuggggccuggugcuggagagccugcagcagccccugaucaacagacaccugaucuacugccugggcgacaucauccuggaguuccuggaccugagcgccagcguggaggagagcgccgccaccaccagcgccagcgacacccccggcaacagcaagagaaugggcgugagcagcuaa

SEQ ID NO: 23825 - RNA, 1569 nt, Artificial Sequence
  SNX1__Homo_sapiens__NP_003090
auggccagcggcggcggcggcugcagcgccagcgagagacugcccccccccuuccccggccuggagcccgagagcgagggcgccgccggcggcagcgagcccgaggccggcgacagcgacaccgagggcgaggacaucuucaccggcgccgccguggugagcaagcaccagagccccaagaucaccaccagccugcugcccaucaacaacggcagcaaggagaacggcauccacgaggagcaggaccaggagccccaggaccuguucgccgacgccaccguggagcugagccuggacagcacccagaacaaccagaagaaggugcuggccaagacccugaucagccugcccccccaggaggccaccaacagcagcaagccccagcccaccuacgaggagcuggaggaggaggagcaggaggaccaguucgaccugaccgugggcaucaccgaccccgagaagaucggcgacggcaugaacgccuacguggccuacaaggugaccacccagaccagccugccccuguucagaagcaagcaguucgccgugaagagaagauucagcgacuuccugggccuguacgagaagcugagcgagaagcacagccagaacggcuucaucgugccccccccccccgagaagagccugaucggcaugaccaaggugaaggugggcaaggaggacagcagcagcgccgaguuccuggagaagagaagagccgcccuggagagauaccugcagagaaucgugaaccaccccaccaugcugcaggaccccgacgugagagaguuccuggagaaggaggagcugcccagagccgugggcacccagacccugagcggcgccggccugcugaagauguucaacaaggccaccgacgccgugagcaagaugaccaucaagaugaacgagagcgacaucugguucgaggagaagcugcaggagguggagugcgaggagcagagacugagaaagcugcacgccgugguggagacccuggugaaccacagaaaggagcuggcccugaacaccgcccaguucgccaagagccuggccaugcugggcagcagcgaggacaacaccgcccugagcagagcccugagccagcuggccgagguggaggagaagaucgagcagcugcaccaggagcaggccaacaacgacuucuuccugcuggccgagcugcugagcgacuacaucagacugcuggccaucgugagagccgccuucgaccagagaaugaagaccuggcagagauggcaggacgcccaggccacccugcagaagaagagagaggccgaggccagacugcugugggccaacaagcccgacaagcugcagcaggccaaggacgagauccuggagugggagagcagagugacccaguacgagagagacuucgagagaaucagcaccguggugagaaaggaggugaucagauucgagaaggagaagagcaaggacuucaagaaccacgugaucaaguaccuggagacccugcuguacagccagcagcagcuggccaaguacugggaggccuuccugcccgaggccaaggccaucagcuaa

SEQ ID NO: 23826 - RNA, 309 nt, Artificial Sequence
  SNX20__Homo_sapiens__NP_001138444
auggccagccccgagcaccccggcagccccggcugcaugggccccaucacccagugcaccgccagaacccagcaggaggcccccgccaccggccccgaccugccccaccccggccccgacggccaccuggacacccacagcggccugagcagcaacagcagcaugaccaccagagagcugcagcaguacuggcagaaccagaagugcagauggaagcacgugaagcugcuguucgagaucgccagcgccagaaucgaggagagaaaggugagcaaguucguggcccccgcccccgacgccacccccuaa

SEQ ID NO: 23827 - RNA, 510 nt, Artificial Sequence
  SNX24__Homo_sapiens__NP_054754
auggagguguacauccccagcuucagauacgaggagagcgaccuggagagaggcuacaccguguucaagaucgaggugcugaugaacggcagaaagcacuucguggagaagagauacagcgaguuccacgcccugcacaagaagcugaagaagugcaucaagacccccgagauccccagcaagcacgugagaaacugggugcccaaggugcuggagcagagaagacagggccuggagaccuaccugcaggccgugauccuggagaacgaggagcugcccaagcuguuccuggacuuccugaacgugagacaccugcccagccugcccaaggccgagagcugcggcagcuucgacgagaccgagagcgaggagagcagcaagcugagccaccagcccgugcugcuguuccugagagaccccuacgugcugcccgccgccagcgacuuccccaacguggugaucgagggcgugcugcacggcaucuucuacccccaccugcagcccagauaa

SEQ ID NO: 23828 - RNA, 3015 nt, Artificial Sequence
  SNX25__Homo_sapiens__XP_005263324
augcaccccgacgccaccgacagcggcggcgccggccccagccccgccagagccgccggcgccggcggcagacccgugagcggcuucagaggcgagagaagacccgagagccccggcgacgccgaggccgccgccgccgccgcccccggcgcccccggcggcagaagcugguggaagcccguggccguggccgcccuggccgccguggcccugagcuuccugggccccggcagcggcgaggccgccggcgccgccggccugagcagcgugcuguucagacugagccuguaccugagcugcgccgccgccgccuuccugcugggcauccuguucgcccuggugugcagaagccccagagcccagccccccgacuucgccgccgccuggagcagacuggccgccaccagcgccgccagaagaccccccggcagccccguguacggcaacagccacgagagcgcccagagcagaagaguggugaucagccacaacauggacaaggcccugaaggagguguucgacuacagcuacagagacuacauccugagcugguacggcaaccugagcagagacgagggccagcuguaccaccugcugcuggaggacuucugggagaucgccagacagcugcaccacagacugagccacguggacguggugaagguggugugcaacgacguggugagaacccugcugacccacuucugcgaccugaaggccgccaacgccagacacgaggagcagcccagacccuucgugcugcacgccugccugagaaacagcgacgacgaggugagauuccugcagaccugcagcagagugcugguguucugccugcugcccagcaaggacgugcagagccugagccugagaaucaugcuggccgagauccugaccaccaaggugcugaagcccgugguggagcugcugagcaaccccgacuacaucaaccagaugcugcuggcccagcuggccuacagagagcagaugaacgagcaccacaagagagccuacaccuacgcccccagcuacgaggacuucaucaagcugaucaacagcaacagcgacguggaguuccugaagcagcugagauaccagaucgugguggagaucauccaggccaccaccaucagcagcuucccccagcugaagagacacaagggcaaggagaccgccgccaugaaggccgaccugcugagagccagaaacaugaagagauacaucaaccagcugaccguggccaagaagcagugcgagaagagaaucagaauccugggcggccccgccuacgaccagcaggaggacggcgcccuggacgagggcgagggcccccagagccagaagauccugcaguucgaggacauccuggccaacaccuucuacagagagcacuucggcauguacauggagagaauggacaagagagcccugaucagcuucugggagagcguggagcaccugaagaacgccaacaagaacgagaucccccagcuggugggcgagaucuaccagaacuucuucguggagagcaaggagaucagcguggagaagagccuguacaaggagauccagcagugccuggugggcaacaagggcaucgagguguucuacaagauccaggaggacguguacgagacccugaaggacagauacuaccccagcuucaucgugagcgaccuguacgagaagcugcugaucaaggaggaggagaagcacgccagccagaugaucagcaacaaggacgagaugggccccagagacgaggccggcgaggaggccguggacgacggcaccaaccagaucaacgagcaggccagcuucgccgugaacaagcugagagagcugaacgagaagcuggaguacaagagacaggcccugaacagcauccagaacgcccccaagcccgacaagaagaucgugagcaagcugaaggacgagaucauccugaucgagaaggagagaaccgaccugcagcugcacauggccagaaccgacugguggugcgagaaccugggcauguggaaggccagcaucaccagcggcgaggugaccgaggagaacggcgagcagcugcccugcuacuucgugauggugagccugcaggaggugggcggcguggagaccaagaacuggaccgugcccagaagacugagcgaguuccagaaccugcacagaaagcugagcgagugcgugcccagccugaagaaggugcagcugcccagccugagcaagcugcccuucaagagcaucgaccagaaguucauggagaagagcaagaaccagcugaacaaguuccugcagaaccugcugagcgacgagagacugugccagagcgaggcccuguacgccuuccugagccccagccccgacuaccugaaggugaucgacgugcagggcaagaagaacagcuucagccugagcagcuuccuggagagacugcccagagacuucuucagccaccaggaggaggagaccgaggaggacagcgaccugagcgacuacggcgacgacguggacggcagaaaggacgcccuggccgagcccugcuucaugcugaucggcgagaucuucgagcugagaggcauguucaagugggugagaagaacccugaucgcccuggugcaggugaccuucggcagaaccaucaacaagcagaucagagacaccgugagcuggaucuucagcgagcagaugcugguguacuacaucaacaucuucagagacgccuucuggcccaacggcaagcuggccccccccaccaccaucagaagcaaggagcagagccaggagaccaagcagagagcccagcagaagcugcuggagaacauccccgacaugcugcagagccuggugggccagcagaacgccagacacggcaucaucaagaucuucaacgcccugcaggagaccagagccaacaagcaccugcuguacgcccugauggagcugcugcugaucgagcugugccccgagcugagagugcaccuggaccagcugaaggccggccagguguaa

SEQ ID NO: 23829 - RNA, 2442 nt, Artificial Sequence
  SNX29__Homo_sapiens__NP_115543
augagcggcagccagaacaacgacaagagacaguuccugcuggagagacugcuggacgccgugaagcagugccagaucagauucggcggcagaaaggagaucgccagcgacagcgacagcagagugaccugccugugcgcccaguucgaggccgugcugcagcacggccugaagagaagcagaggccuggcccugaccgccgccgccaucaagcaggccgccggcuucgccagcaagaccgagaccgagcccguguucugguacuacgugaaggaggugcugaacaagcacgagcugcagagauucuacagccugagacacaucgccagcgacgugggcagaggcagagccuggcugagaugcgcccugaacgagcacagccuggagagauaccugcacaugcugcuggccgacagaugcagacugagcaccuucuacgaggacuggagcuucgugauggacgaggagagaagcagcaugcugcccaccauggccgccggccugaacagcauccuguucgccaucaacaucgacaacaaggaccugaacggccagagcaaguucgcccccaccgugagcgaccugcugaaggagagcacccagaacgugaccagccugcugaaggagagcacccagggcgugagcagccuguucagagagaucaccgccagcagcgccgugagcauccugaucaagcccgagcaggagaccgacccccugcccguggugagcagaaacgugagcgccgacgccaagugcaagaaggagagaaagaagaagaagaaggugaccaacaucaucagcuucgacgacgaggaggacgagcagaacagcggcgacguguucaagaagacccccggcgccggcgagagcagcgaggacaacagcgacagaagcagcgugaacaucaugagcgccuucgagagccccuucggccccaacagcaacggcagccagagcagcaacagcuggaagaucgacagccugagccugaacggcgaguucggcuaccagaagcuggacgugaagagcaucgacgacgaggacguggacgagaacgaggacgacguguacggcaacagcagcggcagaaagcacagaggccacagcgagagccccgagaagccccuggagggcaacaccugccugagccagaugcacagcugggccccccugaaggugcugcacaacgacagcgacauccuguuccccgugagcggcgugggcagcuacagccccgccgacgccccccugggcagccuggagaacggcaccggccccgaggaccacgugcugcccgaccccggccugagauacagcguggaggccagcagccccggccacggcagcccccugagcagccugcugcccagcgccagcgugcccgagagcaugaccaucagcgagcugagacaggccaccguggccaugaugaacagaaaggacgagcuggaggaggagaacagaagccugagaaaccugcuggacggcgagauggagcacagcgccgcccugagacaggagguggacacccugaagagaaagguggccgagcaggaggagagacagggcaugaaggugcaggcccuggccagagagaacgaggugcugaaggugcagcugaagaaguacgugggcgccgugcagaugcugaagagagagggccagaccgccgaggugcccaaccuguggagcguggacggcgaggugaccguggccgagcagaagcccggcgagaucgccgaggagcuggccagcagcuacgagagaaagcugaucgagguggccgagaugcacggcgagcugaucgaguucaacgagagacugcacagagcccugguggccaaggaggcccuggugagccagaugagacaggagcugaucgaccugagaggccccgugcccggcgaccugagccagaccagcgaggaccagagccugagcgacuucgagaucagcaacagagcccugaucaacguguggauccccagcguguuccugagaggcaaggccgccaacgccuuccacguguaccagguguacaucagaaucaaggacgacgaguggaacaucuacagaagauacaccgaguucagaagccugcaccacaagcugcagaacaaguacccccaggugagagccuacaacuucccccccaagaaggccaucggcaacaaggacgccaaguucguggaggagagaagaaagcagcugcagaacuaccugagaagcgugaugaacaaggugauccagauggugcccgaguucgccgccagccccaagaaggagacccugauccagcugaugcccuucuucguggacaucaccccccccggcgagcccgugaacagcagacccaaggccgccagcagauuccccaagcugagcagaggccagcccagagagaccagaaacguggagccccagagcggcgaccuguaa

SEQ ID NO: 23830 - RNA, 1560 nt, Artificial Sequence
  SNX2__Homo_sapiens__NP_003091
auggccgccgagagagagccccccccccugggcgacggcaagcccaccgacuucgaggaccuggaggacggcgaggaccuguucaccagcaccgugagcacccuggagagcagccccagcagccccgagcccgccagccugcccgccgaggacaucagcgccaacagcaacggccccaagcccaccgagguggugcuggacgacgacagagaggaccuguucgccgaggccaccgaggaggugagccuggacagccccgagagagagcccauccugagcagcgagcccagccccgccgugacccccgugacccccaccacccugaucgcccccagaaucgagagcaagagcaugagcgcccccgugaucuucgacagaagcagagaggagaucgaggaggaggccaacggcgacaucuucgacaucgagaucggcgugagcgaccccgagaaggugggcgacggcaugaacgccuacauggccuacagagugaccaccaagaccagccugagcauguucagcaagagcgaguucagcgugaagagaagauucagcgacuuccugggccugcacagcaagcuggccagcaaguaccugcacgugggcuacaucgugccccccgcccccgagaagagcaucgugggcaugaccaaggugaaggugggcaaggaggacagcagcagcaccgaguucguggagaagagaagagccgcccuggagagauaccugcagagaaccgugaagcaccccacccugcugcaggaccccgaccugagacaguuccuggagagcagcgagcugcccagagccgugaacacccaggcccugagcggcgccggcauccugagaauggugaacaaggccgccgacgccgugaacaagaugaccaucaagaugaacgagagcgacgccugguucgaggagaagcagcagcaguucgagaaccuggaccagcagcugagaaagcugcacgugagcguggaggcccuggugugccacagaaaggagcugagcgccaacaccgccgccuucgccaagagcgccgccaugcugggcaacagcgaggaccacaccgcccugagcagagcccugagccagcuggccgagguggaggagaagaucgaccagcugcaccaggagcaggccuucgccgacuucuacauguucagcgagcugcugagcgacuacaucagacugaucgccgccgugaagggcguguucgaccacagaaugaagugcuggcagaagugggaggacgcccagaucacccugcugaagaagagagaggccgaggccaagaugaugguggccaacaagcccgacaagauccagcaggccaagaacgagaucagagagugggaggccaaggugcagcagggcgagagagacuucgagcagaucagcaagaccaucagaaaggaggugggcagauucgagaaggagagagugaaggacuucaagaccgugaucaucaaguaccuggagagccuggugcagacccagcagcagcugaucaaguacugggaggccuuccugcccgaggccaaggccaucgccuaa

SEQ ID NO: 23831 - RNA, 1314 nt, Artificial Sequence
  SNX30__Homo_sapiens__NP_001013012
auggccggcggcccccccaaggcccugcccagcaccggcccccacagccugagagacaugccccacccccuggccggcagcagcagcgaggaggccgugggcggcgacagcacccccagccccgaccugcugauggccagaagcuucggcgacaaggaccugauccugcccaacggcggcacccccgccggcaccagcagccccgccagcagcagcagccugcugaacagacugcagcuggacgacgacaucgacggcgagaccagagaccuguucgugaucguggacgaccccaagaagcacgugugcaccauggagaccuacaucaccuacagaaucaccaccaagagcaccagaguggaguucgaccugcccgaguacagcgugagaagaagauaccaggacuucgacuggcugagaagcaagcuggaggagagccagcccacccaccugauccccccccugcccgagaaguucguggugaagggcgugguggacagauucagcgaggaguucguggagaccagaagaaaggcccuggacaaguuccugaagagaaucaccgaccaccccgugcugagcuucaacgagcacuucaacaucuuccugaccgccaaggaccugaacgccuacaagaagcagggcaucgcccugcugaccagaaugggcgagagcgugaagcacgugaccggcggcuacaagcugagaaccagaccccuggaguucgccgccaucggcgacuaccuggacaccuucgcccugaagcugggcaccaucgacagaaucgcccagagaaucaucaaggaggagaucgaguaccugguggagcugagagaguacggccccguguacagcaccuggagcgcccuggagggcgagcuggccgagccccuggagggcgugagcgccugcaucggcaacugcagcaccgcccuggaggagcugaccgacgacaugaccgaggacuuccugcccgugcugagagaguacauccuguacagcgacagcaugaagagcgugcugaagaagagagaccaggugcaggccgaguacgaggccaagcuggaggccguggcccugagaaaggaggacagacccaaggugcccgccgacguggagaagugccaggacagaauggagugcuucaacgccgaccugaaggccgacauggagagauggcagaacaacaagagacaggacuucagacagcugcugaugggcauggccgacaagaacauccaguacuacgagaagugccugauggccugggagagcaucaucccccugcugcaggagaagcaggaggccaaguaa

SEQ ID NO: 23832 - RNA, 318 nt, Artificial Sequence
  SNX3__Homo_sapiens__NP_001287857
auggccgagaccguggccgacaccagaagacugaucaccaagccccagaaccugaacgacgccuacggcccccccagcaacuuccuggagaucgacgugagcaacccccagaccgugggcgugggcagaggcagauucaccaccuacgagaucagagugaagaccaaccugcccaucuucaagcugaaggagagcaccgugagaagaagauacagcgacuucgaguggcugagaagcgagcuggagagagagagcaagggcagauggagcagcagcggcaccgagagaacccugagcagccacguguucaccagauaa

SEQ ID NO: 23833 - RNA, 1215 nt, Artificial Sequence
  SNX5__Homo_sapiens__NP_689413
auggccgccgugcccgagcugcugcagcagcaggaggaggacagaagcaagcugagaagcgugagcguggaccugaacguggaccccagccugcagaucgacauccccgacgcccugagcgagagagacaaggugaaguucaccgugcacaccaagaccacccugcccaccuuccagagccccgaguucagcgugaccagacagcacgaggacuucguguggcugcacgacacccugaucgagaccaccgacuacgccggccugaucaucccccccgcccccaccaagcccgacuucgacggccccagagagaagaugcagaagcugggcgagggcgagggcagcaugaccaaggaggaguucgccaagaugaagcaggagcuggaggccgaguaccuggccguguucaagaagaccgugagcagccacgagguguuccugcagagacugagcagccaccccgugcugagcaaggacagaaacuuccacguguuccuggaguacgaccaggaccugagcgugagaagaaagaacaccaaggagauguucggcggcuucuucaagagcguggugaagagcgccgacgaggugcuguucaccggcgugaaggagguggacgacuucuucgagcaggagaagaacuuccugaucaacuacuacaacagaaucaaggacagcugcgugaaggccgacaagaugaccagaagccacaagaacguggccgacgacuacauccacaccgccgccugccugcacagccuggcccuggaggagcccaccgugaucaagaaguaccugcugaagguggccgagcuguucgagaagcugagaaagguggagggcagagugagcagcgacgaggaccugaagcugaccgagcugcugagauacuacaugcugaacaucgaggccgccaaggaccugcuguacagaagaaccaaggcccugaucgacuacgagaacagcaacaaggcccuggacaaggccagacugaagagcaaggacgugaagcuggccgaggcccaccagcaggagugcugccagaaguucgagcagcugagcgagagcgccaaggaggagcugaucaacuucaagagaaagagaguggccgccuucagaaagaaccugaucgagaugagcgagcuggagaucaagcacgccagaaacaacgugagccugcugcagagcugcaucgaccuguucaagaacaacuaa

SEQ ID NO: 23834 - RNA, 1788 nt, Artificial Sequence
  SNX9__Homo_sapiens__NP_057308
auggccaccaaggccagagugauguacgacuucgccgccgagcccggcaacaacgagcugaccgugaacgagggcgagaucaucaccaucaccaaccccgacgugggcggcggcuggcuggagggcagaaacaucaagggcgagagaggccuggugcccaccgacuacguggagauccugcccagcgacggcaaggaccaguucagcugcggcaacagcguggccgaccaggccuuccuggacagccugagcgccagcaccgcccaggccagcagcagcgccgccagcaacaaccaccaggugggcagcggcaacgaccccuggagcgccuggagcgccagcaagagcggcaacugggagagcagcgagggcuggggcgcccagcccgagggcgccggcgcccagagaaacaccaacacccccaacaacugggacaccgccuucggccacccccaggccuaccagggccccgccaccggcgacgacgacgacugggacgaggacugggacggccccaagagcagcagcuacuucaaggacagcgagagcgccgacgccggcggcgcccagagaggcaacagcagagccagcagcagcagcaugaagaucccccugaacaaguuccccggcuucgccaagcccggcaccgagcaguaccugcuggccaagcagcuggccaagcccaaggagaagauccccaucaucgugggcgacuacggccccauguggguguaccccaccagcaccuucgacugcgugguggccgaccccagaaagggcagcaagauguacggccugaagagcuacaucgaguaccagcugacccccaccaacaccaacagaagcgugaaccacagauacaagcacuucgacuggcuguacgagagacugcuggugaaguucggcagcgccauccccauccccagccugcccgacaagcaggugaccggcagauucgaggaggaguucaucaagaugagaauggagagacugcaggccuggaugaccagaaugugcagacaccccgugaucagcgagagcgagguguuccagcaguuccugaacuucagagacgagaaggaguggaagaccggcaagagaaaggccgagagagacgagcuggccggcgugaugaucuucagcaccauggagcccgaggcccccgaccuggaccugguggagaucgagcagaagugcgaggccgugggcaaguucaccaaggccauggacgacggcgugaaggagcugcugaccgugggccaggagcacuggaagagaugcaccggcccccugcccaaggaguaccagaagaucggcaaggcccugcagagccuggccaccguguucagcagcagcggcuaccagggcgagaccgaccugaacgacgccaucaccgaggccggcaagaccuacgaggagaucgccagccugguggccgagcagcccaagaaggaccugcacuuccugauggagugcaaccacgaguacaagggcuuccugggcugcuuccccgacaucaucggcacccacaagggcgccaucgagaaggugaaggagagcgacaagcugguggccaccagcaagaucacccugcaggacaagcagaacauggugaagagagugagcaucaugagcuacgcccugcaggccgagaugaaccacuuccacagcaacagaaucuacgacuacaacagcgugaucagacuguaccuggagcagcaggugcaguucuacgagaccaucgccgagaagcugagacaggcccugagcagauuccccgugauguaa

SEQ ID NO: 23835 - RNA, 1479 nt, Artificial Sequence
  SOAT1__Homo_sapiens__NP_001239440
auggagcugaagcccuucuucaugaaggaggugggcagccacuucgacgacuucgugaccaaccugaucgagaagagcgccagccuggacaacggcggcugcgcccugaccaccuucagcgugcuggagggcgagaagaacaaccacagagccaaggaccugagagccccccccgagcagggcaagaucuucaucgccagaagaagccugcuggacgagcugcuggagguggaccacaucagaaccaucuaccacauguucaucgcccugcugauccuguucauccugagcacccuggugguggacuacaucgacgagggcagacuggugcuggaguucagccugcugagcuacgccuucggcaaguuccccaccgugguguggaccugguggaucauguuccugagcaccuucagcgugcccuacuuccuguuccagcacugggccaccggcuacagcaagagcagccacccccugaucagaagccuguuccacggcuuccuguucaugaucuuccagaucggcgugcugggcuucggccccaccuacguggugcuggccuacacccugccccccgccagcagauucaucaucaucuucgagcagaucagauucgugaugaaggcccacagcuucgugagagagaacgugcccagagugcugaacagcgccaaggagaagagcagcaccgugcccauccccaccgugaaccaguaccuguacuuccuguucgcccccacccugaucuacagagacagcuaccccagaaaccccaccgugagauggggcuacguggccaugaaguucgcccagguguucggcugcuucuucuacguguacuacaucuucgagagacugugcgccccccuguucagaaacaucaagcaggagcccuucagcgccagagugcuggugcugugcguguucaacagcauccugcccggcgugcugauccuguuccugaccuucuucgccuuccugcacugcuggcugaacgccuucgccgagaugcugagauucggcgacagaauguucuacaaggacugguggaacagcaccagcuacagcaacuacuacagaaccuggaacgugguggugcacgacuggcuguacuacuacgccuacaaggacuuccugugguucuucagcaagagauucaagagcgccgccaugcuggccguguucgccgugagcgccguggugcacgaguacgcccuggccgugugccugagcuucuucuaccccgugcuguucgugcuguucauguucuucggcauggccuucaacuucaucgugaacgacagcagaaagaagcccaucuggaacgugcugauguggaccagccuguuccugggcaacggcgugcugcugugcuucuacagccaggagugguacgccagacagcacugcccccugaagaaccccaccuuccuggacuacgugagacccagaagcuggaccugcagauacguguucuaa

SEQ ID NO: 23836 - RNA, 1569 nt, Artificial Sequence
  SOAT2__Homo_sapiens__NP_003569
auggagcccggcggcgccagacugagacugcagagaaccgagggccugggcggcgagagagagagacagcccugcggcgacggcaacaccgagacccacagagcccccgaccuggugcaguggaccagacacauggaggccgugaaggcccagcugcuggagcaggcccagggccagcugagagagcugcuggacagagccaugagagaggccauccagagcuaccccagccaggacaagccccugcccccccccccccccggcagccugagcagaacccaggagcccagccugggcaagcagaagguguucaucaucagaaagagccugcuggacgagcugauggaggugcagcacuucagaaccaucuaccacauguucaucgccggccugugcguguucaucaucagcacccuggccaucgacuucaucgacgagggcagacugcugcuggaguucgaccugcugaucuucagcuucggccagcugccccuggcccuggugaccugggugcccauguuccugagcacccugcuggcccccuaccaggcccugagacugugggccagaggcaccuggacccaggccaccggccugggcugcgcccugcuggccgcccacgccguggugcugugcgcccugcccgugcacguggccguggagcaccagcugccccccgccagcagaugcgugcugguguucgagcaggugagauuccugaugaagagcuacagcuuccugagagaggccgugcccggcacccugagagccagaagaggcgagggcauccaggcccccagcuucagcagcuaccuguacuuccuguucugccccacccugaucuacagagagaccuaccccagaacccccuacgugagauggaacuacguggccaagaacuucgcccaggcccugggcugcgugcuguacgccugcuucauccugggcagacugugcgugcccguguucgccaacaugagcagagagcccuucagcaccagagcccuggugcugagcauccugcacgccacccugcccggcaucuucaugcugcugcugaucuucuucgccuuccugcacugcuggcugaacgccuucgccgagaugcugagauucggcgacagaauguucuacagagacugguggaacagcaccagcuucagcaacuacuacagaaccuggaacgugguggugcacgacuggcuguacagcuacguguaccaggacggccugagacugcugggcgccagagccagaggcguggccaugcugggcguguuccuggugagcgccguggcccacgaguacaucuucugcuucgugcugggcuucuucuaccccgugaugcugauccuguuccuggugaucggcggcaugcugaacuucaugaugcacgaccagagaaccggccccgccuggaacgugcugauguggaccaugcuguuccugggccagggcauccaggugagccuguacugccaggagugguacgccagaagacacugcccccugccccaggccaccuucuggggccuggugacccccagaagcuggagcugccacaccuaa

SEQ ID NO: 23837 - RNA, 2622 nt, Artificial Sequence
  SOBP__Homo_sapiens__NP_060483
auggccgagauggagaaggagggcagaccccccgagaacaagagaagcagaaagcccgcccaccccgugaagagagagaucaacgaggagaugaagaacuucgccgagaacaccaugaacgagcugcugggcugguacggcuacgacaagguggagcugaaggacggcgaggacaucgaguucagaagcuaccccaccgacggcgagagcagacagcacaucagcgugcugaaggagaacagccugcccaagcccaagcugcccgaggacagcgugaucagccccuacaacaucagcaccggcuacagcggccuggccaccggcaacggccugagcgacagccccgccggcagcaaggaccacggcagcgugcccaucaucgugccccugauccccccccccuucaucaagccccccgccgaggacgacgugagcaacgugcagaucaugugcgccuggugccagaaggugggcaucaagagauacagccugagcaugggcagcgaggugaagagcuucugcagcgagaagugcuucgccgccugcagaagagccuacuucaagagaaacaaggccagagacgaggacggccacgccgagaacuucccccagcagcacuacgccaaggagacccccagacuggccuucaagaacaacugcgagcugcuggugugcgacuggugcaagcacaucagacacaccaaggaguaccuggacuucggcgacggcgagagaagacugcaguucugcagcgccaagugccugaaccaguacaagauggacaucuucuacaaggagacccaggccaaccugcccgccggccugugcagcacccugcacccccccauggagaacaaggccgagggcaccggcgugcagcugcugacccccgacagcuggaacaucccccugaccgacgccagaagaaaggcccccagccccguggccaccgccggccagagccagggccccggccccagcgccagcaccaccgugagccccagcgacaccgccaacugcagcgugaccaagauccccacccccgugcccaagagcauccccaucagcgagacccccaacaucccccccgugagcgugcagccccccgccagcaucggccccccccugggcgugccccccagaagcccccccauggugaugaccaacagaggccccgugccccugcccaucuucauggagcagcagaucaugcagcagaucagaccccccuucaucagaggccccccccaccacgccagcaaccccaacagcccccugagcaaccccaugcugcccggcaucggccccccccccggcggccccagaaaccugggccccaccagcagccccaugcacagacccaugcugagcccccacauccacccccccagcacccccaccaugcccggcaacccccccggccugcugcccccccccccccccggcgccccccugcccagccugcccuucccccccgugagcaugaugcccaacggccccaugcccgugccccagaugaugaacuucggccugcccagccuggccccccuggugcccccccccacccugcuggugcccuaccccgugaucgugccccugcccgugcccauccccauccccauccccaucccccacgugagcgacagcaagccccccaacggcuucagcagcaacggcgagaacuucauccccaacgcccccggcgacagcgccgccgccggcggcaagcccagcggccacagccugagccccagagacagcaagcagggcagcagcaagagcgccgacagcccccccggcugcagcggccaggcccugagccuggcccccacccccgccgagcacggcagaagcgaggugguggaccugaccagaagagccggcagcccccccggcccccccggcgccggcggccagcugggcuuccccggcgugcugcagggcccccaggacggcgugaucgaccugaccgugggccacagagccagacugcacaacgugauccacagagcccugcacgcccacgugaaggccgagagagagcccagcgccgccgagagaagaaccugcggcggcugcagagacggccacugcagcccccccgccgccggcgaccccggccccggcgcccccgccggccccgaggccgccgccgccugcaacgugaucgugaacggcaccagaggcgccgccgccgagggcgccaagagcgccgagcccccccccgagcagcccccccccccccccccccccgccccccccaagaagcugcugagccccgaggagcccgccgugagcgagcuggagagcgugaaggagaacaacugcgccagcaacugccaccuggacggcgaggccgccaagaagcugaugggcgaggaggcccuggccggcggcgacaagagcgaccccaaccugaacaaccccgccgacgaggaccacgccuacgcccugagaaugcugcccaagaccggcugcgugauccagcccgugcccaagcccgccgagaaggccgccauggcccccugcaucaucagcagccccaugcugagcgccggccccgaggaccuggagcccccccugaagagaagaugccugagaaucagaaaccagaacaaguaa

SEQ ID NO: 23838 - RNA, 636 nt, Artificial Sequence
  SOCS1__Homo_sapiens__NP_003736
augguggcccacaaccagguggccgccgacaacgccgugagcaccgccgccgagcccagaagaagacccgagcccagcagcagcagcagcagcagccccgccgcccccgccagacccagacccugccccgccgugcccgcccccgcccccggcgacacccacuucagaaccuucagaagccacgccgacuacagaagaaucaccagagccagcgcccugcuggacgccugcggcuucuacuggggcccccugagcgugcacggcgcccacgagagacugagagccgagcccgugggcaccuuccuggugagagacagcagacagagaaacugcuucuucgcccugagcgugaagauggccagcggccccaccagcaucagagugcacuuccaggccggcagauuccaccuggacggcagcagagagagcuucgacugccuguucgagcugcuggagcacuacguggccgcccccagaagaaugcugggcgccccccugagacagagaagagugagaccccugcaggagcugugcagacagagaaucguggccaccgugggcagagagaaccuggccagaaucccccugaaccccgugcugagagacuaccugagcagcuuccccuuccagaucuaa

SEQ ID NO: 23839 - RNA, 597 nt, Artificial Sequence
  SOCS2__Homo_sapiens__NP_001257400
augacccugagaugccuggagcccagcggcaacggcggcgagggcaccagaagccaguggggcaccgccggcagcgccgaggagcccagcccccaggccgccagacuggccaaggcccugagagagcugggccagaccggcugguacuggggcagcaugaccgugaacgaggccaaggagaagcugaaggaggcccccgagggcaccuuccugaucagagacagcagccacagcgacuaccugcugaccaucagcgugaagaccagcgccggccccaccaaccugagaaucgaguaccaggacggcaaguucagacuggacagcaucaucugcgugaagagcaagcugaagcaguucgacagcguggugcaccugaucgacuacuacgugcagaugugcaaggacaagagaaccggccccgaggcccccagaaacggcaccgugcaccuguaccugaccaagccccuguacaccagcgcccccagccugcagcaccugugcagacugaccaucaacaagugcaccggcgccaucuggggccugccccugcccaccagacugaaggacuaccuggaggaguacaaguuccagguguaa

SEQ ID NO: 23840 - RNA, 678 nt, Artificial Sequence
  SOCS3__Homo_sapiens__NP_003946
auggugacccacagcaaguuccccgccgccggcaugagcagaccccuggacaccagccugagacugaagaccuucagcagcaagagcgaguaccagcugguggugaacgccgugagaaagcugcaggagagcggcuucuacuggagcgccgugaccggcggcgaggccaaccugcugcugagcgccgagcccgccggcaccuuccugaucagagacagcagcgaccagagacacuucuucacccugagcgugaagacccagagcggcaccaagaaccugagaauccagugcgagggcggcagcuucagccugcagagcgaccccagaagcacccagcccgugcccagauucgacugcgugcugaagcuggugcaccacuacaugcccccccccggcgcccccagcuuccccagcccccccaccgagcccagcagcgaggugcccgagcagcccagcgcccagccccugcccggcagcccccccagaagagccuacuacaucuacagcggcggcgagaagaucccccuggugcugagcagaccccugagcagcaacguggccacccugcagcaccugugcagaaagaccgugaacggccaccuggacagcuacgagaaggugacccagcugcccggccccaucagagaguuccuggaccaguacgacgccccccuguaa

SEQ ID NO: 23841 - RNA, 1323 nt, Artificial Sequence
  SOCS4__Homo_sapiens__NP_543143
auggccgagaacaacgagaacaucagcaagaacguggacgugagacccaagaccagcagaagcagaagcgccgacagaaaggacggcuacguguggagcggcaagaagcugagcuggagcaagaagagcgagagcuacagcgacgccgagaccgugaacggcaucgagaagaccgaggugagccugagaaaccaggagagaaagcacagcugcagcagcaucgagcuggaccuggaccacagcugcggccacagauuccugggcagaagccugaagcagaagcugcaggacgccgugggccagugcuuccccaucaagaacugcagcagcagacacagcagcggccugcccagcaagagaaagauccacaucagcgagcugaugcuggacaagugccccuucccccccagaagcgaccuggccuucagauggcacuucaucaagagacacaccgcccccaucaacagcaagagcgacgagugggugagcaccgaccugagccagaccgagcugagagacggccagcugaagagaagaaacauggaggagaacaucaacugcuucagccacaccaacgugcagcccugcgugaucaccaccgacaacgcccugugcagagagggccccaugaccggcagcgugaugaaccuggugagcaacaacagcaucgaggacagcgacauggacagcgacgacgagauccugacccugugcaccagcagcagaaagagaaacaagcccaagugggaccuggacgacgagauccugcagcuggagaccccccccaaguaccacacccagaucgacuacgugcacugccuggugcccgaccugcugcagaucaacaacaaccccugcuacuggggcgugauggacaaguacgccgccgaggcccugcuggagggcaagcccgagggcaccuuccugcugagagacagcgcccaggaggacuaccuguucagcgugagcuucagaagauacagcagaagccugcacgccagaaucgagcaguggaaccacaacuucagcuucgacgcccacgaccccugcguguuccacagccccgacaucaccggccugcuggagcacuacaaggaccccagcgccugcauguucuucgagccccugcugagcaccccccugaucagaaccuuccccuucagccugcagcacaucugcagaaccgugaucugcaacugcaccaccuacgacggcaucgacgcccugcccauccccagcagcaugaagcuguaccugaaggaguaccacuacaagagcaaggugagagugcugagaaucgacgcccccgagcagcagugcuaa

SEQ ID NO: 23842 - RNA, 1611 nt, Artificial Sequence
  SOCS5__Homo_sapiens__NP_659198
auggacaaggugggcaagauguggaacaacuucaaguacagaugccagaaccuguucggccacgagggcggcagcagaagcgagaacguggacaugaacagcaacagaugccugagcgugaaggagaagaacaucagcaucggcgacagcaccccccagcagcagagcagcccccugagagagaacaucgcccugcagcugggccugagccccagcaagaacagcagcagaagaaaccagaacugcgccaccgagaucccccagaucguggagaucagcaucgagaaggacaacgacagcugcgugacccccggcaccagacuggccagaagagacagcuacagcagacacgcccccuggggcggcaagaagaagcacagcugcagcaccaagacccagagcagccuggacgccgacaagaaguucggcagaaccagaagcggccugcagagaagagagagaagauacggcgugagcagcgugcacgacauggacagcgugagcagcagaaccgugggcagcagaagccugagacagagacugcaggacaccgugggccugugcuuccccaugagaaccuacagcaagcagagcaagccccuguucagcaacaagagaaagauccaccugagcgagcugaugcuggagaagugccccuuccccgccggcagcgaccuggcccagaaguggcaccugaucaagcagcacaccgcccccgugagcccccacagcaccuucuucgacaccuucgaccccagccuggugagcaccgaggacgaggaggacagacugagagagagaagaagacugagcaucgaggagggcguggaccccccccccaacgcccagauccacaccuucgaggccaccgcccaggugaacccccuguacaagcugggccccaagcuggcccccggcaugaccgagaucagcggcgacagcagcgccaucccccaggccaacugcgacagcgaggaggacaccaccacccugugccugcagagcagaagacagaagcagagacagaucagcggcgacagccacacccacgugagcagacagggcgccuggaaggugcacacccagaucgacuacauccacugccuggugcccgaccugcugcagaucaccggcaaccccugcuacuggggcgugauggacagauacgaggccgaggcccugcuggagggcaagcccgagggcaccuuccugcugagagacagcgcccaggaggacuaccuguucagcgugagcuucagaagauacaacagaagccugcacgccagaaucgagcaguggaaccacaacuucagcuucgacgcccacgaccccugcguguuccacagcagcaccgugaccggccugcuggagcacuacaaggaccccagcagcugcauguucuucgagccccugcugaccaucagccugaacagaaccuuccccuucagccugcaguacaucugcagagccgugaucugcagaugcaccaccuacgacggcaucgacggccugccccugcccagcaugcugcaggacuuccugaaggaguaccacuacaagcagaaggugagagugagauggcuggagagagagcccgugaaggccaaguaa

SEQ ID NO: 23843 - RNA, 1608 nt, Artificial Sequence
  SOCS6__Homo_sapiens__XP_005266840
augaagaagaucagccugaagacccugagaaagagcuucaaccugaacaagagcaaggaggagaccgacuucaugguggugcagcagcccagccuggccagcgacuucggcaaggacgacagccuguucggcagcugcuacggcaaggacauggccagcugcgacaucaacggcgaggacgagaagggcggcaagaacagaagcaagagcgagagccugaugggcacccugaagagaagacugagcgccaagcagaagagcaagggcaaggccggcacccccagcggcagcagcgccgacgaggacaccuucagcagcagcagcgcccccaucguguucaaggacgugagagcccagagacccaucagaagcaccagccugagaagccaccacuacagccccgcccccuggccccugagacccaccaacagcgaggagaccugcaucaagauggaggugagagugaaggcccuggugcacagcagcagccccagccccgcccugaacggcgugagaaaggacuuccacgaccugcagagcgagaccaccugccaggagcaggccaacagccugaagagcagcgccagccacaacggcgaccugcaccugcaccuggacgagcacgugcccguggugaucggccugaugccccaggacuacauccaguacaccgugccccuggacgagggcauguacccccuggagggcagcagaagcuacugccuggacagcagcagccccauggaggugagcgccgugcccccccaggugggcggcagagccuuccccgaggacgagagccagguggaccaggaccuggugguggcccccgagaucuucguggaccagagcgugaacggccugcugaucggcaccaccggcgugaugcugcagagccccagagccggccacgacgacgugcccccccugagcccccugcugccccccaugcagaacaaccagauccagagaaacuucagcggccugaccggcaccgaggcccacguggccgagagcaugagaugccaccugaacuucgaccccaacagcgcccccggcguggccagaguguacgacagcgugcagagcagcggccccaugguggugaccagccugaccgaggagcugaagaagcuggccaagcagggcugguacuggggccccaucaccagaugggaggccgagggcaagcuggccaacgugcccgacggcagcuuccuggugagagacagcagcgacgacagauaccugcugagccugagcuucagaagccacggcaagacccugcacaccagaaucgagcacagcaacggcagauucagcuucuacgagcagcccgacguggagggccacaccagcaucguggaccugaucgagcacagcaucagagacagcgagaacggcgccuucugcuacagcagaagcagacugcccggcagcgccaccuaccccgugagacugaccaaccccgugagcagauucaugcaggugagaagccugcaguaccugugcagauucgugaucagacaguacaccagaaucgaccugauccagaagcugccccugcccaacaagaugaaggacuaccugcaggagaagcacuacuaa

SEQ ID NO: 23844 - RNA, 1746 nt, Artificial Sequence
  SOCS7__Homo_sapiens__NP_055413
augguguucagaaacgugggcagaccccccgaggaggaggacguggaggccgcccccgagcccggccccagcgagcugcugugccccagacacagaugcgcccuggaccccaaggcccugccccccggccuggcccuggagagaaccuggggccccgccgccggccuggaggcccagcuggccgcccugggccugggccagcccgccggccccggcgugaagaccgugggcggcggcugcugccccugccccugccccccccagcccccccccccccagccccagccccccgccgccgccccccaggccggcgaggaccccaccgagaccagcgacgcccugcuggugcuggagggccuggagagcgaggccgagagccuggagaccaacagcugcagcgaggaggagcugagcagccccggcagaggcggcggcggcggcggcagacugcugcugcagccccccggccccgagcugccccccgugcccuucccccugcaggaccuggugccccugggcagacugagcagaggcgagcagcagcagcagcagcagcagcagccccccccccccccccccccccccggcccccugagaccccuggccggccccagcagaaagggcagcuucaagaucagacugagcagacuguucagaaccaagagcugcaacggcggcagcggcggcggcgacggcaccggcaagagacccagcggcgagcuggccgccagcgccgccagccugaccgacaugggcggcagcgccggcagagagcuggacgccggcagaaagcccaagcugaccagaacccagagcgccuucagccccgugagcuucagcccccuguucaccggcgagaccgugagccugguggacguggacaucagccagagaggccugaccagcccccacccccccacccccccccccccccccagaagaagccugagccugcuggacgacaucagcggcacccugcccaccagcgugcugguggcccccaugggcagcagccugcagagcuucccccugcccccccccccccccccccacgcccccgacgccuuccccagaaucgcccccaucagagccgccgagagccugcacagccagcccccccagcaccugcagugcccccuguacagacccgacagcagcagcuucgccgccagccugagagagcuggagaagugcggcugguacuggggccccaugaacugggaggacgccgagaugaagcugaagggcaagcccgacggcagcuuccuggugagagacagcagcgaccccagauacauccugagccugagcuucagaagccagggcaucacccaccacaccagaauggagcacuacagaggcaccuucagccuguggugccaccccaaguucgaggacagaugccagagcgugguggaguucaucaagagagccaucaugcacagcaagaacggcaaguuccuguacuuccugagaagcagagugcccggccugccccccacccccgugcagcugcuguaccccgugagcagauucagcaacgugaagagccugcagcaccugugcagauucagaaucagacagcuggugagaaucgaccacauccccgaccugccccugcccaagccccugaucagcuacaucagaaaguucuacuacuacgacccccaggaggagguguaccugagccugaaggaggcccagcugaucagcaagcagaagcaggagguggagcccagcaccuaa

SEQ ID NO: 23845 - RNA, 465 nt, Artificial Sequence
  SOD1__Homo_sapiens__NP_000445
auggccaccaaggccgugugcgugcugaagggcgacggccccgugcagggcaucaucaacuucgagcagaaggagagcaacggccccgugaagguguggggcagcaucaagggccugaccgagggccugcacggcuuccacgugcacgaguucggcgacaacaccgccggcugcaccagcgccggcccccacuucaacccccugagcagaaagcacggcggccccaaggacgaggagagacacgugggcgaccugggcaacgugaccgccgacaaggacggcguggccgacgugagcaucgaggacagcgugaucagccugagcggcgaccacugcaucaucggcagaacccugguggugcacgagaaggccgacgaccugggcaagggcggcaacgaggagagcaccaagaccggcaacgccggcagcagacuggccugcggcgugaucggcaucgcccaguaa

SEQ ID NO: 23846 - RNA, 669 nt, Artificial Sequence
  SOD2__Homo_sapiens__NP_001019636
augcugagcagagccgugugcggcaccagcagacagcuggcccccgugcugggcuaccugggcagcagacagaagcacagccugcccgaccugcccuacgacuacggcgcccuggagccccacaucaacgcccagaucaugcagcugcaccacagcaagcaccacgccgccuacgugaacaaccugaacgugaccgaggagaaguaccaggaggcccuggccaagggcgacgugaccgcccagaucgcccugcagcccgcccugaaguucaacggcggcggccacaucaaccacagcaucuucuggaccaaccugagccccaacggcggcggcgagcccaagggcgagcugcuggaggccaucaagagagacuucggcagcuucgacaaguucaaggagaagcugaccgccgccagcgugggcgugcagggcagcggcuggggcuggcugggcuucaacaaggagagaggccaccugcagaucgccgccugccccaaccaggacccccugcagggcaccaccggccugaucccccugcugggcaucgacgugugggagcacgccuacuaccugcaguacaagaacgugagacccgacuaccugaaggccaucuggaacgugaucaacugggagaacgugaccgagagauacauggccugcaagaaguaa

SEQ ID NO: 23847 - RNA, 723 nt, Artificial Sequence
  SOD3__Homo_sapiens__NP_003093
augcuggcccugcugugcagcugccugcugcuggccgccggcgccagcgacgccuggaccggcgaggacagcgccgagcccaacagcgacagcgccgaguggaucagagacauguacgccaaggugaccgagaucuggcaggaggugaugcagagaagagacgacgacggcgcccugcacgccgccugccaggugcagcccagcgccacccuggacgccgcccagcccagagugaccggcguggugcuguucagacagcuggcccccagagccaagcuggacgccuucuucgcccuggagggcuuccccaccgagcccaacagcagcagcagagccauccacgugcaccaguucggcgaccugagccagggcugcgagagcaccggcccccacuacaacccccuggccgugccccacccccagcaccccggcgacuucggcaacuucgccgugagagacggcagccuguggagauacagagccggccuggccgccagccuggccggcccccacagcaucgugggcagagccgugguggugcacgccggcgaggacgaccugggcagaggcggcaaccaggccagcguggagaacggcaacgccggcagaagacuggccugcugcguggugggcgugugcggccccggccugugggagagacaggccagagagcacagcgagagaaagaagagaagaagagagagcgagugcaaggccgccuaa

SEQ ID NO: 23848 - RNA, 987 nt, Artificial Sequence
  SOHLH1__Homo_sapiens__NP_001012415
auggccagcagaugcagcgagcccuaccccgaggugagcagaauccccaccgugagaggcugcaacggcagccugagcggcgcccugagcugcugcgaggacagcgcccagggcagcggcccccccaaggcccccaccguggccgagggccccagcagcugccugagaagaaacgugaucagcgagagagagagaagaaagagaaugagccugagcugcgagagacugagagcccugcugccccaguucgacggcagaagagaggacauggccagcgugcuggagaugagcgugcaguuccugagacuggccagcgcccugggccccagccaggagcagcacgccauccuggccagcagcaaggagauguggcacagccugcaggaggacgugcugcagcugacccugagcagccagauccaggccggcgugcccgaccccggcaccggcgccagcagcggcaccagaacccccgacgugaaggccuuccuggagagccccuggagccuggaccccgccagcgccagccccgagcccgugccccacauccuggccagcagcagacagugggaccccgccagcugcaccagccugggcaccgacaagugcgaggcccugcugggccugugccaggugagaggcggccugccccccuucagcgagcccagcagccuggugcccuggccccccggcagaagccugcccaaggccgugagacccccccugagcuggccccccuucagccagcagcagacccugcccgugaugagcggcgaggcccugggcuggcugggccaggccggcccccuggccaugggcgccgccccccugggcgagcccgccaaggaggaccccaugcuggcccaggaggccggcagcgcccugggcagcgacguggacgacggcaccagcuuccugcugaccgccggccccagcagcuggcccggcgaguggggccccggcuucagagccggcccccccgccuaa

SEQ ID NO: 23849 - RNA, 1278 nt, Artificial Sequence
  SOHLH2__Homo_sapiens__NP_060296
auggccagcagcaucaucugccaggagcacugccagaucagcggccaggccaagaucgacauccugcuggugggcgacgugaccgugggcuaccuggccgacaccgugcagaagcuguucgccaacaucgccgaggugaccaucaccaucagcgacaccaaggaggccgccgcccugcuggacgacugcaucuucaacauggugcugcugaaggugcccagcagccugagcgccgaggagcuggaggccaucaagcugaucagauucggcaagaagaagaacacccacagccuguucguguucaucauccccgagaacuucaagggcugcaucagcggccacggcauggacaucgcccugaccgagccccugaccauggagaagaugagcaacguggugaaguacuggaccaccugccccagcaacaccgugaagaccgagaacgccaccggccccgaggagcugggccugccccugcagagaagcuacagcgagcaccugggcuacuuccccaccgaccuguucgccugcagcgagagccugagaaacggcaacggccuggagcugaacgccagccugagcgaguucgagaagaacaagaagaucagccugcugcacagcagcaaggagaagcugagaagagagagaaucaaguacugcugcgagcagcugagaacccugcugcccuacgugaagggcagaaagaacgacgccgccagcgugcuggaggccaccguggacuacgugaaguacaucagagagaagaucagccccgccgugauggcccagaucaccgaggcccugcagagcaacaugagauucugcaagaagcagcagacccccaucgagcugagccugcccggcaccgugauggcccagagagagaacagcgugaugagcaccuacagccccgagagaggccugcaguuccugaccaacaccugcuggaacggcugcagcacccccgacgccgagagcagccuggacgaggccgugagagugcccagcagcagcgccagcgagaacgccaucggcgaccccuacaagacccacaucagcagcgccgcccugagccugaacagccugcacaccgugagauacuacagcaaggugacccccagcuacgacgccaccgccgugaccaaccagaacaucagcauccaccugcccagcgccaugccccccgugagcaagcugcugcccagacacugcaccagcggccugggccagaccugcaccacccaccccaacugccugcagcaguucugggccuacuaa

SEQ ID NO: 23850 - RNA, 6327 nt, Artificial Sequence
  SON__Homo_sapiens__NP_001278340
auggccaccaacaucgagcagaucuucagaagcuucguggugagcaaguucagagagauccagcaggagcugagcagcggcagaaacgagggccagcugaacggcgagaccaacacccccaucgagggcaaccaggccggcgacgccgccgccagcgccagaagccugcccaacgaggagaucgugcagaagaucgaggaggugcugagcggcgugcuggacaccgagcugagauacaagcccgaccugaaggagggcagcagaaagagcagaugcgugagcgugcagaccgaccccaccgacgagauccccaccaagaagagcaagaagcacaagaagcacaagaacaagaagaagaagaagaagaaggagaaggagaagaaguacaagagacagcccgaggagagcgagagcaagaccaagagccacgacgacggcaacaucgaccuggagagcgacagcuuccugaaguucgacagcgagcccagcgccguggcccuggagcugcccaccagagccuucggccccagcgagaccaacgagagccccgccguggugcuggagccccccguggugagcauggaggugagcgagccccacauccuggagacccugaagcccgccaccaagaccgccgagcugagcguggugagcaccagcgugaucagcgagcagagcgagcagagcguggccgugaugcccgagcccagcaugaccaagauccuggacagcuucgccgccgcccccgugcccaccaccacccuggugcugaagagcagcgagcccguggugaccaugagcguggaguaccagaugaagagcgugcugaagagcguggagagcaccagccccgagcccagcaagaucaugcugguggagccccccguggccaaggugcuggagcccagcgagacccugguggugagcagcgagacccccaccgagguguaccccgagcccagcaccagcaccaccauggacuuccccgagagcagcgccaucgaggcccugagacugcccgagcagcccguggacgugcccagcgagaucgccgacagcagcaugaccagaccccaggagcugcccgagcugcccaagaccaccgcccuggagcugcaggagagcagcguggccagcgccauggagcugcccggcccccccgccaccagcaugcccgagcugcagggcccccccgugacccccgugcuggagcugcccggccccagcgccacccccgugcccgagcugcccggcccccugagcacccccgugcccgagcugcccggcccccccgccaccgccgugcccgagcugcccggccccagcgugacccccgugccccagcugagccaggagcugcccggccugcccgcccccagcaugggccuggagcccccccaggaggugcccgagccccccgugauggcccaggagcugcccggccugccccuggugaccgccgccguggagcugcccgagcagcccgccgugaccguggccauggagcugaccgagcagcccgugaccaccaccgagcuggagcagcccgugggcaugaccaccguggagcaccccggccaccccgaggugaccaccgccaccggccugcugggccagcccgaggccaccauggugcuggagcugcccggccagcccguggccaccaccgcccuggagcugcccggccagcccagcgugaccggcgugcccgagcugcccggccugcccagcgccaccagagcccuggagcugagcggccagcccguggccaccggcgcccuggagcugcccggcccccugauggccgccggcgcccuggaguucagcggccagagcggcgccgccggcgcccuggagcugcugggccagccccuggccaccggcgugcuggagcugcccggccagcccggcgcccccgagcugcccggccagcccguggccaccguggcccuggagaucagcgugcagagcguggugaccaccagcgagcugagcaccaugaccgugagccagagccuggaggugcccagcaccaccgcccuggagagcuacaacaccguggcccaggagcugcccaccacccuggugggcgagaccagcgugaccgugggcguggacccccugauggcccccgagagccacauccuggccagcaacaccauggagacccacauccuggccagcaacaccauggacagccagaugcuggccagcaacaccauggacagccagaugcuggccagcaacaccauggacagccagaugcuggccagcagcaccauggacagccagaugcuggccaccagcagcauggacagccagaugcuggccaccagcagcauggacagccagaugcuggccaccagcaccauggacagccagaugcuggccaccagcagcauggacagccagaugcuggccaccagcagcauggacagccagaugcuggccaccagcagcauggacagccagaugcuggccaccagcagcauggacagccagaugcuggccaccagcaccauggacagccagaugcuggccaccagcaccauggacagccagaugcuggccaccagcagcauggacagccagaugcuggccagcggcaccauggacagccagaugcuggccagcggcaccauggacgcccagaugcuggccagcggcaccauggacgcccagaugcuggccagcagcacccaggacagcgccaugcugggcagcaagagccccgaccccuacagacuggcccaggaccccuacagacuggcccaggaccccuacagacugggccacgaccccuacagacugggccacgacgccuacagacugggccaggaccccuacagacugggccacgaccccuacagacugacccccgaccccuacagaaugagccccagacccuacagaaucgcccccagaagcuacagaaucgcccccagacccuacagacuggcccccagaccccugaugcuggccagcagaagaagcaugaugaugagcuacgccgccgagagaagcaugaugagcagcuacgagagaagcaugaugagcuacgagagaagcaugaugagccccauggccgagagaagcaugaugagcgccuacgagagaagcaugaugagcgccuacgagagaagcaugaugagccccauggccgagagaagcaugaugagcgccuacgagagaagcaugaugagcgccuacgagagaagcaugaugagccccauggccgacagaagcaugaugagcaugggcgccgacagaagcaugaugagcagcuacagcgccgccgacagaagcaugaugagcagcuacagcgccgccgacagaagcaugaugagcagcuacaccgccgacagaagcaugaugagcauggccgccgacagcuacaccgacagcuacaccgacaccuacaccgaggccuacauggugcccccccugccccccgaggagccccccaccaugcccccccugccccccgaggagccccccaugacccccccccugccccccgaggagccccccgagggccccgcccugcccaccgagcagagcgcccugaccgccgagaacaccuggcccaccgaggugcccagccugcccagcgaggagagcgugagccagcccgagccccccgugagccagagcgagaucagcgagcccagcgccgugcccaccgacuacagcgugagcgccagcgaccccagcgugcuggugagcgaggccgccgugaccgugcccgagcccccccccgagcccgagagcagcaucacccugacccccguggagagcgccgugguggccgaggagcacgagguggugcccgagagacccgugaccugcauggugagcgagacccccgccaugagcgccgagcccaccgugcuggccagcgagccccccgugaugagcgagaccgccgagaccuucgacagcaugagagccagcggccacguggccagcgaggugagcaccagccugcuggugcccgccgugaccacccccgugcuggccgagagcauccuggagccccccgccauggccgcccccgagagcagcgccauggccgugcuggagagcagcgccgugaccgugcuggagagcagcaccgugaccgugcuggagagcagcaccgugaccgugcuggagcccagcguggugaccgugcccgagccccccgugguggccgagcccgacuacgugaccauccccgugcccguggugagcgcccuggagcccagcgugcccgugcuggagcccgccgugagcgugcugcagcccagcaugaucgugagcgagcccagcgugagcgugcaggagagcaccgugaccgugagcgagcccgccgugaccgugagcgagcagacccaggugauccccaccgagguggccaucgagagcacccccaugauccuggagagcagcaucaugagcagccacgugaugaagggcaucaaccugagcagcggcgaccagaaccuggcccccgagaucggcaugcaggagaucgcccugcacagcggcgaggagccccacgccgaggagcaccugaagggcgacuucuacgagagcgagcacggcaucaacaucgaccugaacaucaacaaccaccugaucgccaaggagauggagcacaacaccgugugcgccgccggcaccagccccgugggcgagaucggcgaggagaagauccugcccaccagcgagaccaagcagagaaccgugcuggacaccuaccccggcgugagcgaggccgacgccggcgagacccugagcagcaccggccccuucgcccuggagcccgacgccaccggcaccagcaagggcaucgaguucaccaccgccagcacccugagccuggugaacaaguacgacguggaccugagccugaccacccaggacaccgagcacgacauggugaucagcaccagccccagcggcggcagcgaggccgacaucgagggcccccugcccgccaaggacauccaccuggaccugcccagcaacaacaaccuggugagcaaggacaccgaggagccccugcccgugaaggagagcgaccagacccuggccgcccugcugagccccaaggagagcagcggcggcgagaaggaggugccccccccccccaaggagacccugcccgacagcggcuucagcgccaacaucgaggacaucaacgaggccgaccuggugagaccccugcugcccaaggacauggagagacugaccagccugagagccggcaucgagggcccccugcuggccagcgacgugggcagagacagaagcgccgccagccccguggugagcagcaugcccgagagagccagcgagagcagcagcgaggagaaggacgacuacgagaucuucgugaaggugaaggacacccacgagaagagcaagaagaacaagaacagagacaagggcgagaaggagaagaagagagacagcagccugagaagcagaagcaagagaagcaagagcagcgagcacaagagcagaaagagaaccagcgagagcagaagcagagccagaaagagaagcagcaagagcaagagccacagaagccagaccagaagcagaagcagaagcagaagaagaagaagaagcagcagaagcagaagcaagagcagaggcagaagaagcgugagcaaggagaagagaaagagaagccccaagcacagaagcaagagcagagagagaaagagaaagagaagcagcagcagagacaacagaaagaccgugagagccagaagcagaacccccagcagaagaagcagaagccacacccccagcagaagaagaagaagcagaagcgugggcagaagaagaagcuucagcaucagccccagcagaagaagcagaacccccagcagaagaagcagaacccccagcagaagaagcagaacccccagcagaagaagcagaacccccagcagaagaagcagaacccccagcagaagaagcagaacccccagcagaagaagaagaagcagaagcguggugagaagaagaagcuucagcaucagccccgugagacugagaagaagcagaaccccccugagaagaagauucagcagaagccccaucagaagaaagagaagcagaagcagcgagagaggcagaagccccaagagacugaccgaccuggacaaggcccagcugcuggagaucgccaaggccaacgccgccgccaugugcgccaaggccggcgugccccugccccccaaccugaagcccgcccccccccccaccaucgaggagaagguggccaagaagagcggcggcgccaccaucgaggagcugaccgaguucuaa

SEQ ID NO: 23851 - RNA, 3456 nt, Artificial Sequence
  SORBS1__Homo_sapiens__NP_001030127
augagcagcgagugcgacggcggcagcaaggccgugaugaacggccuggcccccggcagcaacggccaggacaaggccaccgccgacccccugagagccagaagcaucagcgccgugaagaucauccccgugaagaccgugaagaacgccagcggccuggugcugcccaccgacauggaccccaccaagaucugcaccggcaagggcgccgugacccugagagccagcagcagcuacagagagacccccagcagcagccccgccagcccccaggagaccagacagcacgagagcaagcccggccuggagcccgagcccagcagcgccgacgaguggagacugagcagcagcgccgacgccaacggcaacgcccagcccagcagccuggccgccaagggcuacagaagcgugcaccccaaccugcccagcgacaagagccaggacgccaccagcagcagcgccgcccagcccgaggugaucguggugccccuguaccuggugaacaccgacagaggccaggagggcaccgccagaccccccaccccccugggcccccugggcugcgugcccaccauccccgccaccgccagcgccgccagcccccugaccuuccccacccuggacgacuucauccccccccaccugcagagauggccccaccacagccagcccgccagagccagcggcagcuucgcccccaucagccagaccccccccagcuucagccccccccccccccuggugccccccgcccccgaggaccugagaagagugagcgagcccgaccugaccggcgccgugagcagcaccgacagcagcccccugcugaacgaggugagcagcagccugaucggcaccgacagccaggccuuccccagcgugagcaagcccagcagcgccuaccccagcaccaccaucgugaaccccaccaucgugcugcugcagcacaacagagagcagcagaagagacugagcagccugagcgaccccgugagcgagagaagagugggcgagcaggacagcgcccccacccaggagaagcccaccagccccggcaaggccaucgagaagagagccaaggacgacagcagaagaguggugaagagcacccaggaccugagcgacgugagcauggacgaggugggcaucccccugagaaacaccgagagaagcaaggacugguacaagaccauguucaagcagauccacaagcugaacagagacacccccgaggagaaccccuacuuccccaccuacaaguuccccgagcugcccgagauccagcagaccagcgaggagaccaagagcugcagcgugaugagccccagacuggagugcagcggcaccgugaucgcccacugcagccugaagcugcuggacagcagcaacccccccaccagcgccagccagguggccggcaccgccgacgacgacagcgaccuguacagccccagauacagcuucagcgaggacaccaagagcccccugagcgugcccagaagcaagagcgagaugagcuacaucgacggcgagaagguggugaagagaagcgccacccugccccugcccgccagaagcagcagccugaagagcagcagcgagagaaacgacugggagccccccgacaagaagguggacaccagaaaguacagagccgagcccaagagcaucuacgaguaccagcccggcaagagcagcgugcugaccaacgagaagaugagcagagacaucagccccgaggagaucgaccugaagaacgagcccugguacaaguucuucagcgagcuggaguucggcaagcccccccccaagaagaucugggacuacacccccggcgacugcagcauccugcccagagaggacagaaagaccaaccuggacaaggaccugagccugugccagaccgagcuggaggccgaccuggagaagauggagacccugaacaaggcccccagcgccaacgugccccagagcagcgccaucagccccacccccgagaucagcagcgagacccccggcuacaucuacagcagcaacuuccacgccgugaagagagagagcgacggcgcccccggcgaccugaccagccuggagaacgagagacagaucuacaagagcgugcuggagggcggcgacaucccccugcagggccugagcggccugaagagacccagcagcagcgccagcaccaaggacagcgagagccccagacacuucauccccgccgacuaccuggagagcaccgaggaguucaucagaagaagacacgacgacaaggagaagcugcuggccgaccagagaagacugaagagagagcaggaggaggccgacaucgccgccagaagacacaccggcgugauccccacccaccaccaguucaucaccaacgagagauucggcgaccugcugaacaucgacgacaccgccaagagaaagagcggcagcgagaugagacccgccagagccaaguucgacuucaaggcccagacccugaaggagcugccccugcagaagggcgacaucguguacaucuacaagcagaucgaccagaacugguacgagggcgagcaccacggcagagugggcaucuuccccagaaccuacaucgagcugcugccccccgccgagaaggcccagcccaagaagcugacccccgugcaggugcuggaguacggcgaggccaucgccaaguucaacuucaacggcgacacccagguggagaugagcuucagaaagggcgagagaaucacccugcugagacagguggacgagaacugguacgagggcagaauccccggcaccagcagacagggcaucuuccccaucaccuacguggacgugaucaagagaccccuggugaagaaccccguggacuacauggaccugcccuucagcagcagccccagcagaagcgccaccgccagcccccagcccuggagagaggagagcggccaguacgagagaaaggccgagagaggcgccggcgagagaggccccggcggccccaagaucagcaagaagagcugccugaagcccagcgacguggugagaugccugagcaccgagcagagacugagcgaccugaacacccccgaggagagcagacccggcaagccccugggcagcgccuuccccggcagcgaggccgagcagaccgagagacacagaggcggcgagcaggccggcagaaaggccgccagaagaggcggcagccagcagccccaggcccagcagagaagagugacccccgacagaagccagaccagccaggaccuguucagcuaccaggcccuguacagcuacaucccccagaacgacgacgagcuggagcugagagacggcgacaucguggacgugauggagaagugcgacgacggcugguucgugggcaccagcagaagaaccaagcaguucggcaccuuccccggcaacuacgugaagccccuguaccuguaa

SEQ ID NO: 23852 - RNA, 1935 nt, Artificial Sequence
  SORBS2__Homo_sapiens__NP_001139142
augagcgugacccugaccagcgugaagagagugcagagcagccccaaccugcuggccgccggcagagacagccagagccccgacagcgccuggagaagcuacaacgacggcaaccaggagacccugaacggcgacgccaccuacagcagccuggccgccaagggcuucagaagcgugagacccaaccugcaggacaagagaagccccacccagagccagaucaccgugaacggcaacagcggcggcgccgugagccccaugagcuacuaccagagacccuucagccccagcgccuacagccugcccgccagccugaacagcagcaucgugaugcagcacggcaccagccuggacagcaccgacaccuacccccagcacgcccagagccuggacggcaccaccagcagcagcaucccccuguacagaagcagcgaggaggagaagagagugaccgugaucaaggccccccacuaccccggcaucggccccguggacgagagcggcauccccaccgccaucagaaccaccguggacagacccaaggacugguacaagaccauguucaagcagauccacauggugcacaagcccggccuguacaacccccccuacagcgcccagagccaccccgccgccaagacccagaccuacagaccccugagcaagagccacagcgacaacagccccaacgccuucaaggacgccagcagccccgugccccccccccacgugcccccccccgugcccccccugagacccagagacagaagcagcaccgagaagcacgacugggacccccccgacagaaagguggacaccagaaaguucagaagcgagcccagaagcaucuucgaguacgagcccggcaagagcagcauccugcagcacgagagacccgccagccuguaccagagcagcaucgacagaagccuggagagacccaugagcagcgccagcauggccagcgacuucagaaagagaagaaagagcgagcccgccgugggcccccccagaggccugggcgaccagagcgccagcagaaccagccccggcagaguggaccugcccggcagcagcaccacccugaccaagagcuucaccagcagcagccccagcagccccagcagagccaaggacagagagagccccagaagcuacagcagcacccugaccgacaugggcagaagcgcccccagagagagaagaggcacccccgagaaggagaagcugcccgccaaggccguguacgacuucaaggcccagaccagcaaggagcugagcuucaagaagggcgacaccguguacauccugagaaagaucgaccagaacugguacgagggcgagcaccacggcagagugggcaucuuccccaucagcuacguggagaagcugaccccccccgagaaggcccagcccgccagaccccccccccccgcccagcccggcgagaucggcgaggccaucgccaaguacaacuucaacgccgacaccaacguggagcugagccugagaaagggcgacagagugauccugcugaagagaguggaccagaacugguacgagggcaagauccccggcaccaacagacagggcaucuuccccgugagcuacguggagguggugaagaagaacaccaagggcgccgaggacuaccccgacccccccaucccccacagcuacagcagcgacagaauccacagccugagcagcaacaagccccagagacccguguucacccacgagaacauccagggcggcggcgagcccuuccaggcccuguacaacuacacccccagaaacgaggacgagcuggagcugagagagagcgacgugaucgacgugauggagaagugcgacgacggcugguucgugggcaccagcagaagaaccaaguucuucggcaccuuccccggcaacuacgugaagagacuguaa

SEQ ID NO: 23853 - RNA, 2016 nt, Artificial Sequence
  SORBS3__Homo_sapiens__NP_005766
augcagggcccccccagaagccugagagccggccugagccuggacgacuucauccccggccaccugcagagccacaucggcagcagcagcagaggcaccagagugcccgugaucagaaacggcggcagcaacacccugaacuuccaguuccacgaccccgcccccagaaccgugugcaacggcggcuacacccccagaagagacgccagccagcaccccgaccccgccugguaccagaccuggcccggccccggcagcaagcccagcgccagcaccaagauccccgccagccagcacacccagaacuggagcgccaccuggaccaaggacagcaagagaagagacaagagaugggugaaguacgagggcaucggccccguggacgagagcggcaugcccaucgcccccagaagcagcguggacagacccagagacugguacagaagaauguuccagcagauccacagaaagaugcccgaccugcagcuggacuggaccuucgaggagccccccagagaccccagacaccugggcgcccagcagagacccgcccacagacccggccccgccaccagcagcagcggcagaagcugggaccacagcgaggagcugcccagaagcaccuucaacuacagacccggcgccuucagcaccgugcugcagcccagcaaccaggugcugagaagaagagagaagguggacaacguguggaccgaggagagcuggaaccaguuccugcaggagcuggagaccggccagagacccaagaagccccugguggacgaccccggcgagaagcccagccagcccaucgaggugcugcuggagagagagcuggccgagcugagcgccgagcuggacaaggaccugagagccaucgagaccagacugcccagccccaagagcagccccgcccccagaagagcccccgagcagagaccccccgccggccccgccagcgccuggagcagcagcuacccccacgcccccuaccugggcagcgccagaagccugagcccccacaagauggccgacggcggcagccccuuccugggcagaagagacuucguguaccccagcagcaccagagaccccagcgccagcaacggcggcggcagccccgccagaagagaggagaagaagagaaaggccgccagacugaaguucgacuuccaggcccagagccccaaggagcugacccugcagaagggcgacaucguguacauccacaaggagguggacaagaacuggcuggagggcgagcaccacggcagacugggcaucuuccccgccaacuacguggaggugcugcccgccgacgagauccccaagcccaucaagccccccaccuaccaggugcuggaguacggcgaggccguggcccaguacaccuucaagggcgaccuggagguggagcugagcuucagaaagggcgagcacaucugccugaucagaaaggugaacgagaacugguacgagggcagaaucaccggcaccggcagacagggcaucuuccccgccagcuacgugcaggugagcagagagcccagacugagacugugcgacgacggcccccagcugcccaccagccccagacugaccgccgccgccagaagcgccagacaccccagcagccccagcgcccugagaagccccgccgaccccaucgaccugggcggccagaccagccccagaagaaccggcuucagcuuccccacccaggagcccagaccccagacccagaaccugggcacccccggccccgcccugagccacagcagaggccccagccacccccuggaccugggcaccagcagccccaacaccagccagauccacuggacccccuacagagccauguaccaguacagaccccagaacgaggacgagcuggagcugagagagggcgacagaguggacgugaugcagcagugcgacgacggcugguucgugggcgugagcagaagaacccagaaguucggcaccuuccccggcaacuacguggcccccguguaa

SEQ ID NO: 23854 - RNA, 3597 nt, Artificial Sequence
  SORCS1__Homo_sapiens__NP_001013049
augggcaaggugggcgccggcggcggcagccaggccagacugagcgcccugcuggccggcgccggccugcugauccugugcgcccccggcgugugcggcggcggcagcugcugccccagcccccaccccagcagcgcccccagaagcgccagcacccccagaggcuucagccaccagggcagacccggcagagcccccgccaccccccugccccugguggugagaccccuguucagcguggcccccggcgacagagcccugagccuggagagagccagaggcaccggcgccagcauggccguggccgccagaagcggcagaagaagaagaagcggcgccgaccaggagaaggccgagagaggcgagggcgccagcagaagccccagaggcgugcugagagacggcggccagcaggagcccggcaccagagagagagaccccgacaaggccaccagauucagaauggaggagcugagacugaccagcaccaccuucgcccugaccggcgacagcgcccacaaccaggccauggugcacuggagcggccacaacagcagcgugauccugauccugaccaagcuguacgacuacaaccugggcagcaucaccgagagcagccuguggagaagcaccgacuacggcaccaccuacgagaagcugaacgacaaggugggccugaagaccauccugagcuaccuguacgugugccccaccaacaagagaaagaucaugcugcugaccgaccccgagaucgagagcagccugcugaucagcagcgacgagggcgccaccuaccagaaguacagacugaacuucuacauccagagccugcuguuccaccccaagcaggaggacuggauccuggccuacagccaggaccagaagcuguacagcagcgccgaguucggcagaagauggcagcugauccaggagggcguggugcccaacagauucuacuggagcgugaugggcagcaacaaggagcccgaccuggugcaccuggaggccagaaccguggacggccacagccacuaccugaccugcagaaugcagaacugcaccgaggccaacagaaaccagcccuuccccggcuacaucgaccccgacagccugaucgugcaggaccacuacguguucgugcagcugaccagcggcggcagaccccacuacuacgugagcuacagaagaaacgccuucgcccagaugaagcugcccaaguacgcccugcccaaggacaugcacgugaucagcaccgacgagaaccagguguucgccgccgugcaggaguggaaccagaacgacaccuacaaccuguacaucagcgacaccagaggcguguacuucacccuggcccuggagaacgugcagagcagcagaggccccgagggcaacaucaugaucgaccuguacgagguggccggcaucaagggcauguuccuggccaacaagaagaucgacaaccaggugaagaccuucaucaccuacaacaagggcagagacuggagacugcugcaggcccccgacaccgaccugagaggcgaccccgugcacugccugcugcccuacugcagccugcaccugcaccugaaggugagcgagaaccccuacaccagcggcaucaucgccagcaaggacaccgcccccagcaucaucguggccagcggcaacaucggcagcgagcugagcgacaccgacaucagcauguucgugagcagcgacgccggcaacaccuggagacagaucuucgaggaggagcacagcgugcuguaccuggaccagggcggcgugcugguggccaugaagcacaccagccugcccaucagacaccuguggcugagcuucgacgagggcagaagcuggagcaaguacagcuucaccagcaucccccuguucguggacggcgugcugggcgagcccggcgaggagacccugaucaugaccguguucggccacuucagccacagaagcgaguggcagcuggugaagguggacuacaagagcaucuucgacagaagaugcgccgaggaggacuacagacccuggcagcugcacagccagggcgaggccugcaucaugggcgccaagagaaucuacaagaagagaaagagcgagagaaagugcaugcagggcaaguacgccggcgccauggagagcgagcccugcgugugcaccgaggccgacuucgacugcgacuacggcuacgagagacacagcaacggccagugccugcccgccuucugguucaaccccagcagccugagcaaggacugcagccugggccagagcuaccugaacagcaccggcuacagaaagguggugagcaacaacugcaccgacggcgugagagagcaguacaccgccaagccccagaagugccccggcaaggcccccagaggccugagaaucgugaccgccgacggcaagcugaccgccgagcagggccacaacgugacccugauggugcagcuggaggagggcgacgugcagagaacccugauccagguggacuucggcgacggcaucgccgugagcuacgugaaccugagcagcauggaggacggcaucaagcacguguaccagaacgugggcaucuucagagugaccgugcagguggacaacagccugggcagcgacagcgccgugcuguaccugcacgugaccugcccccuggagcacgugcaccugagccugcccuucgugaccaccaagaacaaggaggugaacgccaccgccgugcuguggcccagccaggugggcacccugaccuacguguggugguacggcaacaacaccgagccccugaucacccuggagggcagcaucagcuucagauucaccagcgagggcaugaacaccaucaccgugcaggugagcgccggcaacgccauccugcaggacaccaagaccaucgccguguacgaggaguucagaagccugagacugagcuucagccccaaccuggacgacuacaaccccgacauccccgaguggagaagagacaucggcagagugaucaagaagagccugguggaggccaccggcgugcccggccagcacauccugguggccgugcugcccggccugcccaccaccgccgagcuguucgugcugcccuaccaggaccccgccggcgagaacaagagaagcaccgacgaccuggagcagaucagcgagcugcugauccacacccugaaccagaacagcgugcacuucgagcugaagcccggcgugagagugcuggugcacgccgcccaccugaccgccgccccccugguggaccugacccccacccacagcggcagcgccaugcugaugcugcugagcgugguguucgugggccuggccguguucgugaucuacaaguucaagagaaagauccccggcaucaacguguacgcccagaugcagaacgagaaggagcaggagaugaucagccccgugagccacagcgagagcagacccaacgugccccagaccgagcugagaagacccggccagcugaucgacgagaagguggagagccagcugaucggcagcaucagcaucguggccgagaaccagagcaccaaggagauccccaccuacgugaacguguaa

SEQ ID NO: 23855 - RNA, 3480 nt, Artificial Sequence
  SORCS2__Homo_sapiens__NP_065828
auggcccacagaggccccagcagagccagcaagggccccggccccaccgccagagcccccagccccggcgccccccccccccccagaagccccagaagcagaccccugcugcugcugcugcugcugcugggcgccugcggcgccgccggcagaagccccgagcccggcagacugggcccccacgcccagcugaccagagugcccagaagcccccccgccggcagagccgagcccggcggcggcgaggacagacaggccagaggcaccgagcccggcgcccccggccccagccccggccccgcccccggccccggcgaggacggcgcccccgccgccggcuacagaagaugggagagagccgccccccuggccggcguggccagcagagcccaggugagccugaucagcaccagcuucgugcugaagggcgacgccacccacaaccaggccauggugcacuggaccggcgagaacagcagcgugauccugauccugaccaaguacuaccacgccgacaugggcaaggugcuggagagcagccuguggagaagcagcgacuucggcaccagcuacaccaagcugacccugcagcccggcgugaccaccgugaucgacaacuucuacaucugccccaccaacaagagaaaggugauccuggugagcagcagccugagcgacagagaccagagccuguuccugagcgccgacgagggcgccaccuuccagaagcagcccauccccuucuucguggagacccugaucuuccaccccaaggaggaggacaaggugcuggccuacaccaaggagagcaagcuguacgugagcagcgaccugggcaagaaguggacccugcugcaggagagagugaccaaggaccacguguucuggagcgugagcggcguggacgccgaccccgaccuggugcacguggaggcccaggaccugggcggcgacuucagauacgugaccugcgccauccacaacugcagcgagaagaugcugaccgcccccuucgccggccccaucgaccacggcagccugaccgugcaggacgacuacaucuucuucaaggccaccagcgccaaccagaccaaguacuacgugagcuacagaagaaacgaguucgugcugaugaagcugcccaaguacgcccugcccaaggaccugcagaucaucagcaccgacgagagccagguguucguggccgugcaggagugguaccagauggacaccuacaaccuguaccagagcgaccccagaggcgugagauacgcccuggugcugcaggacgugagaagcagcagacaggccgaggagagcgugcugaucgacauccuggaggugagaggcgugaagggcguguuccuggccaaccagaagaucgacggcaaggugaugacccugaucaccuacaacaagggcagagacugggacuaccugagaccccccagcauggacaugaacggcaagcccaccaacugcaagccccccgacugccaccugcaccugcaccugagaugggccgacaaccccuacgugagcggcaccgugcacaccaaggacaccgcccccggccugaucaugggcgccggcaaccugggcagccagcugguggaguacaaggaggagauguacaucaccagcgacugcggccacaccuggagacagguguucgaggaggagcaccacauccuguaccuggaccacggcggcgugaucguggccaucaaggacaccagcaucccccugaagauccugaaguucagcguggacgagggccugaccuggagcacccacaacuucaccagcaccagcguguucguggacggccugcugagcgagcccggcgacgagacccuggugaugaccguguucggccacaucagcuucagaagcgacugggagcuggugaagguggacuucagacccagcuucagcagacagugcggcgaggaggacuacagcagcugggagcugagcaaccugcagggcgacagaugcaucaugggccagcagagaagcuucagaaagagaaagagcaccagcuggugcaucaagggcagaagcuucaccagcgcccugaccagcagagugugcgagugcagagacagcgacuuccugugcgacuacggcuucgagagaagcagcagcagcgagagcagcaccaacaagugcagcgccaacuucugguucaacccccugagcccccccgacgacugcgcccugggccagaccuacaccagcagccugggcuacagaaagguggugagcaacgugugcgagggcggcguggacaugcagcagagccaggugcagcugcagugcccccugaccccccccagaggccugcaggugagcauccagggcgaggccguggccgugagacccggcgaggacgugcuguucguggugagacaggagcagggcgacgugcugaccaccaaguaccagguggaccugggcgacggcuucaaggccauguacgugaaccugacccugaccggcgagcccaucagacacagauacgagagccccggcaucuacagagugagcgugagagccgagaacaccgccggccacgacgaggccgugcuguucgugcaggugaacagcccccugcaggcccuguaccuggagguggugcccgugaucggccugaaccaggaggugaaccugaccgccgugcugcugccccugaaccccaaccugaccguguucuacugguggaucggccacagccugcagccccugcugagccuggacaacagcgugaccaccagauucagcgacaccggcgacgugagagugaccgugcaggccgccugcggcaacagcgugcugcaggacagcagagugcugagagugcuggaccaguuccaggugaugccccugcaguucagcaaggagcuggacgccuacaaccccaacacccccgaguggagagaggacgugggccugguggugaccagacugcugagcaaggagaccagcgugccccaggagcugcuggugaccguggugaagcccggccugcccacccuggccgaccuguacgugcugcugcccccccccagacccaccagaaagagaagccugagcagcgacaagagacuggccgccauccagcaggugcugaacgcccagaagaucagcuuccugcugagaggcggcgugagagugcugguggcccugagagacaccggcaccggcgccgagcagcugggcggcggcggcggcuacugggccgugguggugcuguucgugaucggccuguucgccgccggcgccuucauccuguacaaguucaagagaaagagacccggcagaaccguguacgcccagaugcacaacgagaaggagcaggagaugaccagccccgugagccacagcgaggacgugcagggcgccgugcagggcaaccacagcggcguggugcugagcaucaacagcagagagaugcacagcuaccuggugagcuaa

SEQ ID NO: 23856 - RNA, 3669 nt, Artificial Sequence
  SORCS3__Homo_sapiens__NP_055793
auggaggccgccagaaccgagagacccgccggcagacccggcgccccccuggugagaaccggccugcugcugcugagcaccugggugcuggccggcgccgagaucaccugggacgccaccggcggccccggcagacccgccgcccccgccagcagaccccccgcccugagcccccugagccccagagccguggccagccaguggcccgaggagcuggccagcgccagaagagccgccgugcugggcagaagagccggccccgagcugcugccccagcagggcggcggcagaggcggcgagaugcagguggaggccggcggcaccagccccgccggcgagagaagaggcagaggcauccccgcccccgccaagcugggcggcgccagaagaagcagaagagcccagccccccaucacccaggagagaggcgacgccugggccaccgcccccgccgacggcagcagaggcagcagaccccuggccaagggcagcagagaggaggugaaggcccccagagccggcggcagcgccgccgaggaccugagacugcccagcaccagcuucgcccugaccggcgacagcgcccacaaccaggccauggugcacuggagcggccacaacagcagcgugauccugauccugaccaagcuguacgacuucaaccugggcagcgugaccgagagcagccuguggagaagcaccgacuacggcaccaccuacgagaagcugaacgacaaggugggccugaagaccgugcugagcuaccuguacgugaaccccaccaacaagagaaagaucaugcugcugagcgaccccgagauggagagcagcauccugaucagcagcgacgagggcgccaccuaccagaaguacagacugaccuucuacauccagagccugcuguuccaccccaagcaggaggacugggugcuggccuacagccuggaccagaagcuguacagcagcauggacuucggcagaagauggcagcugaugcacgagagaaucacccccaacagauucuacuggagcguggccggccuggacaaggaggccgaccuggugcacauggaggugagaaccaccgacggcuacgcccacuaccugaccugcagaauccaggagugcgccgagaccaccagaagcggccccuucgccagaagcaucgacaucagcagccugguggugcaggacgaguacaucuucauccaggugaccaccagcggcagagccagcuacuacgugagcuacagaagagaggccuucgcccagaucaagcugcccaaguacagccugcccaaggacaugcacaucaucagcaccgacgagaaccagguguucgccgccgugcaggaguggaaccagaacgacaccuacaaccuguacaucagcgacaccagaggcaucuacuucacccuggccauggagaacaucaagagcagcagaggccugaugggcaacaucaucaucgagcuguacgagguggccggcaucaagggcaucuuccuggccaacaagaagguggacgaccaggugaagaccuacaucaccuacaacaagggcagagacuggagacugcugcaggcccccgacguggaccugagaggcagccccgugcacugccugcugcccuucugcagccugcaccugcaccugcagcugagcgagaaccccuacagcagcggcagaaucagcagcaaggagaccgcccccggccuggugguggccaccggcaacaucggccccgagcugagcuacaccgacaucggcguguucaucagcagcgacggcggcaacaccuggagacagaucuucgacgaggaguacaacgugugguuccuggacuggggcggcgcccugguggccaugaagcacaccccccugcccgugagacaccugugggugagcuucgacgagggccacagcugggacaaguacggcuucaccagcgugccccuguucguggacggcgcccugguggaggccggcauggagacccacaucaugaccguguucggccacuucagccugagaagcgaguggcagcuggugaagguggacuacaagagcaucuucagcagacacugcaccaaggaggacuaccagaccuggcaccugcugaaccagggcgagcccugcgugaugggcgagagaaagaucuucaagaagagaaagcccggcgcccagugcgcccugggcagagaccacagcggcagcguggugagcgagcccugcgugugcgccaacugggacuucgagugcgacuacggcuacgagagacacggcgagagccagugcgugcccgccuucugguacaaccccgccagccccagcaaggacugcagccugggccagagcuaccugaacagcaccggcuacagaagaaucgugagcaacaacugcaccgacggccugagagagaaguacaccgccaaggcccagaugugccccggcaaggcccccagaggccugcacguggugaccaccgacggcagacugguggccgagcagggccacaacgccaccuucaucauccugauggaggagggcgaccugcagagaaccaacauccagcuggacuucggcgacggcaucgccgugagcuacgccaacuucagccccaucgaggacggcaucaagcacguguacaagagcgccggcaucuuccaggugaccgccuacgccgagaacaaccugggcagcgacaccgccgugcuguuccugcacguggugugccccguggagcacgugcaccugagagugcccuucguggccaucagaaacaaggaggugaacaucagcgccgugguguggcccagccagcugggcacccugaccuacuucuggugguucggcaacagcaccaagccccugaucacccuggacagcagcaucagcuucaccuuccuggccgagggcaccgacaccaucaccgugcagguggccgccggcaacgcccugauccaggacaccaaggagaucgccgugcacgaguacuuccagagccagcugcugagcuucagccccaaccuggacuaccacaaccccgacauccccgaguggagaaaggacaucggcaacgugaucaagagagcccuggugaaggugaccagcgugcccgaggaccagauccugaucgccguguuccccggccugcccaccagcgccgagcuguucauccugccccccaagaaccugaccgagagaagaaagggcaacgagggcgaccuggagcagaucguggagacccuguucaacgcccugaaccagaaccuggugcaguucgagcugaagcccggcgugcaggugaucguguacgugacccagcugacccuggccccccugguggacagcagcgccggccacagcagcagcgccaugcugaugcugcugagcgugguguucgugggccuggccguguuccugaucuacaaguucaagagaaagauccccuggaucaacaucuacgcccaggugcagcacgacaaggagcaggagaugaucggcagcgugagccagagcgagaacgcccccaagaucacccugagcgacuucaccgagcccgaggagcugcuggacaaggagcuggacaccagagugaucggcggcaucgccaccaucgccaacagcgagagcaccaaggagauccccaacugcaccagcguguaa

SEQ ID NO: 23857 - RNA, 1074 nt, Artificial Sequence
  SORD__Homo_sapiens__NP_003095
auggccgccgccgccaagcccaacaaccugagccugguggugcacggccccggcgaccugagacuggagaacuaccccauccccgagcccggccccaacgaggugcugcugagaaugcacagcgugggcaucugcggcagcgacgugcacuacugggaguacggcagaaucggcaacuucaucgugaagaagcccauggugcugggccacgaggccagcggcaccguggagaaggugggcagcagcgugaagcaccugaagcccggcgacagaguggccaucgagcccggcgcccccagagagaacgacgaguucugcaagaugggcagauacaaccugagccccagcaucuucuucugcgccaccccccccgacgacggcaaccugugcagauucuacaagcacaacgccgccuucugcuacaagcugcccgacaacgugaccuucgaggagggcgcccugaucgagccccugagcgugggcauccacgccugcagaagaggcggcgugacccugggccacaaggugcuggugugcggcgccggccccaucggcauggugacccugcugguggccaaggccaugggcgccgcccaggugguggugaccgaccugagcgccaccagacugagcaaggccaaggagaucggcgccgaccuggugcugcagaucagcaaggagagcccccaggagaucgccagaaagguggagggccagcugggcugcaagcccgaggugaccaucgagugcaccggcgccgaggccagcauccaggccggcaucuacgccaccagaagcggcggcaaccuggugcuggugggccugggcagcgagaugaccaccgugccccugcugcacgccgccaucagagagguggacaucaagggcguguucagauacugcaacaccuggcccguggccaucagcaugcuggccagcaagagcgugaacgugaagccccuggugacccacagauucccccuggagaaggcccuggaggccuucgagaccuucaagaagggccugggccugaagaucaugcugaagugcgaccccagcgaccagaaccccuaa

SEQ ID NO: 23858 - RNA, 6645 nt, Artificial Sequence
  SORL1__Homo_sapiens__NP_003096
auggccaccagaagcagcagaagagagagcagacugcccuuccuguucacccugguggcccugcugccccccggcgcccugugcgagguguggacccagagacugcacggcggcagcgccccccugccccaggacagaggcuuccugguggugcagggcgaccccagagagcugagacugugggccagaggcgacgccagaggcgccagcagagccgacgagaagccccugagaagaaagagaagcgccgcccugcagcccgagcccaucaagguguacggccaggugagccugaacgacagccacaaccagaugguggugcacugggccggcgagaagagcaacgugaucguggcccuggccagagacagccuggcccuggccagacccaagagcagcgacguguacgugagcuacgacuacggcaagagcuucaagaagaucagcgacaagcugaacuucggccugggcaacagaagcgaggccgugaucgcccaguucuaccacagccccgccgacaacaagagauacaucuucgccgacgccuacgcccaguaccuguggaucaccuucgacuucugcaacacccugcagggcuucagcauccccuucagagccgccgaccugcugcugcacagcaaggccagcaaccugcugcugggcuucgacagaagccaccccaacaagcagcuguggaagagcgacgacuucggccagaccuggaucaugauccaggagcacgugaagagcuucagcuggggcaucgaccccuacgacaagcccaacaccaucuacaucgagagacacgagcccagcggcuacagcaccguguucagaagcaccgacuucuuccagagcagagagaaccaggaggugauccuggaggaggugagagacuuccagcugagagacaaguacauguucgccaccaagguggugcaccugcugggcagcgagcagcagagcagcgugcagcugugggugagcuucggcagaaagcccaugagagccgcccaguucgugaccagacaccccaucaacgaguacuacaucgccgacgccagcgaggaccagguguucgugugcgugagccacagcaacaacagaaccaaccuguacaucagcgaggccgagggccugaaguucagccugagccuggagaacgugcuguacuacagccccggcggcgccggcagcgacacccuggugagauacuucgccaacgagcccuucgccgacuuccacagaguggagggccugcagggcguguacaucgccacccugaucaacggcagcaugaacgaggagaacaugagaagcgugaucaccuucgacaagggcggcaccugggaguuccugcaggcccccgccuucaccggcuacggcgagaagaucaacugcgagcugagccagggcugcagccugcaccuggcccagagacugagccagcugcugaaccugcagcugagaagaaugcccauccugagcaaggagagcgcccccggccugaucaucgccaccggcagcgugggcaagaaccuggccagcaagaccaacguguacaucagcagcagcgccggcgccagauggagagaggcccugcccggcccccacuacuacaccuggggcgaccacggcggcaucaucaccgccaucgcccagggcauggagaccaacgagcugaaguacagcaccaacgagggcgagaccuggaagaccuucaucuucagcgagaagcccguguucguguacggccugcugaccgagcccggcgagaagagcaccguguucaccaucuucggcagcaacaaggagaacgugcacagcuggcugauccugcaggugaacgccaccgacgcccugggcgugcccugcaccgagaacgacuacaagcuguggagccccagcgacgagagaggcaacgagugccugcugggccacaagaccguguucaagagaagaaccccccacgccaccugcuucaacggcgaggacuucgacagacccgugguggugagcaacugcagcugcaccagagaggacuacgagugcgacuucggcuucaagaugagcgaggaccugagccuggaggugugcgugcccgaccccgaguucagcggcaagagcuacagcccccccgugcccugccccgugggcagcaccuacagaagaaccagaggcuacagaaagaucagcggcgacaccugcagcggcggcgacguggaggccagacuggagggcgagcuggugcccugcccccuggccgaggagaacgaguucauccuguacgccgugagaaagagcaucuacagauacgaccuggccagcggcgccaccgagcagcugccccugaccggccugagagccgccguggcccuggacuucgacuacgagcacaacugccuguacuggagcgaccuggcccuggacgugauccagagacugugccugaacggcagcaccggccaggaggugaucaucaacagcggccuggagaccguggaggcccuggccuucgagccccugagccagcugcuguacuggguggacgccggcuucaagaagaucgagguggccaaccccgacggcgacuucagacugaccaucgugaacagcagcgugcuggacagacccagagcccuggugcuggugccccaggagggcgugauguucuggaccgacuggggcgaccugaagcccggcaucuacagaagcaacauggacggcagcgccgccuaccaccuggugagcgaggacgugaaguggcccaacggcaucagcguggacgaccaguggaucuacuggaccgacgccuaccuggagugcaucgagagaaucaccuucagcggccagcagagaagcgugauccuggacaaccugccccaccccuacgccaucgccguguucaagaacgagaucuacugggacgacuggagccagcugagcaucuucagagccagcaaguacagcggcagccagauggagauccuggccaaccagcugaccggccugauggacaugaagaucuucuacaagggcaagaacaccggcagcaacgccugcgugcccagacccugcagccugcugugccugcccaaggccaacaacagcagaagcugcagaugccccgaggacgugagcagcagcgugcugcccagcggcgaccugaugugcgacugcccccagggcuaccagcugaagaacaacaccugcgugaaggaggagaacaccugccugagaaaccaguacagaugcagcaacggcaacugcaucaacagcaucugguggugcgacuucgacaacgacugcggcgacaugagcgacgagagaaacugccccaccaccaucugcgaccuggacacccaguucagaugccaggagagcggcaccugcaucccccugagcuacaagugcgaccuggaggacgacugcggcgacaacagcgacgagagccacugcgagaugcaccagugcagaagcgacgaguacaacugcagcagcggcaugugcaucagaagcagcugggugugcgacggcgacaacgacugcagagacuggagcgacgaggccaacugcaccgccaucuaccacaccugcgaggccagcaacuuccagugcagaaacggccacugcaucccccagagaugggccugcgacggcgacaccgacugccaggacggcagcgacgaggaccccgugaacugcgagaagaagugcaacggcuucagaugccccaacggcaccugcauccccagcagcaagcacugcgacggccugagagacugcagcgacggcagcgacgagcagcacugcgagccccugugcacccacuucauggacuucgugugcaagaacagacagcagugccuguuccacagcauggugugcgacggcaucauccagugcagagacggcagcgacgaggacgccgccuucgccggcugcagccaggaccccgaguuccacaaggugugcgacgaguucggcuuccagugccagaacggcgugugcaucagccugaucuggaagugcgacggcauggacgacugcggcgacuacagcgacgaggccaacugcgagaaccccaccgaggcccccaacugcagcagauacuuccaguucagaugcgagaacggccacugcauccccaacagauggaagugcgacagagagaacgacugcggcgacuggagcgacgagaaggacugcggcgacagccacauccugcccuucagcacccccggccccagcaccugccugcccaacuacuacagaugcagcagcggcaccugcgugauggacaccugggugugcgacggcuacagagacugcgccgacggcagcgacgaggaggccugcccccugcuggccaacgugaccgccgccagcacccccacccagcugggcagaugcgacagauucgaguucgagugccaccagcccaagaccugcauccccaacuggaagagaugcgacggccaccaggacugccaggacggcagagacgaggccaacugccccacccacagcacccugaccugcaugagcagagaguuccagugcgaggacggcgaggccugcaucgugcugagcgagagaugcgacggcuuccuggacugcagcgacgagagcgacgagaaggccugcagcgacgagcugaccguguacaaggugcagaaccugcaguggaccgccgacuucagcggcgacgugacccugaccuggaugagacccaagaagaugcccagcgccagcugcguguacaacguguacuacagaguggugggcgagagcaucuggaagacccuggagacccacagcaacaagaccaacaccgugcugaaggugcugaagcccgacaccaccuaccaggugaaggugcaggugcagugccugagcaaggcccacaacaccaacgacuucgugacccugagaacccccgagggccugcccgacgcccccagaaaccugcagcugagccugcccagagaggccgagggcgugaucgugggccacugggccccccccauccacacccacggccugaucagagaguacaucguggaguacagcagaagcggcagcaagaugugggccagccagagagccgccagcaacuucaccgagaucaagaaccugcuggugaacacccuguacaccgugagaguggccgccgugaccagcagaggcaucggcaacuggagcgacagcaagagcaucaccaccaucaagggcaaggugauccccccccccgacauccacaucgacagcuacggcgagaacuaccugagcuucacccugaccauggagagcgacaucaaggugaacggcuacguggugaaccuguucugggccuucgacacccacaagcaggagagaagaacccugaacuucagaggcagcauccugagccacaaggugggcaaccugaccgcccacaccagcuacgagaucagcgccugggccaagaccgaccugggcgacagcccccuggccuucgagcacgugaugaccagaggcgugagaccccccgcccccagccugaaggccaaggccaucaaccagaccgccguggagugcaccuggaccggccccagaaacgugguguacggcaucuucuacgccaccagcuuccuggaccuguacagaaaccccaagagccugaccaccagccugcacaacaagaccgugaucgugagcaaggacgagcaguaccuguuccuggugagagugguggugcccuaccagggccccagcagcgacuacgugguggugaagaugauccccgacagcagacugccccccagacaccugcacguggugcacaccggcaagaccagcguggugaucaagugggagagccccuacgacagccccgaccaggaccugcuguacgccaucgccgugaaggaccugaucagaaagaccgacagaagcuacaaggugaagagcagaaacagcaccguggaguacacccugaacaagcuggagcccggcggcaaguaccacaucaucgugcagcugggcaacaugagcaaggacagcagcaucaagaucaccaccgugagccugagcgcccccgacgcccugaagaucaucaccgagaacgaccacgugcugcuguucuggaagagccuggcccugaaggagaagcacuucaacgagagcagaggcuacgagauccacauguucgacagcgccaugaacaucaccgccuaccugggcaacaccaccgacaacuucuucaagaucagcaaccugaagaugggccacaacuacaccuucaccgugcaggccagaugccuguucggcaaccagaucugcggcgagcccgccauccugcuguacgacgagcugggcagcggcgccgacgccagcgccacccaggccgccagaagcaccgacguggccgccgugguggugcccauccuguuccugauccugcugagccugggcgugggcuucgccauccuguacaccaagcacagaagacugcagagcagcuucaccgccuucgccaacagccacuacagcagcagacugggcagcgccaucuucagcagcggcgacgaccugggcgaggacgacgaggacgcccccaugaucaccggcuucagcgacgacgugcccauggugaucgccuaa

SEQ ID NO: 23859 - RNA, 4002 nt, Artificial Sequence
  SOS1__Homo_sapiens__NP_005624
augcaggcccagcagcugcccuacgaguucuucagcgaggagaacgcccccaaguggagaggccugcuggugcccgcccugaagaaggugcagggccaggugcaccccacccuggagagcaacgacgacgcccugcaguacguggaggagcugauccugcagcugcugaacaugcugugccaggcccagcccagaagcgccagcgacguggaggagagagugcagaagagcuucccccaccccaucgacaagugggccaucgccgacgcccagagcgccaucgagaagagaaagagaagaaacccccugagccugcccguggagaagauccacccccugcugaaggaggugcugggcuacaagaucgaccaccaggugagcguguacaucguggccgugcuggaguacaucagcgccgacauccugaagcuggugggcaacuacgugagaaacaucagacacuacgagaucaccaagcaggacaucaagguggccaugugcgccgacaaggugcugauggacauguuccaccaggacguggaggacaucaacauccugagccugaccgacgaggagcccagcaccagcggcgagcagaccuacuacgaccuggugaaggccuucauggccgagaucagacaguacaucagagagcugaaccugaucaucaagguguucagagagcccuucgugagcaacagcaagcuguucagcgccaacgacguggagaacaucuucagcagaaucguggacauccacgagcugagcgugaagcugcugggccacaucgaggacaccguggagaugaccgacgagggcagcccccacccccuggugggcagcugcuucgaggaccuggccgaggagcuggccuucgaccccuacgagagcuacgccagagacauccugagacccggcuuccacgacagauuccugagccagcugagcaagcccggcgccgcccuguaccugcagagcaucggcgagggcuucaaggaggccgugcaguacgugcugcccagacugcugcuggcccccguguaccacugccugcacuacuucgagcugcugaagcagcuggaggagaagagcgaggaccaggaggacaaggagugccugaagcaggccaucaccgcccugcugaacgugcagagcggcauggagaagaucugcagcaagagccuggccaagagaagacugagcgagagcgccugcagauucuacagccagcagaugaagggcaagcagcuggccaucaagaagaugaacgagauccagaagaacaucgacggcugggagggcaaggacaucggccagugcugcaacgaguucaucauggagggcacccugaccagagugggcgccaagcacgagagacacaucuuccuguucgacggccugaugaucugcugcaagagcaaccacggccagcccagacugcccggcgccagcaacgccgaguacagacugaaggagaaguucuucaugagaaaggugcagaucaacgacaaggacgacaccaacgaguacaagcacgccuucgagaucauccugaaggacgagaacagcgugaucuucagcgccaagagcgccgaggagaagaacaacuggauggccgcccugaucagccugcaguacagaagcacccuggagagaaugcuggacgugaccaugcugcaggaggagaaggaggagcagaugagacugcccagcgccgacguguacagauucgccgagcccgacagcgaggagaacaucaucuucgaggagaacaugcagcccaaggccggcauccccaucaucaaggccggcaccgugaucaagcugaucgagagacugaccuaccacauguacgccgaccccaacuucgugagaaccuuccugaccaccuacagaagcuucugcaagccccaggagcugcugagccugaucaucgagagauucgagauccccgagcccgagcccaccgaggccgacagaaucgccaucgagaacggcgaccagccccugagcgccgagcugaagagauucagaaaggaguacauccagcccgugcagcugagagugcugaacgugugcagacacuggguggagcaccacuucuacgacuucgagagagacgccuaccugcugcagagaauggaggaguucaucggcaccgugagaggcaaggccaugaagaaguggguggagagcaucaccaagaucauccagagaaagaagaucgccagagacaacggccccggccacaacaucaccuuccagagcagcccccccaccguggaguggcacaucagcagacccggccacaucgagaccuucgaccugcugacccugcaccccaucgagaucgccagacagcugacccugcuggagagcgaccuguacagagccgugcagcccagcgagcuggugggcagcguguggaccaaggaggacaaggagaucaacagccccaaccugcugaagaugaucagacacaccaccaaccugacccugugguucgagaagugcaucguggagaccgagaaccuggaggagagaguggccguggugagcagaaucaucgagauccugcagguguuccaggagcugaacaacuucaacggcgugcuggagguggugagcgccaugaacagcagccccguguacagacuggaccacaccuucgagcagauccccagcagacagaagaagauccuggaggaggcccacgagcugagcgaggaccacuacaagaaguaccuggccaagcugagaagcaucaacccccccugcgugcccuucuucggcaucuaccugaccaacauccugaagaccgaggagggcaaccccgaggugcugaagagacacggcaaggagcugaucaacuucagcaagagaagaaagguggccgagaucaccggcgagauccagcaguaccagaaccagcccuacugccugagaguggagagcgacaucaagagauucuucgagaaccugaaccccaugggcaacagcauggagaaggaguucaccgacuaccuguucaacaagagccuggagaucgagcccagaaaccccaagccccugcccagauuccccaagaaguacagcuacccccugaagagccccggcgugagacccagcaaccccagacccggcaccaugagacaccccaccccccugcagcaggagcccagaaagaucagcuacagcagaauccccgagagcgagaccgagagcaccgccagcgcccccaacagccccagaaccccccugacccccccccccgccagcggcgccagcagcaccaccgacgugugcagcguguucgacagcgaccacagcagccccuuccacagcagcaacgacaccguguucauccaggugacccugccccacggccccagaagcgccagcgugagcagcaucagccugaccaagggcaccgacgaggugcccgugcccccccccgugccccccagaagaagacccgagagcgcccccgccgagagcagccccagcaagaucaugagcaagcaccuggacagcccccccgccaucccccccagacagcccaccagcaaggccuacagccccagauacagcaucagcgacagaaccagcaucagcgacccccccgagagccccccccugcugccccccagagagcccgugagaacccccgacguguucagcagcagcccccugcaccugcagccccccccccugggcaagaagagcgaccacggcaacgccuucuuccccaacagccccagccccuucacccccccccccccccagacccccagcccccacggcaccagaagacaccugcccagccccccccugacccaggagguggaccugcacagcaucgccggcccccccgugccccccagacagagcaccagccagcacauccccaagcugccccccaagaccuacaagagagagcacacccaccccagcaugcacagagacggccccccccugcuggagaacgcccacagcagcuaa

SEQ ID NO: 23860 - RNA, 3999 nt, Artificial Sequence
  SOS2__Homo_sapiens__NP_008870
augcagcaggccccccagcccuacgaguucuucagcgaggagaacagccccaaguggagaggccugcuggugagcgcccugagaaaggugcaggagcaggugcaccccacccugagcgccaacgaggagagccuguacuacaucgaggagcugaucuuccagcugcugaacaagcugugcauggcccagcccagaaccgugcaggacguggaggagagagugcagaagaccuucccccaccccaucgacaagugggccaucgccgacgcccagagcgccaucgagaagagaaagagaagaaacccccugcugcugcccguggacaagauccaccccagccugaaggaggugcugggcuacaagguggacuaccacgugagccuguacaucguggccgugcuggaguacaucagcgccgacauccugaagcuggccggcaacuacguguucaacaucagacacuacgagaucagccagcaggacaucaaggugagcaugugcgccgacaaggugcugauggacauguucgaccaggacgacaucggccuggugagccugugcgaggacgagcccagcagcagcggcgagcugaacuacuacgaccuggugagaaccgagaucgccgaggagagacaguaccugagagagcugaacaugaucaucaagguguucagagaggccuuccugagcgacagaaagcuguucaagcccagcgacaucgagaagaucuucagcaacaucagcgacauccacgagcugaccgugaagcugcugggccugaucgaggacaccguggagaugaccgacgagagcagcccccacccccuggccggcagcugcuucgaggaccuggccgaggagcaggccuucgaccccuacgagacccugagccaggacauccugagccccgaguuccacgagcacuucaacaagcugauggccagacccgccguggcccugcacuuccagagcaucgccgacggcuucaaggaggccgugagauacgugcugcccagacugaugcuggugcccguguaccacugcuggcacuacuucgagcugcugaagcagcugaaggccugcagcgaggagcaggaggacagagagugccugaaccaggccaucaccgcccugaugaaccugcagggcagcauggacagaaucuacaagcaguacagccccagaagaagacccggcgaccccgugugccccuucuacagccaccagcugagaagcaagcaccuggccaucaagaagaugaacgagauccagaagaacaucgacggcugggagggcaaggacaucggccagugcugcaacgaguucaucauggagggcccccugaccagaaucggcgccaagcacgagagacacaucuuccuguucgacggccugaugaucagcugcaagcccaaccacggccagaccagacugcccggcuacagcagcgccgaguacagacugaaggagaaguucgugaugagaaagauccagaucugcgacaaggaggacaccugcgagcacaagcacgccuucgagcuggugagcaaggacgagaacagcaucaucuucgccgccaagagcgccgaggagaagaacaacuggauggccgcccugaucagccugcacuacagaagcacccuggacagaaugcuggacagcgugcugcugaaggaggagaacgagcagccccugagacugcccagccccgagguguacagauucguggugaaggacagcgaggagaacaucguguucgaggacaaccugcagagcagaagcggcauccccaucaucaagggcggcaccguggugaagcugaucgagagacugaccuaccacauguacgccgaccccaacuucgugagaaccuuccugaccaccuacagaagcuucugcaagccccaggagcugcugagccugcugaucgagagauucgagauccccgagcccgagcccaccgacgccgacaagcuggccaucgagaagggcgagcagcccaucagcgccgaccugaagagauucagaaaggaguacgugcagcccgugcagcugagaauccugaacguguucagacacuggguggagcaccacuucuacgacuucgagagagaccuggagcugcuggagagacuggagagcuucaucagcagcgugagaggcaaggccaugaagaaguggguggagagcaucgccaagaucaucagaagaaagaagcaggcccaggccaacggcgugagccacaacaucaccuucgagagcccccccccccccaucgaguggcacaucagcaagcccggccaguucgagaccuucgaccugaugacccugcaccccaucgagaucgccagacagcugacccugcuggagagcgaccuguacagaaaggugcagcccagcgagcuggugggcagcguguggaccaaggaggacaaggagaucaacagccccaaccugcugaagaugaucagacacaccaccaaccugacccugugguucgagaagugcaucguggaggccgagaacuucgaggagagaguggccgugcugagcagaaucaucgagauccugcagguguuccaggaccugaacaacuucaacggcgugcuggagaucgugagcgccgugaacagcgugagcguguacagacuggaccacaccuucgaggcccugcaggagagaaagagaaagauccuggacgaggccguggagcugagccaggaccacuucaagaaguaccuggugaagcugaagagcaucaacccccccugcgugcccuucuucggcaucuaccugaccaacauccugaagaccgaggagggcaacaacgacuuccugaagaagaagggcaaggaccugaucaacuucagcaagagaagaaagguggccgagaucaccggcgagauccagcaguaccagaaccagcccuacugccugagaaucgagcccgacaugagaagauucuucgagaaccugaaccccaugggcagcgccagcgagaaggaguucaccgacuaccuguucaacaagagccuggagaucgagcccagaaacugcaagcagccccccagauuccccagaaagagcaccuucagccugaagagccccggcaucagacccaacaccggcagacacggcagcaccagcggcacccugagaggccaccccaccccccuggagagagagcccugcaagaucagcuucagcagaaucgccgagaccgagcuggagagcaccgugagcgcccccaccagccccaacacccccagcaccccccccgugagcgccagcagcgaccugagcguguuccuggacguggaccugaacagcagcugcggcagcaacagcaucuucgcccccgugcugcugccccacagcaagagcuucuucagcagcugcggcagccugcacaagcugagcgaggagccccugaucccccccccccugccccccagaaagaaguucgaccacgacgccagcaacagcaagggcaacaugaagagcgacgacgacccccccgccaucccccccagacagccccccccccccaaggugaagcccagagugcccgugcccaccggcgccuucgacggcccccugcacagcccccccccccccccccccagagacccccugcccgacacccccccccccgugccccugagaccccccgagcacuucaucaacugccccuucaaccugcagccccccccccugggccaccugcacagagacagcgacuggcugagagacaucagcaccugccccaacagccccagcaccccccccagcacccccagccccagagugcccagaagaugcuacgugcugagcagcagccagaacaaccuggcccacccccccgccccccccgugccccccagacagaacagcagcccccaccugcccaagcugccccccaagaccuacaagagagagcugagccaccccccccuguacagacugccccugcuggagaacgccgagaccccccaguaa

SEQ ID NO: 23861 - RNA, 621 nt, Artificial Sequence
  SOSTDC1__Homo_sapiens__NP_056279
augcugccccccgccauccacuucuaccugcugccccuggccugcauccugaugaagagcugccuggccuucaagaacgacgccaccgagauccuguacagccacguggugaagcccgugcccgcccaccccagcagcaacagcacccugaaccaggccagaaacggcggcagacacuucagcaacaccggccuggacagaaacaccagagugcaggugggcugcagagagcugagaagcaccaaguacaucagcgacggccagugcaccagcaucagcccccugaaggagcuggugugcgccggcgagugccugccccugcccgugcugcccaacuggaucggcggcggcuacggcaccaaguacuggagcagaagaagcagccaggaguggagaugcgugaacgacaagaccagaacccagagaauccagcugcagugccaggacggcagcaccagaaccuacaagaucaccguggugaccgccugcaagugcaagagauacaccagacagcacaacgagagcagccacaacuucgagagcaugagccccgccaagcccgugcagcaccacagagagagaaagagagccagcaagagcagcaagcacagcaugagcuaa

SEQ ID NO: 23862 - RNA, 642 nt, Artificial Sequence
  SOST__Homo_sapiens__NP_079513
augcagcugccccuggcccugugccuggugugccugcuggugcacaccgccuucagagugguggagggccagggcuggcaggccuucaagaacgacgccaccgagaucauccccgagcugggcgaguaccccgagcccccccccgagcuggagaacaacaagaccaugaacagagccgagaacggcggcagacccccccaccaccccuucgagaccaaggacgugagcgaguacagcugcagagagcugcacuucaccagauacgugaccgacggccccugcagaagcgccaagcccgugaccgagcuggugugcagcggccagugcggccccgccagacugcugcccaacgccaucggcagaggcaagugguggagacccagcggccccgacuucagaugcauccccgacagauacagagcccagagagugcagcugcugugccccggcggcgaggcccccagagccagaaaggugagacugguggccagcugcaagugcaagagacugaccagauuccacaaccagagcgagcugaaggacuucggcaccgaggccgccagaccccagaagggcagaaagcccagacccagagccagaagcgccaaggccaaccaggccgagcuggagaacgccuacuaa

SEQ ID NO: 23863 - RNA, 1401 nt, Artificial Sequence
  SOX10__Homo_sapiens__NP_008872
auggccgaggagcaggaccugagcgagguggagcugagccccgugggcagcgaggagcccagaugccugagccccggcagcgcccccagccugggccccgacggcggcggcggcggcagcggccugagagccagccccggccccggcgagcugggcaaggugaagaaggagcagcaggacggcgaggccgacgacgacaaguuccccgugugcaucagagaggccgugagccaggugcugagcggcuacgacuggacccuggugcccaugcccgugagagugaacggcgccagcaagagcaagccccacgugaagagacccaugaacgccuucauggugugggcccaggccgccagaagaaagcuggccgaccaguacccccaccugcacaacgccgagcugagcaagacccugggcaagcuguggagacugcugaacgagagcgacaagagacccuucaucgaggaggccgagagacugagaaugcagcacaagaaggaccaccccgacuacaaguaccagcccagaagaagaaagaacggcaaggccgcccagggcgaggccgagugccccggcggcgaggccgagcagggcggcaccgccgccauccaggcccacuacaagagcgcccaccuggaccacagacaccccggcgagggcagccccaugagcgacggcaaccccgagcaccccagcggccagagccacggcccccccaccccccccaccacccccaagaccgagcugcagagcggcaaggccgaccccaagagagacggcagaagcaugggcgagggcggcaagccccacaucgacuucggcaacguggacaucggcgagaucagccacgaggugaugagcaacauggagaccuucgacguggccgagcuggaccaguaccugccccccaacggccaccccggccacgugagcagcuacagcgccgccggcuacggccugggcagcgcccuggccguggccagcggccacagcgccuggaucagcaagccccccggcguggcccugcccaccgugagcccccccggcguggacgccaaggcccaggugaagaccgagaccgccggcccccagggccccccccacuacaccgaccagcccagcaccagccagaucgccuacaccagccugagccugccccacuacggcagcgccuuccccagcaucagcagaccccaguucgacuacagcgaccaccagcccagcggccccuacuacggccacagcggccaggccagcggccuguacagcgccuucagcuacaugggccccagccagagaccccuguacaccgccaucagcgaccccagccccagcggcccccagagccacagccccacccacugggagcagcccguguacaccacccugagcagacccuaa

SEQ ID NO: 23864 - RNA, 1326 nt, Artificial Sequence
  SOX11__Homo_sapiens__NP_003099
auggugcagcaggccgagagccuggaggccgagagcaaccugcccagagaggcccuggacaccgaggagggcgaguucauggccugcagccccguggcccuggacgagagcgaccccgacuggugcaagaccgccagcggccacaucaagagacccaugaacgccuucaugguguggagcaagaucgagagaagaaagaucauggagcagagccccgacaugcacaacgccgagaucagcaagagacugggcaagagauggaagaugcugaaggacagcgagaagauccccuucaucagagaggccgagagacugagacugaagcacauggccgacuaccccgacuacaaguacagacccagaaagaagcccaagauggaccccagcgccaagcccagcgccagccagagccccgagaagagcgccgccggcggcggcggcggcagcgccggcggcggcgccggcggcgccaagaccagcaagggcagcagcaagaagugcggcaagcugaaggcccccgccgccgccggcgccaaggccggcgccggcaaggccgcccagagcggcgacuacggcggcgccggcgacgacuacgugcugggcagccugagagugagcggcagcggcggcggcggcgccggcaagaccgugaagugcguguuccuggacgaggacgacgacgacgacgacgacgacgacgagcugcagcugcagaucaagcaggagcccgacgaggaggacgaggagcccccccaccagcagcugcugcagccccccggccagcagcccagccagcugcugagaagauacaacguggccaaggugcccgccagccccacccugagcagcagcgccgagagccccgagggcgccagccuguacgacgaggugagagccggcgccaccagcggcgccggcggcggcagcagacuguacuacagcuucaagaacaucaccaagcagcacccccccccccuggcccagcccgcccugagccccgccagcagcagaagcgugagcaccagcagcagcagcagcagcggcagcagcagcggcagcagcggcgaggacgccgacgaccugauguucgaccugagccugaacuucagccagagcgcccacagcgccagcgagcagcagcugggcggcggcgccgccgccggcaaccugagccugagccugguggacaaggaccuggacagcuucagcgagggcagccugggcagccacuucgaguuccccgacuacugcacccccgagcugagcgagaugaucgccggcgacuggcuggaggccaacuucagcgaccugguguucaccuacuaa

SEQ ID NO: 23865 - RNA, 948 nt, Artificial Sequence
  SOX12__Homo_sapiens__NP_008874
auggugcagcagagaggcgccagagccaagagagacggcggcccccccccccccggccccggccccgccgaggagggcgccagagagcccggcuggugcaagacccccagcggccacaucaagagacccaugaacgccuucaugguguggagccagcacgagagaagaaagaucauggaccaguggcccgacaugcacaacgccgagaucagcaagagacugggcagaagauggcagcugcugcaggacagcgagaagauccccuucgugagagaggccgagagacugagacugaagcacauggccgacuaccccgacuacaaguacagacccagaaagaagagcaagggcgcccccgccaaggccagacccagaccccccggcggcagcggcggcggcagcagacugaagcccggcccccagcugcccggcagaggcggcagaagagccgccggcggcccccugggcggcggcgccgccgcccccgaggacgacgacgaggacgacgacgaggagcugcuggaggugagacugguggagacccccggcagagagcuguggagaauggugcccgccggcagagccgccagaggccaggccgagagagcccagggccccagcggcgagggcgccgccgccgccgccgccgccagccccacccccagcgaggacgaggagcccgaggaggaggaggaggaggccgccgccgccgaggagggcgaggaggagaccguggccagcggcgaggagagccugggcuuccugagcagacugccccccggccccgccggccuggacugcagcgcccuggacagagaccccgaccugcagccccccagcggcaccagccacuucgaguuccccgacuacugcacccccgaggugaccgagaugaucgccggcgacuggagacccagcagcaucgccgaccugguguucaccuacuaa

SEQ ID NO: 23866 - RNA, 1869 nt, Artificial Sequence
  SOX13__Homo_sapiens__NP_005677
augagcaugagaagccccaucagcgcccagcuggcccuggacggcgugggcaccauggugaacugcaccaucaagagcgaggagaagaaggagcccugccacgaggccccccagggcagcgccaccgccgccgagccccagcccggcgaccccgccagagccagccaggacagcgccgacccccaggcccccgcccagggcaacuucagaggcagcugggacugcagcagccccgagggcaacggcagccccgagcccaagagacccggcgugagcgaggccgccagcggcagccaggagaagcuggacuucaacagaaaccugaaggagguggugcccgccaucgagaagcugcugagcagcgacuggaaggagagauuccugggcagaaacagcauggaggccaaggacgugaagggcacccaggagagccuggccgagaaggagcugcagcugcuggugaugauccaccagcugagcacccugagagaccagcugcugaccgcccacagcgagcagaagaacauggccgccaugcuguucgagaagcagcagcagcagauggagcuggccagacagcagcaggagcagaucgccaagcagcagcagcagcugauccagcagcagcacaagaucaaccugcugcagcagcagauccagcaggugaacaugcccuacgugaugauccccgccuucccccccagccaccagccccugcccgugacccccgacagccagcuggcccugcccauccagcccauccccugcaagcccguggaguacccccugcagcugcugcacagcccccccgcccccguggugaagagacccggcgccauggccacccaccacccccugcaggagcccagccagccccugaaccugaccgccaagcccaaggcccccgagcugcccaacaccagcagcagccccagccugaagaugagcagcugcgugcccagaccccccagccacggcggccccaccagagaccugcagagcagcccccccagccugccccugggcuuccugggcgagggcgacgccgugaccaaggccauccaggacgccagacagcugcugcacagccacagcggcgcccuggacggcagccccaacacccccuucagaaaggaccugaucagccuggacagcagccccgccaaggagagacuggaggacggcugcgugcacccccuggaggaggccaugcugagcugcgacauggacggcagcagacacuuccccgagagcagaaacagcagccacaucaagagacccaugaacgccuucauggugugggccaaggacgagagaagaaagauccugcaggccuuccccgacaugcacaacagcagcaucagcaagauccugggcagcagauggaagagcaugaccaaccaggagaagcagcccuacuacgaggagcaggccagacugagcagacagcaccuggagaaguaccccgacuacaaguacaagcccagacccaagagaaccugcaucguggagggcaagagacugagagugggcgaguacaaggcccugaugagaaccagaagacaggacgccagacagagcuacgugauccccccccaggccggccaggugcagaugagcagcagcgacgugcuguaccccagagccgccggcaugccccuggcccagccccugguggagcacuacgugcccagaagccuggaccccaacaugcccgugaucgugaacaccugcagccugagagaggagggcgagggcaccgacgacagacacagcguggccgacggcgagauguacagauacagcgaggacgaggacagcgagggcgaggagaagagcgacggcgagcugguggugcugaccgacuaa

SEQ ID NO: 23867 - RNA, 723 nt, Artificial Sequence
  SOX14__Homo_sapiens__NP_004180
augagcaagcccagcgaccacaucaagagacccaugaacgccuucaugguguggagcagaggccagagaagaaagauggcccaggagaaccccaagaugcacaacagcgagaucagcaagagacugggcgccgaguggaagcugcugagcgaggccgagaagagacccuacaucgacgaggccaagagacugagagcccagcacaugaaggagcaccccgacuacaaguacagacccagaagaaagcccaagaaccugcugaagaaggacagauacguguucccccugcccuaccugggcgacaccgacccccugaaggccgccggccugcccgugggcgccagcgacggccugcugagcgcccccgagaaggccagagccuuccugccccccgccagcgcccccuacagccugcuggaccccgcccaguucagcagcagcgccauccagaagaugggcgaggugccccacacccuggccaccggcgcccugcccuacgccagcacccugggcuaccagaacggcgccuucggcagccugagcugccccagccagcacacccacacccaccccagccccaccaaccccggcuacguggugcccugcaacugcaccgccuggagcgccagcacccugcagccccccguggccuacauccuguuccccggcaugaccaagaccggcaucgaccccuacagcagcgcccacgccaccgccauguaa

SEQ ID NO: 23868 - RNA, 702 nt, Artificial Sequence
  SOX15__Homo_sapiens__NP_008873
auggcccugcccggcagcagccaggaccaggccuggagccuggagccccccgccgccaccgccgccgccagcagcagcagcggcccccaggagagagagggcgccggcagccccgccgcccccggcacccugccccuggagaaggugaagagacccaugaacgccuucaugguguggagcagcgcccagagaagacagauggcccagcagaaccccaagaugcacaacagcgagaucagcaagagacugggcgcccaguggaagcugcuggacgaggacgagaagagacccuucguggaggaggccaagagacugagagccagacaccugagagacuaccccgacuacaaguacagacccagaagaaaggccaagagcagcggcgccggccccagcagaugcggccagggcagaggcaaccuggccagcggcggcccccuguggggccccggcuacgccaccacccagcccagcagaggcuucggcuacagaccccccagcuacagcaccgccuaccugcccggcagcuacggcagcagccacugcaagcuggaggcccccagccccugcagccugccccagagcgaccccagacugcagggcgagcugcugcccaccuacacccacuaccugccccccggcagccccacccccuacaaccccccccuggccggcgcccccaugccccugacccaccuguaa

SEQ ID NO: 23869 - RNA, 1245 nt, Artificial Sequence
  SOX17__Homo_sapiens__NP_071899
augagcagccccgacgccggcuacgccagcgacgaccagagccagacccagagcgcccugcccgccgugauggccggccugggccccugccccugggccgagagccugagccccaucggcgacaugaaggugaagggcgaggcccccgccaacagcggcgcccccgccggcgccgccggcagagccaagggcgagagcagaaucagaagacccaugaacgccuucauggugugggccaaggacgagagaaagagacuggcccagcagaaccccgaccugcacaacgccgagcugagcaagaugcugggcaagagcuggaaggcccugacccuggccgagaagagacccuucguggaggaggccgagagacugagagugcagcacaugcaggaccaccccaacuacaaguacagacccagaagaagaaagcaggugaagagacugaagagaguggagggcggcuuccugcacggccuggccgagccccaggccgccgcccugggccccgagggcggcagaguggccauggacggccugggccugcaguuccccgagcagggcuuccccgccggccccccccugcugcccccccacaugggcggccacuacagagacugccagagccugggcgcccccccccuggacggcuacccccugcccacccccgacaccagcccccuggacggcguggaccccgaccccgccuucuucgccgcccccaugcccggcgacugccccgccgccggcaccuacagcuacgcccaggugagcgacuacgccggcccccccgagccccccgccggccccaugcaccccagacugggccccgagcccgccggccccagcauccccggccugcuggccccccccagcgcccugcacguguacuacggcgccaugggcagccccggcgccggcggcggcagaggcuuccagaugcagccccagcaccagcaccagcaccagcaccagcaccacccccccggccccggccagcccagccccccccccgaggcccugcccugcagagacggcaccgaccccagccagcccgccgagcugcugggcgagguggacagaaccgaguucgagcaguaccugcacuucgugugcaagcccgagaugggccugcccuaccagggccacgacagcggcgugaaccugcccgacagccacggcgccaucagcagcguggugagcgacgccagcagcgccguguacuacugcaacuaccccgacguguaa

SEQ ID NO: 23870 - RNA, 1155 nt, Artificial Sequence
  SOX18__Homo_sapiens__NP_060889
augcagagaagcccccccggcuacggcgcccaggacgacccccccgccagaagagacugcgccugggcccccggccacggcgccgccgccgacaccagaggccuggccgccggccccgccgcccuggccgcccccgccgcccccgccagcccccccagcccccagagaagcccccccagaagccccgagcccggcagauacggccugagccccgccggcagaggcgagagacaggccgccgacgagagcagaaucagaagacccaugaacgccuucauggugugggccaaggacgagagaaagagacuggcccagcagaaccccgaccugcacaacgccgugcugagcaagaugcugggcaaggccuggaaggagcugaacgccgccgagaagagacccuucguggaggaggccgagagacugagagugcagcaccugagagaccaccccaacuacaaguacagacccagaagaaagaagcaggccagaaaggccagaagacuggagcccggccugcugcugcccggccuggcccccccccagcccccccccgagcccuuccccgccgccagcggcagcgccagagccuucagagagcugcccccccugggcgccgaguucgacggccugggccugcccacccccgagagaagcccccuggacggccuggagcccggcgaggccgccuucuuccccccccccgccgcccccgaggacugcgcccugagacccuucagagcccccuacgcccccaccgagcugagcagagaccccggcggcugcuacggcgccccccuggccgaggcccugagaaccgccccccccgccgccccccuggccggccuguacuacggcacccugggcacccccggccccuaccccggcccccugagccccccccccgaggcccccccccuggagagcgccgagccccugggccccgccgccgaccugugggccgacguggaccugaccgaguucgaccaguaccugaacugcagcagaaccagacccgacgcccccggccugcccuaccacguggcccuggccaagcugggccccagagccaugagcugccccgaggagagcagccugaucagcgcccugagcgacgccagcagcgccguguacuacagcgccugcaucagcggcuaa

SEQ ID NO: 23871 - RNA, 1176 nt, Artificial Sequence
  SOX1__Homo_sapiens__NP_005977
auguacagcaugaugauggagaccgaccugcacagccccggcggcgcccaggcccccaccaaccugagcggccccgccggcgccggcggcggcggcggcggcggcggcggcggcggcggcggcggcggcgccaaggccaaccaggacagagugaagagacccaugaacgccuucaugguguggagcagaggccagagaagaaagauggcccaggagaaccccaagaugcacaacagcgagaucagcaagagacugggcgccgaguggaaggugaugagcgaggccgagaagagacccuucaucgacgaggccaagagacugagagcccugcacaugaaggagcaccccgacuacaaguacagacccagaagaaagaccaagacccugcugaagaaggacaaguacagccuggccggcggccugcuggccgccggcgccggcggcggcggcgccgccguggccaugggcgugggcgugggcgugggcgccgccgccgugggccagagacuggagagccccggcggcgccgccggcggcggcuacgcccacgugaacggcugggccaacggcgccuaccccggcagcguggccgccgccgccgccgccgccgccaugaugcaggaggcccagcuggccuacggccagcaccccggcgccggcggcgcccacccccacgcccaccccgcccacccccacccccaccacccccacgcccacccccacaacccccagcccaugcacagauacgacaugggcgcccugcaguacagccccaucagcaacagccagggcuacaugagcgccagccccagcggcuacggcggccugcccuacggcgccgccgccgccgccgccgccgccgccggcggcgcccaccagaacagcgccguggccgccgccgccgccgccgccgccgccagcagcggcgcccugggcgcccugggcagccuggugaagagcgagcccagcggcagcccccccgcccccgcccacagcagagcccccugccccggcgaccugagagagaugaucagcauguaccugcccgccggcgagggcggcgaccccgccgccgccgccgccgccgccgcccagagcagacugcacagccugccccagcacuaccagggcgccggcgccggcgugaacggcaccgugccccugacccacaucuaa

SEQ ID NO: 23872 - RNA, 831 nt, Artificial Sequence
  SOX21__Homo_sapiens__NP_009015
augagcaagcccguggaccacgugaagagacccaugaacgccuucaugguguggagcagagcccagagaagaaagauggcccaggagaaccccaagaugcacaacagcgagaucagcaagagacugggcgccgaguggaagcugcugaccgagagcgagaagagacccuucaucgacgaggccaagagacugagagccaugcacaugaaggagcaccccgacuacaaguacagacccagaagaaagcccaagacccugcugaagaaggacaaguucgccuuccccgugcccuacggccugggcggcguggccgacgccgagcaccccgcccugaaggccggcgccggccugcacgccggcgccggcggcggccuggugcccgagagccugcuggccaaccccgagaaggccgccgccgccgccgccgccgccgccgccagaguguucuucccccagagcgccgccgccgccgccgccgccgccgccgccgccgccgccggcagccccuacagccugcuggaccugggcagcaagauggccgagaucagcagcagcagcagcggccugcccuacgccagcagccugggcuaccccaccgccggcgccggcgccuuccacggcgccgccgccgccgccgccgccgccgccgccgccgccggcggccacacccacagccaccccagccccggcaaccccggcuacaugauccccugcaacugcagcgccuggcccagccccggccugcagcccccccuggccuacauccugcugcccggcaugggcaagccccagcuggaccccuaccccgccgccuacgccgccgcccuguaa

SEQ ID NO: 23873 - RNA, 954 nt, Artificial Sequence
  SOX2__Homo_sapiens__NP_003097
auguacaacaugauggagaccgagcugaagccccccggcccccagcagaccagcggcggcggcggcggcaacagcaccgccgccgccgccggcggcaaccagaagaacagccccgacagagugaagagacccaugaacgccuucaugguguggagcagaggccagagaagaaagauggcccaggagaaccccaagaugcacaacagcgagaucagcaagagacugggcgccgaguggaagcugcugagcgagaccgagaagagacccuucaucgacgaggccaagagacugagagcccugcacaugaaggagcaccccgacuacaaguacagacccagaagaaagaccaagacccugaugaagaaggacaaguacacccugcccggcggccugcuggcccccggcggcaacagcauggccagcggcgugggcgugggcgccggccugggcgccggcgugaaccagagaauggacagcuacgcccacaugaacggcuggagcaacggcagcuacagcaugaugcaggaccagcugggcuacccccagcaccccggccugaacgcccacggcgccgcccagaugcagcccaugcacagauacgacgugagcgcccugcaguacaacagcaugaccagcagccagaccuacaugaacggcagccccaccuacagcaugagcuacagccagcagggcacccccggcauggcccugggcagcaugggcagcguggugaagagcgaggccagcagcagcccccccguggugaccagcagcagccacagcagagcccccugccaggccggcgaccugagagacaugaucagcauguaccugcccggcgccgaggugcccgagcccgccgcccccagcagacugcacaugagccagcacuaccagagcggccccgugcccggcaccgccaucaacggcacccugccccugagccacauguaa

SEQ ID NO: 23874 - RNA, 1341 nt, Artificial Sequence
  SOX3__Homo_sapiens__NP_005625
augagacccgugagagagaacagcagcggcgccagaagccccagagugcccgccgaccuggccagaagcauccugaucagccugcccuucccccccgacagccuggcccacagaccccccagcagcgcccccaccgagagccagggccuguucaccguggccgcccccgcccccggcgcccccagcccccccgccacccuggcccaccugcugcccgcccccgccauguacagccugcuggagaccgagcugaagaaccccgugggcacccccacccaggccgccggcaccggcggccccgccgcccccggcggcgccggcaagagcagcgccaacgccgccggcggcgccaacagcggcggcggcagcagcggcggcgccagcggcggcggcggcggcaccgaccaggacagagugaagagacccaugaacgccuucaugguguggagcagaggccagagaagaaagauggcccuggagaaccccaagaugcacaacagcgagaucagcaagagacugggcgccgacuggaagcugcugaccgacgccgagaagagacccuucaucgacgaggccaagagacugagagccgugcacaugaaggaguaccccgacuacaaguacagacccagaagaaagaccaagacccugcugaagaaggacaaguacagccugcccagcggccugcugccccccggcgccgccgccgccgccgccgccgccgccgccgccgccgccgccgccagcagccccgugggcgugggccagagacuggacaccuacacccacgugaacggcugggccaacggcgccuacagccuggugcaggagcagcugggcuacgcccagccccccagcaugagcagccccccccccccccccgcccugccccccaugcacagauacgacauggccggccugcaguacagccccaugaugccccccggcgcccagagcuacaugaacguggccgccgccgccgccgccgccagcggcuacggcggcauggcccccagcgccaccgccgccgccgccgccgccuacggccagcagcccgccaccgccgccgccgccgccgccgccgccgccgccaugagccugggccccaugggcagcguggugaagagcgagcccagcagccccccccccgccaucgccagccacagccagagagccugccugggcgaccugagagacaugaucagcauguaccugccccccggcggcgacgccgccgacgccgccagcccccugcccggcggcagacugcacggcgugcaccagcacuaccagggcgccggcaccgccgugaacggcaccgugccccugacccacaucuaa

SEQ ID NO: 23875 - RNA, 1425 nt, Artificial Sequence
  SOX4__Homo_sapiens__NP_003098
auggugcagcagaccaacaacgccgagaacaccgaggcccugcuggccggcgagagcagcgacagcggcgccggccuggagcugggcaucgccagcagccccacccccggcagcaccgccagcaccggcggcaaggccgacgaccccagcuggugcaagacccccagcggccacaucaagagacccaugaacgccuucaugguguggagccagaucgagagaagaaagaucauggagcagagccccgacaugcacaacgccgagaucagcaagagacugggcaagagauggaagcugcugaaggacagcgacaagauccccuucaucagagaggccgagagacugagacugaagcacauggccgacuaccccgacuacaaguacagacccagaaagaaggugaagagcggcaacgccaacagcagcagcagcgccgccgccagcagcaagcccggcgagaagggcgacaaggugggcggcagcggcggcggcggccacggcggcggcggcggcggcggcagcagcaacgccggcggcggcggcggcggcgccagcggcggcggcgccaacagcaagcccgcccagaagaagagcugcggcagcaagguggccggcggcgccggcggcggcgugagcaagccccacgccaagcugauccuggccggcggcggcggcggcggcaaggccgccgccgccgccgccgccagcuucgccgccgagcaggccggcgccgccgcccugcugccccugggcgccgccgccgaccaccacagccuguacaaggccagaacccccagcgccagcgccagcgccagcagcgccgccagcgccagcgccgcccuggccgcccccggcaagcaccuggccgagaagaaggugaagagaguguaccuguucggcggccugggcaccagcagcagccccgugggcggcgugggcgccggcgccgaccccagcgacccccugggccuguacgaggaggagggcgccggcugcagccccgacgcccccagccugagcggcagaagcagcgccgccagcagccccgccgccggcagaagccccgccgaccacagaggcuacgccagccugagagccgccagccccgcccccagcagcgcccccagccacgccagcagcagcgccagcagccacagcagcagcagcagcagcagcggcagcagcagcagcgacgacgaguucgaggacgaccugcuggaccugaaccccagcagcaacuucgagagcaugagccugggcagcuucagcagcagcagcgcccuggacagagaccuggacuucaacuucgagcccggcagcggcagccacuucgaguuccccgacuacugcacccccgaggugagcgagaugaucagcggcgacuggcuggagagcagcaucagcaaccugguguucaccuacuaa

SEQ ID NO: 23876 - RNA, 1929 nt, Artificial Sequence
  SOX5__Homo_sapiens__NP_001248343
augagcagcaagagacccgccagccccuacggcgaggccgacggcgagguggccauggugaccagcagacagaagguggaggaggaggagagcgacggccugcccgccuuccaccugccccugcacgugagcuuccccaacaagccccacagcgaggaguuccagcccgugagccugcugacccaggagaccugcggccacagaacccccaccagccagcacaacaccauggagguggacggcaacaaggugaugagcagcuucgccccccacaacagcagcaccagcccccagaaggccgaggagggcggcagacagagcggcgagagccugagcagcaccgcccugggcacccccgagagaagaaagggcagccuggccgacgugguggacacccugaagcagagaaagauggaggagcugaucaagaacgagcccgaggagacccccagcaucgagaagcugcugagcaaggacuggaaggacaagcugcuggccaugggcagcggcaacuucggcgagaucaagggcacccccgagagccuggccgagaaggagagacagcugaugggcaugaucaaccagcugaccagccugagagagcagcugcuggccgcccacgacgagcagaagaagcuggccgccagccagaucgagaagcagagacagcagauggagcuggccaagcagcagcaggagcagaucgccagacagcagcagcagcugcugcagcagcagcacaagaucaaccugcugcagcagcagauccaggugcagggccagcugcccccccugaugauccccguguucccccccgaccagagaacccuggccgccgccgcccagcagggcuuccugcugccccccggcuucagcuacaaggccggcugcagcgaccccuaccccgugcagcugauccccaccaccauggccgccgccgccgccgccacccccggccugggcccccugcagcugcagcagcuguacgccgcccagcuggccgccaugcaggugagccccggcggcaagcugcccggcaucccccagggcaaccugggcgccgccgugagccccaccagcauccacaccgacaagagcaccaacagccccccccccaagagcaaggagaagaccacccuggagagccugacccagcagcuggccgugaagcagaacgaggagggcaaguucagccacgccaugauggacuucaaccugagcggcgacagcgacggcagcgccggcgugagcgagagcagaaucuacagagagagcagaggcagaggcagcaacgagccccacaucaagagacccaugaacgccuucauggugugggccaaggacgagagaagaaagauccugcaggccuuccccgacaugcacaacagcaacaucagcaagauccugggcagcagauggaaggccaugaccaaccuggagaagcagcccuacuacgaggagcaggccagacugagcaagcagcaccuggagaaguaccccgacuacaaguacaagcccagacccaagagaaccugccugguggacggcaagaagcugagaaucggcgaguacaaggccaucaugagaaacagaagacaggagaugagacaguacuucaacgugggccagcaggcccagauccccaucgccaccgccggcgugguguaccccggcgccaucgccauggccggcaugcccagcccccaccugcccagcgagcacagcagcgugagcagcagccccgagcccggcaugcccgugauccagagcaccuacggcgugaagggcgaggagccccacaucaaggaggagauccaggccgaggacaucaacggcgagaucuacgacgaguacgacgaggaggaggacgaccccgacguggacuacggcagcgacagcgagaaccacaucgccggccaggccaacuaa

SEQ ID NO: 23877 - RNA, 2406 nt, Artificial Sequence
  SOX6__Homo_sapiens__NP_001139283
augagcagcaagcaggccaccagccccuucgccugcgccgccgacggcgaggacgccaugacccaggaccugaccagcagagagaaggaggagggcagcgaccagcacguggccagccaccugccccugcaccccaucaugcacaacaagccccacagcgaggagcugcccacccuggugagcaccauccagcaggacgccgacugggacagcgugcugagcagccagcagagaauggagagcgagaacaacaagcugugcagccuguacagcuucagaaacaccagcaccagcccccacaagcccgacgagggcagcagagacagagagaucaugaccagcgugaccuucggcacccccgagagaagaaagggcagccuggccgacgugguggacacccugaagcagaagaagcuggaggagaugaccagaaccgagcaggaggacagcagcugcauggagaagcugcugagcaaggacuggaaggagaagauggagagacugaacaccagcgagcugcugggcgagaucaagggcacccccgagagccuggccgagaaggagagacagcugagcaccaugaucacccagcugaucagccugagagagcagcugcuggccgcccacgacgagcagaagaagcuggccgccagccagaucgagaagcagagacagcagauggaccuggccagacagcagcaggagcagaucgccagacagcagcagcagcugcugcagcagcagcacaagaucaaccugcugcagcagcagauccaggugcagggccacaugcccccccugaugauccccaucuucccccacgaccagagaacccuggccgccgccgccgccgcccagcagggcuuccuguucccccccggcaucaccuacaagcccggcgacaacuaccccgugcaguucauccccagcaccauggccgccgccgccgccagcggccugagcccccugcagcugcagcagcuguacgccgcccagcuggccagcaugcaggugagccccggcgccaagaugcccagcaccccccagccccccaacaccgccggcaccgugagccccaccggcaucaagaacgagaagagaggcaccagccccgugacccaggugaaggacgaggccgccgcccagccccugaaccugagcagcagacccaagaccgccgagcccgugaagagccccaccagccccacccagaaccuguuccccgccagcaagaccagccccgugaaccugcccaacaagagcagcauccccagccccaucggcggcagccugggcagaggcagcagccugggcaaguggaagagccagcaccaggaggagaccuacgagcuggacauccugagcagccugaacagccccgcccuguucggcgaccaggacaccgugaugaaggccauccaggaggccagaaagaugagagagcagauccagagagagcagcagcagcagcagccccacggcguggacggcaagcugagcagcaucaacaacaugggccugaacagcugcagaaacgagaaggagagaaccagauucgagaaccugggcccccagcugaccggcaagagcaacgaggacggcaagcugggccccggcgugaucgaccugaccagacccgaggacgccgagggcagcaaggccaugaacggcagcgccgccaagcugcagcaguacuacugcuggcccaccggcggcgccaccguggccgaggccagaguguacagagacgccagaggcagagccagcagcgagccccacaucaagagacccaugaacgccuucauggugugggccaaggacgagagaagaaagauccugcaggccuuccccgacaugcacaacagcaacaucagcaagauccugggcagcagauggaagagcaugagcaaccaggagaagcagcccuacuacgaggagcaggccagacugagcaagauccaccuggagaaguaccccaacuacaaguacaagcccagacccaagagaaccugcaucguggacggcaagaagcugagaaucggcgaguacaagcagcugaugagaagcagaagacaggagaugagacaguucuucaccgugggccagcagccccagauccccaucaccaccggcaccggcgugguguaccccggcgccaucaccauggccaccaccacccccagcccccagaugaccagcgacugcagcagcaccagcgccagccccgagcccagccugcccgugauccagagcaccuacggcaugaagaccgacggcggcagccuggccggcaacgagaugaucaacggcgaggacgagauggagauguacgacgacuacgaggacgaccccaagagcgacuacagcagcgagaacgaggcccccgaggccgugagcgccaacuaa

SEQ ID NO: 23878 - RNA, 1167 nt, Artificial Sequence
  SOX7__Homo_sapiens__NP_113627
auggccagccugcugggcgccuaccccuggcccgagggccuggagugccccgcccuggacgccgagcugagcgacggccagagcccccccgccgugcccagaccccccggcgacaagggcagcgagagcagaaucagaagacccaugaacgccuucauggugugggccaaggacgagagaaagagacuggccgugcagaaccccgaccugcacaacgccgagcugagcaagaugcugggcaagagcuggaaggcccugacccugagccagaagagacccuacguggacgaggccgagagacugagacugcagcacaugcaggacuaccccaacuacaaguacagacccagaagaaagaagcaggccaagagacugugcaagagaguggaccccggcuuccugcugagcagccugagcagagaccagaacgcccugcccgagaagagaagcggcagcagaggcgcccugggcgagaaggaggacagaggcgaguacagccccggcaccgcccugcccagccugagaggcugcuaccacgagggccccgccggcggcggcggcggcggcacccccagcagcguggacaccuaccccuacggccugcccaccccccccgagaugagcccccuggacgugcuggagcccgagcagaccuucuucagcagccccugccaggaggagcacggccaccccagaagaaucccccaccugcccggccaccccuacagccccgaguacgcccccagcccccugcacugcagccacccccugggcagccuggcccugggccagagccccggcgugagcaugaugagccccgugcccggcugcccccccagccccgccuacuacagccccgccaccuaccacccccugcacagcaaccugcaggcccaccugggccagcugagccccccccccgagcaccccggcuucgacgcccuggaccagcugagccagguggagcugcugggcgacauggacagaaacgaguucgaccaguaccugaacacccccggccaccccgacagcgccaccggcgccauggcccugagcggccacgugcccgugagccaggugacccccaccggccccaccgagaccagccugaucagcgugcuggccgacgccaccgccaccuacuacaacagcuacagcgugagcuaa

SEQ ID NO: 23879 - RNA, 1341 nt, Artificial Sequence
  SOX8__Homo_sapiens__NP_055402
augcuggacaugagcgaggccagaagccagccccccugcagccccagcggcaccgccagcagcaugagccacguggaggacagcgacagcgacgccccccccagccccgccggcagcgagggccugggcagagccggcguggccgugggcggcgccagaggcgaccccgccgaggccgccgacgagagauuccccgccugcaucagagacgccgugagccaggugcugaagggcuacgacuggagccuggugcccaugcccgugagaggcggcggcggcggcgcccugaaggccaagccccacgugaagagacccaugaacgccuucauggugugggcccaggccgccagaagaaagcuggccgaccaguacccccaccugcacaacgccgagcugagcaagacccugggcaagcuguggagacugcugagcgagagcgagaagagacccuucguggaggaggccgagagacugagagugcagcacaagaaggaccaccccgacuacaaguaccagcccagaagaagaaagagcgccaaggccggccacagcgacagcgacagcggcgccgagcugggcccccaccccggcggcggcgccguguacaaggccgaggccggccugggcgacggccaccaccacggcgaccacaccggccagacccacggcccccccaccccccccaccacccccaagaccgagcugcagcaggccggcgccaagcccgagcugaagcuggagggcagaagacccguggacagcggcagacagaacaucgacuucagcaacguggacaucagcgagcugagcagcgaggugaugggcaccauggacgccuucgacgugcacgaguucgaccaguaccugccccugggcggccccgccccccccgagcccggccaggccuacggcggcgccuacuuccacgccggcgccagccccgugugggcccacaagagcgcccccagcgccagcgccagccccaccgagaccggcccccccagaccccacaucaagaccgagcagcccagccccggccacuacggcgaccagcccagaggcagccccgacuacggcagcugcagcggccagagcagcgccacccccgccgcccccgccggccccuucgccggcagccagggcgacuacggcgaccugcaggccagcagcuacuacggcgccuaccccggcuacgcccccggccuguaccaguaccccugcuuccacagccccagaagacccuacgccagcccccugcugaacggccuggcccugccccccgcccacagccccaccagccacugggaccagcccguguacaccacccugaccagacccuaa

SEQ ID NO: 23880 - RNA, 1530 nt, Artificial Sequence
  SOX9__Homo_sapiens__NP_000337
augaaccugcuggaccccuucaugaagaugaccgacgagcaggagaagggccugagcggcgcccccagccccaccaugagcgaggacagcgccggcagccccugccccagcggcagcggcagcgacaccgagaacaccagaccccaggagaacaccuuccccaagggcgagcccgaccugaagaaggagagcgaggaggacaaguuccccgugugcaucagagaggccgugagccaggugcugaagggcuacgacuggacccuggugcccaugcccgugagagugaacggcagcagcaagaacaagccccacgugaagagacccaugaacgccuucauggugugggcccaggccgccagaagaaagcuggccgaccaguacccccaccugcacaacgccgagcugagcaagacccugggcaagcuguggagacugcugaacgagagcgagaagagacccuucguggaggaggccgagagacugagagugcagcacaagaaggaccaccccgacuacaaguaccagcccagaagaagaaagagcgugaagaacggccaggccgaggccgaggaggccaccgagcagacccacaucagccccaacgccaucuucaaggcccugcaggccgacagcccccacagcagcagcggcaugagcgaggugcacagccccggcgagcacagcggccagagccagggcccccccaccccccccaccacccccaagaccgacgugcagcccggcaaggccgaccugaagagagagggcagaccccugcccgagggcggcagacagccccccaucgacuucagagacguggacaucggcgagcugagcagcgacgugaucagcaacaucgagaccuucgacgugaacgaguucgaccaguaccugccccccaacggccaccccggcgugcccgccacccacggccaggugaccuacaccggcagcuacggcaucagcagcaccgccgccacccccgccagcgccggccacguguggaugagcaagcagcaggccccccccccccccccccagcagcccccccaggccccccccgccccccaggcccccccccagccccaggccgcccccccccagcagcccgccgcccccccccagcagccccaggcccacacccugaccacccugagcagcgagcccggccagagccagagaacccacaucaagaccgagcagcugagccccagccacuacagcgagcagcagcagcacagcccccagcagaucgccuacagccccuucaaccugccccacuacagccccagcuacccccccaucaccagaagccaguacgacuacaccgaccaccagaacagcagcagcuacuacagccacgccgccggccagggcaccggccuguacagcaccuucaccuacaugaaccccgcccagagacccauguacacccccaucgccgacaccagcggcgugcccagcaucccccagacccacagcccccagcacugggagcagcccguguacacccagcugaccagacccuaa

SEQ ID NO: 23881 - RNA, 2658 nt, Artificial Sequence
  SP100__Homo_sapiens__NP_001073860
auggccggcggcggcggcgaccugagcaccagaagacugaacgagugcaucagccccguggccaacgagaugaaccaccugcccgcccacagccacgaccugcagagaauguucaccgaggaccagggcguggacgacagacugcuguacgacaucguguucaagcacuucaagagaaacaagguggagaucagcaacgccaucaagaagaccuuccccuuccuggagggccugagagacagagaccugaucaccaacaagauguucgaggacagccaggacagcugcagaaaccuggugcccgugcagagagugguguacaacgugcugagcgagcuggagaagaccuucaaccugcccgugcuggaggcccuguucagcgacgugaacaugcaggaguaccccgaccugauccacaucuacaagggcuucgagaacgugauccacgacaagcugccccugcaggagagcgaggaggaggagagagaggagagaagcggccugcagcugagccuggagcagggcaccggcgagaacagcuucagaagccugaccuggccccccagcggcagccccagccacgccggcaccaccccccccgagaacggccugagcgagcaccccugcgagaccgagcagaucaacgccaagagaaaggacaccaccagcgacaaggacgacagccugggcagccagcagaccaacgagcagugcgcccagaaggccgagcccaccgagagcugcgagcagaucgccgugcaggugaacaacggcgacgccggcagagagaugcccugcccccugcccugcgacgaggagagccccgaggccgagcugcacaaccacggcauccagaucaacagcugcagcgugagacugguggacaucaagaaggagaagcccuucagcaacagcaagguggagugccaggcccaggccagaacccaccacaaccaggccagcgacaucaucgugaucagcagcgaggacagcgagggcagcaccgacguggacgagccccuggagguguucaucagcgcccccagaagcgagcccgugaucaacaacgacaacccccuggagagcaacgacgagaaggagggccaggaggccaccugcagcagaccccagaucgugcccgagcccauggacuucagaaagcugagcaccuucagagagagcuucaagaagagagugaucggccaggaccacgacuucagcgagagcagcgaggaggaggcccccgccgaggccagcagcggcgcccugagaagcaagcacggcgagaaggcccccaugaccagcagaagcaccagcaccuggagaauccccagcagaaagagaagauucagcagcagcgacuucagcgaccugagcaacggcgaggagcugcaggagaccugcagcagcagccugagaagaggcagcggcagccagccccaggagcccgagaacaagaagugcagcugcgugaugugcuuccccaagggcgugcccagaagccaggaggccagaaccgagagcagccaggccagcgacaugauggacaccauggacguggagaacaacagcacccuggagaagcacagcggcaagagaagaaagaagagaagacacagaagcaaggugaacggccugcagagaggcagaaagaaggacagacccagaaagcaccugacccugaacaacaaggugcagaagaagagauggcagcagagaggcagaaaggccaacaccagaccccugaagagaagaagaaagagaggccccagaauccccaaggacgagaacaucaacuucaagcagagcgagcugcccgugaccugcggcgaggugaagggcacccuguacaaggagagauucaagcagggcaccagcaagaagugcauccagagcgaggacaagaagugguucacccccagagaguucgagaucgagggcgacagaggcgccagcaagaacuggaagcugagcaucagaugcggcggcuacacccugaaggugcugauggagaacaaguuccugcccgagccccccagcaccagaaagaagagaauccuggagagccacaacaacacccugguggaccccugccccgagaacagcaacaucugcgaggugugcaacaaguggggcagacuguucugcugcgacaccugccccagaagcuuccacgagcacugccacauccccagcguggaggccaacaagaaccccuggagcugcaucuucugcagaaucaagaccauccaggagagaugccccgagagccagagcggccaccaggagagcgaggugcugaugagacagaugcugcccgaggagcagcugaagugcgaguuccugcugcugaagguguacugcgacagcaagagcugcuucuucgccagcgagcccuacuacaacagagagggcagccagggcccccagaagcccauguggcugaacaaggugaagaccagccugaacgagcagauguacaccagaguggagggcuucgugcaggacaugagacugaucuuccacaaccacaaggaguucuacagagaggacaaguucaccagacugggcauccaggugcaggacaucuucgagaagaacuucagaaacaucuucgccauccaggagaccagcaagaacaucaucauguucaucuaa

SEQ ID NO: 23882 - RNA, 1668 nt, Artificial Sequence
  SP110__Homo_sapiens__NP_001171944
augggcagaggcuucagaauguucaccaugaccagagccauggaggaggcccuguuccagcacuucaugcaccagaagcugggcaucgccuacgccauccacaagcccuuccccuucuucgagggccugcuggacaacagcaucaucaccaagagaauguacauggagagccuggaggccugcagaaaccugauccccgugagcagaguggugcacaacauccugacccagcuggagagaaccuucaaccugagccugcuggugacccuguucagccagaucaaccugagagaguaccccaaccuggugaccaucuacagaagcuucaagagagugggcgccagcuacgaguggcagagcagagacacccccauccugcuggaggcccccaccggccuggccgagggcagcagccugcacaccccccuggcccugccccccccccagcccccccagcccagcugcagccccugcgcccccagagugagcgagcccggcaccagcagccagcagagcgacgagauccugagcgagagccccagccccagcgaccccgugcugccccugcccgcccugauccaggagggcagaagcaccagcgugaccaacgacaagcugaccagcaagaugaacgccgaggaggacagcgaggagaugcccagccugcugaccagcaccgugcagguggccagcgacaaccugaucccccagaucagagacaaggaggacccccaggagaugccccacagcccccugggcagcaugcccgagaucagagacaacagccccgagcccaacgaccccgaggagccccaggaggugagcagcacccccagcgacaagaagggcaagaagagaaagagaugcaucuggagcacccccaagagaagacacaagaagaagagccugcccggcggcaccgccagcagcagacacggcauccagaagaagcugaagagaguggaccaggugccccagaagaaggacgacagcaccugcaacagcaccguggagaccagagcccagaaggccagaaccgagugcgccagaaagagcagaagcgaggagaucaucgacggcaccagcgagaugaacgagggcaagagaagccagaagacccccagcacccccagaagagugacccagggcgccgccagccccggccacggcauccaggagaagcugcaggugguggacaaggugacccagagaaaggacgacagcaccuggaacagcgaggugaugaugagagugcagaaggccagaaccaagugcgccagaaagagcagacugaaggagaagaagaaggagaaggacaucugcagcagcagcaagagaagauuccagaagaacauccacagaagaggcaagcccaagagcgacaccguggacuuccacugcagcaagcugcccgugaccugcggcgaggccaagggcauccuguacaagaagaagaugaagcacggcagcagcgugaagugcaucagaaacgaggacggcaccuggcugacccccaacgaguucgagguggagggcaagggcagaaacgccaagaacuggaagagaaacaucagaugcgagggcaugacccugggcgagcugcugaagagcggccugcugcugugcccccccagaaucaaccugaagagagagcugaacagcaaguaa

SEQ ID NO: 23883 - RNA, 519 nt, Artificial Sequence
  SP140__Homo_sapiens__NP_001005176
auggcccagcagggccagcagggccagauggccagcggcgacagcaaccugaacuucagaaugguggccgagauccagaacguggagggccagaaccugcaggagcaggugugccccgagcccaucuucagauucuucagagagaacaagguggagaucgccagcgccaucaccagacccuuccccuuccugaugggccugagagacagaagcuucaucagcgagcagauguacgagcacuuccaggaggccuucagaaaccuggugcccgugaccagagugauguacugcgugcugagcgagcuggagaagaccuucggcuggagccaccuggaggcccuguucagcagaaucaaccugauggccuaccccgaccugaacgagaucuacagaagcuuccagaacgagaaccugagcagcagcgccgugcugugccagcuggugagccccaacaaggacuggagaagccacgaggagagccuggcccacaccggcacccugagaagaagcugcauguaa

SEQ ID NO: 23884 - RNA, 2358 nt, Artificial Sequence
  SP1__Homo_sapiens__NP_612482
augagcgaccaggaccacagcauggacgagaugaccgccguggugaagaucgagaagggcgugggcggcaacaacggcggcaacggcaacggcggcggcgccuucagccaggccagaagcagcagcaccggcagcagcagcagcaccggcggcggcggccaggagagccagcccagcccccuggcccugcuggccgccaccugcagcagaaucgagagccccaacgagaacagcaacaacagccagggccccagccagagcggcggcaccggcgagcuggaccugaccgccacccagcugagccagggcgccaacggcuggcagaucaucagcagcagcagcggcgccacccccaccagcaaggagcagagcggcagcagcaccaacggcagcaacggcagcgagagcagcaagaacagaaccgugagcggcggccaguacgugguggccgccgcccccaaccugcagaaccagcaggugcugaccggccugcccggcgugaugcccaacauccaguaccaggugaucccccaguuccagaccguggacggccagcagcugcaguucgccgccaccggcgcccaggugcagcaggacggcagcggccagauccagaucauccccggcgccaaccagcagaucaucaccaacagaggcagcggcggcaacaucaucgccgccaugcccaaccugcugcagcaggccgugccccugcagggccuggccaacaacgugcugagcggccagacccaguacgugaccaacgugcccguggcccugaacggcaacaucacccugcugcccgugaacagcgugagcgccgccacccugacccccagcagccaggccgugaccaucagcagcagcggcagccaggagagcggcagccagcccgugaccagcggcaccaccaucagcagcgccagccuggugagcagccaggccagcagcagcagcuucuucaccaacgccaacagcuacagcaccaccaccaccaccagcaacaugggcaucaugaacuucaccaccagcggcagcagcggcaccaacagccagggccagaccccccagagagugagcggccugcagggcagcgacgcccugaacauccagcagaaccagaccagcggcggcagccugcaggccggccagcagaaggagggcgagcagaaccagcagacccagcagcagcagauccugauccagccccagcuggugcagggcggccaggcccugcaggcccugcaggccgccccccugagcggccagaccuucaccacccaggccaucagccaggagacccugcagaaccugcagcugcaggccgugcccaacagcggccccaucaucaucagaacccccaccgugggccccaacggccaggugagcuggcagacccugcagcugcagaaccugcaggugcagaacccccaggcccagaccaucacccuggcccccaugcagggcgugagccugggccagaccagcagcagcaacaccacccugacccccaucgccagcgccgccagcauccccgccggcaccgugaccgugaacgccgcccagcugagcagcaugcccggccugcagaccaucaaccugagcgcccugggcaccagcggcauccaggugcaccccauccagggccugccccuggccaucgccaacgcccccggcgaccacggcgcccagcugggccugcacggcgccggcggcgacggcauccacgacgacaccgccggcggcgaggagggcgagaacagccccgacgcccagccccaggccggcagaagaaccagaagagaggccugcaccugccccuacugcaaggacagcgagggcagaggcagcggcgaccccggcaagaagaagcagcacaucugccacauccagggcugcggcaagguguacggcaagaccagccaccugagagcccaccugagauggcacaccggcgagagacccuucaugugcaccuggagcuacugcggcaagagauucaccagaagcgacgagcugcagagacacaagagaacccacaccggcgagaagaaguucgccugccccgagugccccaagagauucaugagaagcgaccaccugagcaagcacaucaagacccaccagaacaagaagggcggccccggcguggcccugagcgugggcacccugccccuggacagcggcgccggcagcgagggcagcggcaccgccacccccagcgcccugaucaccaccaacaugguggccauggaggccaucugccccgagggcaucgccagacuggccaacagcggcaucaacgugaugcagguggccgaccugcagagcaucaacaucagcggcaacggcuucuaa

SEQ ID NO: 23885 - RNA, 1842 nt, Artificial Sequence
  SP2__Homo_sapiens__NP_003101
augagcgacccccagaccagcauggccgccaccgccgccgugagccccagcgacuaccugcagcccgccgccagcaccacccaggacagccagcccagcccccuggcccugcuggccgccaccugcagcaagaucggcccccccgccguggaggccgccgugaccccccccgcccccccccagcccacccccagaaagcuggugcccaucaagcccgccccccugccccugagccccggcaagaacagcuucggcauccugagcagcaagggcaacauccugcagauccagggcagccagcugagcgccagcuaccccggcggccagcugguguucgccauccagaaccccaccaugaucaacaagggcaccagaagcaacgccaacauccaguaccaggccgugccccagauccaggccagcaacagccagaccauccaggugcagcccaaccugaccaaccagauccagaucauccccggcaccaaccaggccaucaucacccccagccccagcagccacaagcccgugcccaucaagcccgcccccauccagaagagcagcaccaccaccacccccgugcagagcggcgccaacguggugaagcugaccggcggcggcggcaacgugacccugacccugcccgugaacaaccuggugaacgccagcgacaccggcgcccccacccagcugcugaccgagagcccccccaccccccugagcaagaccaacaagaaggccagaaagaagagccugcccgccagccagccccccguggccguggccgagcagguggagaccgugcugaucgagaccaccgccgacaacaucauccaggccggcaacaaccugcugaucgugcagagccccggcggcggccagcccgccguggugcagcaggugcagguggugccccccaaggccgagcagcagcagguggugcagaucccccagcaggcccugagaguggugcaggccgccagcgccacccugcccaccgugccccagaagcccagccagaacuuccagauccaggccgccgagcccacccccacccagguguacaucagaacccccagcggcgaggugcagaccgugcuggugcaggacagcccccccgccaccgccgccgccaccagcaacaccaccugcagcagccccgccagcagagccccccaccugagcggcaccagcaagaagcacagcgccgccauccugagaaaggagagaccccugcccaagaucgcccccgccggcagcaucaucagccugaacgccgcccagcuggccgccgccgcccaggccaugcagaccaucaacaucaacggcgugcaggugcagggcgugcccgugaccaucaccaacaccggcggccagcagcagcugaccgugcagaacgugagcggcaacaaccugaccaucagcggccugagccccacccagauccagcugcagauggagcaggcccuggccggcgagacccagcccggcgagaagagaagaagaauggccugcaccugccccaacugcaaggacggcgagaagagaagcggcgagcagggcaagaagaagcacgugugccacauccccgacugcggcaagaccuucagaaagaccagccugcugagagcccacgugagacugcacaccggcgagagacccuucgugugcaacugguucuucugcggcaagagauucaccagaagcgacgagcugcagagacacgccagaacccacaccggcgacaagagauucgagugcgcccagugccagaagagauucaugagaagcgaccaccugaccaagcacuacaagacccaccuggugaccaagaaccuguaa

SEQ ID NO: 23886 - RNA, 2142 nt, Artificial Sequence
  SP3__Homo_sapiens__NP_001017371
augggcccccccagccccggcgacgacgaggaggaggccgccgccgccgccggcgcccccgccgccgccggcgccaccggcgaccuggccagcgcccagcugggcggcgcccccaacagaugggaggugcugagcgccacccccaccaccaucaaggacgaggccggcaaccuggugcagauccccagcgccgccaccagcagcggccaguacgugcugccccugcagaaccugcagaaccagcagaucuucagcguggcccccggcagcgacagcagcaacggcaccgugagcagcgugcaguaccaggugaucccccagauccagagcgccgacggccagcaggugcagaucggcuucaccggcagcagcgacaacggcggcaucaaccaggagagcagccagauccagaucauccccggcagcaaccagacccugcuggccagcggcacccccagcgccaacauccagaaccugaucccccagaccggccaggugcaggugcagggcguggccaucggcggcagcagcuuccccggccagacccaggugguggccaacgugccccugggccugcccggcaacaucaccuucgugcccaucaacagcguggaccuggacagccugggccugagcggcagcagccagaccaugaccgccggcaucaacgccgacggccaccugaucaacaccggccaggccauggacagcagcgacaacagcgagagaaccggcgagagagugagccccgacaucaacgagaccaacaccgacaccgaccuguucgugcccaccagcagcagcagccagcugcccgugaccaucgacagcaccggcauccugcagcagaacaccaacagccugaccaccagcagcggccaggugcacagcagcgaccugcagggcaacuacauccagagccccgugagcgaggagacccaggcccagaacauccaggugagcaccgcccagcccguggugcagcaccugcagcugcaggagagccagcagcccaccagccaggcccagaucgugcagggcaucaccccccagaccauccacggcgugcaggccagcggccagaacaucagccagcaggcccugcagaaccugcagcugcagcugaaccccggcaccuuccugauccaggcccagaccgugacccccagcggccaggugaccuggcagaccuuccaggugcagggcgugcagaaccugcagaaccugcagauccagaacaccgccgcccagcagaucacccugacccccgugcagacccugacccugggccagguggccgccggcggcgccuucaccagcacccccgugagccugagcaccggccagcugcccaaccugcagaccgugaccgugaacagcaucgacagcgccggcauccagcugcaccccggcgagaacgccgacagccccgccgacaucagaaucaaggaggaggagcccgaccccgaggaguggcagcugagcggcgacagcacccugaacaccaacgaccugacccaccugagagugcaggugguggacgaggagggcgaccagcagcaccaggagggcaagagacugagaagaguggccugcaccugccccaacugcaaggagggcggcggcagaggcaccaaccugggcaagaagaagcagcacaucugccacauccccggcugcggcaagguguacggcaagaccagccaccugagagcccaccugagauggcacagcggcgagagacccuucgugugcaacuggauguacugcggcaagagauucaccagaagcgacgagcugcagagacacagaagaacccacaccggcgagaagaaguucgugugccccgagugcagcaagagauucaugagaagcgaccaccuggccaagcacaucaagacccaccagaacaagaagggcauccacagcagcagcaccgugcuggccagcguggaggccgccagagacgacacccugaucaccgccggcggcaccacccugauccuggccaacauccagcagggcagcgugagcggcaucggcaccgugaacaccagcgccaccagcaaccaggacauccugaccaacaccgagaucccccugcagcuggugaccgugagcggcaacgagaccauggaguaa

SEQ ID NO: 23887 - RNA, 2355 nt, Artificial Sequence
  SP4__Homo_sapiens__NP_003103
augagcgaccagaagaaggaggaggaggaggaggccgccgccgccgccgccauggccaccgagggcggcaagaccagcgagcccgagaacaacaacaagaagcccaagaccagcggcagccaggacagccagcccagcccccuggcccugcuggccgccaccugcagcaagaucggcacccccggcgagaaccaggccaccggccagcagcagaucaucaucgaccccagccagggccuggugcagcugcagaaccagccccagcagcuggagcuggugaccacccagcuggccggcaacgccuggcagcugguggccagcaccccccccgccagcaaggagaacaacgugagccagcccgccagcagcagcagcagcagcagcagcagcaacaacggcagcgccagccccaccaagaccaagagcggcaacagcagcacccccggccaguuccaggugauccaggugcagaaccccagcggcagcgugcaguaccaggugaucccccagcugcagaccguggagggccagcagauccagaucaaccccaccagcagcagcagccugcaggaccugcagggccagauccagcugaucagcgccggcaacaaccaggccauccugaccgccgccaacagaaccgccagcggcaacauccuggcccagaaccuggccaaccagaccgugcccgugcagaucagacccggcgugagcaucccccugcagcugcagacccugcccggcacccaggcccagguggugaccacccugcccaucaacaucggcggcgugacccuggcccugcccgugaucaacaacguggccgccggcggcggcaccggccaggugggccagcccgccgccaccgccgacagcggcaccagcaacggcaaccagcuggugagcacccccaccaacaccaccaccagcgccagcaccaugcccgagagccccagcagcagcaccaccugcaccaccaccgccagcaccagccugaccagcagcgacacccuggugagcagcgccgacaccggccaguacgccagcaccagcgccagcagcagcgagagaaccaucgaggagagccagacccccgccgccaccgagagcgaggcccagagcagcagccagcugcagcccaacggcaugcagaacgcccaggaccagagcaacagccugcagcaggugcagaucgugggccagcccauccugcagcagauccagauccagcagccccagcagcagaucauccaggccauccccccccagagcuuccagcugcagagcggccagaccauccagaccauccagcagcagccccugcagaacgugcagcugcaggccgugaaccccacccaggugcugaucagagcccccacccugacccccagcggccagaucagcuggcagaccgugcaggugcagaacauccagagccugagcaaccugcaggugcagaacgccggccugagccagcagcugaccaucacccccgugagcagcagcggcggcaccacccuggcccagaucgcccccguggccguggccggcgcccccaucacccugaacaccgcccagcuggccagcgugcccaaccugcagaccgugagcguggccaaccugggcgccgccggcgugcaggugcagggcgugcccgugaccaucaccagcguggccggccagcagcagggccaggacggcgugaaggugcagcaggccaccaucgcccccgugaccguggccgugggcggcaucgccaacgccaccaucggcgccgugagccccgaccagcugacccaggugcaccugcagcagggccagcagaccagcgaccaggaggugcagcccggcaagagacugagaagaguggccugcagcugccccaacugcagagagggcgagggcagaggcagcaacgagcccggcaagaagaagcagcacaucugccacaucgagggcugcggcaagguguacggcaagaccagccaccugagagcccaccugagauggcacaccggcgagagacccuucaucugcaacuggauguucugcggcaagagauucaccagaagcgacgagcugcagagacacagaagaacccacaccggcgagaagagauucgagugccccgagugcagcaagagauucaugagaagcgaccaccugagcaagcacgugaagacccaccagaacaagaagggcggcggcaccgcccuggccaucgugaccagcggcgagcuggacagcagcgugaccgaggugcugggcagccccagaaucgugaccguggccgccaucagccaggacagcaaccccgccacccccaacgugagcaccaacauggaggaguucuaa

SEQ ID NO: 23888 - RNA, 1197 nt, Artificial Sequence
  SP5__Homo_sapiens__NP_001003845
auggccgccguggccgugcugagaaacgacagccugcaggccuuccugcaggacagaacccccagcgccagccccgaccugggcaagcacagcccccuggcccugcuggccgccaccugcagcagaaucggccagcccggcgccgccgccccccccgacuuccugcaggugcccuacgaccccgcccugggcagccccagcagacuguuccaccccuggaccgccgacaugcccgcccacagccccggcgcccugccccccccccaccccagccugggccugaccccccagaagacccaccugcagcccagcuucggcgccgcccacgagcugccccugaccccccccgccgaccccagcuaccccuacgaguucagccccgugaagaugcugcccagcagcauggccgcccugcccgccagcugcgcccccgccuacgugcccuacgccgcccaggccgcccugccccccggcuacagcaaccugcugccccccccccccccccccccccccccccccaccugcagacagcugagccccaaccccgcccccgacgaccugcccugguggagcaucccccaggccggcgccggccccggcgccagcggcgugcccggcagcggccugagcggcgccugcgccggcgccccccacgcccccagauuccccgccagcgccgccgccgccgccgccgccgccgccgcccugcagagaggccuggugcugggccccagcgacuucgcccaguaccagagccagaucgccgcccugcugcagaccaaggccccccuggccgccaccgccagaagaugcagaagaugcagaugccccaacugccaggccgccggcggcgcccccgaggccgagcccggcaagaagaagcagcacgugugccacgugcccggcugcggcaagguguacggcaagaccagccaccugaaggcccaccugagauggcacaccggcgagagacccuucgugugcaacuggcuguucugcggcaagagcuucaccagaagcgacgagcugcagagacaccugagaacccacaccggcgagaagagauucgccugccccgagugcggcaagagauucaugagaagcgaccaccuggccaagcacgugaagacccaccagaacaagaagcugaagguggccgaggccggcgugaagagagaggacgccagagaccuguaa

SEQ ID NO: 23889 - RNA, 1131 nt, Artificial Sequence
  SP6__Homo_sapiens__NP_954871
augcugaccgccgugugcggcagccugggcagccagcacaccgaggccccccacgccagcccccccagacuggaccugcagccccugcagaccuaccagggccacaccagccccgaggccggcgacuaccccagcccccugcagcccggcgagcugcagagccugccccugggccccgagguggacuucagccagggcuacgagcugcccggcgccagcagcagagugaccugcgaggaccuggagagcgacagcccccuggcccccggccccuucagcaagcugcugcagcccgacaugagccaccacuacgagagcugguucagacccacccaccccggcgccgaggacggcagcuggugggaccugcaccccggcaccagcuggauggaccugccccacacccagggcgcccugaccagccccggccaccccggcgcccugcaggccggccugggcggcuacgugggcgaccaccagcugugcgccccccccccccacccccacgcccaccaccugcugcccgccgccggcggccagcaccugcugggcccccccgacggcgccaaggcccuggagguggccgcccccgagagccagggccuggacagcagccuggacggcgccgccagacccaagggcagcagaagaagcgugcccagaagcagcggccagaccgugugcagaugccccaacugccuggaggccgagagacugggcgcccccugcggccccgacggcggcaagaagaagcaccugcacaacugccacauccccggcugcggcaaggccuacgccaagaccagccaccugaaggcccaccugagauggcacagcggcgacagacccuucgugugcaacuggcuguucugcggcaagagauucaccagaagcgacgagcugcagagacaccugcagacccacaccggcaccaagaaguuccccugcgccgugugcagcagaguguucaugagaagcgaccaccuggccaagcacaugaagacccacgagggcgccaaggaggaggccgccggcgccgccagcggcgagggcaaggccggcggcgccguggagccccccggcggcaagggcaagagagaggccgagggcagcguggcccccagcaacuaa

SEQ ID NO: 23890 - RNA, 1296 nt, Artificial Sequence
  SP7__Homo_sapiens__NP_690599
auggccagcagccugcuggaggaggaggugcacuacggcagcagcccccuggccaugcugaccgccgccugcagcaaguucggcggcagcagcccccugagagacagcaccacccugggcaaggccggcaccaagaagcccuacagcgugggcagcgaccugagcgccagcaagaccaugggcgacgccuaccccgcccccuucaccagcaccaacggccugcugagccccgccggcagcccccccgcccccaccagcggcuacgccaacgacuacccccccuucagccacagcuuccccggccccaccggcacccaggaccccggccugcuggugcccaagggccacagcagcagcgacugccugcccagcguguacaccagccuggacaugacccaccccuacggcagcugguacaaggccggcauccacgccggcaucagccccggccccggcaacacccccacccccuggugggacaugcaccccggcggcaacuggcugggcggcggccagggccagggcgacggccugcagggcacccugcccaccggccccgcccagcccccccugaacccccagcugcccaccuaccccagcgacuucgccccccugaaccccgcccccuaccccgccccccaccugcugcagcccggcccccagcacgugcugccccaggacguguacaagcccaaggccgugggcaacagcggccagcuggagggcagcggcggcgccaagccccccagaggcgccagcaccggcggcagcggcggcuacggcggcagcggcgccggcagaagcagcugcgacugccccaacugccaggagcuggagagacugggcgccgccgccgccggccugagaaagaagcccauccacagcugccacauccccggcugcggcaagguguacggcaaggccagccaccugaaggcccaccugagauggcacaccggcgagagacccuucgugugcaacuggcuguucugcggcaagagauucaccagaagcgacgagcuggagagacacgugagaacccacaccagagagaagaaguucaccugccugcugugcagcaagagauucaccagaagcgaccaccugagcaagcaccagagaacccacggcgagcccggccccggccccccccccagcggccccaaggagcugggcgagggcagaagcaccggcgaggaggaggccagccagacccccagacccagcgccagccccgccacccccgagaaggcccccggcggcagccccgagcagagcaaccugcuggagaucuaa

SEQ ID NO: 23891 - RNA, 1527 nt, Artificial Sequence
  SP8__Homo_sapiens__NP_874359
auggccaccagccugcugggcgaggagcccagacugggcagcaccccccuggccaugcuggccgccaccugcaacaagaucggcagccccagccccagccccagcagccugagcgacagcagcagcagcuucggcaagggcuuccaccccuggaagagaagcagcagcagcagcagcgccagcugcaacguggugggcagcagccugagcagcuucggcgugagcggcgccagcagaaacggcggcagcagcagcgccgccgccgccgccgccgccgccgccgccgccgccgccgcccuggugagcgacagcuucagcugcggcggcagccccggcagcagcgccuucagccugaccagcagcagcgccgccgccgccgccgccgccgccgccgccgccgccagcagcagccccuucgccaacgacuacagcguguuccaggcccccggcgugagcggcggcagcggcggcggcggcggcggcggcggcggcggcagcagcgcccacagccaggacggcagccaccagcccguguucaucagcaaggugcacaccagcguggacggccugcagggcaucuaccccagagugggcauggcccaccccuacgagagcugguucaagcccagccaccccggccugggcgccgccggcgaggugggcagcgccggcgccagcagcuggugggacgugggcgccggcuggaucgacgugcagaaccccaacagcgccgccgcccugcccggcagccugcaccccgccgccggcggccugcagaccagccugcacagcccccugggcggcuacaacagcgacuacagcggccugagccacagcgccuucagcagcggcgccagcagccaccugcugagccccgccggccagcaccugauggacggcuucaagcccgugcugcccggcagcuaccccgacagcgcccccagcccccuggccggcgccggcggcagcaugcugagcgccggccccagcgccccccugggcggcagccccagaagcagcgccagaagauacagcggcagagccaccugcgacugccccaacugccaggaggccgagagacugggccccgccggcgccagccugagaagaaagggccugcacagcugccacauccccggcugcggcaagguguacggcaagaccagccaccugaaggcccaccugagauggcacaccggcgagagacccuucgugugcaacuggcuguucugcggcaagagauucaccagaagcgacgagcugcagagacaccugagaacccacaccggcgagaagagauucgccugccccgugugcaacaagagauucaugagaagcgaccaccugagcaagcacgugaagacccacagcggcggcggcggcggcggcggcagcgccggcagcggcagcggcggcaagaagggcagcgacaccgacagcgagcacagcgccgccggcagcccccccugccacagccccgagcugcugcagccccccgagcccggccacagaaacggccuggaguaa

SEQ ID NO: 23892 - RNA, 456 nt, Artificial Sequence
  SPA17__Homo_sapiens__XP_011541172
augagcauccccuucagcaacacccacuacagaaucccccagggcuucggcaaccugcuggagggccugaccagagagauccugagagagcagcccgacaacauccccgccuucgccgccgccuacuucgagagccugcuggagaagagagagaagaccaacuucgaccccgccgaguggggcagcaagguggaggacagauucuacaacaaccacgccuucgaggagcaggagccccccgagaagagcgaccccaagcaggaggagagccagaucagcggcaaggaggaggagaccagcgugaccauccuggacagcagcgaggaggacaaggagaaggaggagguggccgccgugaagauccaggccgccuucagaggccacaucgccagagaggaggccaagaagaugaagaccaacagccugcagaacgaggagaaggaggagaacaaguaa

SEQ ID NO: 23893 - RNA, 885 nt, Artificial Sequence
  SPACA1__Homo_sapiens__NP_112222
augagccccagaggcaccggcugcagcgccggccugcugaugaccgugggcuggcugcugcuggccggccugcagagcgccagaggcaccaacgugaccgccgccgugcaggacgccggccuggcccacgagggcgagggcgaggaggagaccgagaacaacgacagcgagaccgccgagaacuacgccccccccgagaccgaggacgugagcaacagaaacguggugaaggagguggaguucggcaugugcaccgugaccugcggcaucggcgugagagaggugauccugaccaacggcugccccggcggcgagagcaagugcguggugagaguggaggagugcagaggccccaccgacugcggcuggggcaagcccaucagcgagagccuggagagcgugagacuggccugcauccacaccagcccccugaacagauucaaguacauguggaagcugcugagacaggaccagcagagcaucauccuggugaacgacagcgccauccuggaggugagaaaggagagccacccccuggccuucgagugcgacacccuggacaacaacgagaucguggccaccaucaaguucaccguguacaccagcagcgagcugcagaugagaagaagcagccugcccgccaccgacgccgcccugaucuucgugcugaccaucggcgugaucaucugcguguucaucaucuuccugcugaucuucaucaucaucaacugggccgccgugaaggccuucuggggcgccaaggccagcacccccgaggugcagagcgagcagagcagcgugagauacaaggacagcaccagccuggaccagcugcccaccgagaugcccggcgaggacgacgcccugagcgaguggaacgaguaa

SEQ ID NO: 23894 - RNA, 648 nt, Artificial Sequence
  SPACA3__Homo_sapiens__NP_776246
auggugagcgcccugagaggcgccccccugaucagagugcacagcagccccgugagcagccccagcgugagcggccccagaagacuggugagcugccugagcagccagagcagcgcccugagccagagcggcggcggcagcaccagcgccgccggcaucgaggccagaagcagagcccugagaagaagauggugccccgccggcaucaugcugcuggcccuggugugccugcugagcugccugcugcccagcagcgaggccaagcuguacggcagaugcgagcuggccagagugcugcacgacuucggccuggacggcuacagaggcuacagccuggccgacugggugugccuggccuacuucaccagcggcuucaacgccgccgcccuggacuacgaggccgacggcagcaccaacaacggcaucuuccagaucaacagcagaagauggugcagcaaccugacccccaacgugcccaacgugugcagaauguacugcagcgaccugcugaaccccaaccugaaggacaccgugaucugcgccaugaagaucacccaggagccccagggccugggcuacugggaggccuggagacaccacugccagggcaaggaccugaccgaguggguggacggcugcgacuucuaa

SEQ ID NO: 23895 - RNA, 327 nt, Artificial Sequence
  SPAG11A__Homo_sapiens__NP_001075021
augagacagagacugcugcccagcgugaccagccugcugcugguggcccugcuguuccccggcagcagccaggccagacacgugaaccacagcgccaccgaggcccugggcgagcugagagagagagcccccggccagggcaccaacggcuuccagcugcugagacacgccgugaagagagaccugcugccccccagaaccccccccuaccagggcgacgugccccugggcaucagaaacaccaucugcagaaugcagcagggcaucugcagacuguucuucugccacagcggcaccggccagcagcacagacagagaugcggcuaa

SEQ ID NO: 23896 - RNA, 312 nt, Artificial Sequence
  SPAG11B__Homo_sapiens__NP_057596
augagacagagacugcugcccagcgugaccagccugcugcugguggcccugcuguuccccggcagcagccaggccagacacgugaaccacagcgccaccgaggcccugggcgagcugagagagagagcccccggccagggcaccaacggcuuccagcugcugagacacgccgugaagagagaccugcugccccccagaaccccccccuaccaggugcacaucagccacagagaggccagaggccccagcuucagaaucugcguggacuuccugggccccagaugggccagaggcugcagcaccggcaacuaa

SEQ ID NO: 23897 - RNA, 552 nt, Artificial Sequence
  SPAG16__Homo_sapiens__NP_001020607
auggccgcccagagaggcaugcccagcagcgccgugagagugcuggaggaggcccugggcaugggccugaccgccgccggcgacgccagagacaccgccgacgccguggccgccgagggcgccuacuaccuggagcaggugaccaucaccgaggccagcgaggacgacuacgaguacgaggagauccccgacgacaacuucagcauccccgagggcgaggaggaccuggccaaggccauccagauggcccaggagcaggccaccgacaccgagauccuggagagaaagaccgugcugcccagcaagcacgccgugcccgaggugaucgaggacuuccugugcaacuuccugaucaagaugggcaugaccagaacccuggacugcuuccagagcgagugguacgagcugauccagaagggcgugaccgagcugagaaccgugggcaacgugcccgacguguacacccagaucaugcugcuggagaacgagaacaagaaccugaagaaggaccugaagcacuacaagcaggccgccgaguacgugaucuucuaa

SEQ ID NO: 23898 - RNA, 2781 nt, Artificial Sequence
  SPAG1__Homo_sapiens__NP_757367
augaccaccaaggacuaccccagccuguggggcuucggcaccaccaagaccuucaagauccccaucgagcaccuggacuucaaguacaucgagaagugcagcgacgugaagcaccuggagaagauccugugcgugcugagaagcggcgaggagggcuacuaccccgagcugaccgaguucugcgagaagcaccugcaggcccuggcccccgagagcagagcccugagaaaggacaagcccgccgccaccgccgccagcuucaccgccgaggagugggagaagaucgacggcgacaucaagagcugggugagcgagaucaagaaggaggaggacaagaugcacuuccacgagaccgagaccuuccccgccaugaaggacaaccugccccccgugagaggcagcaacagcugccugcacgugggcaaggagaaguacagcaagagacccaccaagaagaagacccccagagacuacgccgagugggacaaguucgacguggagaaggagugccugaagaucgacgaggacuacaaggagaagaccgugaucgacaagagccaccugagcaagaucgagaccagaaucgacaccgccggccugaccgagaaggagaaggacuuccuggccaccagagagaaggagaagggcaacgaggccuucaacagcggcgacuacgaggaggccgugauguacuacaccagaagcaucagcgcccugcccaccgugguggccuacaacaacagagcccaggccgagaucaagcugcagaacuggaacagcgccuuccaggacugcgagaaggugcuggagcuggagcccggcaacgugaaggcccugcugagaagagccaccaccuacaagcaccagaacaagcugagagaggccaccgaggaccugagcaaggugcuggacguggagcccgacaacgaccuggccaagaagacccugagcgagguggagagagaccugaagaacagcgaggccgccagcgagacccagaccaagggcaagagaauggugauccaggagaucgagaacagcgaggacgaggagggcaagagcggcagaaagcacgaggacggcggcggcgacaagaagcccgccgagcccgccggcgccgccagagccgcccagcccugcgugaugggcaacauccagaagaagcugaccggcaaggccgagggcggcaagagacccgccagaggcgccccccagagaggccagacccccgaggccggcgccgacaagagaagccccagaagagccagcgccgccgccgccgccggcggcggcgccaccggccaccccggcggcggccagggcgccgagaaccccgccggccugaagagccagggcaacgagcuguucagaagcggccaguucgccgaggccgccggcaaguacagcgccgccaucgcccugcuggagcccgccggcagcgagaucgccgacgaccugagcauccuguacagcaacagagccgccugcuaccugaaggagggcaacugcagcggcugcauccaggacugcaacagagcccuggagcugcaccccuucagcaugaagccccugcugagaagagccauggccuacgagacccuggagcaguacggcaaggccuacguggacuacaagaccgugcugcagaucgacugcggccugcagcuggccaacgacagcgugaacagacugagcagaauccugauggagcuggacggccccaacuggagagagaagcugagccccauccccgccgugcccgccagcgugccccugcaggccuggcaccccgccaaggagaugaucagcaagcaggccggcgacagcagcagccacagacagcagggcaucaccgacgagaagaccuucaaggcccugaaggaggagggcaaccagugcgugaacgacaagaacuacaaggacgcccugagcaaguacagcgagugccugaagaucaacaacaaggagugcgccaucuacaccaacagagcccugugcuaccugaagcugugccaguucgaggaggccaagcaggacugcgaccaggcccugcagcuggccgacggcaacgugaaggccuucuacagaagagcccuggcccacaagggccugaagaacuaccagaagagccugaucgaccugaacaaggugauccugcuggaccccagcaucaucgaggccaagauggagcuggaggaggugaccagacugcugaaccugaaggacaagaccgcccccuucaacaaggagaaggagagaagaaagaucgagauccaggaggugaacgagggcaaggaggagcccggcagacccgccggcgaggugagcaugggcugccuggccagcgagaagggcggcaagagcagcagaagccccgaggaccccgagaagcugcccaucgccaagcccaacaacgccuacgaguucggccagaucaucaacgcccugagcaccagaaaggacaaggaggccugcgcccaccugcuggccaucaccgcccccaaggaccugcccauguuccugagcaacaagcuggagggcgacaccuuccugcugcugauccagagccugaagaacaaccugaucgagaaggaccccagccugguguaccagcaccugcuguaccugagcaaggccgagagauucaagaugaugcugacccugaucagcaagggccagaaggagcugaucgagcagcuguucgaggaccugagcgacacccccaacaaccacuucacccuggaggacauccaggcccugaagagacaguacgagcuguaa

SEQ ID NO: 23899 - RNA, 1314 nt, Artificial Sequence
  SPAG4__Homo_sapiens__NP_003107
augagaagaagcagcagacccggcagcgccagcagcagcagaaagcacacccccaacuucuucagcgagaacagcagcaugagcaucaccagcgaggacagcaagggccugagaagcgccgagcccggccccggcgagcccgagggcagaagagccagaggccccagcugcggcgagcccgcccugagcgccggcgugcccggcggcaccaccugggccggcagcagccagcagaagcccgcccccagaagccacaacuggcagaccgccugcggcgccgccaccgugagaggcggcgccagcgagcccaccggcagccccguggugagcgaggagccccuggaccugcugcccacccuggaccugagacaggagaugcccccccccagaguguucaagagcuuccugagccugcuguuccagggccugagcgugcugcugagccuggccggcgacgugcuggugagcauguacagagaggugugcagcaucagauuccuguucaccgccgugagccugcugagccuguuccugagcgccuucuggcugggccugcuguaccuggugagcccccuggagaacgagcccaaggagaugcugacccugagcgaguaccacgagagagugagaagccagggccagcagcugcagcagcugcaggccgagcuggacaagcugcacaaggaggugagcaccgugagagccgccaacagcgagagaguggccaagcugguguuccagagacugaacgaggacuucgugagaaagcccgacuacgcccugagcagcgugggcgccagcaucgaccugcagaagaccagccacgacuacgccgacagaaacaccgccuacuucuggaacagauucagcuucuggaacuacgccagaccccccaccgugauccuggagccccacguguuccccggcaacugcugggccuucgagggcgaccagggccagguggugauccagcugcccggcagagugcagcugagcgacaucacccugcagcaccccccccccagcguggagcacaccggcggcgccaacagcgcccccagagacuucgccguguucggccugcagguguacgacgagaccgaggugagccugggcaaguucaccuucgacguggagaagagcgagauccagaccuuccaccugcagaacgacccccccgccgccuuccccaaggugaagauccagauccugagcaacuggggccaccccagauucaccugccuguacagagugagagcccacggcgugagaaccagcgagggcgccgagggcagcgcccagggcccccacuaa

SEQ ID NO: 23900 - RNA, 3582 nt, Artificial Sequence
  SPAG5__Homo_sapiens__NP_006452
auguggagagugaagaagcugagccugagccugagccccagcccccagaccggcaagcccagcaugagaaccccccugagagagcugacccugcagcccggcgcccugaccaacagcggcaagagaagccccgccugcagcagccugacccccagccugugcaagcugggccugcaggagggcagcaacaacagcagccccguggacuucgugaacaacaagagaaccgaccugagcagcgagcacuucagccacagcagcaaguggcuggagaccugccagcacgagagcgacgagcagccccuggaccccaucccccagaucagcagcacccccaagaccagcgaggaggccguggacccccugggcaacuacauggugaagaccaucgugcuggugcccagcccccugggccagcagcaggacaugaucuucgaggccagacuggacaccauggccgagaccaacagcaucagccugaacggcccccugagaaccgacgaccuggugagagaggagguggcccccugcaugggcgacagauucagcgagguggccgccgugagcgagaagcccaucuuccaggagagccccagccaccugcuggaggagagcccccccaaccccugcagcgagcagcugcacugcagcaaggagagccugagcagcagaaccgaggccgugagagaggaccuggugcccagcgagagcaacgccuuccugcccagcagcgugcuguggcugagccccagcaccgcccuggccgccgacuucagagugaaccacguggaccccgaggaggagaucguggagcacggcgccauggaggagagagagaugagauuccccacccaccccaaggagagcgagaccgaggaccaggcccuggugagcagcguggaggacauccugagcaccugccugacccccaaccugguggagauggagagccaggaggcccccggccccgccguggaggacgugggcagaauccugggcagcgacaccgagagcuggaugagcccccuggccuggcuggagaagggcgugaacaccagcgugaugcuggagaaccugagacagagccugagccugcccagcaugcugagagacgccgccaucggcaccacccccuucagcaccugcagcgugggcaccugguucacccccagcgccccccaggagaagagcaccaacaccagccagaccggccuggugggcaccaagcacagcaccagcgagaccgagcagcugcugugcggcagaccccccgaccugaccgcccugagcagacacgaccuggaggacaaccugcugagcagccuggugauccuggaggugcugagcagacagcugagagacuggaagagccagcuggccgugccccaccccgagacccaggacagcagcacccagaccgacaccagccacagcggcaucaccaacaagcugcagcaccugaaggagagccacgagaugggccaggcccugcagcaggccagaaacgugaugcagagcugggugcugaucagcaaggagcugaucagccugcugcaccugagccugcugcaccuggaggaggacaagaccaccgugagccaggagagcagaagagccgagacccuggugugcugcugcuucgaccugcugaagaagcugagagccaagcugcagagccugaaggccgagagagaggaggccagacacagagaggagauggcccugagaggcaaggacgccgccgagaucgugcuggaggccuucugcgcccacgccagccagagaaucagccagcuggagcaggaccuggccagcaugagagaguucagaggccugcugaaggacgcccagacccagcuggugggccugcacgccaagcaggaggagcuggugcagcagaccgugagccugaccagcacccugcagcaggacuggagaagcaugcagcuggacuacaccaccuggaccgcccugcugagcagaagcagacagcugaccgagaagcugaccgugaagagccagcaggcccugcaggagagagacguggccaucgaggagaagcaggaggugagcagagugcuggagcaggugagcgcccagcuggaggagugcaagggccagaccgagcagcuggagcuggagaacagcagacuggccaccgaccugagagcccagcugcagauccuggccaacauggacagccagcugaaggagcugcagagccagcacacccacugcgcccaggaccuggccaugaaggacgagcugcugugccagcugacccagagcaacgaggagcaggccgcccaguggcagaaggaggagauggcccugaagcacaugcaggccgagcugcagcagcagcaggccgugcuggccaaggaggugagagaccugaaggagacccuggaguucgccgaccaggagaaccagguggcccaccuggagcugggccagguggagugccagcugaagaccacccuggaggugcugagagagagaagccugcagugcgagaaccugaaggacaccguggagaaccugaccgccaagcuggccagcaccaucgccgacaaccaggagcaggaccuggagaagaccagacaguacagccagaagcugggccugcugaccgagcagcugcagagccugacccuguuccugcagaccaagcugaaggagaagaccgagcaggagacccugcugcugagcaccgccugcccccccacccaggagcacccccugcccaacgacagaaccuuccugggcagcauccugaccgccguggccgacgaggagcccgagagcacccccgugccccugcugggcagcgacaagagcgccuucaccagaguggccagcauggugagccugcagcccgccgagacccccggcauggaggagagccuggccgagaugagcaucaugaccaccgagcugcagagccugugcagccugcugcaggagagcaaggaggaggccaucagaacccugcagagaaagaucugcgagcugcaggccagacugcaggcccaggaggagcagcaccaggaggugcagaaggccaaggaggccgacaucgagaagcugaaccaggcccugugccugagauacaagaacgagaaggagcugcaggaggugauccagcagcagaacgagaagauccuggagcagaucgacaagagcggcgagcugaucagccugagagaggaggugacccaccugaccagaagccugagaagagccgagaccgagaccaaggugcugcaggaggcccuggccggccagcuggacagcaacugccagcccauggccaccaacuggauccaggagaagguguggcugagccaggagguggacaagcugagagugauguuccuggagaugaagaacgagaaggagaagcugaugaucaaguuccagagccacagaaacauccuggaggagaaccugagaagaagcgacaaggagcuggagaagcuggacgacaucgugcagcacaucuacaagacccugcugagcauccccgagguggugagaggcugcaaggagcugcagggccugcuggaguuccugagcuaa

SEQ ID NO: 23901 - RNA, 1455 nt, Artificial Sequence
  SPAG6__Homo_sapiens__NP_001240783
augcacagccugaccauggaccuguggauccccaacggccaggccggcgugaugagccugcugagaacccugcugcuggacguggugcccaccauccagcagaccgccgcccuggcccugggcagacuggccaacuacaacgacgaccuggccgaggccguggugaagugcgacauccugccccagcugguguacagccuggccgagcagaacagauucuacaagaaggccgccgccuucgugcugagagccgugggcaagcacagcccccagcuggcccaggccaucguggacugcggcgcccuggacacccuggugaucugccuggaggacuucgaccccggcgugaaggaggccgccgccugggcccugagauacaucgccagacacaacgccgagcugagccaggccgugguggacgccggcgccgugccccugcuggugcugugcauccaggagcccgagaucgcccugaagagaaucgccgccagcgcccugagcgacaucgccaagcacagccccgagcuggcccagaccgugguggacgccggcgccguggcccaccuggcccagaugauccugaaccccgacgccaagcugaagcaccagauccugagcgcccugagccaggugagcaagcacagcguggaccuggccgagauggugguggaggccgagaucuuccccguggugcugaccugccugaaggacaaggacgaguacgugaagaagaacgccagcacccugaucagagagaucgccaagcacacccccgagcugagccagcugguggugaacgccggcggcguggccgccgugaucgacugcaucggcagcugcaagggcaacaccagacugcccggcaucaugaugcugggcuacguggccgcccacagcgagaaccuggccauggccgugaucaucagcaagggcgugccccagcugagcgugugccugagcgaggagcccgaggaccacaucaaggccgccgccgccugggcccugggccagaucggcagacacacccccgagcacgccagagccguggccgugaccaacacccugcccgugcugcugagccuguacaugagcaccgagagcagcgaggaccugcaggugaagagcaagaaggccaucaagaacauccugcagaagugcaccuaccugcccgcccuggagcccuuccuguacgacgccccccccaacauccugaagcacguggugggccaguucagcaaggugcugccccacgacagcaaggccagaagacuguucgugaccagcggcggccugaagaaggugcaggagaucaaggccgagcccggcagccugcugcaggaguacaucaacagcaucaacagcugcuaccccgaggagaucgugagauacuacagccccggcuacagcgacacccugcugcagagaguggacagcuaccagccccugaacaacuaa

SEQ ID NO: 23902 - RNA, 684 nt, Artificial Sequence
  SPAG7__Homo_sapiens__NP_004881
auggccgaccugcugggcagcauccugagcagcauggagaagccccccagccugggcgaccaggagaccagaagaaaggccagagagcaggccgccagacugaagaagcugcaggagcaggagaagcagcagaagguggaguucagaaagagaauggagaaggaggugagcgacuucauccaggacagcggccagaucaagaagaaguuccagcccaugaacaagaucgagagaagcauccugcacgacgugguggagguggccggccugaccagcuucagcuucggcgaggacgacgacugcagauacgugaugaucuucaagaaggaguucgcccccagcgacgaggagcuggacagcuacagaagaggcgaggagugggacccccagaaggccgaggagaagagaaagcugaaggagcuggcccagagacaggaggaggaggccgcccagcagggccccgugguggugagccccgccagcgacuacaaggacaaguacagccaccugaucggcaagggcgccgccaaggacgccgcccacaugcugcaggccaacaagaccuacggcugcgugcccguggccaacaagagagacaccagaagcaucgaggaggccaugaacgagaucagagccaagaagagacugagacagagcggcgaggagcugccccccaccagcuaa

SEQ ID NO: 23903 - RNA, 1458 nt, Artificial Sequence
  SPAG8__Homo_sapiens__NP_001034681
auggagaccaacgagagcaccgagggcagcagaagcagaagcagaagccuggacauccagcccagcagcgagggccugggccccaccagcgagcccuuccccagcagcgacgacagccccagaagcgcccuggccgccgccaccgccgccgccgccgccgccgccagcgccgccgccgccaccgccgccuucaccaccgccaaggccgccgcccugagcaccaagacccccgcccccugcagcgaguucauggagcccagcagcgaccccagccugcugggcgagcccugcgccggccccggcuucacccacaacaucgcccacggcagccugggcuucgagcccguguacgugagcugcaucgcccaggacaccugcaccaccaccgaccacagcagcaaccccggccccgugcccggcagcagcagcggccccgugcugggcagcagcagcggcgccggccacggcagcggcagcggcagcggccccggcugcggcagcgugcccggcagcggcagcggccccggccccggcagcggccccggcagcggccccggccacggcagcggcagccaccccggccccgccagcggccccggccccgacaccggccccgacagcgagcugagccccugcaucccccccggcuucagaaaccugguggccgacagagugcccaacuacaccagcuggagccagcacugccccugggagccccagaagcagccccccugggaguuccugcaggugcuggagcccggcgccagaggccuguggaagccccccgacaucaagggcaagcugauggugugcuacgagacccugcccagaggccagugccugcuguacaacugggaggaggagagagccaccaaccaccuggaccaggugcccagcaugcaggacggcagcgagagcuucuucuucagacacggccacagaggccugcugaccaugcagcugaagagccccaugcccagcagcaccacccagaaggacagcuaccagccccccggcaacguguacuggccccugagaggcaagagagaggccaugcuggagaugcugcugcagcaccagaucugcaaggaggugcaggccgagcaggagcccaccagaaagcuguucgagguggagagcgugacccaccacgacuacagaauggagcuggcccaggccggcacccccgcccccaccaagccccacgacuacagacaggagcagcccgagaccuucuggauccagagagccccccagcugcccggcgugagcaacaucagaacccuggacacccccuucagaaagaacugcagcuucagcacccccgugccccugagccugggcaagcugcugcccuacgagcccgagaacuaccccuaccagcugggcgagaucagcagccugcccugccccggcggcagacugggcggcggcggcggcagaaugacccccuucuaa

SEQ ID NO: 23904 - RNA, 3936 nt, Artificial Sequence
  SPAG9__Homo_sapiens__NP_001123999
auggagcuggaggacggcgugguguaccaggaggagcccggcggcagcggcgccgugaugagcgagagagugagcggccuggccggcagcaucuacagagaguucgagagacugaucggcagauacgacgaggagguggugaaggagcugaugccccuggugguggccgugcuggagaaccuggacagcguguucgcccaggaccaggagcaccagguggagcuggagcugcugagagacgacaacgagcagcugaucacccaguacgagagagagaaggcccugagaaagcacgccgaggagaaguucaucgaguucgaggacagccaggagcaggagaagaaggaccugcagaccagaguggagagccuggagagccagaccagacagcuggagcugaaggccaagaacuacgccgaccagaucagcagacuggaggagagagaggccgagcugaagaaggaguacaacgcccugcaccagagacacaccgagaugauccacaacuacauggagcaccuggagagaaccaagcugcaccagcugagcggcagcgaccagcuggagagcaccgcccacagcagaaucagaaaggagagacccaucagccugggcaucuucccccugcccgccggcgacggccugcugacccccgacgcccagaagggcggcgagacccccggcagcgagcaguggaaguuccaggagcugagccagcccagaagccacaccagccugaaggacgagcugagcgacgugagccagggcggcagcaaggccaccacccccgccagcaccgccaacagcgacguggccaccauccccaccgacaccccccugaaggaggagaacgagggcuucgugaaggugaccgacgcccccaacaagagcgagaucagcaagcacaucgaggugcagguggcccaggagaccagaaacgugagcaccggcagcgccgagaacgaggagaagagcgaggugcaggccaucaucgagagcacccccgagcuggacauggacaaggaccugagcggcuacaagggcagcagcacccccaccaagggcaucgagaacaaggccuucgacagaaacaccgagagccuguucgaggagcugagcagcgccggcagcggccugaucggcgacguggacgagggcgccgaccugcugggcaugggcagagagguggagaaccugauccuggagaacacccagcugcuggagaccaagaacgcccugaacaucgugaagaacgaccugaucgccaagguggacgagcugaccugcgagaaggacgugcugcagggcgagcuggaggccgugaagcaggccaagcugaagcuggaggagaagaacagagagcuggaggaggagcugagaaaggccagagccgaggccgaggacgccagacagaaggccaaggacgacgacgacagcgacauccccaccgcccagagaaagagauucaccagaguggagauggccagagugcugauggagagaaaccaguacaaggagagacugauggagcugcaggaggccgugagauggaccgagaugaucagagccagcagagagaaccccgccaugcaggagaagaagagaagcagcaucuggcaguucgugcccaccagauucagcagacuguucagcagcagcagcaacaccaccaagaagcccgagccccccgugaaccugaaguacaacgcccccaccagccacgugacccccagcgugaagaagagaagcagcacccugagccagcugcccggcgacaagagcaaggccuucgacuuccugagcgaggagaccgaggccagccuggccagcagaagagagcagaagagagagcaguacagacaggugaaggcccacgugcagaaggaggacggcagagugcaggccuucggcuggagccugccccagaaguacaagcaggugaccaacggccagggcgagaacaagaugaagaaccugcccgugcccguguaccugagaccccuggacgagaaggacaccagcaugaagcuguggugcgccgugggcgugaaccugagcggcggcaagaccagagacggcggcagcguggugggcgccagcguguucuacaaggacguggccggccuggacaccgagggcagcaagcagagaagcgccagccagagcagccuggacaagcuggaccaggagcugaaggagcagcagaaggagcugaagaaccaggaggagcugagcagccugguguggaucugcaccagcacccacagcgccaccaaggugcugaucaucgacgccgugcagcccggcaacauccuggacagcuucaccgugugcaacagccacgugcugugcaucgccagcgugcccggcgccagagagaccgacuaccccgccggcgaggaccugagcgagagcggccagguggacaaggccagccugugcggcagcaugaccagcaacagcagcgccgagaccgacagccugcugggcggcaucaccguggugggcugcagcgccgagggcgugaccggcgccgccaccagccccagcaccaacggcgccagccccgugauggacaagccccccgagauggaggccgagaacagcgagguggacgagaacgugcccaccgccgaggaggccaccgaggccaccgagggcaacgccggcagcgccgaggacaccguggacaucagccagaccggcguguacaccgagcacguguucaccgacccccugggcgugcagauccccgaggaccugagccccguguaccagagcagcaacgacagcgacgccuacaaggaccagaucagcgugcugcccaacgagcaggaccuggugagagaggaggcccagaagaugagcagccugcugcccaccauguggcugggcgcccagaacggcugccuguacgugcacagcagcguggcccaguggagaaagugccugcacagcaucaagcugaaggacagcauccugagcaucgugcacgugaagggcaucgugcugguggcccuggccgacggcacccuggccaucuuccacagaggcguggacggccagugggaccugagcaacuaccaccugcuggaccugggcagaccccaccacagcaucagaugcaugaccguggugcacgacaagguguggugcggcuacagaaacaagaucuacguggugcagcccaaggccaugaagaucgagaagagcuucgacgcccaccccagaaaggagagccaggugagacagcuggccugggugggcgacggcgugugggugagcaucagacuggacagcacccugagacuguaccacgcccacaccuaccagcaccugcaggacguggacaucgagcccuacgugagcaagaugcugggcaccggcaagcugggcuucagcuucgugagaaucaccgcccugauggugagcugcaacagacugugggugggcaccggcaacggcgugaucaucagcaucccccugaccgagaccaacaagaccagcggcgugcccggcaacagacccggcagcgugaucagaguguacggcgacgagaacagcgacaaggugacccccggcaccuucauccccuacugcagcauggcccacgcccagcugugcuuccacggccacagagacgccgugaaguucuucguggccgugcccggccaggugaucagcccccagagcagcagcagcggcaccgaccugaccggcgacaaggccggccccagcgcccaggagcccggcagccagaccccccugaagagcaugcuggugaucagcggcggcgagggcuacaucgacuucagaaugggcgacgagggcggcgagagcgagcugcugggcgaggaccugccccuggagcccagcgugaccaaggccgagagaagccaccugaucguguggcaggugauguacggcaacgaguaa

SEQ ID NO: 23905 - RNA, 1536 nt, Artificial Sequence
  SPAM1__Homo_sapiens__XP_011514825
augggcgugcugaaguucaagcacaucuucuucagaagcuucgugaagagcagcggcgugagccagaucguguucaccuuccugcugauccccugcugccugacccugaacuucagagccccccccgugauccccaacgugcccuuccugugggccuggaacgcccccagcgaguucugccugggcaaguucgacgagccccuggacaugagccuguucagcuucaucggcagccccagaaucaacgccaccggccagggcgugaccaucuucuacguggacagacugggcuacuaccccuacaucgacagcaucaccggcgugaccgugaacggcggcaucccccagaagaucagccugcaggaccaccuggacaaggccaagaaggacaucaccuucuacaugcccguggacaaccugggcauggccgugaucgacugggaggaguggagacccaccugggccagaaacuggaagcccaaggacguguacaagaacagaagcaucgagcuggugcagcagcagaacgugcagcugagccugaccgaggccaccgagaaggccaagcaggaguucgagaaggccggcaaggacuuccugguggagaccaucaagcugggcaagcugcugagacccaaccaccuguggggcuacuaccuguuccccgacugcuacaaccaccacuacaagaagcccggcuacaacggcagcugcuucaacguggagaucaagagaaacgacgaccugagcuggcuguggaacgagagcaccgcccuguaccccagcaucuaccugaacacccagcagagccccguggccgccacccuguacgugagaaacagagugagagaggccaucagagugagcaagauccccgacgccaagagcccccugcccguguucgccuacaccagaaucguguucaccgaccaggugcugaaguuccugagccaggacgagcugguguacaccuucggcgagaccguggcccugggcgccagcggcaucgugaucuggggcacccugagcaucaugagaagcaugaagagcugccugcugcuggacaacuacauggagaccauccugaaccccuacaucaucaacgugacccuggccgccaagaugugcagccaggugcugugccaggagcagggcgugugcaucagaaagaacuggaacagcagcgacuaccugcaccugaaccccgacaacuucgccauccagcuggagaagggcggcaaguucaccgugagaggcaagcccacccuggaggaccuggagcaguucagcgagaaguucuacugcagcugcuacagcacccugagcugcaaggagaaggccgacgugaaggacaccgacgccguggacgugugcaucgccgacggcgugugcaucgacgccuuccugaagccccccauggagaccgaggagccccagaucuucuacaacgccagccccagcacccugagcgccaccauguucaucuggagacuggaggugugggaccagggcaucagcagaaucggcuucuucuaa

SEQ ID NO: 23906 - RNA, 294 nt, Artificial Sequence
  SPANXA2__Homo_sapiens__NP_663695
auggacaagcagagcagcgccggcggcgugaagagaagcgugcccugcgacagcaacgaggccaacgagaugaugcccgagacccccaccggcgacagcgacccccagcccgcccccaagaagaugaagaccagcgagagcagcaccauccugguggugagauacagaagaaacuucaagagaaccagccccgaggagcugcugaacgaccacgccagagagaacagaaucaacccccugcagauggaggaggaggaguucauggagaucaugguggagauccccgccaaguaa

SEQ ID NO: 23907 - RNA, 312 nt, Artificial Sequence
  SPANXB1__Homo_sapiens__NP_115850
augggccagcagagcagcgugagaagacugaagagaagcgugcccugcgagagcaacgaggccaacgaggccaacgaggccaacaagaccaugcccgagacccccaccggcgacagcgacccccagcccgcccccaagaagaugaagaccagcgagagcagcaccauccugguggugagauacagaagaaacgugaagagaaccagccccgaggagcugcugaacgaccacgccagagagaacagaaucaaccccgaccagauggaggaggaggaguucaucgagaucaccaccgagagacccaagaaguaa

SEQ ID NO: 23908 - RNA, 294 nt, Artificial Sequence
  SPANXD__Homo_sapiens__NP_115793
auggacaagcagagcagcgccggcggcgugaagagaagcgugcccugcgacagcaacgaggccaacgagaugaugcccgagaccagcagcggcuacagcgacccccagcccgcccccaagaagcugaagaccagcgagagcagcaccauccugguggugagauacagaagaaacuucaagagaaccagccccgaggagcuggugaacgaccacgccagaaagaacagaaucaacccccugcagauggaggaggaggaguucauggagaucaugguggagauccccgccaaguaa

SEQ ID NO: 23909 - RNA, 300 nt, Artificial Sequence
  SPANXN4__Homo_sapiens__NP_001009613
auggaggagcccaccagcagcaccaacgagaacaagaugaagagccccugcgagagcaacaagagaaagguggacaagaagaagaagaaccugcacagagccagcgcccccgagcagagccugaaggagaccgagaaggccaaguaccccacccugguguucuacugcagaaagaacaagaagagaaacagcaaccagcuggagaacaaccagcccaccgagagcagcaccgaccccaucaaggagaagggcgaccuggacaucagcgccggcagcccccaggacggcggccagaacuaa

SEQ ID NO: 23910 - RNA, 912 nt, Artificial Sequence
  SPARC__Homo_sapiens__NP_003109
augagagccuggaucuucuuccugcugugccuggccggcagagcccuggccgccccccagcaggaggcccugcccgacgagaccgaggugguggaggagaccguggccgaggugaccgaggugagcgugggcgccaaccccgugcagguggaggugggcgaguucgacgacggcgccgaggagaccgaggaggaggugguggccgagaaccccugccagaaccaccacugcaagcacggcaaggugugcgagcuggacgagaacaacacccccaugugcgugugccaggaccccaccagcugccccgcccccaucggcgaguucgagaaggugugcagcaacgacaacaagaccuucgacagcagcugccacuucuucgccaccaagugcacccuggagggcaccaagaagggccacaagcugcaccuggacuacaucggccccugcaaguacaucccccccugccuggacagcgagcugaccgaguucccccugagaaugagagacuggcugaagaacgugcuggugacccuguacgagagagacgaggacaacaaccugcugaccgagaagcagaagcugagagugaagaagauccacgagaacgagaagagacuggaggccggcgaccaccccguggagcugcuggccagagacuucgagaagaacuacaacauguacaucuuccccgugcacuggcaguucggccagcuggaccagcaccccaucgacggcuaccugagccacaccgagcuggccccccugagagccccccugauccccauggagcacugcaccaccagauucuucgagaccugcgaccuggacaacgacaaguacaucgcccuggacgagugggccggcugcuucggcaucaagcagaaggacaucgacaaggaccuggugaucuaa

SEQ ID NO: 23911 - RNA, 1995 nt, Artificial Sequence
  SPARCL1__Homo_sapiens__NP_001121782
augaagaccggccuguucuuccugugccugcugggcaccgccgccgccauccccaccaacgccagacugcugagcgaccacagcaagcccaccgccgagaccguggcccccgacaacaccgccauccccagccugagagccgaggccgaggagaacgagaaggagaccgccgugagcaccgaggacgacagccaccacaaggccgagaagagcagcgugcugaagagcaaggaggagagccacgagcagagcgccgagcagggcaagagcagcagccaggagcugggccugaaggaccaggaggacagcgacggccaccugagcgugaaccuggaguacgcccccaccgagggcacccuggacaucaaggaggacaugagcgagccccaggagaagaagcugagcgagaacaccgacuuccuggcccccggcgugagcagcuucaccgacagcaaccagcaggagagcaucaccaagagagaggagaaccaggagcagcccagaaacuacagccaccaccagcugaacagaagcagcaagcacagccagggccugagagaccagggcaaccaggagcaggaccccaacaucagcaacggcgaggaggaggaggagaaggagcccggcgaggugggcacccacaacgacaaccaggagagaaagaccgagcugcccagagagcacgccaacagcaagcaggaggaggacaacacccagagcgacgacauccuggaggagagcgaccagcccacccaggugagcaagaugcaggaggacgaguucgaccagggcaaccaggagcaggaggacaacagcaacgccgagauggaggaggagaacgccagcaacgugaacaagcacauccaggagaccgaguggcagagccaggagggcaagaccggccuggaggccaucagcaaccacaaggagaccgaggagaagaccgugagcgaggcccugcugauggagcccaccgacgacggcaacaccacccccagaaaccacggcguggacgacgacggcgacgacgacggcgacgacggcggcaccgacggccccagacacagcgccagcgacgacuacuucauccccagccaggccuuccuggaggccgagagagcccagagcaucgccuaccaccugaagaucgaggagcagagagagaaggugcacgagaacgagaacaucggcaccaccgagcccggcgagcaccaggaggccaagaaggccgagaacagcagcaacgaggaggagaccagcagcgagggcaacaugagagugcacgccguggacagcugcaugagcuuccagugcaagagaggccacaucugcaaggccgaccagcagggcaagccccacugcgugugccaggaccccgugaccugcccccccaccaagccccuggaccaggugugcggcaccgacaaccagaccuacgccagcagcugccaccuguucgccaccaagugcagacuggagggcaccaagaagggccaccagcugcagcuggacuacuucggcgccugcaagagcauccccaccugcaccgacuucgaggugauccaguucccccugagaaugagagacuggcugaagaacauccugaugcagcuguacgaggccaacagcgagcacgccggcuaccugaacgagaagcagagaaacaaggugaagaagaucuaccuggacgagaagagacugcuggccggcgaccaccccaucgaccugcugcugagagacuucaagaagaacuaccacauguacguguaccccgugcacuggcaguucagcgagcuggaccagcaccccauggacagagugcugacccacagcgagcuggccccccugagagccagccuggugcccauggagcacugcaucaccagauucuucgaggagugcgaccccaacaaggacaagcacaucacccugaaggaguggggccacugcuucggcaucaaggaggaggacaucgacgagaaccugcuguucuaa

SEQ ID NO: 23912 - RNA, 1851 nt, Artificial Sequence
  SPAST__Homo_sapiens__NP_055761
augaacagccccggcggcagaggcaagaagaagggcagcggcggcgccagcaaccccgugccccccagaccccccccccccugccuggcccccgccccccccgccgccggccccgcccccccccccgagagcccccacaagagaaaccuguacuacuucagcuacccccuguucgugggcuucgcccugcugagacugguggccuuccaccugggccugcuguucguguggcugugccagagauucagcagagcccugauggccgccaagagaagcagcggcgccgcccccgcccccgccagcgccagcgcccccgcccccgugcccggcggcgaggccgagagagugagaguguuccacaagcaggccuucgaguacaucagcaucgcccugagaaucgacgaggacgagaaggccggccagaaggagcaggccguggagugguacaagaagggcaucgaggagcuggagaagggcaucgccgugaucgugaccggccagggcgagcagugcgagagagccagaagacugcaggccaagaugaugaccaaccuggugauggccaaggacagacugcagcugcuggagaagaugcagcccgugcugcccuucagcaagagccagaccgacguguacaacgacagcaccaaccuggccugcagaaacggccaccugcagagcgagagcggcgccgugcccaagagaaaggacccccugacccacaccagcaacagccugcccagaagcaagaccgugaugaagaccggcagcgccggccugagcggccaccacagagcccccagcuacagcggccugagcauggugagcggcgugaagcagggcagcggccccgcccccaccacccacaagggcacccccaagaccaacagaaccaacaagcccagcacccccaccaccgccaccagaaagaagaaggaccugaagaacuucagaaacguggacagcaaccuggccaaccugaucaugaacgagaucguggacaacggcaccgccgugaaguucgacgacaucgccggccaggaccuggccaagcaggcccugcaggagaucgugauccugcccagccugagacccgagcuguucaccggccugagagcccccgccagaggccugcugcuguucggcccccccggcaacggcaagaccaugcuggccaaggccguggccgccgagagcaacgccaccuucuucaacaucagcgccgccagccugaccagcaaguacgugggcgagggcgagaagcuggugagagcccuguucgccguggccagagagcugcagcccagcaucaucuucaucgacgagguggacagccugcugugcgagagaagagagggcgagcacgacgccagcagaagacugaagaccgaguuccugaucgaguucgacggcgugcagagcgccggcgacgacagagugcuggugaugggcgccaccaacagaccccaggagcuggacgaggccgugcugagaagauucaucaagagaguguacgugagccugcccaacgaggagaccagacugcugcugcugaagaaccugcugugcaagcagggcagcccccugacccagaaggagcuggcccagcuggccagaaugaccgacggcuacagcggcagcgaccugaccgcccuggccaaggacgccgcccugggccccaucagagagcugaagcccgagcaggugaagaacaugagcgccagcgagaugagaaacaucagacugagcgacuucaccgagagccugaagaagaucaagagaagcgugagcccccagacccuggaggccuacaucagauggaacaaggacuucggcgacaccaccguguaa

SEQ ID NO: 23913 - RNA, 3834 nt, Artificial Sequence
  SPATA13__Homo_sapiens__NP_001159743
augacccaggccgccgugagacccugggcccccugccuggagaacaugaccaccgcccccaacggccugggccccggccccgccgcccccugcgccggcagcgaccugaaggacgccaagauggugaccagccuggccugcggcaacggcgugugcggcugcagccccggcggcgacaccgacacccaggaggccaagcugagccccgccaagcuggugagacuguucagcaccagcagaaagagaaccggcgcccaccccgagagaccccacagcauggugcuggugggcaacagcagcaccuggaacacccuggccagcuucagaaagaugggcagcuucaagaagcugaagagcagcgugcugaagggcauccagagcagagagggcagcaacgccugcagcaagggcgaggccagcgagcacggccugggcaagagcauccccaacggcgccgugcccggcgcccaggccagcagaggcagcccccuggcccccggccccgccugcggcgcccugagacccgccgaguggggcacccuggacggcagcgaccuggaggacaccgacgacgccuuccagagaagcacccacagaagcagaagccugagaagagccuacggccugggcagaaucugccugcuggacgccccccagaaccacgccacccccaccaucgccaccggccaggugcccgccgugugcgagauccuggugagagaccccgagaacaacagcaugggcuacagaagaagcaagagcaccgacaaccuggccuuccugaagaagagcagcuucaagagaaagagcaccagcaaccuggccgaccugagaaccgcccacgacgccagagugccccagagaacccugagcagcagcagcaccgacagccagaagcugggcagcggcagaaccaagagauggagaagccccaucagagccaaggacuucgacagaguguucaagcuggugagcaacgugaccgaggccgccuggagaagagagagccccagaagcggcgcccccagccccggcgaggccagccugagacugcaggcccacagcagacugcacgacgacuacagcagaagagugagcagaagcaccgagcaggacagcagaagaggcggcgccgugaugcacggcaccaccgccaccugcaccguggcccccggcuucggcagcgccaccagcaagggcccccaccuggacgccgacaccgccguguucccccuggagaccaagagcagcugggccguggagagcgacagcagcugcaccugcagcagccugcccagccccaucgugcaggacgugcugagcaaggacagcugcgaccccaacgccggcagccagcugaccuucgaccccgagcagccccccaccccccugagacccaccacccccaagccccagagcccccagagcccccagagccccggcgccggcagcgccagcugccacagcaaccacagcgcccugagcgccaacagcgaggagagcgagggcagagccgaggagcccgcccagagagagcccggccccgugagccugcaggacccccuggaggccacccacggcgacgagggcagcaaggaccugcuggugaacaucggcguggccgccggccccgaggagaaggagaaggaggagguggugcccgacggccccuggagaagaagcagcagccaggacgaggagagaaccgaggcccagagaacccccaagagaagauggggcagcggcagaagacccagacccagacccuucagcgacuacggccagcuggccagcagaagccugagcauccccgaggacagcguggccgccgacccccagaaggaggacagaguggacgaggacccccaggccagcaugaccagcgccagccccgaggaccagaacgcccccgugggcugccccaagggcgccagaagaagaagacccaucagcgugaucggcggcgugagccuguacggcaccaaccagaccgaggagcuggacaaccugcugacccagcccgccagcagaccccccaugcccgcccaccaggugccccccuacaaggccgugagcgccagauucagacccuucaccuucagccagagcacccccaucggccuggacagagugggcagaagaagacagaugagagccagcaacgugagcagcgacggcggcaccgagcccagcgcccugguggacgacaacggcagcgaggaggacuucagcuacgaggaccugugccaggccagccccagauaccugcagcccggcggcgagcagcuggccaucaacgagcugaucagcgacggcaacguggugugcgccgaggcccugugggaccacgugaccauggacgaccaggagcugggcuucaaggccggcgacgugauccaggugcuggaggccagcaacaaggacuggugguggggcagaagcgaggacaaggaggccugguuccccgccagcuucgugagacugagagugaaccaggaggagcugagcgagaacagcagcagcacccccagcgaggagcaggacgaggaggccagccagagcagacacagacacugcgagaacaagcagcagaugagaaccaacgugaucagagagaucauggacaccgagagaguguacaucaagcaccugagagacaucugcgagggcuacaucagacagugcagaaagcacaccggcauguucaccguggcccagcuggccaccaucuucggcaacaucgaggacaucuacaaguuccagagaaaguuccugaaggaccuggagaagcaguacaacaaggaggagccccaccugagcgagaucggcagcugcuuccugcagaaccaggagggcuucgccaucuacagcgaguacugcaacaaccaccccggcgccugccuggagcuggccaaccugaugaagcagggcaaguacagacacuucuucgaggccugcagacugcugcagcagaugaucgacaucgccaucgacggcuuccugcugacccccgugcagaagaucugcaaguacccccugcagcuggccgagcugcugaaguacaccacccaggagcacggcgacuacagcaacaucaaggccgccuacgaggccaugaagaacguggccugccugaucaacgagagaaagagaaagcuggagagcaucgacaagaucgccagauggcaggugagcaucgugggcugggagggccuggacauccuggacagaagcagcgagcugauccacagcggcgagcugaccaagaucaccaagcagggcaagagccagcagagaaccuucuuccuguucgaccaccagcuggugagcugcaagaaggaccugcugagaagagacaugcuguacuacaagggcagacuggacauggacgagauggagcugguggaccugggcgacggcagagacaaggacugcaaccugagcgugaagaacgccuucaagcuggugagcagaaccaccgacgagguguaccuguucugcgccaagaagcaggaggacaaggccagauggcugcaggccugcgccgacgagagaagaagagugcaggaggacaaggagaugggcauggagaucagcgagaaccagaagaagcuggccaugcugaacgcccagaaggccggccacggcaagagcaagggcuacaacagaugccccguggcccccccccaccagggccugcaccccauccaccagagacacaucaccaugcccaccagcgugccccagcagcagguguucggccuggccgagcccaagagaaagagcagccuguucuggcacaccuucaacagacugacccccuucagaaaguaa

SEQ ID NO: 23914 - RNA, 1710 nt, Artificial Sequence
  SPATA16__Homo_sapiens__NP_114161
auggacgccggcagcagcagaagccuggagaacgccgugaacagaaucuaccacgaccagcuggugcccaagaucaacaccagcaagaagaugagcacccuggcccacccccccaacauccuggagaugagccaggagaucaagaagaacugcggcggcaagcagguggagaucacccuggagagaaccaagaugaccaagggcaucaaggagaagcagagcaacgaccuggagaaggccgccuucaagagaaaggccgagggcgaggagaagcccaccagaaagaagcaggccaagaucaccgagcuggacaaccagcugaucaccaugccccugccccacaucccccugaagaacaucauggacguggagaugaagcugguguacaucgacgagaugggcgugagauacgaguucguggagagcuucaugagcaccggcagccagcccaccugccaggccgccgagaucguggacccccugagcgugcacaacuucagcuuccugccccagaucgacaaguggcugcagguggcccugaaggacgccagcagcugcuacagacagaagaaguacgcccuggccgccggccaguucagaaccgcccuggagcugugcagcaagggcgccgugcugggcgagcccuucgacgcccccgccgaggacaucgccagcguggccagcuucaucgagaccaagcuggugaccugcuaccugagaaugagaaagcccgaccuggcccugaaccacgcccacagaagcaucgugcugaaccccgccuacuucagaaaccaccugagacaggccaccguguucagaugccuggagagauacagcgaggccgccagaagcgccaugaucgccgacuacauguucuggcugggcggcggcagagaggagagcaucagcaagcugaucaagcuguacuggcaggccaugaucgaggaggccaucaccagagccgagagcuucagcgugauguacacccccuucgccaccaagaucagagccgacaagaucgagaaggugaaggacgccuucaccaagacccaccccgccuacgccgaguacauguacaccgaccugcaggcccugcacaugcugccccagaccguggacuggagcagcuuccccccccagcaguaccugcugacccugggcuucaagaacaaggacgacggcaaguuccuggagaagaucagcagcagaaagcugcccaucuucaccgagcacaagacccccuucggccugaccagagaggacaccgugagacagauggagaccaugggcaagagaauccugcccauccuggacuucaucagaagcacccagcugaacggcagcuuccccgccagcagcggcgugauggagaagcugcaguacgccagccugcugagccagcugcagagagugaaggagcagagccaggugaucaaccaggccauggccgagcuggccaccauccccuaccugcaggacaucagccagcaggaggccgagcugcugcagagccugauggccgacgccauggacacccuggagggcagaagaaacaacaacgagagaguguggaacaugauccagaaggugggccagaucgaggacuuccuguaccagcuggaggacagcuuccugaagaccaagaagcugagaaccgccagaagacagaagaccaagaugaagagacugcagaccgugcagcagagauaa

SEQ ID NO: 23915 - RNA, 1086 nt, Artificial Sequence
  SPATA17__Homo_sapiens__XP_005273109
auggccacccuggccagacugcaggccagaagcagcaccgugggcaaccaguacuacuucagaaacagcgugguggaccccuucagaaagaaggagaacgacgccgccgugaagauccagagcugguucagaggcugccaggugagagccuacaucagacaccugaacagaaucgugaccaucauccagaagugguggagaagcuuccugggcagaaagcaguaccagcugaccgugcagguggccuacuacaccaugaugaugaaccuguacaacgccauggccgugagaauccagagaagauggagaggcuacagagugagaaaguaccuguucaacuacuacuaccugaaggaguaccugaagguggugagcgagaccaacgacgccaucagaaaggcccuggaggaguucgccgagaugaaggagagagaggagaagaaggccaaccuggagagagaggagaagaagagagacuaccaggccagaaagaugcacuaccugcugagcaccaagcagauccccggcaucuacaacagccccuucagaaaggagcccgaccccugggagcugcagcugcagaaggccaagccccugacccacagaagacccaaggugaagcagaaggacagcaccagccugaccgacuggcuggccugcaccagcgccagaagcuuccccagaagcgagauccugccccccaucaacagaaagcagugccagggccccuucagagacaucaccgaggugcuggagcagagauacagaccccuggagcccacccugagaguggccgagcccaucgacgagcugaagcuggccagagaggagcugagaagagaggaguggcugcagaacgugaacgacaacauguuccugcccuucagcagcuaccacaagaacgagaaguacauccccagcaugcaccugagcagcaaguacggccccaucagcuacaaggagcaguucagaagcgagaaccccaagaaguggaucugcgacaaggacuuccagaccgugcugcccagcuucgagcuguucagcaaguacggcaagcuguacagcaaggccggccagaucguguaa

SEQ ID NO: 23916 - RNA, 1617 nt, Artificial Sequence
  SPATA18__Homo_sapiens__NP_660306
auggccgagaaccugaagagacuggugagcaacgagacccugagaacccugcaggagaagcuggacuucuggcugaaggaguacaacaccaacaccugcgaccagaaccugaaccacugccuggagcugaucgagcagguggccaaggugcagggccagcuguucggcauccugaccgccgccgcccaggagggcggcagaaacgacggcguggagaccaucaagagcagacugcugcccuggcuggaggccagcuucaccgccgccagccugggcaagagcguggacagcaaggugcccagccugcaggacaccuucgacagagagagacacaaggaccccagccccagagacagagacaugcagcagcuggacagcaaccugaacagcaccagaagccagugcaaccaggugcaggacgaccugguggagaccgagaagaaccuggaggagagcaagaacagaagcgccaucagccugcuggccgccgaggaggagaucaaccagcugaagaagcagcugaagagccugcaggcccaggaggacgccagacacagaaacaccgaccagagaagcagcgagaacagaagaagcgagcccuggagccuggaggagagaaagagagagcaguggaacagccugaagcagaacgccgaccagcaggacaccgaggccaugagcgacuacaagaagcagcugagaaaccugaaggaggagaucgccgugcugagcgccgagaagagcgcccugcagggcagaagcagcagaagcagaagccccagccccgcccccagaagcagaagcugcagcagaagcagaagcgccagccccagcaccgccgugaaggugagaagacccagccccaacagaagcaagcugagcaacguggccagaaaggccgcccugcugagcagauucagcgacagcuacagccaggccagacuggacgcccagugccugcugagaagaugcaucgacaaggccgagaccgugcagagaaucaucuacaucgccaccguggaggccuuccacguggccaagauggccuucagacacuucaagauccacgugagaaagagccugacccccagcuacgugggcagcaacgacuucgagaacgccgugcuggacuacgugaucugccaccuggaccuguacgacagccagagcagcgugaacgacgugaucagagccaugaacgugaaccccaagaucagcuucccccccgugguggacuucugccugcugagcgacuucauccaggagaucugcugcaucgccuucgccaugcaggcccuggagcccccccuggacaucgccuacggcgccgacggcgagguguucaacgacugcaaguacagaagaagcuacgacagcgacuucaccgccccccuggugcuguaccacguguggcccgcccugauggagaacgacugcgugaucaugaagggcgaggccgugaccagaagaggcgccuucuggaacagcgugagaagcgugagcagaugcagaagcagaagccugagccccaucugccccagaagccagaucggccugaacaccaugagcagaagcagaagccccagccccaucagaugcggccugcccagauucuaa

SEQ ID NO: 23917 - RNA, 504 nt, Artificial Sequence
  SPATA19__Homo_sapiens__NP_001278921
augaucaucaccaccuggaucguguacauccuggccagaaagggcgugggccugcccuuccugcccaucaccagcagcgacaucgacgugguggagagcgaggccgugagcgugcugcaccacuggcugaagaagaccgaggaggaggccagcagaggcaucaaggagaagcugagcaucaaccaccccagccagggcgugagagagaagaugagcaccgacagcccccccacccacggccaggacauccacgugaccagagacguggugaagcaccaccugagcaagagcgaccugcuggccaaccagagccaggaggugcuggaggagagaaccagaauccaguucaucagauggagccacaccagaaucuuccaggugcccagcgagaugaccgaggacaucaugagagacagaaucgagcaggugagaagaagcaucagcagacugaccgacgugagcgcccaggacuucagcaugagacccagcagcagcgacugcuaa

SEQ ID NO: 23918 - RNA, 2361 nt, Artificial Sequence
  SPATA20__Homo_sapiens__NP_001245301
augcugggcgccagagccuggcugggcagagugcugcugcugcccagagccggcgccggccuggccgccagcagaagaggcagcagcagcagagacaaggacagaagcgccaccgugagcagcagcgugcccaugcccgccggcggcaagggcagccaccccagcagcaccccccagagagugcccaacagacugauccacgagaagagccccuaccugcugcagcacgccuacaaccccguggacugguaccccuggggccaggaggccuucgacaaggccagaaaggagaacaagcccaucuuccugagcgugggcuacagcaccugccacuggugccacaugauggaggaggagagcuuccagaacgaggagaucggcagacugcugagcgaggacuucgugagcgugaagguggacagagaggagagacccgacguggacaagguguacaugaccuucgugcaggccaccagcagcggcggcggcuggcccaugaacguguggcugacccccaaccugcagcccuucgugggcggcaccuacuucccccccgaggacggccugaccagagugggcuucagaaccgugcugcugagaaucagagagcaguggaagcagaacaagaacacccugcuggagaacagccagagagugaccaccgcccugcuggccagaagcgagaucagcgugggcgacagacagcugccccccagcgccgccaccgugaacaacagaugcuuccagcagcuggacgagggcuacgacgaggaguacggcggcuucgccgaggcccccaaguuccccacccccgugauccugagcuuccuguucagcuacuggcugagccacagacugacccaggacggcagcagagcccagcagauggcccugcacacccugaagaugauggccaacggcggcaucagagaccacgugggccagggcuuccacagauacagcaccgacagacaguggcacgugccccacuucgagaagaugcuguacgaccaggcccagcuggccguggccuacagccaggccuuccagcugagcggcgacgaguucuacagcgacguggccaagggcauccugcaguacguggccagaagccugagccacagaagcggcggcuucuacagcgccgaggacgccgacagcccccccgagagaggccagagacccaaggagggcgccuacuacguguggaccgugaaggaggugcagcagcugcugcccgagcccgugcugggcgccaccgagccccugaccagcggccagcugcugaugaagcacuacggccugaccgaggccggcaacaucagccccagccaggaccccaagggcgagcugcagggccagaacgugcugaccgugagauacagccuggagcugaccgccgccagauucggccuggacguggaggccgugagaacccugcugaacagcggccuggagaagcuguuccaggccagaaagcacagacccaagccccaccuggacagcaagaugcuggccgccuggaacggccugauggugagcggcuacgccgugaccggcgccgugcugggccaggacagacugaucaacuacgccaccaacggcgccaaguuccugaagagacacauguucgacguggccagcggcagacugaugagaaccugcuacaccggccccggcggcaccguggagcacagcaacccccccugcuggggcuuccuggaggacuacgccuucguggugagaggccugcuggaccuguacgaggccagccaggagagcgccuggcuggagugggcccugagacugcaggacacccaggacaagcuguucugggacagccagggcggcggcuacuucugcagcgaggccgagcugggcgccggccugccccugagacugaaggacgaccaggacggcgccgagcccagcgccaacagcgugagcgcccacaaccugcugagacugcacggcuucaccggccacaaggacuggauggacaagugcgugugccugcugaccgccuucagcgagagaaugagaagagugcccguggcccugcccgagauggugagagcccugagcgcccagcagcagacccugaagcagaucgugaucugcggcgacagacaggccaaggacaccaaggcccuggugcagugcgugcacagcguguacauccccaacaaggugcugauccuggccgacggcgaccccagcagcuuccugagcagacagcugcccuuccugagcacccugagaagacuggaggaccaggccaccgccuacgugugcgagaaccaggccugcagcgugcccaucaccgaccccugcgagcugagaaagcugcugcaccccuaa

SEQ ID NO: 23919 - RNA, 2088 nt, Artificial Sequence
  SPATA21__Homo_sapiens__XP_011539714
auggacaacagaaacacccagauguacaccgagggcagaaccaaggcccccggcacccagcccagccccggccugagaaucaccaucaagagagccggcguggagcccaucauccccggcgugagcaaggugauguuccccgacgccagcgaggugggcagcaagaagcaccugagcagcgccagcagaggccccgagaagggccccagacugagagacgccuucgagaagggccccagcgagcugagaauccaggagcagggcccccccgccagacccggcaagaagcagcccagcugggugccccaggagggcagccaggagcugcaggccggccaggaccagagcgagcugggccugcugcccagcugggugcccgaggugcccgagggccugcagcagcugggcagcggcaaggagaucaagggccagcagggcagacagagaaacagaggcaucggcgaggaccagccccccgagagcugccagggcagcggcuaccagagcacccccagccaccaggccgacauggugcagcccgccgagcccugcugcagacuggccagccacggccagccccugggcggcaagcaccccaaggaggccggcgugccccacaucagaccccaggaggccccccccgagcccagccccggcggccacggcgacagcagccaggaggccaugccccccaugagcgugguggcccccgaggagaagaccgugaaccccuuccugcccagcacccccggccccaagaaggccaagggcggcggcgaggccguggagacccaccccgcccccggcccccugcccccccccgaggugagagacaucggcgagagaagagagcccgacagagcccagcagcagccccagaagcccgccguggccgccggcacccagagccugggcaacuucagacagggcuucaugaagugccugcuggagguggagaagauggaggccagccacagaagagccagcaaggccagaagccagaccgcccagaagagccccagaacccugacccccgugcccaccagcgcccccagccugccccagacccccgccagcgugcccgccagcggccccagcugggccagacugcccgcccccggccccgagcccgcccccaugggcgcccccgugcccaccagcaugcccugccccgugcugcugggccccgcccuggaccugggcuggagaagaauggagcugcugcaccagagcagcgagagaacccugagcuacgccaaggccagacaggagcccgaggagcagagccugcagaagcuguaccagaacagagagaagagcgaggagcagcugacccugaagcaggaggaggccuucagaagcuacuucgagaucuucaacggccccggcgagguggacgcccagagccugaagaacauccugcugcugaugggcuucagcgugacccuggcccagguggaggacgcccugaugagcgccgacgugaacggcgacggcagaguggacuucaaggacuuccuggccgugaugaccgacaccagaagauucuucugcagcguggagcagaacgcccugagcgacauggccccccacaacccccacacccugcuguucgagauccugagccugcugguggagaugcuggcccugcccgaggccgugcuggaggagaucaccaacuacuaccagaagaagcugaaggagggcaccugcaaggcccaggagauggaggccgccgugggcagacugagacugcagaagcugcccuacaacccccagcaggaggagagcagcgaggugcccgagagaaaggugcugagcauccugagcagacugaagcagcagaacuacgcccccaaccugcagagccccuacgcccaggugcccugcauccugcugugcccccagcuggacaagaagauggugagaagacagcccagcaaccacuacgcccuggaccagugcaccccccccggccuggaccccgacaucagaagccccuucuuccagagcggcagccagggcaacagagagcacaacagcgacagcagaaaguggcugagcagcgugcccgccagaacccacuaa

SEQ ID NO: 23920 - RNA, 1092 nt, Artificial Sequence
  SPATA22__Homo_sapiens__NP_001164166
augaagagaagccugaacgagaacagcgccagaagcaccgccggcugccugcccgugccccuguucaaccagaagaagagaaacagacagccccugaccagcaacccccugaaggacgacagcggcaucagcacccccagcgacaacuacgacuuccccccccugcccaccgacugggccugggaggccgugaaccccgagcuggcccccgugaugaagaccguggacaccggccagaucccccacagcgugagcagaccccugagaagccaggacagcguguucaacagcauccagagcaacaccggcagaagccagggcggcuggagcuacagagacggcaacaagaacaccagccugaagaccuggaacaagaacgacuucaagccccagugcaagagaaccaaccugguggccaacgacggcaagaacagcugccccgugagcagcggcgcccagcagcagaagcagcugagaauccccgagccccccaaccugagcagaaacaaggagaccgagcugcugagacagacccacagcagcaagaucagcggcugcaccaugagaggccuggacaagaacagcgcccugcagacccugaagcccaacuuccagcagaaccaguacaagaagcagaugcuggacgacauccccgaggacaacacccugaaggagaccagccuguaccagcugcaguucaaggagaaggccagcagccugagaaucaucagcgccgugaucgagagcaugaaguacuggagagagcacgcccagaagaccgugcugcuguucgaggugcuggccgugcuggacagcgccgugacccccggccccuacuacagcaagaccuuccugaugagagacggcaagaacacccugcccugcguguucuacgagaucgacagagagcugcccagacugaucagaggcagagugcacagaugcgugggcaacuacgaccagaagaagaacaucuuccagugcgugagcgugagacccgccagcgugagcgagcagaagaccuuccaggccuucgugaagaucgccgacguggagaugcaguacuacaucaacgugaugaacgagaccuaa

SEQ ID NO: 23921 - RNA, 684 nt, Artificial Sequence
  SPATA25__Homo_sapiens__NP_542175
augagcuacuucagaaccccccagacccaccccggcccccugcccagcggccagggcggcgccgccagccccggccugagccugggccugugcagccccguggagcccguggugguggccagcggcggcaccggcccccugagccagaaggccgagcagguggcccccgccgcccaggccuggggccccgcccuggccaugccccaggccagaggcugccccggcggcaccagcugggagacccugagaaaggaguacagcagaaacugccacaaguucccccacgugagacagcuggagagccugggcugggacaacggcuacagcagaagcagagcccccgaccugggcggccccagcagacccagaccccugaugcugugcggccugagccccagagugcugcccgugcccagcgaggccgugggcaaggaggccagcagccagcccgacaucugcauccugacccuggccaugaugaucgccggcauccccaccgugcccgugcccggcgugagagaggaggaccugaucugggccgcccaggccuucaugauggcccaccccgagcccgagggcgccguggagggcgccagaugggagcaggcccacgcccacaccgccagcggcaagaugccccuggugagaagcaagagaggccagccccccggcagcugccuguaa

SEQ ID NO: 23922 - RNA, 1563 nt, Artificial Sequence
  SPATA2__Homo_sapiens__NP_001129245
augggcaagcccagcagcauggacaccaaguucaaggacgaccuguucagaaaguacgugcaguuccacgagagcaagguggacaccaccaccagcagacagagacccggcagcgacgagugccugagaguggccgccagcacccugcugagccugcacaagguggaccccuucuacagauucagacugauccaguucuacgaggugguggagagcagccugagaagccugagcagcagcagccugagagcccugcacggcgccuucagcaugcuggagaccgugggcaucaaccuguuccuguaccccuggaagaaggaguucagaagcaucaagaccuacaccggccccuucguguacuacgugaagagcacccugcuggaggaggacaucagagccauccugagcugcaugggcuacacccccgagcugggcaccgccuacaagcugagagagcugguggagacccugcaggugaagauggugagcuucgagcuguuccuggccaagguggagugcgagcagaugcuggagauccacagccaggugaaggacaagggcuacagcgagcuggacaucgugagcgagagaaagagcagcgccgaggacgugagaggcugcagcgacgcccugagaagaagagccgagggcagagagcaccugaccgccagcaugagcagaguggcccugcagaagagcgccagcgagagagccgccaaggacuacuacaagcccagagugaccaagcccagcagaagcguggacgccuacgacagcuacugggagagcagaaagcccccccugaaggccagccugagccugagaaaggagcccguggccaccgacgugggcgacgaccugaaggacgagaucaucagacccagccccagccugcugaccauggccagcagcccccacggcagccccgacgugcugccccccgccagccccagcaacggccccgcccugcugagaggcaccuacuucagcacccaggacgacguggaccuguacaccgacagcgagcccagagccaccuacagaagacaggacgcccugagacccgacguguggcugcugagaaacgacgcccacagccuguaccacaagagaagcccccccgccaaggagagcgcccugagcaagugccagagcugcggccugagcugcagcagcagccugugccagagaugcgacagccugcugaccugcccccccgccagcaagcccagcgccuuccccagcaaggccagcacccacgacagccuggcccacggcgccagccugagagagaaguaccccggccagacccagggccuggacagacugccccaccugcacagcaagagcaagcccagcaccacccccaccagcagaugcggcuucugcaacagacccggcgccaccaacaccugcacccagugcagcaaggugagcugcgacgccugccugagcgccuaccacuacgaccccugcuacaagaagagcgagcugcacaaguucaugcccaacaaccagcugaacuacaagagcacccagcugagccaccugguguacagauaa

SEQ ID NO: 23923 - RNA, 2682 nt, Artificial Sequence
  SPATA5__Homo_sapiens__NP_660208
augagcagcaagaagaacagaaagagacugaaccagagcgccgagaacggcagcagccugcccagcgccgccagcagcugcgccgaggccagagcccccagcgccggcagcgacuucgccgccaccagcggcacccugaccgugaccaaccugcuggagaagguggacgacaagauccccaagaccuuccagaacagccugauccaccugggccugaacaccaugaagagcgccaacaucugcaucggcagacccgugcugcugaccagccugaacggcaagcaggagguguacaccgccuggcccauggccggcuuccccggcggcaaggugggccugagcgagauggcccagaagaacgugggcgugagacccggcgacgccauccaggugcagccccuggugggcgccgugcugcaggccgaggagauggacguggcccugagcgacaaggacauggagaucaacgaggaggagcugaccggcugcauccugagaaagcuggacggcaagaucgugcugcccggcaacuuccuguacugcaccuucuacggcagacccuacaagcugcaggugcugagagugaagggcgccgacggcaugauccugggcggcccccagagcgacagcgacaccgacgcccagagaauggccuucgagcagagcagcauggagaccagcagccuggagcugagccugcagcugagccagcuggaccuggaggacacccagauccccaccagcagaagcacccccuacaagcccaucgacgacagaaucaccaacaaggccagcgacgugcugcuggacgugacccagagccccggcgacggcagcggccugaugcuggaggaggugaccggccugaagugcaacuucgagagcgccagagagggcaacgagcagcugaccgaggaggagagacugcugaaguucagcaucggcgccaagugcaacaccgacaccuucuacuucaucagcagcaccaccagagugaacuucaccgagaucgacaagaacagcaaggagcaggacaaccaguucaaggugaccuacgacaugaucggcggccugagcagccagcugaaggccaucagagagaucaucgagcugccccugaagcagcccgagcuguucaagagcuacggcauccccgcccccagaggcgugcugcuguacggcccccccggcaccggcaagaccaugaucgccagagccguggccaacgaggugggcgccuacgugagcgugaucaacggccccgagaucaucagcaaguucuacggcgagaccgaggccaagcugagacagaucuucgccgaggccacccugagacaccccagcaucaucuucaucgacgagcuggacgcccugugccccaagagagagggcgcccagaacgagguggagaagagagugguggccagccugcugacccugauggacggcaucggcagcgaggugagcgagggccaggugcuggugcugggcgccaccaacagaccccacgcccuggacgccgcccugagaagacccggcagauucgacaaggagaucgagaucggcgugcccaacgcccaggacagacuggacauccugcagaagcugcugagaagagugccccaccugcugaccgaggccgagcugcugcagcuggccaacagcgcccacggcuacgugggcgccgaccugaaggugcugugcaacgaggccggccugugcgcccugagaagaauccugaagaagcagcccaaccugcccgacgugaagguggccggccuggugaagaucacccugaaggacuuccugcaggccaugaacgacaucagacccagcgccaugagagagaucgccaucgacgugcccaacgugagcuggagcgacaucggcggccuggagagcaucaagcugaagcuggagcaggccguggaguggccccugaagcaccccgagagcuucaucagaaugggcauccagccccccaagggcgugcugcuguacggcccccccggcugcagcaagaccaugaucgccaaggcccuggccaacgagagcggccugaacuuccuggccaucaagggccccgagcugaugaacaaguacgugggcgagagcgagagagccgugagagagaccuucagaaaggccagagccguggcccccagcaucaucuucuucgacgagcuggacgcccuggccguggagagaggcagcagccugggcgccggcaacguggccgacagagugcuggcccagcugcugaccgagauggacggcaucgagcagcugaaggacgugaccauccuggccgccaccaacagacccgacagaaucgacaaggcccugaugagacccggcagaaucgacagaaucaucuacgugccccugcccgacgccgccaccagaagagagaucuucaagcugcaguuccacagcaugcccgugagcaacgagguggaccuggacgagcugauccugcagaccgacgccuacagcggcgccgagaucguggccgugugcagagaggccgcccugcuggcccuggaggaggacauccaggccaaccugaucaugaagagacacuucacccaggcccugagcaccgugacccccagaauccccgagagccugagaagauucuacgaggacuaccaggagaagagcggccugcacacccuguaa

SEQ ID NO: 23924 - RNA, 1704 nt, Artificial Sequence
  SPATA7__Homo_sapiens__NP_001035518
auggacggcagcagaagagugagagccaccagcgugcugcccagauacggcccccccugccuguucaagggccaccugagcaccaagagcaacgccgccguggacugcagcgugcccgugagcgugagcaccagcaucaaguacgccgaccagcagagaagagagaagcugaagaaggagcuggcccagugcgagaaggaguucaagcugaccaagaccgccaugagagccaacuacaagaacaacagcaagagccuguucaacacccugcagaagcccagcggcgagccccagaucgaggacgacaugcugaaggaggagaugaacggcuucagcagcuucgccagaagccuggugcccagcagcgagagacugcaccugagccugcacaagagcagcaaggugaucaccaacggccccgagaagaacagcagcagcagccccagcagcguggacuacgccgccagcggccccagaaagcugagcagcggcgcccuguacggcagaagacccagaagcaccuuccccaacagccacagauuccagcuggugaucagcaaggcccccagcggcgaccugcuggacaagcacagcgagcuguucagcaacaagcagcugcccuucacccccagaacccugaagaccgaggccaagagcuuccugagccaguacagauacuacacccccgccaagagaaagaaggacuucaccgaccagagaaucgaggccgagacccagaccgagcugagcuucaagagcgagcugggcaccgccgagaccaagaacaugaccgacagcgagaugaacaucaagcaggccagcaacugcgugaccuacgacgccaaggagaagaucgccccccugccccuggagggccacgacagcaccugggacgagaucaaggacgacgcccugcagcacagcagccccagagccaugugccaguacagccugaagccccccagcaccagaaagaucuacagcgacgaggaggagcugcuguaccugagcuucaucgaggacgugaccgacgagauccugaagcugggccuguucagcaacagauuccuggagagacuguucgagagacacaucaagcagaacaagcaccuggaggaggagaagaugagacaccugcugcacgugcugaagguggaccugggcugcaccagcgaggagaacagcgugaagcagaacgacguggacaugcugaacguguucgacuucgagaaggccggcaacagcgagcccaacgagcugaagaacgagagcgaggugaccauccagcaggagagacagcaguaccagaaggcccuggacaugcugcugagcgcccccaaggacgagaacgagaucuuccccagccccaccgaguucuucaugcccaucuacaagagcaagcacagcgagggcgugaucauccagcaggugaacgacgagaccaaccuggagaccagcacccuggacgagaaccaccccagcaucagcgacagccugaccgacagagagaccagcgugaacgugaucgagggcgacagcgaccccgagaagguggagaucagcaacggccugugcggccugaacaccagccccagccagagcgugcaguucagcagcgugaagggcgacaacaaccacgacauggagcugagcacccugaagaucauggagaugagcaucgaggacugcccccuggacguguaa

SEQ ID NO: 23925 - RNA, 318 nt, Artificial Sequence
  SPATA8__Homo_sapiens__NP_775770
auggcccccgccggcaugagcggcgcccaggacaacagcugccuguaccaggagaucgcccccagcuuccagagacugcccugccccagaaccagcagcagacacuucagcgaggccaugaccugccccugcggcuggagacccuucaagggcggccccggcggccugaagggccccguguggcccgccaaggaggagaacagcugcagccacggcagaauccagagagugcagagaagaagagugcccagcgccagcccccugauccagaagaucaacagaagaagcgugcuguuccaccccuacugcuggagcuaa

SEQ ID NO: 23926 - RNA, 765 nt, Artificial Sequence
  SPATA9__Homo_sapiens__NP_114158
augcccaucaagcccgugggcuggaucugcggccaggugcugaagaacuucagcggcagaaucgagggcauccagaaggccaucauggaccugguggacgaguucaaggacgaguuccccaccauccugagacugagccagagcaaccagaagagagagcccgcccagaagaccagcaagaucagaauggccaucgcccuggccaagaucaacagagccacccugaucagaggccugaacagcaucagcagaagcagcaagagcguggccaagcugcugcacccccagcuggccugcagacugcuggagcugagagacaucagcggcagacugcugagagaggugaacgcccccagacagccccuguacaacauccaggugagaaagggcagccuguucgagaucaucagcuuccccgccaagaccgcccugaccagcaucaucuacgccagcuacgccgcccugaucuaccuggccgugugcgugaacgccgugcugaagaaggugaagaacaucuuccaggaggaggagagcaucagacagaacagagaggagagcgagaacugcagaaaggccuucagcgagcccgugcugagcgagcccauguucgccgagggcgagaucaaggccaagcccuacagaagccugcccgagaagcccgacaucagcgacuaccccaagcugcuggccaacaagcagagcaacaacauccaggugcugcacagcguguucgaccagagcgccgagaugaacgagcagaucuaa

SEQ ID NO: 23927 - RNA, 1326 nt, Artificial Sequence
  SPATC1__Homo_sapiens__NP_001127846
augagccugcugaccaacuacgagggccugagacaccagaucgagagacuggugagagagaacgaggagcugaagaagcuggugagacugaucagagagaaccacgagcugaagagcgccaucaagacccaggccggcggccugggcaucagcggcuucaccagcggccugggcgaggccaccgccggccugagcagcagacagaacaacggcguguuccugccccccagccccgccguggccaacgagagagugcuggaggaggugggcaucauggcccuggccccccuggccgagaugcugaccagccugcagcccagcgccacccccggcagccugaugagcccccugaccggcacccugagcacccugcugagcggccccgcccccaccagccagagcagcccccugaccagcuuccugaccagccccaucgccggcccccugaccggcacccuggccagcagccugggccugcccagcaccggcacccugacccccagcagccugguggccggccccguggccaugagccagagcagcccccugaucgcccccgugaugggcaccguggccgugagccugagcagcccccugcugagcagcaccgccaccccccccggcgugagccagaaccugcuggccaaccccaugagcaaccuggugcugcccgaggcccccagacugagacuggccgagccccugagaggcggccccaccggcccccagagccccgccugcguggugcccaccgccaccaccaaggugccccugagcaccgagcccccccagagcacccaggaccccgagccccugagcauggccuucgccggcgccccccugcagaccagcacccccaucggcgccaugggcacccccgcccccaagaccgccuucagcuucaacaccagcgacacccaggcccagcccagcgccgcccaggagcagguggugcccgccagcgugcccaccagccccaccaccagccccaccgugaccgugcuggccagcgcccccgcccuggccccccagguggccaccagcuacacccccagcagcaccacccacaucgcccagggcgccccccacccccccagcagaaugcacaacagccccacccagaaccugcccgugccccacugccccccccacaacgcccacagcccccccagaaccagcagcagccccgccagcgugaacgacagcagaggccccagaaccaccgagcccagcaccaagagcaugauggagguggagagaaagcuggcccacagaaagaccagcaaguuccccgagaaccccagaggcuuccccgagccccaguaa

SEQ ID NO: 23928 - RNA, 594 nt, Artificial Sequence
  SPC24__Homo_sapiens__NP_872319
auggccgccuucagagacaucgaggaggugagccagggccugcugagccugcugggcgccaacagagccgaggcccagcagagaagacugcugggcagacacgagcaggugguggagagacugcuggagacccaggacggcgccgagaagcagcugagagagauccugaccauggagaaggagguggcccagagccugcugaacgccaaggagcaggugcaccagggcggcguggagcugcagcagcuggaggccggccugcaggaggccggcgaggaggacaccagacugaaggccagccugcugcagcugaccagagagcuggaggagcugaaggagaucgaggccgaccuggagagacaggagaaggagguggacgaggacaccaccgugaccauccccagcgccguguacguggcccagcuguaccaccaggugagcaagaucgagugggacuacgagugcgagcccggcauggugaagggcauccaccacggccccagcguggcccagcccauccaccuggacagcacccagcugagcagaaaguucaucagcgacuaccuguggagccugguggacaccgagugguaa

SEQ ID NO: 23929 - RNA, 675 nt, Artificial Sequence
  SPC25__Homo_sapiens__NP_065726
augguggaggacgagcuggcccuguucgacaagagcaucaacgaguucuggaacaaguucaagagcaccgacaccagcugccagauggccggccugagagacaccuacaaggacagcaucaaggccuucgccgagaagcugagcgugaagcugaaggaggaggagagaaugguggagauguuccuggaguaccagaaccagaucagcagacagaacaagcugauccaggagaagaaggacaaccugcugaagcugaucgccgaggugaagggcaagaagcaggagcuggaggugcugaccgccaacauccaggaccugaaggaggaguacagcagaaagaaggagaccaucagcaccgccaacaaggccaacgccgagagacugaagagacugcagaagagcgccgaccuguacaaggacagacugggccuggagaucagaaagaucuacggcgagaagcugcaguucaucuucaccaacaucgaccccaagaaccccgagagccccuucauguucagccugcaccugaacgaggccagagacuacgaggugagcgacagcgccccccaccuggagggccuggccgaguuccaggagaacgugagaaagaccaacaacuucagcgccuuccuggccaacgugagaaaggccuucaccgccaccguguacaacuaa

SEQ ID NO: 23930 - RNA, 543 nt, Artificial Sequence
  SPCS3__Homo_sapiens__NP_068747
augaacaccgugcugagcagagccaacagccuguucgccuucagccugagcgugauggccgcccugaccuucggcugcuucaucaccaccgccuucaaggacagaagcgugcccgugagacugcacgugagcagaaucaugcugaagaacguggaggacuucaccggccccagagagagaagcgaccugggcuucaucaccuucgacaucaccgccgaccuggagaacaucuucgacuggaacgugaagcagcuguuccuguaccugagcgccgaguacagcaccaagaacaacgcccugaaccagguggugcugugggacaagaucgugcugagaggcgacaaccccaagcugcugcugaaggacaugaagaccaaguacuucuucuucgacgacggcaacggccugaagggcaacagaaacgugacccugacccugagcuggaacguggugcccaacgccggcauccugccccuggugaccggcagcggccacgugagcgugcccuuccccgacaccuacgagaucaccaagagcuacuaa

SEQ ID NO: 23931 - RNA, 960 nt, Artificial Sequence
  SPDEF__Homo_sapiens__NP_001239223
augggcagcgccagccccggccugagcagcgugagccccagccaccugcugcugccccccgacaccgugagcagaaccggccuggagaaggccgccgccggcgccgugggccuggagagaagagacuggagccccagcccccccgccacccccgagcagggccugagcgccuucuaccugagcuacuucgacaugcuguaccccgaggacagcagcugggccgccaaggcccccggcgccagcagcagagaggagccccccgaggagcccgagcagugccccgugaucgacagccaggcccccgccggcagccuggaccuggugcccggcggccugacccuggaggagcacagccuggagcaggugcagagcaugguggugggcgaggugcugaaggacaucgagaccgccugcaagcugcugaacaucaccgccgaccccauggacuggagccccagcaacgugcagaaguggcugcuguggaccgagcaccaguacagacugccccccaugggcaaggccuuccaggagcuggccggcaaggagcugugcgccaugagcgaggagcaguucagacagagaagcccccugggcggcgacgugcugcacgcccaccuggacaucuggaagagcgccagcaccagcgaggagagcuggaccgacagcgagguggacagcagcugcagcggccagcccauccaccuguggcaguuccugaaggagcugcugcugaagccccacagcuacggcagauucaucagauggcugaacaaggagaagggcaucuucaagaucgaggacagcgcccagguggccagacuguggggcaucagaaagaacagacccgccaugaacuacgacaagcugagcagaagcaucagacaguacuacaagaagggcaucaucagaaagcccgacaucagccagagacugguguaccaguucgugcaccccaucuaa

SEQ ID NO: 23932 - RNA, 1818 nt, Artificial Sequence
  SPDL1__Homo_sapiens__NP_060255
auggaggccgacaucaucaccaaccugagaugcagacugaaggaggccgaggaggagagacugaaggccgcccaguacggccugcagcugguggagagccagaacgagcugcagaaccagcuggacaagugcagaaacgagaugaugaccaugaccgagagcuacgagcaggagaaguacacccugcagagagagguggagcugaagagcagaaugcuggagagccugagcugcgagugcgaggccaucaagcagcagcagaagaugcaccuggagaagcuggaggagcagcugagcagaagccacggccaggaggugaacgagcugaagaccaagaucgagaagcugaagguggagcuggacgaggccagacugagcgagaagcagcugaagcaccagguggaccaccagaaggagcugcugagcugcaagagcgaggagcugagagugaugagcgagagagugcaggagagcaugagcagcgagaugcuggcccugcagaucgagcugaccgagauggagagcaugaagaccacccugaaggaggaggugaacgagcugcaguacagacaggagcagcuggagcugcugaucaccaaccugaugagacagguggacagacugaaggaggagaaggaggagagagagaaggaggccgugagcuacuacaacgcccuggagaaggccagaguggccaaccaggaccugcaggugcagcuggaccaggcccugcagcaggcccuggaccccaacagcaagggcaacagccuguucgccgagguggaggacagaagagccgccauggagagacagcugaucagcaugaaggugaaguaccagagccugaagaagcagaacguguucaacagagagcagaugcagagaaugaagcugcagaucgccacccugcugcagaugaagggcagccagaccgaguucgagcagcaggagagacugcuggccaugcuggagcagaagaacggcgagaucaagcaccugcugggcgagaucagaaaccuggagaaguucaagaaccuguacgacagcauggagagcaagcccagcguggacagcggcacccuggaggacaacaccuacuacaccgaccugcugcagaugaagcuggacaaccugaacaaggagaucgagagcaccaagggcgagcugagcauccagagaaugaaggcccuguucgagagccagagagcccuggacaucgagagaaagcuguucgccaacgagagaugccugcagcugagcgagagcgagaacaugaagcugagagccaagcuggacgagcugaagcugaaguacgagcccgaggagaccguggaggugcccgugcugaagaagagaagagaggugcugcccguggacaucaccaccgccaaggacgccugcgugaacaacagcgcccugggcggcgagguguacagacugcccccccagaaggaggagacccagagcugccccaacagccuggaggacaacaaccugcagcuggagaagagcgugagcaucuacacccccguggugagccugagcccccacaagaaccugcccguggacaugcagcugaagaaggagaagaagugcgugaagcugaucggcgugcccgccgacgccgaggcccugagcgagagaagcggcaacacccccaacagccccagacuggccgccgagagcaagcugcagaccgaggugaaggagggcaaggagaccagcagcaagcuggagaaggagaccugcaagaagcugcaccccauccuguacgugagcagcaagagcacccccgagacccagugcccccagcaguaa

SEQ ID NO: 23933 - RNA, 861 nt, Artificial Sequence
  SPDYA__Homo_sapiens__NP_001008779
augagacacaaccagaugugcugcgagaccccccccaccgugaccguguacgugaagagcggcagcaacagaagccaccagcccaagaagcccaucacccugaagagacccaucugcaaggacaacuggcaggccuucgagaagaacacccacaacaacaacaagagcaagagacccaagggccccugccuggugauccagagacaggacaugaccgccuucuucaagcuguucgacgacgaccugauccaggacuuccuguggauggacugcugcugcaagaucgccgacaaguaccugcuggccaugaccuucguguacuucaagagagccaaguucaccaucagcgagcacaccagaaucaacuucuucaucgcccuguaccuggccaacaccguggaggaggacgaggaggagaccaaguacgagaucuuccccugggcccugggcaagaacuggagaaagcuguuccccaacuuccugaagcugagagaccagcugugggacagaaucgacuacagagccaucgugagcagaagaugcugcgaggaggugauggccaucgcccccacccacuacaucuggcagagagagagaagcgugcaccacagcggcgccgugagaaacuacaacagagacgaggugcagcugcccagaggccccagcgccacccccguggacugcagccugugcggcaagaagagaagauacgugagacugggccugagcagcagcagcagccugagcagccacaccgccggcgugaccgagaagcacagccaggacagcuacaacagccugagcauggacaucaucggcgaccccagccaggccuacaccggcagcgagggcaugaucuaa

SEQ ID NO: 23934 - RNA, 2130 nt, Artificial Sequence
  SPECC1__Homo_sapiens__NP_001028726
augggcaaccacagcggcagacccgaggaccccgagcccggcgccuucaccaccaccaagagaaccggcauccccgcccccagagaguucagcgugaccgugagcagagagagaagcgugcccagaggccccagcaaccccagaaagagcgugagcagccccaccagcagcaacacccccacccccaccaagcaccugagaacccccagcaccaagcccaagcaggagaacgagggcggcgagaaggccgcccuggagagccaggugagagagcugcuggccgaggccaaggccaaggacagcgagaucaacagacugagaagcgagcugaagaaguacaaggagaagagaacccugaacgccgagggcaccgacgcccugggccccaacguggacggcaccagcgugagccccggcgacaccgagcccaugaucagagcccuggaggagaagaacaagaacuuccagaaggagcugagcgaccuggaggaggagaacagagugcugaaggagaagcugaucuaccuggagcacagccccaacagcgagggcgccgccagccacaccggcgacagcagcugccccaccagcaucacccaggagagcagcuucggcagccccaccggcaaccagaugagcagcgacaucgacgaguacaagaagaacauccacggcaacgcccugagaaccagcggcagcagcagcagcgacgugaccaaggccagccugagccccgacgccagcgacuucgagcacaucaccgccgagacccccagcagaccccugagcagcaccagcaaccccuucaagagcagcaagugcagcaccgccggcagcagccccaacagcgugagcgagcugagccuggccagccugaccgagaagauccagaagauggaggagaaccaccacagcaccgccgaggagcugcaggccacccugcaggagcugagcgaccagcagcagauggugcaggagcugaccgccgagaacgagaagcugguggacgagaagaccauccuggagaccagcuuccaccagcacagagagagagccgagcagcugagccaggagaacgagaagcugaugaaccugcugcaggagagagugaagaacgaggagcccaccacccaggagggcaagaucaucgagcuggagcagaagugcaccggcauccuggagcagggcagauucgagagagagaagcugcugaacauccagcagcagcugaccugcagccugagaaagguggaggaggagaaccagggcgcccuggagaugaucaagagacugaaggaggagaacgagaagcugaacgaguuccuggagcuggagagacacaacaacaacaugauggccaagacccuggaggagugcagagugacccuggagggccugaagauggagaacggcagccugaagagccaccugcagggcgagaagcagaaggccaccgaggccagcgccguggagcagaccgccgagagcugcgaggugcaggagaugcugaagguggccagagccgagaaggaccugcuggagcugagcugcaacgagcugagacaggagcugcugaaggccaacggcgagaucaagcacgugagcagccugcuggccaagguggagaaggacuacagcuaccugaaggagaucugcgaccaccaggccgagcagcugagcagaaccagccugaagcugcaggagaaggccagcgagagcgacgccgagaucaaggacaugaaggagaccaucuucgagcuggaggaccagguggagcagcacagagccgugaagcugcacaacaaccagcugaucagcgagcuggagagcagcgugaucaagcuggaggagcagaagagcgaccuggagagacagcugaagacccugaccaagcagaugaaggaggagaccgaggaguggagaagauuccaggccgaccugcagaccgccguggugguggccaacgacaucaagugcgaggcccagcaggagcugagaaccgugaagagaaagcugcuggaggaggaggagaagaacgccagacugcagaaggagcugggcgacgugcagggccacggcagaguggugaccagcagagccgccccccccagccugggcagcgugagcuaa

SEQ ID NO: 23935 - RNA, 3354 nt, Artificial Sequence
  SPECC1L__Homo_sapiens__NP_001138940
augaagaaggccagcagaagcgugggcagcgugcccaaggugagcgccaucagcaagacccagaccgccgagaagaucaagcccgagaacagcagcagcgccagcaccggcggcaagcuggugaagcccggcaccgccgccagccugagcaagaccaagagcagcgacgaccugcuggccggcauggccggcggcgugaccgugaccaacggcgugaagggcaagaagagcaccugccccagcgccgcccccagcgccagcgcccccgccaugaccaccguggagaacaagagcaagaucagcaccggcaccgccagcagcaccaagagaagcaccagcaccggcaacaaggagagcagcagcaccagagagagacugagagagagaaccagacugaaccagagcaagaagcugcccagcgccggccagggcgccaacgacauggcccuggccaagagaagcagaagcagaaccgccaccgagugcgacgugagaaugagcaagagcaagagcgacaaccagaucagcgacagagccgcccuggaggccaaggugaaggaccugcugacccuggccaagaccaaggacguggagauccugcaccugagaaacgagcugagagacaugagagcccagcugggcaucaacgaggaccacagcgagggcgacgagaagagcgagaaggagaccaucauggcccaccagcccaccgacguggagagcacccugcugcagcugcaggagcagaacaccgccaucagagaggagcugaaccagcugaagaacgagaacagaaugcugaaggacagacugaacgcccugggcuucagccuggagcagagacuggacaacagcgagaagcuguucggcuaccagagccugagccccgagaucacccccggcaaccagagcgacggcggcggcacccugaccagcagcguggagggcagcgcccccggcagcguggaggaccugcugagccaggacgagaacacccugauggaccaccagcacagcaacagcauggacaaccuggacagcgagugcagcgagguguaccagccccugaccagcagcgacgacgcccuggacgcccccagcagcagcgagagcgagggcauccccagcaucgagagaagcagaaagggcagcagcggcaacgccagcgaggugagcguggccugccugaccgagagaauccaccagauggaggagaaccagcacagcaccagcgaggagcugcaggccacccugcaggagcuggccgaccugcagcagaucacccaggagcugaacagcgagaacgagagacugggcgaggagaaggugauccugauggagagccugugccagcagagcgacaagcuggagcacuucagcagacagaucgaguacuucagaagccugcuggacgagcaccacaucagcuacgugaucgacgaggacgugaagagcggcagauacauggagcuggagcagagauacauggaccuggccgagaacgccagauucgagagagagcagcugcugggcgugcagcagcaccugagcaacacccugaagauggccgagcaggacaacaaggaggcccaggagaugaucggcgcccugaaggagagaagccaccacauggagagaaucaucgagagcgagcagaagggcaaggccgcccuggccgccacccuggaggaguacaaggccaccguggccagcgaccagaucgagaugaacagacugaaggcccagcuggagaacgagaagcagaagguggccgagcuguacagcauccacaacagcggcgacaagagcgacauccaggaccugcuggagagcgugagacuggacaaggagaaggccgagacccuggccagcagccugcaggaggaccuggcccacaccagaaacgacgccaacagacugcaggacgccaucgccaagguggaggacgaguacagagccuuccaggaggaggccaagaagcagaucgaggaccugaacaugacccuggagaagcugagaagcgaccuggacgagaaggagaccgagagaagcgacaugaaggagaccaucuucgagcuggaggacgagguggagcagcacagagccgugaagcugcacgacaaccugaucaucagcgaccuggagaacaccgugaagaagcugcaggaccagaagcacgacauggagagagagaucaagacccugcacagaagacugagagaggagagcgccgaguggagacaguuccaggccgaccugcagaccgccguggugaucgccaacgacaucaagagcgaggcccaggaggagaucggcgaccugaagagaagacugcacgaggcccaggagaagaacgagaagcugaccaaggagcuggaggagaucaagagcagaaagcaggaggaggagagaggcagaguguacaacuacaugaacgccguggagagagaccuggccgcccugagacagggcaugggccugagcagaagaagcagcaccagcagcgagcccacccccaccgugaagacccugaucaagagcuucgacagcgccagccaggugcccaaccccgccgccgccgccauccccagaaccccccugagccccagccccaugaagaccccccccgccgccgccgugagccccaugcagagacacagcaucagcggccccaucagcaccagcaagccccugaccgcccugagcgacaagagacccaacuacggcgagauccccgugcaggagcaccugcugagaaccagcagcgccagcagacccgccagccugcccagagugcccgccauggagagcgccaagacccugagcgugagcagaagaagcagcgaggagaugaagagagacaucagcgcccaggagggcgccagccccgccagccugauggccaugggcaccaccagcccccagcugagccugagcagcagccccaccgccagcgugacccccaccaccagaagcagaaucagagaggagagaaaggacccccugagcgcccuggccagagaguacggcggcagcaagagaaacgcccugcugaaguggugccagaagaagaccgagggcuaccagaacaucgacaucaccaacuucagcagcagcuggaacgacggccuggccuucugcgcccugcugcacaccuaccugcccgcccacauccccuaccaggagcugaacagccaggacaagagaagaaacuucaugcuggccuuccaggccgccgagagcgugggcaucaagagcacccuggacaucaacgagauggugagaaccgagagacccgacuggcagaacgugaugcuguacgugaccgccaucuacaaguacuucgagaccuaa

SEQ ID NO: 23936 - RNA, 5469 nt, Artificial Sequence
  SPEF2__Homo_sapiens__NP_079143
augagcgagauccugugccaguggcugaacaaggagcugaaggugagcagaaccgugagccccaagagcuucgccaaggccuucagcagcggcuaccugcugggcgaggugcugcacaaguucgagcugcaggacgacuucagcgaguuccuggacagcagagugagcagcgccaagcugaacaacuucagcagacuggagcccacccugaaccugcugggcgugcaguucgaccagaacguggcccacggcaucaucaccgagaagcccggcguggccaccaagcugcuguaccagcuguacaucgcccugcagaagaagaagaagagcggccugaccggcguggagaugcagaccaugcagagacugaccaaccugagacugcagaacaugaagagcgacaccuuccaggagagacugagacacaugauccccagacagaccgacuucaaccugaugagaaucaccuacagauuccaggagaaguacaagcacgugaaggaggaccuggcccaccugcacuucgagaagcuggagagauuccagaagcugaaggaggagcagagaugcuucgacaucgagaagcaguaccugaacagaagaagacagaacgagaucauggccaagauccaggccgccaucauccagauccccaagcccgccagcaacagaacccugaaggcccuggaggcccagaagaugaugaagaagaagaaggaggccgaggacguggccgacgagaucaagaaguucgaggcccugaucaagaaggaccugcaggccaaggagagcgccagcaagaccagccuggacaccgccggccagaccaccaccgaccugcugaacaccuacagcgacgacgaguacaucaagaagauccagaagagacuggaggaggacgccuucgccagagagcagagagagaagagaagaagaaagcugcugauggaccagcugaucgcccacgaggcccaggaggaggccuacagagaggagcagcugaucaacagacugaugagacagagccagcaggagagaagaaucgccgugcagcugaugcacgugagacacgagaaggaggugcuguggcagaacagaaucuucagagagaagcagcacgaggagagaagacugaaggacuuccaggacgcccuggacagagaggccgcccuggccaagcaggccaagaucgacuucgaggagcaguuccugaaggagaagagauuccacgaccagaucgccguggagagagcccaggccagauacgagaagcacuacagcgugugcgccgagauccuggaccagaucguggaccugagcaccaagguggccgacuacagaaugcugaccaacaaccugauccccuacaagcugaugcacgacuggaaggagcuguucuucaacgccaagcccaucuacgagcaggccagcgugaagacccugcccgccaaccccagcagagagcagcugaccgagcuggagaagagagaccugcuggacaccaacgacuacgaggaguacaagaacauggugggcgagugggcccugcccgaggagaugguggacaaccugccccccagcaacaacugcauccugggccacauccugcacagacuggccgagaagagccugccccccagagccgagagcaccacccccgagcugcccagcuucgccgugaagggcugccugcugggcaagacccugagcggcaagaccaccauccugagaagccugcagaaggacuuccccauccagauccugagcaucgacacccuggugcaggaggccauccaggccuuccacgacaacgagaaggugagcgaggugcugcccauccagaagaacgacgaggaggacgcccugcccgugcugcaggaggagaucaaggagagccaggacccccagcacguguucagcgccggccccgugagcgacgaggugcugcccgagaccgagggcgagaccaugcugagcgccaacgccgacaagacccccaaggccgaggaggugaagagcagcgacagcuuccugaagcugaccaccagagcccagcugggcgccaagagcgagcagcugcugaagaagggcaagagcauccccgacgugcugcugguggacaucaucgugaacgccaucaacgagauccccgugaaccaggacugcauccuggacggcuuccccaugacccugaaccaggcccagcugcuggaggaggcccugaccggcugcaacagaaaccugaccgagguggagagaaagaaggcccagaagagcacccuggccaucgaccccgccaccagcaaggagaucccccugcccagccccgccuucgacuucgugauccugcuggacgugagcgacaccagcagcaugagcagaaugaacgacaucaucgccgaggagcugagcuacaagaccgcccacgaggacaucagccagagaguggccgccgagaaccaggacaaggacggcgaccagaaccugagagaccagauccagcacagaaucaucggcuuccuggacaacuggccccugcuggagcagugguucagcgagcccgagaacauccugaucaagaucaacgccgagaucgacaaggagagccugugcgagaaggugaaggagauccugaccaccgagaucgccaagaagaagaacaagguggagaagaagcuggaggagaaggaggccgagaagaaggccgccgccagccuggccgagcugccccugcccacccccccccccgcccccccccccgagcccgagaaggagaaggagauccaccagagccacguggccagcaagacccccaccgccaagggcaagccccagagcgaggccccccacggcaagcaggagagccugcaggagggcaagggcaagaagggcgagaccgcccugaagagaaagggcagccccaagggcaagagcagcggcggcaaggugcccgugaagaagagccccgccgacagcaccgacaccagccccguggccaucgugccccagccccccaagcccggcagcgaggaguggguguacgugaacgagcccgugcccgaggagaugccccuguuccuggugcccuacugggagcugaucgagaacagcuacaucaacaccaucaagaccgugcugagacaccugagagaggaccagcacaccgugcuggccuaccuguacgagaucagaaccagcuuccaggaguuccugaagagacccgaccacaagcaggacuucguggcccaguggcaggccgacuucaacagccugcccgacgaccugugggacgacgaggagaccaaggccgagcugcaccagagagugaacgaccugagagacagacugugggacaucugcgacgccagaaaggaggaggccgagcaggagagacuggacaucaucaacgagagcuggcugcaggacacccugggcaugaccaugaaccacuucuucagccugaugcaggccgagcugaacagauuccaggacaccaagagacugcugcaggacuacuacuggggcauggagagcaagauccccguggaggacaacaagagauucaccagaaucccccuggugcagcuggacagcaaggacaacagcgagagccagcugagaaucccccuggugcccagaaucagcaucagccuggagaccgugacccccaagcccaagaccaagagcgugcugaagggcaagauggacaacagccuggagaacguggagagcaacuucgaggccgacgagaagcuggugauggacaccuggcagcaggccagccuggccgugagccacaugguggccgccgagauccaccagagacugauggaggaggagaaggagaaccagcccgccgaccccaaggagaagagcccccagaugggcgccaacaagaaggugaagaaggagccccccaagaagaagcaggaggacaagaagcccaagggcaagagcccccccauggccgaggccacccccgugaucgugaccaccgaggagaucgccgagaucaagagaaagaacgagcugagagugaagaucaaggaggagcaccuggccgcccugcaguucgaggagaucgccacccaguucagacuggagcugaucaagaccaaggcccuggcccugcuggaggaccuggugaccaaggugguggacguguacaagcugauggagaaguggcugggcgagagauaccugaacgagauggccagcaccgagaagcugaccgacguggccagauaccacaucgagaccagcaccaagauccagaacgagcuguaccugagccaggaggacuucuucaucaacggcaacaucaagguguuccccgaccccccccccagcaucagacccccccccguggagaaggaggaggacggcacccugaccaucgagcagcuggacagccugagagaccaguuccuggacauggcccccaagggcaucaucggcaacaaggccuucaccgacauccugaucgaccuggugacccugaaccugggcaccaacaacuuccccagcaacuggaugcaccugacccagcccgagcugcaggagcugaccagccugcugaccgugaacagcgaguucguggacuggagaaaguuccugcuggugaccagcaugcccuggcccaucccccuggaggaggagcugcuggagacccugcagaaguucaaggccguggacaaggagcagcugggcaccaucaccuucgagcaguacaugcaggccggccugugguucaccggcgacgaggacaucaagauccccgagaacccccuggagccccugcccuucaacagacaggagcaccugaucgaguucuucuucagacuguucgccgacuacgagaaggaccccccccagcuggacuacacccagaugcugcuguacuucgccugccaccccgacaccguggagggcguguacagagcccugagcguggccgugggcacccacguguuccagcaggugaaggccagcauccccagcgccgagaagaccagcagcaccgacgccggccccgccgaggaguuccccgagcccgaggagaacgccgccagagaggagagaaagcugaaggacgacaccgagaagagagagcagaaggacgaggagauccccgagaacgccaacaacgagaagaugagcauggagacccugcugaagguguucaagggcggcagcgaggcccaggacagcaacagauucgccagccaccugaagaucgagaacaucuacgccgagggcuucaucaagaccuuccaggaccugggcgccaagaaccuggagcccaucgagguggccgugcugcugaagcaccccuucauccaggaccugaucagcaacuacagcgacuacaaguuccccgacaucaagaucauccugcagagaagcgagcacgugcagggcagcgacggcgagagaagccccagcagacacaccgaggagaagaaguaa

SEQ ID NO: 23937 - RNA, 342 nt, Artificial Sequence
  SPEG__Homo_sapiens__NP_001166947
augaagcccagccccagccagaacagaagaagcagcgacaccggcagcaaggccccccccaccuucaaggugagccugauggaccagagcgugagagagggccaggacgugaucaugagcaucagagugcagggcgagcccaagcccguggugagcuggcugagaaacagacagcccgugagacccgaccagagaagauucgccgaggaggccgagggcggccugugcagacugagaauccuggccgccgagagaggcgacgccggcuucuacaccugcaaggccgugaacgaguacggcgccagacagugcgaggccagacuggaggugagaggcgaguaa

SEQ ID NO: 23938 - RNA, 1053 nt, Artificial Sequence
  SPESP1__Homo_sapiens__NP_663633
augaagccccuggugcugcugguggcccugcugcuguggcccagcagcgugcccgccuaccccagcaucaccgugacccccgacgaggagcagaaccugaaccacuacauccaggugcuggagaaccuggugagaagcgugcccagcggcgagcccggcagagagaagaagagcaacagccccaagcacguguacagcaucgccagcaagggcagcaaguucaaggagcuggugacccacggcgacgccagcaccgagaacgacgugcugaccaaccccaucagcgaggagaccaccaccuuccccaccggcggcuucacccccgagaucggcaagaagaagcacaccgagagcacccccuucuggagcaucaagcccaacaacgugagcaucgugcugcacgccgaggagcccuacaucgagaacgaggagcccgagcccgagcccgagcccgccgccaagcagaccgaggcccccagaaugcugcccguggugaccgagagcagcaccagccccuacgugaccagcuacaagagccccgugaccacccuggacaagagcaccggcaucggcaucagcaccgagagcgaggacgugccccagcugagcggcgagaccgccaucgagaagcccgaggaguucggcaagcaccccgagagcuggaacaacgacgacauccugaagaagauccuggacaucaacagccaggugcagcaggcccugcugagcgacaccagcaaccccgccuacagagaggacaucgaggccagcaaggaccaccugaagagaagccuggcccuggccgccgccgccgagcacaagcugaagaccauguacaagagccagcugcugcccgugggcagaaccagcaacaagaucgacgacaucgagaccgugaucaacaugcugugcaacagcagaagcaagcuguacgaguaccuggacaucaagugcgugccccccgagaugagagagaaggccgccaccguguucaacacccugaagaacaugugcagaagcagaagagugaccgcccugcugaagguguacuaa

SEQ ID NO: 23939 - RNA, 6993 nt, Artificial Sequence
  SPG11__Homo_sapiens__NP_001153699
auggccgccgaggagggcguggccagcgccgccagcgccggcggcagcuggggcaccgccgccaugggcagagugcugcccaugcugcuggugcccgugcccgccgaggccaugggccagcugggcagcagagcccagcugagaacccagcccgaggcccugggcagccugaccgccgccggcagccugcaggugcugagccugacccccggcagcagaggcggcggcagaugcugccuggagggccccuucuggcacuuccugugggaggacagcagaaacagcagcacccccaccgagaagcccaagcugcuggcccugggcgagaacuacgagcugcugaucuacgaguucaaccugaaggacggcagaugcgacgccaccauccuguacagcugcagcagagaggcccugcagaagcugaucgacgaccaggacaucagcaucagccugcugagccugagaauccugagcuuccacaacaacaccagccugcuguucaucaacaagugcgugauccugcacaucaucuuccccgagagagacgccgccaucagagugcugaacugcuucacccugccccugcccgcccaggccguggacaugaucaucgacacccagcugugcagaggcauccuguucgugcugagcagccugggcuggaucuacaucuucgacgugguggacggcaccuacguggcccacguggaccuggcccugcacaaggaggacaugugcaacgagcagcagcaggagcccgccaagaucagcagcuucaccagccugaaggugagccaggaccuggacguggccgugaucgugagcagcagcaacagcgccguggcccugaaccugaaccuguacuucagacagcaccccggccaccugcugugcgagagaauccuggaggaccugcccauccagggccccaagggcguggacgaggacgaccccgugaacagcgccuacaacaugaagcuggccaaguucagcuuccagaucgacagaagcuggaaggcccagcugagcagccugaacgagaccaucaagaacagcaagcuggaggugagcugcugcgcccccugguuccaggacauccugcaccuggagagccccgagagcggcaaccacagcaccagcgugcagagcugggccuucaucccccaggacaucaugcacggccaguacaacgugcugcagaaggaccacgccaagaccagcgaccccggcagaagcuggaagaucaugcacaucagcgagcaggaggagcccaucgagcugaagugcgugagcgugaccggcuucaccgcccuguucaccugggagguggagagaaugggcuacaccaucacccugugggaccuggagacccagggcaugcagugcuucagccugggcaccaagugcauccccguggacagcagcggcgaccagcagcugugcuucgugcugaccgagaacggccugagccugauccuguucggccugacccaggaggaguuccugaacagacugaugauccacggcagcgccagcaccguggacacccugugccaccugaacggcuggggcagaugcagcauccccauccacgcccuggaggccggcaucgagaacagacagcuggacaccgugaacuucuuccugaagagcaaggagaaccuguucaaccccagcagcaagagcagcgugagcgaccaguucgaccaccugagcagccaccuguaccugagaaacguggaggagcugauccccgcccuggaccugcugugcagcgccaucagagagagcuacagcgagccccagagcaagcacuucagcgagcagcugcugaaccugacccugagcuuccugaacaaccagaucaaggagcuguucauccacaccgaggagcuggacgagcaccugcagaagggcgugaacauccugaccagcuacaucaacgagcugagaaccuucaugaucaaguuccccuggaagcugaccgacgccaucgacgaguacgacgugcacgagaacgugcccaaggugaaggagagcaacaucuggaagaagcugagcuucgaggaggugaucgccagcgccauccugaacaacaagauccccgaggcccagaccuucuucagaaucgacagccacagcgcccagaagcuggaggagcugaucggcaucggccugaaccugguguucgacaaccugaagaagaacaacaucaaggaggccagcgagcugcugaagaacaugggcuucgacgugaagggccagcugcugaagaucugcuucuacaccaccaacaagaacaucagagacuuccugguggagauccugaaggagaagaacuacuucagcgagaaggagaagagaaccaucgacuucgugcaccagguggagaagcuguaccugggccacuuccaggagaacaugcagauccagagcuuccccagauacuggaucaaggagcaggacuucuucaagcacaagagcgugcuggacagcuuccugaaguacgacugcaaggacgaguucaacaagcaggaccacagaaucgugcugaacugggcccuguggugggaccagcugacccaggagagcauccugcugcccagaaucagccccgaggaguacaagagcuacagccccgaggcccuguggagauaccugaccgccagacacgacuggcugaacaucauccuguggaucggcgaguuccagacccagcacagcuacgccagccugcagcagaacaaguggccccugcugaccguggacgugaucaaccagaacaccagcugcaacaacuacaugagaaacgagauccuggacaagcuggccagaaacggcguguuccuggccagcgagcuggaggacuucgagugcuuccugcugagacugagcagaaucggcggcgugauccaggacacccugcccgugcagaacuacaagaccaaggagggcugggacuuccacagccaguucauccuguacugccuggagcacagccugcagcaccugcuguacguguaccuggacugcuacaagcugagccccgagaacugccccuuccuggagaagaaggagcugcacgaggcccaccccugguucgaguuccuggugcagugcagacagguggccagcaaccugaccgaccccaagcugaucuuccaggccagccuggccaacgcccagauccugauccccaccaaccaggccagcgugagcagcaugcugcuggagggccacacccugcuggcccuggccaccaccauguacagccccggcggcgugagccagguggugcagaacgaggagaacgagaacugccugaagaagguggacccccagcugcugaagauggcccugacccccuaccccaagcugaagaccgcccuguucccccagugcaccccccccagcgugcugcccagcgacaucaccaucuaccaccugauccagagccugagccccuucgaccccagcagacuguucggcuggcagagcgccaacacccuggccaucggcgacgccuggagccaccugccccacuucagcagccccgaccuggugaacaaguacgccaucguggagagacugaacuucgccuacuaccugcacaacggcagacccagcuucgccuucggcaccuuccuggugcaggagcugaucaagagcaagacccccaagcagcugauccagcaggugggcaacgaggccuacgugaucggccugagcagcuuccacauccccagcaucggcgccgccugcgugugcuuccuggagcugcugggccuggacagccugaagcugagaguggacaugaagguggccaacaucauccugagcuacaagugcagaaacgaggacgcccaguacagcuucaucagagagagcguggccgagaagcugagcaagcuggccgacggcgagaagaccaccaccgaggagcugcuggugcugcuggaggagggcaccuggaacagcauccagcagcaggagaucaagagacugagcagcgagagcagcagccagugggcccugguggugcaguucugcagacugcacaacaugaagcugagcaucagcuaccugagagagugcgccaaggccaacgacuggcugcaguucaucauccacagccagcugcacaacuaccaccccgccgaggugaagagccugauccaguacuucagccccgugauccaggaccaccugagacuggccuucgagaaccugcccagcgugcccaccagcaagauggacagcgaccaggugugcaacaagugcccccaggagcugcagggcagcaagcaggagaugaccgaccuguucgagauccugcugcagugcagcgaggagcccgacagcuggcacuggcugcugguggaggccgugaagcagcaggcccccauccugagcgugcuggccagcugccugcagggcgccagcgccaucagcugccugugcguguggaucaucaccagcguggaggacaacguggccaccgaggccaugggccacauccaggacagcaccgaggaccacaccuggaaccuggaggaccugagcgugaucuggagaacccugcugaccagacagaagagcaagacccugaucagaggcuuccagcuguucuucaaggacagcccccugcugcuggugauggagauguacgagcugugcauguucuucagaaacuacaaggaggccgaggccaagcugcuggaguuccagaagagccuggagacccugaacaccgccgccaccaaggugcaccccgugauccccgccauguggcuggaggaccaggugugcuuccugcugaagcugaugcugcagcagugcaagacccaguacgagcugggcaagcugcugcagcuguucguggagagagagcaccuguucagcgacggccccgacgugaagaagcugugcauccugugccagauccugaaggacaccagcaucgccaucaaccacaccaucaucaccagcuacagcaucgagaaccugcagcacgagugcagaagcauccuggagagacugcagaccgacggccaguucgcccuggccagaagaguggccgagcuggccgagcugcccguggacaaccuggugaucaaggagaucacccaggagaugcagacccugaagcacaucgagcaguggagccugaagcaggccagaaucgacuucuggaagaagugccacgagaacuucaagaagaacagcaucagcagcaaggccgccagcagcuucuucagcacccaggcccacguggccugcgagcaccccaccggcuggagcagcauggaggagagacaccugcugcugacccuggccggccacuggcuggcccaggaggacguggugccccuggacaagcuggaggagcuggagaagcagaucuggcugugcagaaucacccagcacacccugggcagaaaccaggaggagaccgagcccagauucagcagacagaucagcaccagcggcgagcugagcuucgacagccuggccagcgaguucagcuucagcaagcuggccgcccugaacaccagcaaguaccuggagcugaacagccugcccagcaaggagaccugcgagaacagacuggacuggaaggagcaggagagccugaacuuccugaucggcagacugcuggacgacggcugcgugcacgaggccagcagagugugcagauacuuccacuucuacaaccccgacguggcccuggugcugcacugcagagcccuggccagcggcgaggccagcauggaggaccugcaccccgagauccacgcccugcugcagagcgccgagcugcuggaggaggaggcccccgacaucccccugagaagagugcacagcagacacaagcagauguucaaccccaccgaggagagccagaccuuccugcagcugaccacccugugccaggacagaacccuggugggcaugaagcugcuggacaagaucagcagcgugccccacggcgagcugagcugcaccaccgagcugcugauccuggcccaccacugcuucacccugaccugccacauggagggcaucaucagagugcugcaggccgcccacaugcugaccgacaaccaccuggcccccagcgaggaguacggccugguggugagacugcugaccggcaucggcagauacaacgagaugaccuacaucuucgaccugcugcacaagaagcacuacuucgaggugcugaugagaaagaagcuggaccccagcggcacccugaagaccgcccugcuggacuacaucaagagaugcagacccggcgacagcgagaagcacaacaugaucgcccugugcuucagcaugugcagagagaucggcgagaaccacgaggccgccgccagaauccagcugaagcugaucgagagccagcccugggaggacagccugaaggacggccaccagcugaagcagcugcugcugaaggcccugacccugaugcuggacgccgccgagagcuacgccaaggacagcugcgugagacaggcccagcacugccagagacugaccaagcugaucacccugcagauccacuuccugaacaccggccagaacaccaugcugaucaaccugggcagacacaagcugauggacugcauccuggcccugcccagauucuaccaggccagcaucguggccgaggccuacgacuucgugcccgacugggccgagauccuguaccagcaggugauccugaagggcgacuucaacuaccuggaggaguucaagcagcagagacugcugaagagcagcaucuucgaggagaucagcaagaaguacaagcagcaccagcccaccgacauggugauggagaaccugaagaagcugcugaccuacugcgaggacguguaccuguacuacaagcuggccuacgagcacaaguucuacgagaucgugaacgugcugcugaaggacccccagaccggcugcugccugaaggacaugcuggccggcuaa

SEQ ID NO: 23940 - RNA, 2001 nt, Artificial Sequence
  SPG20__Homo_sapiens__NP_055902
auggagcaggagccccagaacggcgagcccgccgagaucaagaucaucagagaggccuacaagaaggccuuccuguucgugaacaagggccugaacaccgacgagcugggccagaaggaggaggccaagaacuacuacaagcagggcaucggccaccugcugagaggcaucagcaucagcagcaaggagagcgagcacaccggccccggcugggagagcgccagacagaugcagcagaagaugaaggagacccugcagaacgugagaaccagacuggagauccuggagaagggccuggccaccagccugcagaacgaccugcaggaggugcccaagcuguaccccgaguucccccccaaggacaugugcgagaagcugcccgagccccagagcuucagcagcgccccccagcacgccgaggugaacggcaacaccagcacccccagcgccggcgccguggccgcccccgccagccugagccugcccagccagagcugccccgccgaggccccccccgccuacaccccccaggccgccgagggccacuacaccgugagcuacggcaccgacagcggcgaguucagcagcgugggcgaggaguucuacagaaaccacagccagccccccccccuggagacccugggccuggacgccgacgagcugauccugauccccaacggcgugcagaucuucuucgugaaccccgccggcgaggugagcgcccccagcuaccccggcuaccugagaaucgugagauuccuggacaacagccuggacaccgugcugaacagaccccccggcuuccugcaggugugcgacuggcuguacccccuggugcccgacagaagccccgugcugaagugcaccgccggcgccuacauguuccccgacaccaugcugcaggccgccggcugcuucgugggcguggugcugagcagcgagcugcccgaggacgacagagagcuguucgaggaccugcugagacagaugagcgaccugagacugcaggccaacuggaacagagccgaggaggagaacgaguuccagauccccggcagaaccagacccagcagcgaccagcugaaggaggccagcggcaccgacgugaagcagcuggaccagggcaacaaggacgugagacacaagggcaagagaggcaagagagccaaggacaccagcagcgaggaggugaaccugagccacaucgugcccugcgagcccgugcccgaggagaagcccaaggagcugcccgaguggagcgagaagguggcccacaacauccugagcggcgccagcugggugagcuggggccuggugaagggcgccgagaucaccggcaaggccauccagaagggcgccagcaagcugagagagagaauccagcccgaggagaagcccguggaggugagccccgccgugaccaagggccuguacaucgccaagcaggccaccggcggcgccgccaaggugagccaguuccugguggacggcgugugcaccguggccaacugcgugggcaaggagcuggccccccacgugaagaagcacggcagcaagcuggugcccgagagccugaagaaggacaaggacggcaagagcccccuggacggcgccauggugguggccgccagcagcgugcagggcuucagcaccguguggcagggccuggagugcgccgccaagugcaucgugaacaacgugagcgccgagaccgugcagaccgugagauacaaguacggcuacaacgccggcgaggccacccaccacgccguggacagcgccgugaacgugggcgugaccgccuacaacaucaacaacaucggcaucaaggccauggugaagaagaccgccacccagaccggccacacccugcuggaggacuaccagaucguggacaacagccagagagagaaccaggagggcgccgccaacgugaacgugagaggcgagaaggacgagcagaccaaggaggugaaggaggccaagaagaaggacaaguaa

SEQ ID NO: 23941 - RNA, 846 nt, Artificial Sequence
  SPG21__Homo_sapiens__NP_001121362
augggcgagaucaaggugagccccgacuacaacugguucagaggcaccgugccccugaagaagaucaucguggacgacgacgacagcaagaucuggagccuguacgacgccggccccagaagcaucagaugcccccugaucuuccugccccccgugagcggcaccgccgacguguucuucagacagauccuggcccugaccggcuggggcuacagagugaucgccgugcaccuguucggcgccagccugggcggcuuccuggcccagaaguucgccgaguacacccacaagagccccagagugcacagccugauccugugcaacagcuucagcgacaccagcaucuucaaccagaccuggaccgccaacagcuucuggcugaugcccgccuucaugcugaagaagaucgugcugggcaacuucagcagcggccccguggaccccaugauggccgacgccaucgacuucaugguggacagacuggagagccugggccagagcgagcuggccagcagacugacccugaacugccagaacagcuacguggagccccacaagaucagagacauccccgugaccaucauggacguguucgaccagagcgcccugagcaccgaggccaaggaggagauguacaagcuguaccccaacgccagaagagcccaccugaagaccggcggcaacuuccccuaccugugcagaagcgccgaggugaaccuguacgugcagauccaccugcugcaguuccacggcaccaaguacgccgccaucgaccccagcauggugagcgccgaggagcuggaggugcagaagggcagccugggcaucagccaggaggagcaguaa

SEQ ID NO: 23942 - RNA, 2388 nt, Artificial Sequence
  SPG7__Homo_sapiens__NP_003110
auggccgugcugcugcugcugcugagagcccugagaagaggccccggccccggccccagaccccuguggggccccggccccgccuggagccccggcuuccccgccagacccggcagaggcagacccuacauggccagcagaccccccggcgaccuggccgaggccggcggcagagcccugcagagccugcagcugagacugcugacccccaccuucgagggcaucaacggccugcugcugaagcagcaccuggugcagaaccccgugagacuguggcagcugcugggcggcaccuucuacuucaacaccagcagacugaagcagaagaacaaggagaaggacaagagcaagggcaaggcccccgaggaggacgaggaggagagaagaagaagagagagagacgaccagauguacagagagagacugagaacccugcuggugaucgccguggugaugagccugcugaacgcccugagcaccagcggcggcagcaucagcuggaacgacuucgugcacgagaugcuggccaagggcgaggugcagagagugcagguggugcccgagagcgacgugguggagguguaccugcaccccggcgccgugguguucggcagacccagacuggcccugauguacagaaugcagguggccaacaucgacaaguucgaggagaagcugagagccgccgaggacgagcugaacaucgaggccaaggacagaauccccgugagcuacaagagaaccggcuucuucggcaacgcccuguacagcgugggcaugaccgccgugggccuggccauccugugguacguguucagacuggccggcaugaccggcagagagggcggcuucagcgccuucaaccagcugaagauggccagauucaccaucguggacggcaagaugggcaagggcgugagcuucaaggacguggccggcaugcacgaggccaagcuggaggugagagaguucguggacuaccugaagagccccgagagauuccugcagcugggcgccaaggugcccaagggcgcccugcugcugggcccccccggcugcggcaagacccugcuggccaaggccguggccaccgaggcccaggugcccuuccuggccauggccggccccgaguucguggaggugaucggcggccugggcgccgccagagugagaagccuguucaaggaggccagagccagagcccccugcaucguguacaucgacgagaucgacgccgugggcaagaagagaagcaccaccaugagcggcuucagcaacaccgaggaggagcagacccugaaccagcugcugguggagauggacggcaugggcaccaccgaccacgugaucgugcuggccagcaccaacagagccgacauccuggacggcgcccugaugagacccggcagacuggacagacacguguucaucgaccugcccacccugcaggagagaagagagaucuucgagcagcaccugaagagccugaagcugacccagagcagcaccuucuacagccagagacuggccgagcugacccccggcuucagcggcgccgacaucgccaacaucugcaacgaggccgcccugcacgccgccagagagggccacaccagcgugcacacccugaacuucgaguacgccguggagagagugcuggccggcaccgccaagaagagcaagauccugagcaaggaggagcagaaggugguggccuuccacgagagcggccacgcccuggugggcuggaugcuggagcacaccgaggccgugaugaaggugagcaucacccccagaaccaacgccgcccugggcuucgcccagaugcugcccagagaccagcaccuguucaccaaggagcagcuguucgagagaaugugcauggcccugggcggcagagccagcgaggcccugagcuucaacgaggugaccagcggcgcccaggacgaccugagaaaggugaccagaaucgccuacagcauggugaagcaguucggcauggcccccggcaucggccccaucagcuuccccgaggcccaggagggccugaugggcaucggcagaagacccuucagccagggccugcagcagaugauggaccacgaggccagacugcugguggccaaggccuacagacacaccgagaaggugcugcaggacaaccuggacaagcugcaggcccuggccaacgcccugcuggagaaggaggugaucaacuacgaggacaucgaggcccugaucggcccccccccccacggccccaagaagaugaucgccccccagagauggaucgacgcccagagagagaagcaggaccugggcgaggaggagaccgaggagacccagcagcccccccugggcggcgaggagcccaccuggcccaaguaa

SEQ ID NO: 23943 - RNA, 1197 nt, Artificial Sequence
  SPHK1__Homo_sapiens__NP_068807
auggaccccguggugggcugcggcagaggccuguucggcuucguguucagcgccggcggccccagaggcgugcugcccagacccugcagagugcuggugcugcugaaccccagaggcggcaagggcaaggcccugcagcuguucagaagccacgugcagccccugcuggccgaggccgagaucagcuucacccugaugcugaccgagagaagaaaccacgccagagagcuggugagaagcgaggagcugggcagaugggacgcccugguggugaugagcggcgacggccugaugcacgagguggugaacggccugauggagagacccgacugggagaccgccauccagaagccccugugcagccugcccgccggcagcggcaacgcccuggccgccagccugaaccacuacgccggcuacgagcaggugaccaacgaggaccugcugaccaacugcacccugcugcugugcagaagacugcugagccccaugaaccugcugagccugcacaccgccagcggccugagacuguucagcgugcugagccuggccuggggcuucaucgccgacguggaccuggagagcgagaaguacagaagacugggcgagaugagauucacccugggcaccuuccugagacuggccgcccugagaaccuacagaggcagacuggccuaccugcccgugggcagagugggcagcaagacccccgccagccccgugguggugcagcagggccccguggacgcccaccuggugccccuggaggagcccgugcccagccacuggaccguggugcccgacgaggacuucgugcuggugcuggcccugcugcacagccaccugggcagcgagauguucgccgcccccaugggcagaugcgccgccggcgugaugcaccuguucuacgugagagccggcgugagcagagccaugcugcugagacuguuccuggccauggagaagggcagacacauggaguacgagugccccuaccugguguacgugcccgugguggccuucagacuggagcccaaggacggcaagggcguguucgccguggacggcgagcugauggugagcgaggccgugcagggccaggugcaccccaacuacuucuggauggugagcggcugcguggagcccccccccagcuggaagccccagcagaugcccccccccgaggagccccuguaa

SEQ ID NO: 23944 - RNA, 1788 nt, Artificial Sequence
  SPHK2__Homo_sapiens__NP_001191087
augaacggccaccuggaggccgaggagcagcaggaccaggcccugcacauccagagacugagacccaagcccgaggccagacccagaggcggccuggugccccuggccgaggugagcggcugcugcacccugagaagcagaagccccagcgacagcgccgccuacuucugcaucuacaccuaccccagaggcagaagaggcgccagaagaagagccaccagaaccuucagagccgacggcgccgccaccuacgaggagaacagagccgaggcccagagaugggccaccgcccugaccugccugcugagaggccugccccugcccggcgacggcgagaucacccccgaccugcugcccagaccccccagacugcugcugcuggugaaccccuucggcggcagaggccuggccuggcaguggugcaagaaccacgugcugcccaugaucagcgaggccggccugagcuucaaccugauccagaccgagagacagaaccacgccagagagcuggugcagggccugagccugagcgagugggacggcaucgugaccgugagcggcgacggccugcugcacgaggugcugaacggccugcuggacagacccgacugggaggaggccgugaagaugcccgugggcauccugcccugcggcagcggcaacgcccuggccggcgccgugaaccagcacggcggcuucgagcccgcccugggccuggaccugcugcugaacugcagccugcugcugugcagaggcggcggccacccccuggaccugcugagcgugacccuggccagcggcagcagaugcuucagcuuccugagcguggccuggggcuucgugagcgacguggacauccagagcgagagauucagagcccugggcagcgccagauucacccugggcaccgugcugggccuggccacccugcacaccuacagaggcagacugagcuaccugcccgccaccguggagcccgccagccccacccccgcccacagccugcccagagccaagagcgagcugacccugacccccgaccccgccccccccauggcccacagcccccugcacagaagcgugagcgaccugccccugccccugccccagcccgcccuggccagccccggcagccccgagccccugcccauccugagccugaacggcggcggccccgagcuggccggcgacuggggcggcgccggcgacgccccccugagccccgacccccugcugagcagcccccccggcagccccaaggccgcccugcacagccccgugagcgagggcgcccccgugaucccccccagcagcggccugccccugcccacccccgacgccagagugggcgccagcaccugcggcccccccgaccaccugcugcccccccugggcaccccccugccccccgacugggugacccuggagggcgacuucgugcugaugcuggccaucagccccagccaccugggcgccgaccugguggccgccccccacgccagauucgacgacggccuggugcaccugugcugggugagaagcggcaucagcagagccgcccugcugagacuguuccuggccauggagagaggcagccacuucagccugggcugcccccagcugggcuacgccgccgccagagccuucagacuggagccccugacccccagaggcgugcugaccguggacggcgagcagguggaguacggcccccugcaggcccagaugcaccccggcaucggcacccugcugaccggcccccccggcugccccggcagagagcccuaa

SEQ ID NO: 23945 - RNA, 5103 nt, Artificial Sequence
  SPHKAP__Homo_sapiens__NP_001136116
auggacggcaacagccugcugagcgugcccagcaaccuggagagcagcagaauguacgacgugcuggagccccagcagggcagaggcugcggcagcagcggcagcggccccggcaacagcaucaccgccugcaagaaggugcugagaagcaacagccugcuggagagcaccgacuacuggcugcagaaccagagaaugcccugccagaucggcuucguggaggacaagagcgagaacugcgccagcgugugcuucgugaaccuggacgugaacaaggacgagugcagcaccgagcaccugcagcagaagcuggugaacgugagccccgaccugcccaagcugaucagcagcaugaacgugcagcagcccaaggagaacgagaucguggugcugagcggccuggccagcggcaaccugcaggccgacuucgaggugagccagugccccuggcugcccgacaucugccuggugcagugcgccagaggcaacagacccaacagcaccaacugcaucaucuucgagaucaacaaguuccugaucggccuggagcuggugcaggagagacagcugcaccuggagaccaacauccugaagcuggaggacgacaccaacugcagccugagcagcaucgaggaggacuuccugaccgccagcgagcaccuggaggaggagagcgagguggacgagagcagaaacgacuacgagaacaucaacgugagcgccaacgugcuggagagcaagcagcugaagggcgccacccagguggaguggaacugcaacaaggagaaguggcuguacgcccuggaggacaaguacaucaacaaguaccccaccccccugaucaagaccgagagaagccccgagaaccugaccaagaacaccgcccugcagagccuggaccccagcgccaagcccagccaguggaagagagaggccgugggcaacggcagacaggccacccacuacuaccacagcgaggccuucaagggccagauggagaagagccaggcccuguacauccccaaggacgccuacuucagcaugauggacaaggacgugcccagcgccugcgccguggccgagcagagaagcaaccugaaccccggcgaccacgaggacaccagaaacgcccugccccccagacaggacggcgaggugaccaccggcaaguacgccaccaaccuggccgagagcgugcugcaggacgccuucaucagacugagccagagccagagcacccugccccaggagagcgccgugagcgugagcgugggcagcagccugcugcccagcugcuacagcaccaaggacaccguggugagcagaagcuggaacgagcugcccaagaucgugguggugcagagccccgacggcagcgacgccgccccccagcccggcaucagcagcuggcccgagauggaggugagcguggagaccagcagcauccugagcggcgagaacagcagcagacagccccagagcgcccuggagguggcccuggccugcgccgccaccgugaucggcaccaucagcagcccccaggccaccgagagacugaagauggagcagguggugagcaacuucccccccggcagcagcggcgcccugcagacccaggccccccagggccugaaggagcccagcaucaacgaguacagcuuccccagcgcccugugcggcaugacccagguggccagcgccguggccgugugcggccugggcgagagagaggaggugaccugcagcguggcccccagcggcagccugccccccgccgccgaggccagcgaggccaugcccccccugugcggccuggccagcauggagcugggcaaggaggccaucgccaagggccugcugaaggaggccgcccuggugcugaccagacccaacaccuacagcagcaucggcgacuuccuggacagcaugaacagaagaaucauggagaccgccagcaagagccagacccugugcagcgagaacguggugagaaacgagcuggcccacacccugagcaacgugauccugagacacagcaucgacgaggugcaccacaagaacaugaucaucgaccccaacgacaacagacacagcagcgagauccuggacacccugauggagagcaccaaccagcugcugcuggacgugaucugcuucaccuucaagaagaugagccacaucgugagacugggcgagugccccgccgugcugagcaaggagaccaucagaagaagagagaccgagcccagcugccagcccagcgaccccggcgccagccaggccuggaccaaggccaccgagagcagcagcagcagcccccugagcaacagccacaacaccagccuggugaucaacaaccugguggacggcauguacagcaagcaggacaagggcggcgugagacccggccuguucaagaaccccacccugcagagccagcugagcagaagccacagagugcccgacagcagcaccgccaccaccagcagcaaggagaucuaccugaagggcaucgccggcgaggacaccaagagcccccaccacagcgagaacgagugcagagccagcagcgagggccagagaagccccaccgugagccagagcagaagcggcagccaggaggccgaggagagcauccaccccaacacccaggagaaguacaacugcgccaccagcagaaucaacgaggugcaggugaaccugagccugcugggcgacgaccugcugcugcccgcccagagcacccugcagaccaagcaccccgacaucuacugcaucaccgacuucgccgaggagcuggccgacaccguggugagcauggccaccgagaucgccgccaucugccuggacaacagcagcggcaagcagcccugguucugcgccuggaagagaggcagcgaguuccugaugacccccaacgugcccugcagaagccugaagagaaagaaggagagccagggcagcggcaccgccgugagaaagcacaagccccccagacugagcgagaucaagagaaagaccgacgagcaccccgagcugaaggagaagcugaugaacagagugguggacgagagcaugaaccuggaggacgugcccgacagcgugaaccuguucgccaacgagguggccgccaagaucaugaaccugaccgaguucagcaugguggacggcauguggcaggcccagggcuaccccagaaacagacugcugagcggcgacagauggagcagacugaaggccagcagcugcgagagcauccccgaggaggacagcgaggccagagccuacgugaacagccugggccugaugagcacccugagccagcccgugagcagagccagcagcgugagcaagcagagcagcugcgagagcaucaccgacgaguucagcagauucauggugaaccagauggagaacgagggcagaggcuucgagcugcugcuggacuacuacgccggcaagaacgccagcagcauccugaacagcgccaugcagcaggccugcagaaagagcgaccaccugagcgugagacccagcugccccagcaagcagagcagcaccgagagcaucaccgaggaguucuacagauacaugcugagagacaucgagagagacagcagagagagcgccagcagcagaagaagcagccaggacuggaccgccggccugcugagccccagccugagaagccccgugugccacagacagagcagcaugcccgacagcagaagccccugcagcagacugaccgugaacgugcccaucaaggccaacagccuggacggcuucgcccagaacugcccccaggacuuccugagcgugcagcccgugagcagcgccagcagcagcggccugugcaagagcgacagcugccuguacagaagaggcggcaccgaccacaucaccaacaugcugauccacgagaccugggccagcagcaucgaggcccugaugagaaagaacaagaucaucguggacgacgccgaggaggccgacaccgagcccgugagcggcggcagccccagccaggccgagaagugcgccaacagacuggccgccagcagaaugugcagcggccccacccugcuggugcaggagagccuggacugccccagaaaggacagcgugaccgagugcaagcagccccccgugagcagccugagcaagaccgccagccugaccaaccacagcccccuggacagcaagaaggagaccagcagcugccaggaccccgugcccaucaaccacaagagaagaagccugugcagcagagaggugccccugauccagaucgagaccgaccagagagaggccugcgccggcgagcccgagcccuuccugagcaagagcagccugcuggaggaggccgagggccacagcaacgacaagaacauccccgacguggugagaggcggcgacaccgccgugagcgccugccagauccacagcgacagccuggacaccagagacgugcccgaggccgaggccagcaccgaggccagagcccccgacgaggcccccaacccccccagcagcagcgaggagagcaccggcagcuggacccagcuggccaacgaggaggacaaccccgacgacaccagcagcuuccugcagcugagcgagagaagcaugagcaacggcaacagcagcgccaccagcagccugggcaucauggaccuggacaucuaccaggagagcaugcccagcagccccaugaucaacgagcugguggaggagaagaagauccugaagggccagagcgagagcaccgaggcccccgccagcggcccccccaccggcaccgccagcccccagagaagccugcuggugaucaacuucgaccuggagcccgagugccccgacgccgagcugagagccacccugcaguggaucgccgccagcgagcugggcauccccaccaucuacuucaagaagagccaggagaacagaaucgagaaguuccuggacguggugcagcuggugcacagaaagagcuggaaggugggcgacaucuuccacgccguggugcaguacugcaagaugcacgaggagcagaaggacggcagacugagccuguucgacuggcugcuggagcugggcuaa

SEQ ID NO: 23946 - RNA, 816 nt, Artificial Sequence
  SPI1__Homo_sapiens__NP_001074016
augcugcaggccugcaagauggagggcuucccccuggugcccccccagcccagcgaggaccuggugcccuacgacaccgaccuguaccagagacagacccacgaguacuaccccuaccugagcagcgacggcgagagccacagcgaccacuacugggacuuccacccccaccacgugcacagcgaguucgagagcuucgccgagaacaacuucaccgagcugcagagcgugcagcccccccagcugcagcagcuguacagacacauggagcuggagcagaugcacgugcuggacacccccauggugcccccccaccccagccugggccaccaggugagcuaccugcccagaaugugccugcaguaccccagccugagccccgcccagcccagcagcgacgaggaggagggcgagagacagagccccccccuggaggugagcgacggcgaggccgacggccuggagcccggccccggccugcugcccggcgagaccggcagcaagaagaagaucagacuguaccaguuccugcuggaccugcugagaagcggcgacaugaaggacagcaucugguggguggacaaggacaagggcaccuuccaguucagcagcaagcacaaggaggcccuggcccacagauggggcauccagaagggcaacagaaagaagaugaccuaccagaagauggccagagcccugagaaacuacggcaagaccggcgaggugaagaaggugaagaagaagcugaccuaccaguucagcggcgaggugcugggcagaggcggccuggccgagagaagacaccccccccacuaa

SEQ ID NO: 23947 - RNA, 516 nt, Artificial Sequence
  SPIB__Homo_sapiens__NP_001230927
auggccagcagcaugaccuggaccgccgccagcauccccgccacccugauccagagaggccugcugacccuggugccccccgccuacgcccccuaccccagccccgugcugagcgaggaggaggaccugccccuggacagccccgcccuggaggugagcgacagcgagagcgacgaggcccugguggccggccccgagggcaagggcagcgaggccggcaccagaaagaagcugagacuguaccaguuccugcugggccugcugaccagaggcgacaugagagagugcgugugguggguggagcccggcgccggcguguuccaguucagcagcaagcacaaggagcugcuggccagaagauggggccagcagaagggcaacagaaagagaaugaccuaccagaagcuggccagagcccugagaaacuacgccaagaccggcgagaucagaaaggugaagagaaagcugaccuaccaguucgacagcgcccugcugcccgccgugagaagagccuaa

SEQ ID NO: 23948 - RNA, 747 nt, Artificial Sequence
  SPIC__Homo_sapiens__NP_689536
augaccugcguggagcaggacaagcugggccaggccuucgaggacgccuucgaggugcugagacagcacagcaccggcgaccugcaguacagccccgacuacagaaacuaccuggcccugaucaaccacagaccccacgugaagggcaacagcagcugcuacggcgugcugcccaccgaggagcccguguacaacuggagaaccgugaucaacagcgccgccgacuucuacuucgagggcaacauccaccagagccugcagaacaucaccgagaaccagcuggugcagcccacccugcugcagcagaagggcggcaagggcagaaagaagcugagacuguucgaguaccugcacgagagccuguacaaccccgagauggccagcugcauccaguggguggacaagaccaagggcaucuuccaguucgugagcaagaacaaggagaagcuggccgagcuguggggcaagagaaagggcaacagaaagaccaugaccuaccagaagauggccagagcccugagaaacuacggcagaagcggcgagaucaccaagaucagaagaaagcugaccuaccaguucagcgaggccauccugcagagacugagccccagcuacuuccugggcaaggagaucuucuacagccagugcgugcagcccgaccaggaguaccugagccugaacaacuggaacgccaacuacaacuacaccuacgccaacuaccacgagcugaaccaccacgacugcuaa

SEQ ID NO: 23949 - RNA, 2748 nt, Artificial Sequence
  SPIDR__Homo_sapiens__NP_001073863
augcccagaggcagcagagccagaggcagcaagagaaagagaagcuggaacaccgagugccccagcuuccccggcgagagaccccugcaggugagaagagccggccugagaaccgccggcgccgccgccagccugagcgaggccuggcugagaugcggcgagggcuuccagaacaccagcggcaaccccagccugaccgccgaggagaagaccaucaccgagaagcaccuggagcugugccccagacccaagcaggagaccaccaccagcaagagcaccagcggccugaccgacaucaccuggagcagcagcggcagcgaccugagcgacgaggacaagacccugagccagcugcagagagacgagcugcaguucaucgacugggagaucgacagcgacagagccgaggccagcgacugcgacgaguucgaggacgacgagggcgccguggagaucagcgacugcgccagcugcgccagcaaccagagccugaccagcgacgagaagcugagcgagcugcccaagcccagcagcaucgagauccuggaguacagcagcgacagcgagaaggaggacgaccuggagaacgugcugcugaucgacagcgagagcccccacaaguaccacgugcaguucgccagcgacgccagacagaucauggagagacugaucgaccccagaaccaagagcaccgagaccauccugcacaccccccagaagcccaccgccaaguuccccagaacccccgagaacagcgccaagaagaagcugcugagaggcggccuggccgagagacugaacggccugcagaacagagagagaagcgccaucagccuguggagacaccagugcaucagcuaccagaagacccugagcggcagaaagagcggcgugcugaccgugaagauccuggagcugcacgaggagugcgccaugcagguggccaugugcgagcagcugcugggcagccccgccaccagcagcagccagagcguggcccccagacccggcgccggccugaaggugcuguucaccaaggagaccgccggcuaccugagaggcagaccccaggacaccgugagaaucuucccccccuggcagaagcugaucauccccagcggcagcugccccgugauccugaacaccuacuucugcgagaaggugguggccaaggaggacagcgagaagaccugcgagguguacugccccgacaucccccugcccagaagaagcaucagccuggcccagauguucgugaucaagggccugaccaacaacagccccgagauccagguggugugcagcggcguggccaccaccggcaccgccuggacccacggccacaaggaggccaagcagagaauccccaccagcaccccccugagagacagccugcuggacgugguggagagccagggcgccgccagcuggcccggcgccggcgugagagugguggugcagagaguguacagccugcccagcagagacagcaccagaggccagcagggcgccagcagcggccacaccgaccccgccggcaccagagccugccugcuggugcaggacgccugcggcauguucggcgaggugcaccuggaguucaccaugagcaaggccagacagcuggagggcaagagcugcagccuggugggcaugaaggugcugcagaaggugaccagaggcagaaccgccggcaucuucagccugaucgacacccuguggccccccgccaucccccugaagacccccggcagagaccagcccugcgaggagaucaagacccaccugcccccccccgcccugugcuacauccugaccgcccaccccaaccugggccagaucgacaucaucgacgaggaccccaucuacaagcuguaccagccccccgugaccagaugccugagagacauccugcagaugaacgaccugggcaccagaugcagcuucuacgccaccgugaucuaccagaagccccagcugaagagccugcugcugcuggagcagagagagaucuggcugcuggugaccgacgugacccugcagaccaaggaggagagagaccccagacugcccaagacccugcugguguacguggccccccugugcgugcugggcagcgaggugcuggaggcccuggccggcgccgccccccacagccuguucuucaaggacgcccugagagaccagggcagaaucgugugcgccgagagaaccgugcugcugcugcagaagccccugcugagcguggugagcggcgccagcagcugcgagcugcccggccccgugaugcuggacagccuggacagcgccacccccgugaacagcaucugcagcgugcagggcaccguggugggcguggacgagagcaccgccuucagcuggcccgugugcgacaugugcggcaacggcagacuggagcagagacccgaggacagaggcgccuucagcugcggcgacugcagcagaguggugaccagccccgugcugaagagacaccugcagguguuccuggacugcagaagcagaccccagugcagagugaaggugaagcugcugcagagaagcaucagcagccugcugagauucgccgccggcgaggacggcagcuacgaggugaagagcgugcugggcaaggaggugggccugcugaacugcuucgugcagagcgugaccgcccaccccaccagcugcaucggccuggaggagaucgagcugcugagcgccggcggcgccagcgccgagcacuaa

SEQ ID NO: 23950 - RNA, 789 nt, Artificial Sequence
  SPIN1__Homo_sapiens__NP_006708
augaagacccccuucggcaagacccccggccagagaagcagagccgacgccggccacgccggcgugagcgccaacaugaugaagaagagaaccagccacaagaagcacagaagcagcgugggccccagcaagcccgugagccagcccagaagaaacaucgugggcugcagaauccagcacggcuggaaggagggcaacggccccgugacccaguggaagggcaccgugcuggaccaggugcccgugaaccccagccuguaccugaucaaguacgacggcuucgacugcguguacggccuggagcugaacaaggacgagagagugagcgcccuggaggugcugcccgacagaguggccaccagcagaaucagcgacgcccaccuggccgacaccaugaucggcaaggccguggagcacauguucgagaccgaggacggcagcaaggacgaguggagaggcauggugcuggccagagcccccgugaugaacaccugguucuacaucaccuacgagaaggaccccgugcuguacauguaccagcugcuggacgacuacaaggagggcgaccugagaaucaugcccgacagcaacgacagcccccccgccgagagagagcccggcgaggugguggacagccuggugggcaagcagguggaguacgccaaggaggacggcagcaagagaaccggcauggugauccaccagguggaggccaagcccagcguguacuucaucaaguucgacgacgacuuccacaucuacguguacgaccuggugaagaccagcuaa

SEQ ID NO: 23951 - RNA, 777 nt, Artificial Sequence
  SPIN2A__Homo_sapiens__NP_061876
augaagacccccaacgcccaggaggccgagggccagcagaccagagccgccgccggcagagccaccggcagcgccaacaugaccaagaagaaggugagccagaagaagcagagaggcagacccagcagccagcccagaagaaacaucgugggcugcagaaucagccacggcuggaaggagggcgacgagcccaucacccaguggaagggcaccgugcuggaccaggugcccaucaaccccagccuguaccuggugaaguacgacggcaucgacugcguguacggccuggagcugcacagagacgagagagugcugagccugaagauccugagcgacagaguggccagcagccacaucagcgacgccaaccuggccaacaccaucaucggcaaggccguggagcacauguucgagggcgagcacggcagcaaggacgaguggagaggcauggugcuggcccaggcccccaucaugaaggccugguucuacaucaccuacgagaaggaccccgugcuguacauguaccagcugcuggacgacuacaaggagggcgaccugagaaucaugcccgagagcagcgagagcccccccaccgagagagagcccggcggcgugguggacggccugaucggcaagcacguggaguacaccaaggaggacggcagcaagagaaucggcauggugauccaccagguggagaccaagcccagcguguacuucaucaaguucgacgacgacuuccacaucuacguguacgaccuggugaagaagagcuaa

SEQ ID NO: 23952 - RNA, 240 nt, Artificial Sequence
  SPINK1__Homo_sapiens__NP_003113
augaaggugaccggcaucuuccugcugagcgcccuggcccugcugagccugagcggcaacaccggcgccgacagccugggcagagaggccaagugcuacaacgagcugaacggcugcaccaagaucuacgaccccgugugcggcaccgacggcaacaccuaccccaacgagugcgugcugugcuucgagaacagaaagagacagaccagcauccugauccagaagagcggccccugcuaa

SEQ ID NO: 23953 - RNA, 405 nt, Artificial Sequence
  SPINK2__Homo_sapiens__NP_001258647
auggcccugagcgugcugagacuggcccugcugcugcuggccgugaccuucgccggcagcgccagaagcggccccggcgagagaggcccccccgagaagagcggcuucggcagccagaccggcggcggccccugccccgcccccggcggccugggcgacggcaccagagcccccgugaccggcggcagccccgaggaccugcccgccagccugaucccccaguucggccuguucagcaaguacagaacccccaacugcagccaguacagacugcccggcugccccagacacuucaaccccgugugcggcagcgacaugagcaccuacgccaacgagugcacccugugcaugaagaucagagagggcggccacaacaucaagaucaucagaaacggccccugcuaa

SEQ ID NO: 23954 - RNA, 261 nt, Artificial Sequence
  SPINK4__Homo_sapiens__NP_055286
auggccgugagacagugggugaucgcccuggcccuggccgcccugcuggugguggacagagaggugcccguggccgccggcaagcugcccuucagcagaaugcccaucugcgagcacaugguggagagccccaccugcagccagaugagcaaccuggugugcggcaccgacggccugaccuacaccaacgagugccagcugugccuggccagaaucaagaccaagcaggacauccagaucaugaaggacggcaagugcuaa

SEQ ID NO: 23955 - RNA, 3285 nt, Artificial Sequence
  SPINK5__Homo_sapiens__NP_001121170
augaagaucgccaccgugagcgugcugcugccccuggcccugugccugauccaggacgccgccagcaagaacgaggaccaggagaugugccacgaguuccaggccuucaugaagaacggcaagcuguucugcccccaggacaagaaguucuuccagagccuggacggcaucauguucaucaacaagugcgccaccugcaagaugauccuggagaaggaggccaagagccagaagagagccagacaccuggccagagcccccaaggccaccgcccccaccgagcugaacugcgacgacuucaagaagggcgagagagacggcgacuucaucugccccgacuacuacgaggccgugugcggcaccgacggcaagaccuacgacaacagaugcgcccugugcgccgagaacgccaagaccggcagccagaucggcgugaagagcgagggcgagugcaagagcagcaaccccgagcaggacgugugcagcgccuucagacccuucgugagagacggcagacugggcugcaccagagagaacgaccccgugcugggccccgacggcaagacccacggcaacaagugcgccaugugcgccgagcuguuccugaaggaggccgagaacgccaagagagagggcgagaccagaaucagaagaaacgccgagaaggacuucugcaaggaguacgagaagcaggugagaaacggcagacuguucugcaccagagagagcgaccccgugagaggccccgacggcagaaugcacggcaacaagugcgcccugugcgccgagaucuucaagcagagauucagcgaggagaacagcaagaccgaccagaaccugggcaaggccgaggagaagaccaaggugaagagagagaucgugaagcugugcagccaguaccagaaccaggccaagaacggcauccuguucugcaccagagagaacgaccccaucagaggccccgacggcaagaugcacggcaaccugugcagcaugugccaggccuacuuccaggccgagaacgaggagaagaagaaggccgaggccagagccagaaacaagagagagagcggcaaggccaccagcuacgccgagcugugcagcgaguacagaaagcuggugagaaacggcaagcuggccugcaccagagagaacgaccccauccagggccccgacggcaaggugcacggcaacaccugcagcaugugcgagguguucuuccaggccgaggaggaggagaagaagaagaaggagggcaagagcagaaacaagagacagagcaagagcaccgccagcuucgaggagcugugcagcgaguacagaaagagcagaaagaacggcagacuguucugcaccagagagaacgaccccauccagggccccgacggcaagaugcacggcaacaccugcagcaugugcgaggccuucuuccagcaggaggagagagccagagccaaggccaagagagaggccgccaaggagaucugcagcgaguucagagaccaggugagaaacggcacccugaucugcaccagagagcacaaccccgugagaggccccgacggcaagaugcacggcaacaagugcgccaugugcgccagcguguucaagcuggaggaggaggagaagaagaacgacaaggaggagaagggcaagguggaggccgagaaggugaagagagaggccgugcaggagcugugcagcgaguacagacacuacgugagaaacggcagacugcccugcaccagagagaacgaccccaucgagggccuggacggcaagauccacggcaacaccugcagcaugugcgaggccuucuuccagcaggaggccaaggagaaggagagagccgagcccagagccaaggugaagagagaggccgagaaggagaccugcgacgaguucagaagacugcugcagaacggcaagcuguucugcaccagagagaacgaccccgugagaggccccgacggcaagacccacggcaacaagugcgccaugugcaaggccguguuccagaaggagaacgaggagagaaagagaaaggaggaggaggaccagagaaacgccgccggccacggcagcagcggcggcggcggcggcaacacccaggacgagugcgccgaguacagagagcagaugaagaacggcagacugagcugcaccagagagagcgaccccgugagagacgccgacggcaagagcuacaacaaccagugcaccaugugcaaggccaagcuggagagagaggccgagagaaagaacgaguacagcagaagcagaagcaacggcaccggcagcgagagcggcaaggacaccugcgacgaguucagaagccagaugaagaacggcaagcugaucugcaccagagagagcgaccccgugagaggccccgacggcaagacccacggcaacaagugcaccaugugcaaggagaagcuggagagagaggccgccgagaagaagaagaaggaggacgaggacagaagcaacaccggcgagagaagcaacaccggcgagagaagcaacgacaaggaggaccugugcagagaguucagaagcaugcagagaaacggcaagcugaucugcaccagagagaacaaccccgugagaggccccuacggcaagaugcacaucaacaagugcgccaugugccagagcaucuucgacagagaggccaacgagagaaagaagaaggacgaggagaagagcagcagcaagcccagcaacaacgccaaggaccagugcagacaggugcagaacgaggccgaggacgccaaguucagacagcccggcagaagccuggccagcguggccagaaugagcaccgacgagugcagcgaguucagaaacuacaucagaaacaacgagcugaucugccccagagagaacgaccccgugcacggcgccgacggcaaguucuacaccaacaagugcuacaugugcagagccguguuccugaccgaggcccuggagagagccaagcugcaggagaagcccagccacgugagagccagccaggaggaggacagccccgacagcuucagcagccuggacagcgagaugugcaaggacuacagagugcugcccagaaucggcuaccugugccccaaggaccugaagcccgugugcggcgacgacggccagaccuacaacaaccccugcaugcugugccacgagaaccugaucagacagaccaacacccacaucagaagcaccggcaagugcgaggagagcagcacccccggcaccaccgccgccagcaugccccccagcgacgaguaa

SEQ ID NO: 23956 - RNA, 243 nt, Artificial Sequence
  SPINK6__Homo_sapiens__NP_001182219
augaagcugagcggcauguuccugcugcugagccuggcccuguucugcuuccugaccggcguguucagccagggcggccagguggacugcggcgaguuccaggaccccaagguguacugcaccagagagagcaacccccacugcggcagcgacggccagaccuacggcaacaagugcgccuucugcaaggccaucgugaagagcggcggcaagaucagccugaagcaccccggcaagugcuaa

SEQ ID NO: 23957 - RNA, 258 nt, Artificial Sequence
  SPINK7__Homo_sapiens__NP_115955
augaagaucaccggcggccugcugcugcugugcaccgugguguacuucugcagcagcagcgaggccgccagccugagccccaagaagguggacugcagcaucuacaagaaguaccccgugguggccauccccugccccaucaccuaccugcccgugugcggcagcgacuacaucaccuacggcaacgagugccaccugugcaccgagagccugaagagcaacggcagagugcaguuccugcacgacggcagcugcuaa

SEQ ID NO: 23958 - RNA, 1542 nt, Artificial Sequence
  SPINT1__Homo_sapiens__NP_001027539
auggcccccgccagaaccauggccagagccagacuggcccccgccggcauccccgccguggcccuguggcugcugugcacccugggccugcagggcacccaggccggccccccccccgccccccccggccugcccgccggcgccgacugccugaacagcuucaccgccggcgugcccggcuucgugcuggacaccaacgccagcgugagcaacggcgccaccuuccuggagagccccaccgugagaagaggcugggacugcgugagagccugcugcaccacccagaacugcaaccuggcccugguggagcugcagcccgacagaggcgaggacgccaucgccgccugcuuccugaucaacugccuguacgagcagaacuucgugugcaaguucgcccccagagagggcuucaucaacuaccugaccagagagguguacagaagcuacagacagcugagaacccagggcuucggcggcagcggcauccccaaggccugggccggcaucgaccugaaggugcagccccaggagccccuggugcugaaggacguggagaacaccgacuggagacugcugagaggcgacaccgacgugagaguggagagaaaggaccccaaccagguggagcuguggggccugaaggagggcaccuaccuguuccagcugaccgugaccagcagcgaccaccccgaggacaccgccaacgugaccgugaccgugcugagcaccaagcagaccgaggacuacugccuggccagcaacaaggugggcagaugcagaggcagcuuccccagaugguacuacgaccccaccgagcagaucugcaagagcuucguguacggcggcugccugggcaacaagaacaacuaccugagagaggaggagugcauccuggccugcagaggcgugcagggccccagcauggagagaagacaccccgugugcagcggcaccugccagcccacccaguucagaugcagcaacggcugcugcaucgacagcuuccuggagugcgacgacacccccaacugccccgacgccagcgacgaggccgccugcgagaaguacaccagcggcuucgacgagcugcagagaauccacuuccccagcgacaagggccacugcguggaccugcccgacaccggccugugcaaggagagcauccccagaugguacuacaaccccuucagcgagcacugcgccagauucaccuacggcggcugcuacggcaacaagaacaacuucgaggaggagcagcagugccuggagagcugcagaggcaucagcaagaaggacguguucggccugagaagagagauccccauccccagcaccggcagcguggagauggccguggccguguuccuggugaucugcaucgugguggugguggccauccugggcuacugcuucuucaagaaccagagaaaggacuuccacggccaccaccaccaccccccccccacccccgccagcagcaccgugagcaccaccgaggacaccgagcaccugguguacaaccacaccaccagaccccuguaa

SEQ ID NO: 23959 - RNA, 588 nt, Artificial Sequence
  SPINT2__Homo_sapiens__NP_001159575
auggcccagcugugcggccugagaagaagcagagccuuccuggcccugcugggcagccugcugcugagcggcgugcuggccgccgacagagagagaagcauccacgagaacgccaccggcgaccuggccaccagcagaaacgccgccgacagcagcgugcccagcgcccccagaagacaggacagcgaggaccacagcagcgacauguucaacuacgaggaguacugcaccgccaacgccgugaccggccccugcagagccagcuuccccagaugguacuucgacguggagagaaacagcugcaacaacuucaucuacggcggcugcagaggcaacaagaacagcuacagaagcgaggaggccugcaugcugagaugcuucagacagcaggagaaccccccccugccccugggcagcaaggugguggugcuggccggccuguucgugauggugcugauccuguuccugggcgccagcaugguguaccugaucagaguggccagaagaaaccaggagagagcccugagaaccguguggagcagcggcgacgacaaggagcagcuggugaagaacaccuacgugcuguaa

SEQ ID NO: 23960 - RNA, 1365 nt, Artificial Sequence
  SPNS1__Homo_sapiens__NP_001135921
auggccggcagcgacaccgcccccuuccugagccaggccgacgaccccgacgacggccccgugcccggcacccccggccugcccggcagcaccggcaaccccaagagcgaggagcccgaggugcccgaccaggagggccugcagagaaucaccggccugagccccggcagaagcgcccugaucguggccgugcugugcuacaucaaccugcugaacuacauggacagauucaccguggccguguucaucagcagcuacauggugcuggcccccguguucggcuaccugggcgacagauacaacagaaaguaccugaugugcggcggcaucgccuucuggagccuggugacccugggcagcagcuucauccccggcgagcacuucuggcugcugcugcugaccagaggccuggugggcgugggcgaggccagcuacagcaccaucgcccccacccugaucgccgaccuguucguggccgaccagagaagcagaaugcugagcaucuucuacuucgccauccccgugggcagcggccugggcuacaucgccggcagcaaggugaaggacauggccggcgacuggcacugggcccugagagugacccccggccugggcgugguggccgugcugcugcuguuccugguggugagagagccccccagaggcgccguggagagacacagcgaccugcccccccugaaccccaccagcuggugggccgaccugagagcccuggccagaaaccugaucuucggccugaucaccugccugaccggcgugcugggcgugggccugggcguggagaucagcagaagacugagacacagcaaccccagagccgacccccuggugugcgccaccggccugcugggcagcgcccccuuccuguuccugagccuggccugcgccagaggcagcaucguggccaccuacaucuucaucuucaucggcgagacccugcugagcaugaacugggccaucguggccgacauccugcuguacguggugauccccaccagaagaagcaccgccgaggccuuccagaucgugcugagccaccugcugggcgacgccggcagccccuaccugaucggccugaucagcgacagacugagaagaaacuggccccccagcuuccugagcgaguucagagcccugcaguucagccugaugcugugcgccuucgugggcgcccugggcggcgccgccuuccugggcaccgccaucuucaucgaggccgacagaagaagagcccagcugcacgugcagggccugcugcacgaggccggcagcaccgacgacagaaucguggugccccagagaggcagaagcaccagagugcccguggccagcgugcugaucuaa

SEQ ID NO: 23961 - RNA, 1650 nt, Artificial Sequence
  SPNS2__Homo_sapiens__NP_001118230
augaugugccuggagugcgccagcgccgccgccggcggcgccgaggaggaggaggccgacgccgagagaagaagaagaagaagaggcgcccagagaggcgccggcggcagcggcugcugcggcgccagaggcgccggcggcgccggcgugagcgccgccggcgacgaggugcagacccugagcggcagcgugagaagagcccccaccggcccccccggcacccccggcacccccggcugcgccgccaccgccaagggccccggcgcccagcagcccaagcccgccagccugggcagaggcagaggcgccgccgccgccauccugagccugggcaacgugcugaacuaccuggacagauacaccguggccggcgugcugcuggacauccagcagcacuucggcgugaaggacagaggcgccggccugcugcagagcguguucaucugcagcuucaugguggccgcccccaucuucggcuaccugggcgacagauucaacagaaaggugauccugagcugcggcaucuucuucuggagcgccgugaccuucagcagcagcuucaucccccagcaguacuucuggcugcuggugcugagcagaggccuggugggcaucggcgaggccagcuacagcaccaucgcccccaccaucaucggcgaccuguucaccaagaacaccagaacccugaugcugagcguguucuacuucgccaucccccugggcagcggccugggcuacaucaccggcagcagcgugaagcaggccgccggcgacuggcacugggcccugagagugagccccgugcugggcaugaucaccggcacccugauccugauccuggugcccgccaccaagagaggccacgccgaccagcugggcgaccagcugaaggccagaaccagcuggcugagagacaugaaggcccugaucagaaacagaagcuacguguucagcagccuggccaccagcgccgugagcuucgccaccggcgcccugggcauguggaucccccuguaccugcacagagcccagguggugcagaagaccgccgagaccugcaacagcccccccugcggcgccaaggacagccugaucuucggcgccaucaccugcuucaccggcuuccugggcguggugaccggcgccggcgccaccagauggugcagacugaagacccagagagccgacccccuggugugcgccgugggcaugcugggcagcgccaucuucaucugccugaucuucguggccgccaagagcagcaucgugggcgccuacaucugcaucuucgugggcgagacccugcuguucagcaacugggccaucaccgccgacauccugauguacguggugauccccaccagaagagccaccgccguggcccugcagagcuucaccagccaccugcugggcgacgccggcagccccuaccugaucggcuucaucagcgaccugaucagacagagcaccaaggacagcccccugugggaguuccugagccugggcuacgcccugaugcugugccccuucgugguggugcugggcggcauguucuuccuggccaccgcccuguucuucgugagcgacagagccagagccgagcagcaggugaaccagcuggccaugccccccgccagcgugaagguguaa

SEQ ID NO: 23962 - RNA, 1191 nt, Artificial Sequence
  SPO11__Homo_sapiens__NP_036576
auggccuucgcccccaugggccccgaggccagcuucuucgacgugcuggacagacacagagagagccugcuggccgcccugagaagaggcggcagagagccccccaccggcggcagcagacuggccagcagcagcgaggugcuggccagcaucgagaacaucauccaggacaucaucaccagccuggccagaaacgaggcccccgccuucaccaucgacaacagaagcagcugggagaacaucaaguucgaggacagcgugggccugcagauggugagccacugcaccaccagaaagaucaagagcgacagccccaagagcgcccagaaguucagccugauccugaagauccugagcaugaucuacaagcuggugcagagcaacaccuacgccaccaagagagacaucuacuacaccgacagccagcuguucggcaaccagaccgugguggacaacaucaucaacgacaucagcugcaugcugaaggugagcagaagaagccugcacauccugagcaccagcaagggccugaucgccggcaaccugagauacaucgaggaggacggcaccaaggugaacugcaccugcggcgccaccgccguggccgugcccagcaacauccagggcaucagaaaccuggugaccgacgccaaguucgugcugaucguggagaaggacgccaccuuccagagacugcuggacgacaacuucugcaacaagcugagccccugcaucaugaucaccggcaagggcgugcccgaccugaacaccagacugcuggugaagaagcugugggacaccuuccacgugcccguguucacccugguggacgccgacccccacggcaucgagaucaugugcaucuacaaguacggcagcaugagcaugagcuucgaggcccaccaccugaccgugcccgccaucagauggcugggccugcugcccagcgaccugaagagacugaacgugcccaaggacagccugaucccccugaccaagagagaccagaugaagcuggacagcauccugagaagacccuacgugaccugccagcccuucuggagaaaggagauggagaucauggccgacagcaagaugaaggccgagauccaggcccugaccuuccugagcagcgacuaccugagcagaguguaccugcccaacaagcugaaguucggcggcuggaucuaa

SEQ ID NO: 23963 - RNA, 1320 nt, Artificial Sequence
  SPOCK1__Homo_sapiens__NP_004589
augcccgccaucgccgugcuggccgccgccgccgccgccuggugcuuccugcagguggagagcagacaccuggacgcccuggccggcggcgccggccccaaccacggcaacuuccuggacaacgaccaguggcugagcaccgugagccaguacgacagagacaaguacuggaacagauucagagacgacgacuacuucagaaacuggaaccccaacaagcccuucgaccaggcccuggaccccagcaaggaccccugccugaaggugaagugcagcccccacaaggugugcgugacccaggacuaccagaccgcccugugcgugagcagaaagcaccugcugcccagacagaagaagggcaacguggcccagaagcacugggugggccccagcaaccuggugaagugcaagcccugccccguggcccagagcgccauggugugcggcagcgacggccacagcuacaccagcaagugcaagcuggaguuccacgccugcagcaccggcaagagccuggccacccugugcgacggccccugccccugccugcccgagcccgagccccccaagcacaaggccgagagaagcgccugcaccgacaaggagcugagaaaccuggccagcagacugaaggacugguucggcgcccugcacgaggacgccaacagagugaucaagcccaccagcagcaacaccgcccagggcagauucgacaccagcauccugcccaucugcaaggacagccugggcuggauguucaacaagcuggacaugaacuacgaccugcugcuggaccccagcgagaucaacgccaucuaccuggacaaguacgagcccugcaucaagccccuguucaacagcugcgacagcuucaaggacggcaagcugagcaacaacgaguggugcuacugcuuccagaagcccggcggccugcccugccagaacgagaugaacagaauccagaagcugagcaagggcaagagccugcugggcgccuucauccccagaugcaacgaggagggcuacuacaaggccacccagugccacggcagcaccggccagugcuggugcguggacaaguacggcaacgagcuggccggcagcagaaagcagggcgccgugagcugcgaggaggagcaggagaccagcggcgacuucggcagcggcggcagcguggugcugcuggacgaccuggaguacgagagagagcugggccccaaggacaaggagggcaagcugagagugcacaccagagccgugaccgaggacgacgaggacgaggacgacgacaaggaggacgaggugggcuacaucugguaa

SEQ ID NO: 23964 - RNA, 234 nt, Artificial Sequence
  SPOCK2__Homo_sapiens__NP_001127906
augagagcccccggcugcggcagacuggugcugccccugcugcugcuggccgccgccgcccuggccgagggcgacgccaagggccugaaggagggcgagacccccggcaacuucauggaggacgagcaguggcugagcagcaucagccaguacagcggcaagaucaagcacuggaacagauucagagacgugcccagcagcgacccccccagcaccacccaggccacccccuaa

SEQ ID NO: 23965 - RNA, 1302 nt, Artificial Sequence
  SPOCK3__Homo_sapiens__NP_001035249
augcugaaggugagcgccgugcugugcgugugcgccgccgccuggugcagccagagccuggccgccgccgccgccguggccgccgccggcggcagaagcgacggcggcaacuuccuggacgacaagcaguggcugaccaccaucagccaguacgacaaggaggugggccaguggaacaaguucagagacgacgacuacuucagaaccuggagccccggcaagcccuucgaccaggcccuggaccccgccaaggaccccugccugaagaugaagugcagcagacacaaggugugcaucgcccaggacagccagaccgccgugugcaucagccacagaagacugacccacagaaugaaggaggccggcguggaccacagacaguggagaggccccauccugagcaccugcaagcagugccccgugguguaccccagccccgugugcggcagcgacggccacaccuacagcuuccagugcaagcuggaguaccaggccugcgugcugggcaagcagaucagcgugaagugcgagggccacugccccugccccagcgacaagcccaccagcaccagcagaaacgugaagagagccugcagcgaccuggaguucagagagguggccaacagacugagagacugguucaaggcccugcacgagagcggcagccagaacaagaagaccaagacccugcugagacccgagagaagcagauucgacaccagcauccugcccaucugcaaggacagccugggcuggauguucaacagacuggacaccaacuacgaccugcugcuggaccagagcgagcugagaagcaucuaccuggacaagaacgagcagugcaccaaggccuucuucaacagcugcgacaccuacaaggacagccugaucagcaacaacgaguggugcuacugcuuccagagacagcaggacccccccugccagaccgagcugagcaacauccagaagagacagggcgugaagaagcugcugggccaguacaucccccugugcgacgaggacggcuacuacaagcccacccagugccacggcagcgugggccagugcuggugcguggacagauacggcaacgaggugaugggcagcagaaucaacggcguggccgacugcgccaucgacuucgagaucagcggcgacuucgccagcggcgacuuccacgaguggaccgacgacgaggacgacgaggacgacaucaugaacgacgaggacgagaucgaggacgacgacgaggacgagggcgacgacgacgacggcggcgacgaccacgacguguacaucuaa

SEQ ID NO: 23966 - RNA, 2424 nt, Artificial Sequence
  SPON1__Homo_sapiens__NP_006099
augagacugagccccgccccccugaagcugagcagaacccccgcccugcuggcccuggcccugccccuggccgccgcccuggccuucagcgacgagacccuggacaaggugcccaagagcgagggcuacugcagcagaauccugagagcccagggcaccagaagagagggcuacaccgaguucagccugagaguggagggcgaccccgacuucuacaagcccggcaccagcuacagagugacccugagcgccgccccccccagcuacuucagaggcuucacccugaucgcccugagagagaacagagagggcgacaaggaggaggaccacgccggcaccuuccagaucaucgacgaggaggagacccaguucaugagcaacugccccguggccgugaccgagagcacccccagaagaagaaccagaauccagguguucuggaucgccccccccgccggcaccggcugcgugauccugaaggccagcaucgugcagaagagaaucaucuacuuccaggacgagggcagccugaccaagaagcugugcgagcaggacagcaccuucgacggcgugaccgacaagcccauccuggacugcugcgccugcggcaccgccaaguacagacugaccuucuacggcaacuggagcgagaagacccaccccaaggacuaccccagaagagccaaccacuggagcgccaucaucggcggcagccacagcaagaacuacgugcugugggaguacggcggcuacgccagcgagggcgugaagcagguggccgagcugggcagccccgugaagauggaggaggagaucagacagcagagcgacgaggugcugaccgugaucaaggccaaggcccaguggcccgccuggcagccccugaacgugagagccgcccccagcgccgaguucagcguggacagaaccagacaccugaugagcuuccugaccaugaugggccccagccccgacuggaacgugggccugagcgccgaggaccugugcaccaaggagugcggcugggugcagaagguggugcaggaccugauccccugggacgccggcaccgacagcggcgugaccuacgagagccccaacaagcccaccaucccccaggagaagaucagaccccugaccagccuggaccacccccagagccccuucuacgaccccgagggcggcagcaucacccagguggccagaguggugaucgagagaaucgccagaaagggcgagcagugcaacaucgugcccgacaacguggacgacaucguggccgaccuggcccccgaggagaaggacgaggacgacacccccgagaccugcaucuacagcaacuggagccccuggagcgccugcagcagcagcaccugcgacaagggcaagagaaugagacagagaaugcugaaggcccagcuggaccugagcgugcccugccccgacacccaggacuuccagcccugcaugggccccggcugcagcgacgaggacggcagcaccugcaccaugagcgaguggaucaccuggagccccugcagcaucagcugcggcaugggcaugagaagcagagagagauacgugaagcaguuccccgaggacggcagcgugugcacccugcccaccgaggagaccgagaagugcaccgugaacgaggagugcagccccagcagcugccugaugaccgaguggggcgagugggacgagugcagcgccaccugcggcaugggcaugaagaagagacacagaaugaucaagaugaaccccgccgacggcagcaugugcaaggccgagaccagccaggccgagaagugcaugaugcccgagugccacaccauccccugccugcugagccccuggagcgaguggagcgacugcagcgugaccugcggcaagggcaugagaaccagacagagaaugcugaagagccuggccgagcugggcgacugcaacgaggaccuggagcagguggagaagugcaugcugcccgagugccccaucgacugcgagcugaccgaguggagccaguggagcgagugcaacaagagcugcggcaagggccacgugaucagaaccagaaugauccagauggagccccaguucggcggcgcccccugccccgagaccgugcagagaaagaagugcagaaucagaaagugccugagaaaccccagcauccagaagcugagauggagagaggccagagagagcagaagaagcgagcagcugaaggaggagagcgagggcgagcaguuccccggcugcagaaugagacccuggaccgccuggagcgagugcaccaagcugugcggcggcggcauccaggagagauacaugaccgugaagaagagauucaagagcagccaguucaccagcugcaaggacaagaaggagaucagagccugcaacgugcaccccugcuaa

SEQ ID NO: 23967 - RNA, 996 nt, Artificial Sequence
  SPON2__Homo_sapiens__NP_001185950
auggagaaccccagccccgccgccgcccugggcaaggcccugugcgcccugcugcuggccacccugggcgccgccggccagccccugggcggcgagagcaucugcagcgccagagcccccgccaaguacagcaucaccuucaccggcaaguggagccagaccgccuuccccaagcaguacccccuguucagaccccccgcccaguggagcagccugcugggcgccgcccacagcagcgacuacagcauguggagaaagaaccaguacgugagcaacggccugagagacuucgccgagagaggcgaggccugggcccugaugaaggagaucgaggccgccggcgaggcccugcagagcgugcacgccguguucagcgcccccgccgugcccagcggcaccggccagaccagcgccgagcuggaggugcagagaagacacagccuggugagcuucguggugagaaucgugcccagccccgacugguucgugggcguggacagccuggaccugugcgacggcgacagauggagagagcaggccgcccuggaccuguaccccuacgacgccggcaccgacagcggcuucaccuucagcagccccaacuucgccaccaucccccaggacaccgugaccgagaucaccagcagcagccccagccaccccgccaacagcuucuacuaccccagacugaaggcccugccccccaucgccagagugacccuggugagacugagacagagccccagagccuucaucccccccgcccccgugcugcccagcagagacaacgagaucguggacagcgccagcgugcccgagaccccccuggacugcgaggugagccuguggagcagcuggggccugugcggcggccacugcggcagacugggcaccaagagcagaaccagauacgugagagugcagcccgccaacaacggcagccccugccccgagcuggaggaggaggccgagugcgugcccgacaacugcguguaa

SEQ ID NO: 23968 - RNA, 1125 nt, Artificial Sequence
  SPOP__Homo_sapiens__NP_003554
augagcagagugcccagcccccccccccccgccgagaugagcagcggccccguggccgagagcuggugcuacacccagaucaagguggugaaguucagcuacauguggaccaucaacaacuucagcuucugcagagaggagaugggcgaggugaucaagagcagcaccuucagcagcggcgccaacgacaagcugaaguggugccugagagugaaccccaagggccuggacgaggagagcaaggacuaccugagccuguaccugcugcuggugagcugccccaagagcgaggugagagccaaguucaaguucagcauccugaacgccaagggcgaggagaccaaggccauggagagccagagagccuacagauucgugcagggcaaggacuggggcuucaagaaguucaucagaagagacuuccugcuggacgaggccaacggccugcugcccgacgacaagcugacccuguucugcgaggugagcguggugcaggacagcgugaacaucagcggccagaacaccaugaacauggugaaggugcccgagugcagacuggccgacgagcugggcggccugugggagaacagcagauucaccgacugcugccugugcguggccggccaggaguuccaggcccacaaggccauccuggccgccagaagccccguguucagcgccauguucgagcacgagauggaggagagcaagaagaacagaguggagaucaacgacguggagcccgagguguucaaggagaugaugugcuucaucuacaccggcaaggcccccaaccuggacaagauggccgacgaccugcuggccgccgccgacaaguacgcccuggagagacugaaggugaugugcgaggacgcccugugcagcaaccugagcguggagaacgccgccgagauccugauccuggccgaccugcacagcgccgaccagcugaagacccaggccguggacuucaucaacuaccacgccagcgacgugcuggagaccagcggcuggaagagcaugguggugagccacccccaccugguggccgaggccuacagaagccuggccagcgcccagugccccuuccugggcccccccagaaagagacugaagcagagcuaa

SEQ ID NO: 23969 - RNA, 903 nt, Artificial Sequence
  SPP1__Homo_sapiens__NP_000573
augagaaucgccgugaucugcuucugccugcugggcaucaccugcgccauccccgugaagcaggccgacagcggcagcagcgaggagaagcagcuguacaacaaguaccccgacgccguggccaccuggcugaaccccgaccccagccagaagcagaaccugcuggccccccagacccugcccagcaagagcaacgagagccacgaccacauggacgacauggacgacgaggacgacgacgaccacguggacagccaggacagcaucgacagcaacgacagcgacgacguggacgacaccgacgacagccaccagagcgacgagagccaccacagcgacgagagcgacgagcuggugaccgacuuccccaccgaccugcccgccaccgagguguucacccccguggugcccaccguggacaccuacgacggcagaggcgacagcgugguguacggccugagaagcaagagcaagaaguucagaagacccgacauccaguaccccgacgccaccgacgaggacaucaccagccacauggagagcgaggagcugaacggcgccuacaaggccauccccguggcccaggaccugaacgcccccagcgacugggacagcagaggcaaggacagcuacgagaccagccagcuggacgaccagagcgccgagacccacagccacaagcagagcagacuguacaagagaaaggccaacgacgagagcaacgagcacagcgacgugaucgacagccaggagcugagcaaggugagcagagaguuccacagccacgaguuccacagccacgaggacaugcuggugguggaccccaagagcaaggaggaggacaagcaccugaaguucagaaucagccacgagcuggacagcgccagcagcgaggugaacuaa

SEQ ID NO: 23970 - RNA, 636 nt, Artificial Sequence
  SPP2__Homo_sapiens__NP_008875
augaucagcagaauggagaagaugaccaugaugaugaagauccugaucauguucgcccugggcaugaacuacuggagcugcagcggcuuccccguguacgacuacgaccccagcagccugagagacgcccugagcgccagcguggugaaggugaacagccagagccugagccccuaccuguucagagccuucagaagcagccugaagagaguggaggugcuggacgagaacaaccuggugaugaaccuggaguucagcaucagagagaccaccugcagaaaggacagcggcgaggaccccgccaccugcgccuuccagagagacuacuacgugagcaccgccgugugcagaagcaccgugaaggugagcgcccagcaggugcagggcgugcacgccagaugcagcuggagcagcagcaccagcgagagcuacagcagcgaggagaugaucuucggcgacaugcugggcagccacaaguggagaaacaacuaccuguucggccugaucagcgacgagagcaucagcgagcaguucuacgacagaagccugggcaucaugagaagagugcugccccccggcaacagaagauaccccaaccacagacacagagccagaaucaacaccgacuucgaguaa

SEQ ID NO: 23971 - RNA, 1563 nt, Artificial Sequence
  SPPL2A__Homo_sapiens__NP_116191
augggcccccagagaagacugagccccgccggcgccgcccugcuguggggcuuccugcugcagcugaccgccgcccaggaggccauccugcacgccagcggcaacggcaccaccaaggacuacugcaugcuguacaaccccuacuggaccgcccugcccagcacccuggagaacgccaccagcaucagccugaugaaccugaccagcaccccccugugcaaccugagcgacaucccccccgugggcaucaagagcaaggccgugguggugcccuggggcagcugccacuuccuggagaaggccagaaucgcccagaagggcggcgccgaggccaugcugguggugaacaacagcgugcuguucccccccagcggcaacagaagcgaguuccccgacgugaagauccugaucgccuucaucagcuacaaggacuucagagacaugaaccagacccugggcgacaacaucaccgugaagauguacagccccagcuggcccaacuucgacuacaccaugguggugaucuucgugaucgccguguucaccguggcccugggcggcuacuggagcggccugguggagcuggagaaccugaaggccgugaccaccgaggacagagagaugagaaagaagaaggaggaguaccugaccuucagcccccugaccguggugaucuucguggugaucugcugcgugaugauggugcugcuguacuucuucuacaaguggcugguguacgugaugaucgccaucuucugcaucgccagcgccaugagccuguacaacugccuggccgcccugauccacaagauccccuacggccagugcaccaucgccugcagaggcaagaacauggaggugagacugaucuuccugagcggccugugcaucgccguggccguggugugggccguguucagaaacgaggacagaugggccuggauccugcaggacauccugggcaucgccuucugccugaaccugaucaagacccugaagcugcccaacuucaagagcugcgugauccugcugggccugcugcugcuguacgacguguucuucguguucaucacccccuucaucaccaagaacggcgagagcaucaugguggagcuggccgccggccccuucggcaacaacgagaagcugcccguggugaucagagugcccaagcugaucuacuucagcgugaugagcgugugccugaugcccgugagcauccugggcuucggcgacaucaucgugcccggccugcugaucgccuacugcagaagauucgacgugcagaccggcagcagcuacaucuacuacgugagcagcaccguggccuacgccaucggcaugauccugaccuucguggugcuggugcugaugaagaagggccagcccgcccugcuguaccuggugcccugcacccugaucaccgccagcgugguggccuggagaagaaaggagaugaagaaguucuggaagggcaacagcuaccagaugauggaccaccuggacugcgccaccaacgaggagaaccccgugaucagcggcgagcagaucgugcagcaguaa

SEQ ID NO: 23972 - RNA, 1536 nt, Artificial Sequence
  SPPL2B__Homo_sapiens__NP_001070706
auggccgccgccguggccgccgcccuggccagacugcuggccgccuuccugcugcuggccgcccagguggccugcgaguacggcauggugcacguggugagccaggccggcggccccgagggcaaggacuacugcauccuguacaacccccagugggcccaccugccccacgaccugagcaaggccagcuuccugcagcugagaaacuggaccgccagccugcugugcagcgccgccgaccugcccgccagaggcuucagcaaccagaucccccugguggccagaggcaacugcaccuucuacgagaaggugagacuggcccagggcagcggcgccagaggccugcugaucgugagcagagagagacuggugccccccggcggcaacaagacccaguacgacgagaucggcauccccguggcccugcugagcuacaaggacaugcuggacaucuucaccagauucggcagaaccgugagagccgcccuguacgcccccaaggagcccgugcuggacuacaacauggugaucaucuucaucauggccgugggcaccguggccaucggcggcuacugggccggcagcagagacgugaagaagagauacaugaagcacaagagagacgacggccccgagaagcaggaggacgaggccguggacgugacccccgugaugaccugcguguucguggugaugugcugcagcaugcuggugcugcuguacuacuucuacgaccugcugguguacguggugaucggcaucuucugccuggccagcgccaccggccuguacagcugccuggcccccugcgugagaagacugcccuucggcaagugcagaauccccaacaacagccugcccuacuuccacaagagaccccaggccagaaugcugcugcuggcccuguucugcguggccgugagcgugguguggggcguguucagaaacgaggaccagugggccugggugcugcaggacgcccugggcaucgccuucugccuguacaugcugaagaccaucagacugcccaccuucaaggccugcacccugcugcugcuggugcuguuccuguacgacaucuucuucguguucaucacccccuuccugaccaagagcggcagcagcaucaugguggagguggccaccggccccagcgacagcgccaccagagagaagcugcccauggugcugaaggugcccagacugaacagcagcccccuggcccugugcgacagacccuucagccugcugggcuucggcgacauccuggugcccggccugcugguggccuacugccacagauucgacauccaggugcagagcagcagaguguacuucguggccugcaccaucgccuacggcgugggccugcuggugaccuucguggcccuggcccugaugcagagaggccagcccgcccugcuguaccuggugcccugcacccuggugaccagcugcgccguggcccuguggagaagagagcugggcguguucuggaccggcagcggcuucgccgugaacaccagccugcuguaa

SEQ ID NO: 23973 - RNA, 2055 nt, Artificial Sequence
  SPPL2C__Homo_sapiens__NP_787078
auggccugccugggcuuccugcugcccgugggcuuccugcugcugaucagcaccguggccggcggcaaguacggcguggcccacguggugagcgagaacuggagcaaggacuacugcauccuguucagcagcgacuacaucacccugcccagagaccugcaccacgccccccugcugccccuguacgacggcaccaaggcccccuggugccccggcgaggacagcccccaccaggcccagcugagaagccccagccagagaccccugagacagaccaccgccauggugaugagaggcaacugcagcuuccacaccaagggcuggcuggcccagggccagggcgcccacggccugcugaucgugagcagagugagcgaccagcagugcagcgacaccacccuggccccccaggaccccagacagccccuggccgaccugaccauccccguggccaugcugcacuacgccgacaugcuggacauccugagccacaccagaggcgaggccguggugagaguggccauguacgccccccccgagcccaucaucgacuacaacaugcuggugaucuucauccuggccgugggcaccguggccgccggcggcuacugggccggccugaccgaggccaacagacugcagagaagaagagccagaagaggcggcggcagcggcggccaccaccagcugcaggaggccgccgccgccgagggcgcccagaaggaggacaacgaggacauccccguggacuucacccccgccaugaccggcgugguggugacccugagcugcagccugaugcugcugcuguacuucuucuacgaccacuucguguacgugaccaucggcaucuucggccugggcgccggcaucggccuguacagcugccugagcccccuggugugcagacugagccugagacaguaccagagacccccccacagccugugggccagccugccccugccccugcugcugcuggccagccugugcgccaccgugaucaucuucuggguggccuacagaaacgaggacagaugggccuggcugcugcaggacacccugggcaucagcuacugccuguucgugcugcacagagugagacugcccacccugaagaacugcagcagcuuccugcuggcccugcuggccuucgacguguucuucguguucgugacccccuucuucaccaagaccggcgagagcaucauggcccagguggcccugggccccgccgagagcagcagccacgagagacugcccauggugcugaaggugcccagacugagagugagcgcccugacccugugcagccagcccuucagcauccugggcuucggcgacaucguggugcccggcuuccugguggccuacugcugcagauucgacgugcaggugugcagcagacagaucuacuucguggccugcaccguggccuacgccgugggccugcuggugaccuucauggccauggugcugaugcagaugggccagcccgcccugcuguaccuggugagcagcacccugcugaccagccuggccguggccgccugcagacaggagcugagccuguucuggaccggccagggcagagccaagaugugcggccugggcugcgcccccagcgccggcagcagacagaagcaggagggcgccgccgacgcccacaccgccagcacccuggagagaggcaccagcagaggcgccggcgaccuggacagcaaccccggcgaggacaccaccgagaucgugaccaucagcgagaacgaggccaccaaccccgaggacagaagcgacagcagcgagggcuggagcgacgcccaccuggaccccaacgagcugcccuucaucccccccggcgccagcgaggagcugaugccccugaugcccauggccaugcugaucccccugaugccccugaugcccccccccagcgagcugggccacgugcacgcccaggcccaggcccacgagaccggccugcccugggccggccugcacaagagaaagggccugaaggugagaaagagcaugagcacccaggccccccuguaa

SEQ ID NO: 23974 - RNA, 1155 nt, Artificial Sequence
  SPPL3__Homo_sapiens__NP_620584
auggccgagcagaccuacagcugggccuacagccugguggacagcagccaggugagcaccuuccugaucagcauccugcugaucguguacggcagcuucagaagccugaacauggacuucgagaaccaggacaaggagaaggacagcaacagcagcagcggcagcuucaacggcaacagcaccaacaacagcauccagaccaucgacagcacccaggcccuguuccugcccaucggcgccagcgugagccugcuggugauguucuucuucuucgacagcgugcaggugguguucaccaucugcaccgccgugcuggccaccaucgccuucgccuuccugcugcugcccaugugccaguaccugaccagacccugcagcccccagaacaagaucagcuucggcugcugcggcagauucaccgccgccgagcugcugagcuucagccugagcgugaugcuggugcugaucugggugcugaccggccacuggcugcugauggacgcccuggccaugggccugugcguggccaugaucgccuucgugagacugcccagccugaaggugagcugccugcugcugagcggccugcugaucuacgacguguucuggguguucuucagcgccuacaucuucaacagcaacgugauggugaagguggccacccagcccgccgacaacccccuggacgugcugagcagaaagcugcaccugggccccaacgugggcagagacgugcccagacugagccugcccggcaagcugguguuccccagcagcaccggcagccacuucagcaugcugggcaucggcgacaucgugaugcccggccugcugcugugcuucgugcugagauacgacaacuacaagaagcaggccagcggcgacagcugcggcgcccccggccccgccaacaucagcggcagaaugcagaaggugagcuacuuccacugcacccugaucggcuacuucgugggccugcugaccgccaccguggccagcagaauccacagagccgcccagcccgcccugcuguaccuggugcccuucacccugcugccccugcugaccauggccuaccugaagggcgaccugagaagaauguggagcgagcccuuccacagcaagagcagcagcagcagauuccuggagguguaa

SEQ ID NO: 23975 - RNA, 1335 nt, Artificial Sequence
  SPRED1__Homo_sapiens__NP_689807
augagcgaggagaccgccaccagcgacaacgacaacagcuacgccagagugagagccguggugaugaccagagacgacagcagcggcggcuggcugccccugggcggcagcggccugagcagcgugaccguguucaaggugccccaccaggaggagaacggcugcgccgacuucuucaucagaggcgagagacugagagacaagaugguggugcuggagugcaugcugaagaaggaccugaucuacaacaaggugacccccaccuuccaccacuggaagaucgacgacaagaaguucggccugaccuuccagagccccgccgacgccagagccuucgacagaggcaucagaagagccaucgaggacaucagccagggcugccccgagagcaagaacgaggccgagggcgccgacgaccugcaggccaacgaggaggacagcagcagcagccuggugaaggaccaccuguuccagcaggagaccguggugaccagcgagcccuacagaagcagcaacaucagacccagccccuucgaggaccugaacgccagaagaguguacaugcagagccaggccaaccagaucaccuucggccagcccggccuggacauccagagcagaagcauggaguacgugcagagacagaucagcaaggagugcggcagccugaagagccagaacagagugccccugaagagcaucagacacgugagcuuccaggacgaggacgagaucgugagaaucaaccccagagacauccugaucagaagauacgccgacuacagacaccccgacauguggaagaacgaccuggagagagacgacgccgacagcagcauccaguucagcaagcccgacagcaagaagagcgacuaccuguacagcugcggcgacgagaccaagcugagcagccccaaggacagcgugguguucaagacccagcccagcagccugaagaucaagaagagcaagagaagaaaggaggacggcgagagaagcagaugcguguacugccaggagagauucaaccacgaggagaacgugagaggcaagugccaggacgcccccgaccccaucaagagaugcaucuaccaggugagcugcaugcugugcgccgagagcaugcuguaccacugcaugagcgacagcgagggcgacuucagcgaccccugcagcugcgacaccagcgacgacaaguucugccugagauggcuggcccugguggcccugagcuucaucgugcccugcaugugcugcuacgugccccugagaaugugccacagaugcggcgaggccugcggcugcugcggcggcaagcacaaggccgccggcuaa

SEQ ID NO: 23976 - RNA, 1248 nt, Artificial Sequence
  SPRED2__Homo_sapiens__NP_001121682
auggccagccccggcagcgacagcuacaucgugagagugaaggccguggugaugaccagagacgacagcagcggcggcugguucccccaggagggcggcggcaucagcagagugggcgugugcaaggugaugcaccccgagggcaacggcagaagcggcuuccugauccacggcgagagacagaaggacaagcugguggugcuggagugcuacgugagaaaggaccugguguacaccaaggccaaccccaccuuccaccacuggaagguggacaacagaaaguucggccugaccuuccagagccccgccgacgccagagccuucgacagaggcgugagaaaggccaucgaggaccugaucgagggcagcaccaccagcagcagcaccauccacaacgaggccgagcugggcgacgacgacguguucaccaccgccaccgacagcagcagcaacagcagccagaagagagagcagcccaccagaaccaucagcagccccaccagcugcgagcacagaagaaucuacacccugggccaccugcacgacagcuaccccaccgaccacuaccaccuggaccagcccaugcccagacccuacagacaggugagcuuccccgacgacgacgaggagaucgugagaaucaaccccagagagaagaucuggaugaccggcuacgaggacuacagacacgcccccgugagaggcaaguaccccgaccccagcgaggacgccgacagcagcuacgugagauucgccaagggcgaggugcccaagcacgacuacaacuaccccuacguggacagcagcgacuucggccugggcgaggaccccaagggcagaggcggcagcgugaucaagacccagcccagcagaggcaagagcagaagaagaaaggaggacggcgagagaagcagaugcguguacugcagagacauguucaaccacgaggagaacagaagaggccacugccaggacgcccccgacagcgugagaaccugcaucagaagagugagcugcauguggugcgccgacagcaugcuguaccacugcaugagcgaccccgagggcgacuacaccgaccccugcagcugcgacaccagcgacgagaaguucugccugagauggauggcccugaucgcccugagcuuccuggcccccugcaugugcugcuaccugccccugagagccugcuaccacugcggcgugaugugcagaugcugcggcggcaagcacaaggccgccgccuaa

SEQ ID NO: 23977 - RNA, 1233 nt, Artificial Sequence
  SPRED3__Homo_sapiens__XP_011525279
auggugagagugagagccguggugauggccagagacgacagcagcggcggcuggcugcccgugggcggcggcggccugagccaggugagcgugugcagagugagaggcgccagacccgagggcggcgccagacagggccacuacgugauccacggcgagagacugagagaccagaagaccacccuggagugcacccugaagcccggccugguguacaacaaggugaaccccaucuuccaccacuggagccugggcgacugcaaguucggccugaccuuccagagccccgccgaggccgacgaguuccagaagagccugcuggccgcccuggccgcccugggcagaggcagccugacccccagcagcagcagcagcagcagcagccccagccaggacaccgccgagacccccugcccccugaccagccacguggacagcgacagcagcagcagccacagcagacaggagaccccccccagcgccgccgccgcccccaucaucaccauggagagcgccagcggcuucggccccaccacccccccccagagaagaagaagcagcgcccagagcuaccccccccugcugcccuucaccggcauccccgagcccagcgagccccuggccggcgccggcggccugggcuggggcggcagaggcuacgaggacuacagaagaagcggcccccccgccccccuggcccugagcaccugcguggugagauucgccaagaccggcgcccugagaggcgccgcccugggcccccccgccgcccugcccgccccccugaccgaggccgccccccccgccccccccgccagacccccccccggccccggccccagcagcgcccccgccaaggccagccccgaggccgaggaggccgccagaugcgugcacugcagagcccuguucagaagaagagccgacggcagaggcggcagaugcgccgaggcccccgaccccggcagacugcuggugagaagacugagcugccuguggugcgccgagagccugcuguaccacugccugagcgacgccgagggcgacuucagcgaccccugcgccugcgagcccggccaccccagacccgccgccagaugggccgcccuggccgcccugagccuggccgugcccugccugugcugcuacgccccccugagagccugccacuggguggccgccagaugcggcugcgccggcugcggcggcagacacgaggaggccgccagauaa

SEQ ID NO: 23978 - RNA, 786 nt, Artificial Sequence
  SPR__Homo_sapiens__NP_003115
auggagggcggccugggcagagccgugugccugcugaccggcgccagcagaggcuucggcagaacccuggccccccugcuggccagccugcugagccccggcagcgugcuggugcugagcgccagaaacgacgaggcccugagacagcuggaggccgagcugggcgccgagagaagcggccugagaguggugagagugcccgccgaccugggcgccgaggccggccugcagcagcugcugggcgcccugagagagcugcccagacccaagggccugcagagacugcugcugaucaacaacgccggcagccugggcgacgugagcaagggcuucguggaccugagcgacagcacccaggugaacaacuacugggcccugaaccugaccagcaugcugugccugaccagcagcgugcugaaggccuuccccgacagccccggccugaacagaaccguggugaacaucagcagccugugcgcccugcagcccuucaagggcugggcccuguacugcgccggcaaggccgccagagacaugcuguuccaggugcuggcccuggaggagcccaacgugagagugcugaacuacgcccccggcccccuggacaccgacaugcagcagcuggccagagagaccagcguggaccccgacaugagaaagggccugcaggagcugaaggccaagggcaagcugguggacugcaaggugagcgcccagaagcugcugagccugcuggagaaggacgaguucaagagcggcgcccacguggacuucuacgacaaguaa

SEQ ID NO: 23979 - RNA, 456 nt, Artificial Sequence
  SPRN__Homo_sapiens__NP_001012526
augaacugggcccccgccaccugcugggcccugcugcuggccgccgccuuccugugcgacagcggcgccgccaagggcggcagaggcggcgccagaggcagcgccagaggcggcgugagaggcggcgccagaggcgccagcagagugagagugagacccgcccagagauacggcgcccccggcagcagccugagaguggccgccgccggcgccgccgccggcgccgccgccggcgccgccgccggccuggccgccggcagcggcuggagaagagccgccggccccggcgagagaggccuggaggacgaggaggacggcgugcccggcggcaacggcaccggccccggcaucuacagcuacagagccuggaccagcggcgccggccccaccagaggccccagacugugccuggugcugggcggcgcccugggcgcccugggccugcugagacccuaa

SEQ ID NO: 23980 - RNA, 270 nt, Artificial Sequence
  SPRR1A__Homo_sapiens__NP_001186757
augaacagccagcagcagaagcagcccugcaccccccccccccagccccagcagcagcaggugaagcagcccugccagccccccccccaggagcccugcauccccaagaccaaggagcccugccaccccaaggugcccgagcccugccaccccaaggugcccgagcccugccagcccaaggugcccgagcccugccagcccaaggugcccgagcccugccccagcaccgugacccccgcccccgcccagcagaagaccaagcagaaguaa

SEQ ID NO: 23981 - RNA, 270 nt, Artificial Sequence
  SPRR1B__Homo_sapiens__NP_003116
augagcagccagcagcagaagcagcccugcaccccccccccccagcugcagcagcagcaggugaagcagcccugccagccccccccccaggagcccugcauccccaagaccaaggagcccugccaccccaaggugcccgagcccugccaccccaaggugcccgagcccugccagcccaaggugcccgagcccugccaccccaaggugcccgagcccugccccagcaucgugacccccgcccccgcccagcagaagaccaagcagaaguaa

SEQ ID NO: 23982 - RNA, 219 nt, Artificial Sequence
  SPRR2A__Homo_sapiens__NP_005979
augagcuaccagcagcagcagugcaagcagcccugccagcccccccccgugugccccacccccaagugccccgagcccugccccccccccaagugccccgagcccugccccccccccaagugcccccagcccugccccccccagcagugccagcagaaguacccccccgugacccccagcccccccugccagagcaaguacccccccaagagcaaguaa

SEQ ID NO: 23983 - RNA, 219 nt, Artificial Sequence
  SPRR2B__Homo_sapiens__NP_001017418
augagcuaccagcagcagcagugcaagcagcccugccagcccccccccgugugccccacccccaagugccccgagcccugccccccccccaagugccccgagcccugccccccccccaagugcccccagcccugccccccccagcagugccagcagaaguacccccccgugacccccagcccccccugccagcccaaguacccccccaagagcaaguaa

SEQ ID NO: 23984 - RNA, 510 nt, Artificial Sequence
  SPRR3__Homo_sapiens__NP_001091058
augagcagcuaccagcagaagcagaccuucaccccccccccccagcugcagcagcagcaggugaagcagcccagccagccccccccccaggagaucuucgugcccaccaccaaggagcccugccacagcaaggugccccagcccggcaacaccaagauccccgagcccggcugcaccaaggugcccgagcccggcugcaccaaggugcccgagcccggcugcaccaaggugcccgagcccggcugcaccaaggugcccgagcccggcugcaccaaggugcccgagcccggcugcaccaaggugcccgagcccggcuacaccaaggugcccgagcccggcagcaucaaggugcccgaccagggcuucaucaaguuccccgagcccggcgccaucaaggugcccgagcagggcuacaccaaggugcccgugcccggcuacaccaagcugcccgagcccugccccagcaccgugacccccggccccgcccagcagaagaccaagcagaaguaa

SEQ ID NO: 23985 - RNA, 753 nt, Artificial Sequence
  SPRTN__Homo_sapiens__NP_001010984
auggacgacgaccugaugcuggcccugagacugcaggaggaguggaaccugcaggaggccgagagagaccacgcccaggagagccugagccugguggacgccagcugggagcugguggaccccacccccgaccugcaggcccuguucgugcaguucaacgaccaguucuucuggggccagcuggaggccguggaggugaaguggagcgugagaaugacccugugcgccggcaucugcagcuacgagggcaagggcggcaugugcagcaucagacugagcgagccccugcugaagcugagacccagaaaggaccugguggagacccugcugcacgagaugauccacgccuaccuguucgugaccaacaacgacaaggacagagagggccacggccccgaguucugcaagcacaugcacagaaucaacagccugaccggcgccaacaucaccguguaccacaccuuccacgacgagguggacgaguacagaagacacugguggagaugcaacggccccugccagcacagaccccccuacuacggcuacgugaagagagccaccaacagagagcccagcgcccacgacuacuggugggccgagcaccagaagaccugcggcggcaccuacaucaagaucaaggagcccgagaacuacagcaagaagggcaagggcaaggccaagcugggcaaggagcccgugcuggccgccgagaacaagggcaccuucguguacauccugcugaucuucauguaa

SEQ ID NO: 23986 - RNA, 960 nt, Artificial Sequence
  SPRY1__Homo_sapiens__NP_001244968
auggacccccagaaccagcacggcagcggcagcagccugguggugauccagcagcccagccuggacagcagacagagacuggacuacgagagagagauccagcccaccgccauccugagccuggaccagaucaaggccaucagaggcagcaacgaguacaccgagggccccagcguggugaagagacccgcccccagaaccgcccccagacaggagaagcacgagagaacccacgagaucauccccaucaacgugaacaacaacuacgagcacagacacaccagccaccugggccacgccgugcugcccagcaacgccagaggccccauccugagcagaagcaccagcaccggcagcgccgccagcagcggcagcaacagcagcgccagcagcgagcagggccugcugggcagaagcccccccaccagacccgugcccggccacagaagcgagagagccaucagaacccagcccaagcagcugaucguggacgaccugaagggcagccugaaggaggaccugacccagcacaaguucaucugcgagcagugcggcaagugcaagugcggcgagugcaccgcccccagaacccugcccagcugccuggccugcaacagacagugccugugcagcgccgagagcaugguggaguacggcaccugcaugugccuggugaagggcaucuucuaccacugcagcaacgacgacgagggcgacagcuacagcgacaaccccugcagcugcagccagagccacugcugcagcagauaccugugcaugggcgccaugagccuguuccugcccugccugcugugcuacccccccgccaagggcugccugaagcugugcagaagaugcuacgacuggauccacagacccggcugcagaugcaagaacagcaacaccguguacugcaagcuggagagcugccccagcagaggccagggcaagcccagcuaa

SEQ ID NO: 23987 - RNA, 948 nt, Artificial Sequence
  SPRY2__Homo_sapiens__NP_005833
auggaggccagagcccagagcggcaacggcagccagccccugcugcagacccccagagacggcggcagacagagaggcgagcccgaccccagagacgcccugacccagcaggugcacgugcugagccuggaccagaucagagccaucagaaacaccaacgaguacaccgagggccccaccguggugcccagacccggccugaagcccgcccccagacccagcacccagcacaagcacgagagacugcacggccugcccgagcacagacagccccccagacugcagcacagccaggugcacagcagcgccagagccccccugagcagaagcaucagcaccgugagcagcggcagcagaagcagcaccagaaccagcaccagcagcagcagcagcgagcagagacugcugggcagcagcuucagcagcggccccguggccgacggcaucaucagagugcagcccaagagcgagcugaagcccggcgagcugaagccccugagcaaggaggaccugggccugcacgccuacagaugcgaggacugcggcaagugcaagugcaaggagugcaccuaccccagaccccugcccagcgacuggaucugcgacaagcagugccugugcagcgcccagaacgugaucgacuacggcaccugcgugugcugcgugaagggccuguucuaccacugcagcaacgacgacgaggacaacugcgccgacaaccccugcagcugcagccagagccacugcugcaccagauggagcgccaugggcgugaugagccuguuccugcccugccuguggugcuaccugcccgccaagggcugccugaagcugugccagggcugcuacgacagagugaacagacccggcugcagaugcaagaacagcaacaccgugugcugcaaggugcccaccgugccccccagaaacuucgagaagcccaccuaa

SEQ ID NO: 23988 - RNA, 867 nt, Artificial Sequence
  SPRY3__Homo_sapiens__NP_005831
auggacgccgccgugaccgacgacuuccagcagauccugcccaucgagcagcugagaagcacccacgccagcaacgacuacguggagagaccccccgcccccugcaagcaggcccugagcagccccagccugaucgugcagacccacaagagcgacuggagccuggccaccaugcccaccagccugcccagaagccugagccagugccaccagcugcagccccugccccagcaccugagccagagcagcaucgccagcagcaugagccacagcaccaccgccagcgaccagagacugcuggccagcaucacccccagccccagcggccagagcaucaucagaacccagcccggcgccggcgugcaccccaaggccgacggcgcccugaagggcgaggccgagcagagcgccggccaccccagcgagcaccuguucaucugcgaggagugcggcagaugcaagugcgugcccugcaccgccgccagaccccugcccagcugcuggcugugcaaccagagaugccugugcagcgccgagagccugcuggacuacggcaccugccugugcugcgugaagggccuguucuaccacugcagcaccgacgacgaggacaacugcgccgacgagcccugcagcugcggccccagcagcugcuucgugagaugggccgccaugagccugaucagccuguuccugcccugccugugcugcuaccugcccaccagaggcugccugcaccugugccagcagggcuacgacagccugagaagacccggcugcagaugcaagagacacaccaacaccgugugcagaaagaucagcagcggcagcgcccccuuccccaaggcccaggagaagagcguguaa

SEQ ID NO: 23989 - RNA, 900 nt, Artificial Sequence
  SPRY4__Homo_sapiens__NP_001280218
auggagccccccaucccccagagcgccccccugacccccaacagcgugauggugcagccccugcuggacagcagaaugagccacagcagacugcagcacccccugaccauccugcccaucgaccaggugaagaccagccacguggagaacgacuacaucgacaaccccagccuggcccugaccaccggccccaagagaaccagaggcggcgcccccgagcuggcccccacccccgccagaugcgaccaggacgugacccaccacuggaucagcuucagcggcagacccagcagcgugagcagcagcagcagcaccagcagcgaccagagacugcuggaccacauggcccccccccccguggccgaccaggccagccccagagccgugagaauccagcccaagguggugcacugccagccccuggaccugaagggccccgccgugccccccgagcuggacaagcacuuccugcugugcgaggccugcggcaagugcaagugcaaggagugcgccagccccagaacccugcccagcugcugggugugcaaccaggagugccugugcagcgcccagacccuggugaacuacggcaccugcaugugccuggugcagggcaucuucuaccacugcaccaacgaggacgacgagggcagcugcgccgaccaccccugcagcugcagcagaagcaacugcugcgccagauggagcuucaugggcgcccugagcguggugcugcccugccugcugugcuaccugcccgccaccggcugcgugaagcuggcccagagaggcuacgacagacugagaagacccggcugcagaugcaagcacaccaacagcgugaucugcaaggccgccagcggcgacgccaagaccagcagacccgacaagcccuucuaa

SEQ ID NO: 23990 - RNA, 474 nt, Artificial Sequence
  SPRYD7__Homo_sapiens__NP_001120954
auggccaccagcgugcugugcugccugagaugcugcagagacggcggcaccggccacaucccccugaaggagaugcccgccgugcagcuggacacccagcacaugggcaucuggggcaucggcguggccacccagaaggugaaccugaaccagaucccccugggcagagacaugcacagccuggugaugagaaacgacggcgcccuguaccacaacaacgaggagaagaacagacugcccgccaacagccugccccaggagggcgacguggugggcaucaccuacgaccacguggagcugaacguguaccugaacggcaagaacaugcacugccccgccagcggcaucagaggcaccguguaccccgugguguacguggacgacagcgccauccuggacugccaguucagcgaguucuaccacacccccccccccggcuucgagaagauccuguucgagcagcagaucuucuaa

SEQ ID NO: 23991 - RNA, 1068 nt, Artificial Sequence
  SPSB3__Homo_sapiens__NP_543137
auggccagaagacccagaaacagcagagccuggcacuucgugcugagcgccgccagaagagacgccgacgccagagccguggcccuggccggcagcaccaacuggggcuacgacagcgacggccagcacagcgacagcgacagcgaccccgaguacagcacccugccccccagcauccccagcgccgugcccgugaccggcgagagcuucugcgacugcgccggccagagcgaggccagcuucugcagcagccugcacagcgcccacagaggcagagacugcagaugcggcgaggaggacgaguacuucgacugggugugggacgaccugaacaagagcagcgccacccugcugagcugcgacaacagaaaggugagcuuccacauggaguacagcugcggcaccgccgccaucagaggcaccaaggagcugggcgagggccagcacuucugggagaucaagaugaccagccccguguacggcaccgacaugauggugggcaucggcaccagcgacguggaccuggacaaguacagacacaccuucugcagccugcugggcagagacgaggacagcuggggccugagcuacaccggccugcugcaccacaagggcgacaagaccagcuucagcagcagauucggccagggcagcaucaucggcgugcaccuggacaccuggcacggcacccugaccuucuucaagaacagaaagugcaucggcguggccgccaccaagcugcagaacaagagauucuaccccauggugugcagcaccgccgccagaagcagcaugaaggugaccagaagcugcgccagcgccaccagccugcaguaccugugcugccacagacugagacagcugagacccgacagcggcgacacccuggagggccugccccugccccccggccugaagcaggugcugcacaacaagcugggcugggugcugagcaugagcugcagcagaagaaaggcccccgugagcgacccccaggccgccaccagcgcccaccccagcagcagagagcccagacccugccagagaaagagaugcagaagaaccuaa

SEQ ID NO: 23992 - RNA, 822 nt, Artificial Sequence
  SPSB4__Homo_sapiens__NP_543138
augggccagaagcugagcggcagccugaagagcguggaggugagagagcccgcccugagacccgccaagagagagcugagaggcgccgagcccggcagacccgccagacuggaccagcugcuggacaugcccgccgccggccuggccgugcagcugagacacgccuggaaccccgaggacagaagccugaacguguucgugaaggacgacgacagacugaccuuccacagacaccccguggcccagagcaccgacggcaucagaggcaaggugggccacgccagaggccugcacgccuggcagaucaacuggcccgccagacagagaggcacccacgccguggugggcguggccaccgccagagccccccugcacagcgugggcuacaccgcccuggugggcagcgacgccgagagcuggggcugggaccugggcagaagcagacuguaccacgacggcaagaaccagcccggcguggccuaccccgccuuccugggccccgacgaggccuucgcccugcccgacagccugcugguggugcuggacauggacgagggcacccugagcuucaucguggacggccaguaccugggcguggccuucagaggccugaagggcaagaagcuguaccccguggugagcgccguguggggccacugcgaggugaccaugagauacaucaacggccuggaccccgagccccugccccugauggaccugugcagaagaagcaucagaagcgcccugggcagacagagacugcaggacaucagcagccugccccugccccagagccugaagaacuaccugcaguaccaguaa

SEQ ID NO: 23993 - RNA, 7260 nt, Artificial Sequence
  SPTA1__Homo_sapiens__XP_011508218
auggagcaguuccccaaggagaccgugguggagagcagcggccccaaggugcuggagaccgccgaggagauccaggagagaagacaggaggugcugaccagauaccagagcuucaaggagagaguggccgagagaggccagaagcuggaggacagcuaccaccugcagguguucaagagagacgccgacgaccugggcaaguggaucauggagaaggugaacauccugaccgacaagagcuacgaggaccccaccaacauccagggcaaguaccagaagcaccagagccuggaggccgaggugcagaccaagagcagacugaugagcgagcuggagaagaccagagaggagagauucaccaugggccacagcgcccacgaggagaccaaggcccacaucgaggagcugagacaccugugggaccugcugcuggagcugacccuggagaagggcgaccagcugcugagagcccugaaguuccagcaguacgugcaggagugcgccgacauccuggaguggaucggcgacaaggaggccaucgccaccagcguggagcugggcgaggacugggagagaaccgaggugcugcacaagaaguucgaggacuuccagguggagcugguggccaaggagggcagagugguggaggugaaccaguacgccaacgagugcgccgaggagaaccaccccgaccugccccugauccagagcaagcagaacgaggugaacgccgccugggagagacugagaggccuggcccugcagagacagaaggcccugagcaacgccgccaaccugcagagauucaagagagacgugaccgaggccauccaguggaucaaggagaaggagcccgugcugaccagcgaggacuacggcaaggaccugguggccagcgagggccuguuccacagccacaagggccuggagagaaaccuggccgugaugagcgacaaggugaaggagcugugcgccaaggccgagaagcugacccugagccaccccagcgacgccccccagauccaggagaugaaggaggaccuggugagcagcugggagcacaucagagcccuggccaccagcagauacgagaagcugcaggccaccuacugguaccacagauucagcagcgacuucgacgagcugagcggcuggaugaacgagaagaccgccgccaucaacgccgacgagcugcccaccgacguggccggcggcgaggugcugcuggacagacaccagcagcacaagcacgagaucgacagcuacgacgacagauuccagagcgccgacgagaccggccaggaccuggugaacgccaaccacgaggccagcgacgaggugagagagaagauggagauccuggacaacaacuggaccgcccugcuggagcugugggacgagagacacagacaguacgagcagugccuggacuuccaccuguucuacagagacagcgagcagguggacagcuggaugagcagacaggaggccuuccuggagaacgaggaccugggcaacagccugggcagcgccgaggcccugcugcagaagcacgaggacuucgaggaggccuucaccgcccaggaggagaagaucaucaccguggacaagaccgccaccaagcugaucggcgacgaccacuacgacagcgagaacaucaaggccaucagagacggccugcuggccagaagagacgcccugagagagaaggccgccaccagaagaagacugcugaaggagagccugcugcugcagaagcuguacgaggacagcgacgaccugaagaacuggaucaacaagaagaagaagcuggccgacgacgaggacuacaaggacauccagaaccugaagagcagagugcagaagcagcagguguucgagaaggagcuggccgugaacaagacccagcuggagaacauccagaagaccggccaggagaugaucgagggcggccacuacgccagcgacaacgugaccaccagacugagcgagguggccagccugugggaggagcugcuggaggccaccaagcagaagggcacccagcugcacgaggccaaccagcagcugcaguucgagaacaacgccgaggaccugcagagauggcuggaggacguggaguggcaggugaccagcgaggacuacggcaagggccuggccgaggugcagaacagacugagaaagcacggccugcuggagagcgccguggccgccagacaggaccagguggacauccugaccgaccuggccgccuacuucgaggagaucggccaccccgacagcaaggacaucagagccagacaggagagccuggugugcagauucgaggcccugaaggagccccuggccaccagaaagaagaagcugcuggaccugcugcaccugcagcugaucugcagagacaccgaggacgaggaggccuggauccaggagaccgagcccagcgccaccagcaccuaccugggcaaggaccugaucgccagcaagaagcugcugaacagacacagagugauccuggagaacaucgccagccacgagcccagaauccaggagaucaccgagagaggcaacaagaugguggaggagggccacuucgccgccgaggacguggccagcagagugaagagccugaaccagaacauggagagccugagagccagagccgccagaagacagaacgaccuggaggccaacgugcaguuccagcaguaccuggccgaccugcacgaggccgagaccuggaucagagagaaggagcccaucguggacaacaccaacuacggcgccgacgaggaggccgccggcgcccugcugaagaagcacgaggccuuccugcuggaccugaacagcuucggcgacagcaugaaggcccugagaaaccaggccaacgccugccagcagcagcaggccgcccccguggagggcguggccggcgagcagagagugauggcccuguacgacuuccaggccagaagccccagagaggugaccaugaagaagggcgacgugcugacccugcugagcagcaucaacaaggacugguggaagguggaggccgccgaccaccagggcaucgugcccgccguguacgugagaagacuggcccacgacgaguuccccaugcugccccagagaagaagagaggagcccggcaacaucacccagagacaggagcagaucgagaaccaguacagaagccugcuggacagagccgaggagagaagaagaagacugcugcagagauacaacgaguuccugcuggccuacgaggccggcgacaugcuggaguggauccaggagaagaaggccgagaacaccggcguggagcuggacgacgugugggagcugcagaagaaguucgacgaguuccagaaggaccugaacaccaacgagcccagacugagagacaucaacaagguggccgacgaccugcuguucgagggccugcugacccccgagggcgcccagaucagacaggagcugaacagcagauggggcagccugcagagacuggccgacgagcagagacagcugcugggcagcgcccacgccguggagguguuccacagagaggccgacgacaccaaggagcagaucgagaagaagugccaggcccugagcgccgccgaccccggcagcgaccuguucagcgugcaggcccugcagagaagacacgagggcuucgagagagaccuggugccccugggcgacaaggugaccauccugggcgagaccgccgagagacugagcgagagccaccccgacgccaccgaggaccugcagagacagaagauggagcugaacgaggccugggaggaccugcagggcagaaccaaggacagaaaggagagccugaacgaggcccagaaguucuaccuguuccugagcaaggccagagaccugcagaacuggaucagcagcaucggcggcauggugagcagccaggagcuggccgaggaccugaccggcaucgagauccugcuggagagacaccaggagcacagagccgacauggaggccgaggcccccaccuuccaggcccuggaggacuucagcgccgagcugaucgacagcggccaccacgccagccccgagaucgagaagaagcugcaggccgugaagcuggagagagacgaccuggagaaggccugggagaagagaaagaagauccuggaccagugccuggagcugcagauguuccagggcaacugcgaccagguggagagcuggaugguggccagagagaacagccugagaagcgacgacaagagcagccuggacagccuggaggcccugaugaagaagagagacgaccuggacaaggccaucaccgcccaggagggcaagaucaccgaccuggagcacuucgccgagagccugaucgccgacgagcacuacgccaaggaggagaucgccaccagacugcagagagugcuggacagauggaaggcccugaaggcccagcugaucgacgagagaaccaagcugggcgacuacgccaaccugaagcaguucuacagagaccuggaggagcuggaggaguggaucagcgagaugcugcccaccgccugcgacgagagcuacaaggacgccaccaacauccagagaaaguaccugaagcaccagaccuucgcccacgagguggacggcagaagcgagcaggugcacggcgugaucaaccugggcaacagccugaucgagugcagcgccugcgacggcaacgaggaggccaugaaggagcagcuggagcagcugaaggagcacugggaccaccugcuggagagaaccaacgacaagggcaagaagcugaacgaggccagcagacagcagagauucaacaccagcaucagagacuucgaguucuggcugagcgaggccgagacccugcuggccaugaaggaccaggccagagaccuggccagcgccggcaaccugcugaagaagcaccagcugcuggagagagagaugcuggccagagaggacgcccugaaggaccugaacacccuggccgaggaccugcugagcagcggcaccuucaacguggaccagaucgugaagaagaaggacaacgugaacaagagauuccugaacgugcaggagcuggccgccgcccaccacgagaagcugaaggaggccuacgcccuguuccaguucuuccaggaccuggacgacgaggagagcuggaucgaggagaagcugaucagagugagcagccaggacuacggcagagaccugcagggcgugcagaaccugcugaagaagcacaagagacuggagggcgagcugguggcccacgagcccgccauccagaacgugcuggacauggccgagaagcugaaggacaaggccgccgugggccaggaggagauccagcugagacuggcccaguucguggagcacugggagaagcugaaggagcuggccaaggccagaggccugaagcuggaggagagccuggaguaccugcaguucaugcagaacgccgaggaggaggaggccuggaucaacgagaagaacgcccuggccgugagaggcgacugcggcgacacccuggccgccacccagagccugcugaugaagcacgaggcccuggagaacgacuucgccgugcacgagaccagagugcagaacgugugcgcccagggcgaggacauccugaacaaggugcugcaggaggagagccagaacaaggagaucagcagcaagaucgaggcccugaacgagaagacccccagccuggccaaggccaucgccgccuggaagcugcagcuggaggacgacuacgccuuccaggaguucaacuggaaggccgacgugguggaggccuggaucgccgacaaggagaccagccugaagaccaacggcaacggcgccgaccugggcgacuuccugacccugcuggccaagcaggacacccuggacgccagccugcagagcuuccagcaggagagacugcccgagaucaccgaccugaaggacaagcugaucagcgcccagcacaaccagagcaaggccaucgaggagagauacgccgcccugcugaagagaugggagcagcugcuggaggccagcgccgugcacagacagaagcugcuggagaagcagcugccccugcagaaggccgaggaccuguucguggaguucgcccacaaggccagcgcccugaacaacuggugcgagaagauggaggagaaccugagcgagcccgugcacugcgugagccugaacgagaucagacagcugcagaaggaccacgaggacuuccuggccagccuggccagagcccaggccgacuucaagugccugcuggagcuggaccagcagaucaaggcccugggcgugcccagcagccccuacaccuggcugaccguggaggugcuggagagaaccuggaagcaccugagcgacaucaucgaggagagagagcaggagcugcagaaggaggaggccagacaggugaagaacuucgagaugugccaggaguucgagcagaacgccagcaccuuccugcaguggauccuggagaccagagccuacuuccuggacggcagccugcugaaggagaccggcacccuggagagccagcuggaggccaacaagagaaagcagaaggagauccaggccaugaagagacagcugaccaagaucguggaccugggcgacaaccuggaggacgcccugauccuggacaucaaguacagcaccaucggccuggcccagcagugggaccagcuguaccagcugggccugagaaugcagcacaaccuggagcagcagauccaggccaaggacaucaagggcgugagcgaggagacccugaaggaguucagcaccaucuacaagcacuucgacgagaaccugaccggcagacugacccacaaggaguucagaagcugccugagaggccugaacuacuaccugcccaugguggaggaggacgagcacgagcccaaguucgagaaguuccuggacgccguggaccccggcagaaagggcuacgugagccuggaggacuacaccgccuuccugaucgacaaggagagcgagaacaucaagagcagcgacgagaucgagaacgccuuccaggcccuggccgagggcaagagcuacaucaccaaggaggacaugaagcaggcccugacccccgagcaggugagcuucugcgccacccacaugcagcaguacauggaccccagaggcagaagccaccugagcggcuacgacuacgugggcuucaccaacagcuacuucggcaacuaa

SEQ ID NO: 23994 - RNA, 7434 nt, Artificial Sequence
  SPTAN1__Homo_sapiens__NP_001123910
auggaccccagcggcgugaaggugcuggagaccgccgaggacauccaggagagaagacagcaggugcuggacagauaccacagauucaaggagcugagcacccugagaagacagaagcuggaggacagcuacagauuccaguucuuccagagagacgccgaggagcuggagaaguggauccaggagaagcugcagaucgccagcgacgagaacuacaaggaccccaccaaccugcagggcaagcugcagaagcaccaggccuucgaggccgaggugcaggccaacagcggcgccaucgugaagcuggacgagaccggcaaccugaugaucagcgagggccacuucgccagcgagaccaucagaaccagacugauggagcugcacagacagugggagcugcugcuggagaagaugagagagaagggcaucaagcugcugcaggcccagaagcuggugcaguaccugagagagugcgaggacgugauggacuggaucaacgacaaggaggccaucgugaccagcgaggagcugggccaggaccuggagcacguggaggugcugcagaagaaguucgaggaguuccagaccgacauggccgcccacgaggagagagugaacgaggugaaccaguucgccgccaagcugauccaggagcagcaccccgaggaggagcugaucaagaccaagcaggacgaggugaacgccgccuggcagagacugaagggccuggcccugcagagacagggcaagcuguucggcgccgccgaggugcagagauucaacagagacguggacgagaccaucagcuggaucaaggagaaggagcagcugauggccagcgacgacuucggcagagaccuggccagcgugcaggcccugcugagaaagcacgagggccuggagagagaccuggccgcccuggaggacaaggugaaggcccugugcgccgaggccgacagacugcagcagagccacccccugagcgccacccagauccaggugaagagagaggagcugaucaccaacugggagcagaucagaacccuggccgccgagagacacgccagacugaacgacagcuacagacugcagagauuccuggccgacuucagagaccugaccagcugggugaccgagaugaaggcccugaucaacgccgacgagcuggccagcgacguggccggcgccgaggcccugcuggacagacaccaggagcacaagggcgagaucgacgcccacgaggacagcuucaagagcgccgacgagagcggccaggcccugcuggccgccggccacuacgccagcgacgaggugagagagaagcugaccgugcugagcgaggagagagccgcccugcuggagcugugggagcugagaagacagcaguacgagcagugcauggaccugcagcuguucuacagagacaccgagcagguggacaacuggaugagcaagcaggaggccuuccugcugaacgaggaccugggcgacagccuggacagcguggaggcccugcugaagaagcacgaggacuucgagaagagccugagcgcccaggaggagaagaucaccgcccuggacgaguucgccaccaagcugauccagaacaaccacuacgccauggaggacguggccaccagaagagacgcccugcugagcagaagaaacgcccugcacgagagagccaugagaagaagagcccagcuggccgacagcuuccaccugcagcaguucuucagagacagcgacgagcugaagagcugggugaacgagaagaugaagaccgccaccgacgaggccuacaaggaccccagcaaccugcagggcaaggugcagaagcaccaggccuucgaggccgagcugagcgccaaccagagcagaaucgacgcccuggagaaggccggccagaagcugaucgacgugaaccacuacgccaaggacgagguggccgccagaaugaacgaggugaucagccuguggaagaagcugcuggaggccaccgagcugaagggcaucaagcugagagaggccaaccagcagcagcaguucaacagaaacguggaggacaucgagcuguggcuguacgagguggagggccaccuggccagcgacgacuacggcaaggaccugaccaacgugcagaaccugcagaagaagcacgcccugcuggaggccgacguggccgcccaccaggacagaaucgacggcaucaccauccaggccagacaguuccaggacgccggccacuucgacgccgagaacaucaagaagaagcaggaggcccugguggccagauacgaggcccugaaggagcccaugguggccagaaagcagaagcuggccgacagccugagacugcagcagcuguucagagacguggaggacgaggagaccuggaucagagagaaggagcccaucgccgccagcaccaacagaggcaaggaccugaucggcgugcagaaccugcugaagaagcaccaggcccugcaggccgagaucgccggccacgagcccagaaucaaggccgugacccagaagggcaacgccaugguggaggagggccacuucgccgccgaggacgugaaggccaagcugcacgagcugaaccagaagugggaggcccugaaggccaaggccagccagagaagacaggaccuggaggacagccugcaggcccagcaguacuucgccgacgccaacgaggccgagagcuggaugagagagaaggagcccaucgugggcagcaccgacuacggcaaggacgaggacagcgccgaggcccugcugaagaagcacgaggcccugaugagcgaccugagcgccuacggcagcagcauccaggcccugagagagcaggcccagagcugcagacagcagguggcccccaccgacgacgagaccggcaaggagcuggugcuggcccuguacgacuaccaggagaagagccccagagaggugaccaugaagaagggcgacauccugacccugcugaacagcaccaacaaggacugguggaagguggaggugaacgacagacagggcuucgugcccgccgccuacgugaagaagcuggaccccgcccagagcgccagcagagagaaccugcuggaggagcagggcagcaucgcccugagacaggagcagaucgacaaccagaccagaaucaccaaggaggccggcagcgugagccugagaaugaagcagguggaggagcuguaccacagccugcuggagcugggcgagaagagaaagggcaugcuggagaagagcugcaagaaguucaugcuguucagagaggccaacgagcugcagcaguggaucaacgagaaggaggccgcccugaccagcgaggaggugggcgccgaccuggagcagguggaggugcugcagaagaaguucgacgacuuccagaaggaccugaaggccaacgagagcagacugaaggacaucaacaagguggccgaggaccuggagagcgagggccugauggccgaggaggugcaggccgugcagcagcaggagguguacggcaugaugcccagagacgagaccgacagcaagaccgccagccccuggaagagcgccagacugauggugcacaccguggccaccuucaacagcaucaaggagcugaacgagagauggagaagccugcagcagcuggccgaggagagaagccagcugcugggcagcgcccacgaggugcagagauuccacagagacgccgacgagaccaaggaguggaucgaggagaagaaccaggcccugaacaccgacaacuacggccacgaccuggccagcgugcaggcccugcagagaaagcacgagggcuucgagagagaccuggccgcccugggcgacaaggugaacagccugggcgagaccgccgagagacugauccagagccaccccgagagcgccgaggaccugcaggagaagugcaccgagcugaaccaggccuggagcagccugggcaagagagccgaccagagaaaggccaagcugggcgacagccacgaccugcagagauuccugagcgacuucagagaccugaugagcuggaucaacggcaucagaggccuggugagcagcgacgagcuggccaaggacgugaccggcgccgaggcccugcuggagagacaccaggagcacagaaccgagaucgacgccagagccggcaccuuccaggccuucgagcaguucggccagcagcugcuggcccacggccacuacgccagccccgagaucaagcagaagcuggacauccuggaccaggagagagccgaccuggagaaggccugggugcagagaagaaugaugcuggaccagugccuggagcugcagcuguuccacagagacugcgagcaggccgagaacuggauggccgccagagaggccuuccugaacaccgaggacaagggcgacagccuggacagcguggaggcccugaucaagaagcacgaggacuucgacaaggccaucaacgugcaggaggagaagaucgccgcccugcaggccuucgccgaccagcugaucgccgccggccacuacgccaagggcgacaucagcagcagaagaaacgaggugcuggacagauggagaagacugaaggcccagaugaucgagaagagaagcaagcugggcgagagccagacccugcagcaguucagcagagacguggacgagaucgaggccuggaucagcgagaagcugcagaccgccagcgacgagagcuacaaggaccccaccaacauccagcugagcaagcugcugagcaagcaccagaagcaccaggccuucgaggccgagcugcacgccaacgccgacagaaucagaggcgugaucgacaugggcaacagccugaucgagagaggcgccugcgccggcagcgaggacgccgugaaggccagacuggccgcccuggccgaccaguggcaguuccuggugcagaagagcgccgagaagagccagaagcugaaggaggccaacaagcagcagaacuucaacaccggcaucaaggacuucgacuucuggcugagcgagguggaggcccugcuggccagcgaggacuacggcaaggaccuggccagcgugaacaaccugcugaagaagcaccagcugcuggaggccgacaucagcgcccacgaggacagacugaaggaccugaacagccaggccgacagccugaugaccagcagcgccuucgacaccagccaggugaaggacaagagagacaccaucaacggcagauuccagaagaucaagagcauggccgccagcagaagagccaagcugaacgagagccacagacugcaccaguucuucagagacauggacgacgaggagagcuggaucaaggagaagaagcugcuggugggcagcgaggacuacggcagagaccugaccggcgugcagaaccugagaaagaagcacaagagacuggaggccgagcuggccgcccacgagcccgccauccagggcgugcuggacaccggcaagaagcugagcgacgacaacaccaucggcaaggaggagauccagcagagacuggcccaguucguggagcacuggaaggagcugaagcagcuggccgccgccagaggccagagacuggaggagagccuggaguaccagcaguucguggccaacguggaggaggaggaggccuggaucaacgagaagaugacccugguggccagcgaggacuacggcgacacccuggccgccauccagggccugcugaagaagcacgaggccuucgagaccgacuucaccgugcacaaggacagagugaacgacgugugcaccaacggccaggaccugaucaagaagaacaaccaccacgaggagaacaucagcagcaagaugaagggccugaacggcaaggugagcgaccuggagaaggccgccgcccagagaaaggccaagcuggacgagaacagcgccuuccugcaguucaacuggaaggccgacgugguggagagcuggaucggcgagaaggagaacagccugaagaccgacgacuacggcagagaccugagcagcgugcagacccugcugaccaagcaggagaccuucgacgccggccugcaggccuuccagcaggagggcaucgccaacaucaccgcccugaaggaccagcugcuggccgccaagcacgugcagagcaaggccaucgaggccagacacgccagccugaugaagagauggagccagcugcuggccaacagcgccgccagaaagaagaagcugcuggaggcccagagccacuucagaaagguggaggaccuguuccugaccuucgccaagaaggccagcgccuucaacagcugguucgagaacgccgaggaggaccugaccgaccccgugagaugcaacagccuggaggagaucaaggcccugagagaggcccacgacgccuucagaagcagccugagcagcgcccaggccgacuucaaccagcuggccgagcuggacagacagaucaagagcuucagaguggccagcaaccccuacaccugguucaccauggaggcccuggaggagaccuggagaaaccugcagaagaucaucaaggagagagagcuggagcugcagaaggagcagagaagacaggaggagaacgacaagcugagacaggaguucgcccagcacgccaacgccuuccaccaguggauccaggagaccagaaccuaccugcuggacggcagcugcaugguggaggagagcggcacccuggagagccagcuggaggccaccaagagaaagcaccaggagaucagagccaugagaagccagcugaagaagaucgaggaccugggcgccgccauggaggaggcccugauccuggacaacaaguacaccgagcacagcaccgugggccuggcccagcagugggaccagcuggaccagcugggcaugagaaugcagcacaaccuggagcagcagauccaggccagaaacaccaccggcgugaccgaggaggcccugaaggaguucagcaugauguucaagcacuucgacaaggacaagagcggcagacugaaccaccaggaguucaagagcugccugagaagccugggcuacgaccugcccaugguggaggagggcgagcccgaccccgaguucgaggccauccuggacaccguggaccccaacagagacggccacgugagccugcaggaguacauggccuucaugaucagcagagagaccgagaacgugaagagcagcgaggagaucgagagcgccuucagagcccugagcagcgagggcaagcccuacgugaccaaggaggagcuguaccagaaccugaccagagagcaggccgacuacugcgugagccacaugaagcccuacguggacggcaagggcagagagcugcccaccgccuucgacuacguggaguucaccagaagccuguucgugaacuaa

SEQ ID NO: 23995 - RNA, 6414 nt, Artificial Sequence
  SPTB__Homo_sapiens__NP_000338
augaccagcgccaccgaguucgagaacgugggcaaccagccccccuacagcagaaucaacgccagaugggacgcccccgacgacgagcuggacaacgacaacagcagcgccagacuguucgagagaagcagaaucaaggcccuggccgacgagagagagguggugcagaagaagaccuucaccaagugggugaacagccaccuggccagagugagcugcagaaucaccgaccuguacaaggaccugagagacggcagaaugcugaucaagcugcuggaggugcugagcggcgagaugcugcccaagcccaccaagggcaagaugagaauccacugccuggagaacguggacaaggcccugcaguuccugaaggagcagagagugcaccuggagaacaugggcagccacgacaucguggacggcaaccacagacuggugcugggccugaucuggaccaucauccugagauuccagauccaggacaucguggugcagacccaggagggcagagagaccagaagcgccaaggacgcccugcugcuguggugccagaugaagaccgccggcuacccccacgugaacgugaccaacuucaccagcagcuggaaggacggccuggccuucaacgcccugauccacaagcacagacccgaccugaucgacuucgacaagcugaaggacagcaacgccagacacaaccuggagcacgccuucaacguggccgagagacagcugggcaucaucccccugcuggaccccgaggacguguucaccgagaaccccgacgagaagagcaucaucaccuacgugguggccuucuaccacuacuucagcaagaugaaggugcuggccguggagggcaagagagugggcaaggugaucgaccacgccaucgagaccgagaagaugaucgagaaguacagcggccuggccagcgaccugcugaccuggaucgagcagaccaucaccgugcugaacagcagaaaguucgccaacagccugaccggcgugcagcagcagcugcaggccuucagcaccuacagaaccguggagaagccccccaaguuccaggagaagggcaaccuggaggugcugcuguucaccauccagagcagaaugagagccaacaaccagaagguguacaccccccacgacggcaagcuggugagcgacaucaacagagccugggagagccuggaggaggccgaguacagaagagagcuggcccugagaaacgagcugaucagacaggagaagcuggagcagcuggccagaagauucgacagaaaggccgccaugagagagaccuggcugagcgagaaccagagacugguggcccaggacaacuucggcuacgaccuggccgccguggaggccgccaagaagaagcacgaggccaucgagaccgacaccgccgccuacgaggagagagugagagcccuggaggaccuggcccaggagcuggagaaggagaacuaccacgaccagaagagaaucaccgccagaaaggacaacauccugagacuguggagcuaccugcaggagcugcugcagagcagaagacagagacuggagaccacccuggcccugcagaagcuguuccaggacaugcugcacagcaucgacuggauggacgagaucaaggcccaccugcugagcgccgaguucggcaagcaccugcuggagguggaggaccugcugcagaagcacaagcugauggaggccgacaucgccauccagggcgacaaggugaaggccaucaccgccgccacccugaaguucaccgagggcaagggcuaccagcccugcgacccccaggugauccaggacagaaucagccaccuggagcagugcuucgaggagcugagcaacauggccgccggcagaaaggcccagcuggagcagagcaagagacuguggaaguucuucugggagauggacgaggccgagagcuggaucaaggagaaggagcagaucuacagcagccuggacuacggcaaggaccugaccagcgugcugauccugcagagaaagcacaaggccuucgaggacgagcugagaggccuggacgcccaccuggagcagaucuuccaggaggcccacggcaugguggccagaaagcaguucggccacccccagaucgaggccagaaucaaggaggugagcgcccagugggaccagcugaaggaccuggccgccuucugcaagaagaaccugcaggacgccgagaacuucuuccaguuccagggcgacgccgacgaccugaaggccuggcugcaggacgcccacagacugcugagcggcgaggacgugggccaggacgagggcgccaccagagcccugggcaagaagcacaaggacuuccuggaggagcuggaggagagcagaggcgugauggagcaccuggagcagcaggcccagggcuuccccgaggaguucagagacagccccgacgugacccacagacugcaggcccugagagagcuguaccagcaggugguggcccaggccgaccugagacagcagagacugcaggaggcccuggaccuguacaccguguucggcgagaccgacgccugcgagcuguggaugggcgagaaggagaaguggcuggccgagauggagaugcccgacacccuggaggaccuggagguggugcagcacagauucgacauccuggaccaggagaugaagacccugaugacccagaucgacggcgugaaccuggccgccaacagccugguggagagcggccaccccagaagcagagaggugaagcaguaccaggaccaccugaacaccagauggcaggccuuccagacccuggugagcgagagaagagaggccguggacagcgcccugagagugcacaacuacugcguggacugcgaggagaccagcaaguggaucaccgacaagaccaaggugguggagagcaccaaggaccugggcagagaccuggccggcaucaucgccauccagagaaagcugagcggccuggagagagacguggccgccauccaggccagaguggacgcccuggagagagagagccagcagcugauggacagccaccccgagcagaaggaggacaucggccagagacagaagcaccuggaggagcuguggcagggccugcagcagagccugcagggccaggaggaccugcugggcgaggugagccagcugcaggccuuccugcaggaccuggacgacuuccaggccuggcugagcaucacccagaaggccguggccagcgaggacaugcccgagagccugcccgaggccgagcagcugcugcagcagcacgccggcaucaaggacgagaucgacggccaccaggacagcuaccagagagugaaggagagcggcgagaaggugauccagggccagaccgaccccgaguaccugcugcugggccagagacuggagggccuggacaccggcuggaacgcccugggcagaaugugggagagcagaagccacacccuggcccagugccugggcuuccaggaguuccagaaggacgccaagcaggccgaggccauccugagcaaccaggaguacacccuggcccaccuggagccccccgacagccuggaggccgccgaggccggcaucagaaaguucgaggacuuccugggcagcauggagaacaacagagacaaggugcugagccccguggacagcggcaacaagcugguggccgagggcaaccuguacagcgacaagaucaaggagaaggugcagcugaucgaggacagacacagaaagaacaacgagaaggcccaggaggccagcgugcugcugagagacaaccuggagcugcagaacuuccugcagaacugccaggagcugacccuguggaucaacgacaagcugcugaccagccaggacgugagcuacgacgaggccagaaaccugcacaacaaguggcugaagcaccaggccuucguggccgagcuggccagccacgagggcuggcuggagaacaucgacgccgagggcaagcagcugauggacgagaagccccaguucaccgcccuggugagccagaagcuggaggcccugcacagacugugggacgagcugcaggccaccaccaaggagaagacccagcaccugagcgccgccagaagcagcgaccugagacugcagacccacgccgaccugaacaaguggaucagcgccauggaggaccagcugagaagcgacgaccccggcaaggaccugaccagcgugaacagaaugcuggccaagcugaagagaguggaggaccaggugaacgugagaaaggaggagcugggcgagcuguucgcccaggugcccagcaugggcgaggagggcggcgacgccgaccugagcaucgagaagagauuccuggaccugcuggagccccugggcagaagaaagaagcagcuggagagcagcagagccaagcugcagaucagcagagaccuggaggacgagacccuguggguggaggagagacugccccuggcccagagcgccgacuacggcaccaaccugcagaccgugcagcuguucaugaagaagaaccagacccugcagaacgagauccugggccacacccccagaguggaggacgugcugcagagaggccagcagcugguggaggccgccgagaucgacugccaggaccuggaggagagacugggccaccugcagagcagcugggacagacugagagaggccgccgccggcagacugcagagacugagagacgccaacgaggcccagcaguacuaccuggacgccgacgaggccgaggccuggaucggcgagcaggagcuguacgugaucagcgacgagauccccaaggacgaggagggcgccaucgugaugcugaagagacaccugagacagcagagagccguggaggacuacggcagaaacaucaagcagcuggccagcagagcccagggccugcugagcgccggccaccccgagggcgagcagaucaucagacugcagggccagguggacaagcacuacgccggccugaaggacguggccgaggagagaaagagaaagcuggagaacauguaccaccuguuccagcugaagagagagaccgacgaccuggagcaguggaucagcgagaaggagcugguggccagcagccccgagaugggccaggacuucgaccacgugacccugcugagagacaaguucagagacuucgccagagagaccggcgccaucggccaggagagaguggacaacgugaacgccuucaucgagagacugaucgacgccggccacagcgaggccgccaccaucgccgaguggaaggacggccugaacgagaugugggccgaccugcuggagcugaucgacaccagaaugcagcugcuggccgccagcuacgaccugcacagauacuucuacaccggcgccgagauccugggccugaucgacgagaagcacagagagcugcccgaggacgugggccuggacgccagcaccgccgagagcuuccacagagugcacaccgccuucgagagagagcugcaccugcugggcgugcaggugcagcaguuccaggacguggccaccagacugcagaccgccuacgccggcgagaaggccgaggccauccagaacaaggagcaggaggugagcgccgccuggcaggcccugcuggacgccugcgccggcagaagaacccagcugguggacaccgccgacaaguucagauucuucagcauggccagagaccugcugagcuggauggagagcaucaucagacagaucgagacccaggagagacccagagacgugagcagcguggagcugcugaugaaguaccaccagggcaucaacgccgagaucgagaccagaagcaagaacuucagcgccugccuggagcugggcgagagccugcugcagagacagcaccaggccagcgaggagaucagagagaagcugcagcaggugaugagcagaagaaaggagaugaacgagaagugggaggccagaugggagagacugagaaugcugcuggaggugugccaguucagcagagacgccagcguggccgaggccuggcugaucgcccaggagcccuaccuggccagcggcgacuucggccacaccguggacagcguggagaagcugaucaagagacacgaggccuucgagaagagcaccgccagcugggccgagagauucgccgcccuggagaagcccaccacccuggagcugaaggagagacagaucgccgagagacccgccgaggagaccggcccccaggaggaggagggcgagaccgccggcgaggcccccgugagccaccacgccgccaccgagagaaccagccccgugagccuguggagcagacugagcagcagcugggagagccugcagcccgagcccagccaccccuacuaa

SEQ ID NO: 23996 - RNA, 6468 nt, Artificial Sequence
  SPTBN1__Homo_sapiens__NP_842565
auggagcugcagagaaccagcagcaucagcggcccccugagccccgccuacaccggccaggugcccuacaacuacaaccagcuggagggcagauucaagcagcugcaggacgagagagaggccgugcagaagaagaccuucaccaagugggugaacagccaccuggccagagugagcugcagaaucaccgaccuguacaccgaccugagagacggcagaaugcugaucaagcugcuggaggugcugagcggcgagagacugcccaagcccaccaagggcagaaugagaauccacugccuggagaacguggacaaggcccugcaguuccugaaggagcagagagugcaccuggagaacaugggcagccacgacaucguggacggcaaccacagacugacccugggccugaucuggaccaucauccugagauuccagauccaggacaucagcguggagaccgaggacaacaaggagaagaagagcgccaaggacgcccugcugcuguggugccagaugaagaccgccggcuaccccaacgugaacauccacaacuucaccaccagcuggagagacggcauggccuucaacgcccugauccacaagcacagacccgaccugaucgacuucgacaagcugaagaagagcaacgcccacuacaaccugcagaacgccuucaaccuggccgagcagcaccugggccugaccaagcugcuggaccccgaggacaucagcguggaccaccccgacgagaagagcaucaucaccuacguggugaccuacuaccacuacuucagcaagaugaaggcccuggccguggagggcaagagaaucggcaaggugcuggacaacgccaucgagaccgagaagaugaucgagaaguacgagagccuggccagcgaccugcuggaguggaucgagcagaccaucaucauccugaacaacagaaaguucgccaacagccuggugggcgugcagcagcagcugcaggccuucaacaccuacagaaccguggagaagccccccaaguucaccgagaagggcaaccuggaggugcugcuguucaccauccagagcaagaugagagccaacaaccagaagguguacaugcccagagagggcaagcugaucagcgacaucaacaaggccugggagagacuggagaaggccgagcacgagagagagcuggcccugagaaacgagcugaucagacaggagaagcuggagcagcuggccagaagauucgacagaaaggccgccaugagagagaccuggcugagcgagaaccagagacuggugagccaggacaacuucggcuucgaccugcccgccguggaggccgccaccaagaagcacgaggccaucgagaccgacaucgccgccuacgaggagagagugcaggccgugguggccguggccagagagcuggaggccgagaacuaccacgacaucaagagaaucaccgccagaaaggacaacgugaucagacugugggaguaccugcuggagcugcugagagccagaagacagagacuggagaugaaccugggccugcagaagaucuuccaggagaugcuguacaucauggacuggauggacgagaugaaggugcuggugcugagccaggacuacggcaagcaccugcugggcguggaggaccugcugcagaagcacacccugguggaggccgacaucggcauccaggccgagagagugagaggcgugaacgccagcgcccagaaguucgccaccgacggcgagggcuacaagcccugcgacccccaggugaucagagacagaguggcccacauggaguucugcuaccaggagcugugccagcuggccgccgagagaagagccagacuggaggagagcagaagacuguggaaguucuucugggagauggccgaggaggagggcuggaucagagagaaggagaagauccugagcagcgacgacuacggcaaggaccugaccagcgugaugagacugcugagcaagcacagagccuucgaggacgagaugagcggcagaagcggccacuucgagcaggccaucaaggagggcgaggacaugaucgccgaggagcacuucggcagcgagaagaucagagagagaaucaucuacaucagagagcagugggccaaccuggagcagcugagcgccaucagaaagaagagacuggaggaggccagccugcugcaccaguuccaggccgacgccgacgacaucgacgccuggaugcuggacauccugaagaucgugagcagcagcgacgugggccacgacgaguacagcacccagagccuggugaagaagcacaaggacguggccgaggagaucgccaacuacagacccacccuggacacccugcacgagcaggccagcgcccugccccaggagcacgccgagagccccgacgugagaggcagacugagcggcaucgaggagagauacaaggagguggccgagcugaccagacugagaaagcaggcccugcaggacacccuggcccuguacaagauguucagcgaggccgacgccugcgagcuguggaucgacgagaaggagcaguggcugaacaacaugcagauccccgagaagcuggaggaccuggaggugauccagcacagauucgagagccuggagcccgagaugaacaaccaggccagcagaguggccguggugaaccagaucgccagacagcugaugcacagcggccaccccagcgagaaggagaucaaggcccagcaggacaagcugaacaccagauggagccaguucagagagcugguggacagaaagaaggacgcccugcugagcgcccugagcauccagaacuaccaccuggagugcaacgagaccaagagcuggaucagagagaagaccaaggugaucgagagcacccaggaccugggcaacgaccuggccggcgugauggcccugcagagaaagcugaccggcauggagagagaccugguggccaucgaggccaagcugagcgaccugcagaaggaggccgagaagcuggagagcgagcaccccgaccaggcccaggccauccugagcagacuggccgagaucagcgacgugugggaggagaugaagaccacccugaagaacagagaggccagccugggcgaggccagcaagcugcagcaguuccugagagaccuggacgacuuccagagcuggcugagcagaacccagaccgccaucgccagcgaggacaugcccaacacccugaccgaggccgagaagcugcugacccagcacgagaacaucaagaacgagaucgacaacuacgaggaggacuaccagaagaugagagacaugggcgagauggugacccagggccagaccgacgcccaguacauguuccugagacagagacugcaggcccuggacaccggcuggaacgagcugcacaagaugugggagaacagacagaaccugcugagccagagccacgccuaccagcaguuccugagagacaccaagcaggccgaggccuuccugaacaaccaggaguacgugcuggcccacaccgagaugcccaccacccuggagggcgccgaggccgccaucaagaagcaggaggacuucaugaccaccauggacgccaacgaggagaagaucaacgccgugguggagaccggcagaagacuggugagcgacggcaacaucaacagcgacagaauccaggagaagguggacagcaucgacgacagacacagaaagaacagagagaccgccagcgagcugcugaugagacugaaggacaacagagaccugcagaaguuccugcaggacugccaggagcugagccuguggaucaacgagaagaugcugaccgcccaggacaugagcuacgacgaggccagaaaccugcacagcaaguggcugaagcaccaggccuucauggccgagcuggccagcaacaaggaguggcuggacaagaucgagaaggagggcaugcagcugaucagcgagaagcccgagaccgaggccguggugaaggagaagcugaccggccugcacaagaugugggaggugcuggagagcaccacccagaccaaggcccagagacuguucgacgccaacaaggccgagcuguucacccagagcugcgccgaccuggacaaguggcugcacggccuggagagccagauccagagcgacgacuacggcaaggaccugaccagcgugaacauccugcugaagaagcagcagaugcuggagaaccagauggaggugagaaagaaggagaucgaggagcugcagagccaggcccaggcccugagccaggagggcaagagcaccgacgagguggacagcaagagacugaccgugcagaccaaguucauggagcugcuggagccccugaacgagagaaagcacaaccugcuggccagcaaggagauccaccaguucaacagagacguggaggacgagauccugugggugggcgagagaaugccccuggccaccagcaccgaccacggccacaaccugcagaccgugcagcugcugaucaagaagaaccagacccugcagaaggagauccagggccaccagcccagaaucgacgacaucuucgagagaagccagaacaucgugaccgacagcagcagccugagcgccgaggccaucagacagagacuggccgaccugaagcagcuguggggccugcugaucgaggagaccgagaagagacacagaagacuggaggaggcccacagagcccagcaguacuacuucgacgccgccgaggccgaggccuggaugagcgagcaggagcuguacaugaugagcgaggagaaggccaaggacgagcagagcgccgugagcaugcugaagaagcaccagauccuggagcaggccguggaggacuacgccgagaccgugcaccagcugagcaagaccagcagagcccugguggccgacagccaccccgagagcgagagaaucagcaugagacagagcaagguggacaagcuguacgccggccugaaggaccuggccgaggagagaagaggcaagcuggacgagagacacagacuguuccagcugaacagagagguggacgaccuggagcaguggaucgccgagagagaggugguggccggcagccacgagcugggccaggacuacgagcacgugaccaugcugcaggagagauucagagaguucgccagagacaccggcaacaucggccaggagagaguggacaccgugaaccaccuggccgacgagcugaucaacagcggccacagcgacgccgccaccaucgccgaguggaaggacggccugaacgaggccugggccgaccugcuggagcugaucgacaccagaacccagauccuggccgccagcuacgagcugcacaaguucuaccacgacgccaaggagaucuucggcagaauccaggacaagcacaagaagcugcccgaggagcugggcagagaccagaacaccguggagacccugcagagaaugcacaccaccuucgagcacgacauccaggcccugggcacccaggugagacagcugcaggaggacgccgccagacugcaggccgccuacgccggcgacaaggccgacgacauccagaagagagagaacgaggugcuggaggccuggaagagccugcuggacgccugcgagagcagaagagugagacugguggacaccggcgacaaguucagauucuucagcauggugagagaccugaugcuguggauggaggacgugaucagacagaucgaggcccaggagaagcccagagacgugagcagcguggagcugcugaugaacaaccaccagggcaucaaggccgagaucgacgccagaaacgacagcuucaccaccugcaucgagcugggcaagagccugcuggccagaaagcacuacgccagcgaggagaucaaggagaagcugcugcagcugaccgagaagagaaaggagaugaucgacaagugggaggacagaugggaguggcugagacugauccuggaggugcaccaguucagcagagacgccagcguggccgaggccuggcugcugggccaggagcccuaccugagcagcagagagaucggccagagcguggacgagguggagaagcugaucaagagacacgaggccuucgagaagagcgccgccaccugggacgagagauucagcgcccuggagagacugaccacccuggagcugcuggaggugagaagacagcaggaggaggaggagagaaagagaagaccccccagccccgagcccagcaccaaggugagcgaggaggccgagagccagcagcagugggacaccagcaagggcgagcaggugagccagaacggccugcccgccgagcagggcagccccagagugagcuacagaagccagaccuaccagaacuacaagaacuucaacagcagaagaaccgccagcgaccagcccuggagcggccuguaa

SEQ ID NO: 23997 - RNA, 7173 nt, Artificial Sequence
  SPTBN2__Homo_sapiens__NP_008877
augagcagcacccugagccccaccgacuucgacagccuggagauccagggccaguacagcgacaucaacaacagaugggaccugcccgacagcgacugggacaacgacagcagcagcgccagacuguucgagagaagcagaaucaaggcccuggccgacgagagagaggccgugcagaagaagaccuucaccaagugggugaacagccaccuggccagagugaccugcagagugggcgaccuguacagcgaccugagagacggcagaaaccugcugagacugcuggaggugcugagcggcgagauccugcccaagcccaccaagggcagaaugagaauccacugccuggagaacguggacaaggcccugcaguuccugaaggagcagaaggugcaccuggagaacaugggcagccacgacaucguggacggcaaccacagacugacccugggccugguguggaccaucauccugagauuccagauccaggacaucagcguggagaccgaggacaacaaggagaagaagagcgccaaggacgcccugcugcuguggugccagaugaagaccgccggcuaccccaacgugaacgugcacaacuucaccaccagcuggagagacggccuggccuucaacgccaucgugcacaagcacagacccgaccugcuggacuucgagagccugaagaagugcaacgcccacuacaaccugcagaacgccuucaaccuggccgagaaggagcugggccugaccaagcugcuggaccccgaggacgugaacguggaccagcccgacgagaagagcaucaucaccuacguggccaccuacuaccacuacuucagcaagaugaaggcccuggccguggagggcaagagaaucggcaaggugcuggaccacgccauggaggccgagagacugguggagaaguacgagagccuggccagcgagcugcugcaguggaucgagcagaccaucgugacccugaacgacagacagcuggccaacagccugagcggcgugcagaaccagcugcagagcuucaacagcuacagaaccguggagaagccccccaaguucaccgagaagggcaaccuggaggugcugcuguucaccauccagagcaagcugagagccaacaaccagaagguguacacccccagagagggcagacugaucagcgacaucaacaaggccugggagagacuggagaaggccgagcacgagagagagcuggcccugagaaccgagcugaucagacaggagaagcuggagcagcuggccgccagauucgacagaaaggccgccaugagagagaccuggcugagcgagaaccagagacuggugagccaggacaacuucggccuggagcuggccgccguggaggccgccgugagaaagcacgaggccaucgagaccgacaucguggccuacagcggcagagugcaggccguggacgccguggccgccgagcuggccgccgagagauaccacgacaucaagagaaucgccgccagacagcacaacguggccagacugugggacuuccugagacagaugguggccgccagaagagagagacugcugcugaaccuggagcugcagaagguguuccaggaccugcuguaccugauggacuggauggaggagaugaagggcagacugcagagccaggaccugggcagacaccuggccggcguggaggaccugcugcagcugcacgagcugguggaggccgacaucgccgugcaggccgagagagugagagccgugagcgccagcgcccugagauucugcaaccccggcaaggaguacagacccugcgacccccagcuggugagcgagagaguggccaagcuggagcagagcuacgaggcccugugcgagcuggccgccgccagaagagccagacuggaggagagcagaagacuguggagauuccugugggaggugggcgaggccgaggccugggugagagagcagcagcaccugcuggccagcgccgacaccggcagagaccugaccggcgcccugagacugcugaacaagcacaccgcccugagaggcgagaugagcggcagacugggcccccugaagcugacccuggagcagggccagcagcugguggccgagggccaccccggcgccagccaggccagcgccagagccgccgagcugcaggcccagugggagagacuggaggcccuggccgaggagagagcccagagacuggcccaggccgccagccuguaccaguuccaggccgacgccaacgacauggaggccuggcugguggacgcccugagacuggugagcagccccgagcugggccacgacgaguucagcacccaggcccuggccagacagcacagagcccuggaggaggagaucagaagccacagacccacccuggacgcccugagagagcaggccgccgcccugccccccacccugagcagaacccccgaggugcagggcagagugcccacccuggagagacacuacgaggagcugcaggccagagccggcgagagagccagagcccuggaggccgcccuggcccuguacaccaugcugagcgaggccggcgccugcggccuguggguggaggagaaggagcaguggcugaacggccuggcccugcccgagagacuggaggaccuggagguggugcagcagagauucgagacccuggagcccgagaugaacacccuggccgcccagaucaccgccgugaacgacaucgccgagcagcugcugaaggccaacccccccggcaaggacagaaucgugaacacccaggagcagcugaaccacagauggcagcaguucagaagacuggccgacggcaagaaggccgcccugaccagcgcccugagcauccagaacuaccaccuggagugcaccgagacccaggccuggaugagagagaagaccaaggugaucgagagcacccagggccugggcaacgaccuggccggcgugcuggcccugcagagaaagcuggccggcaccgagagagaccuggaggccaucgccgccagagugggcgagcugaccagagaggccaacgcccuggccgccggccaccccgcccaggccguggccaucaacgccagacugagagaggugcagaccggcugggaggaccugagagccaccaugagaagaagagaggagagccugggcgaggccagaagacugcaggacuuccugagaagccuggacgacuuccaggccuggcugggcagaacccagaccgccguggccagcgaggagggccccgccacccugcccgaggccgaggcccugcuggcccagcacgccgcccugagaggcgagguggagagagcccagagcgaguacagcagacugagagcccugggcgaggaggugaccagagaccaggccgacccccagugccuguuccugagacagagacuggaggcccugggcaccggcugggaggagcugggcagaaugugggagagcagacagggcagacuggcccaggcccacggcuuccagggcuuccugagagacgccagacaggccgagggcgugcugagcagccaggaguacgugcugagccacaccgagaugcccggcacccugcaggccgccgacgccgccaucaagaagcuggaggacuucaugagcaccauggacgccaacggcgagagaauccacggccugcuggaggccggcagacagcuggugagcgagggcaacauccacgccgacaagaucagagagaaggccgacagcaucgagagaagacacaagaagaaccaggacgccgcccagcaguuccugggcagacugagagacaacagagagcagcagcacuuccugcaggacugccacgagcugaagcuguggaucgacgagaagaugcugaccgcccaggacgugagcuacgacgaggccagaaaccugcacaccaaguggcagaagcaccaggccuucauggccgagcuggccgccaacaaggacuggcuggacaagguggacaaggagggcagagagcugacccuggagaagcccgagcugaaggcccuggugagcgagaagcugagagaccugcacagaagaugggacgagcuggagaccaccacccaggccaaggccagaagccuguucgacgccaacagagccgagcuguucgcccagagcugcugcgcccuggagagcuggcuggagagccugcaggcccagcugcacagcgacgacuacggcaaggaccugaccagcgugaacauccugcugaagaagcagcagaugcuggagugggagauggccgugagagagaaggagguggaggccauccaggcccaggccaaggcccuggcccaggaggaccagggcgccggcgagguggagagaaccagcagagccguggaggagaaguucagagcccugugccagcccaugagagagagaugcagaagacugcaggccagcagagagcagcaccaguuccacagagacguggaggacgagauccugugggugaccgagagacugcccauggccagcagcauggagcacggcaaggaccugcccagcgugcagcugcugaugaagaagaaccagacccugcagaaggagauccagggccacgagcccagaaucgccgaccugagagagagacagagagcccugggcgccgccgccgccggccccgagcuggccgagcugcaggagauguggaagagacugggccacgagcuggagcugagaggcaagagacuggaggacgcccugagagcccagcaguucuacagagacgccgccgaggccgaggccuggaugggcgagcaggagcugcacaugaugggccaggagaaggccaaggacgagcugagcgcccaggccgaggugaagaagcaccaggugcuggagcaggcccuggccgacuacgcccagaccauccaccagcuggccgccagcagccaggacaugaucgaccacgagcaccccgagagcaccagaaucagcaucagacaggcccagguggacaagcuguacgccggccugaaggagcuggccggcgagagaagagagagacugcaggagcaccugagacugugccagcugagaagagagcuggacgaccuggagcaguggauccaggagagagaggugguggccgccagccacgagcugggccaggacuacgagcacgugaccaugcugagagacaaguucagagaguucagcagagacaccagcaccaucggccaggagagaguggacagcgccaacgcccuggccaacggccugaucgccggcggccacgccgccagagccaccguggccgaguggaaggacagccugaacgaggccugggccgaccugcuggagcugcuggacaccagaggccaggugcuggccgccgccuacgagcugcagagauuccugcacggcgccagacaggcccuggccagagugcagcacaagcagcagcagcugcccgacggcaccggcagagaccugaacgccgccgaggcccugcagagaagacacugcgccuacgagcacgacauccaggcccugagcccccaggugcagcaggugcaggacgacggccacagacugcagaaggccuacgccggcgacaaggccgaggagaucggcagacacaugcaggccguggccgaggccugggcccagcugcagggcagcagcgccgccagaagacagcugcugcuggacaccaccgacaaguucagauucuucaaggccgugagagagcugaugcuguggauggacgaggugaaccugcagauggacgcccaggagagacccagagacgugagcagcgccgaccuggugaucaagaaccagcagggcaucaaggccgagaucgaggccagagccgacagauucagcagcugcaucgacaugggcaaggagcugcuggccagaagccacuacgccgccgaggagaucagcgagaagcugagccagcugcaggccagaagacaggagaccgccgagaaguggcaggagaagauggacuggcugcagcuggugcuggaggugcugguguucggcagagacgccggcauggccgaggccuggcugugcagccaggagccccuggugagaagcgccgagcugggcugcaccguggacgagguggagagccugaucaagagacacgaggccuuccagaagagcgccguggccugggaggagagauucugcgcccuggagaagcugaccgcccuggaggagagagagaaggagagaaagagaaagagagaggaggaggagagaagaaagcagccccccgcccccgagcccaccgccagcgugccccccggcgaccuggugggcggccagaccgccagcgacaccaccugggacggcacccagcccagacccccccccagcacccaggcccccagcgugaacggcgugugcaccgacggcgagcccagccagccccugcugggccagcagagacuggagcacagcagcuuccccgagggccccggccccggcagcggcgacgaggccaacggccccagaggcgagagacagaccagaaccagaggccccgcccccagcgccaugccccagagcagaagcaccgagagcgcccacgccgccacccugccccccagaggccccgagcccagcgcccaggagcagauggagggcaugcugugcagaaagcaggagauggaggccuucggcaagaaggccgccaacagaagcuggcagaacguguacugcgugcugagaagaggcagccugggcuucuacaaggacgccaaggccgccagcgccggcgugcccuaccacggcgaggugcccgugagccuggccagagcccagggcagcguggccuucgacuacagaaagagaaagcacguguucaagcugggccugcaggacggcaaggaguaccuguuccaggccaaggacgaggccgagaugagcagcuggcugagaguggugaacgccgccaucgccaccgccagcagcgccagcggcgagcccgaggagcccguggugcccagcaccaccagaggcaugaccagagccaugaccaugccccccgugagccccgugggcgccgagggccccguggugcugagaagcaaggacggcagagagagagagagagagaagagauucagcuucuucaagaagaacaaguaa

SEQ ID NO: 23998 - RNA, 7695 nt, Artificial Sequence
  SPTBN4__Homo_sapiens__NP_066022
auggcccaggugcccggcgagguggacaacauggagggccugcccgcccccaacaacaaccccgccgccagaugggagagccccgacagaggcugggagagagagcagcccgccgccagcaccgccgccgccagccuguucgagugcagcagaaucaaggcccuggccgacgagagagaggccgugcagaagaagaccuucaccaagugggugaacagccaccuggccagagugggcugccacaucggcgaccuguacguggaccugagagacggcuucgugcugaccagacugcuggaggugcugagcggcgagcagcugcccagacccaccagaggcagaaugagaauccacagccuggagaacguggacaaggcccugcaguuccugaaggagcagagagugcaccuggagaacgugggcagccacgacaucguggacggcaaccacagacugacccugggccugguguggaccaucauccugagauuccagauccaggugaucaagaucgagaccgaggacaacagagagaccagaagcgccaaggacgcccugcugcuguggugccagaugaagaccgccggcuaccccgaggugaacauccagaacuucaccaccagcuggagagacggccuggccuucaacgcccugauccacagacacagacccgaccugguggacuucagcaagcugaccaagagcaacgccaacuacaaccugcagagagccuucagaaccgccgagcagcaccugggccuggccagacugcuggaccccgaggacgugaacauggaggcccccgacgagaagagcaucaucaccuacguggugagcuucuaccacuacuucagcaagaugaaggcccuggccguggagggcaagagaaucggcaaggugcuggaccaggugcuggaggugggcaagaucaucgagagauacgaggagcuggccgccgagcugcuggccuggauccacagaaccgugggccugaucagcaaccagaaguucgccaacagccugagcggcgugcagcagcagcugcaggccuucaccgccuacugcacccuggagaagcccgugaaguuccaggagaagggcaaccuggaggugcugcuguucagcauccagagcaagcugagagccugcaacagaagacuguucgugcccagagagggcugcggcaucugggacaucgacaaggccuggggcgagcuggagaaggccgagcacgagagagaggccgcccugagagccgagcugaucagacaggagaagcuggagcugcuggcccagagauucgaccacaagguggccaugagagagagcuggcugaacgagaaccagagacuggugagccaggacaacuucggcuacgagcugcccgccguggaggccgccaugaagaagcacgaggccaucgaggccgacaucgccgccuacgaggagagagugcagggcguggccgagcuggcccaggcccuggccgccgagggcuacuacgacaucagaagaguggccgcccagagagacagcgugcugagacagugggcccugcugaccggccuggugggcgccagaagaaccagacuggagcagaaccuggcccugcagaagguguuccaggagaugguguacaugguggacuggauggaggagaugcaggcccagcugcugagcagagagugcggccagcaccugguggaggccgacgaccugcugcagaagcacggccugcuggagggcgacaucgccgcccagagcgagagaguggaggcccugaacgccgccgcccugagauucagccagcugcagggcuaccagcccugcgacccccaggugaucugcaacagagugaaccacgugcacggcugccuggccgagcugcaggagcaggccgccagaagaagagccgagcuggaggccagcagaagccugugggcccugcugcaggagcuggaggaggccgagagcugggccagagacaaggagagacugcuggaggccgccggcggcggcggcgccgccggcgccgccggcgccgccggcaccgccggcggcgcccacgaccugagcagcaccgccagacugcuggcccagcacaagauccugcagggcgagcugggcggcagaagagcccugcugcagcaggcccugagaugcggcgaggagcugguggccgccggcggcgccgugggccccggcgccgacaccgugcaccuggugggccuggccgagagagccgccagcgccagaagaagauggcagagacuggaggaggccgccgccagaagagagagaagacugcaggaggccagagcccugcaccaguucggcgccgaccuggacggccugcuggacuggcugagagacgccuacagacuggccgccgccggcgacuucggccacgacgaggccagcagcagaagacuggccagacagcacagagcccugaccggcgagguggaggcccacagaggccccgugagcggccugagaagacagcuggccacccugggcggcgccagcggcgccggcccccuggugguggcccugcaggugagagugguggaggccgagcagcuguucgccgaggugaccgagguggccgcccugagaagacaguggcugagagacgcccuggccguguacagaauguucggcgaggugcacgccugcgagcuguggaucggcgagaaggagcaguggcugcugagcaugagagugcccgacagccuggacgacguggagguggugcagcacagauucgagagccuggaccaggagaugaacagccugaugggcagagugcuggacgugaaccacaccgugcaggagcugguggagggcggccaccccagcagcgacgaggugagaagcugccaggaccaccugaacagcagauggaacagaaucguggagcugguggagcagagaaaggaggagaugagcgccgugcugcugguggagaaccacgugcuggagguggccgaggugagagcccaggugagagagaagagaagagccguggagagcgcccccagagccggcggcgcccugcaguggagacugagcggccuggaggccgcccugcaggcccuggagcccagacaggccgcccugcuggaggaggccgcccugcuggccgagagauuccccgcccaggccgccagacugcaccagggcgccgaggagcugggcgccgaguggggcgcccuggccagcgccgcccaggccugcggcgaggccguggccgccgccggcagacugcagagauuccugcacgaccuggacgccuuccuggacuggcuggugagagcccaggaggccgccggcggcagcgagggcccccugcccaacagccuggaggaggccgacgcccugcuggccagacacgccgcccugaaggaggagguggaccagagagaggaggacuacgccagaaucguggccgccagcgaggcccugcuggccgccgacggcgccgagcugggccccggccuggcccuggacgaguggcugccccaccuggagcugggcuggcacaagcugcugggccugugggaggccagaagagaggcccuggugcaggcccacaucuaccagcuguuccugagagaccugagacaggcccugguggugcugagaaaccaggagauggcccugagcggcgccgagcugcccggcaccguggagagcguggaggaggcccugaagcagcacagagacuuccugaccaccauggagcugagccagcagaagaugcagguggccgugcaggccgccgagggccugcugagacagggcaacaucuacggcgagcaggcccaggaggccgugaccagacugcuggagaagaaccaggagaaccagcugagagcccagcaguggaugcagaagcugcacgaccagcuggagcugcagcacuuccugagagacugccacgagcuggacggcuggauccacgagaagaugcugauggccagagacggcaccagagaggacaaccacaagcugcacaagagauggcugagacaccaggccuucauggccgagcuggcccagaacaaggaguggcuggagaagaucgagagagagggccagcagcugaugcaggagaagcccgagcuggccgccagcgugagaaagaagcugggcgagaucagacagugcugggccgagcuggagagcaccacccaggccaaggccagacagcuguucgaggccagcaaggccgaccagcuggugcagagcuucgccgagcuggacaagaagcugcugcacauggagagccagcugcaggacguggaccccggcggcgaccuggccaccgugaacagccagcugaagaagcugcagagcauggagagccagguggaggagugguacagagaggugggcgagcugcaggcccagaccgccgcccugccccuggagcccgccagcaaggagcuggugggcgagagacagaacgccgugggcgagagacuggugagacugcuggagccccugcaggagagaagaagacugcugcuggccagcaaggagcugcaccagguggcccacgaccuggacgacgagcuggccugggugcaggagagacugccccuggccaugcagaccgagagaggcaacggccugcaggccgugcagcagcacaucaagaagaaccagggccugagaagagagauccaggcccacggccccagacuggaggaggugcuggagagagccggcgcccuggccagccugagaagccccgaggccgaggccgugagaagaggccuggagcagcugcagagcgccugggccggccugagagaggccgccgagagaagacagcaggugcuggacgccgccuuccagguggagcaguacuacuucgacguggccgagguggaggccuggcugggcgagcaggagcugcugaugaugagcgaggacaagggcaaggacgagcagagcacccugcagcugcugaagaagcaccugcagcuggagcagggcguggagaacuacgaggagagcaucgcccagcugagcagacagugcagagcccugcuggagaugggccaccccgacagcgagcagaucagcagaagacagagccagguggacagacuguacguggcccugaaggagcugggcgaggagagaagaguggcccuggagcagcaguacuggcuguaccagcugagcagacaggugagcgagcuggagcacuggaucgccgagaaggaggugguggccggcagccccgagcugggccaggacuucgagcacgugagcgugcugcaggagaaguucagcgaguucgccagcgagaccggcauggccggcagagagagacuggccgccgugaaccagaugguggacgagcugaucgagugcggccacaccgccgccgccaccauggccgaguggaaggacggccugaacgaggccugggccgagcugcuggagcugaugggcaccagagcccagcugcuggccgccagcagagagcugcacaaguucuucagcgacgccagagagcugcagggccagaucgaggagaagagaagaagacugcccagacugaccaccccccccgagcccagacccagcgccagcagcaugcagagaacccugagagccuucgagcacgaccugcagcugcuggugagccaggugagacagcugcaggagggcgccgcccagcugagaaccguguacgccggcgagcacgccgaggccaucgccagcagagagcaggaggugcugcagggcuggaaggagcugcugagcgccugcgaggacgccagacugcacgugagcagcaccgccgacgcccugagauuccacagccaggugagagaccugcugagcuggauggacggcaucgccagccagaucggcgccgccgacaagcccagagacgugagcagcguggaggugcugaugaacuaccaccagggccugaagaccgagcuggaggccagagugcccgagcugaccaccugccaggagcugggcagaagccugcugcugaacaagagcgccauggccgacgagauccaggcccagcuggacaagcugggcaccagaaaggaggaggugagcgagaagugggacagacacugggaguggcugcagcagaugcuggaggugcaccaguucgcccaggaggccgugguggccgacgccuggcugaccgcccaggagccccugcugcagagcagagagcugggcagcagcguggacgagguggagcagcugaucagaagacacgaggccuucagaaaggccgccgccgccugggaggagagauucagcagccugagaagacugaccaccaucgagaagaucaaggccgagcagagcaagcagccccccaccccccugcugggcagaaaguucuucggcgaccccaccgagcuggccgccaaggccgccccccugcugagacccggcggcuacgagagaggccuggagccccuggccagaagagccagcgacacccugagcgccgaggugagaaccagagugggcuacgugagacaggagcugaagcccgagagacugcagcccagaaucgacagacugcccgagauccccggcagaguggagcccgccgcccugcccgccgcccccgaggacgccgccgagacccccgccacccccgccgccgccgagcaggugagacccagacccgagagacaggagagcgccgacagagccgaggagcugcccagaagaagaagacccgagagacaggagagcguggaccagagcgaggaggccgccagaagaagaagacccgagagacaggagagcgccgagcacgaggccgcccacagccugacccugggcagauacgagcagauggagagaagaagagagagaagagagagaagacuggagagacaggagagcagcgagcaggagaugcccaucagaggcgaccuggugaagggcaaggccacccuggccgacaucguggagcagcugcaggagaaggaggccggccccggccugcccgccggccccagccugccccagcccagagagcugccccccggcagacugcccaacggccuggagcugcccgagagaacccccagacccgacagacccagagccagagacagacccaagcccagaagaagacccagacccagagagggcggcgagggcggcggcagcagaagaagcagaagcgcccccgcccagggcggcagcgcccccgcccccccccccccccccacccacaccgugcagcacgagggcuuccugcugagaaagagagagcuggacgccaacagaaagagcagcaacagaagcugggugagccuguacugcgugcugagcaagggcgagcugggcuucuacaaggacagcaagggccccgccagcggcagcacccacggcggcgagccccugcugagccugcacaaggccaccagcgagguggccagcgacuacaagaagaagaagcacguguucaagcugcagacccaggacggcagcgaguuccugcugcaggccaaggacgaggaggagaugaacggcuggcuggaggccguggccagcagcguggccgagcacgccgagaucgccagauggggccagacccugcccaccaccagcagcaccgacgagggcaaccccaagagagagggcggcgacagaagagccagcggcagaagaaaguaa

SEQ ID NO: 23999 - RNA, 11025 nt, Artificial Sequence
  SPTBN5__Homo_sapiens__NP_057726
auggccggccagccccacagccccagagagcugcugggcgccgccggccacagaagcagaagacccagcaccgagcugagagugccccccagccccagccugaccauggacagccaguacgagaccggccacaucagaaagcugcaggccagacacaugcagaugcaggagaagaccuucaccaaguggaucaacaacguguuccagugcggccaggccggcaucaagaucagaaaccuguacaccgagcuggccgacggcauccaccugcugagacugcuggagcugaucagcggcgaggcccugcccccccccagcagaggcagacugagagugcacuuccuggagaacagcagcagagcccuggccuuccugagagccaaggugcccgugccccugaucggccccgagaacaucguggacggcgaccagacccugauccugggccugaucugggugaucauccugagauuccagaucagccacaucagccuggacaaggaggaguucggcgccagcgccgcccugcugagcaccaaggaggcccugcugguguggugccagagaaagaccgccagcuacaccaacgugaacaucaccgacuucagcagaagcuggagcgacggccugggcuucaacgcccugauccacgcccacagacccgaccugcuggacuacggcagccugagacccgacagaccccugcacaaccuggccuucgccuuccugguggccgagcaggagcugggcaucgcccagcugcuggaccccgaggacguggccgccgcccagcccgacgagagaagcaucaugaccuacgugagccuguacuaccacuacugcagcagacugcaccagggccagaccgugcagagaagacugaccaagauccugcugcagcugcaggagaccgagcugcugcagacccaguacgagcagcugguggccgaccugcugagauggaucgccgagaagcagaugcagcuggaggccagagacuuccccgacagccugcccgccaugagacagcugcuggccgccuucaccaucuucagaacccaggagaagccccccagacugcagcagagaggcgccgccgaggcccugcuguucagacugcagaccgcccugcaggcccagaacagaagacccuuccugccccacgagggccugggccuggccgagcugagccagugcugggccggccuggagugggccgaggccgccagaagccaggcccugcagcagagacugcugcagcugcagagacuggagacccuggccagaagauuccagcacaaggccgcccugagagagagcuuccugaaggacgccgagcaggugcuggaccaggccagagccccccccgccagccuggccaccguggaggccgccgugcagagacugggcaugcuggaggccggcauccugccccaggagggcagauuccaggcccuggccgagaucgccgacauccugagacaggagcaguaccacagcugggccgacguggccagaagacaggaggaggugaccgugagauggcagagacugcugcagcaccugcagggccagagaaagcagguggccgacaugcaggccgugcugagccugcugcaggagguggaggccgccagccaccagcuggaggagcugcaggagcccgccagaagcaccgccugcggccagcagcuggccgaggugguggagcugcugcagagacacgaccugcuggaggcccaggugagcgcccacggcgcccacgugagccaccuggcccagcagaccgccgagcuggacagcagccugggcaccagcguggaggugcugcaggccaaggccagaacccuggcccagcugcagcagagccugguggcccuggugagagccagaagagcccugcuggagcagacccugcagagagccgaguuccugagaaacugcgaggaggaggaggccuggcugaaggagugcggccagagagugggcaacgccgcccugggcagagaccugagccagaucgccggcgcccugcagaagcacaaggcccuggaggccgaggugcacagacaccaggccgugugcguggaccuggugagaagaggcagagaccugagcgccagaagaccccccacccagcccgaccccggcgagagagccgaggccgugcagggcggcuggcagcugcugcagaccagaguggugggcagaggcgccagacugcagaccgcccugcuggugcugcaguacuucgccgacgccgccgaggccgccagcuggcugagagagagaagaagcagccuggagagagccagcugcggccaggaccaggccgccgccgagacccugcugagaagacacgugagacuggagagagugcugagagccuucgccgccgagcugagaagacuggaggagcagggcagagccgccagcgccagagccagccuguucaccgugaacagcgcccugagcccccccggcgagagccugagaaaccccggccccuggagcgaggccagcugccaccccggccccggcgacgccuggaagauggcccugcccgccgagcccgaccccgacuucgaccccaacaccauccugcagacccaggaccaccugagccaggacuacgagagccugagagcccuggcccagcugagaagagccagacuggaggaggccauggcccuguucggcuucugcagcagcugcggcgagcugcagcuguggcuggagaagcagaccgugcugcugcagagagugcagccccaggccgacacccuggaggugaugcagcugaaguacgagaacuuccugaccgcccuggccgugggcaagggccugugggccgaggugagcagcagcgccgagcagcugagacagagauaccccggcaacagcacccagauccagagacagcaggaggagcugagccagagauggggccagcuggaggcccugaagagagagaaggccgugcagcuggcccacagcguggaggugugcagcuuccugcaggagugcggccccacccaggugcagcugagagacgugcugcugcagcuggaggcccugcagcccggcagcagcgaggacaccugccacgcccugcagcuggcccagaagaagacccuggugcuggagagaagagugcacuuccugcagagcgugguggugaagguggaggagcccggcuacgccgagagccagccccugcagggccagguggagacccugcagggccugcugaagcaggugcaggagcagguggcccagagagccagaagacaggccgagacccaggccagacagagcuuccugcaggagagccagcagcugcugcugugggccgagagcgugcaggcccagcugagaagcaaggaggugagcguggacguggccagcgcccagagacugcugagagagcaccaggaccugcuggaggagauccaccuguggcaggagagacugcagcagcuggacgcccagagccagcccauggccgcccuggacugccccgacagccaggaggugcccaacacccugagagugcugggccagcagggccaggagcugaaggugcugugggagcagagacagcaguggcugcaggagggccuggagcugcagaaguucggcagagagguggacggcuucaccgccaccugcgccaaccaccaggccuggcugcaccuggacaaccugggcgaggacgugagagaggcccugagccugcugcagcagcacagagaguucggcagacugcugagcacccugggccccagagccgaggcccugagagcccacggcgagaagcuggugcagagccagcaccccgccgcccacaccgugagagagcagcugcagagcauccaggcccaguggaccagacugcagggcagaagcgagcagagaagaagacagcugcuggccagccugcagcugcaggaguggaagcaggacguggccgagcugaugcaguggauggaggagaagggccugauggccgcccacgagcccagcggcgccagaagaaacauccugcagacccugaagagacacgaggccgccgagagcgagcugcuggccaccagaagacacguggaggcccugcagcaggugggcagagagcugcugagcagaagacccugcggccaggaggacauccagaccagacugcagggccugagaagcaagugggaggcccugaacagaaagaugaccgagagaggcgacgagcugcagcaggccggccagcaggagcagcugcugagacagcugcaggacgccaaggagcagcuggagcagcuggagggcgcccugcagagcagcgagaccggccaggaccugagaagcagccagagacugcagaagagacaccagcagcuggagagcgagagcagaacccuggccgccaagauggccgcccuggccagcauggcccacggcauggccgccagccccgccauccuggaggagacccagaagcaccugagaagacuggagcugcugcagggccaccuggccaucagaggccugcagcugcaggccagcguggagcugcaccaguucugccaccugagcaacauggagcugagcuggguggccgagcacaugccccacggcagccccaccagcuacaccgagugccugaacggcgcccagagccugcacagaaagcacaaggagcugcagguggaggugaaggcccaccagggccaggugcagagagugcugagcagcggcagaagccuggccgccagcggccacccccaggcccagcacaucguggagcagugccaggagcuggagggccacugggccgagcuggagagagccugcgaggccagagcccagugccugcagcaggccgugaccuuccagcaguacuuccuggacgugagcgagcuggagggcuggguggaggagaagagaccccuggugagcagcagagacuacggcagagacgaggccgccacccugagacugaucaacaagcaccaggcccugcaggaggagcuggccaucuacuggagcagcauggaggagcuggaccagaccgcccagacccugaccggccccgaggugcccgagcagcagagaguggugcaggagagacugagagagcagcugagagcccugcaggagcuggccgccaccagagacagagagcuggagggcacccugagacugcacgaguuccugagagaggccgaggaccugcagggcuggcuggccagccagaagcaggccgccaagggcggcgagagccugggcgaggaccccgagcacgcccugcaccugugcaccaaguucgccaaguuccagcaccagguggagaugggcagccagagaguggccgccugcagacugcuggccgagagccugcuggagagaggccacagcgccggccccauggugagacagagacagcaggaccugcagaccgccuggagcgagcugugggagcugacccaggccagaggccacgcccugagagacaccgagaccacccugagagugcacagagaccugcuggaggugcugacccaggugcaggagaaggccaccagccugcccaacaacguggccagagaccugugcggccuggaggcccagcugagaagccaccagggccuggagagagagcuggugggcaccgagagacagcugcaggagcugcuggagaccgccggcagagugcagaagcugugccccggcccccaggcccacgccgugcagcagagacagcaggccgugacccaggccugggccgugcugcagagaagaauggagcagagaagagcccagcuggagagagccagacugcuggccagauucagaaccgccgugagagacuacgccagcugggccgccagagugagacaggaccugcagguggaggagagcagccaggagcccagcagcggcccccugaagcugagcgcccaccaguggcugagagccgagcuggaggccagagagaagcuguggcagcaggccacccagcugggccagcaggcccugcuggccgccggcacccccaccaaggaggugcaggaggagcugagagcccugcaggaccagagagaccagguguaccagaccugggccagaaagcaggagagacugcaggccgagcagcaggagcagcuguuccugagagagugcggcagacuggaggagauccuggccgcccaggaggugagccugaagaccagcgcccugggcagcagcguggaggagguggagcagcugaucagaaagcacgagguguuccugaaggugcugaccgcccaggacaagaaggaggccgcccugagagagagacugaagacccugagaagacccagagugagagacagacugcccauccugcugcagagaagaaugagagugaaggagcuggccgagagcagaggccacgcccugcacgccagccugcugauggccagcuucacccaggccgccacccaggccgaggacuggauccaggccugggcccagcagcugaaggagcccgugccccccggcgaccugagagacaagcugaagccccugcugaagcaccaggccuucgaggccgaggugcaggcccacgaggaggugaugaccagcguggccaagaagggcgaggcccugcuggcccagagccaccccagagccggcgaggugagccagagacugcagggccugagaaagcacugggaggaccugagacaggccauggcccugagaggccaggagcuggaggacagaagaaacuuccuggaguuccugcagagaguggaccuggccgaggccuggauccaggagaaggaggugaagaugaacgugggcgaccugggccaggaccuggagcacugccugcagcugagaagaagacugagagaguucagaggcaacagcgccggcgacaccgugggcgacgccugcaucagaagcaucagcgaccugagccugcagcugaagaacagagaccccgaggaggugaagaucaucugccagagaagaagccagcugaacaacagaugggccagcuuccacggcaaccugcugagauaccagcagcagcuggagggcgcccuggagauccacgugcugagcagagagcuggacaacgugaccaagagaauccaggagaaggaggcccugauccaggcccuggacugcggcaaggaccuggagagcgugcagagacugcugagaaagcacgaggagcuggagagagaggugcaccccauccaggcccagguggagagccuggagagagaggugggcagacugugccagagaagccccgaggccgcccacggccugagacacagacagcaggagguggccgagagcugguggcagcugagaagcagagcccagaagagaagagaggcccuggacgcccugcaccaggcccagaagcugcaggccaugcugcaggagcugcuggugagcgcccagagacugagagcccagauggacaccagccccgcccccagaagccccguggaggccagaagaaugcuggaggagcaccaggagugcaaggccgagcuggacagcuggaccgacagcaucagccuggccagaagcaccggccagcagcugcugaccgccggccaccccuucagcagcgacaucagacaggugcuggccggccuggagcaggagcugagcagccuggagggcgccuggcaggagcaccagcugcagcugcagcaggcccuggagcugcagcuguuccugagcagcguggagaagauggagagauggcugugcagcaaggaggacagccuggccagcgagggccugugggacccccuggcccccauggagccccugcuguggaagcacaagaugcuggagugggaccuggaggugcaggccggcaagaucagcgcccuggaggccaccgccagaggccugcaccagggcggccaccccgaggcccagagcgcccugggcagaugccaggccaugcugcugagaaaggaggcccuguucagacaggccggcaccagaagacacagacuggaggagcugagacagcugcaggccuuccugcaggacagccaggagguggccgccuggcugagagagaagaaccugguggcccuggaggagggccugcuggacaccgccaugcugcccgcccagcugcagaagcagcagaacuuccaggccgagcuggacgccagcaugcaccagcagcaggagcugcagagagagggccagagacugcugcagggcggccaccccgccagcgaggccauccaggagagacuggaggagcugggcgcccuguggggcgagcugcaggacaacagccagaagaagguggccaagcugcagaaggccugcgaggcccugagacugagaagaagcauggaggagcuggagaacuggcuggagcccaucgagguggagcugagagcccccaccgugggccaggcccugcccggcgugggcgagcugcugggcacccagagagagcuggaggccgccguggacaagaaggccagacaggccgaggcccugcugggccaggcccaggccuucgugagagagggccacugccuggcccaggacguggaggagcaggccagaagacugcugcagagauucaagagccugagagagccccugcaggagagaagaaccgcccuggaggccagaagccugcugcugaaguucuucagagacgccgacgaggagauggccugggugcaggagaagcugccccuggccgccgcccaggacuacggccagagccugagcgccgugagacaccugcaggagcagcaccagaaccuggagagcgagaugagcagccacgaggcccugaccagaguggugcugggcaccggcuacaagcuggugcaggccggccacuucgccgcccacgagguggccgccagagugcagcagcuggagaaggccauggcccaccugagagccgaggccgccagaagaagacugcugcugcagcaggcccaggaggcccagcaguuccugaccgagcugcuggaggccggcagcuggcuggccgagagaggccacgugcuggacagcgaggacaugggccacagcgccgaggccacccaggcccugcugagaagacuggaggccaccaagagagaccuggaggccuucagccccagaaucgagagacugcagcagaccgccgcccugcuggagagcagaaagaaccccgagagccccaaggugcuggcccagcugcaggccgugagagaggcccacgccgagcugcugagaagagccgaggccagaggccacggccugcaggagcagcugcagcugcaccagcuggagagagagacccugcugcuggacgccuggcugaccaccaaggccgccaccgccgagagccaggacuacggccaggaccuggagggcgugaaggugcuggaggagaaguucgacgccuucagaaaggaggugcagagccugggccaggccaagguguacgcccugagaaagcuggccggcacccuggagagaggcgcccccagaagauacccccacauccaggcccagagaagcagaaucgaggccgccugggagagacuggaccaggccaucaaggccagaaccgagaaccuggccgccgcccacgaggugcacagcuuccagcaggccgccgccgagcugcagggcagaaugcaggagaagaccgcccugaugaagggcgaggacggcggccacagccugagcagcgugagaacccugcagcagcagcacagaagacuggagagagagcuggaggccauggagaaggagguggccagacugcagaccgaggccugcagacugggccagcugcaccccgccgcccccggcggccuggccaaggugcaggaggccugggccacccugcaggccaaggcccaggagagaggccaguggcuggcccaggccgcccagggccacgccuuccugggcagaugccaggagcugcuggccugggcccaggagagacaggagcuggccagcagcgaggagcuggccgaggacguggccggcgccgagcagcugcugggccagcacgaggagcugggccaggagaucagagagugcagacugcaggcccaggaccugagacaggagggccagcagcugguggacaacagccacuucaugagcgccgaggugaccgagugccugcaggagcuggagggcagacugcaggagcuggaggaggccugggcccugagauggcagagaugcgccgagagcuggggccugcagaagcugagacagagacuggagcaggccgaggccuggcuggccugcugggagggccugcugcugaagcccgacuacggccacagcgugagcgacguggagcugcugcugcacagacaccaggaccuggagaagcugcuggccgcccaggaggagaaguucgcccagaugcagaagaccgagauggagcaggagcugcugcugcagccccaggagcugaagcccggcagagccggcagcagccugaccagcuuccaguggagacccagcggccaccagggccugggcgcccagcuggccgagaccagagacccccaggacgccaagggcacccccaccauggagggcagccuggaguucaagcagcaccugcugcccggcggcagacagcccagcagcagcagcugggacagcugcagaggcaaccugcagggcagcagccugagccuguuccuggacgagagaauggccgccgagaagguggccagcaucgcccugcuggaccugaccggcgccagaugcgagagacugagaggcagacacggcagaaagcacaccuucagccugagacugaccagcggcgccgagauccuguucgccgcccccagcgaggagcaggccgagagcugguggagagcccugggcagcaccgccgcccagagccugagccccaagcugaaggccaagcccgugagcagccugaacgagugcaccaccaaggacgccagacccggcugccugcugagaagcgaccccuaa

SEQ ID NO: 24000 - RNA, 1422 nt, Artificial Sequence
  SPTLC1__Homo_sapiens__NP_006406
auggccaccgccaccgagcagugggugcugguggagauggugcaggcccuguacgaggcccccgccuaccaccugauccuggagggcauccugauccuguggaucaucagacugcuguucagcaagaccuacaagcugcaggagagaagcgaccugaccgugaaggagaaggaggagcugaucgaggaguggcagcccgagccccuggugccccccgugcccaaggaccaccccgcccugaacuacaacaucgugagcggcccccccagccacaagaccguggugaacggcaaggagugcaucaacuucgccagcuucaacuuccugggccugcuggacaaccccagagugaaggccgccgcccuggccagccugaagaaguacggcgugggcaccugcggccccagaggcuucuacggcaccuucgacgugcaccuggaccuggaggacagacuggccaaguucaugaagaccgaggaggccaucaucuacagcuacggcuucgccaccaucgccagcgccauccccgccuacagcaagagaggcgacaucguguucguggacagagccgccugcuucgccauccagaagggccugcaggccagcagaagcgacaucaagcuguucaagcacaacgacauggccgaccuggagagacugcugaaggagcaggagaucgaggaccagaagaaccccagaaaggccagagugaccagaagauucaucgugguggagggccuguacaugaacaccggcaccaucugcccccugcccgagcuggugaagcugaaguacaaguacaaggccagaaucuuccuggaggagagccugagcuucggcgugcugggcgagcacggcagaggcgugaccgagcacuacggcaucaacaucgacgacaucgaccugaucagcgccaacauggagaacgcccuggccagcaucggcggcuucugcugcggcagaagcuucgugaucgaccaccagagacugagcggccagggcuacugcuucagcgccagccugcccccccugcuggccgccgccgccaucgaggcccugaacaucauggaggagaaccccggcaucuucgccgugcugaaggagaagugcggccagauccacaaggcccugcagggcaucagcggccugaagguggugggcgagagccugagccccgccuuccaccugcagcuggaggagagcaccggcagcagagagcaggacgugagacugcugcaggagaucguggaccagugcaugaacagaagcaucgcccugacccaggccagauaccuggagaaggaggagaagugccugcccccccccagcaucagagugguggugaccguggagcagaccgaggaggagcuggagagagccgccagcaccaucaaggagguggcccaggccgugcugcuguaa

SEQ ID NO: 24001 - RNA, 1689 nt, Artificial Sequence
  SPTLC2__Homo_sapiens__NP_004854
augagacccgagcccggcggcugcugcugcagaagaaccgugagagccaacggcugcguggccaacggcgaggugagaaacggcuacgugagaagcagcgccgccgccgccgccgccgccgccgccggccagauccaccacgugacccagaacggcggccuguacaagagacccuucaacgaggccuucgaggagacccccaugcugguggccgugcugaccuacgugggcuacggcgugcugacccuguucggcuaccugagagacuuccugagauacuggagaaucgagaagugccaccacgccaccgagagagaggagcagaaggacuucgugagccuguaccaggacuucgagaacuucuacaccagaaaccuguacaugagaaucagagacaacuggaacagacccaucugcagcgugcccggcgccagaguggacaucauggagagacagagccacgacuacaacuggagcuucaaguacaccggcaacaucaucaagggcgugaucaacaugggcagcuacaacuaccugggcuucgccagaaacaccggcagcugccaggaggccgccgccaaggugcuggaggaguacggcgccggcgugugcagcaccagacaggagaucggcaaccuggacaagcacgaggagcuggaggagcugguggccagauuccugggcguggaggccgccauggccuacggcaugggcuucgccaccaacagcaugaacauccccgcccuggugggcaagggcugccugauccugagcgacgagcugaaccacgccagccuggugcugggcgccagacugagcggcgccaccaucagaaucuucaagcacaacaacaugcagagccuggagaagcugcugaaggacgccaucguguacggccagcccagaaccagaagacccuggaagaagauccugauccugguggagggcaucuacagcauggagggcagcaucgugagacugcccgaggugaucgcccugaagaagaaguacaaggccuaccuguaccuggacgaggcccacagcaucggcgcccugggccccaccggcagaggcgugguggaguacuucggccuggaccccgaggacguggacgugaugaugggcaccuucaccaagagcuucggcgccagcggcggcuacaucggcggcaagaaggagcugaucgacuaccugagaacccacagccacagcgccguguacgccaccagccugagcccccccgugguggagcagaucaucaccagcaugaagugcaucaugggccaggacggcaccagccugggcaaggagugcgugcagcagcuggccgagaacaccagauacuucagaagaagacugaaggagaugggcuucaucaucuacggcaacgaggacagccccguggugccccugaugcuguacaugcccgccaagaucggcgccuucggcagagagaugcugaagagaaacaucggcguggugguggugggcuuccccgccacccccaucaucgagagcagagccagauucugccugagcgccgcccacaccaaggagauccuggacaccgcccugaaggagaucgacgaggugggcgaccugcugcagcugaaguacagcagacacagacuggugccccugcuggacagacccuucgacgagaccaccuacgaggagaccgaggacuaa

SEQ ID NO: 24002 - RNA, 1659 nt, Artificial Sequence
  SPTLC3__Homo_sapiens__NP_060797
auggccaaccccggcggcggcgccgugugcaacggcaagcugcacaaccacaagaagcagagcaacggcagccagagcagaaacugcaccaagaacggcaucgugaaggaggcccagcagaacggcaagccccacuucuacgacaagcugaucguggagagcuucgaggaggccccccugcacgugaugguguucaccuacaugggcuacggcaucggcacccuguucggcuaccugagagacuuccugagaaacuggggcaucgagaagugcaacgccgccguggagagaaaggagcagaaggacuucgugccccuguaccaggacuucgagaacuucuacaccagaaaccuguacaugagaaucagagacaacuggaacagacccaucugcagcgcccccggcccccuguucgaccugauggagagagugagcgacgacuacaacuggaccuucagauucaccggcagagugaucaaggacgugaucaacaugggcagcuacaacuuccugggccuggccgccaaguacgacgagagcaugagaaccaucaaggacgugcuggagguguacggcaccggcguggccagcaccagacacgagaugggcacccuggacaagcacaaggagcuggaggaccugguggccaaguuccugaacguggaggccgccaugguguucggcaugggcuucgccaccaacagcaugaacauccccgcccuggugggcaagggcugccugauccugagcgacgagcugaaccacaccagccuggugcugggcgccagacugagcggcgccaccaucagaaucuucaagcacaacaacacccagagccuggagaagcugcugagagacgccgugaucuacggccagcccagaaccagaagagccuggaagaagauccugauccugguggagggcguguacagcauggagggcagcaucgugcaccugccccagaucaucgcccugaagaagaaguacaaggccuaccuguacaucgacgaggcccacagcaucggcgccgugggccccaccggcagaggcgugaccgaguucuucggccuggacccccacgagguggacgugcugaugggcaccuucaccaagagcuucggcgccagcggcggcuacaucgccggcagaaaggaccugguggacuaccugagagugcacagccacagcgccguguacgccagcagcaugagcccccccaucgccgagcagaucaucagaagccugaagcugaucaugggccuggacggcaccacccagggccugcagagagugcagcagcuggccaagaacaccagauacuucagacagagacugcaggagaugggcuucaucaucuacggcaacgagaacgccagcguggugccccugcugcuguacaugcccggcaagguggccgccuucgccagacacaugcuggagaagaagaucggcguggugguggugggcuuccccgccaccccccuggccgaggccagagccagauucugcgugagcgccgcccacaccagagagaugcuggacaccgugcuggaggcccuggacgagaugggcgaccugcugcagcugaaguacagcagacacaagaagagcgccagacccgagcuguacgacgagaccagcuucgagcuggaggacuaa

SEQ ID NO: 24003 - RNA, 231 nt, Artificial Sequence
  SPTSSB__Homo_sapiens__NP_001035189
auggaccugagaagagugaaggaguacuucagcuggcuguacuaccaguaccagaucaucagcugcugcgccgugcuggagcccugggagagaagcauguucaacaccauccugcugaccaucaucgccauggugguguacaccgccuacguguucauccccauccacaucagacuggccugggaguucuucagcaagaucugcggcuaccacagcaccaucagcaacuaa

SEQ ID NO: 24004 - RNA, 2058 nt, Artificial Sequence
  SPTY2D1__Homo_sapiens__NP_919261
auggacuucagagagauccugaugaucgccagcaagggccagggcgugaacaacgugcccaagagauacagccuggccgugggcccccccaagaaggaccccaaggugaagggcgugcagagcgccgccgugcaggccuuccugaagagaaaggaggaggagcugagaagaaaggcccuggaggagaagagaagaaaggaggagcuggugaagaagagaaucgagcugaagcacgacaagaaggccagagccauggccaagagaaccaaggacaacuuccacggcuacaacggcauccccaucgaggagaagagcaagaagagacaggccaccgagagccacaccagccagggcaccgacagagaguacgagauggaggaggagaacgaguuccuggaguacaaccacgccgagagcgagcaggaguacgaggaggagcaggagccccccaagguggagagcaagcccaaggugccccugaagagcgcccccccccccaugaacuucaccgaccugcugagacuggccgagaagaagcaguucgagcccguggagaucaagguggugaagaagagcgaggagagacccaugaccgccgaggagcugagagagagagaguuccuggagagaaagcacagaagaaagaagcuggagaccgacggcaagcugccccccaccgugagcaagaaggcccccagccagaaggagagcgugggcaccaagcugagcaagggcagcggcgacagacaccccagcagcaagggcaugccccugccccacgccgagaagaagagcagacccagcauggccaacgagaagcaccuggcccugagcagcagcaagagcaugcccggcgagagaaucaaggccggcagcggcaacagcagccagcccagccugagagagggccacgacaagcccguguucaacggcgccggcaagccccacagcagcaccagcagccccagcgugcccaagaccagcgccagcagaacccagaagagcgccguggagcacaaggccaagaagagccugagccaccccagccacagcagacccggccccauggugaccccccacaacaaggccaagagccccggcgugagacagcccggcagcagcagcagcagcgcccccggccagcccagcaccggcguggccagacccaccgugagcagcggccccgugcccagaagacagaacggcagcagcagcagcggccccgagagaagcaucagcggcagcaagaagcccaccaacgacagcaaccccagcagaagaaccgugagcggcaccugcggccccggccagcccgccagcagcagcggcggccccggcagacccaucagcggcagcgugagcagcgccagaccccugggcagcagcagaggccccggcagacccgugagcagcccccacgagcugagaagacccgugagcggccugggcccccccggcagaagcgugagcggccccggcagaagcaucagcggcagcauccccgccggcagaaccgugagcaacagcgugcccggcagacccgugagcagccugggccccggccagaccgugagcagcagcggccccaccaucaagcccaagugcaccguggugagcgagaccaucagcagcaagaacaucaucagcagaagcagcaacggccagaugaacggcaugaagcccccccugagcggcuacagagccgcccagggcccccagagacugcccuuccccaccggcuacaagagacagagagaguacgaggaggaggacgacgacgacgacgaguacgacagcgagauggaggacuucaucgaggacgagggcgagccccaggaggagaucagcaagcacaucagagagaucuucggcuacgacagaaagaaguacaaggacgagagcgacuacgcccugagauacauggagagcagcuggaaggagcagcagaaggaggaggccaagagccugagacugggcaugcaggaggaccuggaggagaugagaagagaggaggaggagaugcagagaagaagagccaagaagcugaagagaagauaa

SEQ ID NO: 24005 - RNA, 1293 nt, Artificial Sequence
  SPZ1__Homo_sapiens__NP_115956
auggccagcagcgccaagagcgccgagaugcccaccaucagcaagaccgugaaccccacccccgacccccaccaggaguaccuggaccccagaaucaccaucgcccuguucgagaucggcagccacagccccagcagcuggggcagccugcccuuccugaagaacagcagccaccaggugaccgagcagcagaccgcccagaaguucaacaaccugcugaaggagaucaaggacauccugaagaacauggccggcuucgaggagaagaucaccgaggccaaggagcuguucgaggagaccaacaucaccgaggacgugagcgcccacaaggagaacaucagaggccuggacaagaucaacgagaugcugagcaccaaccugcccgugagccuggcccccgagaaggaggacaacgagaagaagcaggagaugauccuggagaccaacaucaccgaggacgugagcgcccacaaggagaacaucagaggccuggacaagaucaacgagaugcugagcaccaaccugcccgugagccuggcccccgagaaggaggacaacgagaagaagcagcagaugaucauggagaaccagaacagcgagaacaccgcccagguguucgccagagaccuggugaacagacuggaggagaagaaggugcugaacgagacccagcagagccaggagaaggccaagaacagacugaacgugcaggaggagaccaugaagaucagaaacaacauggagcagcugcugcaggaggccgagcacuggagcaagcagcacaccgagcugagcaagcugaucaagagcuaccagaagagccagaaggacaucagcgagacccugggcaacaacggcgugggcuuccagacccagcccaacaacgaggugagcgccaagcacgagcuggaggagcaggugaagaagcugagccacgacaccuacagccugcagcugauggccgcccugcuggagaacgagugccagauccugcagcagagaguggagauccugaaggagcugcaccaccagaagcagggcacccugcaggagaagcccauccagaucaacuacaagcaggacaagaagaaccagaagcccagcgaggccaagaagguggagauguacaagcagaacaagcaggccaugaagggcaccuucuggaagaaggacagaagcugcagaagccuggacgugugccugaacaagaaggccugcaacacccaguucaacauccacguggccagaaaggcccugagaggcaagaugagaagcgccagcagccugagauaa

SEQ ID NO: 24006 - RNA, 1725 nt, Artificial Sequence
  SQLE__Homo_sapiens__NP_003120
auguggaccuuccugggcaucgccaccuucaccuacuucuacaagaaguucggcgacuucaucacccuggccaacagagaggugcugcugugcgugcugguguuccugagccugggccuggugcugagcuacagaugcagacacagaaacggcggccugcugggcagacagcagagcggcagccaguucgcccuguucagcgacauccugagcggccugcccuucaucggcuucuucugggccaagagcccccccgagagcgagaacaaggagcagcuggaggccagaagaagaagaaagggcaccaacaucagcgagaccagccugaucggcaccgccgccugcaccagcaccagcagccagaacgaccccgaggugaucaucgugggcgccggcgugcugggcagcgcccuggccgccgugcugagcagagacggcagaaaggugaccgugaucgagagagaccugaaggagcccgacagaaucgugggcgaguuccugcagcccggcggcuaccacgugcugaaggaccugggccugggcgacaccguggagggccuggacgcccagguggugaacggcuacaugauccacgaccaggagagcaagagcgaggugcagauccccuacccccugagcgagaacaaccaggugcagagcggcagagccuuccaccacggcagauucaucaugagccugagaaaggccgccauggccgagcccaacgccaaguucaucgagggcguggugcugcagcugcuggaggaggacgacguggugaugggcgugcaguacaaggacaaggagaccggcgacaucaaggagcugcacgccccccugaccgugguggccgacggccuguucagcaaguucagaaagagccuggugagcaacaaggugagcgugagcagccacuucgugggcuuccugaugaagaacgccccccaguucaaggccaaccacgccgagcugauccuggccaaccccagccccgugcugaucuaccagaucagcagcagcgagaccagagugcugguggacaucagaggcgagaugcccagaaaccugagagaguacaugguggagaagaucuacccccagauccccgaccaccugaaggagcccuuccuggaggccaccgacaacagccaccugagaagcaugcccgccagcuuccugccccccagcagcgugaagaagagaggcgugcugcugcugggcgacgccuacaacaugagacacccccugaccggcggcggcaugaccguggccuucaaggacaucaagcuguggagaaagcugcugaagggcauccccgaccuguacgacgacgccgccaucuucgaggccaagaagagcuucuacugggccagaaagaccagccacagcuucguggugaacauccuggcccaggcccuguacgagcuguucagcgccaccgacgacagccugcaccagcugagaaaggccugcuuccuguacuucaagcugggcggcgagugcguggccggccccgugggccugcugagcgugcugagccccaacccccuggugcugaucggccacuucuucgccguggccaucuacgccguguacuucugcuucaagagcgagcccuggaucaccaagcccagagcccugcugagcagcggcgccgugcuguacaaggccugcagcgugaucuucccccugaucuacagcgagaugaaguacauggugcacuaa

SEQ ID NO: 24007 - RNA, 1353 nt, Artificial Sequence
  SQRDL__Homo_sapiens__NP_067022
auggugccccugguggccguggugagcggccccagagcccagcuguucgccugccugcugagacugggcacccagcaggugggcccccugcagcugcacaccggcgccagccacgccgccagaaaccacuacgaggugcuggugcugggcggcggcagcggcggcaucaccauggccgccagaaugaagagaaaggugggcgccgagaacguggccaucguggagcccagcgagagacacuucuaccagcccaucuggacccuggugggcgccggcgccaagcagcugagcagcagcggcagacccaccgccagcgugauccccagcggcguggaguggaucaaggccagagugaccgagcugaaccccgacaagaacugcauccacaccgacgacgacgagaagaucagcuacagauaccugaucaucgcccugggcauccagcuggacuacgagaagaucaagggccugcccgagggcuucgcccaccccaagaucggcagcaacuacagcgugaagaccguggagaagaccuggaaggcccugcaggacuucaaggagggcaacgccaucuucaccuuccccaacacccccgugaagugcgccggcgccccccagaagaucauguaccugagcgaggccuacuucagaaagaccggcaagagaagcaaggccaacaucaucuucaacaccagccugggcgccaucuucggcgugaagaaguacgccgacgcccugcaggagaucauccaggagagaaaccugaccgugaacuacaagaagaaccugaucgaggugagagccgacaagcaggaggccguguucgagaaccuggacaagcccggcgagacccaggugaucagcuacgagaugcugcacgugaccccccccaugagcccccccgacgugcugaagaccagccccguggccgacgccgccggcuggguggacguggacaaggagacccugcagcacagaagauaccccaacguguucggcaucggcgacugcaccaaccugcccaccagcaagaccgccgccgccguggccgcccagagcggcauccuggacagaaccaucagcgugaucaugaagaaccagacccccaccaagaaguacgacggcuacaccagcugcccccuggugaccggcuacaacagagugauccuggccgaguucgacuacaaggccgagccccuggagaccuuccccuucgaccagagcaaggagagacugagcauguaccugaugaaggccgaccugaugcccuuccuguacuggaacaugaugcugagaggcuacuggggcggccccgccuuccugagaaagcuguuccaccugggcaugagcuaa

SEQ ID NO: 24008 - RNA, 1071 nt, Artificial Sequence
  SQSTM1__Homo_sapiens__NP_001135771
auggccaugagcuacgugaaggacgacaucuucagaaucuacaucaaggagaagaaggagugcagaagagaccacagaccccccugcgcccaggaggcccccagaaacauggugcaccccaacgugaucugcgacggcugcaacggccccguggugggcaccagauacaagugcagcgugugccccgacuacgaccugugcagcgugugcgagggcaagggccugcacagaggccacaccaagcuggccuuccccagccccuucggccaccugagcgagggcuucagccacagcagauggcugagaaaggugaagcacggccacuucggcuggcccggcugggagaugggcccccccggcaacuggagccccagaccccccagagccggcgaggccagacccggccccaccgccgagagcgccagcggccccagcgaggaccccagcgugaacuuccugaagaacgugggcgagagcguggccgccgcccugagcccccugggcaucgagguggacaucgacguggagcacggcggcaagagaagcagacugacccccgugagccccgagagcagcagcaccgaggagaagagcagcagccagcccagcagcugcugcagcgaccccagcaagcccggcggcaacguggagggcgccacccagagccuggccgagcagaugagaaagaucgcccuggagagcgagggcagacccgaggagcagauggagagcgacaacugcagcggcggcgacgacgacuggacccaccugagcagcaaggagguggaccccagcaccggcgagcugcagagccugcagaugcccgagagcgagggccccagcagccuggaccccagccaggagggccccaccggccugaaggaggccgcccuguacccccaccugccccccgaggccgaccccagacugaucgagagccugagccagaugcugagcaugggcuucagcgacgagggcggcuggcugaccagacugcugcagaccaagaacuacgacaucggcgccgcccuggacaccauccaguacagcaagcacccccccccccuguaa

SEQ ID NO: 24009 - RNA, 711 nt, Artificial Sequence
  SRA1__Homo_sapiens__NP_001030312
augaccagaugccccgccggccaggccgagguggagauggccgagcuguacgugaagcccggcaacaaggagagaggcuggaacgaccccccccaguucagcuacggccugcagacccaggccggcggccccagaagaagccugcugaccaagagaguggccgccccccaggacggcagccccagagugcccgccagcgagaccagccccggccccccccccaugggcccccccccccccagcagcaaggcccccagaagcccccccgugggcagcggccccgccagcggcguggagcccaccagcuuccccguggagagcgaggccgugauggaggacgugcugagaccccuggagcaggcccuggaggacugcagaggccacaccagaaagcaggugugcgacgacaucagcagaagacuggcccugcugcaggagcagugggccggcggcaagcugagcauccccgugaagaagagaauggcccugcuggugcaggagcugagcagccacagaugggacgccgccgacgacauccacagaagccugaugguggaccacgugaccgaggugagccaguggauggugggcgugaagagacugaucgccgagaagagaagccuguucagcgaggaggccgccaacgaggagaagagcgccgccaccgccgagaagaaccacaccauccccggcuuccagcaggccagcuaa

SEQ ID NO: 24010 - RNA, 2988 nt, Artificial Sequence
  SRBD1__Homo_sapiens__NP_060549
augagcagccugcccagaagagccaaggugcaggugcaggacguggugcugaaggacgaguucagcagcuucagcgagcugagcagcgccagcgaggaggacgacaaggaggacagcgccugggagccccagaagaaggugcccagaagcagaaagcagcccccccccaaggagagcaagcccaagagaaugcccagagugaagaagaacgccccccagaucagcgacggcagcgagguggugguggugaaggaggagcugaacagcagcguggccaucgccgacaccgcccuggaggacagaaagaacaagcuggacaccgugcagacccugaagaccgccaagaccaagcagaagugcgccgcccagccccacaccgugagaagaaccaagaagcugaagguggaggaggagaccagcaaggccagcaaccuggagggcgagagcaacagcagcgagacccccagcaccagcaccguguggggcggcaccugcaagaaggaggagaacgacgacgacuucaccuucggccagagcgcccugaagaagaucaagaccgagaccuacccccagggccagcccgugaaguuccccgccaacgccaacagcaccaaggaggagguggagaugaacugggacauggugcaggugcugagcgagagaaccaacaucgagcccugggugugcgccaacaucaucagacuguucaacgacgacaacaccauccccuucaucaucagauacagaaaggagcugaucaacaaccuggacgccgacagccugagagaggugcagcagacccuggaggagcugagagccguggccaagaaggugcacagcaccauccagaagaucaagaaggagggcaagaugagcgagugccugcugaaggccaugcugaacugcaagaccuucgaggagcuggagcacgugagcgcccccuacaagaccggcagcaagggcaccaaggcccagagagccagacagcugggccuggagggcgccgccagagcccugcuggagaagcccggcgagcugagccugcugagcuacaucagacccgacgugaagggccugagcacccugcaggacaucgagaucggcgugcagcacauccuggccgacaugaucgccaaggacaaggacacccuggacuucaucagaaaccugugccagaagagacacgugugcauccagagcagccuggccaaggugagcagcaagaaggugaacgagaaggacguggacaaguuccugcuguaccagcacuucagcugcaacaucagaaacauccaccaccaccagauccuggccaucaacagaggcgagaaccugaaggugcugaccgugaaggugaacaucagcgacggcgugaaggacgaguucugcagauggugcauccagaacagauggagacccagaagcuucgccagacccgagcugaugaagauccuguacaacagccugaacgacagcuucaagagacugaucuacccccugcugugcagagaguucagagccaagcugaccagcgacgccgagaaggagagcgugaugauguucggcagaaaccugagacagcugcugcugaccagccccgugcccggcagaacccugaugggcguggaccccggcuacaagcacggcugcaagcuggccaucaucagccccaccagccagauccugcacaccgacgugguguaccugcacugcggccagggcuucagagaggccgagaagaucaagacccugcugcugaacuucaacugcagcaccguggugaucggcaacggcaccgccugcagagagaccgaggccuacuucgccgaccugaucaugaagaacuacuucgccccccuggacgugguguacugcaucgugagcgaggccggcgccagcaucuacagcgugagccccgaggccaacaaggagaugcccggccuggaccccaaccugagaagcgccgugagcaucgccagaagagugcaggacccccuggccgagcuggugaagaucgagcccaagcacaucggcgugggcauguaccagcacgacgugagccagacccugcugaaggccacccuggacagcgugguggaggagugcgugagcuucgugggcguggacaucaacaucugcagcgaggugcugcugagacacaucgccggccugaacgccaacagagccaagaacaucaucgaguggagagagaagaacggccccuucaucaacagagagcagcugaagaaggugaagggccugggccccaagagcuuccagcagugcgccggcuucaucagaaucaaccaggacuacaucagaaccuucugcagccagcagaccgagaccagcggccagauccagggcguggccgugaccagcagcgccgacguggaggugaccaacgagaagcagggcaagaagaagagcaagaccgccgugaacgugcugcugaagcccaacccccuggaccagaccugcauccaccccgagagcuacgacaucgccaugagauuccugagcagcaucggcggcacccuguacgaggugggcaagcccgagaugcagcagaagaucaacagcuuccuggagaaggagggcauggagaagaucgccgagagacugcagaccaccgugcacacccugcaggugaucaucgacggccugagccagcccgagagcuucgacuucagaaccgacuucgacaagcccgacuucaagagaagcaucgugugccuggaggaccugcagaucggcaccgugcugaccggcaagguggagaacgccacccuguucggcaucuucguggacaucggcgugggcaagagcggccugauccccaucagaaacgugaccgaggccaagcugagcaagaccaagaagagaagaagccugggccugggccccggcgagagaguggaggugcaggugcugaacaucgacauccccagaagcagaaucacccuggaccugaucagagugcuguaa

SEQ ID NO: 24011 - RNA, 9693 nt, Artificial Sequence
  SRCAP__Homo_sapiens__NP_006653
augcagagcagccccagccccgcccacccccagcugcccgugcugcagacccagauggugagcgacggcaugaccggcagcaaccccgugagccccgccagcagcagcagccccgccagcagcggcgccggcggcaucagcccccagcacaucgcccaggacagcagccuggacggcccccccggcccccccgacggcgccaccgugccccuggagggcuucagccugagccaggccgccgaccuggccaacaagggccccaagugggagaagagccacgccgagaucgccgagcaggccaagcacgaggccgagaucgagaccagaaucgccgagcugagaaaggagggcuucuggagccugaagagacugcccaaggugcccgagccccccagacccaagggccacugggacuaccugugcgaggagaugcaguggcugagcgccgacuucgcccaggagagaagauggaagagaggcguggccagaaagguggugagaauggugaucagacaccacgaggagcagagacagaaggaggagagagccagaagagaggagcaggccaagcugagaagaaucgccagcaccauggccaaggacgugagacaguucuggagcaacguggagaagguggugcaguucaagcagcagagcagacuggaggagaagagaaagaaggcccuggaccugcaccuggacuucaucgugggccagaccgagaaguacagcgaccugcugagccagagccugaaccagccccugaccagcagcaaggccggcagcagccccugccugggcagcagcagcgccgccagcagcccccccccccccgccagcagacuggacgacgaggacggcgacuuccagccccaggaggacgaggaggaggacgacgaggagaccaucgagguggaggagcagcaggagggcaacgacgccgaggcccagagaagagagaucgagcugcugagaagagagggcgagcugccccuggaggagcugcugagaagccugcccccccagcugcuggagggccccagcagccccagccagacccccagcagccacgacagcgacaccagagacggccccgaggagggcgccgaggaggagcccccccaggugcuggagaucaagcccccccccagcgccgugacccagagaaacaagcagcccuggcaccccgacgaggacgacgaggaguucaccgccaacgaggaggaggccgaggacgaggaggacaccaucgccgccgaggagcagcuggagggcgagguggaccacgccauggagcugagcgagcuggccagagagggcgagcugagcauggaggagcugcugcagcaguacgccggcgccuacgcccccggcagcggcagcagcgaggacgaggacgaggacgagguggacgccaacagcagcgacugcgagcccgagggccccguggaggccgaggagcccccccaggaggacagcagcagccagagcgacagcguggaggacagaagcgaggacgaggaggacgagcacagcgaggaggaggagaccagcggcagcagcgccagcgaggagagcgagagcgaggagagcgaggacgcccagagccagagccaggccgacgaggaggaggaggacgacgacuucggcguggaguaccugcuggccagagacgaggagcagagcgaggccgacgccggcagcggcccccccacccccggccccaccacccugggccccaagaaggagaucaccgacaucgccgccgccgccgagagccugcagcccaagggcuacacccuggccaccacccaggugaagacccccaucccccugcugcugagaggccagcugagagaguaccagcacaucggccuggacuggcuggugaccauguacgagaagaagcugaacggcauccuggccgacgagaugggccugggcaagaccauccagaccaucagccugcuggcccaccuggccugcgagaagggcaacuggggcccccaccugaucaucgugcccaccagcgugaugcugaacugggagauggagcugaagagauggugccccagcuucaagauccugaccuacuacggcgcccagaaggagagaaagcugaagagacagggcuggaccaagcccaacgccuuccacgugugcaucaccagcuacaagcuggugcugcaggaccaccaggccuucagaagaaagaacuggagauaccugauccuggacgaggcccagaacaucaagaacuucaagagccagagauggcagagccugcugaacuucaacagccagagaagacugcugcugaccggcaccccccugcagaacagccugauggagcuguggagccugaugcacuuccugaugccccacguguuccagagccacagagaguucaaggagugguucagcaacccccugaccggcaugaucgagggcagccaggaguacaacgagggccuggugaagagacugcacaaggugcugagacccuuccugcugagaagagugaagguggacguggagaagcagaugcccaagaaguacgagcacgugaucagaugcagacugagcaagagacagagaugccuguacgacgacuucauggcccagaccaccaccaaggagacccuggccaccggccacuucaugagcgugaucaacauccugaugcagcugagaaaggugugcaaccaccccaaccuguucgaccccagacccgugaccagccccuucaucacccccggcaucugcuucagcaccgccagccuggugcugagagccaccgacgugcacccccugcagagaaucgacaugggcagauucgaccugaucggccuggagggcagagugagcagauacgaggccgacaccuuccugcccagacacagacugagcagaagagugcugcuggagguggccaccgcccccgaccccccccccagacccaagcccgugaagaugaaggugaacagaaugcugcagcccgugcccaagcaggagggcagaaccguggugguggugaacaaccccagagccccccugggccccgugcccgugagacccccccccggccccgagcugagcgcccagcccacccccggccccgugccccaggugcugcccgccagccugauggugagcgccagccccgccggccccccccugauccccgccagcagaccccccggccccgugcugcugcccccccugcagcccaacagcggcagccugccccaggugcugcccagcccccugggcgugcugagcggcaccagcagaccccccacccccacccugagccugaagcccaccccccccgcccccgugagacugagccccgcccccccccccggcagcagcagccugcugaagccccugaccgugccccccggcuacaccuucccccccgccgccgccaccaccaccagcaccaccaccgccaccgccaccaccaccgccgugcccgcccccacccccgccccccagagacugauccugagccccgacaugcaggccagacugcccagcggcgagguggugagcaucggccagcuggccagccuggcccagagacccguggccaacgccggcggcagcaagccccugaccuuccagauccagggcaacaagcugacccugaccggcgcccaggugagacagcuggccgugggccagcccagaccccugcagagaaacguggugcaccuggugagcgccggcggccagcaccaccugaucagccagcccgcccacguggcccugauccaggccguggcccccacccccggccccacccccgugagcgugcugcccagcagcacccccagcaccacccccgcccccaccggccugagccugccccuggccgccaaccaggugccccccaccauggugaacaacaccggcguggugaagaucguggugagacaggcccccagagacggccugacccccgugcccccccuggcccccgcccccagaccccccagcagcggccugcccgccgugcugaaccccagacccacccugacccccggcagacugcccacccccacccugggcaccgccagagcccccaugcccacccccacccuggugagaccccugcugaagcuggugcacagccccagccccgaggugagcgccagcgcccccggcgccgccccccugaccaucagcagcccccugcacgugcccagcagccugcccggccccgccagcagccccaugcccauccccaacagcagcccccuggccagccccgugagcagcaccgugagcgugccccugagcagcagccugcccaucagcgugcccaccacccugcccgcccccgccagcgccccccugaccauccccaucagcgccccccugaccgugagcgccagcggccccgcccugcugaccagcgugacccccccccuggcccccguggugcccgccgcccccggcccccccagccuggcccccagcggcgccagccccagcgccagcgcccugacccugggccuggccaccgcccccagccugagcagcagccagacccccggccacccccugcugcuggcccccaccagcagccacgugcccggccugaacagcaccguggcccccgccugcagccccgugcuggugcccgccagcgcccuggccagccccuuccccagcgcccccaaccccgcccccgcccaggccagccugcuggcccccgccagcagcgccagccaggcccuggccaccccccuggcccccauggccgccccccagaccgccauccuggcccccagccccgcccccccccuggccccccugcccgugcuggcccccagccccggcgccgcccccgugcuggccagcagccagacccccgugcccgugauggcccccagcagcacccccggcaccagccuggccagcgccagccccgugcccgcccccacccccgugcuggcccccagcagcacccagaccaugcugcccgcccccgugcccagcccccugcccagccccgccagcacccagacccuggcccuggcccccgcccuggcccccacccugggcggcagcagccccagccagacccugagccugggcaccggcaacccccagggccccuuccccacccagacccugagccugacccccgccagcagccuggugcccacccccgcccagacccugagccuggcccccggccccccccugggccccacccagacccugagccuggcccccgcccccccccuggcccccgccagccccgugggccccgcccccgcccacacccugacccuggcccccgccagcagcagcgccagccugcuggcccccgccagcgugcagacccugacccugagccccgcccccgugcccacccugggccccgccgccgcccagacccuggcccuggcccccgccagcacccagagccccgccagccaggccagcagccugguggugagcgccagcggcgccgccccccugcccgugaccauggugagcagacugcccgugagcaaggacgagcccgacacccugacccugagaagcggcccccccagcccccccagcaccgccaccagcuucggcggccccagacccagaagacagcccccccccccccccagaagccccuucuaccuggacagccuggaggagaagagaaagagacagagaagcgagagacuggagagaaucuuccagcugagcgaggcccacggcgcccuggcccccguguacggcaccgaggugcuggacuucugcacccugccccagcccguggccagccccaucggccccagaagccccggccccagccaccccaccuucuggaccuacaccgaggccgcccacagagccgugcuguucccccagcagagacuggaccagcugagcgagaucaucgagagauucaucuucgugaugccccccguggaggcccccccccccagccugcacgccugccaccccccccccuggcuggcccccagacaggccgccuuccaggagcagcuggccagcgagcuguggcccagagccagaccccugcacagaaucgugugcaacaugagaacccaguuccccgaccugagacugauccaguacgacugcggcaagcugcagacccuggccgugcugcugagacagcugaaggccgagggccacagagugcugaucuucacccagaugaccagaaugcuggacgugcuggagcaguuccugaccuaccacggccaccuguaccugagacuggacggcagcaccagaguggagcagagacaggcccugauggagagauucaacgccgacaagagaaucuucugcuucauccugagcaccagaagcggcggcgugggcgugaaccugaccggcgccgacaccgugguguucuacgacagcgacuggaaccccaccauggacgcccaggcccaggacagaugccacagaaucggccagaccagagacgugcacaucuacagacugaucagcgagagaaccguggaggagaacauccugaagaaggccaaccagaagagaaugcugggcgacauggccaucgagggcggcaacuucaccaccgccuacuucaagcagcagaccaucagagagcuguucgacaugccccuggaggagcccagcagcagcagcgugcccagcgcccccgaggaggaggaggagaccguggccagcaagcagacccacauccuggagcaggcccugugcagagccgaggacgaggaggacaucagagccgccacccaggccaaggccgagcagguggccgagcuggccgaguucaacgagaacgacggcuuccccgccggcgagggcgaggaggccggcagacccggcgccgaggacgaggagaugagcagagccgagcaggagaucgccgcccugguggagcagcugacccccaucgagagauacgccaugaaguuccuggaggccagccuggaggaggugagcagagaggagcugaagcaggccgaggagcagguggaggccgccagaaaggaccuggaccaggccaaggaggagguguucagacugccccaggaggaggaggagggccccggcgccggcgacgagagcagcugcggcaccggcggcggcacccacagaagaagcaagaaggccaaggcccccgagagacccggcaccagagugagcgagagacugagaggcgccagagccgagacccagggcgccaaccacacccccgugaucagcgcccaccagaccagaagcaccaccaccccccccagaugcagccccgccagagagagagugcccagacccgcccccagacccagacccacccccgccagcgcccccgccgccauccccgcccuggugcccgugcccgugagcgcccccgugcccaucagcgcccccaaccccaucaccauccugcccgugcacauccugcccagcccccccccccccagccagaucccccccugcagcagccccgccugcacccccccccccgccugcacccccccccccgcccacacccccccccccgcccagaccugccuggugacccccagcagcccccugcugcugggcccccccagcgugcccaucagcgccagcgugaccaaccugccccugggccugagacccgaggccgagcugugcgcccaggcccuggccagccccgagagccuggagcuggccagcguggccagcagcgagaccagcagccugagccuggugccccccaaggaccugcugcccguggccguggagauccugcccgugagcgagaagaaccugagccugacccccagcgcccccagccugacccuggaggccggcagcauccccaacggccaggagcaggaggcccccgacagcgccgagggcaccacccugaccgugcugcccgagggcgaggagcugccccugugcgugagcgagagcaacggccuggagcugccccccagcgccgccagcgacgagccccugcaggagccccuggaggccgacagaaccagcgaggagcugaccgaggccaagacccccaccagcagccccgagaagccccaggagcuggugaccgccgagguggccgcccccagcaccagcagcagcgccaccagcagccccgagggccccagccccgccagaccccccagaagaagaaccagcgccgacguggagaucagaggccagggcaccggcagacccggccagccccccggccccaaggugcugagaaagcugcccggcagacuggugaccgugguggaggagaaggagcuggugagaagaagaagacagcagagaggcgccgccagcacccuggugcccggcgugagcgagaccagcgccagccccggcagccccagcgugagaagcaugagcggccccgagagcagcccccccaucggcggccccugcgaggccgcccccagcagcagccugcccacccccccccagcagcccuucaucgccagaagacacaucgagcugggcgugaccggcggcggcagccccgagaacggcgacggcgcccugcuggccaucaccccccccgccgugaagagaagaagaggcagaccccccaagaagaacagaagccccgccgacgccggcagaggcguggacgaggcccccagcagcacccugaagggcaagaccaacggcgccgaccccgugcccggccccgagacccugaucguggccgaccccgugcuggagccccagcugauccccggcccccagccccugggcccccagcccgugcacagacccaacccccugcugagccccguggagaagagaagaagaggcagaccccccaaggccagagaccugcccauccccggcaccaucagcagcgccggcgacggcaacagcgagagcagaacccagccccccccccaccccagcccccugaccccccugcccccccugcuggugugccccaccgccaccguggccaacaccgugaccaccgugaccaucagcaccagcccccccaagagaaagagaggcagaccccccaagaacccccccagccccagacccagccagcugcccgugcuggacagagacagcaccagcgugcuggagagcugcggccugggcagaagaagacagccccagggccagggcgagagcgagggcagcagcagcgacgaggacggcagcagaccccugaccagacuggccagacugagacuggaggccgagggcaugagaggcagaaagagcggcggcagcauggugguggccgugauccaggacgaccuggaccuggccgacagcggccccggcggccuggagcugaccccccccguggugagccugacccccaagcugagaagcaccagacugagacccggcagccuggugcccccccuggagaccgagaagcugcccagaaagagagccggcgcccccgugggcggcagccccggccuggccaagagaggcagacugcagccccccagcccccugggccccgagggcagcguggaggagagcgaggccgaggccagcggcgaggaggaggagggcgacggcacccccagaagaagacccggccccagaagacuggugggcaccaccaaccagggcgaccagagaauccugagaagcagcgccccccccagccuggccggccccgccgugagccacagaggcagaaaggccaagaccuaa

SEQ ID NO: 24012 - RNA, 1611 nt, Artificial Sequence
  SRC__Homo_sapiens__NP_005408
augggcagcaacaagagcaagcccaaggacgccagccagagaagaagaagccuggagcccgccgagaacgugcacggcgccggcggcggcgccuuccccgccagccagacccccagcaagcccgccagcgccgacggccacagaggccccagcgccgccuucgcccccgccgccgccgagcccaagcuguucggcggcuucaacagcagcgacaccgugaccagcccccagagagccggcccccuggccggcggcgugaccaccuucguggcccuguacgacuacgagagcagaaccgagaccgaccugagcuucaagaagggcgagagacugcagaucgugaacaacaccgagggcgacugguggcuggcccacagccugagcaccggccagaccggcuacauccccagcaacuacguggcccccagcgacagcauccaggccgaggagugguacuucggcaagaucaccagaagagagagcgagagacugcugcugaacgccgagaaccccagaggcaccuuccuggugagagagagcgagaccaccaagggcgccuacugccugagcgugagcgacuucgacaacgccaagggccugaacgugaagcacuacaagaucagaaagcuggacagcggcggcuucuacaucaccagcagaacccaguucaacagccugcagcagcugguggccuacuacagcaagcacgccgacggccugugccacagacugaccaccgugugccccaccagcaagccccagacccagggccuggccaaggacgccugggagauccccagagagagccugagacuggaggugaagcugggccagggcugcuucggcgagguguggaugggcaccuggaacggcaccaccagaguggccaucaagacccugaagcccggcaccaugagccccgaggccuuccugcaggaggcccaggugaugaagaagcugagacacgagaagcuggugcagcuguacgccguggugagcgaggagcccaucuacaucgugaccgaguacaugagcaagggcagccugcuggacuuccugaagggcgagaccggcaaguaccugagacugccccagcugguggacauggccgcccagaucgccagcggcauggccuacguggagagaaugaacuacgugcacagagaccugagagccgccaacauccuggugggcgagaaccuggugugcaagguggccgacuucggccuggccagacugaucgaggacaacgaguacaccgccagacagggcgccaaguuccccaucaaguggaccgcccccgaggccgcccuguacggcagauucaccaucaagagcgacguguggagcuucggcauccugcugaccgagcugaccaccaagggcagagugcccuaccccggcauggugaacagagaggugcuggaccagguggagagaggcuacagaaugcccugcccccccgagugccccgagagccugcacgaccugaugugccagugcuggagaaaggagcccgaggagagacccaccuucgaguaccugcaggccuuccuggaggacuacuucaccagcaccgagccccaguaccagcccggcgagaaccuguaa

SEQ ID NO: 24013 - RNA, 3552 nt, Artificial Sequence
  SRCIN1__Homo_sapiens__NP_079524
augggcaacgcccccagccaggaccccgagagaagcagcccccccaugcugagcgccgacgacgccgaguaccccagagaguacagaacccugggcggcggcggcggcggcggcagcggcggcagaagauucagcaacgugggccuggugcacaccagcgagagaagacacaccgugaucgccgcccagagccuggaggcccugagcggccugcagaaggccgacgccgacagaaagagagacgccuucauggaccaccugaagagcaaguacccccagcacgcccuggcccugagaggccagcaggacagaaugagagagcagcccaacuacuggagcuucaagaccagaagcagcagacacacccagggcgcccagcccggccuggccgaccaggccgccaagcugagcuacgccagcgccgagagccuggagaccaugagcgaggccgagcugccccugggcuucagcagaaugaacagauucagacagagccugccccugagcagaagcgccagccagaccaagcugagaagccccggcgugcuguuccugcaguucggcgaggagaccagaagagugcacaucacccacgaggugagcagccuggacacccugcacgcccugaucgcccacauguucccccagaagcugaccaugggcaugcugaagagccccaacaccgccauccugaucaaggacgaggccagaaacguguucuacgagcuggaggacgugagagacauccaggacagaagcaucaucaagaucuacagaaaggagccccuguacgccgccuuccccggcagccaccugaccaacggcgaccugagaagagagaugguguacgccagcagagagagcagccccaccagaagacugaacaaccugagccccgccccccaccuggccagcggcagccccccccccggccugcccagcggccugcccagcggccugcagagcggcagccccagcagaagcagacugagcuacgccggcggcagaccccccagcuacgccggcagccccgugcaccacgccgccgagagacugggcggcgcccccgccgcccagggcgugagccccagccccagcgccauccuggagagaagagacgugaagcccgacgaggaccuggccagcaaggccggcggcauggugcuggugaagggcgagggccuguacgccgaccccuacggccugcugcacgagggcagacugagccuggccgccgccgccggcgaccccuucgccuaccccggcgccggcggccuguacaagagaggcagcgugagaagccugagcaccuacagcgccgccgcccugcagagcgaccuggaggacagccuguacaaggccgccggcggcggcggcccccuguacggcgacggcuacggcuucagacugccccccagcagcccccagaagcuggccgacguggccgccccccccggcggccccccccccccccacagccccuacagcggcccccccagcagaggcagccccgugagacagagcuucagaaaggacagcggcagcagcagcguguucgccgagagccccggcggcaagaccagaagcgccggcagcgccagcaccgccggcgccccccccagcgagcuguuccccggccccggcgagagaagccuggugggcuucggcccccccgugcccgccaaggacaccgagaccagagagagaauggaggccauggagaagcagaucgccagccugaccggccuggugcagagcgcccugcugagaggcagcgagcccgagacccccagcgagaagaucgagggcagcaacggcgccgccacccccagcgcccccugcggcagcggcggcagaagcagcggcgccacccccgugagcggcccccccccccccagcgccagcagcacccccgccggccagcccaccgccgugagcagacugcagaugcagcugcaccugagaggccugcagaacagcgccagcgaccugagaggccagcugcagcagcugagaaagcugcagcugcagaaccaggagagcgugagagcccugcugaagagaaccgaggccgagcugagcaugagagugagcgaggccgccagaagacaggaggacccccugcagagacagagaacccugguggaggaggagagacugagauaccugaacgacgaggagcugaucacccagcagcugaacgaccuggagaagagcguggagaagauccagagagacgugagccacaaccacagacuggugcccggccccgagcuggaggagaaggcccuggugcugaagcagcugggcgagacccugaccgagcugaaggcccacuuccccggccugcagagcaagaugagaguggugcugagaguggagguggaggccgugaaguuccugaaggaggagccccagagacuggacggccugcugaagagaugcagaggcgugaccgacacccuggcccagaucagaagacagguggacgagggcguguggcccccccccaacaaccugcugagccagagccccaagaaggugaccgccgagaccgacuucaacaagagcguggacuucgagaugcccccccccagccccccccugaaccugcacgagcugagcggccccgccgagggcgccagccugacccccaagggcggcaaccccaccaagggccuggacacccccggcaagagaagcguggacaaggccgugagcguggaggccgccgagagagacugggaggagaagagagccgcccugacccaguacagcgccaaggacaucaacagacugcuggaggagacccaggccgagcugcugaaggccauccccgaccuggacugcgccagcaaggcccaccccggccccgcccccacccccgaccacaagccccccaaggccccccacggccagaaggccgcccccagaaccgagcccagcggcagaagaggcagcgacgagcugaccgugcccagauacagaaccgagaagcccagcaagagcccccccccccccccccccagaagaagcuuccccagcagccacggccugaccaccaccagaaccggcgaggugguggugaccagcaagaaggacagcgccuucaucaagaaggccgagagcgaggagcuggaggugcagaagccccaggugaagcugagaagagccgugagcgagguggccagacccgccagcaccccccccaucauggccagcgccaucaaggacgaggacgacgaggacagaaucaucgccgagcuggagagcggcggcggcagcgugccccccaugaagguggugacccccggcgccagcagacugaaggccgcccagggccaggccggcagccccgacaagagcaagcacggcaagcagagagccgaguacaugagaauccaggcccagcagcaggccaccaagcccagcaaggagaugagcggcagcaacgagaccagcagccccgugagcgagaagcccagcgccagcagaaccagcauccccgugcugaccagcuucggcgccagaaacagcagcaucagcuucuaa

SEQ ID NO: 24014 - RNA, 639 nt, Artificial Sequence
  SRD5A1__Homo_sapiens__XP_011512405
auggagcacgccgcccagcccuggagauggcagagaagaagaggcuggagaagaagcgccugcuggcccagaagccccaccugcagcgcccccugggccgccagaagcagcagagccaucgugagaagaacccagugcaccgccgccaccagaugccccgccaccggcagcgagugcagaagaggcccccccggcuggugcagaagcugccccagauggcccugcagaagcaccagcacccccgccagcccccccagagugagcgccgccagacccaccgccagcagcuggcccugcagcagcagcaccaccggcaucggcuucggccuguggcugaccggcaugcugaucaacauccacagcgaccacauccugagaaaccugagaaagcccggcgacaccggcuacaagauccccagaggcggccuguucgaguacgugaccgccgccaacuacuucggcgagaucauggaguggugcggcuacgcccuggccagcuggagcgugcagggcgccgccuucgccuucuucaccuucugcuuccugagcggcagagccaaggagcaccacgagugguaccugagaaaguucgaggaguaccccaaguucagaaagaucaucauccccuuccuguucuaa

SEQ ID NO: 24015 - RNA, 747 nt, Artificial Sequence
  SRD5A2__Homo_sapiens__XP_011531370
augcaggugcagugccagcagagccccgugcuggccggcagcgccacccugguggcccugggcgcccuggcccuguacguggccaagcccagcggcuacggcaagcacaccgagagccugaagcccgccgccaccagacugcccgccagagccgccugguuccugcaggagcugcccagcuucgccgugcccgccggcauccuggccagacagccccugagccuguucggcccccccggcaccgugcugcugggccuguucugccugcacuacuuccacagaaccuucguguacagccugcugaacagaggcagacccuaccccgccauccugauccugagaggcaccgccuucugcaccggcaacggcgugcugcagggcuacuaccugaucuacugcgccgaguaccccgacggcugguacaccgacaucagauucagccuggccugccugcccguggugcugcuguucaucaccagcuggcugcaggacguggacugcagcagcagacacuacaucuggcagagcagacaggaggagagaagaagcagaggcaccggccuggccugcaccuucuaccagaagagcaagagauuccccagaaagagccccaaccaggacuucacccugcaccugaucggcggcaccagcagcugcgacccccugagccagugcaaccugugcagcggcggcuggcagaagaagagaggcuggaaccagcugcugagauacgagaccagcaucuaa

SEQ ID NO: 24016 - RNA, 957 nt, Artificial Sequence
  SRD5A3__Homo_sapiens__NP_078868
auggcccccugggccgaggccgagcacagcgcccugaacccccugagagccguguggcugacccugaccgccgccuuccugcugacccugcugcugcagcugcugccccccggccugcugcccggcugcgccaucuuccaggaccugaucagauacggcaagaccaagugcggcgagcccagcagacccgccgccugcagagccuucgacgugcccaagagauacuucagccacuucuacaucaucagcgugcuguggaacggcuuccugcuguggugccugacccagagccuguuccugggcgcccccuuccccagcuggcugcacggccugcugagaauccugggcgccgcccaguuccagggcggcgagcuggcccugagcgccuuccuggugcugguguuccuguggcugcacagccugagaagacuguucgagugccuguacgugagcguguucagcaacgugaugauccacguggugcaguacugcuucggccugguguacuacgugcuggugggccugaccgugcugagccaggugcccauggacggcagaaacgccuacaucaccggcaagaaccugcugaugcaggccagaugguuccacauccugggcaugaugauguucaucuggagcagcgcccaccaguacaagugccacgugauccugggcaaccugagaaagaacaaggccggcguggugauccacugcaaccacagaauccccuucggcgacugguucgaguacgugagcagccccaacuaccuggccgagcugaugaucuacgugagcauggccgugaccuucggcuuccacaaccugaccugguggcugguggugaccaacguguucuucaaccaggcccugagcgccuuccugagccaccaguucuacaagagcaaguucgugagcuaccccaagcacagaaaggccuuccugcccuuccuguucuaa

SEQ ID NO: 24017 - RNA, 3534 nt, Artificial Sequence
  SREBF1__Homo_sapiens__NP_001005291
auggacgagccccccuucagcgaggccgcccuggagcaggcccugggcgagcccugcgaccuggacgccgcccugcugaccgacaucgagggcgaggugggcgccggcagaggcagagccaacggccuggacgcccccagagccggcgccgacagaggcgccauggacugcaccuucgaggacaugcugcagcugaucaacaaccaggacagcgacuuccccggccuguucgacccccccuacgccggcagcggcgccggcggcaccgaccccgccagccccgacaccagcagccccggcagccugagccccccccccgccacccugagcagcagccuggaggccuuccugagcggcccccaggccgcccccagcccccugagccccccccagcccgcccccaccccccugaagauguaccccagcaugcccgccuucagccccggccccggcaucaaggaggagagcgugccccugagcauccugcagacccccaccccccagccccugcccggcgcccugcugccccagagcuuccccgcccccgcccccccccaguucagcagcacccccgugcugggcuaccccagcccccccggcggcuucagcaccggcagcccccccggcaacacccagcagccccugcccggccugccccuggccagcccccccggcgugccccccgugagccugcacacccaggugcagagcguggugccccagcagcugcugaccgugaccgccgcccccaccgccgcccccgugaccaccaccgugaccagccagauccagcaggugcccgugcugcugcagccccacuucaucaaggccgacagccugcugcugaccgccaugaagaccgacggcgccaccgugaaggccgccggccugagcccccuggugagcggcaccaccgugcagaccggcccccugcccacccuggugagcggcggcaccauccuggccaccgugccccuggugguggacgccgagaagcugcccaucaacagacuggccgccggcagcaaggcccccgccagcgcccagagcagaggcgagaagagaaccgcccacaacgccaucgagaagagauacagaagcagcaucaacgacaagaucaucgagcugaaggaccugguggugggcaccgaggccaagcugaacaagagcgccgugcugagaaaggccaucgacuacaucagauuccugcagcacagcaaccagaagcugaagcaggagaaccugagccugagaaccgccgugcacaagagcaagagccugaaggaccuggugagcgccugcggcagcggcggcaacaccgacgugcugauggagggcgugaagaccgagguggaggacacccugacccccccccccagcgacgccggcagccccuuccagagcagcccccugagccugggcagcagaggcagcggcagcggcggcagcggcagcgacagcgagcccgacagccccguguucgaggacagcaaggccaagcccgagcagagacccagccugcacagcagaggcaugcuggacagaagcagacuggcccugugcacccugguguuccugugccugagcugcaacccccuggccagccugcugggcgccagaggccugcccagccccagcgacaccaccagcguguaccacagccccggcagaaacgugcugggcaccgagagcagagacggccccggcugggcccaguggcugcugccccccgugguguggcugcugaacggccugcuggugcuggugagccuggugcugcuguucguguacggcgagcccgugaccagaccccacagcggccccgccguguacuucuggagacacagaaagcaggccgaccuggaccuggccagaggcgacuucgcccaggccgcccagcagcuguggcuggcccugagagcccugggcagaccccugcccaccagccaccuggaccuggccugcagccugcuguggaaccugaucagacaccugcugcagagacugugggugggcagauggcuggccggcagagccggcggccugcagcaggacugcgcccugagaguggacgccagcgccagcgccagagacgccgcccugguguaccacaagcugcaccagcugcacaccaugggcaagcacaccggcggccaccugaccgccaccaaccuggcccugagcgcccugaaccuggccgagugcgccggcgacgccgugagcguggccacccuggccgagaucuacguggccgccgcccugagagugaagaccagccugcccagagcccugcacuuccugaccagauucuuccugagcagcgccagacaggccugccuggcccagagcggcagcgugccccccgccaugcaguggcugugccaccccgugggccacagauucuucguggacggcgacuggagcgugcugagcacccccugggagagccuguacagccuggccggcaaccccguggacccccuggcccaggugacccagcuguucagagagcaccugcuggagagagcccugaacugcgugacccagcccaaccccagccccggcagcgccgacggcgacaaggaguucagcgacgcccugggcuaccugcagcugcugaacagcugcagcgacgccgccggcgcccccgccuacagcuucagcaucagcagcagcauggccaccaccaccggcguggaccccguggccaaguggugggccagccugaccgccguggugauccacuggcugagaagagacgaggaggccgccgagagacugugcccccugguggagcaccugcccagagugcugcaggagagcgagagaccccugcccagagccgcccugcacagcuucaaggccgccagagcccugcugggcugcgccaaggccgagagcggccccgccagccugaccaucugcgagaaggccagcggcuaccugcaggacagccuggccaccacccccgccagcagcagcaucgacaaggccgugcagcuguuccugugcgaccugcugcugguggugagaaccagccuguggagacagcagcagccccccgcccccgcccccgccgcccagggcaccagcagcagaccccaggccagcgcccuggagcugagaggcuuccagagagaccugagcagccugagaagacuggcccagagcuucagacccgccaugagaagaguguuccugcacgaggccaccgccagacugauggccggcgccagccccaccagaacccaccagcugcuggacagaagccugagaagaagagccggccccggcggcaagggcggcgccguggccgagcuggagcccagacccaccagaagagagcacgccgaggcccugcugcuggccagcugcuaccugccccccggcuuccugagcgcccccggccagagagugggcaugcuggccgaggccgccagaacccuggagaagcugggcgacagaagacugcugcacgacugccagcagaugcugaugagacugggcggcggcaccaccgugaccagcagcuaa

SEQ ID NO: 24018 - RNA, 3426 nt, Artificial Sequence
  SREBF2__Homo_sapiens__NP_004590
auggacgacagcggcgagcugggcggccuggagaccauggagacccugaccgagcugggcgacgagcugacccugggcgacaucgacgagaugcugcaguucgugagcaaccaggugggcgaguuccccgaccuguucagcgagcagcugugcagcagcuuccccggcagcggcggcagcggcagcagcagcggcagcagcggcagcagcagcagcagcagcaacggcagaggcagcagcagcggcgccguggaccccagcgugcagagaagcuucacccaggugacccugcccagcuucagccccagcgccgccagcccccaggcccccacccugcaggugaaggugagccccaccagcgugcccaccacccccagagccacccccauccugcagcccagaccccagccccagccccagccccagacccagcugcagcagcagaccgugaugaucacccccaccuucagcaccaccccccagaccagaaucauccagcagccccugaucuaccagaacgccgccaccagcuuccaggugcugcagccccaggugcagagccuggugaccagcagccaggugcagcccgugaccauccagcagcaggugcagaccgugcaggcccagagagugcugacccagaccgccaacggcacccugcagacccuggcccccgccaccgugcagaccguggccgccccccaggugcagcaggugcccgugcuggugcagccccagaucaucaagaccgacagccuggugcugaccacccugaagaccgacggcagccccgugauggccgccgugcagaaccccgcccugaccgcccugaccacccccauccagaccgccgcccugcaggugcccacccuggugggcagcagcggcaccauccugaccaccaugcccgugaugaugggccaggagaaggugcccaucaagcaggugcccggcggcgugaagcagcuggagccccccaaggagggcgagagaagaaccacccacaacaucaucgagaagagauacagaagcagcaucaacgacaagaucaucgagcugaaggaccuggugaugggcaccgacgccaagaugcacaagagcggcgugcugagaaaggccaucgacuacaucaaguaccugcagcaggugaaccacaagcugagacaggagaacauggugcugaagcuggccaaccagaagaacaagcugcugaagggcaucgaccugggcagccugguggacaacgagguggaccugaagaucgaggacuucaaccagaacgugcugcugaugagcccccccgccagcgacagcggcagccaggccggcuucagccccuacagcaucgacagcgagcccggcagcccccugcuggacgacgccaaggugaaggacgagcccgacagcccccccguggcccugggcaugguggacagaagcagaauccugcugugcgugcugaccuuccugugccugagcuucaacccccugaccagccugcugcaguggggcggcgcccacgacagcgaccagcacccccacagcggcagcggcagaagcgugcugagcuucgagagcggcagcggcggcugguucgacuggaugaugcccacccugcugcuguggcuggugaacggcgugaucgugcugagcguguucgugaagcugcuggugcacggcgagcccgugaucagaccccacagcagaagcagcgugaccuucuggagacacagaaagcaggccgaccuggaccuggccagaggcgacuucgccgccgccgccggcaaccugcagaccugccuggccgugcugggcagagcccugcccaccagcagacuggaccuggccugcagccugagcuggaacgugaucagauacagccugcagaagcugagacuggugagauggcugcugaagaagguguuccagugcagaagagccacccccgccaccgaggccggcuucgaggacgaggccaagaccagcgccagagacgccgcccuggccuaccacagacugcaccagcugcacaucaccggcaagcugcccgccggcagcgccugcagcgacgugcacauggcccugugcgccgugaaccuggccgagugcgccgaggagaagaucccccccagcacccugguggagauccaccugaccgccgccaugggccugaagaccagaugcggcggcaagcugggcuuccuggccagcuacuuccugagcagagcccagagccugugcggccccgagcacagcgccgugcccgacagccugagauggcugugccacccccugggccagaaguucuucauggagagaagcuggagcgugaagagcgccgccaaggagagccuguacugcgcccagagaaaccccgccgaccccaucgcccaggugcaccaggccuucugcaagaaccugcuggagagagccaucgagagccuggugaagccccaggccaagaagaaggccggcgaccaggaggaggagagcugcgaguucagcagcgcccuggaguaccugaagcugcugcacagcuucguggacagcgugggcgugaugagccccccccugagcagaagcagcgugcugaagagcgcccugggccccgacaucaucugcagaugguggaccagcgccaucaccguggccaucagcuggcugcagggcgacgacgccgccgugagaagccacuucaccaagguggagagaauccccaaggcccuggaggugaccgagagcccccuggugaaggccaucuuccacgccugcagagccaugcacgccagccugcccggcaaggccgacggccagcagagcagcuucugccacugcgagagagccagcggccaccuguggagcagccugaacgugagcggcgccaccagcgaccccgcccugaaccacguggugcagcugcugaccugcgaccugcugcugagccugagaaccgcccuguggcagaagcaggccagcgccagccaggccgugggcgagaccuaccacgccagcggcgccgagcuggccggcuuccagagagaccugggcagccugagaagacuggcccacagcuucagacccgccuacagaaagguguuccugcacgaggccaccgugagacugauggccggcgccagccccaccagaacccaccagcugcuggagcacagccugagaagaagaaccacccagagcaccaagcacggcgagguggacgccuggcccggccagagagagagagccaccgccauccugcuggccugcagacaccugccccugagcuuccugagcagccccggccagagagccgugcugcuggccgaggccgccagaacccuggagaaggugggcgacagaagaagcugcaacgacugccagcagaugaucgugaagcugggcggcggcaccgccaucgccgccagcuaa

SEQ ID NO: 24019 - RNA, 1875 nt, Artificial Sequence
  SREK1__Homo_sapiens__NP_001070667
augaacagcggcggcggcuucggccugggccugggcuucggccugacccccaccagcgugauccaggugaccaaccugagcagcgccgugaccagcgagcagaugagaacccuguucagcuuccugggcgagaucgaggagcugagacuguacccccccgacaacgccccccuggccuucagcagcaaggugugcuacgugaaguucagagaccccagcagcgugggcguggcccagcaccugaccaacaccguguucaucgacagagcccugaucguggugcccugcgccgagggcaagauccccgaggagagcaaggcccugagccugcuggcccccgcccccaccaugaccagccugaugcccggcgccggccugcugcccauccccacccccaacccccugaccacccugggcgugagccugagcagccugggcgccauccccgccgccgcccuggaccccaacaucgccacccugggcgagaucccccagcccccccugaugggcaacguggaccccagcaagaucgacgagaucagaagaaccguguacgugggcaaccugaacagccagaccaccaccgccgaccagcugcuggaguucuucaagcaggugggcgaggugaaguucgugagaauggccggcgacgagacccagcccaccagauucgccuucguggaguucgccgaccagaacagcgugcccagagcccuggccuucaacggcgugauguucggcgacagaccccugaagaucaaccacagcaacaacgccaucgugaagccccccgagaugaccccccaggccgccgccaaggagcuggaggaggugaugaagagagugagagaggcccagagcuucaucagcgccgccaucgagcccgagagcggcaagagcaacgagagaaagggcggcagaagcagaagccacaccagaagcaagagcagaagcagcagcaagagccacagcagaagaaagagaagccagagcaagcacagaagcagaagccacaacagaagcagaagcagacagaaggacagaagaagaagcaagagcccccacaagaagagaagcaagagcagagagagaagaaagagcagaagcagaagccacagcagagacaagagaaaggacaccagagagaagaucaaggagaaggagagagugaaggagaaggacagagagaaggagagagagagagagaaggagagagagaaggagaaggagagaggcaagaacaaggacagagacaaggagagagagaaggacagagagaaggacaaggagaaggacagagagagagagagagagaaggagcacgagaaggacagagacaaggagaaggagaaggagcaggacaaggagaaggagagagagaaggacagaagcaaggagaucgacgagaagagaaagaaggacaagaagagcagaaccccccccagaagcuacaacgccagcagaagaagcagaagcagcagcagagagagaagaagaagaagaagcagaagcagcagcagaagccccagaaccagcaagaccaucaagagaaagagcagcagaagccccagccccagaagcagaaacaagaaggacaagaagagagagaaggagagagaccacaucagcgagagaagagagagagagagaagcaccagcaugagaaagagcagcaacgacagagacggcaaggagaagcuggagaagaacagcaccagccugaaggagaaggagcacaacaaggagcccgacagcagcgugagcaaggagguggacgacaaggacgcccccagaaccgaggagaacaagauccagcacaacggcaacugccagcugaacgaggagaaccugagcaccaagaccgaggccguguaa

SEQ ID NO: 24020 - RNA, 468 nt, Artificial Sequence
  SREK1IP1__Homo_sapiens__NP_776190
auggccgugcccggcugcaacaaggacagcgugagagccggcugcaagaagugcggcuaccccggccaccugaccuucgagugcagaaacuuccugagaguggaccccaagagagacaucgugcuggacgugagcagcaccagcagcgaggacagcgacgaggagaacgaggagcugaacaagcugcaggcccugcaggagaagagaaucaacgaggaggaggagaagaagaaggagaagagcaaggagaagaucaagcugaagaagaagagaaagagaagcuacagcagcagcagcaccgaggaggacaccagcaagcagaagaagcagaaguaccagaagaaggagaagaagaaggagaagaagagcaagagcaagaagggcaagcaccacaagaaggagaagaagaagagaaagaaggagaagcacagcagcacccccaacagcagcgaguucagcagaaaguaa

SEQ ID NO: 24021 - RNA, 1290 nt, Artificial Sequence
  SRFBP1__Homo_sapiens__NP_689759
auggcccagcccggcacccugaaccugaacaacgagguggugaagaugagaaaggaggugaagagaaucagagugcuggugaucagaaagcuggugagaagcgugggcagacugaagagcaagaagggcaccgaggacgcccugcugaagaaccagagaagagcccagagacugcuggaggagauccacgccaugaaggagcugaagcccgacaucgugaccaagagcgcccugggcgacgacaucaacuucgagaagaucuucaagaagcccgacagcaccgccaccgagagagccaucgccagacuggccgugcacccccugcugaagaagaagaucgacgugcugaaggccgccgugcaggccuucaaggaggccagacagaacguggccgagguggagagcagcaagaacgccagcgaggacaaccacagcgagaacacccuguacagcaacgacaacggcagcaaccugcagagagaggccaccgugaucagcgagcagaaggugaaggagaccaagauccuggccaagaagcccauccacaacagcaaggagaagaucgccaagauggagcacggccccaaggccgugaccaucgccaacagccccagcaagcccagcgagaaggacagcguggugagccuggagagccagaagacccccgccgaccccaagcugaagacccugagccagaccaagaagaacaagggcagcgacagcagccugagcggcaacagcgacggcggcgaggaguucugcgaggaggagaaggaguacuucgacgacagcaccgaggagagauucuacaagcagagcagcaugagcgaggacagcgacagcggcgacgacuucuucaucggcaaggugagaagaaccagaaagaaggagagcagcugccacagcagcgugaaggagcagaagccccuggagaagguguuccugaaggaggacaccggcgagacccacggcgacaccagaaacgacaagaucaagcccagcaccgagaccagaaagcuggagagcguguucuuccacagccugagcggcagcaagagcagcagaagaaacuucaaggagcaggcccccaagaccagaagccuggacuucccccagaacgagccccagaucaagaaccaguucaacaagaagcugagcggcagacuggagaacaccaagcagcagcugcagcugccccugcaccccagcugggaggccagcagaagaagaaaggagcagcagagcaacaucgccguguuccagggcaagaagaucaccuucgacgacuaa

SEQ ID NO: 24022 - RNA, 915 nt, Artificial Sequence
  SRF__Homo_sapiens__NP_001278930
augaucaccagcgagaccggcaaggcccugauccagaccugccugaacagccccgacagcccccccagaagcgaccccaccaccgaccagagaaugagcgccaccggcuucgaggagaccgaccugaccuaccaggugagcgagagcgacagcagcggcgagaccaaggacacccugaagcccgccuucaccgugaccaaccugcccggcaccaccagcaccauccagaccgcccccagcaccagcaccaccaugcaggugagcagcggccccagcuuccccaucaccaacuaccuggcccccgugagcgccagcgugagccccagcgccgugagcagcgccaacggcaccgugcugaagagcaccggcagcggccccgugagcagcggcggccugaugcagcugcccaccagcuucacccugaugcccggcggcgccguggcccagcaggugcccgugcaggccauccaggugcaccaggccccccagcaggccagccccagcagagacagcagcaccgaccugacccagaccagcagcagcggcaccgugacccugcccgccaccaucaugaccagcagcgugcccaccaccgugggcggccacaugauguaccccagcccccacgccgugauguacgcccccaccagcggccugggcgacggcagccugaccgugcugaacgccuucagccaggcccccagcaccaugcaggugagccacagccaggugcaggagcccggcggcgugccccagguguuccugaccgccagcagcggcaccgugcagauccccgugagcgccgugcagcugcaccagauggccgugaucggccagcaggccggcagcagcagcaaccugaccgagcugcagguggugaaccuggacaccgcccacagcaccaagagcgaguaa

SEQ ID NO: 24023 - RNA, 3258 nt, Artificial Sequence
  SRGAP1__Homo_sapiens__NP_065813
augagcacccccagcagauucaagaaggacaaggagaucaucgccgaguacgagagccaggugaaggagaucagagcccagcugguggagcagcagaagugccuggagcagcagaccgagaugagagugcagcugcugcaggaccugcaggacuucuucagaaagaaggccgagaucgagaccgaguacagcagaaaccuggagaagcuggccgagagauucauggccaagaccagaagcaccaaggaccaccagcaguacaagaaggaccagaaccugcugagccccgugaacugcugguaccugcugcugaaccaggugagaagagagagcaaggaccacgccacccugagcgacaucuaccugaacaacgugaucaugagauucaugcagaucagcgaggacagcaccagaauguucaagaagagcaaggagaucgccuuccagcugcacgaggaccugaugaaggugcugaacgagcuguacaccgugaugaagaccuaccacauguaccacgccgagagcaucagcgccgagagcaagcugaaggaggccgagaagcaggaggagaagcagaucggcagaagcggcgaccccguguuccacaucagacuggaggagagacaccagagaagaagcagcgugaagaagaucgagaagaugaaggagaagagacaggccaaguacagcgagaacaagcugaagagcaucaaggccagaaacgaguaccugcugacccuggaggccaccaacgccagcguguucaaguacuacauccacgaccugagcgaccugaucgacugcugcgaccugggcuaccacgccagccugaacagagcccugagaaccuaccugagcgccgaguacaaccuggagaccagcagacacgagggccuggacaucaucgagaacgccguggacaaccuggagcccagaagcgacaagcagagauucauggagauguaccccgccgccuucugcccccccaugaaguucgaguuccagagccacaugggcgacgaggugugccaggugagcgcccagcagcccgugcaggccgagcugaugcugagauaccagcagcugcagagcagacuggccacccugaagaucgagaacgaggaggugaagaagaccaccgaggccacccugcagaccauccaggacauggugaccaucgaggacuacgacgugagcgagugcuuccagcacagcagaagcaccgagagcgugaagagcaccgugagcgagaccuaccugagcaagcccagcaucgccaagagaagagccaaccagcaggagaccgagcaguucuacuucaugaagcugagagaguaccuggagggcagcaaccugaucaccaagcugcaggccaagcacgaccugcugcagagaacccugggcgagggccacagagccgaguacaugaccaccagaccccccaacgugccccccaagccccagaagcacagaaagagcagacccagaagccaguacaacaccaagcuguucaacggcgaccuggagaccuucgugaaggacagcggccaggugaucccccugaucguggagagcugcaucagauucaucaaccuguacggccugcagcaccagggcaucuucagagugagcggcagccagguggaggugaacgacaucaagaacagcuucgagagaggcgagaacccccuggccgacgaccagagcaaccacgacaucaacagcguggccggcgugcugaagcuguacuucagaggccuggagaacccccuguuccccaaggagagauucaacgaccugaucagcugcaucagaaucgacaaccuguacgagagagcccugcacaucagaaagcugcugcugacccugcccagaagcgugcugaucgugaugagauaccuguucgccuuccugaaccaccugagccaguacagcgacgagaacaugauggaccccuacaaccuggccaucugcuucggccccacccugaugcccgugcccgagauccaggaccaggugagcugccaggcccacgugaacgagaucaucaagaccaucaucauccaccacgagaccaucuuccccgacgccaaggagcuggacggccccguguacgagaagugcauggccggcgacgacuacugcgacagccccuacagcgagcacggcacccuggaggagguggaccaggacgccggcaccgagccccacaccagcgaggacgagugcgagcccaucgaggccaucgccaaguucgacuacgugggcagaagcgccagagagcugagcuucaagaagggcgccagccugcugcuguaccacagagccagcgaggacuggugggagggcagacacaacggcaucgacggccuggugccccaccaguacaucguggugcaggacauggacgacaccuucagcgacacccugagccagaaggccgacagcgaggccagcagcggccccgugaccgaggacaagagcagcagcaaggacaugaacagccccaccgacagacaccccgacggcuaccuggccagacagagaaagagaggcgagccccccccccccgugagaagacccggcagaaccagcgacggccacugcccccugcaccccccccacgcccugagcaacagcagcguggaccugggcagccccagccuggccagccaccccagaggccugcugcagaacagaggccugaacaacgacagccccgagagaagaagaagacccggccacggcagccugaccaacaucagcagacacgacagccugaagaagaucgacagcccccccaucagaagaagcaccagcagcggccaguacaccggcuucaacgaccacaagccccuggaccccgagaccaucgcccaggacaucgaggagaccaugaacaccgcccugaacgagcugagagagcuggagagacagagcaccgccaagcacgcccccgacguggugcuggacacccuggagcaggugaagaacagccccacccccgccaccagcaccgagagccugagcccccugcacaacguggcccugagaagcagcgagccccagaucagaagaagcaccagcagcagcagcgacaccaugagcaccuucaagcccaugguggcccccagaaugggcgugcagcugaagccccccgcccugagacccaagcccgccgugcugcccaagaccaaccccaccaucggccccgccccccccccccagggccccaccgacaagagcugcaccauguaa

SEQ ID NO: 24024 - RNA, 2370 nt, Artificial Sequence
  SRGAP2__Homo_sapiens__NP_001287881
augaccagccccgccaaguucaagaaggacaaggagaucaucgccgaguacgacacccaggugaaggagaucagagcccagcugaccgagcagaugaagugccuggaccagcagugcgagcugagagugcagcugcugcaggaccugcaggacuucuucagaaagaaggccgagaucgagauggacuacagcagaaaccuggagaagcuggccgagagauuccuggccaagaccagaagcaccaaggaccagcaguucaagaaggaccagaacgugcugagccccgugaacugcuggaaccugcugcugaaccaggugaagagagagagcagagaccacaccacccugagcgacaucuaccugaacaacaucauccccagauucgugcaggugagcgaggacagcggcagacuguucaagaagagcaaggaggugggccagcagcugcaggacgaccugaugaaggugcugaacgagcuguacagcgugaugaagaccuaccacauguacaacgccgacagcaucagcgcccagagcaagcugaaggaggccgagaagcaggaggagaagcagaucggcaagagcgugaagcaggaggacagacagacccccagaagccccgacagcaccgccaacgugagaaucgaggagaagcacgugagaagaagcagcgugaagaagaucgagaagaugaaggagaagagacaggccaaguacaccgagaacaagcugaaggccaucaaggccagaaacgaguaccugcuggcccuggaggccaccaacgccagcguguucaaguacuacauccacgaccugagcgaccugaucgacugcugcgaccugggcuaccacgccagccugaacagagcccugagaaccuuccugagcgccgagcugaaccuggagcagagcaagcacgagggccuggacgccaucgagaacgccguggagaaccuggacgccaccagcgacaagcagagacugauggagauguacaacaacguguucugcccccccaugaaguucgaguuccagccccacaugggcgacauggccagccagcugugcgcccagcagcccgugcagagcgagcuggugcagagaugccagcagcugcagagcagacugagcacccugaagaucgagaacgaggaggugaagaagaccauggaggccacccugcagaccauccaggacaucgugaccguggaggacuucgacgugagcgacugcuuccaguacagcaacagcauggagagcgugaagagcaccgugagcgagaccuucaugagcaagcccagcaucgccaagagaagagccaaccagcaggagaccgagcaguucuacuucaccaagaugaaggaguaccuggagggcagaaaccugaucaccaagcugcaggccaagcacgaccugcugcagaagacccugggcgagagccagagaaccgacugcagccuggccagaagaagcagcaccgugagaaagcaggacagcagccaggccaucccccuggugguggagagcugcaucagauucaucagcagacacggccugcagcacgagggcaucuucagagugagcggcagccagguggaggugaacgacaucaagaacgccuucgagagaggcgaggacccccuggccggcgaccagaacgaccacgacauggacagcaucgccggcgugcugaagcuguacuucagaggccuggagcacccccuguuccccaaggacaucuuccacgaccugauggccugcgugaccauggacaaccugcaggagagagcccugcacaucagaaaggugcugcuggugcugcccaagaccacccugaucaucaugagauaccuguucgccuuccugaaccaccugagccaguucagcgaggagaacaugauggaccccuacaaccuggccaucugcuucggccccagccugaugagcgugcccgagggccacgaccaggugagcugccaggcccacgugaacgagcugaucaagaccaucaucauccagcacgagaacaucuuccccagccccagagagcuggagggccccguguacagcagaggcggcagcauggaggacuacugcgacagcccccacggcgagaccaccagcguggaggacagcacccaggacgugaccgccgagcaccacaccagcgacgacgagugcgagcccaucgaggccaucgccaaguucgacuacgugggcagaaccgccagagagcugagcuucaagaagggcgccagccugcugcuguaccagagagccagcgacgacuggugggagggcagacacaacggcaucgacggccugaucccccaccaguacaucguggugcaggacacccugaucagcuaa

SEQ ID NO: 24025 - RNA, 3228 nt, Artificial Sequence
  SRGAP3__Homo_sapiens__NP_001028289
augagcagccagaccaaguucaagaaggacaaggagaucaucgccgaguacgaggcccagaucaaggagaucagaacccagcugguggagcaguucaagugccuggagcagcagagcgagagcagacugcagcugcugcaggaccugcaggaguucuucagaagaaaggccgagaucgagcuggaguacagcagaagccuggagaagcuggccgagagauucagcagcaagaucagaagcagcagagagcaccaguucaagaaggaccaguaccugcugagccccgugaacugcugguaccuggugcugcaccagaccagaagagagagcagagaccacgccacccugaacgacaucuucaugaacaacgugaucgugagacugagccagaucagcgaggacgugaucagacuguucaagaagagcaaggagaucggccugcagaugcacgaggagcugcugaaggugaccaacgagcuguacaccgugaugaagaccuaccacauguaccacgccgagagcaucagcgccgagagcaagcugaaggaggccgagaagcaggaggagaagcaguucaacaagagcggcgaccugagcaugaaccugcugagacacgaggacagaccccagagaagaagcagcgugaagaagaucgagaagaugaaggagaagagacaggccaaguacagcgagaacaagcugaagugcaccaaggccagaaacgacuaccugcugaaccuggccgccaccaacgccgccaucagcaaguacuacauccacgacgugagcgaccugaucgacugcugcgaccugggcuuccacgccagccuggccagaaccuucagaaccuaccugagcgccgaguacaaccuggagaccagcagacacgagggccuggacgugaucgagaacgccguggacaaccuggacagcagaagcgacaagcacaccgugauggacaugugcaaccagguguucugccccccccugaaguucgaguuccagccccacaugggcgacgaggugugccaggugagcgcccagcagcccgugcagaccgagcugcugaugagauaccaccagcugcagagcagacuggccacccugaagaucgagaacgaggaggugagaaagacccuggacgccaccaugcagacccugcaggacaugcugaccguggaggacuucgacgugagcgacgccuuccagcacagcagaagcaccgagagcgugaagagcgccgccagcgagaccuacaugagcaagaucaacaucgccaagagaagagccaaccagcaggagaccgagauguucuacuucaccaaguucaaggaguacgugaacggcagcaaccugaucaccaagcugcaggccaagcacgaccugcugaagcagacccugggcgagggcgagagagccgagugcggcaccaccagaggcagaagaaacgccagaaccagaaaccaggacagcggccaggccaucccccuggugguggagagcugcaucagauacaucaaccuguacggccugcagcagcagggcaucuucagagugcccggcagccagguggaggugaacgacaucaagaacagcuucgagagaggcgaggacccccugguggacgaccagaacgagagagacaucaacagcguggccggcgugcugaagcuguacuucagaggccuggagaacccccuguuccccaaggagagauuccaggaccugaucagcaccaucaagcuggagaaccccgccgagagagugcaccagauccagcagauccuggugacccugcccagaguggugaucguggugaugagauaccuguucgccuuccugaaccaccugagccaguacagcgacgagaacaugauggaccccuacaaccuggccaucugcuucggccccacccugaugcacauccccgacggccaggaccccgugagcugccaggcccacaucaacgaggugaucaagaccaucaucauccaccacgaggccaucuuccccagccccagagagcuggagggccccguguacgagaagugcauggccggcggcgaggaguacugcgacagcccccacagcgagcccggcgccaucgacgagguggaccacgacaacggcaccgagccccacaccagcgacgaggagguggagcagaucgaggccaucgccaaguucgacuacaugggcagaagccccagagagcugagcuucaagaagggcgccagccugcugcuguaccacagagccagcgaggacuggugggagggcagacacaacggcguggacggccugaucccccaccaguacaucguggugcaggacauggacgacgccuucagcgacagccugagccagaaggccgacagcgaggccagcagcggcccccugcuggacgacaaggccagcagcaagaacgaccugcagagccccaccgagcacaucagcgacuacggcuucggcggcgugaugggcagagugagacugagaagcgacggcgccgccauccccagaagaagaagcggcggcgacacccacagcccccccagaggccugggccccagcaucgacaccccccccagagccgccgccugccccagcagcccccacaagaucccccugaccagaggcagaaucgagagccccgagaagagaagaauggccaccuucggcagcgccggcagcaucaacuaccccgacaagaaggcccugagcgagggccacagcaugagaagcaccugcggcagcaccagacacagcagccugggcgaccacaagagccuggaggccgaggcccuggccgaggacaucgagaagaccaugagcaccgcccugcacgagcugagagagcuggagagacagaacaccgugaagcaggcccccgacguggugcuggacacccuggagccccugaagaacccccccggccccgugagcagcgagcccgccagcccccugcacaccaucgugaucagagaccccgacgccgccaugagaagaagcagcagcagcagcaccgagaugaugaccaccuucaagcccgcccugagcgccagacuggccggcgcccagcugagacccccccccaugagacccgugagacccguggugcagcacagaagcagcagcagcagcagcagcggcgugggcagccccgccgugacccccaccgagaagauguuccccaacagcagcgccgacaagagcggcaccauguaa

SEQ ID NO: 24026 - RNA, 477 nt, Artificial Sequence
  SRGN__Homo_sapiens__NP_002718
augaugcagaagcugcugaagugcagcagacuggugcuggcccuggcccugauccuggugcuggagagcagcgugcagggcuaccccaccagaagagccagauaccagugggugagaugcaaccccgacagcaacagcgccaacugccuggaggagaagggccccauguucgagcugcugcccggcgagagcaacaagauccccagacugagaaccgaccuguuccccaagaccagaauccaggaccugaacagaaucuucccccugagcgaggacuacagcggcagcggcuucggcagcggcagcggcagcggcagcggcagcggcagcggcuuccugaccgagauggagcaggacuaccagcugguggacgagagcgacgccuuccacgacaaccugagaagccuggacagaaaccugcccagcgacagccaggaccugggccagcacggccuggaggaggacuucaugcuguaa

SEQ ID NO: 24027 - RNA, 543 nt, Artificial Sequence
  SRI__Homo_sapiens__NP_001243821
augcaguacggcggcgcccccggcggccccgccuuccccggccagacccaggacccccuguacggcuacuucgccgccguggccggccaggacggccagaucgacgccgacgagcugcagagaugccugacccagagcggcaucgccggcggcuacaagcccuucaaccuggagaccugcagacugauggugagcaugcuggacagagacaugagcggcaccaugggcuucaacgaguucaaggagcugugggccgugcugaacggcuggagacagcacuucaucagcuucgacaccgacagaagcggcaccguggacccccaggagcugcagaaggcccugaccaccaugggcuucagacugagcccccaggccgugaacagcaucgccaagagauacagcaccaacggcaagaucaccuucgacgacuacaucgccugcugcgugaagcugagagcccugaccgacagcuucagaagaagagacaccgcccagcagggcguggugaacuuccccuacgacgacgugagccugagaaacuaa

SEQ ID NO: 24028 - RNA, 1422 nt, Artificial Sequence
  SRL__Homo_sapiens__NP_001092284
augagagcccuggugcugcugggcugccugcuggccagccugcuguucagcggccaggccgaggagaccgaggacgccaacgaggaggccccccugagagacagaagccacaucgagaagacccugaugcugaacgaggacaagcccagcgacgacuacagcgccgugcugcagagacugagaaagaucuaccacagcagcaucaagccccuggagcagagcuacaaguacaacgagcugagacagcacgagaucaccgacggcgagaucaccagcaagcccauggugcuguuccugggccccuggagcgugggcaagagcaccaugaucaacuaccugcugggccuggagaacaccagauaccagcuguacaccggcgccgagcccaccaccagcgaguucaccgugcugaugcacggccccaagcugaagaccaucgagggcaucgugauggccgccgacagcgccagaagcuucagcccccuggagaaguucggccagaacuuccuggagaagcugaucggcaucgaggugccccacaagcugcuggagagagugaccuucguggacacccccggcaucaucgagaacagaaagcagcaggagagaggcuaccccuucaacgacgugugccagugguucaucgacagagccgaccugaucuucgugguguucgaccccaccaagcuggacgugggccuggagcuggagaugcuguucagacagcugaagggcagagagagccagaucagaaucauccugaacaaggccgacaaccuggccacccagaugcugaugagaguguacggcgcccuguucuggagccuggccccccugaucaacgugaccgagccccccagaguguacgugagcagcuucuggccccaggaguacaagcccgacacccaccaggagcuguuccugcaggaggagaucagccugcuggaggaccugaaccaggugaucgagaacagacuggagaacaagaucgccuucaucagacagcacgccaucagagugagaauccacgcccugcugguggacagauaccugcagaccuacaaggacaagaugaccuucuucagcgacggcgagcugguguucaaggacaucguggaggaccccgacaaguucuacaucuucaagaccauccuggccaagaccaacgugagcaaguucgaccugcccaacagagaggccuacaaggacuucuucggcaucaaccccaucagcagcuucaagcugcugagccagcagugcagcuacaugggcggcugcuuccuggagaagaucgagagagccaucacccaggagcugcccggccugcugggcagccugggccugggcaagaaccccggcgcccugaacugcgacaagaccggcugcagcgagacccccaagaacagauacagaaagcacuaa

SEQ ID NO: 24029 - RNA, 1467 nt, Artificial Sequence
  SRMS__Homo_sapiens__NP_543013
auggagcccuuccugagaagaagacuggccuuccugagcuucuucugggacaagaucuggcccgccggcggcgagcccgaccacggcacccccggcagccuggaccccaacaccgaccccgugcccacccugcccgccgagcccugcagccccuucccccagcuguuccuggcccuguacgacuucaccgccagaugcggcggcgagcugagcgugagaagaggcgacagacugugcgcccuggaggagggcggcggcuacaucuucgccagaagacugagcggccagcccagcgccggccuggugcccaucacccacguggccaaggccagccccgagacccugagcgaccagcccugguacuucagcggcgugagcagaacccaggcccagcagcugcugcugagcccccccaacgagcccggcgccuuccugaucagacccagcgagagcagccugggcggcuacagccugagcgugagagcccaggccaaggugugccacuacagagugagcauggccgccgacggcagccuguaccugcagaagggcagacuguuccccggccuggaggagcugcugaccuacuacaaggccaacuggaagcugauccagaacccccugcugcagcccugcaugccccagaaggcccccagacaggacgugugggagagaccccacagcgaguucgcccugggcagaaagcugggcgagggcuacuucggcgaggugugggagggccuguggcugggcagccugcccguggccaucaaggugaucaagagcgccaacaugaagcugaccgaccuggccaaggagauccagacccugaagggccugagacacgagagacugaucagacugcacgccgugugcagcggcggcgagcccguguacaucgugaccgagcugaugagaaagggcaaccugcaggccuuccugggcacccccgagggcagagcccugagacugcccccccugcugggcuucgccugccagguggccgagggcaugagcuaccuggaggagcagagaguggugcacagagaccuggccgccagaaacgugcugguggacgacggccuggccugcaagguggccgacuucggccuggccagacugcugaaggacgacaucuacagccccagcagcagcagcaagauccccgugaaguggaccgcccccgaggccgccaacuacagaguguucagccagaagagcgacguguggagcuucggcgugcugcugcacgagguguucaccuacggccagugccccuacgagggcaugaccaaccacgagacccugcagcagaucaugagaggcuacagacugcccagacccgccgccugccccgccgagguguacgugcugaugcuggagugcuggagaagcagccccgaggagagacccagcuucgccacccugagagagaagcugcacgccauccacagaugccaccccuaa

SEQ ID NO: 24030 - RNA, 411 nt, Artificial Sequence
  SRP14__Homo_sapiens__NP_003125
auggugcugcuggagagcgagcaguuccugaccgagcugaccagacuguuccagaagugcagaaccagcggcagcguguacaucacccugaagaaguacgacggcagaaccaagcccauccccaagaagggcaccguggagggcuucgagcccgccgacaacaagugccugcugagagccaccgacggcaagaagaagaucagcaccguggugagcagcaaggaggugaacaaguuccagauggccuacagcaaccugcugagagccaacauggacggccugaagaagagagacaagaagaacaagaccaagaagaccaaggccgccgccgccgccgccgccgccgcccccgccgccgccgccaccgcccccaccaccgccgccaccaccgccgccaccgccgcccaguaa

SEQ ID NO: 24031 - RNA, 333 nt, Artificial Sequence
  SRP19__Homo_sapiens__NP_001191122
auggccugcgccgccgccagaagccccgccgaccaggacagauucaucugcaucuaccccgccuaccugaacaacaagaagaccaucgccgagggcagaagaauccccaucagcaaggccguggagaaccccaccgccaccgagauccaggacgugugcagcgccgugggccugaacguguuccuggagaagaacaagauguacagcagagaguggaacagagacgugcaguacagaggcagagugagagugcagcugaagcaggaggacggcagccugugccuggugcaguuccccagccacuacacccugagccugaccagcggcagcuaa

SEQ ID NO: 24032 - RNA, 1770 nt, Artificial Sequence
  SRP68__Homo_sapiens__NP_001247431
auggccgccgagaagcaggugcccggcggcggcggcggcggcggcagcggcggcggcggcggcagcggcggcggcggcagcggcggcggcagaggcgccggcggcgaggagaacaaggagaacgagagacccagcgccggcagcaaggccaacaaggaguucggcgacagccugagccuggagauccugcagaucaucaaggagagccagcagcagcacggccugagacacggcgacuuccagagauacagauaccugcugcuggugcugauggacgccgagagagccuggagcuacgccaugcagcugaagcaggaggccaacaccgagcccagaaagagauuccaccugcugagcagacugagaaaggccgugaagcacgccgaggagcuggagagacugugcgagagcaacagaguggacgccaagaccaagcuggaggcccaggccuacaccgccuaccugagcggcaugcugagauucgagcaccaggaguggaaggccgccaucgaggccuucaacaagugcaagaccaucuacgagaagcuggccagcgccuucaccgaggagcaggccgugcuguacaaccagagaguggaggagaucagccccaacaucagauacugcgccuacaacaucggcgaccagagcgccaucaacgagcugaugcagaugagacugagaagcggcggcaccgagggccugcuggccgagaagcuggaggcccugaucacccagaccagagccaagcaggccgccaccaugagcgagguggaguggagaggcagaaccgugcccgugaagaucgacaaggugagaaucuuccugcugggccuggccgacaacgaggccgccaucgugcaggccgagagcgaggagaccaaggagagacuguucgagagcaugcugagcgagugcagagacgccauccagguggugagagaggagcugaagcccgaccagaagcagagagacuacauccuggagggcgagcccggcaaggugagcaaccugcaguaccugcacagcuaccugaccuacaucaagcugagcaccgccaucaagagaaacgagaacauggccaagggccugcagagagcccugcugcagcagcagcccgaggacgacagcaagagaagccccagaccccaggaccugaucagacuguacgacaucauccugcagaaccugguggagcugcugcagcugcccggccuggaggaggacaaggccuuccagaaggagaucggccugaagacccugguguucaaggccuacagaugcuucuucaucgcccagagcuacgugcuggugaagaaguggagcgaggcccuggugcuguacgacagagugcugaaguacgccaacgaggugaacagcgacgccggcgccuucaagaacagccugaaggaccugcccgacgugcaggagcugaucacccaggugagaagcgagaagugcagccugcaggccgccgccauccuggacgccaacgacgcccaccagaccgagaccagcagcagccaggugaaggacaacaagccccugguggagagauucgagaccuucugccuggaccccagccuggugaccaagcaggccaaccuggugcacuucccccccggcuuccagcccauccccugcaagccccuguucuucgaccuggcccugaaccacguggccuuccccccccuggaggacaagcuggagcagaagaccaagagcggccugaccggcuacaucaagggcaucuucggcuucagaagcuaa

SEQ ID NO: 24033 - RNA, 1833 nt, Artificial Sequence
  SRP72__Homo_sapiens__NP_001254651
auggccagcggcggcagcggcggcgugagcgugcccgcccuguggagcgaggugaacagauacggccagaacggcgacuucaccagagcccugaagaccgugaacaagauccugcagaucaacaaggacgacgugaccgcccugcacugcaagguggugugccugauccagaacggcagcuucaaggaggcccugaacgugaucaacacccacaccaaggugcuggccaacaacagccugagcuucgagaaggccuacugcgaguacagacugaacagaaucgagaacgcccugaagaccaucgagagcgccaaccagcagaccgacaagcugaaggagcuguacggccaggugcuguacagacuggagagauacgacgagugccuggccguguacagagaccuggugagaaacagccaggacgacuacgacgaggagagaaagaccaaccugagcgccgugguggccgcccagagcaacugggagaagguggugcccgagaaccugggccugcaggagggcacccacgagcugugcuacaacaccgccugcgcccugaucggccagggccagcugaaccaggccaugaagauccugcagaaggccgaggaccugugcagaagaagccugagcgaggacaccgaccagaacguguucgacagcaagaagaaggugaagcugaccaacgccgagggcguggaguucaagcugagcaagaagcagcugcaggccaucgaguucaacaaggcccugcuggccauguacaccaaccaggccgagcagugcagaaagaucagcgccagccugcagagccagagccccgagcaccugcugcccgugcugauccaggccgcccagcugugcagagagaagcagcacaccaaggccaucgagcugcugcaggaguucagcgaccagcaccccgagaacgccgccgagaucaagcugaccauggcccagcugaagaucagccagggcaacaucagcaaggccugccugauccugagaagcaucgaggagcugaagcacaagcccggcauggugagcgcccuggugaccauguacagccacgaggaggacaucgacagcgccaucgagguguucacccaggccauccagugguaccagaaccaccagcccaagagccccgcccaccugagccugaucagagaggccgccaacuucaagcugaaguacggcagaaagaaggaggccaucagcgaccugcagcagcuguggaagcagaaccccaaggacauccacacccuggcccagcugaucagcgccuacagccugguggaccccgagaaggccaaggcccugagcaagcaccugcccagcagcgacagcaugagccugaagguggacguggaggcccuggagaacagcgccggcgccaccuacaucagaaagaagggcggcaaggugaccggcgacagccagcccaaggagcagggccagggcgaccugaagaagaagaagaagaagaagaagggcaagcugcccaagaacuacgaccccaaggugacccccgaccccgagagauggcugcccaugagagagagaagcuacuacagaggcagaaagaagggcaagaagaaggaccagaucggcaagggcacccagggcgccaccgccggcgccagcagcgagcuggacgccagcaagaccgugagcagcccccccaccagccccagacccggcagcgccgccaccgugagcgccagcaccagcaacaucaucccccccagacaccagaagcccgccggcgcccccgccaccaagaagaagcagcagcagaagaagaagaagggcggcaagggcggcugguaa

SEQ ID NO: 24034 - RNA, 249 nt, Artificial Sequence
  SRP9__Homo_sapiens__NP_001123912
augccccaguaccagaccugggaggaguucagcagagccgccgagaagcuguaccuggccgaccccaugaaggccagaguggugcugaaguacagacacagcgacggcaaccugugcgugaaggugaccgacgaccuggugagacagugccuggcccugcugcugagacugcagugcagcggcaugaucaucgcccacugcauccuggaccugcugggcagcagcggcccccuggccagcgccagcuaa

SEQ ID NO: 24035 - RNA, 1968 nt, Artificial Sequence
  SRPK1__Homo_sapiens__NP_003128
auggagagaaaggugcuggcccugcaggccagaaagaagagaaccaaggccaagaaggacaaggcccagagaaagagcgagacccagcacagaggcagcgccccccacagcgagagcgaccugcccgagcaggaggaggagauccugggcagcgacgacgacgagcaggaggaccccaacgacuacugcaagggcggcuaccaccuggugaagaucggcgaccuguucaacggcagauaccacgugaucagaaagcugggcuggggccacuucagcaccguguggcugagcugggacauccagggcaagaaguucguggccaugaagguggugaagagcgccgagcacuacaccgagaccgcccuggacgagaucagacugcugaagagcgugagaaacagcgaccccaacgaccccaacagagagaugguggugcagcugcuggacgacuucaagaucagcggcgugaacggcacccacaucugcaugguguucgaggugcugggccaccaccugcugaaguggaucaucaagagcaacuaccagggccugccccugcccugcgugaagaagaucauccagcaggugcugcagggccuggacuaccugcacaccaagugcagaaucauccacaccgacaucaagcccgagaacauccugcugagcgugaacgagcaguacaucagaagacuggccgccgaggccaccgaguggcagagaagcggcgcccccccccccagcggcagcgccgugagcaccgccccccagcccaagcccgccgacaagaugagcaagaacaagaagaagaagcugaagaagaagcagaagagacaggccgagcugcuggagaagagaaugcaggagaucgaggagauggagaaggagagcggccccggccagaagagacccaacaagcaggaggagagcgagagccccguggagagaccccugaaggagaacccccccaacaagaugacccaggagaagcuggaggagagcagcaccaucggccaggaccagacccugauggagagagacaccgagggcggcgccgccgagaucaacugcaacggcgugaucgaggugaucaacuacacccagaacagcaacaacgagacccugagacacaaggaggaccugcacaacgccaacgacugcgacgugcagaaccugaaccaggagagcagcuuccugagcagccagaacggcgacagcagcaccagccaggagaccgacagcugcacccccaucaccagcgaggugagcgacaccauggugugccagagcagcagcaccgugggccagagcuucagcgagcagcacaucagccagcugcaggagagcaucagagccgagauccccugcgaggacgagcaggagcaggagcacaacggcccccuggacaacaagggcaagagcaccgccggcaacuuccuggugaacccccuggagcccaagaacgccgagaagcugaaggugaagaucgccgaccugggcaacgccugcugggugcacaagcacuucaccgaggacauccagaccagacaguacagaagccuggaggugcugaucggcagcggcuacaacacccccgccgacaucuggagcaccgccugcauggccuucgagcuggccaccggcgacuaccuguucgagccccacagcggcgaggaguacaccagagacgaggaccacaucgcccugaucaucgagcugcugggcaaggugcccagaaagcugaucguggccggcaaguacagcaaggaguucuucaccaagaagggcgaccugaagcacaucaccaagcugaagcccuggggccuguucgaggugcugguggagaaguacgaguggagccaggaggaggccgccggcuucaccgacuuccugcugcccaugcuggagcugauccccgagaagagagccaccgccgccgagugccugagacaccccuggcugaacagcuaa

SEQ ID NO: 24036 - RNA, 2067 nt, Artificial Sequence
  SRPK2__Homo_sapiens__NP_872633
augagcgugaacagcgagaagagcagcagcagcgagagacccgagccccagcagaaggccccccuggugccccccccccccccccccccccccccccccccccccccccugcccgaccccaccccccccgagcccgaggaggagauccugggcagcgacgacgaggagcaggaggaccccgccgacuacugcaagggcggcuaccaccccgugaagaucggcgaccuguucaacggcagauaccacgugaucagaaagcugggcuggggccacuucagcaccguguggcugugcugggacaugcagggcaagagauucguggccaugaagguggugaagagcgcccagcacuacaccgagaccgcccuggacgagaucaagcugcugaagugcgugagagagagcgaccccagcgaccccaacaaggacaugguggugcagcugaucgacgacuucaagaucagcggcaugaacggcauccacgugugcaugguguucgaggugcugggccaccaccugcugaaguggaucaucaagagcaacuaccagggccugcccgugagaugcgugaagagcaucaucagacaggugcugcagggccuggacuaccugcacagcaagugcaagaucauccacaccgacaucaagcccgagaacauccugaugugcguggacgacgccuacgugagaagaauggccgccgaggccaccgaguggcagaaggccggcgcccccccccccagcggcagcgccgugagcaccgccccccagcagaagcccaucggcaagaucagcaagaacaagaagaagaagcugaagaagaagcagaagagacaggccgagcugcuggagaagagacugcaggagaucgaggagcuggagagagaggccgagagaaagaucaucgaggagaacaucaccagcgccgcccccagcaacgaccaggacggcgaguacugccccgaggugaagcugaagaccaccggccuggaggaggccgccgaggccgagaccgccaaggacaacggcgaggccgaggaccaggaggagaaggaggacgccgagaaggagaacaucgagaaggacgaggacgacguggaccaggagcuggccaacaucgaccccaccuggaucgagagccccaagaccaacggccacaucgagaacggccccuucagccuggagcagcagcuggacgacgaggacgacgacgaggaggacugccccaaccccgaggaguacaaccuggacgagcccaacgccgagagcgacuacaccuacagcagcagcuacgagcaguucaacggcgagcugcccaacggcagacacaagauccccgagagccaguuccccgaguucagcaccagccuguucagcggcagccuggagcccguggccugcggcagcgugcugagcgagggcagcccccugaccgagcaggaggagagcagccccagccacgacagaagcagaaccgugagcgccagcagcaccggcgaccugcccaaggccaagaccagagccgccgaccugcuggugaacccccuggaccccagaaacgccgacaagaucagagugaagaucgccgaccugggcaacgccugcugggugcacaagcacuucaccgaggacauccagaccagacaguacagaagcaucgaggugcugaucggcgccggcuacagcacccccgccgacaucuggagcaccgccugcauggccuucgagcuggccaccggcgacuaccuguucgagccccacagcggcgaggacuacagcagagacgaggaccacaucgcccacaucaucgagcugcugggcagcauccccagacacuucgcccugagcggcaaguacagcagagaguucuucaacagaagaggcgagcugagacacaucaccaagcugaagcccuggagccuguucgacgugcugguggagaaguacggcuggccccacgaggacgccgcccaguucaccgacuuccugauccccaugcuggagauggugcccgagaagagagccagcgccggcgagugccugagacaccccuggcugaacagcuaa

SEQ ID NO: 24037 - RNA, 816 nt, Artificial Sequence
  SRPRB__Homo_sapiens__NP_067026
auggccagcgccgacagcagaagaguggccgacggcggcggcgccggcggcaccuuccagcccuaccuggacacccugagacaggagcugcagcagaccgaccccacccugcugagcguggugguggccgugcuggccgugcugcugacccugguguucuggaagcugaucagaagcagaagaagcagccagagagccgugcugcuggugggccugugcgacagcggcaagacccugcuguucgugagacugcugaccggccuguacagagacacccagaccagcaucaccgacagcugcgccguguacagagugaacaacaacagaggcaacagccugacccugaucgaccugcccggccacgagagccugagacugcaguuccuggagagauucaagagcagcgccagagccaucguguucgugguggacagcgccgccuuccagagagaggugaaggacguggccgaguuccuguaccaggugcugaucgacagcaugggccugaagaacacccccagcuuccugaucgccugcaacaagcaggacaucgccauggccaagagcgccaagcugauccagcagcagcuggagaaggagcugaacacccugagagugaccagaagcgccgcccccagcacccuggacagcagcagcaccgcccccgcccagcugggcaagaagggcaaggaguucgaguucagccagcugccccugaagguggaguuccuggagugcagcgccaagggcggcagaggcgacgugggcagcgccgacauccaggaccuggagaaguggcuggccaagaucgccuaa

SEQ ID NO: 24038 - RNA, 1833 nt, Artificial Sequence
  SRPR__Homo_sapiens__NP_001171313
augcuggacuucuucaccaucuucagcaagggcggccuggugcuguggugcuuccagggcgugagcgacagcugcaccggccccgugaacgcccugaucagaagcgugcugcugcaggugggcuuccagaagauccugacccugaccuacguggacaagcugaucgacgacgugcacagacuguucagagacaaguacagaaccgagauccagcagcagagcgcccugagccugcugaacggcaccuucgacuuccagaacgacuuccugagacugcugagagaggccgaggagagcagcaagaucagagcccccaccaccaugaagaaguucgaggacagcgagaaggccaagaagcccgugagaagcaugaucgagaccagaggcgagaagcccaaggagaaggccaagaacagcaagaagaagggcgccaagaaggagggcagcgacggcccccuggccaccagcaagcccgugcccgccgagaagagcggccugcccgugggccccgagaacggcguggagcugagcaaggaggagcugaucagaagaaagagagaggaguucauccagaagcacggcagaggcauggagaagagcaacaagagcaccaagagcgacgcccccaaggagaagggcaagaaggcccccagagugugggagcugggcggcugcgccaacaaggaggugcuggacuacagcacccccaccaccaacggcacccccgaggccgcccugagcgaggacaucaaccugaucagaggcaccggcagcggcggccagcugcaggaccuggacugcagcagcagcgacgacgagggcgccgcccagaacagcaccaagcccagcgccaccaagggcacccugggcggcauguucggcaugcugaagggccuggugggcagcaagagccugagcagagaggacauggagagcgugcuggacaagaugagagaccaccugaucgccaagaacguggccgccgacaucgccgugcagcugugcgagagcguggccaacaagcuggagggcaaggugaugggcaccuucagcaccgugaccagcaccgugaagcaggcccugcaggagagccuggugcagauccugcagccccagagaagaguggacaugcugagagacaucauggacgcccagagaagacagagacccuacguggugaccuucugcggcgugaacggcgugggcaagagcaccaaccuggccaagaucagcuucuggcugcuggagaacggcuucagcgugcugaucgccgccugcgacaccuucagagccggcgccguggagcagcugagaacccacaccagaagacugagcgcccugcacccccccgagaagcacggcggcagaaccauggugcagcuguucgagaagggcuacggcaaggacgccgccggcaucgccauggaggccaucgccuucgccagaaaccagggcuucgacguggugcugguggacaccgccggcagaaugcaggacaacgccccccugaugaccgcccuggccaagcugaucaccgugaacacccccgaccuggugcuguucgugggcgaggcccuggugggcaacgaggccguggaccagcuggugaaguucaacagagcccuggccgaccacagcauggcccagacccccagacugaucgacggcaucgugcugaccaaguucgacaccaucgacgacaaggugggcgccgccaucagcaugaccuacaucaccagcaagcccaucguguucgugggcaccggccagaccuacugcgaccugagaagccugaacgccaaggccgugguggccgcccugaugaaggccuaa

SEQ ID NO: 24039 - RNA, 1398 nt, Artificial Sequence
  SRPX2__Homo_sapiens__XP_005262178
auggccagccagcugacccagagaggcgcccuguuccugcuguucuuccugacccccgccgugacccccaccugguacgccggcagcggcuacuaccccgacgagagcuacaacgagguguacgccgaggaggugccccaggcccccgcccuggacuacagagugcccagauggugcuacacccugaacauccaggacggcgaggccaccugcuacagccccaagggcggcaacuaccacagcagccugggcaccagaugcgagcugagcugcgacagaggcuucagacugaucggcagaagaagcgugcagugccugcccagcagaagauggagcggcaccgccuacugcagacagaugagaugccacgcccugcccuucaucaccagcggcaccuacaccugcaccaacggcgugcugcuggacagcagaugcgacuacagcugcagcagcggcuaccaccuggagggcgacagaagcagaaucugcauggaggacggcagauggagcggcggcgagcccgugugcguggacaucgacccccccaagaucagaugcccccacagcagagagaagauggccgagcccgagaagcugaccgccagaguguacugggaccccccccuggugaaggacagcgccgacggcaccaucaccagagugacccugagaggccccgagcccggcagccacuuccccgagggcgagcacgugaucagauacaccgccuacgacagagccuacaacagagccagcugcaaguucaucgugaaggugcaggugagaagaugccccacccugaagcccccccagcacggcuaccugaccugcaccagcgccggcgacaacuacggcgccaccugcgaguaccacugcgacggcggcuacgacagacagggcacccccagcagagugugccagagcagcagacaguggagcggcagcccccccaucugcgcccccaugaagaucaacgugaacgugaacagcgccgccggccugcuggaccaguucuacgagaagcagagacugcugaucaucagcgcccccgaccccagcaacagauacuacaagaugcagaucagcaugcugcagcagagcaccugcggccuggaccugagacacgugaccaucaucgagcuggugggccagcccccccaggaggugggcagaaucagagagcagcagcugagcgccaacaucaucgaggagcugagacaguuccagagacugaccagaagcuacuucaacauggugcugaucgacaagcagggcaucgacagagacagauacauggagcccgugacccccgaggagaucuucaccuucaucgacgacuaccugcugagcaaccaggagcugacccagagaagagagcagagagacaucugcgaguaa

SEQ ID NO: 24040 - RNA, 1335 nt, Artificial Sequence
  SRPX__Homo_sapiens__NP_001164221
augggcagccccgcccacagacccgcccugcugcugcugcugcccccccugcugcugcugcugcugcugagagugccccccagcagaagcuuccccgacacccccuggugcagccccaucaaggugaaguacggcgacguguacugcagagccccccagggcggcuacuacaagaccgcccugggcaccagaugcgacaucagaugccagaagggcuacgagcugcacggcagcagccugcugaucugccagagcaacaagagauggagcgacaaggugaucugcaagcagaagagaugccccacccuggccaugcccgccaacggcggcuucaagugcguggacggcgccuacuucaacagcagaugcgaguacuacugcagccccggcuacacccugaagggcgagagaaccgugaccugcauggacaacaaggccuggagcggcagacccgccagcugcguggacauggagccccccagaaucaagugccccagcgugaaggagagaaucgccgagcccaacaagcugaccgugagagugagcugggagacccccgagggcagagacaccgccgacggcauccugaccgacgugauccugaagggccugccccccggcagcaacuuccccgagggcgaccacaagauccaguacaccguguacgacagagccgagaacaagggcaccugcaaguucagagugaaggugagagugaagagaugcggcaagcugaacgcccccgagaacggcuacaugaagugcagcagcgacggcgacaacuacggcgccaccugcgaguucagcugcaucggcggcuacgagcugcagggcagccccgccagagugugccagagcaaccuggccuggagcggcaccgagcccaccugcgccgccaugaacgugaacgugggcgugagaaccgccgccgcccugcuggaccaguucuacgagaagagaagacugcugaucgugagcacccccaccgccagaaaccugcuguacagacugcagcugggcaugcugcagcaggcccagugcggccuggaccugagacacaucaccgugguggagcuggugggcguguuccccacccugaucggcagaaucggcgccaagaucaugccccccgcccuggcccugcagcugagacugcugcugagaaucccccuguacagcuucagcauggugcugguggacaagcacggcauggacaaggagagauacgugagccuggugaugcccguggcccuguucaaccugaucgacaccuucccccugagaaaggaggagauggugcugcaggccgagaugagccagaccugcaacaccuaa

SEQ ID NO: 24041 - RNA, 1023 nt, Artificial Sequence
  SRR__Homo_sapiens__XP_011522276
augugcgcccaguacugcaucagcuucgccgacguggagaaggcccacaucaacaucagagacagcauccaccugacccccgugcugaccagcagcauccugaaccagcugaccggcagaaaccuguucuucaagugcgagcuguuccagaagaccggcagcuucaagaucagaggcgcccugaacgccgugagaagccuggugcccgacgcccuggagagaaagcccaaggccguggugacccacagcagcggcaaccacggccaggcccugaccuacgccgccaagcuggagggcauccccgccuacaucguggugccccagaccgcccccgacugcaagaagcuggccauccaggccuacggcgccagcaucguguacugcgagcccagcgacgagagcagagagaacguggccaagagagugaccgaggagaccgagggcaucauggugcaccccaaccaggagcccgccgugaucgccggccagggcaccaucgcccuggaggugcugaaccaggugccccugguggacgcccugguggugcccgugggcggcggcggcaugcuggccggcaucgccaucaccgugaaggcccugaagcccagcgugaagguguacgccgccgagcccagcaacgccgacgacugcuaccagagcaagcugaagggcaagcugaugcccaaccuguacccccccgagaccaucgccgacggcgugaagagcagcaucggccugaacaccuggcccaucaucagagaccugguggacgacaucuucaccgugaccgaggacgagaucaagugcgccacccagcuggugugggagagaaugaagcugcugaucgagcccaccgccggcgugggcguggccgccgugcugagccagcacuuccagaccgugagccccgaggugaagaacaucugcaucgugcugagcggcggcaacguggaccugaccagcagcaucaccugggugaagcaggccgagagacccgccagcuaccagagcgugagcguguaa

SEQ ID NO: 24042 - RNA, 2751 nt, Artificial Sequence
  SRRM1__Homo_sapiens__NP_001290377
auggacgccggcuucuucagaggcaccagcgccgagcaggacaacagauucagcaacaagcagaagaagcugcugaagcagcugaaguucgccgagugccuggagaagaagguggacaugagcaaggugaaccuggaggugaucaagcccuggaucaccaagagagugaccgagauccugggcuucgaggacgacguggugaucgaguucaucuucaaccagcuggaggugaagaaccccgacagcaagaugaugcagaucaaccugaccggcuuccugaacggcaagaacgccagagaguucaugggcgagcuguggccccugcugcugagcgcccaggagaacaucgccggcauccccagcgccuuccuggagcugaagaaggaggagaucaagcagagacagaucgagcaggagaagcuggccagcaugaagaagcaggacgaggacaaggacaagagagacaaggaggagaaggagagcagcagagagaagagagagagaagcagaagccccagaagaagaaagagcagaagccccagccccagaagaagaagcagccccgugagaagagagagaaagagaagccacagcagaagccccagacacagaaccaagagcagaagccccagccccgcccccgagaagaaggagaagacccccgagcugcccgagcccagcgugaaggugaaggagcccagcgugcaggaggccaccagcaccagcgacauccugaaggugcccaagcccgagcccauccccgagcccaaggagcccagccccgagaagaacagcaagaaggagaaggagaaggagaagaccagacccagaagcagaagcagaagcaagagcagaagcagaaccagaagcagaagccccagccacaccagacccagaagaagacacagaagcagaagcagaagcuacagccccagaagaagacccagccccagaagaagacccagccccagaagaagaaccccccccagaagaaugccccccccccccagacacagaagaagcagaagccccgugagaagaagaagaagaagcagcgccagccugagcggcagcagcagcagcagcagcagcagcagaagcagaagcccccccaagaagccccccaagagaaccagcagcccccccagaaagaccagaagacugagccccagcgccagcccccccagaagaagacacagacccagcccccccgccacccccccccccaagaccagacacagccccaccccccagcagagcaacagaaccagaaagagcagagugagcgugagccccggcagaaccagcgugaccaagcacaagggcaccgagaagagagagagccccagccccgcccccaagcccagaaagguggagcugagcgagagcgaggaggacaagggcggcaagauggccgccgccgacagcgugcagcagagaagacaguacagaagacagaaccagcagagcagcagcgacagcggcagcagcagcagcagcgaggacgagagacccaagagaagccacgugaagaacggcgaggugggcagaagaagaagacacagccccagcagaagcgccagccccagccccagaaagagacagaaggagaccagccccagaaugcagaugggcaagagauggcagagccccgugaccaagagcggcagaagaagaagaagccccagccccccccccaccagaagaagaagaagccccagccccgcccccccccccagaagaagaagaacccccacccccccccccagaagaagaacccccagccccccccccagaagaagaagccccagccccagaagauacagcccccccauccagagaagauacagccccagccccccccccaagagaagaaccgccagccccccccccccccccaagagaagagccagccccagccccccccccaagagaagagugagccacagccccccccccaagcagagaagcagccccgugaccaagagaagaagccccagccugagcagcaagcacagaaagggcagcagccccagcagaagcaccagagaggccagaagcccccagcccaacaagagacacagccccagccccagacccagagccccccagaccagcagcagccccccccccgugagaagaggcgccagcagcagcccccagagaagacagagccccagccccagcaccagacccaucagaagagugagcagaacccccgagcccaagaagaucaagaaggccgccagccccagcccccagagcgugagaagagugagcagcagcagaagcgugagcggcagccccgagcccgccgccaagaagccccccgccccccccagccccgugcagagccagagccccagcaccaacuggagccccgccgugcccgugaagaaggccaagagccccacccccagccccagcccccccagaaacagcgaccaggagggcggcggcaagaagaagaagaagaagaaggacaagaagcacaagaaggacaagaagcacaagaagcacaagaagcacaagaaggagaaggccguggccgccgccgccgccgccgccgugacccccgccgccaucgccgccgccaccaccacccuggcccaggaggagcccguggccgcccccgagcccaagaaggagaccgagagcgaggccgaggacaaccuggacgaccuggagaagcaccugagagagaaggcccugagaagcaugagaaaggcccaggugagcccccagagcuaa

SEQ ID NO: 24043 - RNA, 8259 nt, Artificial Sequence
  SRRM2__Homo_sapiens__NP_057417
auguacaacggcaucggccugcccacccccagaggcagcggcaccaacggcuacgugcagagaaaccugagccuggugagaggcagaagaggcgagagacccgacuacaagggcgaggaggagcugagaagacuggaggccgcccuggugaagagacccaaccccgacauccuggaccacgagagaaagagaagaguggagcugagaugccuggagcuggaggagaugauggaggagcagggcuacgaggagcagcagauccaggagaagguggccaccuucagacugaugcugcuggagaaggacgugaaccccggcggcaaggaggagacccccggccagagacccgccgugaccgagacccaccagcuggccgagcugaacgagaagaagaacgagagacugagagccgccuucggcaucagcgacagcuacguggacggcagcagcuucgacccccagagaagagccagagaggccaagcagcccgcccccgagccccccaagcccuacagccuggugagagagagcagcagcagcagaagccccacccccaagcagaagaagaagaagaagaagaaggacagaggcagaagaagcgagagcagcagccccagaagagagagaaagaagagcagcaagaagaagaagcacagaagcgagagcgagagcaagaagagaaagcacagaagccccacccccaagagcaagagaaagagcaaggacaagaagagaaagagaagcagaagcaccacccccgcccccaagagcagaagagcccacagaagcaccagcgccgacagcgccagcagcagcgacaccagcagaagcagaagcagaagcgccgccgccaagacccacaccaccgcccuggccggcagaagccccagccccgccagcggcagaagaggcgagggcgacgcccccuucagcgagcccggcaccaccagcacccagagacccagcagccccgagaccgccaccaagcagcccagcagccccuacgaggacaaggacaaggacaagaaggagaagagcgccaccagacccagccccagccccgagagaagcagcaccggccccgagccccccgcccccaccccccugcuggccgagagacacggcggcagcccccagccccuggccaccaccccccugagccaggagcccgugaacccccccagcgaggccagccccaccagagacagaagcccccccaagagccccgagaagcugccccagagcagcagcagcgagagcagcccccccagcccccagcccaccaaggugagcagacacgccagcagcagccccgagagccccaagcccgcccccgcccccggcagccacagagagaucagcagcagccccaccagcaagaacagaagccacggcagagccaagagagacaagagccacagccacacccccagcagaagaaugggcagaagcagaagccccgccaccgccaagagaggcagaagcagaagcagaacccccaccaagagaggccacagcagaagcagaagcccccaguggagaagaagcagaagcgcccagagauggggcagaagcagaagcccccagagaagaggcagaagcagaagcccccagagacccggcuggagcagaagcagaaacacccagagaagaggcagaagcagaagcgccagaagaggcagaagccacagcagaagccccgccaccagaggcagaagcagaagcagaacccccgccagaagaggcagaagcagaagcagaacccccgccagaagaagaagcagaagcagaacccccaccagaagaagaagcagaagcagaacccccgccagaagaggcagaagcagaagcagaacccccgccagaagaagaagcagaaccagaagccccgugagaagaagaagcagaagcagaagccccgccagaagaagcggcagaagcagaagcagaacccccgccagaagaggcagaagcagaagcagaacccccgccagaagaggcagaagcagaagcagaacccccgccagaagaagcggcagaagcagaagcagaacccccgccagaagaggcagaagcagaagcagaacccccagaagaggcagaagcagaagcagaagccuggugagaagaggcagaagccacagcagaaccccccagagaagaggcagaagcggcagcagcagcgagagaaagaacaagagcagaaccagccagagaagaagcagaagcaacagcagccccgagaugaagaagagcagaaucagcagcagaagaagcagaagccugagcagccccagaagcaaggccaagagcagacugagccugagaagaagccugagcggcagcagccccugccccaagcagaagagccagaccccccccagaagaagcagaagcggcagcagccagcccaaggccaagagcagaaccccccccagaagaagcagaagcagcagcagccccccccccaagcagaagagcaagacccccagcagacagagccacagcagcagcagcccccaccccaaggugaagagcggcaccccccccagacagggcagcaucaccagcccccaggccaacgagcagagcgugaccccccagagaagaagcugcuucgagagcagccccgaccccgagcugaagagcagaacccccagcagacacagcugcagcggcagcagcccccccagagugaagagcagcaccccccccagacagagccccagcagaagcagcagcccccagcccaaggugaaggccaucaucagccccagacagagaagccacagcggcagcagcagccccagccccagcagagugaccagcagaaccacccccagaagaagcagaagcgugagccccugcagcaacguggagagcagacugcugcccagauacagccacagcggcagcagcagccccgacaccaaggugaagcccgagaccccccccagacagagccacagcggcagcaucagccccuaccccaaggugaaggcccagaccccccccggccccagccugagcggcagcaagagccccugcccccaggagaagagcaaggacagccuggugcagagcugccccggcagccugagccugugcgccggcgugaagagcagcaccccccccggcgagagcuacuucggcgugagcagccugcagcugaagggccagagccagaccagccccgaccacagaagcgacaccagcagccccgaggugagacagagccacagcgagagccccagccugcagagcaagagccagaccagccccaagggcggcagaagcagaagcagcagccccgugaccgagcuggccagcagaagccccaucagacaggacagaggcgaguucagcgccagccccaugcugaagagcggcaugagccccgagcagagcagauuccagagcgacagcagcagcuaccccaccguggacagcaacagccugcugggccagagcagacuggagaccgccgagagcaaggagaagauggcccugcccccccaggaggacgccaccgccagcccccccagacagaaggacaaguucagccccuuccccgugcaggacagacccgagagcagccugguguucaaggacacccugagaaccccccccagagagagaagcggcgccggcagcagccccgagaccaaggagcagaacagcgcccugcccaccagcagccaggacgaggagcugauggaggugguggagaagagcgaggagcccgccggccagauccugagccaccugagcagcgagcugaaggagaugagcaccagcaacuucgagagcagccccgagguggaggagagacccgccgugagccugacccuggaccagagccagagccaggccagccuggaggccguggaggugcccagcauggccagcagcuggggcggcccccacuucagccccgagcacaaggagcugagcaacagcccccugagagagaacagcuucggcagcccccuggaguucagaaacagcggcccccugggcaccgagaugaacaccggcuucagcagcgaggugaaggaggaccugaacggccccuuccugaaccagcuggagaccgaccccagccuggacaugaaggagcagagcaccagaagcagcggccacagcagcagcgagcugagccccgacgccguggagaaggccggcaugagcagcaaccagagcaucagcagccccgugcuggacgccgugcccagaacccccagcagagagagaagcagcagcgccagcagccccgagaugaaggacggccugcccagaacccccagcagaagaagcagaagcggcagcagccccggccugagagacggcagcggcacccccagcagacacagccugagcggcagcagccccggcaugaaggacauccccagaacccccagcagaggcagaagcgagugcgacagcagccccgagcccaaggcccugccccagacccccagacccagaagcagaagccccagcagccccgagcugaacaacaagugccugaccccccagagagagagaagcggcagcgagagcagcguggaccagaagaccguggccagaaccccccugggccagagaagcagaagcggcagcagccaggagcuggacgugaagcccagcgccagcccccaggagagaagcgagagcgacagcagccccgacagcaaggccaagaccagaaccccccugagacagagaagcagaagcggcagcagccccgagguggacagcaagagcagacugagccccagaagaagcagaagcggcagcagccccgaggugaaggacaagcccagagccgcccccagagcccagagcggcagcgacagcagccccgagcccaaggcccccgcccccagagcccugcccagaagaagcagaagcggcagcagcagcaagggcagaggccccagccccgagggcagcagcagcaccgagagcagccccgagcacccccccaagagcagaaccgccagaagaggcagcagaagcagccccgagcccaagaccaagagcagaaccccccccagaagaagaagcagcagaagcagccccgagcugaccagaaaggccagacugagcagaagaagcagaagcgccagcagcagccccgagaccagaagcagaaccccccccagacacagaagaagccccagcgugagcagccccgagcccgccgagaagagcagaagcagcagaagaagaagaagcgccagcagccccagaaccaagaccaccagcagaagaggcagaagccccagccccaagcccagaggccugcagagaagcagaagcagaagcagaagagagaagaccagaaccaccagaagaagagacagaagcggcagcagccagagcaccagcagaagaagacagagaagcagaagcagaagcagagugaccagaagaagaagaggcggcagcggcuaccacagcagaagccccgccagacaggagagcagcagaaccagcagcagaagaagaagaggcagaagcagaaccccccccaccagcagaaagagaagcagaagcagaaccagccccgcccccuggaagagaagcagaagcagagccagccccgccacccacagaagaagcagaagcagaaccccccugaucagcagaagaagaagcagaagcagaaccagccccgugagcagaagaagaagcagaagcagaaccagcgugaccagaagaagaagcagaagcagagccagccccgugagcagaagaagaagcagaagcagaaccccccccgugaccagaagaagaagcagaagcagaacccccaccaccagaagaagaagcagaagcagaaccccccccgugaccagaagaagaagcagaagcagaaccccccccgugaccagaagaagaagcagaagcagaaccagccccaucaccagaagaagaagcagaagcagaaccagccccgugaccagaagaagaagcagaagcagaaccagccccgugaccagaagaagaagcagaagcagaaccagccccgugaccagaagaagaagcagaagcagaaccccccccgccaucagaagaagaagcagaagcagaaccccccugcugcccagaaagagaagcagaagcagaagcccccuggccaucagaagaagaagcagaagcagaacccccagaaccgccagaggcaagagaagccugaccagaagcccccccgccaucagaagaagaagcgccagcggcagcagcagcgacagaagcagaagcgccaccccccccgccaccagaaaccacagcggcagcagaaccccccccguggcccugaacagcagcagaaugagcugcuucagcagacccagcaugagccccaccccccuggacagaugcagaagccccggcaugcuggagccccugggcagcagcagaacccccaugagcgugcugcagcaggccggcggcagcaugauggacggccccggccccagaauccccgaccaccagagaaccagcgugcccgagaaccacgcccagagcagaaucgcccuggcccugaccgccaucagccugggcaccgccagacccccccccagcaugagcgccgccggccuggccgccagaaugagccaggugcccgcccccgugccccugaugagccugagaaccgcccccgccgccaaccuggccagcagaauccccgccgccagcgccgccgccaugaaccuggccagcgccagaacccccgccauccccaccgccgugaaccuggccgacagcagaacccccgccgccgccgccgccaugaaccuggccagccccagaaccgccguggcccccagcgccgugaaccuggccgaccccagaacccccaccgcccccgccgugaaccuggccggcgccagaacccccgccgcccuggccgcccugagccugaccggcagcggcaccccccccaccgccgccaacuaccccagcagcagcagaaccccccaggcccccgccagcgccaaccuggugggccccagaagcgcccacgccaccgcccccgugaacaucgccggcagcagaaccgccgccgcccuggcccccgccagccugaccagcgccagaauggcccccgcccugagcggcgccaaccugaccagccccagagugccccugagcgccuacgagagagugagcggcagaaccagccccccccugcuggacagagccagaagcagaaccccccccagcgcccccagccagagcagaaugaccagcgagagagcccccagccccagcagcagaaugggccaggcccccagccagagccugcugccccccgcccaggaccagcccagaagccccgugcccagcgccuucagcgaccagagcagaugccugaucgcccagaccacccccguggccggcagccagagccugagcagcggcgccguggccaccaccaccagcagcgccggcgaccacaacggcaugcugagcgugcccgcccccggcgugccccacagcgacgugggcgagccccccgccagcaccggcgcccagcagcccagcgcccuggccgcccugcagcccgccaaggagagaagaagcagcagcagcagcagcagcagcagcagcagcagcagcagcagcagcagcagcagcagcagcagcagcagcagcggcagcagcagcagcgacagcgagggcagcagccugcccgugcagcccgagguggcccugaagagagugcccagccccacccccgcccccaaggaggccgugagagagggcagaccccccgagcccacccccgccaagagaaagagaagaagcagcagcagcagcagcagcagcagcagcagcagcagcagcagcagcagcagcagcagcagcagcagcagcagcagcagcagcagcagcagcagcagcagcagcagcagcagcagcagcagcagccccagccccgccaagcccggcccccaggcccugcccaagcccgccagccccaagaagcccccccccggcgagagaagaagcagaagccccagaaagcccaucgacagccugagagacagcagaagccugagcuacagccccguggagagaagaagacccagcccccagcccagccccagagaccagcagagcagcagcagcgagagaggcagcagaagaggccagagaggcgacagcagaagccccagccacaagagaagaagagagacccccagccccagacccaugagacacagaagcagcagaagccccuaa

SEQ ID NO: 24044 - RNA, 1836 nt, Artificial Sequence
  SRRM4__Homo_sapiens__NP_919262
auggccagcgugcagcagggcgagaagcagcuguucgagaaguucuggagaggcaccuucaaggccguggccacccccagacccgagagcaucaucguggccagcaucaccgccagaaagccccugcccagaaccgagccccagaacaaccccguggugcccgcccaggacggccccagcgagaagcugggccagcaccuggccaccgagccccugggcaccaacagcugggagagagacaagaccugcagagagcugggcgccaccagaggccacagcgccagccacgacaaggaccugacccccccccccagcagcagaggcaagaagaagaagaagaagagcaccagaaagaagagaagaagaagcagcagcuacagccccagccccgugaagaagaagaagaagaagagcagcaagaagcacaagagaagaagaagcuucagcaagaagagaagacacagcagcagcagccccaagagcaagagaagagacgagaagagacacaagaagcagagcagaagcagacccagaaagagccacagacacagacaccacagaugccccagcagaagccagagcagcgagagcagacccagcagcugcgagagcagacacagaggcagaagccccgaggagggccagaagagcagaagaagacacagcagaagaugcagcaagacccugugcaaggacagccccgaggcccagagcagcagaccccccagccagccccugcagaugcugggcuaccugagcgccagaggcgugaucaccggcagcggcagcgccgccgaccuguucaccaagaccgccagcccccugaccaccagcagaggcagaagccaggaguacgacagcggcaacgacaccagcagcccccccagcacccagaccagcagcgccagaagcagaggccaggagaagggcagccccagcggcggccugagcaagagcagagagcugaacagcggcaacaccagcgacagcggcaacagcuucaccaccagcagcccccagaacaagggcgccaugcuggagaaccugagccccaccagcagaggcagagagagcagaggcuuccagagccccugccuggagugcgccgaggugaagaagagcagccuggugcccagcaccgccagaagcagccccaugaagggcugcagcagaagcagcagcuacgccagcaccagaagcagcagccacagcagcagaagccccaaccccagagccagccccagauacacccagagcagaagcaccagcagcgagaagagaagcuacagcagaagccccagcuacagcagcaagagcggcaagagaagcccccccagcagaagcagcagaagcagaagaagccccagcuacagcagauacagccccagcagagagagagaccccaaguacagcgagaaggacagccagcagagagagagagagagagccagaagaagaagaagaagcuacagccccaugagaaagagaagaagagacagccccagccaccuggaggccagaagaaucaccagcgccagaaagagacccauccccuacuacagacccagccccagcagcagcggcagccugagcagcaccagcagcugguacagcagcagcagcagcagaagcgccagcagaagcuacagcagaagcagaagcagaagcagaagcagaagaagaagcagaaccagaaccagcagcagcagcagcagcagaagccccagccccggcagcagaagcagaagcagaagcagaagcagaagcagaagcagaagcagaagccagagcagaagcuacagcagcgccgacagcuacagcagcaccagaagauaa

SEQ ID NO: 24045 - RNA, 2652 nt, Artificial Sequence
  SRRT__Homo_sapiens__XP_005250462
auggcccccagcgacagagccaugggcgacagcgacgacgaguacgacagaagaagaagagacaaguucagaagagagagaagcgacuacgacagaagcagagagagagacgagagaagaagaggcgacgacuggaacgacagagagugggacagaggcagagagagaagaagcagaggcgaguacagagacuacgacagaaacagaagagagagauucagcccccccagacacgagcugagccccccccagaagagaaugagaagagacugggacgagcacagcagcgaccccuaccacagcggcuacgagaugcccuacgccggcggcggcggcggccccaccuacggccccccccagcccuggggccaccccgacgugcacaucaugcagcaccacgugcugcccauccaggccagacugggcagcaucgccgagaucgaccugggcgugcccccccccgugaugaagaccuucaaggaguuccugcugagccuggacgacagcguggacgagaccgaggccgugaagagauacaacgacuacaagcuggacuucagaagacagcagaugcaggacuucuuccuggcccacaaggacgaggagugguucagaagcaaguaccaccccgacgaggugggcaagagaagacaggaggccagaggcgcccugcagaacagacugagaguguuccugagccugauggagaccggcugguucgacaaccugcugcuggacaucgacaaggccgacgccaucgugaagaugcuggacgccgccgugaucaagauggagggcggcaccgagaacgaccugagaauccuggagcaggaggaggaggaggagcaggccggcaagcccggcgagcccagcaagaaggaggagggcagagccggcgccggccugggcgacggcgagagaaagaccaacgacaaggacgagaagaaggaggacggcaagcaggccgagaacgacagcagcaacgacgacaagaccaagaagagcgagggcgacggcgacaaggaggagaagaaggaggacagcgagaaggaggccaagaagagcagcaagaagagaaacagaaagcacagcggcgacgacagcuucgacgagggcagcgugagcgagagcgagagcgagagcgagagcggccaggccgaggaggagaaggaggaggccgaggaggcccugaaggagaaggagaagcccaaggaggaggagugggagaagcccaaggacgccgccggccuggagugcaagcccagaccccugcacaagaccugcagccuguucaugagaaacaucgcccccaacaucagcagagccgagaucaucagccugugcaagagauaccccggcuucaugagaguggcccugagcgagccccagcccgagagaagauucuucagaagaggcugggugaccuucgacagaagcgugaacaucaaggagaucugcuggaaccugcagaacaucagacugagagagugcgagcugagccccggcgugaacagagaccugaccagaagagugagaaacaucaacggcaucacccagcacaagcagaucgugagaaacgacaucaagcuggccgccaagcugauccacacccuggacgacagaacccagcugugggccagcgagcccggcacccccccccugcccaccagccugcccagccagaaccccauccugaagaacaucaccgacuaccugaucgaggaggugagcgccgaggaggaggagcugcugggcagcagcggcggcgccccccccgaggagccccccaaggagggcaaccccgccgagaucaacguggagagagacgagaagcugaucaaggugcuggacaagcugcugcuguaccugagaaucgugcacagccuggacuacuacaacaccugcgaguaccccaacgaggacgagaugcccaacagaugcggcaucauccacgugagaggccccaugccccccaacagaaucagccacggcgaggugcuggaguggcagaagaccuucgaggagaagcugaccccccugcugagcgugagagagagccugagcgaggaggaggcccagaagaugggcagaaaggaccccgagcaggagguggagaaguucgugaccagcaacacccaggagcugggcaaggacaaguggcugugcccccugagcggcaagaaguucaagggccccgaguucgugagaaagcacaucuucaacaagcacgccgagaagaucgaggaggugaagaaggagguggccuucuucaacaacuuccugaccgacgccaagagacccgcccugcccgagaucaagcccgcccagccccccggccccgcccagauccugccccccggccugacccccggccugcccuacccccaccagaccccccagggccugaugcccuacggccagcccagaccccccauccugggcuacggcgccggcgccgugagacccgccgugcccaccggcggcccccccuacccccacgcccccuacggcgccggcagaggcaacuacgacgccuucagaggccagggcggcuaccccggcaagcccagaaacagaauggugagaggcgaccccagagccaucguggaguacagagaccuggacgcccccgacgacguggacuucuucuaa

SEQ ID NO: 24046 - RNA, 519 nt, Artificial Sequence
  SRSF10__Homo_sapiens__NP_001287865
augagcagauaccugagaccccccaacaccagccuguucgugagaaacguggccgacgacaccagaagcgaggaccugagaagagaguucggcagauacggccccaucguggacguguacgugccccuggacuucuacaccagaagacccagaggcuucgccuacgugcaguucgaggacgugagagacgccgaggacgcccugcacaaccuggacagaaaguggaucugcggcagacagaucgagauccaguucgcccagggcgacagaaagacccccaaccagaugaaggccaaggagggcagaaacguguacagcagcagcagauacgacgacuacgacagauacagaagaagcagaagcagaagcuacgagagaagaagaagcagaagcagaagcuucgacuacaacuacagaagaagcuacagccccagaaacagacccaccggcagacccagaagaagcagaagccacagcgacaacgacagccaggugagcaagaagaagaacgagagauaa

SEQ ID NO: 24047 - RNA, 1455 nt, Artificial Sequence
  SRSF11__Homo_sapiens__XP_011540729
augagcaacaccaccguggugcccagcaccgccggccccggccccagcggcggccccggcggcggcggcggcggcggcggcggcggcggcggcaccgaggugauccaggugaccaacgugagccccagcgccagcagcgagcagaugagaacccuguucggcuuccugggcaagaucgacgagcugagacuguucccccccgacgacagcccccugcccgugagcagcagagugugcuucgugaaguuccacgaccccgacagcgccgugguggcccagcaccugaccaacaccguguucguggacagagcccugaucguggugcccuacgccgagggcgugauccccgacgaggccaaggcccugagccugcuggcccccgccaacgccguggccggccugcugcccggcggcggccugcugcccacccccaacccccugacccagaucggcgccgugccccuggccgcccugggcgcccccacccuggaccccgcccuggccgcccugggccugcccggcgccaaccugaacagccagagccuggccgccgaccagcugcugaagcugaugagcaccguggaccccaagcugaaccacguggccgccggccuggugagccccagccugaagagcgacaccagcagcaaggagaucgaggaggccaugaagagagugagagaggcccagagccugaucagcgccgccaucgagcccgacaagaaggaggagaagagaagacacagcagaagcagaagcagaagcagaagaagaagaacccccagcagcagcagacacagaagaagcagaagcagaagcagaagaagaagccacagcaagagcagaagcagaagaagaagcaagagccccagaagaagaagaagccacagcagagagagaggcagaagaagcagaagcaccagcaagaccagagacaagaagaaggaggacaaggagaagaagagaagcaagaccccccccaagagcuacagcaccgccagaagaagcagaagcgccagcagagagagaagaagaagaagaagcagaagcggcaccagaagccccaagaagcccagaagccccaagagaaagcugagcagaagccccagccccagaagacacaagaaggagaagaagaaggacaaggacaaggagagaagcagagacgagagagagagaagcaccagcaagaagaagaagagcaaggacaaggagaaggacagagagagaaagagcgagagcgacaaggacgugaagcaggugaccagagacuacgacgaggaggagcagggcuacgacagcgagaaggagaagaaggaggagaagaagcccaucgagaccggcagccccaagaccaaggagugcagcguggagaagggcaccggcgacagccugagagagagcaaggugaacggcgacgaccaccacgaggaggacauggacaugagcgacuaa

SEQ ID NO: 24048 - RNA, 786 nt, Artificial Sequence
  SRSF12__Homo_sapiens__NP_542781
augagcagauacaccagaccccccaacaccagccuguucaucagaaacguggccgacgccaccagacccgaggaccugagaagagaguucggcagauacggccccaucguggacguguacaucccccuggacuucuacaccagaagacccagaggcuucgccuacgugcaguucgaggacgugagagacgccgaggacgcccuguacaaccugaacagaaagugggugugcggcagacagaucgagauccaguucgcccagggcgacagaaagacccccggccagaugaagagcaaggagagacaccccugcagccccagcgaccacagaagaagcagaagccccagccagagaagaaccagaagcagaagcagcagcuggggcagaaacagaagaagaagcgacagccugaaggagagcagacacagaagauucagcuacagccagagcaagagcagaagcaagagccugcccagaagaagcaccagcgccagacagagcagaacccccagaagaaacuucggcagcagaggcagaagcagaagcaagagccugcagaagagaagcaagagcaucggcaagagccagagcagcagcccccagaagcagaccagcagcggcaccaagagcagaagccacggcagacacagcgacagcaucgccagaagccccugcaagagccccaagggcuacaccaacagcgagaccaaggugcagaccgccaagcacagccacuucagaagccacagcagaagcagaagcuacagacacaagaacagcugguaa

SEQ ID NO: 24049 - RNA, 606 nt, Artificial Sequence
  SRSF1__Homo_sapiens__NP_001071634
augagcggcggcggcgugaucagaggccccgccggcaacaacgacugcagaaucuacgugggcaaccugccccccgacaucagaaccaaggacaucgaggacguguucuacaaguacggcgccaucagagacaucgaccugaagaacagaagaggcggcccccccuucgccuucguggaguucgaggaccccagagacgccgaggacgccguguacggcagagacggcuacgacuacgacggcuacagacugagaguggaguuccccagaagcggcagaggcaccggcagaggcggcggcggcggcggcggcggcggcgcccccagaggcagauacggcccccccagcagaagaagcgagaacagagugguggugagcggccugccccccagcggcagcuggcaggaccugaaggaccacaugagagaggccggcgacgugugcuacgccgacguguacagagacggcaccggcgugguggaguucgugagaaaggaggacaugaccuacgccgugagaaagcuggacaacaccaaguucagaagccacgaggugggcuacaccagaauccuguucuucgaccagaacuggauccaguggagcuaa

SEQ ID NO: 24050 - RNA, 666 nt, Artificial Sequence
  SRSF2__Homo_sapiens__NP_001182356
augagcuacggcagacccccccccgacguggagggcaugaccagccugaagguggacaaccugaccuacagaaccagccccgacacccugagaagaguguucgagaaguacggcagagugggcgacguguacauccccagagacagauacaccaaggagagcagaggcuucgccuucgugagauuccacgacaagagagacgccgaggacgccauggacgccauggacggcgccgugcuggacggcagagagcugagagugcagauggccagauacggcagaccccccgacagccaccacagcagaagaggccccccccccagaagauacggcggcggcggcuacggcagaagaagcagaagccccagaagaagaagaagaagcagaagcagaagcagaagcagaagcagaagcagaagcagaagcagauacagcagaagcaagagcagaagcagaaccagaagcagaagcagaagcaccagcaagagcagaagcgccagaagaagcaagagcaagagcagcagcgugagcagaagcagaagcagaagcagaagcagaagcagaagcagaagccccccccccgugagcaagagagagagcaagagcagaagcagaagcaagagcccccccaagagccccgaggaggagggcgccgugagcagcuaa

SEQ ID NO: 24051 - RNA, 495 nt, Artificial Sequence
  SRSF3__Homo_sapiens__NP_003008
augcacagagacagcugcccccuggacugcaagguguacgugggcaaccugggcaacaacggcaacaagaccgagcuggagagagccuucggcuacuacggcccccugagaagcguguggguggccagaaacccccccggcuucgccuucguggaguucgaggaccccagagacgccgccgacgccgugagagagcuggacggcagaacccugugcggcugcagagugagaguggagcugagcaacggcgagaagagaagcagaaacagaggccccccccccagcuggggcagaagacccagagacgacuacagaagaagaagccccccccccagaagaagaagccccagaagaagaagcuucagcagaagcagaagcagaagccugagcagagacagaagaagagagagaagccugagcagagagagaaaccacaagcccagcagaagcuucagcagaagcagaagcagaagcagaagcaacgagagaaaguaa

SEQ ID NO: 24052 - RNA, 1395 nt, Artificial Sequence
  SRSF4__Homo_sapiens__XP_011540253
augcccagaguguacaucggcagacugagcuaccaggccagagagagagacguggagagauucuucaagggcuacggcaagauccuggagguggaccugaagaacggcuacggcuucguggaguucgacgaccugagagacgccgacgacgccguguacgagcugaacggcaaggaccugugcggcgagagagugaucguggagcacgccagaggccccagaagagacggcagcuacggcagcggcagaagcggcuacggcuacagaagaagcggcagagacaaguacggcccccccaccagaaccgaguacagacugaucguggagaaccugagcagcagaugcagcuggcaggaccugaaggacuacaugagacaggccggcgaggugaccuacgccgacgcccacaagggcagaaagaacgagggcgugaucgaguucgugagcuacagcgacaugaagagagcccuggagaagcuggacggcaccgaggugaacggcagaaagaucagacugguggaggacaagcccggcagcagaagaagaagaagcuacagcagaagcagaagccacagcagaagcggcagcagaagcagaagcaagagcagaagcagaagccagagcagaagcagaagcaagaaggagaagagcagaagccccagcaaggagaagagcagaagcagaagccacagcgccggcaagagcagaagcaagagcaaggaccaggccgaggagaagauccagaacaacgacaacgugggcaagcccaagagcagaagccccagcagacacaagagcaagagcaagagcagaagcagaagccaggagagaagaguggaggaggagaagagaggcagcgugagcagaggcagaagccaggagaagagccugagacagagcagaagcagaagcagaagcaagggcggcagcagaagcagaagcagaagcagaagcaagagcaaggacaagagaaagggcagaaagagaagcagagaggagagcagaagcagaagcagaagcagaagcaagagcgagagaagcagaaagagaggcagcaagagagacagcaaggccggcagcagcaagaagaagaagaaggaggacaccgacagaagccagagcagaagccccagcagaagcgugagcaaggagagagagcacgccaagagcgagagcagccagagagagggcagaggcgagagcgagaacgccggcaccaaccaggagaccagaagcagaagcagaagcaacagcaagagcaagcccaaccugcccagcgagagcagaagcagaagcaagagcgccagcaagaccagaagcagaagcaagagcagaagcagaagcgccagcagaagccccagcagaagcagaagcagaagccacagcagaagcuaa

SEQ ID NO: 24053 - RNA, 819 nt, Artificial Sequence
  SRSF5__Homo_sapiens__NP_001307143
augagcggcugcagaguguucaucggcagacugaaccccgccgccagagagaaggacguggagagauucuucaagggcuacggcagaaucagagacaucgaccugaagagaggcuucggcuucguggaguucgaggaccccagagacgccgacgacgccguguacgagcuggacggcaaggagcugugcagcgagagagugaccaucgagcacgccagagccagaagcagaggcggcagaggcagaggcagauacagcgacagauucagcagcagaagacccagaaacgacagaagaaacgccccccccgugagaaccgagaacagacugaucguggagaaccugagcagcagagugagcuggcaggaccugaaggacuucaugagacaggccggcgaggugaccuucgccgacgcccacagacccaagcugaacgagggcgugguggaguucgccagcuacggcgaccugaagaacgccaucgagaagcugagcggcaaggagaucaacggcagaaagaucaagcugaucgagggcagcaagagacacagcagaagcagaagcagaagcagaagcagaaccagaagcagcagcagaagcagaagcagaagcagaagcagaagcagaaagagcuacagcagaagcagaagcagaagcagaagcagaagcagaagcaagagcagaagcgugagcagaagccccgugcccgagaagagccagaagagaggcagcagcagcagaagcaagagccccgccagcguggacagacagagaagcagaagcagaagcagaagcagaagcguggacagcggcaacuaa

SEQ ID NO: 24054 - RNA, 1035 nt, Artificial Sequence
  SRSF6__Homo_sapiens__NP_006266
augcccagaguguacaucggcagacugagcuacaacgugagagagaaggacauccagagauucuucagcggcuacggcagacugcuggagguggaccugaagaacggcuacggcuucguggaguucgaggacagcagagacgccgacgacgccguguacgagcugaacggcaaggagcugugcggcgagagagugaucguggagcacgccagaggccccagaagagacagagacggcuacagcuacggcagcagaagcggcggcggcggcuacagcagcagaagaaccagcggcagagacaaguacggcccccccgugagaaccgaguacagacugaucguggagaaccugagcagcagaugcagcuggcaggaccugaaggacuucaugagacaggccggcgaggugaccuacgccgacgcccacaaggagagaaccaacgagggcgugaucgaguucagaagcuacagcgacaugaagagagcccuggacaagcuggacggcaccgagaucaacggcagaaacaucagacugaucgaggacaagcccagaaccagccacagaagaagcuacagcggcagcagaagcagaagcagaagcagaagaagaagcagaagcagaagcagaagaagcagcagaagcagaagcagaagcaucagcaagagcagaagcagaagcagaagcagaagcaagggcagaagcagaagcagaagcaagggcagaaagagcagaagcaagagcaagagcaagcccaagagcgacagaggcagccacagccacagcagaagcagaagcaaggacgaguacgagaagagcagaagcagaagcagaagcagaagccccaaggagaacggcaagggcgacaucaagagcaagagcagaagcagaagccagagcagaagcaacagcccccugcccgugccccccagcaaggccagaagcgugagccccccccccaagagagccaccagcagaagcagaagcagaagcagaagcaagagcagaagcagaagcagaagcagcagcagagacuaa

SEQ ID NO: 24055 - RNA, 717 nt, Artificial Sequence
  SRSF7__Homo_sapiens__NP_001026854
augagcagauacggcagauacggcggcgagaccaagguguacgugggcaaccugggcaccggcgccggcaagggcgagcuggagagagccuucagcuacuacggcccccugagaaccguguggaucgccagaaacccccccggcuucgccuucguggaguucgaggaccccagagacgccgaggacgccgugagaggccuggacggcaaggugaucugcggcagcagagugagaguggagcugagcaccggcaugcccagaagaagcagauucgacagaccccccgccagaagacccuucgaccccaacgacagaugcuacgagugcggcgagaagggccacuacgccuacgacugccacagauacagcagaagaagaagaagcagaagcagaagcagaagccacagcagaagcagaggcagaagauacagcagaagcagaagcagaagcagaggcagaagaagcagaagcgccagccccagaagaagcagaagcaucagccugagaagaagcagaagcgccagccugagaagaagcagaagcggcagcaucaagggcagcagauacuuccagagccccagcagaagcagaagcagaagcagaagcaucagcagacccagaagcagcagaagcaagagcagaagccccagccccaagagaagcagaagccccagcggcagccccagaagaagcgccagccccgagagaauggacuaa

SEQ ID NO: 24056 - RNA, 666 nt, Artificial Sequence
  SRSF9__Homo_sapiens__NP_003760
augagcggcugggccgacgagagaggcggcgagggcgacggcagaaucuacgugggcaaccugcccaccgacgugagagagaaggaccuggaggaccuguucuacaaguacggcagaaucagagagaucgagcugaagaacagacacggccuggugcccuucgccuucgugagauucgaggaccccagagacgccgaggacgccaucuacggcagaaacggcuacgacuacggccagugcagacugagaguggaguuccccagaaccuacggcggcagaggcggcuggcccagaggcggcagaaacggcccccccaccagaagaagcgacuucagagugcuggugagcggccugccccccagcggcagcuggcaggaccugaaggaccacaugagagaggccggcgacgugugcuacgccgacgugcagaaggacggcgugggcaugguggaguaccugagaaaggaggacauggaguacgcccugagaaagcuggacgacaccaaguucagaagccacgagggcgagaccagcuacaucagaguguaccccgagagaagcaccagcuacggcuacagcagaagcagaagcggcagcagaggcagagacagccccuaccagagcagaggcagcccccacuacuucagccccuucagacccuacuaa

SEQ ID NO: 24057 - RNA, 414 nt, Artificial Sequence
  SRXN1__Homo_sapiens__NP_542763
augggccugagagccggcggcacccugggcagagccggcgccggcagaggcgcccccgagggccccggccccagcggcggcgcccagggcggcagcauccacagcggcagaaucgccgccgugcacaacgugccccugagcgugcugaucagaccccugcccagcgugcuggaccccgccaaggugcagagccugguggacaccaucagagaggaccccgacagcgugccccccaucgacgugcuguggaucaagggcgcccagggcggcgacuacuucuacagcuucggcggcugccacagauacgccgccuaccagcagcugcagagagagaccauccccgccaagcuggugcagagcacccugagcgaccugagaguguaccugggcgccagcacccccgaccugcaguaa

SEQ ID NO: 24058 - RNA, 615 nt, Artificial Sequence
  SRY__Homo_sapiens__NP_003131
augcagagcuacgccagcgccaugcugagcguguucaacagcgacgacuacagccccgccgugcaggagaacauccccgcccugagaagaagcagcagcuuccugugcaccgagagcugcaacagcaaguaccagugcgagaccggcgagaacagcaagggcaacgugcaggacagagugaagagacccaugaacgccuucaucguguggagcagagaccagagaagaaagauggcccuggagaaccccagaaugagaaacagcgagaucagcaagcagcugggcuaccaguggaagaugcugaccgaggccgagaaguggcccuucuuccaggaggcccagaagcugcaggccaugcacagagagaaguaccccaacuacaaguacagacccagaagaaaggccaagaugcugcccaagaacugcagccugcugcccgccgaccccgccagcgugcugugcagcgaggugcagcuggacaacagacuguacagagacgacugcaccaaggccacccacagcagaauggagcaccagcugggccaccugccccccaucaacgccgccagcagcccccagcagagagacagauacagccacuggaccaagcuguaa

SEQ ID NO: 24059 - RNA, 1257 nt, Artificial Sequence
  SS18__Homo_sapiens__NP_001007560
augagcguggccuucgccgcccccagacagagaggcaagggcgagaucacccccgccgccauccagaagaugcuggacgacaacaaccaccugauccagugcaucauggacagccagaacaagggcaagaccagcgagugcagccaguaccagcagaugcugcacaccaaccugguguaccuggccaccaucgccgacagcaaccagaacaugcagagccugcugcccgccccccccacccagaacaugcccaugggccccggcggcaugaaccagagcggccccccccccccccccagaagccacaacaugcccagcgacggcauggugggcggcggcccccccgccccccacaugcagaaccagaugaacggccagaugcccggccccaaccacaugcccaugcagggccccggccccaaccagcugaacaugaccaacagcagcaugaacaugcccagcagcagccacggcagcaugggcggcuacaaccacagcgugcccagcagccagagcaugcccgugcagaaccagaugaccaugagccagggccagcccaugggcaacuacggccccagacccaacaugagcaugcagcccaaccagggccccaugaugcaccagcagccccccagccagcaguacaacaugccccagggcggcggccagcacuaccagggccagcagccccccaugggcaugaugggccaggugaaccagggcaaccacaugaugggccagagacagaucccccccuacagacccccccagcagggccccccccagcaguacagcggccaggaggacuacuacggcgaccaguacagccacggcggccagggcccccccgagggcaugaaccagcaguacuaccccgacggccacaacgacuacggcuaccagcagcccagcuaccccgagcagggcuacgacagacccuacgaggacagcagccagcacuacuacgagggcggcaacagccaguacggccagcagcaggacgccuaccagggcccccccccccagcagggcuaccccccccagcagcagcaguaccccggccagcagggcuaccccggccagcagcagggcuacggccccagccagggcggccccggcccccaguaccccaacuacccccagggccagggccagcaguacggcggcuacagacccacccagcccggccccccccagcccccccagcagagacccuacggcuacgaccagggccaguacggcaacuaccagcaguaa

SEQ ID NO: 24060 - RNA, 1191 nt, Artificial Sequence
  SS18L1__Homo_sapiens__NP_945173
augagcguggccuucgccagcgccagacccagaggcaagggcgaggugacccagcagaccauccagaagaugcuggacgagaaccaccaccugauccagugcauccuggaguaccagagcaagggcaagaccgccgagugcacccaguaccagcagauccugcacagaaaccugguguaccuggccaccaucgccgacagcaaccagaacaugcagagccugcugcccgccccccccacccagaacaugaaccugggccccggcgcccugacccagagcggcagcagccagggccugcacagccagggcagccugagcgacgccaucagcaccggccugccccccagcagccugcugcagggccagaucggcaacggccccagccacgugagcaugcagcagaccgcccccaacacccugcccaccaccagcaugagcaucagcggccccggcuacagccacgccggccccgccagccagggcgugcccaugcagggccagggcaccaucggcaacuacgugagcagaaccaacaucaacaugcagagcaaccccgugagcaugaugcagcagcaggccgccaccagccacuacagcagcgcccagggcggcagccagcacuaccagggccagagcagcaucgccaugaugggccagggcagccagggcagcagcaugaugggccagagacccauggcccccuacagacccagccagcagggcagcagccagcaguaccugggccaggaggaguacuacggcgagcaguacagccacagccagggcgccgccgagcccaugggccagcaguacuaccccgacggccacggcgacuacgccuaccagcagagcagcuacaccgagcagagcuacgacagaagcuucgaggagagcacccagcacuacuacgagggcggcaacagccaguacagccagcagcaggccggcuaccagcagggcgccgcccagcagcagaccuacagccagcagcaguaccccagccagcagagcuaccccggccagcagcagggcuacggcagcgcccagggcgcccccagccaguaccccggcuaccagcagggccagggccagcaguacggcagcuacagagccccccagaccgcccccagcgcccagcagcagagacccuacggcuacgagcagggccaguacggcaacuaccagcaguaa

SEQ ID NO: 24061 - RNA, 1227 nt, Artificial Sequence
  SSB__Homo_sapiens__NP_003133
auggccgagaacggcgacaacgagaagauggccgcccuggaggccaagaucugccaccagaucgaguacuacuucggcgacuucaaccugcccagagacaaguuccugaaggagcagaucaagcuggacgagggcugggugccccuggagaucaugaucaaguucaacagacugaacagacugaccaccgacuucaacgugaucguggaggcccugagcaagagcaaggccgagcugauggagaucagcgaggacaagaccaagaucagaagaagccccagcaagccccugcccgaggugaccgacgaguacaagaacgacgugaagaacagaagcguguacaucaagggcuuccccaccgacgccacccuggacgacaucaaggaguggcuggaggacaagggccaggugcugaacauccagaugagaagaacccugcacaaggccuucaagggcagcaucuucgugguguucgacagcaucgagagcgccaagaaguucguggagacccccggccagaaguacaaggagaccgaccugcugauccuguucaaggacgacuacuucgccaagaagaacgaggagagaaagcagaacaagguggaggccaagcugagagccaagcaggagcaggaggccaagcagaagcuggaggaggacgccgagaugaagagccuggaggagaagaucggcugccugcugaaguucagcggcgaccuggacgaccagaccugcagagaggaccugcacauccuguucagcaaccacggcgagaucaaguggaucgacuucgugagaggcgccaaggagggcaucauccuguucaaggagaaggccaaggaggcccugggcaaggccaaggacgccaacaacggcaaccugcagcugagaaacaaggaggugaccugggaggugcuggagggcgagguggagaaggaggcccugaagaagaucaucgaggaccagcaggagagccugaacaaguggaagagcaagggcagaagauucaagggcaagggcaagggcaacaaggccgcccagcccggcagcggcaagggcaaggugcaguuccagggcaagaagaccaaguucgccagcgacgacgagcacgacgagcacgacgagaacggcgccaccggccccgugaagagagccagagaggagaccgacaaggaggagcccgccagcaagcagcagaagaccgagaacggcgccggcgaccaguaa

SEQ ID NO: 24062 - RNA, 447 nt, Artificial Sequence
  SSBP1__Homo_sapiens__NP_001243442
auguucagaagacccgugcugcaggugcugagacaguucgugagacacgagagcgagaccaccaccagccuggugcuggagagaagccugaacagagugcaccugcugggcagagugggccaggaccccgugcugagacagguggagggcaagaaccccgugaccaucuucagccuggccaccaacgagauguggagaagcggcgacagcgagguguaccagcugggcgacgugagccagaagaccaccuggcacagaaucagcguguucagacccggccugagagacguggccuaccaguacgugaagaagggcagcagaaucuaccuggagggcaagaucgacuacggcgaguacauggacaagaacaacgugagaagacaggccaccaccaucaucgccgacaacaucaucuuccugagcgaccagaccaaggagaaggaguaa

SEQ ID NO: 24063 - RNA, 1026 nt, Artificial Sequence
  SSBP2__Homo_sapiens__NP_001243662
auguacggcaagggcaagagcaacagcagcgccgugcccagcgacagccaggccagagagaagcuggcccuguacguguacgaguaccugcugcacgugggcgcccagaagagcgcccagaccuuccugagcgagaucagaugggagaagaacaucacccugggcgagccccccggcuuccugcacagcugguggugcguguucugggaccuguacugcgccgcccccgagagaagagagaccugcgagcacagcagcgaggccaaggccuuccacgacuacagcgccgccgccgcccccagccccgugcugggcaacaucccccccggcgacggcaugcccgugggccccgugccccccggcuucuuccaggcccugggcggcgugcccggcagccagccccugcugcccagcggcauggaccccaccagacagcagggccaccccaacaugggcggccccaugcagagaaugaccccccccagaggcauggugccccugggcccccagaacuacggcggcgccaugagacccccccugaacgcccugggcggccccggcaugcccggcaugaacaugggccccggcggcggcagacccuggcccaaccccaccaacgccaacagcauccccuacagcagcgccagccccggcaacuacgugggcccccccggcggcggcggcccccccggcacccccaucaugcccagccccgccgacagcaccaacagcggcgacaacauguacacccugaugaacgccgugccccccggccccaacagacccaacuuccccaugggccccggcagcgacggccccaugggcggccugggcggcauggagagccaccacaugaacggcagccugggcagcggcgacauggacagcaucagcaagaacagccccaacaacaugagccugagcaaccagcccggcacccccagagacgacggcgagaugggcggcaacuuccugaaccccuuccagagcgagagcuacagccccagcaugaccaugagcguguaa

SEQ ID NO: 24064 - RNA, 3780 nt, Artificial Sequence
  SSFA2__Homo_sapiens__NP_001123917
auggacagaccccugagcagcagcgccgaggccgaggaggagcuggaguggcagguggccagcagaagaagaaaggccugggccaagugcagaagcagcuggcaggccagcgagaccgaggaccugagcaccgaggccaccacccaggacgaggaggaggacgaggaggaggaccugcccggcgcccagcugcccgccgccggcggcagaggcaacgugcccaacgagaagaucgccaucuggcugaaggacugcagaaccccccugggcgccagccuggacgagcagagcagcagcacccugaagggcgugcuggugagaaacggcggcagcuucgaggacgaccugagccugggcgccgaggccaaccaccugcacgagagcgacgcccagaucgagaacugcaacaacauccuggccaaggagagaagacugcaguuccaccagaagggcagaagcaugaacagcaccggcagcggcaagagcagcggcaccgugagcagcgugagcgagcugcuggagcuguacgaggaggaccccgaggagauccuguacaaccugggcuucggcagagacgagcccgacaucgccagcaagauccccagcagauucuucaacagcagcagcuucgccaagggcaucgacaucaagguguuccugagcgcccagaugcagagaauggagguggagaaccccaacuacgcccugaccagcagauucagacagaucgaggugcugaccaccguggccaacgccuucagcagccuguacagccaggugagcggcaccccccugcagagaaucggcagcaugagcagcgugaccagcaacaaggagaccgaccccccccccccccugaccagaagcaacaccgccaacagacugaugaagacccugagcaagcugaaccugugcguggacaagaccgagaagggcgagagcagcagccccagccccagcgccgagaagggcaagauccugaacgugagcgugaucgaggagagcggcaacaagaacgaccagaagagccagaagaucaugaagaagaaggagagcagcagcaugcuggccaccgugaaggaggaggugagcggcagcagcgccgccgugaccgagaacgccgacagcgacagaaucagcgacgaggccaacagcaacuucaaccagggcaccgagaacgagcagagcaaggagacccagagccacgagagcaagcugggcgaggagagcggcaucguggagagcaagcuggacagcgacuucaacaucagcagccacagcgagcuggagaacagcagcgagcugaagagcgugcacaucagcacccccgagaaggagcccugcgccccccugaccauccccagcaucagaaacaucaugacccagcagaaggacagcuucgagauggaggaggugcagagcaccgagggcgaggccccccacgugcccgccaccuaccagcugggccugaccaagagcaagagagaccaccugcugagaaccgccagccagcacagcgacagcagcggcuucgccgaggacagcaccgacugccugagccugaaccaccugcaggugcaggagagccugcaggccaugggcagcagcgccgacagcugcgacagcgagaccaccgugaccagccugggcgaggaccuggccacccccaccgcccaggaccagcccuacuucaacgagagcgaggaggagagccuggugccccugcagaagggccuggagaaggccgccgccguggccgacaagagaaagagcggcagccaggacuucccccagugcaacaccaucgagaacaccggcaccaagcagagcaccugcagccccggcgaccacaucaucgagaucaccgagguggaggaggaccuguuccccgccgagaccguggagcugcugagagaggccagcgccgagagcgacgugggcaagagcagcgagagcgaguucacccaguacaccacccaccacauccugaagagccuggccagcaucgaggccaagugcagcgacaugagcagcgagaacaccaccggcccccccagcagcauggacagagugaacaccgcccugcagagagcccagaugaaggugugcagccugagcaaccagagaaugggcagaagccugcugaagagcaaggaccugcugaagcagagauaccuguucgccaaggccggcuacccccugagaagaagccagagccugcccaccacccugcugagccccgugagaguggugagcagcgugaacgugagacugagccccggcaaggagaccagaugcagcccccccagcuucaccuacaaguacacccccgaggaggagcaggagcuggagaagagagugauggagcacgacggccagagccuggugaagagcaccaucuucaucagccccagcagcgugaagaaggaggaggccccccagagcgaggcccccagaguggaggagugccaccacggcagaacccccaccugcagcagacuggcccccccccccaugagccagagcaccugcagccugcacagcauccacagcgaguggcaggagagaccccugugcgagcacaccagaacccugagcacccacagcgugcccaacaucagcggcgccaccugcagcgccuucgccagccccuucggcugccccuacagccacagacacgccaccuaccccuacagagugugcagcgugaacccccccagcgccaucgagaugcagcugagaagagugcugcacgacaucagaaacagccugcagaaccugagccaguaccccaugaugagaggccccgaccccgccgccgcccccuacagcacccagaagagcagcgugcugccccuguacgagaacaccuuccaggagcugcaggugaugagaagaagccugaaccuguucagaacccagaugauggaccuggagcuggccaugcugagacagcagaccaugguguaccaccacaugaccgaggaggagagauucgagguggaccagcugcagggccugagaaacagcgugagaauggagcugcaggaccuggagcugcagcuggaggagagacugcugggccuggaggagcagcugagagccgugagaaugcccagccccuucagaagcagcgcccugaugggcaugugcggcagcagaagcgccgacaaccugagcugccccagcccccugaacgugauggagcccgugaccgagcugaugcaggagcagagcuaccugaagagcgagcugggccugggccugggcgagaugggcuucgagaucccccccggcgagagcagcgagagcguguucagccaggccaccagcgagagcagcagcgugugcagcggccccagccacgccaacagaagaaccggcgugcccagcaccgccagcgugggcaagagcaagaccccccugguggccagaaagaagguguucagagccagcguggcccugacccccaccgcccccagcagaaccggcagcgugcagaccccccccgaccuggagagcagcgaggagguggacgccgccgagggcgcccccgagguggugggccccaagagcgagguggaggagggccacggcaagcugcccagcaugcccgccgccgaggagaugcacaagaacguggagcaggacgagcugcagcaggugaucagagagaucaaggagagcaucgugggcgagaucagaagagagaucgugagcggccugcuggccgccgugagcagcagcaaggccagcaacagcaagcaggacuaccacuaa

SEQ ID NO: 24065 - RNA, 2079 nt, Artificial Sequence
  SSH1__Homo_sapiens__NP_001154802
auggcccuggugacccugcagagaagccccacccccagcgccgccagcagcagcgccagcaacagcgagcuggaggccggcagcgaggaggacagaaagcugaaccugagccugagcgagagcuucuucauggugaagggcgccgcccuguuccugcagcagggcagcagcccccagggccagagaagccugcagcacccccacaagcacgccggcgaccugccccagcaccugcaggugaugaucaaccugcugagaugcgaggacagaaucaagcuggccgugagacuggagagcgccugggccgacagagugagauacaugguggugguguacagcagcggcagacaggacaccgaggagaacauccugcugggcguggacuucagcagcaaggagagcaagagcugcaccaucggcauggugcugagacuguggagcgacaccaagauccaccuggacggcgacggcggcuucagcgugagcaccgccggcagaaugcacaucuucaagcccgugagcgugcaggccauguggagcgcccugcaggugcugcacaaggccugcgagguggccagaagacacaacuacuuccccggcggcguggcccugaucugggccaccuacuacgagagcugcaucagcagcgagcagagcugcaucaacgaguggaacgccaugcaggaccuggagagcaccagacccgacagccccgcccuguucguggacaagcccaccgagggcgagagaaccgagagacugaucaaggccaagcugagaagcaucaugaugagccaggaccuggagaacgugaccagcaaggagaucagaaacgagcuggagaagcagaugaacugcaaccugaaggagcugaaggaguucaucgacaacgagaugcugcugauccugggccagauggacaagcccagccugaucuucgaccaccuguaccugggcagcgaguggaacgccagcaaccuggaggagcugcagggcagcggcguggacuacauccugaacgugaccagagagaucgacaacuucuuccccggccuguucgccuaccacaacaucagaguguacgacgaggagaccaccgaccugcuggcccacuggaacgaggccuaccacuucaucaacaaggccaagagaaaccacagcaagugccuggugcacugcaagaugggcgugagcagaagcgccagcaccgugaucgccuacgccaugaaggaguucggcuggccccuggagaaggccuacaacuacgugaagcagaagagaagcaucaccagacccaacgccggcuucaugagacagcugagcgaguacgagggcauccuggacgccagcaagcagagacacaacaagcuguggagacagcagaccgacagcagccugcagcagcccguggacgaccccgccggccccggcgacuuccugcccgagacccccgacggcacccccgagagccagcugcccuuccuggacgacgccgcccagcccggccugggccccccccugcccugcugcuucagaagacugagcgacccccugcugcccagccccgaggacgagaccggcagccuggugcaccuggaggaccccgagagagaggcccugcuggaggaggccgccccccccgccgaggugcacagacccgccagacagccccagcagggcagcggccugugcgagaaggacgugaagaagaagcuggaguucggcagccccaagggcagaagcggcagccugcugcagguggaggagaccgagagagaggagggccugggcgccggcagauggggccagcugcccacccagcuggaccagaaccugcugaacagcgagaaccugaacaacaacagcaagagaagcugccccaacggcauggaggugggcagagccagacccgccggcuggcacacccccagccugcccagccacagcaacuggcccaccagcgccagcguggugggcaccaccggcaccagacaccacacccagcugaucuucuucuacugccugcugugggcccccagcagccaccugcagggccccgagggcagcuucaccggcuaa

SEQ ID NO: 24066 - RNA, 4353 nt, Artificial Sequence
  SSH2__Homo_sapiens__NP_001269058
auggcccuggugaccgugcagagaagccccacccccagcaccaccagcagccccugcgccagcagcagccaccuggaggacagcgagagcgccgcccugcugugcugcgagugcgaggagagcgagaucuucaccgacagcaacgaggccgacagcggcgaggaggagugcagaagccagcccagaagcaucagcgagagcuuccugaccgugaagggcgccgcccuguuccugcccagaggcaacggcagcagcacccccagaaucagccacagaagaaacaagcacgccggcgaccugcagcagcaccugcaggccauguucauccugcugagacccgaggacaacaucagacuggccgugagacuggagagcaccuaccagaacagaaccagauacauggugguggugagcaccaacggcagacaggacaccgaggagagcaucgugcugggcauggacuucagcagcaacgacagcagcaccugcaccaugggccuggugcugccccuguggagcgacacccugauccaccuggacggcgacggcggcuucagcgugagcaccgacaacagagugcacaucuucaagcccgugagcgugcaggccauguggagcgcccugcagagccugcacaaggccugcgagguggccagagcccacaacuacuaccccggcagccuguuccugaccugggugagcuacuacgagagccacaucaacagcgaccagagcagcgugaacgaguggaacgccaugcaggacgugcagagccacagacccgacagccccgcccuguucaccgacauccccaccgagagagagagaaccgagagacugaucaagaccaagcugagagagaucaugaugcagaaggaccuggagaacaucaccagcaaggagaucagaaccgagcuggagaugcagauggugugcaaccugagagaguucaaggaguucaucgacaacgagaugaucgugauccugggccagauggacagccccacccagaucuucgagcacguguuccugggcagcgaguggaacgccagcaaccuggaggaccugcagaacagaggcgugagauacauccugaacgugaccagagagaucgacaacuucuuccccggcguguucgaguaccacaacaucagaguguacgacgaggaggccaccgaccugcuggccuacuggaacgacaccuacaaguucaucagcaaggccaagaagcacggcagcaagugccuggugcacugcaagaugggcgugagcagaagcgccagcaccgugaucgccuacgccaugaaggaguacggcuggaaccuggacagagccuacgacuacgugaaggagagaagaaccgugaccaagcccaaccccagcuucaugagacagcuggaggaguaccagggcauccugcuggccagcaagcagagacacaacaagcuguggagaagccacagcgacagcgaccugagcgaccaccacgagcccaucugcaagcccggccuggagcugaacaagaaggacaucaccaccagcgccgaccagaucgccgaggugaagaccauggagagccacccccccaucccccccguguucguggagcacauggugccccaggacgccaaccagaagggccugugcaccaaggagagaaugaucugccuggaguucaccagcagagaguuccacgccggccagaucgaggacgagcugaaccugaacgacaucaacggcugcagcagcggcugcugccugaacgagagcaaguucccccuggacaacugccacgccagcaaggcccugauccagcccggccacgugcccgagauggccaacaaguuccccgaccugaccguggaggaccuggagaccgacgcccugaaggccgacaugaacgugcaccugcugcccauggaggagcugaccagcccccugaaggacccccccaugagccccgaccccgagagccccagcccccagcccagcugccagaccgagaucagcgacuucagcaccgacagaaucgacuucuucagcgcccuggagaaguucguggagcugagccaggagaccagaagcagaagcuucagccacagcagaauggaggagcugggcggcggcagaaacgagagcugcagacugagcgugguggagguggcccccagcaaggugaccgccgacgaccagagaagcagcagccugagcaacaccccccacgccagcgaggagagcagcauggacgaggagcagagcaaggccaucagcgagcuggugagccccgacaucuucaugcagagccacagcgagaacgccaucagcgugaaggagaucgugaccgagaucgagagcaucagccagggcgugggccagauccagcugaagggcgacauccugcccaaccccugccacacccccaagaagaacagcauccacgagcugcugcuggagagagcccagacccccgagaacaagcccggccacauggagcaggacgaggacagcugcaccgcccagcccgagcuggccaaggacagcggcaugugcaaccccgagggcugccugaccacccacagcagcaucgccgaccuggaggagggcgagcccgccgagggcgagcaggagcugcagggcagcggcaugcaccccggcgccaagugguaccccggcagcgugagaagagccacccuggaguucgaggagagacugagacaggagcaggagcaccacggcgccgcccccaccugcaccagccugagcaccagaaagaacagcaagaacgacagcagcguggccgaccuggcccccaagggcaagagcgacgaggccccccccgagcacagcuucgugcugaaggagcccgagaugagcaagggcaagggcaaguacagcggcagcgaggccggcagccugagccacagcgagcagaacgccaccgugcccgcccccagagugcuggaguucgaccaccugcccgacccccaggagggccccggcagcgacaccggcacccagcaggagggcgugcugaaggaccugagaaccgugauccccuaccaggagagcgagacccaggccgugccccugccccugcccaagagaguggagaucaucgaguacacccacaucgugaccagccccaaccacaccggccccggcagcgagaucgccaccagcgagaagagcggcgagcagggccugagaaaggugaacauggagaagagcgugaccgugcugugcacccuggacgagaaccugaacagaacccuggaccccaaccaggugagccugcacccccaggugcugccccugccccacagcagcagccccgagcacaacagacccaccgaccaccccaccagcauccugagcagccccgaggacagaggcagcagccugagcaccgcccuggagaccgccgcccccuucgugagccacaccacccaccugcugagcgccagccuggacuaccugcacccccagaccauggugcaccuggagggcuucaccgagcagagcagcaccaccgacgagcccagcgccgagcaggugagcugggaggagagccaggagagcccccugagcagcggcagcgaggugcccuacaaggacagccagcugagcagcgccgaccugagccugaucagcaagcugggcgacaacaccggcgagcugcaggagaagauggacccccugcccguggccugcagacugccccacagcagcagcagcgagaacaucaagagccugagccacagccccggcguggugaaggagagagccaaggagaucgagagcagagugguguuccaggccggccugaccaagcccagccagaugagaagaagcgccagccuggccaagcugggcuaccuggaccugugcaaggacugccugcccgagagagagcccgccagcugcgagagcccccaccugaagcugcugcagcccuuccugagaaccgacagcggcaugcacgccauggaggaccaggagagccuggagaaccccggcgccccccacaaccccgagcccaccaagagcuucguggagcagcugaccaccaccgagugcaucgugcagagcaagcccguggagagaccccuggugcaguacgccaaggaguucggcagcagccagcaguaccugcugcccagagccggccuggagcugaccagcagcgagggcggccugcccgugcugcagacccagggccugcagugcgccugccccgcccccggccuggccguggcccccagacagcagcacggcagaacccacccccugagaagacugaagaaggccaacgacaagaagagaaccaccaaccccuucuacaacaccauguaa

SEQ ID NO: 24067 - RNA, 735 nt, Artificial Sequence
  SSMEM1__Homo_sapiens__NP_660311
augggcgaccuguucagccuguucugggagguggaccccccccccauccccgugaacugcgccauccccaaccaggacuacgagugcuggaaggacgacagcugcggcaccaucggcagcuuccugcugugguacuucgugaucguguucgugcugauguucuucagcagagccagcguguggaugagcgaggacaagaaggacgagggcagcggcaccagcaccagcgugagaaaggccagcaaggagaccagcugcaagagacagagcaaggacagcgccugggaccccagccagaccaugaagaagcccaagcagaaccagcugacccccgugaccaacagcgagguggcccuggugaacgccuaccccgagcagagaagagccagaagacagagccaguucaacgaggugaaccagaaccagcacgacagcgacaccaccgaguacggcagcgaggagagcaacagcgaggccagcagcuggaaggagagcgagagcgagcaccaccccagccccgacagcaucaagagaagaaagauggcccagagacagagaaaccugggcagcuaccagaugagcgagagacacugccugcacugcaaggcccugagaaccaacgaguggcuggcccaccacagcagacagaagcccagcgugaccccccccaugaagagagacagccaggaggagagcagcaucagcgacaucaacaagaaguucagcaaguucuaa

SEQ ID NO: 24068 - RNA, 360 nt, Artificial Sequence
  SSNA1__Homo_sapiens__NP_003722
augacccagcagggcgccgcccugcagaacuacaacaacgagcuggugaagugcaucgaggagcugugccagaagagagaggagcugugcagacagauccaggaggaggaggacgagaagcagagacugcagaacgaggugagacagcugaccgagaagcuggccagagugaacgagaaccuggccagaaagaucgccagcagaaacgaguucgacagaaccaucgccgagaccgaggccgccuaccugaagauccuggagagcagccagacccugcugagcgugcugaagagagaggccggcaaccugaccaaggccaccgcccccgaccagaagagcagcggcggcagagacagcuaa

SEQ ID NO: 24069 - RNA, 732 nt, Artificial Sequence
  SSPN__Homo_sapiens__NP_005077
augggcaagaacaagcagcccagaggccagcagagacagggcggcccccccgccgccgacgccgccggccccgacgacauggagcccaagaagggcaccggcgcccccaaggagugcggcgaggaggagcccagaaccugcugcggcugcagauucccccugcugcuggcccugcugcagcuggcccugggcaucgccgugaccguggugggcuuccugauggccagcaucagcagcagccugcuggugagagacacccccuucugggccggcaucaucgugugccugguggccuaccugggccuguucaugcugugcgugagcuaccagguggacgagagaaccugcauccaguucagcaugaagcugcuguacuuccugcugagcgcccugggccugaccgugugcgugcuggccguggccuucgccgcccaccacuacagccagcugacccaguucaccugcgagaccacccuggacagcugccagugcaagcugcccagcagcgagccccugagcagaaccuucguguacagagacgugaccgacugcaccagcgugaccggcaccuucaagcuguuccugcugauccagaugauccugaaccuggugugcggccuggugugccugcuggccugcuucgugauguggaagcacagauaccagguguucuacgugggcgugagaaucugcagccugaccgccagcgagggcccccagcagaagaucuaa

SEQ ID NO: 24070 - RNA, 15444 nt, Artificial Sequence
  SSPO__Homo_sapiens__NP_940857
augcugcugcccgcccugcuguucggcauggccugggcccuggccgacggcagauggugcgaguggaccgagaccaucagaguggaggaggagguggcccccagacaggaggaccuggugcccugcgccagccuggaccacuacagcagacugggcuggagacuggaccugcccuggagcggcagaagcggccugaccagaagccccgcccccggccugugccccaucuacaagccccccgagaccagacccgccaaguggaacagaaccgugagaaccugcugccccggcuggggcggcgcccacugcaccgaggcccuggccaaggccagccccgagggccacugcuucgccauguggcagugccagcugcaggccggcagcgccaacgccagcgccggcagccuggaggagugcugcgccagacccuggggccagagcuggugggacggcagcagccaggccugcagaagcugcagcagcagacaccugcccggcagcgccagcagccccgcccugcugcagccccuggccggcgccgugggccagcuguggagccagcaccagagacccagcgccaccugcgccagcuggagcggcuuccacuacagaaccuucgacggcagacacuaccacuuccugggcagaugcaccuaccugcuggccggcgccgccgacagcaccugggccgugcaccugacccccggcgacagaugcccccagcccggccacugccagagagugaccaugggccccgaggaggugcugauccaggccggcaacgugagcgugaagggccagcuggugcccgagggccagagcuggcugcugcacggccugagccugcaguggcugggcgacuggcuggugcugagcggcggccugggcgugguggugagacuggacagaaccggcagcaucagcaucagcguggaccacgagcuguggggccagacccagggccugugcggccuguacaacggcuggcccgaggacgacuucauggagcccggcggcggccuggccaugcuggccgccaccuucggcaacagcuggagacugcccggcagcgagagcggcugccuggacgccguggagguggcccagggcugcgacccccugggccugaucgacgccgacguggagcccggccaccugagagccgaggcccaggacgugugccaccagcugcuggagggccccuucggccagugccacgcccaggugagccccgccgaguaccacgaggccugccuguucgccuacugcgccggcgccauggccggcagcggccaggagggcagacagcaggccgugugcgccaccuucgccagcuacgugcaggccugcgccagaagacacauccacaucagauggagaaagcccggcuucugcgagagacugugccccggcggccagcuguacagcgacugcgugagccugugcccccccagcugcgaggccgugggccagggcgaggaggagagcugcagagaggagugcgugagcggcugcgagugccccagaggccuguucuggaacggcacccugugcgugcccgccgcccacugccccugcuacuacugcagacagagauacgugcccggcgacaccgugagacagcugugcaaccccugcgugugcagagacggcagauggcacugcgcccaggcccugugccccgccgagugcgccgugggcggcgacggccacuaccugaccuucgacggcagaagcuacagcuucuggggcggccagggcugcagauacagccuggugcaggacuacgugaagggccagcugcugauccugcuggagcacggcgccugcgacgccggcagcugccugcacgccaucagcgugagccuggaggacacccacauccagcugagagacagcggcgccgugcuggugaacggccaggacgugggccugcccuggaucggcgccgagggccugagcgugagaagagccagcagcgccuuccugcugcugagauggcccggcgcccaggugcuguggggccugagcgaccccguggccuacaucacccuggaccccagacacgcccaccaggugcagggccugugcggcaccuucacccagaaccagcaggacgacuuccugacccccgccggcgacguggagaccagcaucgccgccuucgccagcaaguuccagguggccggcaagggcagaugccccagcgaggacagcgcccugcugagccccugcaccacccacagccagagacacgccuucgccgaggccgccugcgccauccugcacagcagcguguuccaggagugccacagacugguggacaaggagcccuucuaccugagaugccuggccgccgugugcggcugcgaccccggcagcgacugccugugccccgugcugagcgccuacgccagaagaugcgcccaggagggcgccagcccccccuggagaaaccagacccugugccccgugaugugccccggcggccaggaguacagagagugcgcccccgccugcggccagcacugcggcaagcccgaggacugcggcgagcugggcagcugcguggccggcugcaacugcccccugggccugcugugggaccccgagggccagugcgugccccccagccugugccccugccagcugggcgccagaagauacgcccccggcagcgccaccaugaaggagugcaacagaugcaucugccaggagagaggccuguggaacugcaccgccagacacugccccagccaggccuucugccccagagagcugguguacgcccccggcgccugccugcugaccugcgacagccccagcgccaaccacagcugccccgccggcagcaccgacggcugcgugugcccccccggcaccgugcugcuggacgagagaugcgugccccccgaccugugccccugcagacacagcggccagugguaccugcccaacgccaccauccaggaggacugcaacgugugcgugugcagaggcagacaguggcacugcaccggccagagaagaagcggcagaugccaggccagcggcgccccccacuacgugaccuucgacggccuggccuucaccuaccccggcgccugcgaguaccugcuggugagagaggccagcggccuguucaccgugagcgcccagaaccugcccugcggcgccagcggccugaccugcaccaaggcccuggccgugagacuggagggcaccguggugcacaugcugagaggcagagccgugaccgugaacggcgugagcgugaccccccccaagguguacaccggccccggccugagccugagaagagccggccuguuccugcugcugagcacccaccugggccugacccugcugugggacggcggcaccagagugcuggugcagcugagcccccaguucagaggcagaguggccggccugugcggcgacuucgacggcgacgccagcaacgaccugagaagcagacagggcgugcuggagcccaccgccgagcuggccgcccacagcuggagacugagcccccugugccccgagcccggcgaccugccccaccccugcaccaugaacacccacagagccggcugggccagagccagaugcggcgcccugcugcagccccuguucacccugugccacgccgaggugcccccccagcagcacuacgaguggugccuguacgacgccugcggcugcgacagcggcggcgacugcgagugccugugcagcgccaucgccaccuacgccgacgagugcgccagacacggccaccacgugagauggagaagccaggagcugugcagccugcagugcgagggcggccagguguacgaggccugcggccccaccugcccccccaccugccacgagcagcaccccgagcccggcuggcacugccaggugguggccugcguggagggcugcuucugccccgagggcacccugcugcacggcggcgccugccuggagcccgccagcugccccugcgaguggggcagaaacagcuucccccccggcagcgugcugcagaaggacugcggcaacugcaccugccaggagggccaguggcacugcggcggcgacggcggccacugcgaggagcuggugcccgccugcgccgagggcgaggcccugugccaggagaacggccacugcgugccccacggcuggcugugcgacaaccaggacgacugcggcgacggcagcgacgaggagggcugcgccgcccccggcugcggcgagggccagaugaccugcagcagcggccacugccugccccuggcccugcugugcgacagacaggacgacugcggcgacggcaccgacgagcccagcuaccccugcccccagggccugcuggccugcgccgacggcagaugccugccccccgcccugcugugcgacggccaccccgacugccuggacgccgccgacgaggagagcugccugggccaggugaccugcgugcccggcgaggugagcugcguggacggcaccugccugggcgccauccagcugugcgacggcgugugggacugccccgacggcgccgacgagggccccggccacugcccccugcccagccugcccaccccccccgccagcacccugcccggccccagccccggcagccuggacaccgccagcagcccccuggccagcgccagccccgccccccccugcggccccuucgaguucagaugcggcagcggcgagugcacccccagaggcuggagaugcgaccaggaggaggacugcgccgacggcagcgacgagagaggcugcggcggccccugcgccccccaccacgcccccugcgccagaggcccccacugcgugagccccgagcagcugugcgacggcgugagacagugccccgacggcagcgacgagggccccgacgccugcggcggccugcccgcccugggcggccccaacagaaccggccugcccugccccgaguacaccugccccaacggcaccugcaucggcuuccagcuggugugcgacggccagcccgacugcggcagacccggccaggugggccccagccccgaggagcagggcugcggcgccuggggccccuggagccccuggggccccugcagcagaaccugcggccccuggggccagggcagaagcagaagaugcagcccccugggccugcuggugcugcagaacugccccggccccgagcaccagagccaggccugcuucaccgccgccugccccguggacggcgaguggagcaccuggagccccuggagcgugugcagcgagcccugcagaggcaccaugaccagacagagacagugccacagcccccagaacggcggcagaaccugcgccgcccugcccggcggccugcacagcaccagacagaccaagcccugcccccaggacggcugccccaacgccaccugcagcggcgagcugauguuccagcccugcgcccccugcccccugaccugcgacgacaucagcggccaggugaccugcccccccgacuggcccugcggcagccccggcugcuggugccccgagggccaggugcugggcagcgagggcuggugcguguggcccagacagugccccugccugguggacggcgccagauacuggcccggccagagaaucaaggccgacugccagcugugcaucugccaggacggcagacccagaagaugcagacugaaccccgacugcgccguggacugcggcuggagcagcuggagccccugggccaagugccugggccccugcggcagccagagcauccaguggagcuucagaagcagcaacaaccccagacccagcggcagaggcagacagugcagaggcauccacagaaaggccagaagaugccagaccgagcccugcgagggcugcgagcaccagggccaggugcacagagugggcgagagauggcacggcggccccugcagagugugccagugccugcacaaccugaccgcccacugcagccccuacugcccccugggcagcugcccccagggcugggugcugguggagggcaccggcgagagcugcugccacugcgcccugcccggcgagaaccagaccgugcagcccauggccacccccgccgccgcccccgcccccagcccccagaucagauucccccuggccaccuacauccugccccccagcggcgaccccugcuacagcccccugggccuggccggccuggccgagggcagccugcacgccagcagccagcagcuggagcaccccacccaggccgcccugcugggcgcccccacccagggccccagcccccagggcuggcacgccggcggcgacgccuacgccaaguggcacaccagaccccacuaccugcagcuggaccugcugcagcccagaaaccugaccggcauccuggugcccgagaccggcagcagcaacgccuacgccagcagcuucagccugcaguucagcagcaacggccugcacuggcacgacuacagagaccugcugcccggcauccugccccugcccaagcuguuccccagaaacugggacgaccuggaccccgccguguggaccuucggcagaauggugcaggccagauucgugagaguguggccccacgacgugcaccacagcgacgugccccugcagguggagcugcugggcugcgagcccggcagcccccccgccccccugugccccggcgugggccugagaugcgccagcggcgagugcgugcugagaggcggccccugcgacggcgugcuggacugcgaggacggcagcgacgaggagggcugcgugcugcugcccgagggcaccggcagauuccacagcaccgccaagacccuggcccugagcagcgcccagcccggccagcugcugcacuggcccagagagggccuggccgagaccgagcacuggccccccggccaggagagccccaccagccccaccgagaccagacccgugagccccggccccgccagcggcgugccccaccacggcgagagcgugcagauggugaccaccacccccaucccccagauggaggccagaacccugccccccggcauggccgccgugaccguggugcccccccaccccgugacccccgccacccccgccggccagagcguggcccccggccccuucccccccgugcagugcggccccggccagacccccugcgaggugcugggcugcguggagcaggcccaggugugcgacggcagagaggacugccuggacggcagcgacgagagacacugcgccagaaaccugcugauguggcugcccagccugcccgcccugugggccgccagcaccgugcccuucaugaugcccaccauggcccugcccggccugcccgccagcagagcccugugcagccccagccagcugagcugcggcagcggcgagugccugagcgccgagagaagaugcgaccugagacccgacugccaggacggcagcgacgaggacggcugcguggacugcgugcuggcccccuggagcguguggagcagcugcagcagaagcugcggccugggccugaccuuccagagacaggagcugcugagacccccccugcccggcggcagcugccccagagacagauucagaagccagagcugcuucgugcaggccugccccguggccggcgccugggccaugugggaggccuggggccccugcagcgugagcugcggcggcggccaccagagcagacagagaagcugcguggaccccccccccaagaacggcggcgcccccugccccggcgccagccaggagagagcccccugcggccugcagcccugcagcggcggcaccgacugcgagcugggcagaguguacgugagcgccgaccugugccagaagggccuggugccccccugcccccccagcugccuggaccccaaggccaacagaagcugcagcggccacugcguggagggcugcagaugcccccccggccugcugcugcacgacaccagaugccugccccugagcgagugccccugccuggugggcgaggagcugaaguggcccggcgugagcuuccugcugggcaacugcagccagugcgugugcgagaagggcgagcugcugugccagcccggcggcugcccccugcccugcggcuggagcgccuggagcagcugggcccccugcgacagaagcugcggcagcggcgugagagccagauucagaagccccagcaacccccccgccgccuggggcggcgcccccugcgagggcgacagacaggagcugcagggcugccacaccgugugcggcaccgagguguucggcuggacccccuggaccagcuggagcagcugcagccagagcugccuggcccccggcggcggccccggcuggagaagcagaagcagacugugccccagccccggcgacagcagcugccccggcgacgccacccaggaggagcccugcagcccccccgugugccccgugcccagcaucuggggccugugggcccccuggagcaccugcagcgcccccugcgacggcggcauccagaccagaggcagaagcugcagcagccuggcccccggcgacaccaccugccccggcccccacagccagaccagagacugcaacacccagcccugcaccgcccagugccccgagaacaugcuguucagaagcgccgagcagugccaccaggagggcggccccugccccagacugugccugacccagggccccggcaucgagugcaccggcuucugcgcccccggcugcaccugcccccccggccuguuccugcacaacgccagcugccugcccagaagccagugccccugccagcugcacggccagcuguacgccagcggcgccauggccagacuggacagcugcaacaacugcaccugcgugagcggcaagauggccugcaccagcgagagaugccccguggccugcggcuggagccccuggacccuguggagccugugcagcugcagcugcaacgugggcaucagaagaagauucagagccggcaccgccccccccgccgccuucggcggcgccgagugccagggccccaccauggaggccgaguucugcagccugagacccugccccggccccggcggcgaguggggccccuggagccccugcagcgugcccugcggcggcggcuacagaaacagaaccagaggcagcagcagaagccugauggaguucagcaccugcggccugcagcccugcgccggccccgugcccggcaugugccccagagacaagcaguggcuggacugcgcccagggccccgccagcugcgccgagcugagcgcccccagaggcaccaaccagaccugccaccccggcugccacugccccagcggcaugcugcugcugaacaacgugugcgugcccacccaggacugccccugcgcccacgagggccaccuguacccccccggcagcaccguggugagacccugcgagaacugcagcugcgugagcggccugaucgccaacugcagcagcuggcccugcgccgagggcgagcccaccuggagccccuggacccccuggagccagugcagcgccagcugcggccccgccagaugccacagacacagauucugcgccagaagccccagcgccgugcccagcaccguggccccccugccccugcccgccacccccaccccccugugcagcggccccgaggccgaggaggagcccugccugcugcagggcugcgacagagccggcggcuggggccccuggggccccuggagccacugcagcagaagcugcggcggcggccugagaagcagaaccagagccugcgaccagccccccccccagggccugggcgacuacugcgagggccccagagcccagggcgaggugugccaggcccugcccugccccgugaccaacugcaccgccaucgagggcgccgaguacagccccugcggcccccccugccccagaagcugcgacgaccuggugcacugcguguggagaugccagcccggcugcuacugcccccccggccaggugcugagcagcaacggcgccaucugcgugcagcccggccacugcagcugccuggaccugcugaccggccagagacaccaccccggcgccagacuggccagacccgacggcugcaaccacugcaccugccuggagggcagacugaacugcaccgaccugcccugccccgugcccggcggcuggugccccuggagcgaguggaccaugugcagccagcccugcagaggccagaccagaagcagaagcagagccugcgccugccccaccccccagcacggcggcgcccccugcaccggcgaggccggcgaggccggcgcccagcaccagagagaggccugccccagcuacgccaccugccccguggacggcgccuggggccccuggggccccuggagccccugcgacaugugccugggccagagccacagaagcagagccugcagcagaccccccacccccgagggcggcagacccugccccggcaaccacacccagagcagacccugccaggagaacagcacccagugcaccgacugcggcggcggccagagccugcaccccugcggccagcccugccccagaagcugccaggaccugagccccggcagcgugugccagcccggcagcgugggcugccagcccaccugcggcugcccccugggccagcugagccaggacggccugugcgugccccccgcccacugcagaugccaguaccagcccggcgccaugggcauccccgagaaccagagcagaagcgccggcagcagauucagcagcugggagagccuggagcccggcgagguggugaccggccccugcgacaacugcaccugcguggccggcauccugcagugccaggaggugcccgacugccccgaccccggcguguggagcagcuggggccccugggaggacugcagcgugagcugcggcggcggcgagcagcugagaagcagaagaugcgccagaccccccugccccggccccgccagacagagcagaaccugcagcacccaggugugcagagaggccggcugccccgccggcagacuguacagagagugccagcccggcgagggcugccccuucagcugcgcccacgugacccagcaggugggcugcuucagcgagggcugcgaggagggcugccacugccccgagggcaccuuccagcacagacuggccugcgugcaggagugccccugcgugcugaccgccuggcugcugcaggagcugggcgccaccaucggcgaccccggccagccccugggccccggcgacgagcuggacagcggccagacccugagaaccagcugcggcaacugcagcugcgcccacggcaagcugagcugcagccuggacgacugcuucgaggccgacggcggcuucggccccuggagccccuggggccccugcagcagaagcugcggcggccugggcaccagaaccagaagcagacagugcgugcugaccaugcccacccugagcggccagggcugcagaggccccagacaggaccuggagugccccagccccgacugccccggcgccgagggcagcaccguggagcccgugaccggccugcccggcggcuggggccccuggagcagcuggagccccugcagcagaagcugcaccgaccccgccagacccgccuggagaagcagaaccagacugugccuggccaacugcaccaugggcgacccccugcaggagagacccugcaaccugcccagcugcaccgagcugcccgugugccccggccccggcugcggcgccggcaacugcagcuggaccagcugggcccccugggagcccugcagcagaagcugcggcgugggccagcagagaagacugagagccuacagaccccccggccccggcggccacuggugccccaacauccugaccgccuaccaggagagaagauucugcaaccugagagccugccccgugcccggcggcuggagcagauggagccccuggagcuggugcgacagaagcugcggcggcggccagagccugagaagcagaagcugcagcagcccccccagcaagaacggcggcgcccccugcgccggcgagagacaccaggccagacugugcaaccccaugcccugcgaggccggcugccccgccggcauggagguggugaccugcgccaacagaugccccagaagaugcagcgaccugcaggagggcaucgugugccaggacgaccaggugugccagaagggcugcagaugccccaagggcagccuggagcaggacggcggcugcgugcccaucggccacugcgacugcaccgacgcccagggccacagcugggcccccggcagccagcaccaggacgccugcaacaacugcagcugccaggccggccagcugagcugcaccgcccagcccugccccccccccacccacugcgccuggagccacuggagcgccuggagccccugcagccacagcugcggccccagaggccagcagagcagauucagaagcagcaccagcggcagcugggcccccgagugcagagaggagcagagccagagccagcccugcccccagcccagcugccccccccugugccugcagggcaccagaagcagaacccugggcgacagcuggcugcagggcgagugccagagaugcagcugcacccccgagggcgugaucugcgaggacaccgagugcgccgugcccgaggccuggacccuguggagcagcuggagcgacugccccgugagcugcggcggcggcaaccaggugagaaccagagccugcagagccgccgccccccaccacagaagcccccccugccugggccccgacacccagaccagacagcagcccugccccggccugcuggaggccugcagcuggggccccuggggccccugcagcagaagcugcggccccggccuggccagcagaagcggcagcugccccugccugauggccaaggccgaccccaccugcaacagcaccuuccugcaccuggacacccagggcugcuacagcggccccugccccgaggagugcguguggagcagcuggagcagcuggaccagaugcagcugcagagugcuggugcagcagagauacagacaccagggccccgccagcagaggcgccagagccggcgcccccugcaccagacuggacggccacuucagacccugccugaucagcaacugcagcgaggacagcugcaccccccccuucgaguuccacgccugcggcagccccugcgccggccugugcgccacccaccugagccaccagcugugccaggaccugccccccugccagcccggcugcuacugccccaagggccugcuggagcaggccggcggcugcaucccccccgaggagugcaacugcuggcacaccagcgccgccggcgccggcaugacccuggcccccggcgacagacugcagcugggcugcaaggagugcgagugcagaagaggcgagcugcacugcaccagccagggcugccagggccugcugccccugagcgaguggagcgaguggagccccugcggccccugccugccccccagcgcccuggcccccgccagcagaaccgcccuggaggagcacuggcugagagaccccaccggccugagccccacccuggccccccugcuggccagcgagcagcacagacacagacugugccuggaccccgccaccggcagacccuggaccggcgccccccaccugugcaccgccccccugagccagcagagacugugccccgaccccggcgccugccccgacagcugccaguggagccuguggggccccuggagccccugccaggugcccugcagcggcggcuucagacugagauggagagaggccgaggcccugugcggcggcggcugcagagagcccugggcccaggagagcugcaacggcggccccugccccgagugcgaggcccaggacaccguguucacccuggacugcgccaaccagugcccccacagcugcgccgaccugugggacagagugcagugccugcagggccccugcagacccggcugcagaugcccccccggccagcuggugcaggacggcagaugcgugcccaucagcagcugcagaugcggccugcccagcgccaacgccagcugggagcuggcccccgcccaggccgugcagcuggacugccagaacugcaccugcgugaacgagagccuggugugcccccaccaggagugccccgugcugggccccuggagcgccuggagcagcugcagcgcccccugcggcggcggcaccauggagagacacagaaccugcgagggcggccccggcguggcccccugccaggcccaggacaccgagcagagacaggagugcaaccugcagcccugccccgagugcccccccggccaggugcugagcgccugcgccaccagcugccccugccugugcuggcaccugcagcccggcgccaucugcgugcaggagcccugccagcccggcugcggcugccccggcggccagcugcugcacaacggcaccugcgugccccccaccgccugccccugcacccagcacagccugcccuggggccugacccugacccuggaggagcaggcccaggagcugccccccggcaccgugcugaccagaaacugcaccagaugcgugugccacggcggcgccuucagcugcagccugguggacugccaggugccccccggcgagaccuggcagcagguggcccccggcgagcugggccugugcgagcagaccugccuggagaugaacgccaccaagacccagagcaacugcagcagcgccagagccagcggcugcgugugccagcccggccacuucagaagccaggccggccccugcgugcccgaggaccacugcgagugcuggcaccugggcagaccccaccugcccggcagcgaguggcaggaggccugcgagagcugccugugccugagcggcagacccgugugcacccagcacugcagcccccugaccugcgcccagggcgaggagauggugcuggagcccggcagcugcugccccagcugcagaagagaggcccccgaggagcagagccccagcugccagcugcugaccgagcugagaaacuucaccaagggcaccugcuaccuggaccagguggaggugagcuacugcagcggcuacugccccagcagcacccacgugaugcccgaggagcccuaccugcagagccagugcgacugcugcagcuacagacuggaccccgagagccccgugagaauccugaaccugagaugccugggcggccacaccgagcccguggugcugcccgugauccacagcugccagugcagcagcugccagggcggcgacuucagcaagagauaa

SEQ ID NO: 24071 - RNA, 861 nt, Artificial Sequence
  SSR1__Homo_sapiens__NP_003135
augagacugcugcccagacugcugcugcugcugcugcugguguuccccgccaccgugcuguucagaggcggccccagaggccugcuggccguggcccaggaccugaccgaggacgaggagaccguggaggacagcaucaucgaggacgaggacgacgaggccgagguggaggaggacgagcccaccgaccugguggaggacaaggaggaggaggacgugagcggcgagcccgaggccagccccagcgccgacaccaccauccuguucgugaagggcgaggacuuccccgccaacaacaucgugaaguuccuggugggcuucaccaacaagggcaccgaggacuucaucguggagagccuggacgccagcuucagauacccccaggacuaccaguucuacauccagaacuucaccgcccugccccugaacaccguggugcccccccagagacaggccaccuucgaguacagcuucauccccgccgagcccaugggcggcagacccuucggccuggugaucaaccugaacuacaaggaccugaacggcaacguguuccaggacgccguguucaaccagaccgugaccgugaucgagagagaggacggccuggacggcgagaccaucuucauguacauguuccuggccggccugggccugcuggugaucgugggccugcaccagcugcuggagagcagaaagagaaagagacccauccagaagguggagaugggcaccagcagccagaacgacguggacaugagcuggaucccccaggagacccugaaccagaucaacaaggccagccccagaagacugcccagaaagagagcccagaagagaagcgugggcagcgacgaguaa

SEQ ID NO: 24072 - RNA, 609 nt, Artificial Sequence
  SSR2__Homo_sapiens__XP_011508225
augcugacccugagcagcugccugugcggcagcggcaaggccuucggcaugcccaccaugagacugcugagcuucguggugcuggcccuguucgccgugacccaggccgaggagggcgccagacugcuggccagcaagagccugcugaacagauacgccguggagggcagagaccugacccugcaguacaacaucuacaacgugggcagcagcgccgcccuggacguggagcugagcgacgacagcuucccccccgaggacuucggcaucgugagcggcaugcugaacgugaagugggacagaaucgcccccgccagcaacgugagccacaccguggugcugagaccccugaaggccggcuacuucaacuucaccagcgccaccaucaccuaccuggcccaggaggacggccccguggugaucggcagcaccagcgcccccggccagggcggcauccuggcccagagagaguucgacagaagauucagcccccacuuccuggacugggccgccuucggcgugaugacccugcccagcaucggcaucccccugcugcugugguacagcagcaagagaaaguacgacacccccaagaccaagaagaacuaa

SEQ ID NO: 24073 - RNA, 2130 nt, Artificial Sequence
  SSRP1__Homo_sapiens__NP_003137
auggccgagacccuggaguucaacgacguguaccaggaggugaagggcagcaugaacgacggcagacugagacugagcagacagggcaucaucuucaagaacagcaagaccggcaagguggacaacauccaggccggcgagcugaccgagggcaucuggagaagaguggcccugggccacggccugaagcugcugaccaagaacggccacguguacaaguacgacggcuucagagagagcgaguucgagaagcugagcgacuucuucaagacccacuacagacuggagcugauggagaaggaccugugcgugaagggcuggaacuggggcaccgugaaguucggcggccagcugcugagcuucgacaucggcgaccagcccguguucgagaucccccugagcaacgugagccagugcaccaccggcaagaacgaggugacccuggaguuccaccagaacgacgacgccgaggugagccugauggaggugagauucuacgugccccccacccaggaggacggcguggaccccguggaggccuucgcccagaacgugcugagcaaggccgacgugauccaggccaccggcgacgccaucugcaucuucagagagcugcagugccugacccccagaggcagauacgacaucagaaucuaccccaccuuccugcaccugcacggcaagaccuucgacuacaagauccccuacaccaccgugcugagacuguuccugcugccccacaaggaccagagacagauguucuucgugaucagccuggacccccccaucaagcagggccagaccagauaccacuuccugauccugcuguucagcaaggacgaggacaucagccugacccugaacaugaacgaggaggagguggagaagagauucgagggcagacugaccaagaacaugagcggcagccuguacgagauggugagcagagugaugaaggcccuggugaacagaaagaucaccgugcccggcaacuuccagggccacagcggcgcccagugcaucaccugcagcuacaaggccagcagcggccugcuguacccccuggagagaggcuucaucuacgugcacaagccccccgugcacaucagauucgacgagaucagcuucgugaacuucgccagaggcaccaccaccaccagaagcuucgacuucgagaucgagaccaagcagggcacccaguacaccuucagcagcaucgagagagaggaguacggcaagcuguucgacuucgugaacgccaagaagcugaacaucaagaacagaggccugaaggagggcaugaaccccagcuacgacgaguacgccgacagcgacgaggaccagcacgacgccuaccuggagagaaugaaggaggagggcaagaucagagaggagaacgccaacgacagcagcgacgacagcggcgaggagaccgacgagagcuucaaccccggcgaggaggaggaggacguggccgaggaguucgacagcaacgccagcgccagcagcagcagcaacgagggcgacagcgacagagacgagaagaagagaaagcagcugaagaaggccaagauggccaaggacagaaagagcagaaagaagcccguggaggugaagaagggcaaggaccccaacgcccccaagagacccaugagcgccuacaugcuguggcugaacgccagcagagagaagaucaagagcgaccaccccggcaucagcaucaccgaccugagcaagaaggccggcgagaucuggaagggcaugagcaaggagaagaaggaggagugggacagaaaggccgaggacgccagaagagacuacgagaaggccaugaaggaguacgagggcggcagaggcgagagcagcaagagagacaagagcaagaagaagaagaaggugaaggugaagauggagaagaagagcacccccagcagaggcagcagcagcaagagcagcagcagacagcugagcgagagcuucaagagcaaggaguucgugagcagcgacgagagcagcagcggcgagaacaagagcaagaagaagagaagaagaagcgaggacagcgaggaggaggagcuggccagcaccccccccagcagcgaggacagcgccagcggcagcgacgaguaa

SEQ ID NO: 24074 - RNA, 600 nt, Artificial Sequence
  SSSCA1__Homo_sapiens__NP_006387
auggcccugaacggcgccgagguggacgacuucagcugggagccccccaccgaggccgagaccaaggugcugcaggccagaagagagagacaggacagaaucagcagacugaugggcgacuaccugcugagaggcuacagaaugcugggcgagaccugcgccgacugcggcaccauccugcugcaggacaagcagagaaagaucuacugcguggccugccaggagcuggacagcgacguggacaaggacaaccccgcccugaacgcccaggccgcccugagccaggccagagagcaccagcuggccagcgccagcgagcugccccugggcagcagacccgccccccagccccccgugcccagacccgagcacugcgagggcgccgccgccggccugaaggccgcccagggcccccccgcccccgccgugccccccaacaccgacgugauggccugcacccagaccgcccugcugcagaagcugaccugggccagcgccgagcugggcagcagcaccagccuggagaccagcauccagcugugcggccugaucagagccugcgccgaggcccugagaagccugcagcagcugcagcacuaa

SEQ ID NO: 24075 - RNA, 351 nt, Artificial Sequence
  SST__Homo_sapiens__NP_001039
augcugagcugcagacugcagugcgcccuggccgcccugagcaucgugcuggcccugggcugcgugaccggcgcccccagcgaccccagacugagacaguuccugcagaagagccuggccgccgccgccggcaagcaggagcuggccaaguacuuccuggccgagcugcugagcgagcccaaccagaccgagaacgacgcccuggagcccgaggaccugagccaggccgccgagcaggacgagaugagacuggagcugcagagaagcgccaacagcaaccccgccauggcccccagagagagaaaggccggcugcaagaacuucuucuggaagaccuucaccagcugcuaa

SEQ ID NO: 24076 - RNA, 1176 nt, Artificial Sequence
  SSTR1__Homo_sapiens__NP_001040
auguuccccaacggcaccgccagcagccccagcagcagccccagccccagccccggcagcugcggcgagggcggcggcagcagaggccccggcgccggcgccgccgacggcauggaggagcccggcagaaacgccagccagaacggcacccugagcgagggccagggcagcgccauccugaucagcuucaucuacagcguggugugccuggugggccugugcggcaacagcauggugaucuacgugauccugagauacgccaagaugaagaccgccaccaacaucuacauccugaaccuggccaucgccgacgagcugcugaugcugagcgugcccuuccuggugaccagcacccugcugagacacuggcccuucggcgcccugcugugcagacuggugcugagcguggacgccgugaacauguucaccagcaucuacugccugaccgugcugagcguggacagauacguggccguggugcaccccaucaaggccgccagauacagaagacccaccguggccaagguggugaaccugggcgugugggugcugagccugcuggugauccugcccaucgugguguucagcagaaccgccgccaacagcgacggcaccguggccugcaacaugcugaugcccgagcccgcccagagauggcuggugggcuucgugcuguacaccuuccugaugggcuuccugcugcccgugggcgccaucugccugugcuacgugcugaucaucgccaagaugagaaugguggcccugaaggccggcuggcagcagagaaagagaagcgagagaaagaucacccugauggugaugaugguggugaugguguucgugaucugcuggaugcccuucuacguggugcagcuggugaacguguucgccgagcaggacgacgccaccgugagccagcugagcgugauccugggcuacgccaacagcugcgccaaccccauccuguacggcuuccugagcgacaacuucaagagaagcuuccagagaauccugugccugagcuggauggacaacgccgccgaggagcccguggacuacuacgccaccgcccugaagagcagagccuacagcguggaggacuuccagcccgagaaccuggagagcggcggcguguucagaaacggcaccugcaccagcagaaucaccacccuguaa

SEQ ID NO: 24077 - RNA, 1110 nt, Artificial Sequence
  SSTR2__Homo_sapiens__NP_001041
auggacauggccgacgagccccugaacggcagccacaccuggcugagcauccccuucgaccugaacggcagcguggugagcaccaacaccagcaaccagaccgagcccuacuacgaccugaccagcaacgccgugcugaccuucaucuacuucguggugugcaucaucggccugugcggcaacacccuggugaucuacgugauccugagauacgccaagaugaagaccaucaccaacaucuacauccugaaccuggccaucgccgacgagcuguucaugcugggccugcccuuccuggccaugcagguggcccuggugcacuggcccuucggcaaggccaucugcagaguggugaugaccguggacggcaucaaccaguucaccagcaucuucugccugaccgugaugagcaucgacagauaccuggccguggugcaccccaucaagagcgccaaguggagaagacccagaaccgccaagaugaucaccauggccguguggggcgugagccugcuggugauccugcccaucaugaucuacgccggccugagaagcaaccaguggggcagaagcagcugcaccaucaacuggcccggcgagagcggcgccugguacaccggcuucaucaucuacaccuucauccugggcuuccuggugccccugaccaucaucugccugugcuaccuguucaucaucaucaaggugaagagcagcggcaucagagugggcagcagcaagagaaagaagagcgagaagaaggugaccagaauggugagcaucgugguggccguguucaucuucugcuggcugcccuucuacaucuucaacgugagcagcgugagcauggccaucagccccacccccgcccugaagggcauguucgacuucgugguggugcugaccuacgccaacagcugcgccaaccccauccuguacgccuuccugagcgacaacuucaagaagagcuuccagaacgugcugugccuggugaaggugagcggcaccgacgacggcgagagaagcgacagcaagcaggacaagagcagacugaacgagaccaccgagacccagagaacccugcugaacggcgaccugcagaccagcaucuaa

SEQ ID NO: 24078 - RNA, 1257 nt, Artificial Sequence
  SSTR3__Homo_sapiens__XP_005261778
auggacaugcugcaccccagcagcgugagcaccaccagcgagcccgagaacgccagcagcgccuggccccccgacgccacccugggcaacgugagcgccggccccagccccgccggccuggccgugagcggcgugcugaucccccugguguaccugguggugugcguggugggccugcugggcaacagccuggugaucuacguggugcugagacacaccgccagccccagcgugaccaacguguacauccugaaccuggcccuggccgacgagcuguucaugcugggccugcccuuccuggccgcccagaacgcccugagcuacuggcccuucggcagccugaugugcagacuggugauggccguggacggcaucaaccaguucaccagcaucuucugccugaccgugaugagcguggacagauaccuggccguggugcaccccaccagaagcgccagauggagaaccgcccccguggccagaaccgugagcgccgccguguggguggccagcgccgugguggugcugcccguggugguguucagcggcgugcccagaggcaugagcaccugccacaugcaguggcccgagcccgccgccgccuggagagccggcuucaucaucuacaccgccgcccugggcuucuucggcccccugcuggugaucugccugugcuaccugcugaucguggugaaggugagaagcgccggcagaagagugugggcccccagcugccagagaagaagaagaagcgagagaagagugaccagaauggugguggccgugguggcccuguucgugcugugcuggaugcccuucuacgugcugaacaucgugaacguggugugcccccugcccgaggagcccgccuucuucggccuguacuuccuggugguggcccugcccuacgccaacagcugcgccaaccccauccuguacggcuuccugagcuacagauucaagcagggcuucagaagagugcugcugagacccagcagaagagugagaagccaggagcccaccgugggcccccccgagaagaccgaggaggaggacgaggaggaggaggacggcgaggagagcagagagggcggcaagggcaaggagaugaacggcagagugagccagaucacccagcccggcaccagcggccaggagagaccccccagcagaguggccagcaaggagcagcagcugcugccccaggaggccagcaccggcgagaagagcagcaccaugagaaucagcuaccuguaa

SEQ ID NO: 24079 - RNA, 1167 nt, Artificial Sequence
  SSTR4__Homo_sapiens__NP_001043
augagcgcccccagcacccugccccccggcggcgaggagggccugggcaccgccuggcccagcgccgccaacgccagcagcgcccccgccgaggccgaggaggccguggccggccccggcgacgccagagccgccggcaugguggccauccagugcaucuacgcccuggugugccuggugggccuggugggcaacgcccuggugaucuucgugauccugagauacgccaagaugaagaccgccaccaacaucuaccugcugaaccuggccguggccgacgagcuguucaugcugagcgugcccuucguggccagcagcgccgcccugagacacuggcccuucggcagcgugcugugcagagccgugcugagcguggacggccugaacauguucaccagcguguucugccugaccgugcugagcguggacagauacguggccguggugcacccccugagagccgccaccuacagaagacccagcguggccaagcugaucaaccugggcguguggcuggccagccugcuggugacccugcccaucgccaucuucgccgacaccagacccgccagaggcggccaggccguggccugcaaccugcaguggccccaccccgccuggagcgccguguucgugguguacaccuuccugcugggcuuccugcugcccgugcuggccaucggccugugcuaccugcugaucgugggcaagaugagagccguggcccugagagccggcuggcagcagagaagaagaagcgagaagaagaucaccagacuggugcugauggugguggugguguucgugcugugcuggaugcccuucuacguggugcagcugcugaaccuguucgugaccagccuggacgccaccgugaaccacgugagccugauccugagcuacgccaacagcugcgccaaccccauccuguacggcuuccugagcgacaacuucagaagauucuuccagagagugcugugccugagaugcugccugcuggagggcgccggcggcgccgaggaggagccccuggacuacuacgccaccgcccugaagagcaagggcggcgccggcugcaugugccccccccugcccugccagcaggaggcccugcagcccgagcccggcagaaagagaaucccccugaccagaaccaccaccuucuaa

SEQ ID NO: 24080 - RNA, 1095 nt, Artificial Sequence
  SSTR5__Homo_sapiens__NP_001166031
auggagccccuguuccccgccagcacccccagcuggaacgccagcagccccggcgccgccagcggcggcggcgacaacagaacccuggugggccccgcccccagcgccggcgccagagccgugcuggugcccgugcuguaccugcuggugugcgccgccggccugggcggcaacacccuggugaucuacguggugcugagauucgccaagaugaagaccgugaccaacaucuacauccugaaccuggccguggccgacgugcuguacaugcugggccugcccuuccuggccacccagaacgccgccagcuucuggcccuucggccccgugcugugcagacuggugaugacccuggacggcgugaaccaguucaccagcguguucugccugaccgugaugagcguggacagauaccuggccguggugcacccccugagcagcgccagauggagaagacccagaguggccaagcuggccagcgccgccgccugggugcugagccugugcaugagccugccccugcugguguucgccgacgugcaggagggcggcaccugcaacgccagcuggcccgagcccgugggccuguggggcgccguguucaucaucuacaccgccgugcugggcuucuucgccccccugcuggugaucugccugugcuaccugcugaucguggugaaggugagagccgccggcgugagagugggcugcgugagaagaagaagcgagagaaaggugaccagaauggugcuggugguggugcugguguucgccggcugcuggcugcccuucuucaccgugaacaucgugaaccuggccguggcccugccccaggagcccgccagcgccggccuguacuucuucguggugauccugagcuacgccaacagcugcgccaaccccgugcuguacggcuuccugagcgacaacuucagacagagcuuccagaaggugcugugccugagaaagggcagcggcgccaaggacgccgacgccaccgagcccagacccgacagaaucagacagcagcaggaggccaccccccccgcccacagagccgccgccaacggccugaugcagaccagcaagcuguaa

SEQ ID NO: 24081 - RNA, 1128 nt, Artificial Sequence
  SSUH2__Homo_sapiens__NP_001243677
auggacagagaccugaacgaggacgacagcgugguggaccugagcuucgaggccgagagcccccuggccccccccaccgagcugcuggagagacugcccagcuacgacuggcugcugcagggcggcagaggccagaucuucuuccccccccuggaggcccccggcagaccccaggagcagagaagcuggcccagcuuccuggagcacagagugcccgccaugaccgaggagguggccagagaggcccugcugagcuucguggacagcaagugcugcuacagcagcaccguggccggcgaccuggugauccaggagcugaagagacagacccugugcagauacagacuggagaccuucagcgagagcagaaucagcgaguggaccuuccagcccuucaccaaccacagcguggacggcccccagagaggcgccagccccagacugugggacaucaaggugcagggcccccccauguuccaggaggacaccagaaaguuccaggugccccacagcagccuggugaaggagugccacaagugccacggcagaggcagauacaagugcagcggcugccacggcgccggcaccgugagaugccccagcugcugcggcgccaagagaaaggccaagcagagcagaagaugccagcugugcgccggcagcggcagaagaagaugcagcaccugcagcggcagaggcaacaagaccugcgccaccugcaagggcgagaagaagcugcugcacuucauccagcuggugaucauguggaagaacagccuguucgaguucgugagcgagcacagacugaacugccccagagagcugcuggccaaggccaagggcgagaaccuguucaaggacgagaacagcgugguguaccccaucguggacuucccccugagagacaucagccuggccagccagagaggcaucgccgagcacagcgccgcccuggccagcagagccagagugcugcagcagagacagaccaucgagcugaucccccugaccgaggugcacuacugguaccagggcaagaccuacguguacuacaucuacggcaccgaccaccagguguacgccguggacuaccccgagagauacugcugcggcugcaccaucguguaa

SEQ ID NO: 24082 - RNA, 567 nt, Artificial Sequence
  SSX1__Homo_sapiens__NP_005626
augaacggcgacgacaccuucgccaagagacccagagacgacgccaaggccagcgagaagagaagcaaggccuucgacgacaucgccaccuacuucagcaagaaggaguggaagaagaugaaguacagcgagaagaucagcuacguguacaugaagagaaacuacaaggccaugaccaagcugggcuucaaggugacccugccccccuucaugugcaacaagcaggccaccgacuuccagggcaacgacuucgacaacgaccacaacagaagaauccagguggagcacccccagaugaccuucggcagacugcacagaaucauccccaagaucaugcccaagaagcccgccgaggacgagaacgacagcaagggcgugagcgaggccagcggcccccagaacgacggcaagcagcugcacccccccggcaaggccaacaucagcgagaagaucaacaagagaagcggccccaagagaggcaagcacgccuggacccacagacugagagagagaaagcagcuggugaucuacgaggagaucagcgaccccgaggaggacgacgaguaa

SEQ ID NO: 24083 - RNA, 567 nt, Artificial Sequence
  SSX2B__Homo_sapiens__NP_001157889
augaacggcgacgacgccuucgccagaagacccaccgugggcgcccagauccccgagaagauccagaaggccuucgacgacaucgccaaguacuucagcaaggaggagugggagaagaugaaggccagcgagaagaucuucuacguguacaugaagagaaaguacgaggccaugaccaagcugggcuucaaggccacccugccccccuucaugugcaacaagagagccgaggacuuccagggcaacgaccuggacaacgaccccaacagaggcaaccagguggagagaccccagaugaccuucggcagacugcagggcaucagccccaagaucaugcccaagaagcccgccgaggagggcaacgacagcgaggaggugcccgaggccagcggcccccagaacgacggcaaggagcugugcccccccggcaagcccaccaccagcgagaagauccacgagagaagcggccccaagagaggcgagcacgccuggacccacagacugagagagagaaagcagcuggugaucuacgaggagaucagcgaccccgaggaggacgacgaguaa

SEQ ID NO: 24084 - RNA, 1521 nt, Artificial Sequence
  SSX2IP__Homo_sapiens__XP_011538914
augggcgacuggaugaccgugaccgaccccggccugagcagcgagagcaagaccaucagccaguacaccagcgagaccaagaugagccccagcagccuguacagccagcaggugcugugcagcagcaucccccugagcaagaacgugcacagcuucuucagcgccuucugcaccgaggacaacaucgagcagagcaucagcuaccuggaccaggagcugaccaccuucggcuuccccagccuguacgaggagagcaagggcaaggagaccaagagagagcugaacaucguggccgugcugaacugcaugaacgagcugcuggugcugcagagaaagaaccugcuggcccaggagaacguggagacccagaaccugaagcugggcagcgacauggaccaccugcagagcugcuacagcaagcugaaggagcagcuggagaccagcagaagagagaugaucggccugcaggagagagacagacagcugcagugcaagaacagaaaccugcaccagcugcugaagaacgagaaggacgaggugcagaagcugcagaacaucaucgccagcagagccacccaguacaaccacgacaugaagagaaaggagagagaguacaacaagcugaaggagagacugcaccagcuggugaugaacaagaaggacaagaagaucgccauggacauccugaacuacgugggcagagccgacggcaagagaggcagcuggagaaccggcaagaccgaggccagaaacgaggacgagauguacaagauccugcugaacgacuacgaguacagacagaagcagauccugauggagaacgccgagcugaagaaggugcugcagcagaugaagaaggagaugaucagccugcugagcccccagaagaagaagcccagagagagaguggacgacagcaccggcaccgugaucagcgacguggaggaggacgccggcgagcugagcagagagagcaugugggaccugagcugcgagaccgugagagagcagcugaccaacagcaucagaaagcaguggagaauccugaagagccacguggagaagcuggacaaccaggugagcaaggugcaccuggagggcuucaacgacgaggacgugaucagcagacaggaccacgagcaggagaccgagaagcuggagcuggagauccagcagugcaaggagaugaucaagacccagcagcagcugcugcagcagcagcuggccaccgccuacgacgacgacaccaccagccugcugagagacugcuaccugcuggaggagaaggagagacugaaggaggaguggagccuguucaaggagcagaagaagaacuucgagagagagagaagaagcuucaccgaggccgccaucagacugggccuggagagaaaggccuucgaggaggagagagccagcuggcugaagcagcaguuccugaacaugaccaccuucgaccaccagaacagcgagaacgugaagcuguucagcgccuucagcggcauccagagcauguacuaa

SEQ ID NO: 24085 - RNA, 567 nt, Artificial Sequence
  SSX4B__Homo_sapiens__NP_001030004
augaacggcgacgacgccuucgccagaagacccagagacgacgcccagaucagcgagaagcugagaaaggccuucgacgacaucgccaaguacuucagcaagaaggagugggagaagaugaagagcagcgagaagaucguguacguguacaugaagcugaacuacgaggugaugaccaagcugggcuucaaggugacccugccccccuucaugagaagcaagagagccgccgacuuccacggcaacgacuucggcaacgacagaaaccacagaaaccagguggagagaccccagaugaccuucggcagccugcagagaaucuuccccaagaucaugcccaagaagcccgccgaggaggagaacggccugaaggaggugcccgaggccagcggcccccagaacgacggcaagcagcugugcccccccggcaaccccagcacccuggagaagaucaacaagaccagcggccccaagagaggcaagcacgccuggacccacagacugagagagagaaagcagcuggugguguacgaggagaucagcgaccccgaggaggacgacgaguaa

SEQ ID NO: 24086 - RNA, 690 nt, Artificial Sequence
  SSX5__Homo_sapiens__NP_066295
augaacggcgacgacgccuucgugagaagacccagagugggcagccagauccccgagaagaugcagaagcaccccuggagacaggugugcgacagaggcauccaccuggugaaccugagccccuucuggaaggugggcagagagcccgccagcagcaucaaggcccugcugugcggcagaggcgaggccagagccuucgacgacaucgccaaguacuucagcgagaaggagugggagaagaugaaggccagcgagaagaucaucuacguguacaugaagagaaaguacgaggccaugaccaagcugggcuucaaggccacccugccccccuucaugagaaacaagagaguggccgacuuccagggcaacgacuucgacaacgaccccaacagaggcaaccagguggagcacccccagaugaccuucggcagacugcagggcaucuuccccaagaucacccccgagaagcccgccgaggagggcaacgacagcaagggcgugcccgaggccagcggcccccagaacaacggcaagcagcugagacccagcggcaagcugaacaccagcgagaaggugaacaagaccagcggccccaagagaggcaagcacgccuggacccacagagugagagagagaaagcagcuggugaucuacgaggagaucagcgacccccaggaggacgacgaguaa

SEQ ID NO: 24087 - RNA, 1110 nt, Artificial Sequence
  ST13__Homo_sapiens__NP_003923
auggaccccagaaaggugaacgagcugagagccuucgugaagaugugcaagcaggaccccagcgugcugcacaccgaggagaugagauuccugagagaguggguggagagcaugggcggcaaggugccccccgccacccagaaggccaagagcgaggagaacaccaaggaggagaagcccgacagcaagaagguggaggaggaccugaaggccgacgagcccagcagcgaggagagcgaccuggagaucgacaaggagggcgugaucgagcccgacaccgacgccccccaggagaugggcgacgagaacgccgagaucaccgaggagaugauggaccaggccaacgacaagaagguggccgccaucgaggcccugaacgacggcgagcugcagaaggccaucgaccuguucaccgacgccaucaagcugaaccccagacuggccauccuguacgccaagagagccagcguguucgugaagcugcagaagcccaacgccgccaucagagacugcgacagagccaucgagaucaaccccgacagcgcccagcccuacaaguggagaggcaaggcccacagacugcugggccacugggaggaggccgcccacgaccuggcccuggccugcaagcuggacuacgacgaggacgccagcgccaugcugaaggaggugcagcccagagcccagaagaucgccgagcacagaagaaaguacgagagaaagagagaggagagagagaucaaggagagaaucgagagagugaagaaggccagagaggagcacgagagagcccagagagaggaggaggccagaagacagagcggcgcccaguacggcagcuuccccggcggcuuccccggcggcaugcccggcaacuuccccggcggcaugcccggcaugggcggcggcaugcccggcauggccggcaugcccggccugaacgagauccugagcgaccccgaggugcuggccgccaugcaggaccccgaggugaugguggccuuccaggacguggcccagaaccccgccaacaugagcaaguaccagagcaaccccaaggugaugaaccugaucagcaagcugagcgccaaguucggcggccaggccuaa

SEQ ID NO: 24088 - RNA, 2568 nt, Artificial Sequence
  ST14__Homo_sapiens__NP_068813
augggcagcgacagagccagaaagggcggcggcggccccaaggacuucggcgccggccugaaguacaacagcagacacgagaaggugaacggccuggaggagggcguggaguuccugcccgugaacaacgugaagaagguggagaagcacggccccggcagauggguggugcuggccgccgugcugaucggccugcugcuggugcugcugggcaucggcuuccugguguggcaccugcaguacagagacgugagagugcagaagguguucaacggcuacaugagaaucaccaacgagaacuucguggacgccuacgagaacagcaacagcaccgaguucgugagccuggccagcaaggugaaggacgcccugaagcugcuguacagcggcgugcccuuccugggccccuaccacaaggagagcgccgugaccgccuucagcgagggcagcgugaucgccuacuacuggagcgaguucagcaucccccagcaccugguggaggaggccgagagagugauggccgaggagagaguggugaugcugccccccagagccagaagccugaagagcuucguggugaccagcgugguggccuuccccaccgacagcaagaccgugcagagaacccaggacaacagcugcagcuucggccugcacgccagaggcguggagcugaugagauucaccacccccggcuuccccgacagccccuaccccgcccacgccagaugccagugggcccugagaggcgacgccgacagcgugcugagccugaccuucagaagcuucgaccuggccagcugcgacgagagaggcagcgaccuggugaccguguacaacacccugagccccauggagccccacgcccuggugcagcugugcggcaccuacccccccagcuacaaccugaccuuccacagcagccagaacgugcugcugaucacccugaucaccaacaccgagagaagacaccccggcuucgaggccaccuucuuccagcugcccagaaugagcagcugcggcggcagacugagaaaggcccagggcaccuucaacagccccuacuaccccggccacuacccccccaacaucgacugcaccuggaacaucgaggugcccaacaaccagcacgugaaggugagauucaaguucuucuaccugcuggagcccggcgugcccgccggcaccugccccaaggacuacguggagaucaacggcgagaaguacugcggcgagagaagccaguucguggugaccagcaacagcaacaagaucaccgugagauuccacagcgaccagagcuacaccgacaccggcuuccuggccgaguaccugagcuacgacagcagcgaccccugccccggccaguucaccugcagaaccggcagaugcaucagaaaggagcugagaugcgacggcugggccgacugcaccgaccacagcgacgagcugaacugcagcugcgacgccggccaccaguucaccugcaagaacaaguucugcaagccccuguucugggugugcgacagcgugaacgacugcggcgacaacagcgacgagcagggcugcagcugccccgcccagaccuucagaugcagcaacggcaagugccugagcaagagccagcagugcaacggcaaggacgacugcggcgacggcagcgacgaggccagcugccccaaggugaacguggugaccugcaccaagcacaccuacagaugccugaacggccugugccugagcaagggcaaccccgagugcgacggcaaggaggacugcagcgacggcagcgacgagaaggacugcgacugcggccugagaagcuucaccagacaggccagaguggugggcggcaccgacgccgacgagggcgaguggcccuggcaggugagccugcacgcccugggccagggccacaucugcggcgccagccugaucagccccaacuggcuggugagcgccgcccacugcuacaucgacgacagaggcuucagauacagcgaccccacccaguggaccgccuuccugggccugcacgaccagagccagagaagcgcccccggcgugcaggagagaagacugaagagaaucaucagccaccccuucuucaacgacuucaccuucgacuacgacaucgcccugcuggagcuggagaagcccgccgaguacagcagcauggugagacccaucugccugcccgacgccagccacguguuccccgccggcaaggccaucugggugaccggcuggggccacacccaguacggcggcaccggcgcccugauccugcagaagggcgagaucagagugaucaaccagaccaccugcgagaaccugcugccccagcagaucacccccagaaugaugugcgugggcuuccugagcggcggcguggacagcugccagggcgacagcggcggcccccugagcagcguggaggccgacggcagaaucuuccaggccggcguggugagcuggggcgacggcugcgcccagagaaacaagcccggcguguacaccagacugccccuguucagagacuggaucaaggagaacaccggcguguaa

SEQ ID NO: 24089 - RNA, 3144 nt, Artificial Sequence
  ST18__Homo_sapiens__NP_055497
auggacgccgaggccgaggacaagacccugagaaccagaagcaagggcaccgaggugcccauggacagccugauccaggagcugagcguggccuacgacugcagcauggccaagaagagaaccgccgaggaccaggcccugggcgugcccgugaacaagagaaagagccugcugaugaagcccagacacuacagccccaaggccgacugccaggaggacagaagcgacagaaccgaggacgacggcccccuggagacccacggccacagcaccgccgaggagaucaugaucaagcccauggacgagagccugcugagcaccgcccaggagaacagcagcagaaaggaggacagauacagcugcuaccaggagcugauggugaagagccugaugcaccugggcaaguucgagaagaacgugagcgugcagaccgugagcgagaaccugaacgacagcggcauccagagccugaaggccgagagcgacgaggccgacgagugcuuccugauccacagcgacgacggcagagacaagaucgacgacagccagccccccuucugcagcagcgacgacaacgagagcaacagcgagagcgccgagaacggcugggacagcggcagcaacuucagcgaggagaccaagccccccagagugcccaaguacgugcugaccgaccacaagaaggaccugcuggaggugcccgagaucaagaccgagggcgacaaguucauccccugcgagaacagaugcgacagcgagaccgagagaaaggacccccagaacgcccuggccgagccccuggacggcaacgcccagcccagcuuccccgacguggaggaggaggacagcgagagccuggccgugaugaccgaggagggcagcgaccuggagaaggccaagggcaaccugagccugcuggagcaggccaucgcccugcaggccgagagaggcugcguguuccacaacaccuacaaggagcuggacagauuccugcuggagcaccuggccggcgagagaagacagaccaaggugaucgacaugggcggcagacagaucuucaacaacaagcacagccccagacccgagaagagagagaccaagugccccauccccggcugcgacggcaccggccacgugaccggccuguacccccaccacagaagccugagcggcugcccccacaaggugagagugccccuggagauccuggccaugcacgagaacgugcugaagugccccacccccggcugcaccggcagaggccacgugaacagcaacagaaacacccacagaagccugagcggcugccccaucgccgccgccgagaagcuggccaugagccaggacaagaaccagcuggacagcccccagaccggccagugccccgaccaggcccacagaaccagccuggugaagcagaucgaguucaacuuccccagccaggccaucaccagccccagagccaccgugagcaaggagcaggagaaguucggcaaggugcccuucgacuacgccagcuucgacgcccagguguucggcaagagaccccugauccagaccgugcagggcagaaagaccccccccuuccccgagagcaagcacuuccccaaccccgugaaguuccccaacagacugcccagcgccggcgcccacacccagagccccggcagagccagcagcuacagcuacggccagugcagcgaggacacccacaucgccgccgccgccgccauccugaaccugagcaccagaugcagagaggccaccgacauccugagcaacaagccccagagccugcacgccaagggcgccgagaucgagguggacgagaacggcacccuggaccugagcaugaagaagaacagaauccuggacaagagcgccccccugaccagcagcaacaccagcauccccacccccagcagcagccccuucaagaccagcagcauccuggugaacgccgccuucuaccaggcccugugcgaccaggagggcugggacacccccaucaacuacagcaagacccacggcaagaccgaggaggagaaggagaaggaccccgugagcagccuggagaaccuggaggagaagaaguuccccggcgaggccagcauccccagccccaagcccaagcugcacgccagagaccugaagaaggagcugaucaccugccccacccccggcugcgacggcagcggccacgugaccggcaacuacgccagccacagaagcgugagcggcugcccccuggccgacaagacccugaagagccugauggccgccaacagccaggagcugaagugccccacccccggcugcgacggcagcggccacgugaccggcaacuacgccagccacagaagccugagcggcugccccagagccagaaagggcggcgugaagaugacccccaccaaggaggagaaggaggaccccgagcugaagugccccgugaucggcugcgacggccagggccacaucagcggcaaguacaccagccacagaaccgccagcggcugcccccuggccgccaagagacagaaggagaacccccugaacggcgccagccugagcuggaagcugaacaagcaggagcugccccacugcccccugcccggcugcaacggccugggccacgugaacaacguguucgugacccacagaagccugagcggcugcccccugaacgcccaggugaucaagaagggcaaggugagcgaggagcugaugaccaucaagcugaaggccaccggcggcaucgagagcgacgaggagaucagacaccuggacgaggagaucaaggagcugaacgagagcaaccugaagaucgaggccgacaugaugaagcugcagacccagaucaccagcauggagagcaaccugaagaccaucgaggaggagaacaagcugaucgagcagaacaacgagagccugcugaaggagcuggccggccugagccaggcccugaucagcagccuggccgacauccagcugccccagaugggccccaucagcgagcagaacuucgaggccuacgugaacacccugaccgacauguacagcaaccuggagagagacuacagccccgagugcaaggcccugcuggagagcaucaagcaggccgugaagggcauccacguguaa

SEQ ID NO: 24090 - RNA, 240 nt, Artificial Sequence
  ST20__Homo_sapiens__NP_001094349
auggccagaagcagacugaccgccaccagcgugagccaggugcaggagaacggcuucgugaagaagcuggagcccaagagcggcuggaugaccuuccuggaggugaccggcaagaucugcgagaugcuguucugccccgaggccauccugcugaccagaaaggacacccccuacugcgagaccggccugaucuuccugacccugaccaagaccaucgccaacaccuacuucuacuucuaa

SEQ ID NO: 24091 - RNA, 1023 nt, Artificial Sequence
  ST3GAL1__Homo_sapiens__XP_005251082
auggugacccugagaaagagaacccugaaggugcugaccuuccuggugcuguucaucuuccugaccagcuucuuccugaacuacagccacaccaugguggccaccaccugguuccccaagcagauggugcuggagcugagcgagaaccugaagagacugaucaagcacagacccugcaccugcacccacugcaucggccagagaaagcugagcgccugguucgacgagagauucaaccagaccaugcagccccugcugaccgcccagaacgcccugcuggaggacgacaccuacagaugguggcugagacugcagagagagaagaagcccaacaaccugaacgacaccaucaaggagcuguucagaguggugcccggcaacguggaccccaugcuggagaagagaagcgugggcugcagaagaugcgccguggugggcaacagcggcaaccugagagagagcagcuacggccccgagaucgacagccacgacuucgugcugagaaugaacaaggcccccaccgccggcuucgaggccgacgugggcaccaagaccacccaccaccugguguaccccgagagcuucagagagcugggcgacaacgugagcaugauccuggugcccuucaagaccaucgaccuggaguggguggugagcgccaucaccaccggcaccaucagccacaccuacauccccgugcccgccaagaucagagugaagcaggacaagauccugaucuaccaccccgccuucaucaaguacguguucgacaacuggcugcagggccacggcagauaccccagcaccggcauccugagcgugaucuucagcaugcacgugugcgacgagguggaccuguacggcuucggcgccgacagcaagggcaacuggcaccacuacugggagaacaaccccagcgccggcgccuucagaaagaccggcgugcacgacgccgacuucgagagcaacgugaccgccacccuggccagcaucaacaagaucagaaucuucaagggcagauaa

SEQ ID NO: 24092 - RNA, 1053 nt, Artificial Sequence
  ST3GAL2__Homo_sapiens__NP_008858
augaagugcagccugagagugugguuccugagcguggccuuccugcugguguucaucaugagccugcuguucaccuacagccaccacagcauggccacccugcccuaccuggacagcggcgcccuggacggcacccacagagugaagcuggugcccggcuacgccggccugcagagacugagcaaggagagacugagcggcaagagcugcgccugcagaagaugcaugggcgacgccggcgccagcgacugguucgacagccacuucgacggcaacaucagccccguguggaccagagagaacauggaccugccccccgacgugcagagaugguggaugaugcugcagccccaguucaagagccacaacaccaacgaggugcuggagaagcuguuccagaucgugcccggcgagaaccccuacagauucagagacccccaccagugcagaagaugcgccguggugggcaacagcggcaaccugagaggcagcggcuacggccaggacguggacggccacaacuucaucaugagaaugaaccaggcccccaccgugggcuucgagcaggacgugggcagcagaaccacccaccacuucauguaccccgagagcgccaagaaccugcccgccaacgugagcuucgugcuggugcccuucaaggugcuggaccugcuguggaucgccagcgcccugagcaccggccagaucagauucaccuacgcccccgugaagagcuuccugagaguggacaaggagaaggugcagaucuacaaccccgccuucuucaaguacauccacgacagauggaccgagcaccacggcagauaccccagcaccggcaugcuggugcuguucuucgcccugcacgugugcgacgaggugaacguguacggcuucggcgccgacagcagaggcaacuggcaccacuacugggagaacaacagauacgccggcgaguucagaaagaccggcgugcacgacgccgacuucgaggcccacaucaucgacaugcuggccaaggccagcaagaucgagguguacagaggcaacuaa

SEQ ID NO: 24093 - RNA, 1002 nt, Artificial Sequence
  ST3GAL4__Homo_sapiens__NP_001241687
auggugagcaagagcagauggaagcugcuggccaugcuggcccuggugcugguggugauggugugguacagcaucagcagagaggacagauacaucgagcuguucuacuuccccauccccgagaagaaggagcccugccugcagggcgaggccgagagcaaggccagcaagcuguucggcaacuacagcagagaccagcccaucuuccugagacuggaggacuacuucugggugaagacccccagcgccuacgagcugcccuacggcaccaagggcagcgaggaccugcugcugagagugcuggccaucaccagcagcagcauccccaagaacauccagagccugagaugcagaagaugcgugguggugggcaacggccacagacugagaaacagcagccugggcgacgccaucaacaaguacgacguggugaucagacugaacaacgcccccguggccggcuacgagggcgacgugggcagcaagaccaccaugagacuguucuaccccgagagcgcccacuucgaccccaagguggagaacaaccccgacacccugcuggugcugguggccuucaaggccauggacuuccacuggaucgagaccauccugagcgacaagaagagagugagaaagggcuucuggaagcagcccccccugaucugggacgugaaccccaagcagaucagaauccugaaccccuucuucauggagaucgccgccgacaagcugcugagccugcccaugcagcagcccagaaagaucaagcagaagcccaccaccggccugcuggccaucacccuggcccugcaccugugcgaccuggugcacaucgccggcuucggcuaccccgacgccuacaacaagaagcagaccauccacuacuacgagcagaucacccugaagagcauggccggcagcggccacaacgugagccaggaggcccuggccaucaagagaaugcuggagaugggcgccaucaagaaccugaccagcuucuaa

SEQ ID NO: 24094 - RNA, 1188 nt, Artificial Sequence
  ST3GAL5__Homo_sapiens__NP_001035902
auggccagcgugcccaugcccagcgaguacaccuacgugaagcugagaagcgacugcagcagacccagccugcagugguacaccagagcccagagcaagaugagaagacccagccugcugcugaaggacauccugaagugcacccugcugguguucggcguguggauccuguacauccugaagcugaacuacaccaccgaggagugcgacaugaagaagaugcacuacguggaccccgaccacgugaagagagcccagaaguacgcccagcaggugcugcagaaggagugcagacccaaguucgccaagaccagcauggcccugcuguucgagcacagauacagcguggaccugcugcccuucgugcagaaggcccccaaggacagcgaggccgagagcaaguacgacccccccuucggcuucagaaaguucagcagcaaggugcagacccugcuggagcugcugcccgagcacgaccugcccgagcaccugaaggccaagaccugcagaagaugcguggugaucggcagcggcggcauccugcacggccuggagcugggccacacccugaaccaguucgacguggugaucagacugaacagcgcccccguggagggcuacagcgagcacgugggcaacaagaccaccaucagaaugaccuaccccgagggcgccccccugagcgaccuggaguacuacagcaacgaccuguucguggccgugcuguucaagagcguggacuucaacuggcugcaggccauggugaagaaggagacccugcccuucugggugagacuguucuucuggaagcagguggccgagaagaucccccugcagcccaagcacuucagaauccugaaccccgugaucaucaaggagaccgccuucgacauccugcaguacagcgagccccagagcagauucuggggcagagacaagaacgugcccaccaucggcgugaucgccguggugcuggccacccaccugugcgacgaggugagccuggccggcuucggcuacgaccugaaccagcccagaaccccccugcacuacuucgacagccagugcauggccgccaugaacuuccagaccaugcacaacgugaccaccgagaccaaguuccugcugaagcuggugaaggagggcguggugaaggaccugagcggcggcaucgacagagaguucuaa

SEQ ID NO: 24095 - RNA, 1155 nt, Artificial Sequence
  ST3GAL6__Homo_sapiens__NP_001258074
auguggcaggcccccagagagagacagcagcccgccggcgccgccgccccccaggugagcgagcccggcgccccccugagaagcagccugcugggccugggcggcagccugcugcccgccggcuucgccgccggccugcacugccccggcgagcccgccaugagaggcuaccugguggccaucuuccugagcgccguguuccuguacuacgugcugcacugcauccuguggggcaccaacguguacuggguggcccccguggagaugaagagaagaaacaagauccagcccugccugagcaagcccgccuucgccagccugcugagauuccaccaguuccaccccuuccugugcgccgccgacuucagaaagaucgccagccuguacggcagcgacaaguucgaccugcccuacggcaugagaaccagcgccgaguacuucagacuggcccugagcaagcugcagagcugcgaccuguucgacgaguucgacaacauccccugcaagaagugcgugguggugggcaacggcggcgugcugaagaacaagacccugggcgagaagaucgacagcuacgacgugaucaucagaaugaacaacggccccgugcugggccacgaggaggaggugggcagaagaaccaccuucagacuguucuaccccgagagcguguucagcgaccccauccacaacgaccccaacaccaccgugauccugaccgccuucaagccccacgaccugagauggcugcuggagcugcugaugggcgacaagaucaacaccaacggcuucuggaagaagcccgcccugaaccugaucuacaagcccuaccagaucagaauccuggaccccuucaucaucagaaccgccgccuacgagcugcugcacuuccccaagguguuccccaagaaccagaagcccaagcaccccaccaccggcaucaucgccaucacccuggccuucuacaucugccacgaggugcaccuggccggcuucaaguacaacuucagcgaccugaagagcccccugcacuacuacggcaacgccaccaugagccugaugaacaagaacgccuaccacaacgugaccgccgagcagcuguuccugaaggacaucaucgagaagaaccuggugaucaaccugacccaggacuaa

SEQ ID NO: 24096 - RNA, 3414 nt, Artificial Sequence
  ST5__Homo_sapiens__NP_005409
augaccaugaccgccaacaagaacagcagcaucacccacggcgccggcggcaccaaggcccccagaggcacccugagcagaagccagagcgugagccccccccccgugcugagcccccccagaagccccaucuacccccugagcgacagcgagaccagcgccugcagauaccccagccacagcagcagcagagugcugcugaaggacagacacccccccgcccccagcccccagaacccccaggaccccagccccgacaccagcccccccaccugccccuucaagaccgccagcuucggcuaccuggacagaagccccagcgccugcaagagagacgcccagaaggagagcgugcagggcgccgcccaggacguggccggcguggccgccugccugccccuggcccagagcacccccuuccccggccccgccgccggccccagaggcgugcugcugaccagaaccggcaccagagcccacagccugggcaucagagagaagaucagcgccugggagggcagaagagaggccagccccagaaugagcaugugcggcgagaagagagagggcagcggcagcgagugggccgccagcgagggcugccccagccugggcugccccagcguggugcccagccccugcagcagcgagaagaccuucgacuucaagggccugagaagaaugagcagaaccuucagcgagugcagcuaccccgagaccgaggaggagggcgaggcccugcccgugagagacagcuucuacagacuggagaagagacugggcagaagcgagcccagcgccuuccugagaggccacggcagcagaaaggagagcagcgccgugcugagcagaauccagaagaucgagcaggugcugaaggagcagcccggcagaggccugccccagcugcccagcagcugcuacagcguggacagaggcaagagaaagaccggcacccugggcagccuggaggagcccgccggcggcgccagcgugagcgccggcagcagagccgugggcguggccggcguggccggcgaggccggccccccccccgagagagagggcagcggcagcaccaagcccggcacccccggcaacagccccagcagccagagacugcccagcaagagcagccuggaccccgccgugaaccccgugcccaagcccaagagaaccuucgaguacgaggccgacaagaaccccaagagcaagcccagcaacggccugccccccagccccacccccgccgccccccccccccugcccagcacccccgccccccccgugaccagaagacccaagaaggacaugagaggccacagaaagagccagagcagaaagagcuucgaguucgaggacgccagcagccugcagagccuguaccccagcagccccaccgagaacggcaccgagaaccagcccaaguucggcagcaagagcacccuggaggagaacgccuacgaggacaucgugggcgaccugcccaaggagaaccccuacgaggacguggaccugaagagcagaagagccggcagaaagagccagcagcugagcgagaacagccuggacagccugcacagaauguggagcccccaggacagaaaguacaacagcccccccacccagcugagccugaagcccaacagccagagccugagaagcggcaacuggagcgagagaaagagccacagacugcccagacugcccaagagacacagccacgacgacaugcugcugcuggcccagcugagccugcccagcagccccagcagccugaacgaggacagccugagcaccaccagcgagcugcugagcagcagaagagccagaagaauccccaagcuggugcagagaaucaacagcaucuacaacgccaagagaggcaagaagagacugaagaagcugagcaugagcagcaucgagaccgccagccugagagacgagaacagcgagagcgagagcgacagcgacgacagauucaaggcccacacccagagacuggugcacauccagagcaugcugaagagagcccccagcuacagaacccuggagcuggagcugcuggaguggcaggagagagagcuguucgaguacuucgugguggugagccugaagaagaagcccagcagaaacaccuaccugcccgaggugagcuaccaguuccccaagcuggacagacccaccaagcagaugagagaggccgaggagagacugaaggccaucccccaguucugcuuccccgacgccaaggacuggcugcccgugagcgaguacagcagcgagaccuucagcuucaugcugaccggcgaggacggcagcagaagauucggcuacugcagaagacugcugcccagcggcaagggccccagacugcccgagguguacugcgugaucagcagacugggcugcuucggccuguucagcaaggugcuggacgagguggagagaagaagaggcaucagcgccgcccugguguaccccuucaugagaagccugauggagagccccuuccccgcccccggcaagaccaucaaggugaagaccuuccugcccggcgccggcaacgaggugcuggagcugagaagacccauggacagcagacuggagcacguggacuucgagugccuguucaccugccugagcgugagacagcugaucagaaucuucgccagccugcugcuggagagaagagugaucuucguggccgacaagcugagcacccugagcagcugcagccacgccgugguggcccugcuguaccccuucagcuggcagcacaccuucauccccgugcugcccgccagcaugaucgacaucgugugcugccccacccccuuccuggugggccugcugagcagcagccugcccaagcugaaggagcugcccguggaggaggcccugauggugaaccugggcagcgacagauucaucagacagauggacgacgaggacacccugcugcccagaaagcugcaggccgcccuggagcaggcccuggagagaaagaacgagcugaucagccaggacagcgacagcgacagcgacgacgagugcaacacccugaacggccuggugagcgagguguucaucagauucuucguggagaccgugggccacuacagccuguuccugacccagagcgagaagggcgagagagccuuccagagagaggccuucagaaagagcguggccagcaagagcaucagaagauuccuggagguguucauggagagccagauguucgccggcuucauccaggacagagagcugagaaagugcagagccaagggccuguucgagcagagaguggagcaguaccuggaggagcugcccgacaccgagcagagcggcaugaacaaguuccugagaggccugggcaacaagaugaaguuccugcacaagaagaacuaa

SEQ ID NO: 24097 - RNA, 1221 nt, Artificial Sequence
  ST6GAL1__Homo_sapiens__NP_775323
augauccacaccaaccugaagaagaaguucagcugcugcgugcugguguuccugcuguucgccgugaucugcguguggaaggagaagaagaagggcagcuacuacgacagcuucaagcugcagaccaaggaguuccaggugcugaagagccugggcaagcuggccaugggcagcgacagccagagcgugagcagcagcagcacccaggacccccacagaggcagacagacccugggcagccugagaggccuggccaaggccaagcccgaggccagcuuccagguguggaacaaggacagcagcagcaagaaccugauccccagacugcagaagaucuggaagaacuaccugagcaugaacaaguacaaggugagcuacaagggccccggccccggcaucaaguucagcgccgaggcccugagaugccaccugagagaccacgugaacgugagcaugguggaggugaccgacuuccccuucaacaccagcgagugggagggcuaccugcccaaggagagcaucagaaccaaggccggccccuggggcagaugcgccguggugagcagcgccggcagccugaagagcagccagcugggcagagagaucgacgaccacgacgccgugcugagauucaacggcgcccccaccgccaacuuccagcaggacgugggcaccaagaccaccaucagacugaugaacagccagcuggugaccaccgagaagagauuccugaaggacagccuguacaacgagggcauccugaucgugugggaccccagcguguaccacagcgacauccccaagugguaccagaaccccgacuacaacuucuucaacaacuacaagaccuacagaaagcugcaccccaaccagcccuucuacauccugaagccccagaugcccugggagcugugggacauccugcaggagaucagccccgaggagauccagcccaacccccccagcagcggcaugcugggcaucaucaucaugaugacccugugcgaccagguggacaucuacgaguuccugcccagcaagagaaagaccgacgugugcuacuacuaccagaaguucuucgacagcgccugcaccaugggcgccuaccacccccugcuguacgagaagaaccuggugaagcaccugaaccagggcaccgacgaggacaucuaccugcugggcaaggccacccugcccggcuucagaaccauccacugcuaa

SEQ ID NO: 24098 - RNA, 1401 nt, Artificial Sequence
  ST6GAL2__Homo_sapiens__NP_001135824
augaagccccaccugaagcaguggagacagagaaugcuguucggcaucuucgccuggggccugcuguuccugcugaucuucaucuacuucaccgacagcaaccccgccgagcccgugcccagcagccugagcuuccuggagaccagaagacugcugcccgugcagggcaagcagagagccaucaugggcgccgcccacgagcccagcccccccggcggccuggacgccagacaggcccugcccagagcccaccccgccggcagcuuccacgccggccccggcgaccugcagaagugggcccagagccaggacggcuucgagcacaaggaguucuucagcagccaggugggcagaaagagccagagcgccuucuaccccgaggacgacgacuacuucuucgccgccggccagcccggcuggcacagccacacccagggcacccugggcuuccccagccccggcgagcccggccccagagagggcgccuuccccgccgcccaggugcagagaagaagagugaagaagagacacagaagacagagaagaagccacgugcuggaggagggcgacgacggcgacagacuguacagcagcaugagcagagccuuccuguacagacuguggaagggcaacgugagcagcaagaugcugaaccccagacugcagaaggccaugaaggacuaccugaccgccaacaagcacggcgugagauucagaggcaagagagaggccggccugagcagagcccagcugcugugccagcugagaagcagagccagagugagaacccuggacggcaccgaggcccccuucagcgcccugggcuggagaagacuggugcccgccgugccccugagccagcugcaccccagaggccugagaagcugcgccguggugaugagcgccggcgccauccugaacagcagccugggcgaggagaucgacagccacgacgccgugcugagauucaacagcgcccccaccagaggcuacgagaaggacgugggcaacaagaccaccaucagaaucaucaacagccagauccugaccaaccccagccaccacuucaucgacagcagccuguacaaggacgugauccugguggccugggaccccgcccccuacagcgccaaccugaaccugugguacaagaagcccgacuacaaccuguucacccccuacauccagcacagacagagaaaccccaaccagcccuucuacauccugcaccccaaguucaucuggcagcugugggacaucauccaggagaacaccaaggagaagauccagcccaacccccccagcagcggcuucaucggcagcuucgugaagaucggccacaucagagccugcagcgagcccagaagcagagacugcacccccgccuggaccaccgaguaa

SEQ ID NO: 24099 - RNA, 1803 nt, Artificial Sequence
  ST6GALNAC1__Homo_sapiens__NP_060884
augagaagcugccuguggagaugcagacaccugagccagggcgugcaguggagccugcugcuggccgugcugguguucuuccuguucgcccugcccagcuucaucaaggagccccagaccaagcccagcagacaccagagaaccgagaacaucaaggagagaagccugcagagccuggccaagcccaagagccaggcccccaccagagccagaagaaccaccaucuacgccgagcccgugcccgagaacaacgcccugaacacccagacccagcccaaggcccacaccaccggcgacagaggcaaggaggccaaccaggccccccccgaggagcaggacaaggugccccacaccgcccagagagccgccuggaagagccccgagaaggagaagaccauggugaacacccugagccccagaggccaggacgccggcauggccagcggcagaaccgaggcccagagcuggaagagccaggacaccaagaccacccagggcaacggcggccagaccagaaagcugaccgccagcagaaccgugagcgagaagcaccagggcaaggccgccaccaccgccaagacccugauccccaagagccagcacagaaugcuggcccccaccggcgccgugagcaccagaaccagacagaagggcgugaccaccgccgugaucccccccaaggagaagaagccccaggccacccccccccccgcccccuuccagagccccaccacccagagaaaccagagacugaaggccgccaacuucaagagcgagcccagaugggacuucgaggagaaguacagcuucgagaucggcggccugcagaccaccugccccgacagcgugaagaucaaggccagcaagagccuguggcugcagaagcuguuccugcccaaccugacccuguuccuggacagcagacacuucaaccagagcgagugggacagacuggagcacuucgccccccccuucggcuucauggagcugaacuacagccuggugcagaagguggugaccagauucccccccgugccccagcagcagcugcugcuggccagccugcccgccggcagccugagaugcaucaccugcgccguggugggcaacggcggcauccugaacaacagccacaugggccaggagaucgacagccacgacuacguguucagacugagcggcgcccugaucaagggcuacgagcaggacgugggcaccagaaccagcuucuacggcuucaccgccuucagccugacccagagccugcugauccugggcaacagaggcuucaagaacgugccccugggcaaggacgugagauaccugcacuuccuggagggcaccagagacuacgaguggcuggaggcccugcugaugaaccagaccgugaugagcaagaaccuguucugguucagacacagaccccaggaggccuucagagaggcccugcacauggacagauaccugcugcugcaccccgacuuccugagauacaugaagaacagauuccugagaagcaagacccuggacggcgcccacuggagaaucuacagacccaccaccggcgcccugcugcugcugaccgcccugcagcugugcgaccaggugagcgccuacggcuucaucaccgagggccacgagagauucagcgaccacuacuacgacaccagcuggaagagacugaucuucuacaucaaccacgacuucaagcuggagagagagguguggaagagacugcacgacgagggcaucaucagacuguaccagagacccggccccggcaccgccaaggccaagaacuaa

SEQ ID NO: 24100 - RNA, 1125 nt, Artificial Sequence
  ST6GALNAC2__Homo_sapiens__NP_006447
augggccugcccagaggcagcuucuucuggcugcugcugcugcugaccgccgccugcagcggccugcuguucgcccuguacuucagcgccgugcagagauaccccggccccgccgccggcgccagagacaccaccagcuucgaggccuucuuccagagcaaggccagcaacagcuggaccggcaagggccaggccugcagacaccugcugcaccuggccauccagagacacccccacuucagaggccuguucaaccugagcauccccgugcugcuguggggcgaccuguucacccccgcccugugggacagacugagccagcacaaggcccccuacggcuggagaggccugagccaccaggugaucgccagcacccugagccugcugaacggcagcgagagcgccaagcuguucgccccccccagagacaccccccccaagugcaucagaugcgccguggugggcaacggcggcauccugaacggcagcagacagggccccaacaucgacgcccacgacuacguguucagacugaacggcgccgugaucaagggcuucgagagagacgugggcaccaagaccagcuucuacggcuucaccgugaacaccaugaagaacagccuggugagcuacuggaaccugggcuucaccagcgugccccagggccaggaccugcaguacaucuucauccccagcgacaucagagacuacgugaugcugagaagcgccauccugggcgugcccgugcccgagggccuggacaagggcgacagaccccacgccuacuucggccccgaggccagcgccagcaaguucaagcugcugcaccccgacuucaucagcuaccugaccgagagauuccugaagagcaagcugaucaacacccacuucggcgaccuguacaugcccagcaccggcgcccugaugcugcugaccgcccugcacaccugcgaccaggugagcgccuacggcuucaucaccagcaacuacuggaaguucagcgaccacuacuucgagagaaagaugaagccccugaucuucuacgccaaccacgaccugagccuggaggccgcccuguggagagaccugcacaaggccggcauccugcagcuguaccagagauaa

SEQ ID NO: 24101 - RNA, 909 nt, Artificial Sequence
  ST6GALNAC4__Homo_sapiens__NP_778204
augaaggcccccggcagacuggugcugaucauccugugcagcgugguguucagcgccguguacauccugcugugcugcugggccggccugccccugugccuggccaccugccuggaccaccacuuccccaccggcagcagacccaccgugcccggcccccugcacuucagcggcuacagcagcgugcccgacggcaagccccuggugagagagcccugcagaagcugcgccguggugagcagcagcggccagaugcugggcagcggccugggcgccgagaucgacagcgccgagugcguguucagaaugaaccaggcccccaccgugggcuucgaggccgacgugggccagagaagcacccugagaguggugagccacaccagcgugccccugcugcugagaaacuacagccacuacuuccagaaggccagagacacccuguacaugguguggggccagggcagacacauggacagagugcugggcggcagaaccuacagaacccugcugcagcugaccagaauguaccccggccugcagguguacaccuucaccgagagaaugauggccuacugcgaccagaucuuccaggacgagaccggcaagaacagaagacagagcggcagcuuccugagcaccggcugguucaccaugauccuggcccuggagcugugcgaggagaucgugguguacggcauggugagcgacagcuacugcagagagaagagccaccccagcgugcccuaccacuacuucgagaagggcagacuggacgagugccagauguaccuggcccacgagcaggcccccagaagcgcccacagauucaucaccgagaaggccguguucagcagaugggccaagaagagacccaucguguucgcccaccccagcuggagaaccgaguaa

SEQ ID NO: 24102 - RNA, 1125 nt, Artificial Sequence
  ST6GALNAC6__Homo_sapiens__NP_001273928
auggccugcagcagaccccccagccagugcgagcccaccagccugccccccggcccccccgccggcagaagacaccugccccugagcagaagaagaagagagaugagcagcaacaaggagcagagaagcgccguguucgugauccuguucgcccugaucaccauccugauccuguacagcagcaacagcgccaacgagguguuccacuacggcagccugagaggcagaagcagaagacccgugaaccugaagaaguggagcaucaccgacggcuacgugcccauccugggcaacaagacccugcccagcagaugccaccagugcgugaucgugagcagcagcagccaccugcugggcaccaagcugggccccgagaucgagagagccgagugcaccaucagaaugaacgacgcccccaccaccggcuacagcgccgacgugggcaacaagaccaccuacagagugguggcccacagcagcguguucagagugcugagaagaccccaggaguucgugaacagaacccccgagaccguguucaucuucuggggcccccccagcaagaugcagaagccccagggcagccuggugagagugauccagagagccggccugguguuccccaacauggaggccuacgccgugagccccggcagaaugagacaguucgacgaccuguucagaggcgagaccggcaaggacagagagaagagccacagcuggcugagcaccggcugguucaccauggugaucgccguggagcugugcgaccacgugcacguguacggcauggugccccccaacuacugcagcggccccgccagcagcgccugccccaccaccaccaccagccccagaggcagaaccaacgugagccccaccagcagaaugagcaccguggccagagccaccaccaccgccagcagccccagaaagggcagcagccacagaggccccagcugcauggccagccccagccccaccccccccggccccagaccccccagccugugggaccugagaagagugagaggcgaggccgccagcgcccagccccugggccagggccccagcagcggccagagcagacuggccggcgugagccccagccagagcggccccuaa

SEQ ID NO: 24103 - RNA, 1665 nt, Artificial Sequence
  ST7__Homo_sapiens__NP_060882
auggccgaggccgccaccggcuuccuggagcagcugaagagcugcaucguguggagcuggaccuaccuguggaccgugugguucuucaucgugcuguuccugguguacauccugagagugccccugaagaucaacgacaaccugagcaccgugagcauguuccugaacacccugacccccaaguucuacguggcccugaccggcaccagcagccugaucagcggccugauccugaucuucgaguggugguacuucagaaaguacggcaccagcuucaucgagcaggugagcgugagccaccugagaccccugcugggcggcguggacaacaacagcagcaacaacagcaacagcagcaacggcgacagcgacagcaacagacagagcgugagcgagugcaagguguggagaaacccccugaaccuguucagaggcgccgaguacaacagauacaccugggugaccggcagagagccccugaccuacuacgacaugaaccugagcgcccaggaccaccagaccuucuucaccugcgacagcgaccaccugagacccgccgacgccaucaugcagaaggccuggagagagagaaacccccaggccagaaucagcgccgcccacgaggcccuggagaucaacgagugcgccaccgccuacauccugcuggccgaggaggaggccaccaccaucgccgaggccgagaagcuguucaagcaggcccugaaggccggcgacggcugcuacagaagaagccagcagcugcagcaccacggcagccaguacgaggcccagcacagaagagacaccaacgugcugguguacaucaagagaagacuggccaugugcgccagaagacugggcagaaccagagaggccgugaagaugaugagagaccugaugaaggaguucccccugcugagcauguucaacauccacgagaaccugcuggaggcccugcuggagcugcaggccuacgccgacgugcaggccgugcuggccaaguacgacgacaucagccugcccaagagcgccaccaucugcuacaccgccgcccugcugaaggccagagccgugagcgacaaguucagccccgaggccgccagcagaagaggccugagcaccgccgagaugaacgccguggaggccauccacagagccguggaguucaacccccacgugcccaaguaccugcuggagaugaagagccugauccugccccccgagcacauccugaagagaggcgacagcgaggccaucgccuacgccuucuuccaccuggcccacuggaagagaguggagggcgcccugaaccugcugcacugcaccugggagggcaccuucagaaugauccccuacccccuggagaagggccaccuguucuaccccuaccccaucugcaccgagaccgccgacagagagcugcugcccagcuuccacgaggugagcguguaccccaagaaggagcugcccuucuucauccuguucaccgccggccugugcagcuucaccgccaugcuggcccugcugacccaccaguuccccgagcugaugggcguguucgccaaggccuuccugagcacccuguucgccccccugaacuucgugauggagaagguggagagcauccugcccagcagccuguggcaccagcugaccagaaucuaa

SEQ ID NO: 24104 - RNA, 1560 nt, Artificial Sequence
  ST7L__Homo_sapiens__XP_011539931
augagccccuuccuguucagagacgacaugaaggaccugaccguguuccugaacagccugacccccaaguucuacguggcccugaccggcaccagcagccugaucagcggccugaucuucaucuucgaguggugguacuuccacaagcacggcaccagcuucaucgagcaggugagcgugagccaccugcagccccugaugggcggcaccgagagcagcaucagcgagcccggcagccccagcagaaacagagagaacgagaccagcagacagaaccugagcgagugcaagguguggagaaacccccugaaccuguucagaggcgccgaguacagaagauacaccugggugaccggcaaggagccccugaccuacuacgacaugaaccugagcgcccaggaccaccagaccuucuucaccugcgacaccgacuuccugagacccagcgacaccgugaugcagaaggccuggagagagagaaacccccccgccagaaucaaggccgccuaccaggcccuggagcugaacaacgacugcgccaccgccuacgugcugcuggccgaggaggaggccaccaccaucguggacgccgagagacuguucaagcaggcccugaaggccggcgagaccaucuacagacagagccagcagugccagcaccagagcccccagcacgaggcccagcugagaagagacaccaacgugcugguguacaucaagagaagacuggccaugugcgccagaaagcugggcagaaucagagaggccgugaagaucaugagagaccugaugaaggaguuccccccccugaccaugcugaacauccacgagaaccugcuggagagccugcuggagcugcaggccuaccccgacgugcaggccgugcuggccaaguacgacgacaucagccugcccaagagcgccgccaucugcuacaccgccgcccugcugaagaccagaaccgugagcgagaaguucagccccgagaccgccagcagaagaggccugagcaccgccgagaucaacgccguggaggccauccacagagccguggaguucaacccccacgugcccaaguaccugcuggagaugaagagccugauccugccccccgagcacauccugaagagaggcgacagcgaggccaucgccuacgccuucuuccaccugcagcacuggaagagaaucgagggcgcccugaaccugcugcagugcaccugggagggcaccuucagaaugauccccuacccccuggagaagggccaccuguucuaccccuaccccagcugcaccgagaccgccgacagagagcugcugcccaccuuccaccacgugagcguguaccccaagaaggagcugccccuguucauccacuucaccgccggcuucugcagcagcaccgccaugaucgccauccugacccaccaguuccccgagaucaugggcaucuucgccaaggccgugcugggccuguggugcccccagcccugggccagcagcggcuucgaggagaacacccaggaccugaagagcgaggaccugggccugagcagcggcuaa

SEQ ID NO: 24105 - RNA, 642 nt, Artificial Sequence
  ST8SIA1__Homo_sapiens__NP_001291379
augaccggcagcuucuacacccacagcccccugaccauccagcugacccugagcagccacagaugcaaccugcccccccugagcagcgaguacaccaaggacgugggcagcaagagccagcuggugaccgccaaccccagcaucaucagacagagauuccagaaccugcuguggagcagaaagaccuucguggacaacaugaagaucuacaaccacagcuacaucuacaugcccgccuucagcaugaagaccggcaccgagcccagccugagaguguacuacacccugagcgacgugggcgccaaccagaccgugcuguucgccaaccccaacuuccugagaagcaucggcaaguucuggaagagcagaggcauccacgccaagagacugagcaccggccuguuccuggugagcgccgcccugggccugugcgaggagguggccaucuacggcuucuggcccuucagcgugaacaugcacgagcagcccaucagccaccacuacuacgacaacgugcugcccuucagcggcuuccacgccaugcccgaggaguuccugcagcugugguaccugcacaagaucggcgcccugagaaugcagcuggaccccugcgaggacaccagccugcagcccaccagcuaa

SEQ ID NO: 24106 - RNA, 1128 nt, Artificial Sequence
  ST8SIA2__Homo_sapiens__NP_006002
augcagcugcaguucagaagcuggaugcuggccgcccugacccugcuggugguguuccugaucuucgccgacaucagcgagaucgaggaggagaucggcaacagcggcggcagaggcaccaucagaagcgccgugaacagccugcacagcaagagcaacagagccgagguggugaucaacggcagcagcagccccgccgugguggacagaagcaacgagagcaucaagcacaacauccagcccgccagcagcaaguggagacacaaccagacccugagccugagaaucagaaagcagauccugaaguuccuggacgccgagaaggacaucagcgugcugaagggcacccugaagcccggcgacaucauccacuacaucuucgacagagacagcaccaugaacgugagccagaaccuguacgagcugcugcccagaaccagcccccugaagaacaagcacuucggcaccugcgccaucgugggcaacagcggcgugcugcugaacagcggcugcggccaggagaucgacgcccacagcuucgugaucagaugcaaccuggcccccgugcaggaguacgccagagacgugggccugaagaccgaccuggugaccaugaaccccagcgugauccagagagccuucgaggaccuggugaacgccaccuggagagagaagcugcugcagagacugcacagccugaacggcagcauccuguggauccccgccuucauggccagaggcggcaaggagagaguggagugggugaacgagcugauccugaagcaccacgugaacgugagaaccgccuaccccagccugagacugcugcacgccgugagaggcuacuggcugaccaacaaggugcacaucaagagacccaccaccggccugcugauguacacccuggccaccagauucugcaagcagaucuaccuguacggcuucuggcccuucccccuggaccagaaccagaaccccgugaaguaccacuacuacgacagccugaaguacggcuacaccagccaggccagcccccacaccaugccccuggaguucaaggcccugaagagccugcacgagcagggcgcccugaagcugaccgugggccagugcgacggcgccaccuaa

SEQ ID NO: 24107 - RNA, 1143 nt, Artificial Sequence
  ST8SIA3__Homo_sapiens__NP_056963
augagaaacugcaagauggccagaguggccagcgugcugggccuggugaugcugagcguggcccugcugauccugagccugaucagcuacgugagccugaagaaggagaacaucuucaccacccccaaguacgccagccccggcgcccccagaauguacauguuccacgccggcuucagaagccaguucgcccugaaguuccuggaccccagcuucgugcccaucaccaacagccugacccaggagcugcaggagaagcccagcaaguggaaguucaacagaaccgccuuccugcaccagagacaggagauccugcagcacguggacgugaucaagaacuucagccugaccaagaacagcgugagaaucggccagcugaugcacuacgacuacagcagccacaaguacguguucagcaucagcaacaacuucagaagccugcugcccgacgugagccccaucaugaacaagcacuacaacaucugcgccguggugggcaacagcggcauccugaccggcagccagugcggccaggagaucgacaagagcgacuucguguucagaugcaacuucgcccccaccgaggccuuccagagagacgugggcagaaagaccaaccugaccaccuucaaccccagcauccuggagaaguacuacaacaaccugcugaccauccaggacagaaacaacuucuuccugagccugaagaagcuggacggcgccauccuguggauccccgccuucuucuuccacaccagcgccaccgugaccagaacccugguggacuucuucguggagcacagaggccagcugaaggugcagcuggccuggcccggcaacaucaugcagcacgugaacagauacuggaagaacaagcaccugagccccaagagacugagcaccggcauccugauguacacccuggccagcgccaucugcgaggagauccaccuguacggcuucuggcccuucggcuucgaccccaacaccagagaggaccugcccuaccacuacuacgacaagaagggcaccaaguucaccaccaaguggcaggagagccaccagcugcccgccgaguuccagcugcuguacagaaugcacggcgagggccugaccaagcugacccugagccacugcgccuaa

SEQ ID NO: 24108 - RNA, 1080 nt, Artificial Sequence
  ST8SIA4__Homo_sapiens__NP_005659
augagaagcaucagaaagagauggaccaucugcaccaucagccugcugcugaucuucuacaagaccaaggagaucgccagaaccgaggagcaccaggagacccagcugaucggcgacggcgagcugagccugagcagaagccuggugaacagcagcgacaagaucaucagaaaggccggcagcagcaucuuccagcacaacguggagggcuggaagaucaacagcagccuggugcuggagaucagaaagaacauccugagauuccuggacgccgagagagacgugagcguggugaagagcagcuucaagcccggcgacgugauccacuacgugcuggacagaagaagaacccugaacaucagccacgaccugcacagccugcugcccgaggugagccccaugaagaacagaagauucaagaccugcgccguggugggcaacagcggcauccugcuggacagcgagugcggcaaggagaucgacagccacaacuucgugaucagaugcaaccuggcccccgugguggaguucgccgccgacgugggcaccaagagcgacuucaucaccaugaaccccagcguggugcagagagccuucggcggcuucagaaacgagagcgacagagagaaguucgugcacagacugagcaugcugaacgacagcgugcuguggauccccgccuucauggugaagggcggcgagaagcacguggagugggugaacgcccugauccugaagaacaagcugaaggugagaaccgccuaccccagccugagacugauccacgccgugagaggcuacuggcugaccaacaaggugcccaucaagagacccagcaccggccugcugauguacacccuggccaccagauucugcgacgagauccaccuguacggcuucuggcccuuccccaaggaccugaacggcaaggccgugaaguaccacuacuacgacgaccugaaguacagauacuucagcaacgccagcccccacagaaugccccuggaguucaagacccugaacgugcugcacaacagaggcgcccugaagcugaccaccggcaagugcgugaagcaguaa

SEQ ID NO: 24109 - RNA, 1197 nt, Artificial Sequence
  ST8SIA6__Homo_sapiens__NP_001004470
augagacccggcggcgcccugcuggcccugcuggccagccugcugcugcugcugcugcugagacugcuguggugccccgccgacgcccccggcagagccagaauccugguggaggagagcagagaggccacccacggcacccccgccgcccugagaacccugagaagccccgccaccgccgugcccagagccaccaacagcaccuaccugaacgagaagagccugcagcugaccgagaagugcaagaaccugcaguacggcaucgagagcuucagcaacaagaccaagggcuacagcgagaacgacuaccugcagaucaucaccgacauccagagcugccccuggaagagacaggccgaggaguacgccaacuucagagccaagcuggccagcugcugcgacgccgugcagaacuucguggugagccagaacaacacccccgugggcaccaacaugagcuacgagguggagagcaagaaggagauccccaucaagaagaacaucuuccacauguuccccgugagccagcccuucguggacuaccccuacaaccagugcgccguggugggcaacggcggcauccugaacaagagccugugcggcaccgagaucgacaagagcgacuucguguucagaugcaaccugccccccaccaccggcgacgugagcaaggacgugggcagcaagaccaaccuggugaccaucaaccccagcaucaucacccugaaguacggcaaccugaaggagaagaaggcccuguuccuggaggacaucgccaccuacggcgacgccuucuuccugcugcccgccuucagcuucagagccaacaccggcaccagcuucaagguguacuacacccuggaggagagcaaggccagacagaaggugcuguucuuccaccccaaguaccugaaggaccuggcccuguucuggagaaccaagggcgugaccgccuacagacugagcaccggccugaugaucaccagcguggccguggagcugugcaagaacgugaagcuguacggcuucuggcccuucagcaagaccguggaggacauccccgugagccaccacuacuacgacaacaagcugcccaagcacggcuuccaccagaugcccaaggaguacagccagauccugcagcugcacaugaagggcauccugaagcugcaguucagcaagugcgagguggccuaa

SEQ ID NO: 24110 - RNA, 7713 nt, Artificial Sequence
  STAB1__Homo_sapiens__NP_055951
auggccggccccagaggccugcugccccugugccugcuggccuucugccuggccggcuucagcuucgugagaggccaggugcuguucaagggcugcgacgugaagaccaccuucgugacccacgugcccugcaccagcugcgccgccaucaagaagcagaccugccccagcggcuggcugagagagcugcccgaccagaucacccaggacugcagauacgaggugcagcugggcggcagcauggugagcaugagcggcugcagaagaaagugcagaaagcagguggugcagaaggccugcugccccggcuacuggggcagcagaugccacgagugccccggcggcgccgagacccccugcaacggccacggcaccugccuggacggcauggacagaaacggcaccugcgugugccaggagaacuucagaggcagcgccugccaggagugccaggaccccaacagauucggccccgacugccagagcgugugcagcugcgugcacggcgugugcaaccacggccccagaggcgacggcagcugccugugcuucgccggcuacaccggcccccacugcgaccaggagcugcccgugugccaggagcugagaugcccccagaacacccagugcagcgccgaggcccccagcugcagaugccugcccggcuacacccagcagggcagcgagugcagagcccccaaccccugcuggcccagccccugcagccugcuggcccagugcagcgugagccccaagggccaggcccagugccacugccccgagaacuaccacggcgacggcauggugugccugcccaaggaccccugcaccgacaaccugggcggcugccccagcaacagcacccugugcguguaccagaagcccggccaggccuucugcaccugcagacccggccuggugagcaucaacagcaacgccagcgccggcugcuucgccuucugcagccccuucagcugcgacagaagcgccaccugccaggugaccgccgacggcaagaccagcugcgugugcagagagagcgaggugggcgacggcagagccugcuacggccaccugcugcacgaggugcagaaggccacccagaccggcagaguguuccugcagcugagaguggccguggccaugauggaccagggcugcagagagauccugaccaccgccggccccuucaccgugcuggugcccagcgugagcagcuucagcagcagaaccaugaacgccagccuggcccagcagcugugcagacagcacaucaucgccggccagcacauccuggaggacaccagaacccagcagaccagaagaugguggacccuggccggccaggagaucaccgugaccuucaaccaguucaccaaguacagcuacaaguacaaggaccagccccagcagaccuucaacaucuacaaggccaacaacaucgccgccaacggcguguuccacguggugaccggccugagauggcaggcccccagcggcacccccggcgaccccaagagaaccaucggccagauccuggccagcaccgaggccuucagcagauucgagaccauccuggagaacugcggccugcccagcauccuggacggccccggccccuucaccguguucgcccccagcaacgaggccguggacagccugagagacggcagacugaucuaccuguucaccgccggccugagcaagcugcaggagcuggugagauaccacaucuacaaccacggccagcugaccguggagaagcugaucagcaagggcagaauccugaccauggccaaccaggugcuggccgugaacaucagcgaggagggcagaauccugcugggccccgagggcgugccccugcagagaguggacgugauggccgccaacggcgugauccacaugcuggacggcauccugcugccccccaccauccugcccauccugcccaagcacugcagcgaggagcagcacaagaucguggccggcagcugcguggacugccaggcccugaacaccagcaccugcccccccaacagcgugaagcuggacaucuuccccaaggagugcguguacauccacgaccccaccggccugaacgugcugaagaagggcugcgccagcuacugcaaccagaccaucauggagcagggcugcugcaagggcuucuucggccccgacugcacccagugccccggcggcuucagcaaccccugcuacggcaagggcaacugcagcgacggcauccagggcaacggcgccugccugugcuuccccgacuacaagggcaucgccugccacaucugcagcaaccccaacaagcacggcgagcagugccaggaggacugcggcugcgugcacggccugugcgacaacagacccggcagcggcggcgugugccagcagggcaccugcgcccccggcuucagcggcagauucugcaacgagagcaugggcgacugcggccccaccggccuggcccagcacugccaccugcacgccagaugcgugagccaggagggcguggccagaugcagaugccuggacggcuucgagggcgacggcuucagcugcacccccagcaaccccugcagccaccccgacagaggcggcugcagcgagaacgccgagugcgugcccggcagccugggcacccaccacugcaccugccacaagggcuggagcggcgacggcagagugugcguggccaucgacgagugcgagcuggacaugagaggcggcugccacaccgacgcccugugcagcuacgugggccccggccagagcagaugcaccugcaagcugggcuucgccggcgacggcuaccagugcagccccaucgaccccugcagagccggcaacggcggcugccacggccuggccaccugcagagccgugggcggcggccagagagugugcaccugcccccccggcuucggcggcgacggcuucagcugcuacggcgacaucuucagagagcuggaggccaacgcccacuucagcaucuucuaccaguggcugaagagcgccggcaucacccugcccgccgacagaagagugaccgcccuggugcccagcgaggccgccgugagacagcugagccccgaggacagagccuucuggcugcagcccagaacccugcccaaccuggugagagcccacuuccugcagggcgcccuguucgaggaggagcuggccagacugggcggccaggagguggccacccugaaccccaccaccagaugggagaucagaaacaucagcggcagagugugggugcagaacgccagcguggacguggccgaccugcuggccaccaacggcgugcugcacauccugagccaggugcugcugccccccagaggcgacgugcccggcggccagggccugcugcagcagcuggaccuggugcccgccuucagccuguucagagagcugcugcagcaccacggccuggugccccagaucgaggccgccaccgccuacaccaucuucgugcccaccaacagaagccuggaggcccagggcaacagcagccaccuggacgccgacaccgugagacaccacguggugcugggcgaggcccugagcauggagacccugagaaagggcggccacagaaacagccugcugggccccgcccacuggaucguguucuacaaccacagcggccagcccgaggugaaccacgugccccuggagggccccaugcuggaggcccccggcagaagccugaucggccugagcggcgugcugaccgugggcagcagcagaugccugcacagccacgccgaggcccugagagagaagugcgugaacugcaccagaagauucagaugcacccagggcuuccagcugcaggacacccccagaaagagcugcguguacagaagcggcuucagcuucagcagaggcugcagcuacaccugcgccaagaagauccaggugcccgacugcugccccggcuucuucggcacccugugcgagcccugccccggcggccugggcggcgugugcagcggccacggccagugccaggacagauuccugggcagcggcgagugccacugccacgagggcuuccacggcaccgccugcgaggugugcgagcugggcagauacggccccaacugcaccggcgugugcgacugcgcccacggccugugccaggagggccugcagggcgacggcagcugcgugugcaacgugggcuggcagggccugagaugcgaccagaagaucaccagcccccagugccccagaaagugcgaccccaacgccaacugcgugcaggacagcgccggcgccagcaccugcgccugcgccgccggcuacagcggcaacggcaucuucugcagcgagguggaccccugcgcccacggccacggcggcugcagcccccacgccaacugcaccaagguggcccccggccagagaaccugcaccugccaggacggcuacaugggcgacggcgagcugugccaggagaucaacagcugccugauccaccacggcggcugccacauccacgccgagugcauccccaccggcccccagcaggugagcugcagcugcagagagggcuacagcggcgacggcaucagaaccugcgagcugcuggaccccugcagcaagaacaacggcggcugcagccccuacgccaccugcaagagcaccggcgacggccagagaaccugcaccugcgacaccgcccacaccgugggcgacggccugaccugcagagccagagugggccuggagcugcugagagacaagcacgccagcuucuucagccugagacugcuggaguacaaggagcugaagggcgacggccccuucaccaucuucgugccccacgccgaccugaugagcaaccugagccaggacgagcuggccagaaucagagcccacagacagcugguguucagauaccacguggugggcugcagaagacugagaagcgaggaccugcuggagcagggcuacgccaccgcccugagcggccacccccugagauucagcgagagagagggcagcaucuaccugaacgacuucgccagaguggugagcagcgaccacgaggccgugaacggcauccugcacuucaucgacagagugcugcugccccccgaggcccugcacugggagcccgacgacgcccccauccccagaagaaacgugaccgccgccgcccagggcuucggcuacaagaucuucagcggccugcugaagguggccggccugcugccccugcugagagaggccagccacagacccuucaccaugcuguggcccaccgacgccgccuucagagcccugccccccgacagacaggccuggcuguaccacgaggaccacagagacaagcuggccgccauccugagaggccacaugaucagaaacguggaggcccuggccagcgaccugcccaaccugggcccccugagaaccaugcacggcacccccaucagcuucagcugcagcagaaccagagccggcgagcugauggugggcgaggacgacgccagaaucgugcagagacaccugcccuucgagggcggccuggccuacggcaucgaccagcugcuggagccccccggccugggcgccagaugcgaccacuucgagaccagaccccugagacugaacaccugcagcaucugcggccuggagccccccugccccgagggcagccaggagcagggcagccccgaggccugcuggagauucuaccccaaguucuggaccagccccccccugcacagccugggccugagaagcgugugggugcaccccagccuguggggcagaccccagggccugggcagaggcugccacagaaacugcgugaccaccaccuggaagcccagcugcugccccggccacuacggcagcgagugccaggccugccccggcggccccagcagccccugcagcgacagaggcgugugcauggacggcaugagcggcagcggccagugccugugcagaagcggcuucgccggcaccgccugcgagcugugcgcccccggcgccuucggcccccacugccaggccugcagaugcaccgugcacggcagaugcgacgagggccugggcggcagcggcagcugcuucugcgacgagggcuggaccggccccagaugcgaggugcagcuggagcugcagcccgugugcaccccccccugcgcccccgaggccgugugcagagccggcaacagcugcgagugcagccugggcuacgagggcgacggcagagugugcaccguggccgaccugugccaggacggccacggcggcugcagcgagcacgccaacugcagccaggugggcaccauggugaccugcaccugccugcccgacuacgagggcgacggcuggagcugcagagccagaaaccccugcaccgacggccacagaggcggcugcagcgagcacgccaacugccugagcaccggccugaacaccagaagaugcgagugccacgccggcuacgugggcgacggccugcagugccuggaggagagcgagccccccguggacagaugccugggccagcccccccccugccacagcgacgccaugugcaccgaccugcacuuccaggagaagagagccggcguguuccaccugcaggccaccagcggccccuacggccugaacuucagcgaggccgaggccgccugcgaggcccagggcgccgugcuggccagcuucccccagcugagcgccgcccagcagcugggcuuccaccugugccugaugggcuggcuggccaacggcagcaccgcccaccccgugguguuccccguggccgacugcggcaacggcagagugggcaucgugagccugggcgccagaaagaaccugagcgagagaugggacgccuacugcuucagagugcaggacguggccugcagaugcagaaacggcuucgugggcgacggcaucagcaccugcaacggcaagcugcuggacgugcuggccgccaccgccaacuucagcaccuucuacggcaugcugcugggcuacgccaacgccacccagagaggccuggacuuccuggacuuccuggacgacgagcugaccuacaagacccuguucgugcccgugaacgagggcuucguggacaacaugacccugagcggccccgaccuggagcugcacgccagcaacgccacccugcugagcgccaacgccagccagggcaagcugcugcccgcccacagcggccugagccugaucaucagcgacgccggccccgacaacagcagcugggcccccguggcccccggcaccgugguggugagcagaaucaucgugugggacaucauggccuucaacggcaucauccacgcccuggccagcccccugcuggcccccccccagccccaggccgugcuggcccccgaggccccccccguggccgccggcgugggcgccgugcuggccgccggcgcccugcugggccugguggccggcgcccuguaccugagagccagaggcaagcccaugggcuucggcuucagcgccuuccaggccgaggacgacgccgacgacgacuucagccccuggcaggagggcaccaaccccacccuggugagcgugcccaaccccguguucggcagcgacaccuucugcgagcccuucgacgacagccugcuggaggaggacuuccccgacacccagagaauccugaccgugaaguaa

SEQ ID NO: 24111 - RNA, 7656 nt, Artificial Sequence
  STAB2__Homo_sapiens__NP_060034
augaugcugcagcaccuggugaucuucugccugggccugguggugcagaacuucugcagccccgccgagaccaccggccaggccagaagaugcgacagaaagagccugcugaccaucagaaccgagugcagaagcugcgcccugaaccugggcgugaagugccccgacggcuacaccaugaucaccagcggcagcgugggcgugagagacugcagauacaccuucgaggugagaaccuacagccugagccugcccggcugcagacacaucugcagaaaggacuaccugcagcccagaugcugccccggcagauggggccccgacugcaucgagugccccggcggcgccggcagccccugcaacggcagaggcagcugcgccgagggcauggagggcaacggcaccugcagcugccaggagggcuucggcggcaccgccugcgagaccugcgccgacgacaaccuguucggccccagcugcagcagcgugugcaacugcgugcacggcgugugcaacagcggccuggacggcgacggcaccugcgagugcuacagcgccuacaccggccccaagugcgacaagcccauccccgagugcgccgcccugcugugccccgagaacagcagaugcagccccagcaccgaggacgagaacaagcuggagugcaagugccugcccaacuacagaggcgacggcaaguacugcgaccccaucaaccccugccugagaaagaucugccacccccacgcccacugcaccuaccugggccccaacagacacagcugcaccugccaggagggcuacagaggcgacggccaggugugccugcccguggaccccugccagaucaacuucggcaacugccccaccaagagcaccgugugcaaguacgacggccccggccagagccacugcgagugcaaggagcacuaccagaacuucgugcccggcgugggcugcagcaugaccgacaucugcaagagcgacaaccccugccacagaaacgccaacugcaccaccguggcccccggcagaaccgagugcaucugccagaagggcuacgugggcgacggccugaccugcuacggcaacaucauggagagacugagagagcugaacaccgagcccagaggcaaguggcagggcagacugaccagcuucaucagccugcuggacaaggccuacgccuggccccugagcaagcugggccccuucaccgugcugcugcccaccgacaagggccugaagggcuucaacgugaacgagcugcugguggacaacaaggccgcccaguacuucgugaagcugcacaucaucgccggccagaugaacaucgaguacaugaacaacaccgacauguucuacacccugaccggcaagagcggcgagaucuucaacagcgacaaggacaaccagaucaagcugaagcugcacggcggcaagaagaaggugaagaucauccagggcgacaucaucgccagcaacggccugcugcacauccuggacagagccauggacaagcuggagcccaccuucgagagcaacaacgagcagaccaucaugaccaugcugcagcccagauacagcaaguucagaagccugcuggaggagaccaaccugggccacgcccuggacgaggacggcgugggcggccccuacaccaucuucgugcccaacaacgaggcccugaacaacaugaaggacggcacccuggacuaccugcugagccccgagggcagcagaaagcugcuggagcuggugagauaccacaucgugcccuucacccagcuggagguggccacccugaucagcaccccccacaucagaagcauggccaaccagcugauccaguucaacaccaccgacaacggccagauccuggccaacgacguggccauggaggagaucgagaucaccgccaagaacggcagaaucuacacccugaccggcgugcugaucccccccagcaucgugcccauccugccccacagaugcgacgagaccaagagagagaugaagcugggcaccugcgugagcugcagccugguguacuggagcagaugccccgccaacagcgagcccaccgcccuguucacccacagaugcguguacagcggcagauucggcagccugaagagcggcugcgccagauacugcaacgccaccgugaagauccccaagugcugcaagggcuucuacggccccgacugcaaccagugccccggcggcuucagcaaccccugcagcggcaacggccagugcgccgacagccugggcggcaacggcaccugcaucugcgaggagggcuuccagggcagccagugccaguucugcagcgaccccaacaaguacggccccagaugcaacaagaagugccugugcgugcacggcaccugcaacaacagaaucgacagcgacggcgccugccugaccggcaccugcagagacggcagcgccggcagacugugcgacaagcagaccagcgccugcggccccuacgugcaguucugccacauccacgccaccugcgaguacagcaacggcaccgccagcugcaucugcaaggccggcuacgagggcgacggcacccugugcagcgagauggaccccugcaccggccugacccccggcggcugcagcagaaacgccgagugcaucaagaccggcaccggcacccacaccugcgugugccagcagggcuggaccggcaacggcagagacugcagcgagaucaacaacugccugcugcccagcgccggcggcugccacgacaacgccagcugccuguacgugggccccggccagaacgagugcgagugcaagaagggcuucagaggcaacggcaucgacugcgagcccaucaccagcugccuggagcagaccggcaagugccacccccuggccagcugccagagcaccagcagcggcguguggagcugcgugugccaggagggcuacgagggcgacggcuuccugugcuacggcaacgccgccguggagcugagcuuccugagcgaggccgccaucuucaacagauggaucaacaacgccagccugcagcccacccugagcgccaccagcaaccugaccgugcuggugcccagccagcaggccaccgaggacauggaccaggacgagaagagcuucuggcugagccagagcaacauccccgcccugaucaaguaccacaugcugcugggcaccuacagaguggccgaccugcagacccugagcagcagcgacaugcuggccaccagccugcagggcaacuuccugcaccuggccaagguggacggcaacaucaccaucgagggcgccagcaucguggacggcgacaacgccgccaccaacggcgugauccacaucaucaacaaggugcuggugccccagagaagacugaccggcagccugcccaaccugcugaugagacuggagcagaugcccgacuacagcaucuucagaggcuacaucauccaguacaaccuggccaacgccaucgaggccgccgacgccuacaccguguucgcccccaacaacaacgccaucgagaacuacaucagagagaagaaggugcugagccuggaggaggacgugcugagauaccacguggugcuggaggagaagcugcugaagaacgaccugcacaacggcaugcacagagagaccaugcugggcuucagcuacuuccugagcuucuuccugcacaacgaccagcuguacgugaacgaggcccccaucaacuacaccaacguggccaccgacaagggcgugauccacggccugggcaaggugcuggagauccagaagaacagaugcgacaacaacgacaccaccaucaucagaggcagaugcagaaccugcagcagcgagcugaccugccccuucggcaccaagagccugggcaacgagaagagaagaugcaucuacaccagcuacuucaugggcagaagaacccuguucaucggcugccagcccaagugcgugagaaccgugaucaccagagagugcugcgccggcuucuucggcccccagugccagcccugccccggcaacgcccagaacgugugcuucggcaacggcaucugccuggacggcgugaacggcaccggcgugugcgagugcggcgagggcuucagcggcaccgccugcgagaccugcaccgagggcaaguacggcauccacugcgaccaggccugcagcugcgugcacggcagaugcaaccagggcccccugggcgacggcagcugcgacugcgacgugggcuggagaggcgugcacugcgacaacgccaccaccgaggacaacugcaacggcaccugccacaccagcgccaacugccugaccaacagcgacggcaccgccagcugcaagugcgccgccggcuuccagggcaacggcaccaucugcaccgccaucaacgccugcgagaucagcaacggcggcugcagcgccaaggccgacugcaagagaaccacccccggcagaagagugugcaccugcaaggccggcuacaccggcgacggcaucgugugccuggagaucaaccccugccuggagaaccacggcggcugcgacaagaacgccgagugcacccagaccggccccaaccaggccgccugcaacugccugcccgccuacaccggcgacggcaaggugugcacccugaucaacgugugccugaccaagaacggcggcugcagcgaguucgccaucugcaaccacaccggccagguggagagaaccugcaccugcaagcccaacuacaucggcgacggcuucaccugcagaggcagcaucuaccaggagcugcccaagaaccccaagaccagccaguacuucuuccagcugcaggagcacuucgugaaggaccuggugggccccggccccuucaccguguucgccccccugagcgccgccuucgacgaggaggccagagugaaggacugggacaaguacggccugaugccccaggugcugagauaccacgugguggccugccaccagcugcugcuggagaaccugaagcugaucagcaacgccaccagccugcagggcgagcccaucgugaucagcgugagccagagcaccguguacaucaacaacaaggccaagaucaucagcagcgacaucaucagcaccaacggcaucgugcacaucaucgacaagcugcugagccccaagaaccugcugaucacccccaaggacaacagcggcagaauccugcagaaccugaccacccuggccaccaacaacggcuacaucaaguucagcaaccugauccaggacagcggccugcugagcgugaucaccgaccccauccacacccccgugacccuguucuggcccaccgaccaggcccugcacgcccugcccgccgagcagcaggacuuccuguucaaccaggacaacaaggacaagcugaaggaguaccugaaguuccacgugaucagagacgccaaggugcuggccguggaccugcccaccagcaccgccuggaagacccugcagggcagcgagcugagcgugaagugcggcgccggcagagacaucggcgaccuguuccugaacggccagaccugcagaaucgugcagagagagcugcuguucgaccugggcguggccuacggcaucgacugccugcugaucgaccccacccugggcggcagaugcgacaccuucaccaccuucgacgccagcggcgagugcggcagcugcgugaacacccccagcugccccagauggagcaagcccaagggcgugaagcagaagugccuguacaaccugcccuucaagagaaaccuggagggcugcagagagagaugcagccuggugauccagauccccagaugcugcaagggcuacuucggcagagacugccaggccugccccggcggccccgacgcccccugcaacaacagaggcgugugccuggaccaguacagcgccaccggcgagugcaagugcaacaccggcuucaacggcaccgccugcgagaugugcuggcccggcagauucggccccgacugccugcccugcggcugcagcgaccacggccagugcgacgacggcaucaccggcagcggccagugccugugcgagaccggcuggaccggccccagcugcgacacccaggccgugcugcccgccgugugcaccccccccugcagcgcccacgccaccugcaaggagaacaacaccugcgagugcaaccuggacuacgagggcgacggcaucaccugcaccgugguggacuucugcaagcaggacaacggcggcugcgccaagguggccagaugcagccagaagggcaccaaggugagcugcagcugccagaagggcuacaagggcgacggccacagcugcaccgagaucgaccccugcgccgacggccugaacggcggcugccacgagcacgccaccugcaagaugaccggccccggcaagcacaagugcgagugcaagagccacuacgugggcgacggccugaacugcgagcccgagcagcugcccaucgacagaugccugcaggacaacggccagugccacgccgacgccaagugcguggaccugcacuuccaggacaccaccgugggcguguuccaccugagaagcccccugggccaguacaagcugaccuucgacaaggccagagaggccugcgccaacgaggccgccaccauggccaccuacaaccagcugagcuacgcccagaaggccaaguaccaccugugcagcgccggcuggcuggagaccggcagaguggccuaccccaccgccuucgccagccagaacugcggcagcggcguggugggcaucguggacuacggccccagacccaacaagagcgagaugugggacguguucugcuacagaaugaaggacgugaacugcaccugcaaggugggcuacgugggcgacggcuucagcugcagcggcaaccugcugcaggugcugaugagcuuccccagccugaccaacuuccugaccgaggugcuggccuacagcaacagcagcgccagaggcagagccuuccuggagcaccugaccgaccugagcaucagaggcacccuguucgugccccagaacagcggccugggcgagaacgagacccugagcggcagagacaucgagcaccaccuggccaacgugagcauguucuucuacaacgaccuggugaacggcaccacccugcagaccagacugggcagcaagcugcugaucaccgccagccaggacccccugcagcccaccgagaccagauucguggacggcagagccauccugcagugggacaucuucgccagcaacggcaucauccacgugaucagcagaccccugaaggccccccccgcccccgugacccugacccacaccggccugggcgccggcaucuucuucgccaucauccuggugaccggcgccguggcccuggccgccuacagcuacuucagaaucaacagaagaaccaucggcuuccagcacuucgagagcgaggaggacaucaacguggccgcccugggcaagcagcagcccgagaacaucagcaacccccuguacgagagcaccaccagcgccccccccgagcccagcuacgaccccuucaccgacagcgaggagagacagcuggagggcaacgacccccugagaacccuguaa

SEQ ID NO: 24112 - RNA, 978 nt, Artificial Sequence
  STAC3__Homo_sapiens__NP_001273185
auggagcugccccccgagccccaggccaacggcgaggccgugggcgccggcggcggccccaucuacuacaucuacgaggaggaggaggaggaggaggaggaggaggaggagcccccccccgagccccccaagcuggugaacgacaagccccacaaguucaaggaccacuucuucaagaagcccaaguucugcgacgugugcgccagaaugaucgugcugaacaacaaguucggccugagaugcaagaacugcaagaccaacauccacgagcacugccagagcuacguggagaugcagagaugcuucggcaagaucccccccggcuuccacagagccuacagcagcccccuguacagcaaccagcaguacgccugcgugaaggaccugagcgccgccaacagaaacgaccccguguucgagacccugagaaccggcgugaucauggccaacaaggagagaaagaagggccaggccgacaagaagaaccccguggccgccaugauggaggaggagcccgagagcgccagacccgaggagggcaagccccaggacggcaaccccgagggcgacaagaaggccgagaagaagacccccgacgacaagcacaagcagcccggcuuccagcagagccacuacuucguggcccuguacagauucaaggcccuggagaaggacgaccuggacuucccccccggcgagaagaucaccgugaucgacgacagcaacgaggagugguggagaggcaagaucggcgagaaggugggcuucuucccccccaacuucaucaucagagugagagccggcgagagagugcacagagugaccagaagcuucgugggcaacagagagaucggccagaucacccugaagaaggaccagaucguggugcagaagggcgacgaggccggcggcuacgugaagguguacaccggcagaaaggugggccuguuccccaccgacuuccuggaggagaucuaa

SEQ ID NO: 24113 - RNA, 1209 nt, Artificial Sequence
  STAC__Homo_sapiens__NP_003140
augaucccccccagcagccccagagaggacggcguggacggccugcccaaggaggccgugggcgccgagcagccccccagccccgccagcaccagcagccaggagagcaagcugcagaagcugaagagaagccugagcuucaagaccaagagccugagaagcaagagcgccgacaacuucuuccagagaaccaacagcgaggacaugaagcugcaggcccacaugguggccgagaucagccccagcagcagcccccugcccgcccccggcagccugaccagcacccccgccagagccggccugcaccccggcggcaaggcccacgccuuccaggaguacaucuucaagaagcccaccuucugcgacgugugcaaccacaugaucgugggcaccaacgccaagcacggccugagaugcaaggccugcaagaugagcauccaccacaagugcaccgacggccuggccccccagagaugcaugggcaagcugcccaagggcuucagaagauacuacagcagcccccugcugauccacgagcaguucggcugcaucaaggaggugaugcccaucgccugcggcaacaagguggaccccguguacgagacccugagauucggcaccagccuggcccagagaaccaagaagggcagcagcggcagcggcagcgacagcccccacagaaccagcaccagcgaccugguggaggugcccgaggaggccaacggccccggcggcggcuacgaccugagaaagagaagcaacagcguguucaccuaccccgagaacggcaccgacgacuucagagaccccgccaagaacaucaaccaccagggcagccugagcaaggacccccugcagaugaacaccuacguggcccuguacaaguucgugccccaggagaacgaggaccuggagaugagacccggcgacaucaucacccugcuggaggacagcaacgaggacugguggaagggcaagauccaggacagaaucggcuucuuccccgccaacuucgugcagagacugcagcagaacgagaagaucuucagaugcgugagaaccuucaucggcugcaaggagcagggccagaucacccugaaggagaaccagaucugcgugagcagcgaggaggagcaggacggcuucaucagagugcugagcggcaagaagaagggccugaucccccuggacgugcuggagaacaucuaa

SEQ ID NO: 24114 - RNA, 3777 nt, Artificial Sequence
  STAG1__Homo_sapiens__NP_005853
augaucaccagcgagcugcccgugcugcaggacagcaccaacgagaccaccgcccacagcgacgccggcagcgagcuggaggagaccgaggugaagggcaagagaaagagaggcagacccggcagaccccccagcaccaacaagaagcccagaaagagccccggcgagaagagcagaaucgaggccggcaucagaggcgccggcagaggcagagccaacggccacccccagcagaacggcgagggcgagcccgugacccuguucgagguggugaagcugggcaagagcgccaugcagagcgugguggacgacuggaucgagagcuacaagcaggacagagacaucgcccugcuggaccugaucaacuucuucauccagugcagcggcugcagaggcaccgugagaaucgagauguucagaaacaugcagaacgccgagaucaucagaaagaugaccgaggaguucgacgaggacagcggcgacuacccccugaccaugcccggcccccaguggaagaaguucagaagcaacuucugcgaguucaucggcgugcugaucagacagugccaguacagcaucaucuacgacgaguacaugauggacaccgugaucagccugcugaccggccugagcgacagccaggugagagccuucagacacaccagcacccuggccgccaugaagcugaugaccgcccuggugaacguggcccugaaccugagcauccaccaggacaacacccagagacaguacgaggccgagagaaacaagaugaucggcaagagagccaacgagagacuggagcugcugcugcagaagagaaaggagcugcaggagaaccaggacgagaucgagaacaugaugaacagcaucuucaagggcaucuucgugcacagauacagagacgccaucgccgagaucagagccaucugcaucgaggagaucggcguguggaugaagauguacagcgacgccuuccugaacgacagcuaccugaaguacgugggcuggacccugcacgacagacagggcgaggugagacugaagugccugaaggcccugcagagccuguacaccaacagagagcuguuccccaagcuggagcuguucaccaacagauucaaggacagaaucgugagcaugacccuggacaaggaguacgacguggccguggaggccaucagacuggugacccugauccugcacggcagcgaggaggcccugagcaacgaggacugcgagaacguguaccaccugguguacagcgcccacagacccguggccguggccgccggcgaguuccugcacaagaagcuguucagcagacacgacccccaggccgaggaggcccuggccaagagaagaggcagaaacagccccaacggcaaccugaucagaaugcuggugcuguucuuccuggagagcgagcugcacgagcacgccgccuaccugguggacagccugugggagagcagccaggagcugcugaaggacugggagugcaugaccgagcugcugcuggaggagcccgugcagggcgaggaggccaugagcgacagacaggagagcgcccugaucgagcugauggugugcaccaucagacaggccgccgaggcccacccccccgugggcagaggcaccggcaagagagugcugaccgccaaggagagaaagacccagaucgacgacagaaacaagcugaccgagcacuucaucaucacccugcccaugcugcugagcaaguacagcgccgacgccgagaagguggccaaccugcugcagaucccccaguacuucgaccuggagaucuacagcaccggcagaauggagaagcaccuggacgcccugcugaagcagaucaaguucgugguggagaagcacguggagagcgacgugcuggaggccugcagcaagaccuacagcauccugugcagcgaggaguacaccauccagaacagaguggacaucgccagaagccagcugaucgacgaguucguggacagauucaaccacagcguggaggaccugcugcaggagggcgaggaggccgacgacgacgacaucuacaacgugcugagcacccugaagagacugaccagcuuccacaacgcccacgaccugaccaagugggaccuguucggcaacugcuacagacugcugaagaccggcaucgagcacggcgccaugcccgagcagaucguggugcaggcccugcagugcagccacuacagcauccuguggcagcuggugaagaucaccgacggcagccccagcaaggaggaccugcuggugcugagaaagaccgugaagagcuuccuggccgugugccagcagugccugagcaacgugaacacccccgugaaggagcaggccuucaugcugcugugcgaccugcugaugaucuucagccaccagcugaugaccggcggcagagagggccugcagccccugguguucaaccccgacaccggccugcagagcgagcugcugagcuucgugauggaccacguguucaucgaccaggacgaggagaaccagagcauggagggcgacgaggaggacgaggccaacaagaucgaggcccugcacaagagaagaaaccugcuggccgccuucagcaagcugaucaucuacgacaucguggacaugcacgccgccgccgacaucuucaagcacuacaugaaguacuacaacgacuacggcgacaucaucaaggagacccugagcaagaccagacagaucgacaagauccagugcgccaagacccugauccugagccugcagcagcuguucaacgagcuggugcaggagcagggccccaaccuggacagaaccagcgcccacgugagcggcaucaaggagcuggccagaagauucgcccugaccuucggccuggaccagaucaagaccagagaggccguggccacccugcacaaggacggcaucgaguucgccuucaaguaccagaaccagaagggccaggaguaccccccccccaaccuggccuuccuggaggugcugagcgaguucagcagcaagcugcugagacaggacaagaagaccgugcacagcuaccuggagaaguuccugaccgagcagaugauggagagaagagaggacguguggcugccccugaucagcuacagaaacagccuggugaccggcggcgaggacgacagaaugagcgugaacagcggcagcagcagcagcaagaccagcagcgugagaaacaagaagggcagacccccccugcacaagaagagaguggaggacgagagccuggacaacaccuggcugaacagaaccgacaccaugauccagacccccggcccccugcccgccccccagcugaccagcaccgugcugagagagaacagcagacccaugggcgaccagauccaggagcccgagagcgagcacggcagcgagcccgacuuccugcacaacccccagaugcagaucagcuggcugggccagcccaagcuggaggaccugaacagaaaggacagaaccggcaugaacuacaugaaggugagaaccggcgugagacacgccgugagaggccugauggaggaggacgccgagcccaucuucgaggacgugaugaugagcagcagaagccagcuggaggacaugaacgaggaguucgaggacaccauggugaucgaccugccccccagcagaaacagaagagagagagccgagcugagacccgacuucuucgacagcgccgccaucaucgaggacgacagcggcuucggcaugcccauguucuaa

SEQ ID NO: 24115 - RNA, 3807 nt, Artificial Sequence
  STAG2__Homo_sapiens__NP_001036215
augaucgccgcccccgagauccccaccgacuucaaccugcugcaggagagcgagacccacuucagcagcgacaccgacuucgaggacaucgagggcaagaaccagaagcagggcaagggcaagaccugcaagaagggcaagaagggccccgccgagaagggcaagggcggcaacggcggcggcaagccccccagcggccccaacagaaugaacggccaccaccagcagaacggcguggagaacaugaugcuguucgagguggugaagaugggcaagagcgccaugcagagcgugguggacgacuggaucgagagcuacaagcacgacagagacaucgcccugcuggaccugaucaacuucuucauccagugcagcggcugcaagggcguggugaccgccgagauguucagacacaugcagaacagcgagaucaucagaaagaugaccgaggaguucgacgaggacagcggcgacuacccccugaccauggccggcccccaguggaagaaguucaagagcagcuucugcgaguucaucggcgugcuggugagacagugccaguacagcaucaucuacgacgaguacaugauggacaccgugaucagccugcugaccggccugagcgacagccaggugagagccuucagacacaccagcacccuggccgccaugaagcugaugaccgcccuggugaacguggcccugaaccugagcaucaacauggacaacacccagagacaguacgaggccgagagaaacaagaugaucggcaagagagccaacgagagacuggagcugcugcugcagaagagaaaggagcugcaggagaaccaggacgagaucgagaacaugaugaacgccaucuucaagggcguguucgugcacagauacagagacgccaucgccgagaucagagccaucugcaucgaggagaucggcaucuggaugaagauguacagcgacgccuuccugaacgacagcuaccugaaguacgugggcuggaccaugcacgacaagcagggcgaggugagacugaagugccugaccgcccugcagggccuguacuacaacaaggagcugaacagcaagcuggagcuguucaccagcagauucaaggacagaaucgugagcaugacccuggacaaggaguacgacguggccgugcaggccaucaagcugcugacccuggugcugcagagcagcgaggaggugcugaccgccgaggacugcgagaacguguaccaccugguguacagcgcccacagacccguggccguggccgccggcgaguuccuguacaagaagcuguucagcagaagagaccccgaggaggacggcaugaugaagagaagaggcagacagggccccaacgccaaccuggugaagacccugguguucuucuuccuggagagcgagcugcacgagcacgccgccuaccugguggacagcaugugggacugcgccaccgagcugcugaaggacugggagugcaugaacagccugcugcuggaggagccccugagcggcgaggaggcccugaccgacagacaggagagcgcccugaucgagaucaugcugugcaccaucagacaggccgccgagugccacccccccgugggcagaggcaccggcaagagagugcugaccgccaaggagaagaagacccagcuggacgacagaaccaagaucaccgagcuguucgccguggcccugccccagcugcuggccaaguacagcguggacgccgagaaggugaccaaccugcugcagcugccccaguacuucgaccuggagaucuacaccaccggcagacuggagaagcaccuggacgcccugcugagacagaucagaaacaucguggagaagcacaccgacaccgacgugcuggaggccugcagcaagaccuaccacgcccugugcaacgaggaguucaccaucuucaacagaguggacaucagcagaagccagcugaucgacgagcuggccgacaaguucaacagacugcuggaggacuuccugcaggagggcgaggagcccgacgaggacgacgccuaccaggugcugagcacccugaagagaaucaccgccuuccacaacgcccacgaccugagcaagugggaccuguucgccugcaacuacaagcugcugaagaccggcaucgagaacggcgacaugcccgagcagaucgugauccacgcccugcagugcacccacuacgugauccuguggcagcuggccaagaucaccgagagcagcagcaccaaggaggaccugcugagacugaagaagcagaugagaguguucugccagaucugccagcacuaccugaccaacgugaacaccaccgugaaggagcaggccuucaccauccugugcgacauccugaugaucuucagccaccagaucaugagcggcggcagagacaugcuggagccccugguguacacccccgacagcagccugcagagcgagcugcugagcuucauccuggaccacguguucaucgagcaggacgacgacaacaacagcgccgacggccagcaggaggacgaggccagcaagaucgaggcccugcacaagagaagaaaccugcuggccgccuucugcaagcugaucguguacaccgugguggagaugaacaccgccgccgacaucuucaagcaguacaugaaguacuacaacgacuacggcgacaucaucaaggagaccaugagcaagaccagacagaucgacaagauccagugcgccaagacccugauccugagccugcagcagcuguucaacgagaugauccaggagaacggcuacaacuucgacagaagcagcagcaccuucagcggcaucaaggagcuggccagaagauucgcccugaccuucggccuggaccagcugaagaccagagaggccaucgccaugcugcacaaggacggcaucgaguucgccuucaaggagcccaacccccagggcgagagccaccccccccugaaccuggccuuccuggacauccugagcgaguucagcagcaagcugcugagacaggacaagagaaccguguacguguaccuggagaaguucaugaccuuccagaugagccugagaagagaggacguguggcugccccugaugagcuacagaaacagccugcuggccggcggcgacgacgacaccaugagcgugaucagcggcaucagcagcagaggcagcaccgugagaagcaagaagagcaagcccagcaccggcaagagaaaggugguggagggcaugcagcugagccugaccgaggagagcagcagcagcgacagcauguggcugagcagagagcagacccugcacacccccgugaugaugcagaccccccagcugaccagcaccaucaugagagagcccaagagacugagacccgaggacagcuucaugagcguguaccccaugcagaccgagcaccaccagaccccccuggacuacaacacccaggugaccuggaugcuggcccagagacagcaggaggaggccagacagcagcaggagagagccgccaugagcuacgugaagcugagaaccaaccugcagcacgccaucagaagaggcaccagccugauggaggacgacgaggagcccaucguggaggacgugaugaugagcagcgagggcagaaucgaggaccugaacgagggcauggacuucgacaccauggacaucgaccugccccccagcaagaacagaagagagagaaccgagcugaagcccgacuucuucgaccccgccagcaucauggacgagagcgugcugggcgugagcauguucuaa

SEQ ID NO: 24116 - RNA, 3681 nt, Artificial Sequence
  STAG3__Homo_sapiens__NP_001269646
augagcagcccccugcagagagccgugggcgacaccaagagagcccugagcgccagcagcagcagcagcgccagccugcccuucgacgacagagacagcaaccacaccagcgagggcaacggcgacagccugcuggccgacgaggacaccgacuucgaggacagccugaacagaaacgugaagaagagagccgccaagagaccccccaagaccacccccguggccaagcaccccaagaagggcagcagaguggugcacagacacagcagaaagcagagcgagccccccgccaacgaccuguucaacgccgugaaggccgccaagagcgacaugcagagccugguggacgaguggcuggacagcuacaagcaggaccaggacgccggcuuccuggagcuggugaacuucuucauccagagcugcggcugcaagggcaucgugacccccgagauguucaagaagaugagcaacagcgagaucauccagcaccugaccgagcaguucaacgaggacagcggcgacuacccccugaucgcccccggccccagcuggaagaaguuccagggcagcuucugcgaguucgugagaacccuggugugccagugccaguacagccugcuguacgacggcuuccccauggacgaccugaucagccugcugaccggccugagcgacagccaggugagagccuucagacacaccagcacccuggccgccaugaagcugaugaccagccuggugaagguggcccugcagcugagcgugcaccaggacaacaaccagagacaguacgaggccgagagaaacaagggccccggccagagagcccccgagagacuggagagccugcuggagaagagaaaggagcugcaggagcaccaggaggagaucgagggcaugaugaacgcccuguucagaggcguguucgugcacagauacagagacgugcugcccgagaucagagccaucugcaucgaggagaucggcugcuggaugcagagcuacagcaccagcuuccugaccgacagcuaccugaaguacaucggcuggacccugcacgacaagcacagagaggugagacugaagugcgugaaggcccugaagggccuguacggcaacagagaccugaccaccagacuggagcuguucaccagcagauucaaggacagaauggugagcauggugauggacagagaguacgacguggccguggaggccgugagacugcugauccugauccugaagaacauggagggcgugcugaccgacgccgacugcgagagcguguaccccgugguguacgccagccacagaggccuggccagcgccgccggcgaguuccuguacuggaagcuguucuaccccgagugcgagaucagaaugaugggcggcagagagcagagacagagccccggcgcccagagaaccuucuuccagcugcugcugagcuucuucguggagagcgagcugcacgaccacgccgccuaccugguggacagccugugggacugcgccggcgccagacugaaggacugggagggccugaccagccugcugcuggagaaggaccagaaccugggcgacgugcaggagagcacccugaucgagauccuggugagcagcgccagacaggccagcgagggccacccccccgugggcagagugaccggcagaaagggccugaccagcaaggagagaaagacccaggccgacgacagagugaagcugaccgagcaccugaucccccugcugccccagcugcuggccaaguucagcgccgacgccgagaaggugaccccccugcugcagcugcugagcugcuucgaccugcacaucuacugcaccggcagacuggagaagcaccuggagcuguuccugcagcagcugcaggaggugguggugaagcacgccgagcccgccgugcuggaggccggcgcccacgcccuguaccugcugugcaaccccgaguucaccuucuucagcagagccgacuucgccagaagccagcugguggaccugcugaccgacagauuccagcaggagcuggaggagcugcugcagagcagcuuccuggacgaggacgagguguacaaccuggccgccacccugaagagacugagcgccuucuacaacacccacgaccugaccagaugggagcuguacgagcccugcugccagcugcugcagaaggccguggacaccggcgaggugccccaccaggugauccugcccgcccugacccugguguacuucagcauccuguggacccugacccacaucagcaagagcgacgccagccagaagcagcugagcagccugagagacagaaugguggccuucugcgagcugugccagagcugccugagcgacguggacaccgagauccaggagcaggccuucgugcugcugagcgaccugcugcugaucuucagcccccagaugaucgugggcggcagagacuuccugagaccccugguguucuuccccgaggccacccugcagagcgagcuggccagcuuccugauggaccacguguucauccagcccggcgaccugggcagcggcgacagccaggaggaccaccugcagaucgagagacugcaccagagaagaagacugcuggccggcuucugcaagcugcugcuguacggcgugcuggagauggacgccgccagcgacguguucaagcacuacaacaaguucuacaacgacuacggcgacaucaucaaggagacccugaccagagccagacagaucgacagaagccacugcagcagaauccugcugcugagccugaagcagcuguacaccgagcugcugcaggagcacggcccccagggccugaacgagcugcccgccuucaucgagaugagagaccuggccagaagauucgcccugagcuucggcccccagcagcugcagaacagagaccugguggugaugcugcacaaggagggcauccaguucagccugagcgagcugccccccgccggcagcagcaaccagccccccaaccuggccuuccuggagcugcugagcgaguucagccccagacuguuccaccaggacaagcagcugcugcugagcuaccuggagaagugccugcagcacgugagccaggcccccggccaccccuggggccccgugaccaccuacugccacagccugagccccguggagaacaccgccgagaccagcccccaggugcugcccagcagcaagagaagaagaguggagggccccgccaagcccaacagagaggacgugagcagcagccaggaggagagccugcagcugaacagcaucccccccacccccacccugaccagcaccgccgugaagagcagacagccccuguggggccugaaggagauggaggaggaggacggcagcgagcuggacuucgcccagggcagccagcccguggccggcaccgagagaagcagauuccugggcccccaguacuuccagaccccccacaaccccagcggccccggccugggcaaccagcugaugagacugagccugauggaggaggacgaggaggaggagcuggagauccaggacgagagcaacgaggagagacaggacaccgacaugcaggccagcagcuacagcagcaccagcgagagaggccuggaccugcuggacagcaccgagcuggacaucgaggacuucuaa

SEQ ID NO: 24117 - RNA, 1578 nt, Artificial Sequence
  STAM2__Homo_sapiens__NP_005834
augccccuguucaccgccaaccccuucgagcaggacguggagaaggccaccaacgaguacaacaccaccgaggacuggagccugaucauggacaucugcgacaaggugggcagcacccccaacggcgccaaggacugccugaaggccaucaugaagagagugaaccacaaggugccccacguggcccugcaggcccugacccugcugggcgccugcguggccaacugcggcaagaucuuccaccuggaggugugcagcagagacuucgccaccgaggugagagccgugaucaagaacaaggcccaccccaaggugugcgagaagcugaagagccugaugguggaguggagcgaggaguuccagaaggacccccaguucagccugaucagcgccaccaucaagagcaugaaggaggagggcaucaccuucccccccgccggcagccagaccgugagcgccgccgccaagaacggcaccagcagcaacaagaacaaggaggacgaggacaucgccaaggccaucgagcugagccugcaggagcagaagcagcagcacaccgagaccaagagccuguaccccagcagcgagauccagcugaacaacaagguggccagaaaggugagagcccuguacgacuucgaggccguggaggacaacgagcugaccuucaagcacggcgagaucaucaucgugcuggacgacagcgacgccaacugguggaagggcgagaaccacagaggcaucggccuguuccccagcaacuucgugaccaccaaccugaacaucgagaccgaggccgccgccguggacaagcugaacgugaucgacgacgacguggaggagaucaagaagagcgagcccgagcccguguacaucgacgaggacaagauggacagagcccugcaggugcugcagagcaucgaccccaccgacagcaagcccgacagccaggaccugcuggaccuggaggacaucugccagcagaugggccccaugaucgacgagaagcuggaggagaucgacagaaagcacagcgagcugagcgagcugaacgugaaggugcuggaggcccuggagcuguacaacaagcuggugaacgaggcccccguguacagcguguacagcaagcugcacccccccgcccacuacccccccgccagcagcggcgugcccaugcagaccuaccccgugcagagccacggcggcaacuacaugggccagagcauccaccaggugaccguggcccagagcuacagccugggccccgaccagaucggcccccugagaagccugccccccaacgugaacagcagcgugaccgcccagcccgcccagaccagcuaccugagcaccggccaggacaccgugagcaaccccaccuacaugaaccagaacagcaaccugcagagcgccaccggcaccaccgccuacacccagcagaugggcaugagcguggacaugagcagcuaccagaacaccaccagcaaccugccccagcuggccggcuuccccgugaccgugcccgcccaccccguggcccagcagcacaccaacuaccaccagcagccccugcuguaa

SEQ ID NO: 24118 - RNA, 1275 nt, Artificial Sequence
  STAMBP__Homo_sapiens__NP_998787
augagcgaccacggcgacgugagccugccccccgaggacagagugagagcccugagccagcugggcagcgccguggaggugaacgaggacaucccccccagaagauacuucagaagcggcguggagaucaucagaauggccagcaucuacagcgaggagggcaacaucgagcacgccuucauccuguacaacaaguacaucacccuguucaucgagaagcugcccaagcacagagacuacaagagcgccgugauccccgagaagaaggacaccgugaagaagcugaaggagaucgccuuccccaaggccgaggagcugaaggccgagcugcugaagagauacaccaaggaguacaccgaguacaacgaggagaagaagaaggaggccgaggagcuggccagaaacauggccauccagcaggagcuggagaaggagaagcagagaguggcccagcagaagcagcagcagcuggagcaggagcaguuccacgccuucgaggagaugaucagaaaccaggagcuggagaaggagagacugaagaucgugcaggaguucggcaagguggaccccggccugggcggcccccuggugcccgaccuggagaagcccagccuggacguguuccccacccugaccgugagcagcauccagcccagcgacugccacaccaccgugagacccgccaagccccccgugguggacagaagccugaagcccggcgcccugagcaacagcgagagcauccccaccaucgacggccugagacacgugguggugcccggcagacugugcccccaguuccugcagcuggccagcgccaacaccgccagaggcguggagaccugcggcauccugugcggcaagcugaugagaaacgaguucaccaucacccacgugcugauccccaagcagagcgccggcagcgacuacugcaacaccgagaacgaggaggagcuguuccugauccaggaccagcagggccugaucacccugggcuggauccacacccaccccacccagaccgccuuccugagcagcguggaccugcacacccacugcagcuaccagaugaugcugcccgagagcguggccaucgugugcagccccaaguuccaggagaccggcuucuucaagcugaccgaccacggccuggaggagaucagcagcugcagacagaagggcuuccacccccacagcaaggaccccccccuguucugcagcugcagccacgugaccgugguggacagagccgugaccaucaccgaccugagauaa

SEQ ID NO: 24119 - RNA, 1311 nt, Artificial Sequence
  STAMBPL1__Homo_sapiens__NP_065850
auggaccagcccuucaccgugaacagccugaagaagcuggccgccaugcccgaccacaccgacgugagccugagccccgaggagagagugagagcccugagcaagcugggcugcaacaucaccaucagcgaggacaucacccccagaagauacuucagaagcggcguggagauggagagaauggccagcguguaccuggaggagggcaaccuggagaacgccuucgugcuguacaacaaguucaucacccuguucguggagaagcugcccaaccacagagacuaccagcagugcgccgugcccgagaagcaggacaucaugaagaagcugaaggagaucgccuuccccagaaccgacgagcugaagaacgaccugcugaagaaguacaacguggaguaccaggaguaccugcagagcaagaacaaguacaaggccgagauccugaagaagcuggagcaccagagacugaucgaggccgagagaaagagaaucgcccagaugagacagcagcagcuggagagcgagcaguuccuguucuucgaggaccagcugaagaagcaggagcuggccagaggccagaugagaagccagcagaccagcggccugagcgagcagaucgacggcagcgcccugagcugcuucagcacccaccagaacaacagccugcugaacguguucgccgaccagcccaacaagagcgacgccaccaacuacgccagccacagcccccccgugaacagagcccugacccccgccgccacccugagcgccgugcagaaccuggugguggagggccugagaugcguggugcugcccgaggaccugugccacaaguuccugcagcuggccgagagcaacaccgugagaggcaucgagaccugcggcauccugugcggcaagcugacccacaacgaguucaccaucacccacgugaucgugcccaagcagagcgccggccccgacuacugcgacauggagaacguggaggagcuguucaacgugcaggaccagcacgaccugcugacccugggcuggauccacacccaccccacccagaccgccuuccugagcagcguggaccugcacacccacugcagcuaccagcugaugcugcccgaggccaucgccaucgugugcagccccaagcacaaggacaccggcaucuucagacugaccaacgccggcaugcuggaggugagcgccugcaagaagaagggcuuccacccccacaccaaggagcccagacuguucagcaucugcaagcacgugcuggugaaggacaucaagaucaucgugcuggaccugagauaa

SEQ ID NO: 24120 - RNA, 1623 nt, Artificial Sequence
  STAM__Homo_sapiens__NP_003464
augccccuguucgccaccaaccccuucgaccaggacguggagaaggccaccagcgagaugaacaccgccgaggacuggggccugauccuggacaucugcgacaaggugggccagagcagaaccggccccaaggacugccugagaagcaucaugagaagagugaaccacaaggacccccacguggccaugcaggcccugacccugcugggcgccugcgugagcaacugcggcaagaucuuccaccuggaggugugcagcagagacuucgccagcgaggugagcaacgugcugaacaagggccaccccaaggugugcgagaagcugaaggcccugaugguggaguggaccgacgaguucaagaacgacccccagcugagccugaucagcgccaugaucaagaaccugaaggagcagggcgugaccuuccccgccaucggcagccaggccgccgagcaggccaaggccagccccgcccugguggccaaggaccccggcaccguggccaacaagaaggaggaggaggaccuggccaaggccaucgagcugagccugaaggagcagagacagcagagcaccacccugagcacccuguaccccagcaccagcagccugcugaccaaccaccagcacgagggcagaaaggugagagccaucuacgacuucgaggccgccgaggacaacgagcugaccuucaaggccggcgagaucaucaccgugcuggacgacagcgaccccaacugguggaagggcgagacccaccagggcaucggccuguuccccagcaacuucgugaccgccgaccugaccgccgagcccgagaugaucaagaccgagaagaagaccgugcaguucagcgacgacgugcagguggagaccaucgagcccgagcccgagcccgccuucaucgacgaggacaagauggaccagcugcugcagaugcugcagagcaccgaccccagcgacgaccagcccgaccugcccgagcugcugcaccuggaggccaugugccaccagaugggcccccugaucgacgagaagcuggaggacaucgacagaaagcacagcgagcugagcgagcugaacgugaaggugauggaggcccugagccuguacaccaagcugaugaacgaggaccccauguacagcauguacgccaagcugcagaaccagcccuacuacaugcagagcagcggcgugagcggcagccagguguacgccggccccccccccagcggcgccuaccugguggccggcaacgcccagaugagccaccugcagagcuacagccugccccccgagcagcugagcagccugagccaggccguggugccccccagcgccaaccccgcccugcccagccagcagacccaggccgccuaccccaacaccauggugagcagcgugcagggcaacaccuaccccagccaggcccccguguacagccccccccccgccgccaccgccgccgccgccaccgccgacgugacccuguaccagaacgccggccccaacaugccccaggugcccaacuacaaccugaccagcagcacccugccccagcccggcggcagccagcagcccccccagccccagcagcccuacagccagaaggcccugcuguaa

SEQ ID NO: 24121 - RNA, 888 nt, Artificial Sequence
  STAP1__Homo_sapiens__NP_036240
augauggccaagaagccccccaagcccgcccccagaagaaucuuccaggagagacugaagaucaccgcccugccccuguacuucgagggcuuccugcugaucaagagaagcggcuacagagaguacgagcacuacuggaccgagcugagaggcaccacccuguucuucuacaccgacaagaagagcaucaucuacguggacaagcuggacaucguggaccugaccugccugaccgagcagaacagcaccgagaagaacugcgccaaguucacccuggugcugcccaaggaggaggugcagcugaagaccgagaacaccgagagcggcgaggaguggagaggcuucauccugaccgugaccgagcugagcgugccccagaacgugagccugcugcccggccaggugaucaagcugcacgaggugcuggagagagagaagaagagaagaaucgagaccgagcagagcaccagcguggagaaggagaaggagcccaccgaggacuacguggacgugcugaaccccaugcccgccugcuucuacaccgugagcagaaaggaggccaccgagaugcugcagaagaaccccagccugggcaacaugauccugagacccggcagcgacagcagaaacuacagcaucaccaucagacaggagaucgacauccccagaaucaagcacuacaaggugaugagcgugggccagaacuacaccaucgagcuggagaagcccgugacccugcccaaccuguucagcgugaucgacuacuucgugaaggagaccagaggcaaccugagacccuucaucugcagcaccgacgagaacaccggccaggagcccagcauggagggcagaagcgagaagcugaagaagaacccccacaucgccuaa

SEQ ID NO: 24122 - RNA, 1212 nt, Artificial Sequence
  STAP2__Homo_sapiens__NP_001013863
auggccagcgcccugagaccccccagagugcccaagcccaagggcgugcugcccagccacuacuacgagagcuuccuggagaagaagggccccugcgacagagacuacaagaaguucugggccggccugcagggccugaccaucuacuucuacaacagcaacagagacuuccagcacguggagaagcugaaccugggcgccuucgagaagcugaccgacgagauccccuggggcagcagcagagaccccggcacccacuucagccugauccugagagaccaggagaucaaguucaagguggagacccuggagugcagagagauguggaagggcuucauccugaccgugguggagcugagagugcccaccgaccugacccugcugcccggccaccuguacaugaugagcgaggugcuggccaaggaggaggccagaagagcccuggagacccccagcugcuuccugaaggugagcagacuggaggcccagcugcugcuggagagauaccccgagugcggcaaccugcugcugagacccagcggcgacggcgccgacggcgugagcgugaccaccagacagaugcacaacggcacccacguggugagacacuacaaggugaagagagagggccccaaguacgugaucgacguggagcagcccuucagcugcaccagccuggacgccguggugaacuacuucgugagccacaccaagaaggcccuggugcccuuccugcuggacgaggacuacgagaaggugcugggcuacguggaggccgacaaggagaacggcgagaacguguggguggcccccagcgcccccggccccggccccgcccccugcaccggcggccccaagccccugagccccgccagcagccaggacaagcugcccccccugcccccccugcccaaccaggaggagaacuacgugacccccaucggcgacggccccgccguggacuacgagaaccaggacguggccagcagcagcuggcccgugauccugaagcccaagaagcugcccaagccccccgccaagcugcccaagccccccgugggccccaagcccgagcccaagguguucaacggcggccugggcagaaagcugcccgugagcagcgcccagccccuguuccccaccgccggccuggccgacaugaccgccgagcugcagaagaagcuggagaagagaagagcccuggagcacuaa

SEQ ID NO: 24123 - RNA, 876 nt, Artificial Sequence
  STARD10__Homo_sapiens__NP_006636
auggagaagcuggccgccagcaccgagccccagggccccagacccgugcugggcagagagagcgugcaggugcccgacgaccaggacuucagaagcuucagaagcgagugcgaggccgaggugggcuggaaccugaccuacagcagagccggcgugagcgugugggugcaggccguggagauggacagaacccugcacaagaucaagugcagaauggagugcugcgacgugcccgccgagacccuguacgacgugcugcacgacaucgaguacagaaagaagugggacagcaacgugaucgagaccuucgacaucgccagacugaccgugaacgccgacgugggcuacuacagcuggagaugccccaagccccugaagaacagagacgugaucacccugagaagcuggcugcccaugggcgccgacuacaucaucaugaacuacagcgugaagcaccccaaguacccccccagaaaggaccuggugagagccgugagcauccagaccggcuaccugauccagagcaccggccccaagagcugcgugaucaccuaccuggcccagguggaccccaagggcagccugcccaaguggguggugaacaagagcagccaguuccuggcccccaaggccaugaagaagauguacaaggccugccugaaguaccccgaguggaagcagaagcaccugccccacuucaagcccuggcugcaccccgagcagagcccccugcccagccuggcccugagcgagcugagcgugcagcacgccgacagccuggagaacaucgacgagagcgccguggccgagagcagagaggagagaaugggcggcgccggcggcgagggcagcgacgacgacaccagccugaccuaa

SEQ ID NO: 24124 - RNA, 2064 nt, Artificial Sequence
  STARD13__Homo_sapiens__NP_001230395
augcuggagcccagcagcgugcugcacgccaacgugaaccaggccccccuguggugccuggugcugagauggugcagagagugcaaggacaccgugugcggcggcaagcagaagagcagagugaaccacaccuuccagagaagagagaucgaggccaaggaggccugcgacuggcugagagccgccggcuucccccaguacgcccagcuguacgaggacagccaguuccccaucaacaucguggccgugaagaacgaccacgacuuccuggagaaggaccugguggagccccugugcagaagacugaacacccugaacaagugcgccagcaugaagcuggacgugaacuuccagagaaagaagggcgacgacagcgacgaggaggaccugugcaucagcaacaaguggaccuuccagagaaccagcagaagauggagcagaguggacgaccuguacacccugcugcccagaggcgacagaaacggcagccccggcggcaccggcaugagaaacaccaccagcagcgagagcgugcugaccgaccugagcgagcccgaggugugcagcauccacagcgagagcagcggcggcagcgacagcagaagccagcccggccagugcugcaccgacaaccccgugaugcuggacgccccccuggugagcagcagccugccccagccccccagagacgugcugaaccaccccuuccaccccaagaacgagaagcccaccagagccagagccaagagcuuccugaagagaauggagacccugagaggcaagggcgcccacggcagacacaagggcagcggcagaaccggcggccuggugaucagcggccccaugcugcagcaggagcccgagagcuucaaggccaugcagugcauccagauccccaacggcgaccugcagaacagccccccccccgccugcagaaagggccugcccugcagcggcaagagcagcggcgagagcagccccagcgagcacagcagcagcggcgugagcacccccugccugaaggagagaaagugccacgaggccaacaagagaggcggcauguaccuggaggaccuggacgugcuggccggcaccgcccugcccgacgccggcgaccagagcagaaugcacgaguuccacagccaggagaaccugguggugcacauccccaaggaccacaagcccggcaccuuccccaaggcccugagcaucgagagccugagccccaccgacagcagcaacggcgugaacuggagaaccggcagcaucagccugggcagagagcaggugcccggcgccagagagcccagacugauggccagcugccacagagccagcagagugagcaucuacgacaacgugcccggcagccaccuguacgccagcaccggcgaccugcuggaccuggagaaggacgaccuguucccccaccuggacgacauccugcagcacgugaacggccugcaggaggugguggacgacuggagcaaggacgugcugcccgagcugcagacccacgacacccuggugggcgagcccggccugagcaccuuccccagccccaaccagaucacccuggacuucgagggcaacagcgugagcgagggcagaaccacccccagcgacguggagagagacgugaccagccugaacgagagcgagccccccggcgugagagacagaagagacagcggcgugggcgccagccugaccagacccaacagaagacugagauggaacagcuuccagcugagccaccagcccagacccgcccccgccagcccccacaucagcagccagaccgccagccagcugagccugcugcagagauucagccugcugagacugaccgccaucauggagaagcacagcaugagcaacaagcacggcuggaccuggagcgugcccaaguucaugaagagaaugaaggugcccgacuacaaggacaaggccguguucggcgugccccugaucgugcacgugcagagaaccggccagccccugccccagagcauccagcaggcccugagauaccugagaagcaacugccuggaccaggaguaa

SEQ ID NO: 24125 - RNA, 1338 nt, Artificial Sequence
  STARD3__Homo_sapiens__NP_001159409
augagcaagcugcccagagagcugaccagagaccuggagagaagccugcccgccguggccagccugggcagcagccugagccacagccagagccugagcagccaccugcugcccccccccgagaagagaagagccaucagcgacgugagaagaaccuucugccuguucgugaccuucgaccugcuguucaucagccugcuguggaucaucgagcugaacaccaacaccggcaucagaaagaaccuggagcaggagaucauccaguacaacuucaagaccagcuucuucgacaucuucgugcuggccuucuucagauucagcggccugcugcugggcuacgccgugcugagacugagacacuggagcagaagauggugccccgugcacagcagccugagcagaagcagcagccugagcugcagcgccaagggccaccuggccaccugcagccccagcagccugcugagcagccccggcuggagacccggcagccugaccagcaagagcuaccccagaaagcugaagagaagcgacagcgccccccccggcuaccuggccgcccagguggccguggccagaggcccccugcuguucagcggcgcccugagcgagggccaguucuacagcccccccgagagcuucgccggcagcgacaacgagagcgacgaggagguggccggcaagaagagcuucagcgcccaggagagagaguacaucagacagggcaaggaggccaccgccgugguggaccagauccuggcccaggaggagaacuggaaguucgagaagaacaacgaguacggcgacaccguguacaccaucgaggugcccuuccacggcaagaccuucauccugaagaccuuccugcccugccccgccgagcugguguaccaggaggugauccugcagcccgagagaauggugcuguggaacaagaccgugaccgccugccagauccugcagagaguggaggacaacacccugaucagcuacgacgugagcgccggcgccgccggcggcguggugagccccagagacuucgugaacgugagaagaaucgagagaagaagagacagauaccugagcagcggcaucgccaccagccacagcgccaagccccccacccacaaguacgugagaggcgagaacggccccggcggcuucaucgugcugaagagcgccagcaaccccagagugugcaccuucguguggauccugaacaccgaccugaagggcagacugcccagauaccugauccaccagagccuggccgccaccauguucgaguucgccuuccaccugagacagagaaucagcgagcugggcgccagagccuaa

SEQ ID NO: 24126 - RNA, 705 nt, Artificial Sequence
  STARD3NL__Homo_sapiens__NP_114405
augaaccaccugcccgaggacauggagaacgcccugaccggcagccagagcagccacgccagccugagaaacauccacagcaucaaccccacccagcugauggccagaaucgagagcuacgagggcagagagaagaagggcaucagcgacgugagaagaaccuucugccuguucgugaccuucgaccugcuguucgugacccugcuguggaucaucgagcugaacgugaacggcggcaucgagaacacccuggagaaggaggugaugcaguacgacuacuacagcagcuacuucgacaucuuccugcuggccguguucagauucaaggugcugauccuggccuacgccgugugcagacugagacacuggugggccaucgcccugaccaccgccgugaccagcgccuuccugcuggccaaggugauccugagcaagcuguucagccagggcgccuucggcuacgugcugcccaucaucagcuucauccuggccuggaucgagaccugguuccuggacuucaaggugcugccccaggaggccgaggaggagaacagacugcugaucgugcaggacgccagcgagagagccgcccugauccccggcggccugagcgacggccaguucuacagcccccccgagagcgaggccggcagcgaggaggccgaggagaagcaggacagcgagaagccccugcuggagcuguaa

SEQ ID NO: 24127 - RNA, 642 nt, Artificial Sequence
  STARD5__Homo_sapiens__NP_871629
auggaccccgcccuggccgcccagaugagcgaggccguggccgagaagaugcugcaguacagaagagacaccgccggcuggaagaucugcagagagggcaacggcgugagcgugagcuggagacccagcguggaguuccccggcaaccuguacagaggcgagggcaucguguacggcacccuggaggaggugugggacugcgugaagcccgccgugggcggccugagagugaagugggacgagaacgugaccggcuucgagaucauccagagcaucaccgacacccugugcgugagcagaaccagcacccccagcgccgccaugaagcugaucagccccagagacuucguggaccuggugcuggugaagagauacgaggacggcaccaucagcagcaacgccacccacguggagcacccccugugcccccccaagcccggcuucgugagaggcuucaaccaccccugcggcugcuucugcgagccccugcccggcgagcccaccaagaccaaccuggugaccuucuuccacaccgaccugagcggcuaccugccccagaacgugguggacagcuucuuccccagaagcaugaccagauucuacgccaaccugcagaaggccgugaagcaguuccacgaguaa

SEQ ID NO: 24128 - RNA, 1113 nt, Artificial Sequence
  STARD7__Homo_sapiens__NP_064536
augcugcccagaagacugcuggccgccuggcuggccggcaccagaggcggcggccugcuggcccugcuggccaaccagugcagauucgugaccggccugagagugagaagagcccagcagaucgcccagcuguacggcagacuguacagcgagagcagcagaagagugcugcugggcagacuguggagaagacugcacggcagacccggccacgccagcgcccugauggccgcccuggccggcguguucgugugggacgaggagagaauccaggaggaggagcugcagagaagcaucaacgagaugaagagacuggaggagaugagcaacauguuccagagcagcggcgugcagcaccacccccccgagcccaaggcccagaccgagggcaacgaggacagcgagggcaaggagcagagaugggagauggugauggacaagaagcacuucaagcuguggagaagacccaucaccggcacccaccuguaccaguacagaguguucggcaccuacaccgacgugacccccagacaguucuucaacgugcagcuggacaccgaguacagaaagaagugggacgcccuggugaucaagcuggaggugaucgagagagacguggugagcggcagcgaggugcugcacugggugacccacuuccccuaccccauguacagcagagacuacguguacgugagaagauacagcguggaccaggagaacaacaugauggugcuggugagcagagccguggagcaccccagcgugcccgagagccccgaguucgugagagugagaagcuacgagagccagauggugaucagaccccacaagagcuucgacgagaacggcuucgacuaccugcugaccuacagcgacaacccccagaccguguuccccagauacugcgugagcuggauggugagcagcggcaugcccgacuuccuggagaagcugcacauggccacccugaaggccaagaacauggagaucaaggugaaggacuacaucagcgccaagccccuggagaugagcagcgaggccaaggccaccagccagagcagcgagagaaagaacgagggcagcugcggccccgccagaaucgaguacgccuaa

SEQ ID NO: 24129 - RNA, 3312 nt, Artificial Sequence
  STARD8__Homo_sapiens__NP_001135975
augccccugcuggacguguucuggagcugcuucagaaaggugaagugcuucccccugcugcaggugaagaagaacgccgaggccgaggccaagagagccugcgaguggcugcaggccaccggcuucccccaguacgugcagcuguucgaggagggcagcuucccccuggacaucggcagcgugaagaagaaccacggcuuccuggacgaggacagccugggcgcccugugcagaagacugaugacccugaacaacugcgccagcaugaagcuggaggugcacuuccagagcaagcagaacgaggacagcgaggaggaggagcagugcaccaucagcagccacugggccuuccagcaggagagcaagugcuggagccccaugggcagcagcgaccugcuggccccccccagccccggccugcccgccaccagcagcugcgagagcgugcugaccgagcugagcgccaccagccugcccgugaucaccgugagccugccccccgagcccgccgaccugccccugcccggcagagcccccagcagcagcgacagaccccugcugagccccacccagggccaggagggcccccaggacaaggccaagaagagacacagaaacagaagcuuccugaagcaccuggagagccugagaagaaaggagaagagcggcagccagcaggccgagcccaagcacagccccgccaccagcgagaaggugagcaaggccagcagcuucagaagcugcagaggcuuccugagcgccggcuucuacagagccaagaacugggccgccaccagcgccggcggcagcggcgccaacaccagaaaggccugggaggccuggcccguggccagcuucagacacccccaguggacccacagaggcgacugccuggugcacgugcccggcgaccacaagcccggcaccuuccccagaagccugagcaucgagagccugugccccgaggacggccacagacuggccgacuggcagcccggcagaagauggggcugcgagggcagaagaggcagcugcggcagcaccggcagccacgccagcaccuacgacaaccugcccgagcuguaccccgccgagcccgugauggugggcgccgaggccgaggacgaggacgacgaggagagcggcggcagcuacgcccaccuggacgacauccugcagcacguguggggccugcagcagagaguggagcuguggagcagagccauguaccccgaccugggccccggcgacgaggaggaggaggaggccaccagcagcguggagaucgccaccguggaggugaagugccaggccgaggcccugagccagauggaggugcccgcccacggcgagagccccgccugggcccaggccgaggugcagcccgccgugcuggcccccgcccaggcccccgccgaggccgagcccguggcccaggaggaggccgaggcccccgcccccgcccccgcccccgcccccgcccaggacagcgagcaggaggcccacagcggcggcgagcccaccuucgccagcagccugagcguggaggagggccacagcaucagcgacaccguggccagcagcagcgagcuggacagcagcggcaacagcaugaacgaggccgaggccgccggcccccuggccggccugcaggccagcaugcccagagagagaagagacagcggcgugggcgccagccugaccagacccugcagaaagcugagauggcacagcuuccagaacagccacagacccagccugaacagcgagagccuggagaucaacagacaguucgccggccagaucaaccugcugcacaagggcagccugcugagacugaccgccuucauggagaaguacaccgugccccacaagcagggcuggguguggagcaugcccaaguucaugagaagaaacaagacccccgacuacagaggccagcacguguucggcgugcccccccugauccacgugcagagaaccggccagccccugccccagagcauccagcaggccaugagauaccugagaagccagugccuggaccaggugggcaucuucagaaagagcggcgugaagagcagaauccagaaccugagacagaugaacgagaccagccccgacaacgugugcuacgagggccagagcgccuacgacguggccgaccugcugaagcaguacuucagagaccugcccgagcccaucuucaccagcaagcugaccaccaccuuccugcagaucuaccagcugcugcccaaggaccaguggcuggccgccgcccaggccgccacccugcugcugcccgacgagaacagagaggugcugcagacccugcuguacuuccugagcgacaucgccagcgccgaggagaaccagaugaccgccggcaaccuggccgugugccuggcccccagcaucuuccaccugaacgugagcaagaaggacagccccagccccagaaucaagagcaagagaagccugaucggcagacccggccccagagaccugagcgacaacauggccgccacccagggccugagccacaugaucagcgacugcaagaagcuguuccaggugccccaggacauggugcugcagcugugcagcagcuacagcgccgccgagcugagcccccccggccccgcccuggccgagcugagacaggcccaggccgccggcgugagccugagccuguacauggaggagaacauccaggaccugcugagagacgccgccgagagauucaagggcuggaugagcgugcccggcccccagcacaccgagcuggccugcagaaaggcccccgacggccacccccugagacuguggaaggccagcaccgagguggccgccccccccgccguggugcugcacagagugcugagagagagagcccugugggacgaggaccugcugagagcccaggugcuggaggcccugaugcccggcguggagcuguaccacuacgugaccgacagcauggccccccaccccugcagagacuucguggugcugagaauguggagaagcgaccugcccagaggcggcugccugcuggugagccagagccuggaccccgagcagcccgugcccgagagcggcgugagagcccugaugcugaccagccaguaccugauggagcccugcggccugggcagaagcagacugacccacaucugcagagccgaccugagaggcagaagccccgacugguacaacaagguguucggccaccugugcgccauggagguggccaagaucagagacagcuuccccacccugcaggccgccggccccgagaccaagcuguaa

SEQ ID NO: 24130 - RNA, 14103 nt, Artificial Sequence
  STARD9__Homo_sapiens__NP_065810
auggccaacgugcagguggccgugagagugagaccccugagcaagagagagaccaaggagggcggcagaaucaucguggagguggacggcaagguggccaagaucagaaaccugaagguggacaacagacccgacggcuucggcgacagcagagagaaggugauggccuucggcuucgacuacugcuacuggagcgugaaccccgaggacccccaguacgccagccaggacgugguguuccaggaccugggcauggaggugcugagcggcguggccaagggcuacaacaucugccuguucgccuacggccagaccggcagcggcaagaccuacaccaugcugggcacccccgccagcgugggccugacccccagaaucugcgagggccuguucgugagagagaaggacugcgccagccugcccagcagcugcagaaucaaggugagcuuccuggagaucuacaacgagagagugagagaccugcugaagcagagcggccagaagaagagcuacacccugagagugagagagcaccccgagaugggccccuacgugcagggccugagccagcacguggugaccaacuacaagcaggugauccagcugcuggaggagggcaucgccaacagaaucaccgccgccacccacgugcacgaggccagcagcagaagccacgccaucuucaccauccacuacacccaggccauccuggagaacaaccugcccagcgagauggccagcaagaucaaccugguggaccuggccggcagcgagagagccgaccccagcuacugcaaggacagaaucgccgagggcgccaacaucaacaagagccuggugacccugggcaucgugaucagcacccuggcccagaacagccagguguucagcagcugccagagccugaacagcagcgugagcaacggcggcgacagcggcauccugagcagccccagcggcaccagcagcggcggcgcccccagcagaagacagagcuacauccccuacagagacagcgugcugaccuggcugcugaaggacagccugggcggcaacagcaagaccaucaugguggccaccgugagccccgcccacaccagcuacagcgagaccaugagcacccugagauacgccagcagcgccaagaacaucaucaacaagcccagagugaacgaggacgccaaccugaagcugaucagagagcugagagaggagaucgagagacugaaggcccugcugcugagcuucgagcugagaaacuucagcagccugagcgacgagaaccugaaggagcuggugcugcagaacgagcugaagaucgaccagcugaccaaggacuggacccagaaguggaacgacuggcaggcccugauggagcacuacagcguggacaucaacagaagaagagccggcguggugaucgacagcagccugccccaccugauggcccuggaggacgacgugcugagcaccggcguggugcuguaccaccugaaggagggcaccaccaagaucggcagaaucgacagcgaccaggagcaggacaucgugcugcagggccaguggaucgagagagaccacugcaccaucaccagcgccugcggcgugguggugcugagacccgccagaggcgccagaugcaccgugaacggcagagaggugaccgccagcugcagacugacccagggcgccgugaucacccugggcaaggcccagaaguucagauucaaccaccccgccgaggccgccgugcugagacagagaagacaggugggcgaggccgccgccggcagaggcagccuggaguggcuggaccuggacggcgaccuggccgccagcagacugggccugagcccccugcuguggaaggagagaagagcccuggaggagcagugcgacgaggaccaccagacccccagagacggcgagaccagccacagagcccagauccagcagcagcagagcuacguggaggaccugagacaccagauccuggccgaggagaucagagccgccaaggagcuggaguucgaccaggccuggaucagccagcagaucaaggagaaccagcagugccugcugagagaggagaccuggcuggccagccugcagcagcagcagcaggaggaccagguggccgagaaggagcuggaggccagcguggcccuggacgccuggcugcagaccgaccccgagauccagcccagccccuucgugcagagccagaagagaguggugcaccugcagcugcugagaagacacacccugagagccgccgagagaaacgugagaagaaagaaggugagcuuccagcuggagagaaucaucaagaagcagagacugcuggaggcccagaagagacuggagaagcugaccacccugugcuggcugcaggacgacagcacccaggagccccccuaccaggugcugagccccgacgccaccgugcccagaccccccugcagaagcaagcugaccagcugcagcagccugagcccccagagacugugcagcaagcacaugccccagcugcacagcaucuuccugagcugggaccccagcaccacccugccccccagacccgaccccacccaccagaccagcgagaagaccagcagcgaggagcaccugccccaggccgccagcuaccccgccagaaccggcugccugagaaagaacggccugcacagcagcggccacggccagcccugcaccgccagagccgcccuggccagaaagggcgccagcgcccccgacgccugccugaccaugagccccaacagcgugggcauccaggagauggagaugggcgugaagcagccccaccagauggugagccagggccuggccagccugagaaagagcgccaacaagcugaagcccagacacgagcccaagaucuucaccagcaccacccagaccagaggcgccaagggccuggccgaccccagccacacccaggccggcuggagaaaggagggcaaccugggcacccacaaggccgccaagggcgccagcugcaacagccuguacccccacggccccagacagaccgccggccacggcaaggccgugaagaccuucuggaccgaguacaagccccccagccccagcagagccagcaagagacaccagagagugcuggccaccagagugagaaacaucaccaagaagagcagccaccugccccugggcagcccccugaagagacagcagaacaccagagaccccgacaccauggugccccugaccgacuucagccccgugauggaccacagcagagagaaggacaacgaccugagcgacaccgacagcaacuacagccuggacagccugagcugcguguacgccaaggcccugaucgagccccugaagcccgaggagagaaagugggacuuccccgagcccgagaacagcgagagcgacgacagccagcugagcgaggacagccuggccgagaagagauaccagagccccaagaacagacugggcggcaacagacccaccaacaacagaggccagcccagaaccagaaccagagccagcgugagaggcuucaccgccgccagcgacagcgaccugcuggcccagacccacagaagcuucagccuggacagccugaucgacgccgaggaggagcugggcgaggaccagcaggaggagcccuuccccggcagcgccgacgagauccccaccgagaccuucuggcaccuggaggacagcagccugcccgugauggaccaggaggccaucugcagacugggccccaucaacuacagaaccgccgccagacuggacgccgugcugcccaugagcagcagcuucuaccuggacccccaguuccagccccacugcgagcugcagccccacugcgagcugcagccccacugcgagcugcagccccacugcgagcaggccgagagccagguggagcccagcuacagcgagcaggccgacagccugcagggcaugcagcugagcagagagagcccccugaugagcauggacagcugguucagcugcgacagcaagaucaaccccagcagcccccccggcaucgugggcagccugugccccagccccgacaugcaggaguuccacagcugcaagggcgagagacccggcuacuggcccaacaccgaggagcugaagcccagcgacgccgagaccgugcugcccuacagcagcaagcugcaccagggcagcaccgagcugcugugcagcgccagagacgagcacaccgccagcgccgccgacaccagcagacugagccuguggggcauccagagacugauccagcccggcgccgacggcaccuuccagggcagaugcauccccgacaugacccagcagggcagcagcgaggccagccacaacagcagcgugagcaacgugcuggccgccagcgccaccacccugacccacgugggcagcacccacgagagagacuggagcgcccugcagcagaaguaccugcuggagcugagcugccccgugcuggaggccaucggcgcccccaagcccgccuaccccuaccuggaggaggacagcggcagccuggcccaggccagcagcaagggcggcgacacccugcugcccgugggccccagagugagcagcaaccugaaccugaacaacuuccccgugcaccugagcagaaucagaagacugagagccgagaaggagcaggacagccugaacgccaagcuggagggcgugagcgacuucuucagcaccagcgagaaggaggccagcuacgacgagaccuacagcgccgaccuggagagccugagcgccagcagaagcaccaacgcccagguguucgccaccgagaacgccauccccgacagcaugaccgaggccugcgaggugaagcagaacaaccuggaggagugccugcagagcugcagaaagcccggccugaugaccagcagcgacgaggacuucuuccagaagaacgccugccacagcaacgugaccaccgccaccaaggccgaccacuggagccagggcugggccccccugagaaagaacagcgccgugcagcccggccagcugagccccgacagccacuacccccuggaggaggagaagaccgacugccaggagagcagcaaggaggccgugagaagacacaucaacgugagcuucgcccugcccagcggccccgagcuguaccugcacagcgcccccuggaacccccugagcagcagccugcagcccccccugcuggagaccuucuacgugaccaagagcagagacgcccugaccgagaccgcccuggagauccccgccugcagagaggugagagugcccagccccccccccagagaggccuggggcuucggccacaaccaccaggcccugcagggcgccuaccugaagaacaaccugcccgugcugcugcagaaccagaacagcaagaucgccagcagccagcaggugaccgccgagauccccguggaccugaacaccagagaggugaucagagagagcggcaagugccccggcaacaucaccgaggagagccacgacagcguguacagcagcgugacccagaacagacacuuccugcccagcaccagcaccaaggugugcgaguucgagaaccagguggugauccugaacaagaagcacagcuuccccgcccuggagggcggcgaggugaccgcccagagcugcugcggcgccagcagcgacagcaccgagagcggcaagagccugcuguucagagagagcgaggccagagaggaggaggagcuggaccagaacaccgugcugagacagaccaucaacgugagccuggagaaggacaugcccggcgagagcgccgugagccugaagagcagaagcguggacagaagagugagcagccccgugaugguggcccagggcggcggccccacccccaagugggagggcaagaacgagaccggccugcuggagaagggccugagacccaaggacagcagcgaggaguucaagcugcccggcaccaagcccgccuacgagagauuccagcugguggccugcccccaggagagaaaccccagcgagugcaagagccaggagaugcugaaccccaacagagagcccagcggcaagaagcagaacaagagagugaacaacaccgacgagauggccagacugaucagaagcgugaugcagcuggagaacggcauccuggagaucgagagcaagcagaacaagcaggugcacgccagccacacccccggcaccgacaaggagcugguguuccaggaccagaaggagcaggagaagaccgaccacgccuucagacccgacagcagcggcaacccccugcccagcaaggaccagcccagcagccccagacagaccgacgacaccguguucagagacagcgaggccggcgccauggaggugaacagcaucggcaaccacccccaggugcagaagaucacccccaaccccuucagaagcagagagggcgugagagagagcgagcccgugagagagcacacccaccccgccggcagcgacagacccgccagagacaucugcgacagccugggcaagcacaccaccugcagagaguucaccaacaccagccugcacccccagagaaugaaggcccuggccagagcccugccccugcagcccagacuggagagaagcagcaagaacaacggccaguucgugaaggccagcgccagccugaagggccagcccuggggccugggcagccuggaggagcuggagaccgugaagggcuuccaggagagccagguggccgagcacgugagcagcagcaaccaggaggagcccaaggcccagggcaagguggaggagaugcccaugcagagaggcggcagccugcaggaggagaacaaggugacccagaaguuccccagccugagccagcugugcagagacaccuucuucagacaggagaccgugagcccccugcugagcagaaccgaguucugcaccgccccccugcaccaggaccugagcaacacccugccccugaacagccccagauggcccagaagaugccugcacgugcccguggcccugggcaucagcagccuggacugcgugcuggaccugaccaugcugaagauccacaacagcccccuggugaccggcguggagcaccaggaccagagcaccgagaccagaagccacagccccgagggcaacgugagaggcagaagcagcgaggcccacaccgccuggugcggcagcgugagaagcauggccaugggcagccacagccagagcggcgugcccgagagcaucccccugggcaccgaggacagaaucagcgccagcaccagcccccaggaccacggcaaggaccugagaaucacccugcugggcuucagcaccagcgaggacuucgccagcgaggccgagguggccgugcagaaggagaucagagugagcagccugaacaaggugagcagccagcccgagaagagagugagcuucagccuggaggaggacagcgaccaggccagcaagcccagacagaaggccgagaaggagaccgaggacgugggccugaccagcggcgugagccuggcccccgugagccugcccagagugcccagccccgagcccagacugcuggagcccagcgaccacgccagcaugugccuggccauccuggaggagaucagacaggccaaggcccagagaaagcagcugcacgacuucguggccagaggcaccgugcugagcuacugcgagacccugcuggagcccgagugcagcagcagaguggccggcagaccccagugcaagcagaucgaccagagcagcagcgaccagaccagaaacgagggcgaggcccccggcuuccacguggccagccugagcgccgaggccggccagaucgaccugcugcccgacgagagaaaggugcaggccaccagccugagcgccgacagcuucgagagccugcccaacaccgagaccgacagagagcccugggaccccgugcaggccuucagccacgccgcccccgcccaggacagaaagagaagaaccggcgagcugagacaguucgccggcgccagcgagcccuucaucugccacagcagcagcagcgagaucaucgagaagaagaaggacgccaccagaacccccagcagcgccgacccccuggcccccgacagccccagaagcagcgcccccguggaggaggugagaagaguggugagcaagaaggugguggccgcccugcccagccaggcccccuacgacgaccccagagugacccugcacgagcugagccagagcgugccccaggagaccgccgagggcaucccccccggcagccaggacagcagccccgagcaccaggagcccagaacccuggacaccaccuacggcgaggugagcgacaaccugcuggugaccgcccagggcgagaagaccgcccacuucgagagccagagcgugaccugcgacgugcagaacagcaccagcgccagcggccccaagcaggaccacgugcagugccccgaggccagcaccggcuucgaggagggcagagccagccccaagcaggacaccauccugcccggcgcccugaccagaguggcccuggaggcccccacccagcagugcgugcagugcaaggagagcgugggcagcggccugaccgaggugugcagagccggcagcaagcacagcagacccaucccccugcccgaccagagacccagcgccaaccccggcggcaucggcgaggaggcccccugcagacaccccagagaggcccuggacggccccguguucagcagaaaccccgagggcagcagaacccugagccccagcagaggcaaggagagcagaacccugcccugcagacagcccugcagcagccagcccguggccacccacgccuacagcagccacagcagcacccugcugugcuucagagacggcgaccugggcaaggagcccuucaaggccgccccccacaccauccacccccccugcguggugcccagcagagccuacgagauggacgagaccggcgagaucagcagaggccccgacgugcaccugacccacggccuggagcccaaggacgugaacagagaguucagacugaccgagagcagcaccugcgagcccagcaccguggccgccgugcugagcagagcccagggcugcagaagccccagcgcccccgacgugagaaccggcagcuucagccacagcgccaccgacggcagcgugggccugaucggcgugcccgagaagaagguggccgagaagcaggccagcaccgagcuggaggccgccagcuuccccgccggcauguacagcgagccccugagacaguucagagacagcagcgugggcgaccagaacgcccaggugugccagaccaaccccgagccccccgccaccacccagggcccccacacccuggaccugagcgagggcagcgccgagagcaagcuggugguggagccccagcacgagugccuggagaacaccaccagaugcuuccuggagaagccccaguucagcaccgagcugagagaccacaacagacuggacagccaggccaaguucguggccagacugaagcacaccugcagcccccaggaggacagccccuggcaggaggaggagcagcacagagaccaggccagcggcggcggcgagggcuucgcccagggcgugaacccccugcccgacgaggacggccuggacggcugccagauccuggacgccggcagagaggagguggccguggccaagccccccgugagcaagauccugagccagggcuucaaggaccccgccaccgugagccugagacagaacgagaccccccagcccgccgcccagagaagcggccaccuguacaccggcagagagcagcccgcccccaaccacagaggcagccugcccgugaccaccaucuucagcggccccaagcacagcagaagcagccccaccccccaguucagcguggugggcagcagcagaagccugcaggagcugaaccugagcguggagccccccagccccaccgacgaggacacccagggccccaacagacuguggaacccccaccugagaggcuacagcagcggcaagagcguggccagaaccagccugcaggccgaggacagcaaccagaaggccagcagcagacuggacgacggcaccaccgaccacagacaccugaagcccgccaccccccccuaccccaugcccagcacccugagccacaugcccacccccgacuucaccaccagcuggaugagcggcacccuggagcaggcccagcagggcaagagagagaagcugggcgugcaggugagacccgagaacuggugcagccagauggacaagggcaugcugcacuucggcagcagcgacaucagccccuacgcccugcccuggagacccgaggagcccgccagaaucagcuggaagcaguacaugagcggcagcgccguggacgugagcugcagccagaagccccagggccugacccugagcaacguggccagaugcagcagcauggacaacggccuggaggaccagaacagccccuuccacagccaccugagcaccuacgccaacaucugcgaccugagcaccacccacagcagcaccgagaacgcccagggcagcaacgaggccugggagguguucagaggcagcagcagcaucgcccugggcgacccccacauccccaccagccccgagggcguggcccccaccagcggccacgacagaagaccccaguucagaggccccagcggcgaggccgacugccugagaagcaagcccccccuggccaagggcagcgccgccggccccguggacgagaucaugcugcuguaccccagcgaggccggcugccccgugggccagaccagaaccaacaccuucgagcagggcacccagacccugggcagcagaagacacuggagcagcaccgacaucagcuucgcccagcccgaggccagcgccgugagcgccuucgaccuggccagcuggaccagcaugcacaaccugagccugcaccugagccagcugcugcacagcaccagcgagcugcugggcagccugagccagcccgacguggccagaagagagcagaacaccaagagagacauccccgacaaggccccccaggcccugaugauggacggcagcacccagaccaccguggacgagggcagccagaccgaccugacccugcccacccugugccugcagaccagcgaggccgagccccagggcgccaacgugauccuggagggccugggcagcgacaccagcaccgugagccaggaggagggcgacgugcccggcgugccccagaagagagaggccgaggagaccgcccagaagauggcccagcugcuguaccugcaggaggagagcacccccuacaagccccagagccccagcauccccagcagccaccugagauuccagaaggcccccgugggccagcaccugcccagcgugagccccagcgugagcgacgccuuccugccccccagcagccagcccgaggagagcuacugccugguggugagcagccccagccccagcagcccccacagccccggccuguuccccagcaccagcgaguaccccggcgacagcagagugcagaagaagcugggccccaccagcgcccuguucguggacagagccagcagccccauccugacccugagcgccagcacccaggagcccggccugagccccggcagccugacccugagcgcccccagcacccaccccguggagggccaccagaagcuggacagcagccccgaccccguggacgcccccagaacccccauggacaacuacagccagaccaccgacgagcugggcggcagccagagaggcagaagcagccugcagagaagcaacggcagaagcuuccuggagcugcacagcccccacagcccccagcagagccccaagcugcaguucagcuuccugggccagcacccccagcagcugcagcccagaaccaccaucggcgugcagagcagacugcugccccccccccugagacacagaagccagagacugggcaacagcuucgugcccgagaagguggccagccccgagcacugcccccugagcggcagagagcccagccaguggcagagcagaaccgagaacggcggcgagagcagcgccagccccggcgagccccagagaacccuggacagacccagcagcuggggcggccugcagcaccugagccccugccccgugagcgagcugaccgacaccgccggccugagaggcagcgcccugggccugccccaggccugccagcccgaggagcugcugugcuucagcugccagaugugcauggcccccgagcaccagcaccacagccugagagaccugcccgugcacaacaaguucagcaacuggugcggcgugcagaagggcagccccggcggccuggacaugaccgaggaggagcugggcgccagcggcgaccugagcagcgagaagcaggagcagagccccccccagccccccaacgaccacagccaggacagcgaguggagcaagagagagcagaucccccugcaggugggcgcccagaaccugagccugagcguggagcugaccgaggccaagcugcaccacggcuucggcgaggccgacgcccugcugcaggugcugcagagcggcaccggcgaggcccuggccgccgacgagcccgugaccagcaccuggaaggagcuguacgccagacagaagaaggccaucgagacccugagaagagagagagccgagagacugggcaacuucugcagaaccagaagccugagcccccagaagcagcugagccugcugcccaacaaggaccuguucaucugggaccuggaccugcccagcagaagaagagaguaccugcagcagcugagaaaggacgugguggagaccaccagaagccccgagagcgugagcagaagcgcccacacccccagcgacaucgagcugaugcugcaggacuaccagcaggcccacgaggaggccaagguggagaucgccagagccagagaccagcugagagagagaaccgagcaggagaagcugagaauccaccagaagaucaucagccagcugcugaaggaggaggacaagcugcacacccuggccaacagcagcagccugugcaccagcagcaacggcagccugagcagcggcaugaccagcggcuacaacagcagccccgcccugagcggccagcugcaguuccccgagaacaugggccacaccaaccugcccgacagcagagacguguggaucggcgacgagagaggcggccacagcgccgugagaaagaacagcgccuacagccacagagccagccugggcagcugcugcugcagccccagcagccugagcagccugggcaccugcuucagcagcagcuaccaggaccuggccaagcacgugguggacaccagcauggccgacgugauggccgccugcagcgacaaccugcacaaccuguucagcugccaggccaccgccggcuggaacuaccagggcgaggagcaggccgugcagcuguacuacaagguguucagccccaccagacacggcuuccugggcgccggcguggugagccagccccugagcagagugugggccgccgugagcgaccccaccguguggccccuguacuacaagcccauccagaccgccagacugcaccagagagugaccaacagcaucagccugguguaccuggugugcaacaccacccugugcgcccugaagcagcccagagacuucugcugcgugugcguggaggccaaggagggccaccugagcgugauggccgcccagagcguguacgacaccagcaugcccagacccagcagaaagauggugagaggcgagauccugcccagcgccuggauccugcagcccaucaccguggagggcaaggaggugaccagagugaucuaccuggcccagguggagcugggcgcccccggcuuccccccccagcugcugagcagcuucaucaagagacagccccuggugaucgccagacuggccagcuuccugggcagauaa

SEQ ID NO: 24131 - RNA, 858 nt, Artificial Sequence
  STAR__Homo_sapiens__NP_000340
augcugcuggccaccuucaagcugugcgccggcagcagcuacagacacaugagaaacaugaagggccugagacagcaggccgugauggccaucagccaggagcugaacagaagagcccugggcggccccacccccagcaccuggaucaaccaggugagaagaagaagcagccugcugggcagcagacuggaggagacccuguacagcgaccaggagcuggccuaccugcagcagggcgaggaggccaugcagaaggcccugggcauccugagcaaccaggagggcuggaagaaggagagccagcaggacaacggcgacaaggugaugagcaagguggugcccgacgugggcaagguguucagacuggagguggugguggaccagcccauggagagacuguacgaggagcugguggagagaauggaggccaugggcgaguggaaccccaacgugaaggagaucaaggugcugcagaagaucggcaaggacaccuucaucacccacgagcuggccgccgaggccgccggcaaccuggugggccccagagacuucgugagcgugagaugcgccaagagaagaggcagcaccugcgugcuggccggcauggccaccgacuucggcaacaugcccgagcagaagggcgugaucagagccgagcacggccccaccugcauggugcugcacccccuggccggcagccccagcaagaccaagcugaccuggcugcugagcaucgaccugaagggcuggcugcccaagagcaucaucaaccaggugcugagccagacccagguggacuucgccaaccaccugagaaagagacuggagagccaccccgccagcgaggccagaugcuaa

SEQ ID NO: 24132 - RNA, 2253 nt, Artificial Sequence
  STAT1__Homo_sapiens__NP_009330
augagccagugguacgagcugcagcagcuggacagcaaguuccuggagcaggugcaccagcuguacgacgacagcuuccccauggagaucagacaguaccuggcccaguggcuggagaagcaggacugggagcacgccgccaacgacgugagcuucgccaccaucagauuccacgaccugcugagccagcuggacgaccaguacagcagauucagccuggagaacaacuuccugcugcagcacaacaucagaaagagcaagagaaaccugcaggacaacuuccaggaggaccccauccagaugagcaugaucaucuacagcugccugaaggaggagagaaagauccuggagaacgcccagagauucaaccaggcccagagcggcaacauccagagcaccgugaugcuggacaagcagaaggagcuggacagcaaggugagaaacgugaaggacaaggugaugugcaucgagcacgagaucaagagccuggaggaccugcaggacgaguacgacuucaagugcaagacccugcagaacagagagcacgagaccaacggcguggccaagagcgaccagaagcaggagcagcugcugcugaagaagauguaccugaugcuggacaacaagagaaaggagguggugcacaagaucaucgagcugcugaacgugaccgagcugacccagaacgcccugaucaacgacgagcugguggaguggaagagaagacagcagagcgccugcaucggcggcccccccaacgccugccuggaccagcugcagaacugguucaccaucguggccgagagccugcagcaggugagacagcagcugaagaagcuggaggagcuggagcagaaguacaccuacgagcacgaccccaucaccaagaacaagcaggugcugugggacagaaccuucagccuguuccagcagcugauccagagcagcuucgugguggagagacagcccugcaugcccacccacccccagagaccccuggugcugaagaccggcgugcaguucaccgugaagcugagacugcuggugaagcugcaggagcugaacuacaaccugaaggugaaggugcuguucgacaaggacgugaacgagagaaacaccgugaagggcuucagaaaguucaacauccugggcacccacaccaaggugaugaacauggaggagagcaccaacggcagccuggccgccgaguucagacaccugcagcugaaggagcagaagaacgccggcaccagaaccaacgagggcccccugaucgugaccgaggagcugcacagccugagcuucgagacccagcugugccagcccggccuggugaucgaccuggagaccaccagccugcccgugguggugaucagcaacgugagccagcugcccagcggcugggccagcauccugugguacaacaugcugguggccgagcccagaaaccugagcuucuuccugaccccccccugcgccagaugggcccagcugagcgaggugcugagcuggcaguucagcagcgugaccaagagaggccugaacguggaccagcugaacaugcugggcgagaagcugcugggccccaacgccagccccgacggccugauccccuggaccagauucugcaaggagaacaucaacgacaagaacuuccccuucuggcuguggaucgagagcauccuggagcugaucaagaagcaccugcugccccuguggaacgacggcugcaucaugggcuucaucagcaaggagagagagagagcccugcugaaggaccagcagcccggcaccuuccugcugagauucagcgagagcagcagagagggcgccaucaccuucaccuggguggagagaagccagaacggcggcgagcccgacuuccacgccguggagcccuacaccaagaaggagcugagcgccgugaccuuccccgacaucaucagaaacuacaaggugauggccgccgagaacauccccgagaacccccugaaguaccuguaccccaacaucgacaaggaccacgccuucggcaaguacuacagcagacccaaggaggcccccgagcccauggagcuggacggccccaagggcaccggcuacaucaagaccgagcugaucagcgugagcgaggugcaccccagcagacugcagaccaccgacaaccugcugcccaugagccccgaggaguucgacgaggugagcagaaucgugggcagcguggaguucgacagcaugaugaacaccguguaa

SEQ ID NO: 24133 - RNA, 2556 nt, Artificial Sequence
  STAT2__Homo_sapiens__NP_005410
auggcccagugggagaugcugcagaaccuggacagccccuuccaggaccagcugcaccagcuguacagccacagccugcugcccguggacaucagacaguaccuggccguguggaucgaggaccagaacuggcaggaggccgcccugggcagcgacgacagcaaggccaccaugcuguucuuccacuuccuggaccagcugaacuacgagugcggcagaugcagccaggaccccgagagccugcugcugcagcacaaccugagaaaguucugcagagacauccagcccuucagccaggaccccacccagcuggccgagaugaucuucaaccugcugcuggaggagaagagaauccugauccaggcccagagagcccagcuggagcagggcgagcccgugcuggagacccccguggagagccagcagcacgagaucgagagcagaauccuggaccugagagccaugauggagaagcuggugaagagcaucagccagcugaaggaccagcaggacguguucugcuucagauacaagauccaggccaagggcaagacccccagccuggacccccaccagaccaaggagcagaagauccugcaggagacccugaacgagcuggacaagagaagaaaggaggugcuggacgccagcaaggcccugcugggcagacugaccacccugaucgagcugcugcugcccaagcuggaggaguggaaggcccagcagcagaaggccugcaucagagcccccaucgaccacggccuggagcagcuggagaccugguucaccgccggcgccaagcugcuguuccaccugagacagcugcugaaggagcugaagggccugagcugccuggugagcuaccaggacgacccccugaccaagggcguggaccugagaaacgcccaggugaccgagcugcugcagagacugcugcacagagccuucgugguggagacccagcccugcaugccccagaccccccacagaccccugauccugaagaccggcagcaaguucaccgugagaaccagacugcuggugagacugcaggagggcaacgagagccugaccguggaggugagcaucgacagaaaccccccccagcugcagggcuucagaaaguucaacauccugaccagcaaccagaagacccugacccccgagaagggccagagccagggccugaucugggacuucggcuaccugacccugguggagcagagaagcggcggcagcggcaagggcagcaacaagggcccccugggcgugaccgaggagcugcacaucaucagcuucaccgugaaguacaccuaccagggccugaagcaggagcugaagaccgacacccugcccguggugaucaucagcaacaugaaccagcugagcaucgccugggccagcgugcugugguucaaccugcugagccccaaccugcagaaccagcaguucuucagcaacccccccaaggcccccuggagccugcugggccccgcccugagcuggcaguucagcagcuacgugggcagaggccugaacagcgaccagcugagcaugcugagaaacaagcuguucggccagaacugcagaaccgaggacccccugcugagcugggccgacuucaccaagagagagagcccccccggcaagcugcccuucuggaccuggcuggacaagauccuggagcuggugcacgaccaccugaaggaccuguggaacgacggcagaaucaugggcuucgugagcagaagccaggagagaagacugcugaagaagaccaugagcggcaccuuccugcugagauucagcgagagcagcgagggcggcaucaccugcagcuggguggagcaccaggacgacgacaaggugcugaucuacagcgugcagcccuacaccaaggaggugcugcagagccugccccugaccgagaucaucagacacuaccagcugcugaccgaggagaacauccccgagaacccccugagauuccuguaccccagaauccccagagacgaggccuucggcugcuacuaccaggagaaggugaaccugcaggagagaagaaaguaccugaagcacagacugaucguggugagcaacagacagguggacgagcugcagcagccccuggagcugaagcccgagcccgagcuggagagccuggagcuggagcugggccuggugcccgagcccgagcugagccuggaccuggagccccugcugaaggccggccuggaccugggccccgagcuggagagcgugcuggagagcacccuggagcccgugaucgagcccacccugugcauggugagccagaccgugcccgagcccgaccagggccccgugagccagcccgugcccgagcccgaccugcccugcgaccugagacaccugaacaccgagcccauggagaucuucagaaacugcgugaagaucgaggagaucaugcccaacggcgacccccugcuggccggccagaacaccguggacgagguguacgugagcagacccagccacuucuacaccgacggcccccugaugcccagcgacuucuaa

SEQ ID NO: 24134 - RNA, 2310 nt, Artificial Sequence
  STAT3__Homo_sapiens__NP_003141
auggcccaguggaaccagcugcagcagcuggacaccagauaccuggagcagcugcaccagcuguacagcgacagcuuccccauggagcugagacaguuccuggcccccuggaucgagagccaggacugggccuacgccgccagcaaggagagccacgccacccugguguuccacaaccugcugggcgagaucgaccagcaguacagcagauuccugcaggagagcaacgugcuguaccagcacaaccugagaagaaucaagcaguuccugcagagcagauaccuggagaagcccauggagaucgccagaaucguggccagaugccugugggaggagagcagacugcugcagaccgccgccaccgccgcccagcagggcggccaggccaaccaccccaccgccgccguggugaccgagaagcagcagaugcuggagcagcaccugcaggacgugagaaagagagugcaggaccuggagcagaagaugaaggugguggagaaccugcaggacgacuucgacuucaacuacaagacccugaagagccagggcgacaugcaggaccugaacggcaacaaccagagcgugaccagacagaagaugcagcagcuggagcagaugcugaccgcccuggaccagaugagaagaagcaucgugagcgagcuggccggccugcugagcgccauggaguacgugcagaagacccugaccgacgaggagcuggccgacuggaagagaagacagcagaucgccugcaucggcggcccccccaacaucugccuggacagacuggagaacuggaucaccagccuggccgagagccagcugcagaccagacagcagaucaagaagcuggaggagcugcagcagaaggugagcuacaagggcgaccccaucgugcagcacagacccaugcuggaggagagaaucguggagcuguucagaaaccugaugaagagcgccuucgugguggagagacagcccugcaugcccaugcaccccgacagaccccuggugaucaagaccggcgugcaguucaccaccaaggugagacugcuggugaaguuccccgagcugaacuaccagcugaagaucaaggugugcaucgacaaggacagcggcgacguggccgcccugagaggcagcagaaaguucaacauccugggcaccaacaccaaggugaugaacauggaggagagcaacaacggcagccugagcgccgaguucaagcaccugacccugagagagcagagaugcggcaacggcggcagagccaacugcgacgccagccugaucgugaccgaggagcugcaccugaucaccuucgagaccgagguguaccaccagggccugaagaucgaccuggagacccacagccugcccgugguggugaucagcaacaucugccagaugcccaacgccugggccagcauccugugguacaacaugcugaccaacaaccccaagaacgugaacuucuucaccaagccccccaucggcaccugggaccagguggccgaggugcugagcuggcaguucagcagcaccaccaagagaggccugagcaucgagcagcugaccacccuggccgagaagcugcugggccccggcgugaacuacagcggcugccagaucaccugggccaaguucugcaaggagaacauggccggcaagggcuucagcuucuggguguggcuggacaacaucaucgaccuggugaagaaguacauccuggcccuguggaacgagggcuacaucaugggcuucaucagcaaggagagagagagagccauccugagcaccaagccccccggcaccuuccugcugagauucagcgagagcagcaaggagggcggcgugaccuucaccuggguggagaaggacaucagcggcaagacccagauccagagcguggagcccuacaccaagcagcagcugaacaacaugagcuucgccgagaucaucaugggcuacaagaucauggacgccaccaacauccuggugagcccccugguguaccuguaccccgacauccccaaggaggaggccuucggcaaguacugcagacccgagagccaggagcaccccgaggccgaccccggcgccgcccccuaccugaagaccaaguucaucugcgugacccccaccaccugcagcaacaccaucgaccugcccaugagccccagaacccuggacagccugaugcaguucggcaacaacggcgagggcgccgagcccagcgccggcggccaguucgagagccugaccuucgacauggagcugaccagcgagugcgccaccagccccauguaa

SEQ ID NO: 24135 - RNA, 2247 nt, Artificial Sequence
  STAT4__Homo_sapiens__NP_003142
augagccaguggaaccaggugcagcagcuggagaucaaguuccuggagcagguggaccaguucuacgacgacaacuuccccauggagaucagacaccugcuggcccaguggaucgagaaccaggacugggaggccgccagcaacaacgagaccauggccaccauccugcugcagaaccugcugauccagcuggacgagcagcugggcagagugagcaaggagaagaaccugcugcugauccacaaccugaagagaaucagaaaggugcugcagggcaaguuccacggcaaccccaugcacguggccguggugaucagcaacugccugagagaggagagaagaauccuggccgccgccaacaugcccgugcagggcccccuggagaagagccugcagagcagcagcgugagcgagagacagagaaacguggagcacaagguggccgccaucaagaacagcgugcagaugaccgagcaggacaccaaguaccuggaggaccugcaggacgaguucgacuacagauacaagaccauccagaccauggaccagagcgacaagaacagcgccauggugaaccaggaggugcugacccugcaggagaugcugaacagccuggacuucaagagaaaggaggcccugagcaagaugacccagaucauccacgagaccgaccugcugaugaacaccaugcugaucgaggagcugcaggacuggaagagaagacagcagaucgccugcaucggcggcccccugcacaacggccuggaccagcugcagaacugcuucacccugcuggccgagagccuguuccagcugagaagacagcuggagaagcuggaggagcagagcaccaagaugaccuacgagggcgaccccauccccaugcagagaacccacaugcuggagagagugaccuuccugaucuacaaccuguucaagaacagcuucgugguggagagacagcccugcaugcccacccacccccagagaccccuggugcugaagacccugauccaguucaccgugaagcugagacugcugaucaagcugcccgagcugaacuaccaggugaaggugaaggccagcaucgacaagaacgugagcacccugagcaacagaagauucgugcugugcggcaccaacgugaaggccaugagcaucgaggagagcagcaacggcagccugagcguggaguucagacaccugcagcccaaggagaugaagagcagcgccggcggcaagggcaacgagggcugccacauggugaccgaggagcugcacagcaucaccuucgagacccagaucugccuguacggccugaccaucgaccuggagaccagcagccugcccguggugaugaucagcaacgugagccagcugcccaacgccugggccagcaucaucugguacaacgugagcaccaacgacagccagaaccugguguucuucaacaaccccccccccgccacccugagccagcugcuggaggugaugagcuggcaguucagcagcuacgugggcagaggccugaacagcgaccagcugcacaugcuggccgagaagcugaccgugcagagcagcuacagcgacggccaccugaccugggccaaguucugcaaggagcaccugcccggcaagagcuucaccuucuggaccuggcuggaggccauccuggaccugaucaagaagcacauccugccccuguggaucgacggcuacgugaugggcuucgugagcaaggagaaggagagacugcugcugaaggacaagaugcccggcaccuuccugcugagauucagcgagagccaccugggcggcaucaccuucaccuggguggaccacagcgagagcggcgaggugagauuccacagcguggagcccuacaacaagggcagacugagcgcccugcccuucgccgacauccugagagacuacaaggugaucauggccgagaacauccccgagaacccccugaaguaccuguaccccgacauccccaaggacaaggccuucggcaagcacuacagcagccagcccugcgaggugagcagacccaccgagagaggcgacaagggcuacgugcccagcguguucauccccaucagcaccaucagaagcgacagcaccgagccccacagccccagcgaccugcugcccaugagccccagcguguacgccgugcugagagagaaccugagccccaccaccaucgagaccgccaugaagagccccuacagcgccgaguaa

SEQ ID NO: 24136 - RNA, 2295 nt, Artificial Sequence
  STAT5A__Homo_sapiens__NP_001275648
auggccggcuggauccaggcccagcagcugcagggcgacgcccugagacagaugcaggugcuguacggccagcacuuccccaucgaggugagacacuaccuggcccaguggaucgagagccagcccugggacgccaucgaccuggacaacccccaggacagagcccaggccacccagcugcuggagggccuggugcaggagcugcagaagaaggccgagcaccaggugggcgaggacggcuuccugcugaagaucaagcugggccacuacgccacccagcugcagugcagcagccccgccggcauccugguggacgccaugagccagaagcaccugcagaucaaccagaccuucgaggagcugagacuggugacccaggacaccgagaacgagcugaagaagcugcagcagacccaggaguacuucaucauccaguaccaggagagccugagaauccaggcccaguucgcccagcuggcccagcugagcccccaggagagacugagcagagagaccgcccugcagcagaagcaggugagccuggaggccuggcugcagagagaggcccagacccugcagcaguacagaguggagcuggccgagaagcaccagaagacccugcagcugcugagaaagcagcagaccaucauccuggacgacgagcugauccaguggaagagaagacagcagcuggccggcaacggcggcccccccgagggcagccuggacgugcugcagagcuggugcgagaagcuggccgagaucaucuggcagaacagacagcagaucagaagagccgagcaccugugccagcagcugcccauccccggccccguggaggagaugcuggccgaggugaacgccaccaucaccgacaucaucagcgcccuggugaccagcaccuucaucaucgagaagcagcccccccaggugcugaagacccagaccaaguucgccgccaccgugagacugcuggugggcggcaagcugaacgugcacaugaaccccccccaggugaaggccaccaucaucagcgagcagcaggccaagagccugcugaagaacgagaacaccagaaacgagugcagcggcgagauccugaacaacugcugcgugauggaguaccaccaggccaccggcacccugagcgcccacuucagaaacaugagccugaagagaaucaagagagccgacagaagaggcgccgagagcgugaccgaggagaaguucaccgugcuguucgagagccaguucagcgugggcagcaacgagcugguguuccaggugaagacccugagccugcccgugguggugaucgugcacggcagccaggaccacaacgccaccgccaccgugcugugggacaacgccuucgccgagcccggcagagugcccuucgccgugcccgacaaggugcuguggccccagcugugcgaggcccugaacaugaaguucaaggccgaggugcagagcaacagaggccugaccaaggagaaccugguguuccuggcccagaagcuguucaacaacagcagcagccaccuggaggacuacagcggccugagcgugagcuggagccaguucaacagagagaaccugcccggcuggaacuacaccuucuggcagugguucgacggcgugauggaggugcugaagaagcaccacaagccccacuggaacgacggcgccauccugggcuucgugaacaagcagcaggcccacgaccugcugaucaacaagcccgacggcaccuuccugcugagauucagcgacagcgagaucggcggcaucaccaucgccuggaaguucgacagccccgagagaaaccuguggaaccugaagcccuucaccaccagagacuucagcaucagaagccuggccgacagacugggcgaccugagcuaccugaucuacguguuccccgacagacccaaggacgagguguucagcaaguacuacacccccgugcuggccaaggccguggacggcuacgugaagccccagaucaagcagguggugcccgaguucgugaacgccagcgccgacgccggcggcagcagcgccaccuacauggaccaggcccccagccccgccgugugcccccaggcccccuacaacauguacccccagaaccccgaccacgugcuggaccaggacggcgaguucgaccuggacgagaccauggacguggccagacacguggaggagcugcugagaagacccauggacagccuggacagcagacugagcccccccgccggccuguucaccagcgccagaggcagccugagcuaa

SEQ ID NO: 24137 - RNA, 2364 nt, Artificial Sequence
  STAT5B__Homo_sapiens__NP_036580
auggccguguggauccaggcccagcagcugcagggcgaggcccugcaccagaugcaggcccuguacggccagcacuuccccaucgaggugagacacuaccugagccaguggaucgagagccaggccugggacagcguggaccuggacaacccccaggagaacaucaaggccacccagcugcuggagggccuggugcaggagcugcagaagaaggccgagcaccaggugggcgaggacggcuuccugcugaagaucaagcugggccacuacgccacccagcugcagaacaccuacgacagaugccccauggagcuggugagaugcaucagacacauccuguacaacgagcagagacuggugagagaggccaacaacggcagcagccccgccggcagccuggccgacgccaugagccagaagcaccugcagaucaaccagaccuucgaggagcugagacuggugacccaggacaccgagaacgagcugaagaagcugcagcagacccaggaguacuucaucauccaguaccaggagagccugagaauccaggcccaguucggcccccuggcccagcugagcccccaggagagacugagcagagagaccgcccugcagcagaagcaggugagccuggaggccuggcugcagagagaggcccagacccugcagcaguacagaguggagcuggccgagaagcaccagaagacccugcagcugcugagaaagcagcagaccaucauccuggacgacgagcugauccaguggaagagaagacagcagcuggccggcaacggcggcccccccgagggcagccuggacgugcugcagagcuggugcgagaagcuggccgagaucaucuggcagaacagacagcagaucagaagagccgagcaccugugccagcagcugcccauccccggccccguggaggagaugcuggccgaggugaacgccaccaucaccgacaucaucagcgcccuggugaccagcaccuucaucaucgagaagcagcccccccaggugcugaagacccagaccaaguucgccgccaccgugagacugcuggugggcggcaagcugaacgugcacaugaaccccccccaggugaaggccaccaucaucagcgagcagcaggccaagagccugcugaagaacgagaacaccagaaacgacuacagcggcgagauccugaacaacugcugcgugauggaguaccaccaggccaccggcacccugagcgcccacuucagaaacaugagccugaagagaaucaagagaagcgacagaagaggcgccgagagcgugaccgaggagaaguucaccauccuguucgagagccaguucagcgugggcggcaacgagcugguguuccaggugaagacccugagccugcccgugguggugaucgugcacggcagccaggacaacaacgccaccgccaccgugcugugggacaacgccuucgccgagcccggcagagugcccuucgccgugcccgacaaggugcuguggccccagcugugcgaggcccugaacaugaaguucaaggccgaggugcagagcaacagaggccugaccaaggagaaccugguguuccuggcccagaagcuguucaacaacagcagcagccaccuggaggacuacagcggccugagcgugagcuggagccaguucaacagagagaaccugcccggcagaaacuacaccuucuggcagugguucgacggcgugauggaggugcugaagaagcaccugaagccccacuggaacgacggcgccauccugggcuucgugaacaagcagcaggcccacgaccugcugaucaacaagcccgacggcaccuuccugcugagauucagcgacagcgagaucggcggcaucaccaucgccuggaaguucgacagccaggagagaauguucuggaaccugaugcccuucaccaccagagacuucagcaucagaagccuggccgacagacugggcgaccugaacuaccugaucuacguguuccccgacagacccaaggacgagguguacagcaaguacuacacccccgugcccugcgagagcgccaccgccaaggccguggacggcuacgugaagccccagaucaagcagguggugcccgaguucgugaacgccagcgccgacgccggcggcggcagcgccaccuacauggaccaggcccccagccccgccgugugcccccaggcccacuacaacauguacccccagaaccccgacagcgugcuggacaccgacggcgacuucgaccuggaggacaccauggacguggccagaagaguggaggagcugcugggcagacccauggacagccaguggaucccccacgcccagagcuaa

SEQ ID NO: 24138 - RNA, 2544 nt, Artificial Sequence
  STAT6__Homo_sapiens__XP_006719637
augagccuguggggccuggugagcaagaugccccccgagaaggugcagagacuguacguggacuucccccagcaccugagacaccugcugggcgacuggcuggagagccagcccugggaguuccuggugggcagcgacgccuucugcugcaaccuggccagcgcccugcugagcgacaccgugcagcaccugcaggccagcgugggcgagcagggcgagggcagcaccauccugcagcacaucagcacccuggagagcaucuaccagagagacccccugaagcugguggccaccuucagacagauccugcagggcgagaagaaggccgugauggagcaguucagacaccugcccaugcccuuccacuggaagcaggaggagcugaaguucaagaccggccugagaagacugcagcacagagugggcgagauccaccugcugagagaggcccugcagaagggcgccgaggccggccaggugagccugcacagccugaucgagacccccgccaacggcaccggccccagcgaggcccuggccaugcugcugcaggagaccaccggcgagcuggaggccgccaaggcccuggugcugaagagaauccagaucuggaagagacagcagcagcuggccggcaacggcgcccccuucgaggagagccuggccccccugcaggagagaugcgagagccugguggacaucuacagccagcugcagcaggaggugggcgccgccggcggcgagcuggagcccaagaccagagccagccugaccggcagacuggacgaggugcugagaacccuggugaccagcugcuuccugguggagaagcagcccccccaggugcugaagacccagaccaaguuccaggccggcgugagauuccugcugggccugagauuccugggcgcccccgccaagcccccccuggugagagccgacauggugaccgagaagcaggccagagagcugagcgugccccagggccccggcgccggcgccgagagcaccggcgagaucaucaacaacaccgugccccuggagaacagcauccccggcaacugcugcagcgcccuguucaagaaccugcugcugaagaagaucaagagaugcgagagaaagggcaccgagagcgugaccgaggagaagugcgccgugcuguucagcgccagcuucacccugggccccggcaagcugcccauccagcugcaggcccugagccugccccugguggugaucgugcacggcaaccaggacaacaacgccaaggccaccauccugugggacaacgccuucagcgagauggacagagugcccuucgugguggccgagagagugcccugggagaagaugugcgagacccugaaccugaaguucauggccgaggugggcaccaacagaggccugcugcccgagcacuuccuguuccuggcccagaagaucuucaacgacaacagccugagcauggaggccuuccagcacagaagcgugagcuggagccaguucaacaaggagauccugcugggcagaggcuucaccuucuggcagugguucgacggcgugcuggaccugaccaagagaugccugagaagcuacuggagcgacagacugaucaucggcuucaucagcaagcaguacgugaccagccugcugcugaacgagcccgacggcaccuuccugcugagauucagcgacagcgagaucggcggcaucaccaucgcccacgugaucagaggccaggacggcagcccccagaucgagaacauccagcccuucagcgccaaggaccugagcaucagaagccugggcgacagaaucagagaccuggcccagcugaagaaccuguaccccaagaagcccaaggacgaggccuucagaagccacuacaagcccgagcagaugggcaaggacggcagaggcuacgugcccgccaccaucaagaugaccguggagagagaccagccccugcccacccccgagcugcagaugcccaccauggugcccagcuacgaccugggcauggcccccgacagcagcaugagcaugcagcugggccccgacauggugccccagguguaccccccccacagccacagcaucccccccuaccagggccugagccccgaggagagcgugaacgugcugagcgccuuccaggagccccaccugcagaugccccccagccugggccagaugagccugcccuucgaccagccccacccccagggccugcugcccugccagccccaggagcacgccgugagcagccccgacccccugcugugcagcgacgugaccaugguggaggacagcugccugagccagcccgugaccgccuucccccagggcaccuggaucggcgaggacaucuuccccccccugcugccccccaccgagcaggaccugaccaagcugcugcuggagggccagggcgagagcggcggcggcagccugggcgcccagccccugcugcagcccagccacuacggccagagcggcaucagcaugagccacauggaccugagagccaaccccagcugguaa

SEQ ID NO: 24139 - RNA, 159 nt, Artificial Sequence
  STATH__Homo_sapiens__NP_001009181
augaaguuccugguguucgccuucauccuggcccugauggugagcaugaucggcgccgacagcagcgaggaguacggcuacggccccuaccagcccgugcccgagcagccccuguacccccagcccuaccagccccaguaccagcaguacaccuucuaa

SEQ ID NO: 24140 - RNA, 1713 nt, Artificial Sequence
  STAU2__Homo_sapiens__NP_001157852
auggccaaccccaaggagaagaccgccaugugccuggugaacgagcuggccagauucaacagagugcagccccaguacaagcugcugaacgagagaggccccgcccacagcaagauguucagcgugcagcugagccugggcgagcagaccugggagagcgagggcagcagcaucaagaaggcccagcaggccguggccaacaaggcccugaccgagagcacccugcccaagcccgugcagaagccccccaagagcaacgugaacaacaaccccggcagcaucacccccaccguggagcugaacggccuggccaugaagagaggcgagcccgccaucuacagaccccuggaccccaagcccuuccccaacuacagagccaacuacaacuucagaggcauguacaaccagagauaccacugccccgugcccaagaucuucuacgugcagcugaccgugggcaacaacgaguucuucggcgagggcaagaccagacaggccgccagacacaacgccgccaugaaggcccugcaggcccugcagaacgagcccauccccgagagaagcccccagaacggcgagagcggcaaggacguggacgacgacaaggacgccaacaagagcgagaucagccugguguucgagaucgcccugaagagaaacaugcccgugagcuucgaggugaucaaggagagcggccccccccacaugaagagcuucgugaccagagugagcgugggcgaguucagcgccgagggcgagggcaacagcaagaagcugagcaagaagagagccgccaccaccgugcugcaggagcugaagaagcugcccccccugcccgugguggagaagcccaagcuguucuucaagaagagacccaagaccaucgugaaggccggccccgaguacggccagggcaugaaccccaucagcagacuggcccagauccagcaggccaagaaggagaaggagcccgacuacgugcugcugagcgagagaggcaugcccagaagaagagaguucgugaugcaggugaaggugggcaacgagguggccaccggcaccggccccaacaagaagaucgccaagaagaacgccgccgaggccaugcugcugcagcugggcuacaaggccagcaccaaccugcaggaccagcuggagaagaccggcgagaacaagggcuggagcggccccaagcccggcuuccccgagcccaccaacaacacccccaagggcauccugcaccugagccccgacguguaccaggagauggaggccagcagacacaaggugaucagcggcaccacccugggcuaccugagccccaaggacaugaaccagcccagcagcagcuucuucagcaucagccccaccagcaacagcagcgccaccaucgccagagagcugcugaugaacggcaccagcagcaccgccgaggccaucggccugaagggcagcagccccaccccccccugcagccccgugcagcccagcaagcagcuggaguaccuggccagaauccagggcuuccaggccgcccugagcgcccugaagcaguucagcgagcagggccuggaccccaucgacggcgccaugaacaucgagaagggcagccuggagaagcaggccaagcaccugagagagaaggccgacaacaaccaggccccccccggcagcaucgcccaggacugcaagaagagcaacagcgccguguaa

SEQ ID NO: 24141 - RNA, 1077 nt, Artificial Sequence
  STBD1__Homo_sapiens__NP_003934
augggcgccguguggagcgcccugcuggugggcggcggccuggccggcgcccuguucguguggcugcugagaggcggccccggcgacaccggcaaggacggcgacgccgagcaggagaaggacgccccccugggcggcgccgccauccccggcggccaccagagcggcagcagcggccugagccccggccccagcggccaggagcuggugaccaagcccgagcaccugcaggagagcaacggccaccugaucagcaagaccaaggaccugggcaagcugcaggccgccagcuggagacugcagaaccccagcagagaggugugcgacaacagcagagagcacgugcccagcggccaguuccccgacaccgaggcccccgccaccagcgagaccagcaacagcagaagcuacagcgaggugagcagaaacgagagccuggagagccccaugggcgaguggggcuuccagaagggccaggagaucagcgccaaggccgccaccugcuucgccgagaagcugcccagcagcaaccugcugaagaacagagccaaggaggagaugagccugagcgaccugaacagccaggacagaguggaccacgaggagugggagauggugcccagacacagcagcuggggcgacgugggcgugggcggcagccugaaggcccccgugcugaaccugaaccagggcauggacaacggcagaagcacccugguggaggccagaggccagcaggugcacggcaagauggagagaguggccgugaugcccgccggcagccagcaggugagcgugagauuccaggugcacuacgugaccagcaccgacgugcaguucaucgccgugaccggcgaccacgagugccugggcagauggaacaccuacaucccccugcacuacaacaaggacggcuucuggagccacagcaucuuccugcccgccgacaccgugguggaguggaaguucgugcugguggagaacggcggcgugaccagaugggaggagugcagcaacagauuccuggagaccggccacgaggacaagguggugcacgccugguggggcauccacuaa

SEQ ID NO: 24142 - RNA, 744 nt, Artificial Sequence
  STC1__Homo_sapiens__NP_003146
augcugcagaacagcgccgugcugcuggugcuggugaucagcgccagcgccacccacgaggccgagcagaacgacagcgugagccccagaaagagcagaguggccgcccagaacagcgccgagguggugagaugccugaacagcgcccugcaggugggcugcggcgccuucgccugccuggagaacagcaccugcgacaccgacggcauguacgacaucugcaagagcuuccuguacagcgccgccaaguucgacacccagggcaaggccuucgugaaggagagccugaagugcaucgccaacggcgugaccagcaagguguuccuggccaucagaagaugcagcaccuuccagagaaugaucgccgaggugcaggaggagugcuacagcaagcugaacgugugcagcaucgccaagagaaaccccgaggccaucaccgagguggugcagcugcccaaccacuucagcaacagauacuacaacagacuggugagaagccugcuggagugcgacgaggacaccgugagcaccaucagagacagccugauggagaagaucggccccaacauggccagccuguuccacauccugcagaccgaccacugcgcccagacccaccccagagccgacuucaacagaagaagaaccaacgagccccagaagcugaaggugcugcugagaaaccugagaggcgaggaggacagccccagccacaucaagagaaccagccacgagagcgccuaa

SEQ ID NO: 24143 - RNA, 909 nt, Artificial Sequence
  STC2__Homo_sapiens__NP_003705
augugcgccgagagacugggccaguucaugacccuggcccuggugcuggccaccuucgaccccgccagaggcaccgacgccaccaacccccccgagggcccccaggacagaagcagccagcagaagggcagacugagccugcagaacaccgccgagauccagcacugccuggugaacgccggcgacgugggcugcggcguguucgagugcuucgagaacaacagcugcgagaucagaggccugcacggcaucugcaugaccuuccugcacaacgccggcaaguucgacgcccagggcaagagcuucaucaaggacgcccugaagugcaaggcccacgcccugagacacagauucggcugcaucagcagaaagugccccgccaucagagagauggugagccagcugcagagagagugcuaccugaagcacgaccugugcgccgccgcccaggagaacaccagagugaucguggagaugauccacuucaaggaccugcugcugcacgagcccuacguggaccuggugaaccugcugcugaccugcggcgaggaggugaaggaggccaucacccacagcgugcaggugcagugcgagcagaacuggggcagccugugcagcauccugagcuucugcaccagcgccauccagaagccccccaccgccccccccgagagacagccccagguggacagaaccaagcugagcagagcccaccacggcgaggccggccaccaccugcccgagcccagcagcagagagaccggcagaggcgccaagggcgagagaggcagcaagagccaccccaacgcccacgccagaggcagagugggcggccugggcgcccagggccccagcggcagcagcgagugggaggacgagcagagcgaguacagcgacaucagaagauaa

SEQ ID NO: 24144 - RNA, 1020 nt, Artificial Sequence
  STEAP1__Homo_sapiens__NP_036581
auggagagcagaaaggacaucaccaaccaggaggagcuguggaagaugaagcccagaagaaaccuggaggaggacgacuaccugcacaaggacaccggcgagaccagcaugcugaagagacccgugcugcugcaccugcaccagaccgcccacgccgacgaguucgacugccccagcgagcugcagcacacccaggagcuguucccccaguggcaccugcccaucaagaucgccgccaucaucgccagccugaccuuccuguacacccugcugagagaggugauccacccccuggccaccagccaccagcaguacuucuacaagauccccauccuggugaucaacaaggugcugcccauggugagcaucacccugcuggcccugguguaccugcccggcgugaucgccgccaucgugcagcugcacaacggcaccaaguacaagaaguucccccacuggcuggacaaguggaugcugaccagaaagcaguucggccugcugagcuucuucuucgccgugcugcacgccaucuacagccugagcuaccccaugagaagaagcuacagauacaagcugcugaacugggccuaccagcaggugcagcagaacaaggaggacgccuggaucgagcacgacguguggagaauggagaucuacgugagccugggcaucgugggccuggccauccuggcccugcuggccgugaccagcauccccagcgugagcgacagccugaccuggagagaguuccacuacauccagagcaagcugggcaucgugagccugcugcugggcaccauccacgcccugaucuucgccuggaacaaguggaucgacaucaagcaguucgugugguacaccccccccaccuucaugaucgccguguuccugcccaucguggugcugaucuucaagagcauccuguuccugcccugccugagaaagaagauccugaagaucagacacggcugggaggacgugaccaagaucaacaagaccgagaucugcagccagcuguaa

SEQ ID NO: 24145 - RNA, 1473 nt, Artificial Sequence
  STEAP2__Homo_sapiens__NP_001231873
auggagagcaucagcaugaugggcagccccaagagccugagcgagaccuuccugcccaacggcaucaacggcaucaaggacgccagaaaggugaccgugggcgugaucggcagcggcgacuucgccaagagccugaccaucagacugaucagaugcggcuaccacguggugaucggcagcagaaaccccaaguucgccagcgaguucuucccccacgugguggacgugacccaccacgaggacgcccugaccaagaccaacaucaucuucguggccauccacagagagcacuacaccagccugugggaccugagacaccugcuggugggcaagauccugaucgacgugagcaacaacaugagaaucaaccaguaccccgagagcaacgccgaguaccuggccagccuguuccccgacagccugaucgugaagggcuucaacguggugagcgccugggcccugcagcugggccccaaggacgccagcagacagguguacaucugcagcaacaacauccaggccagacagcaggugaucgagcuggccagacagcugaacuucauccccaucgaccugggcagccugagcagcgccagagagaucgagaaccugccccugagacuguucacccuguggagaggccccguggugguggccaucagccuggccaccuucuucuuccuguacagcuucgugagagacgugauccaccccuacgccagaaaccagcagagcgacuucuacaagauccccaucgagaucgugaacaagacccugcccaucguggccaucacccugcugagccugguguaccuggccggccugcuggccgccgccuaccagcuguacuacggcaccaaguacagaagauucccccccuggcuggagaccuggcugcagugcagaaagcagcugggccugcugagcuucuucuucgccauggugcacguggccuacagccugugccugcccaugagaagaagcgagagauaccuguuccugaacauggccuaccagcaggugcacgccaacaucgagaacagcuggaacgaggaggagguguggagaaucgagauguacaucagcuucggcaucaugagccugggccugcugagccugcuggccgugaccagcauccccagcgugagcaacgcccugaacuggagagaguucagcuucauccagagcacccugggcuacguggcccugcugaucagcaccuuccacgugcugaucuacggcuggaagagagccuucgaggaggaguacuacagauucuacaccccccccaacuucgugcuggcccuggugcugcccagcaucgugauccugggcaagaucauccuguuccugcccugcaucagcagaaagcugaagagaaucaagaagggcugggagaagagccaguuccuggaggagggcaugggcggcaccaucccccacgugagccccgagagagugaccgugauguaa

SEQ ID NO: 24146 - RNA, 1467 nt, Artificial Sequence
  STEAP3__Homo_sapiens__NP_001008410
augcccgaggagauggacaagccccugaucagccugcaccugguggacagcgacagcagccuggccaaggugcccgacgaggcccccaaggugggcauccugggcagcggcgacuucgccagaagccuggccaccagacuggugggcagcggcuucaaggugguggugggcagcagaaaccccaagagaaccgccagacuguuccccagcgccgcccaggugaccuuccaggaggaggccgugagcagccccgaggugaucuucguggccguguucagagagcacuacagcagccugugcagccugagcgaccagcuggccggcaagauccugguggacgugagcaaccccaccgagcaggagcaccugcagcacagagagagcaacgccgaguaccuggccagccuguuccccaccugcaccguggugaaggccuucaacgugaucagcgccuggacccugcaggccggccccagagacggcaacagacaggugcccaucugcggcgaccagcccgaggccaagagagccgugagcgagauggcccuggccaugggcuucaugcccguggacaugggcagccuggccagcgccugggagguggaggccaugccccugagacugcugcccgccuggaaggugcccacccugcuggcccugggccuguucgugugcuucuacgccuacaacuucgugagagacgugcugcagcccuacgugcaggagagccagaacaaguucuucaagcugcccgugagcguggugaacaccacccugcccugcguggccuacgugcugcugagccugguguaccugcccggcgugcuggccgccgcccugcagcugagaagaggcaccaaguaccagagauuccccgacuggcuggaccacuggcugcagcacagaaagcagaucggccugcugagcuucuucugcgccgcccugcacgcccuguacagcuucugccugccccugagaagagcccacagauacgaccuggugaaccuggccgugaagcaggugcuggccaacaagagccaccuguggguggaggaggagguguggagaauggagaucuaccugagccugggcgugcuggcccugggcacccugagccugcuggccgugaccagccugcccagcaucgccaacagccugaacuggagagaguucagcuucgugcagagcagccugggcuucguggcccuggugcugagcacccugcacacccugaccuacggcuggaccagagccuucgaggagagcagauacaaguucuaccugccccccaccuucacccugacccugcuggugcccugcguggugauccuggccaaggcccuguuccugcugcccugcaucagcagaagacuggccagaaucagaagaggcugggagagagagagcaccaucaaguucacccugcccaccgaccacgcccuggccgagaagaccagccacguguaa

SEQ ID NO: 24147 - RNA, 852 nt, Artificial Sequence
  STEAP4__Homo_sapiens__NP_001192245
auggagaagaccugcaucgacgcccugccccugaccaugaacagcagcgagaagcaggagaccgugugcaucuucggcaccggcgacuucggcagaagccugggccugaagaugcugcagugcggcuacagcgugguguucggcagcagaaacccccagaagaccacccugcugcccagcggcgccgaggugcugagcuacagcgaggccgccaagaagagcggcaucaucaucaucgccauccacagagagcacuacgacuuccugaccgagcugaccgaggugcugaacggcaagauccugguggacaucagcaacaaccugaagaucaaccaguaccccgagagcaacgccgaguaccuggcccaccuggugcccggcgcccacguggugaaggccuucaacaccaucagcgccugggcccugcagagcggcgcccuggacgccagcagacaggccauccugaagaaggagaaccccuucagcaccagcagcgccuggcugagcgacagcuacguggcccugggcauccugggcuucuuccuguucgugcugcugggcaucaccagccugcccagcgugagcaacgccgugaacuggagagaguucagauucgugcagagcaagcugggcuaccugacccugauccugugcaccgcccacacccugguguacggcggcaagagauuccugagccccagcaaccugagaugguaccugcccgccgccuacgugcugggccugaucauccccugcaccgugcuggugaucaaguucgugcugaucaugcccugcguggacaacacccugaccagaaucagacagggcugggagagaaacagcaagcacuaa

SEQ ID NO: 24148 - RNA, 387 nt, Artificial Sequence
  STH__Homo_sapiens__NP_001007533
augagcgagggcggcggccaggugagcugcaucuucgccgcccccaccagacugugcagauggcccgcccugaucgagugcggcgugaaccugacccagccccugugcgaguggaugauccagguggccagagacagaacccugagccuggccugggagguggccagccugcugacccugagcagcagcgaggugggccuggagggcgugggcaccaucuggcccagcagcuacagcagcgaggagagcagcagaaacggcgccgagcagggcagacagcugagcaucgagggccccuuccagggccagaacugccccagccaccccgccgccgcccugccccugcccaugagaggcgagagccaggccaccagcugccagguguaa

SEQ ID NO: 24149 - RNA, 3867 nt, Artificial Sequence
  STIL__Homo_sapiens__XP_011540294
auggagcccaucuaccccuucgccagaccccagaugaacaccagauuccccagcagcagaauggugcccuuccacuucccccccagcaagugcgcccuguggaaccccacccccaccggcgacuucaucuaccugcaccugagcuacuacagaaaccccaagcugguggugaccgagaagaccaucagacuggccuacagacacgccaagcagaacaagaagaacagcagcugcuuccugcugggcagccugaccgccgacgaggacgaggagggcgugacccugaccguggacagauucgaccccggcagagaggugcccgagugccuggagaucacccccaccgccagccugcccggcgacuuccugauccccugcaaggugcacacccaggagcugugcagcagagagaugaucgugcacagcguggacgacuucagcagcgcccugaaggcccugcagugccacaucugcagcaaggacagccuggacugcggcaagcugcugagccugagagugcacaucaccagcagagagagccuggacagcguggaguucgaccugcacugggccgccgugacccuggccaacaacuucaagugcacccccgugaagcccauccccaucauccccaccgcccuggccagaaaccugagcagcaaccugaacaucagccaggugcagggcaccuacaaguacggcuaccugaccauggacgagaccagaaagcugcugcugcugcuggagagcgaccccaagguguacagccugccccuggugggcaucuggcugagcggcaucacccacaucuacagcccccaggugugggccugcugccugagauacaucuucaacagcagcgugcaggagagaguguucagcgagagcggcaacuucaucaucgugcuguacagcaugacccacaaggagcccgaguucuacgagugcuuccccugcgacggcaagauccccgacuucagauuccagcugcugaccagcaaggagacccugcaccuguucaagaacguggagccccccgacaagaaccccaucagaugcgagcugagcgccgagagccagaacgccgagaccgaguucuucagcaaggccagcaagaacuucagcaucaagagaagcagccagaagcugagcagcggcaagaugcccauccacgaccacgacagcggcguggaggacgaggacuucagccccagacccauccccagcccccaccccgugagccagaagaucagcaagauccagcccagcgugcccgagcugagccuggugcuggacggcaacuucaucgagagcaacccccugcccaccccccuggagauggugaacaacgagaaccccccccugaucaaccaccuggagcaccugaagccccugcagccccagcuguacgacgagaagcacagccccgagguggaggccggcgagcccagccugagaggcauccccaaccagcugaaccaggacaagcccgcccugcugagacacugcaaggugagacagccccccgccuacaagaagggcaacccccacaccagaaacagcaucaagcccagcagccacaacggccccagccacgacaucuucgagaagcugcagaccgugagcgccggcaacgugcagaacgaggaguaccccaucagacccagcacccugaacagcagacagagcagccuggccccccagagccagccccacgacuucguguucagcccccacaacagcggcagacccauggagcugcagauccccacccccccccugcccagcuacugcagcaccaacgugugcagaugcugccagcaccacagccacauccaguacagcccccugaacagcuggcagggcgccaacaccgugggcagcauccaggacgugcagagcgaggcccugcagaagcacagccuguuccaccccagcggcugccccgcccuguacugcaacgccuucugcagcagcagcagccccaucgcccugagaccccagggcgacaugggcagcugcagcccccacagcaacaucgagcccagccccguggccagaccccccagccacauggaccugugcaacccccagcccugcaccgugugcaugcacacccccaagaccgagagcgacaacggcaugaugggccugagccccgacgccuacagauuccugaccgagcaggacagacagcugagacugcugcaggcccagauccagagacugcuggaggcccagagccugaugcccugcagccccaagaccaccgccguggaggacaccgugcaggccggcagacagauggagcuggugagcguggaggcccagagcagccccggccugcacaugagaaagggcgugagcaucgccgugagcaccggcgccagccuguucuggaacgccgccggcgaggaccaggagcccgacagccagaugaagcaggacgacaccaagaucagcagcgaggacaugaacuucagcguggacaucaacaacgaggugaccagccugcccggcagcgccagcagccugaaggccguggacauccccagcuucgaggagagcaacaucgccguggaggaggaguucaaccagccccugagcgugagcaacagcagcagccugguggugagaaaggagcccgacgugcccguguucuuccccagcggccagcuggccgagagcgugagcaugugccugcagaccggccccaccggcggcgccagcaacaacagcgagaccagcgaggagcccaagaucgagcacgugaugcagccccugcugcaccagcccagcgacaaccagaagaucuaccaggaccugcugggccaggugaaccaccugcugaacagcagcagcaaggagaccgagcagcccagcaccaaggccgugaucaucagccacgagugcaccagaacccagaacguguaccacaccaagaagaagacccaccacagcagacugguggacaaggacugcgugcugaacgccacccugaagcagcugagaagccugggcgugaagaucgacagccccaccaaggugaagaagaacgcccacaacguggaccacgccagcgugcuggccugcaucagccccgaggccgugaucagcggccugaacugcaugagcuucgccaacgugggcaugagcggccugagccccaacggcguggaccugagcauggaggccaacgccaucgcccugaaguaccugaacgagaaccagcugagccagcugagcgugaccagaagcaaccagaacaacugcgaccccuucagccugcugcacaucaacaccgacagaagcaccgugggccugagccugaucagccccaacaacaugagcuucgccaccaagaaguacaugaagagauacggccugcugcagagcagcgacaacagcgaggacgaggaggagccccccgacaacgccgacagcaagagcgaguaccugcugaaccagaaccugagaagcauccccgagcagcugggcggccagaaggagcccagcaagaacgaccacgagaucaucaacugcagcaacugcgagagcgugggcaccaacgccgacacccccgugcugagaaacaucaccaacgaggugcugcagaccaaggccaagcagcagcugaccgagaagcccgccuuccuggugaagaaccugaagcccagccccgccgugaaccugagaaccggcaaggccgaguucacccagcaccccgagaaggagaacgagggcgacaucaccaucuuccccgagagccugcagcccagcgagacccugaagcagaugaacagcaugaacagcgugggcaccuuccuggacgugaagagacugagacagcugcccaagcuguucuaa

SEQ ID NO: 24150 - RNA, 2058 nt, Artificial Sequence
  STIM1__Homo_sapiens__NP_003147
auggacgugugcgugagacuggcccuguggcugcuguggggccugcugcugcaccagggccagagccugagccacagccacagcgagaaggccaccggcaccagcagcggcgccaacagcgaggagagcaccgccgccgaguucugcagaaucgacaagccccugugccacagcgaggacgagaagcugagcuucgaggccgugagaaacauccacaagcugauggacgacgacgccaacggcgacguggacguggaggagagcgacgaguuccugagagaggaccugaacuaccacgaccccaccgugaagcacagcaccuuccacggcgaggacaagcugaucagcguggaggaccuguggaaggccuggaagagcagcgagguguacaacuggaccguggacgagguggugcaguggcugaucaccuacguggagcugccccaguacgaggagaccuucagaaagcugcagcugagcggccacgccaugcccagacuggccgugaccaacaccaccaugaccggcaccgugcugaagaugaccgacagaagccacagacagaagcugcagcugaaggcccuggacaccgugcuguucggccccccccugcugaccagacacaaccaccugaaggacuucaugcugguggugagcaucgugaucggcgugggcggcugcugguucgccuacauccagaacagauacagcaaggagcacaugaagaagaugaugaaggaccuggagggccugcacagagccgagcagagccugcacgaccugcaggagagacugcacaaggcccaggaggagcacagaaccguggagguggagaaggugcaccuggagaagaagcugagagacgagaucaaccuggccaagcaggaggcccagagacugaaggagcugagagagggcaccgagaacgagagaagcagacagaaguacgccgaggaggagcuggagcaggugagagaggcccugagaaaggccgagaaggagcuggagagccacagcagcugguacgcccccgaggcccugcagaaguggcugcagcugacccacgagguggaggugcaguacuacaacaucaagaagcagaacgccgagaagcagcugcugguggccaaggagggcgccgagaagaucaagaagaagagaaacacccuguucggcaccuuccacguggcccacagcagcagccuggacgacguggaccacaagauccugaccgccaagcaggcccugagcgaggugaccgccgcccugagagagagacugcacagauggcagcagaucgagauccugugcggcuuccagaucgugaacaaccccggcauccacagccugguggccgcccugaacaucgaccccagcuggaugggcagcaccagacccaaccccgcccacuucaucaugaccgacgacguggacgacauggacgaggagaucgugagcccccugagcaugcagagccccagccugcagagcagcgugagacagagacugaccgagccccagcacggccugggcagccagagagaccugacccacagcgacagcgagagcagccugcacaugagcgacagacagagaguggcccccaagcccccccagaugagcagagccgccgacgaggcccugaacgccaugaccagcaacggcagccacagacugaucgagggcgugcaccccggcagccugguggagaagcugcccgacagccccgcccuggccaagaaggcccugcuggcccugaaccacggccuggacaaggcccacagccugauggagcugagccccagcgccccccccggcggcagcccccaccuggacagcagcagaagccacagccccagcagccccgaccccgacacccccagccccgugggcgacagcagagcccugcaggccagcagaaacaccagaaucccccaccuggccggcaagaaggccguggccgaggaggacaacggcagcaucggcgaggagaccgacagcagccccggcagaaagaaguucccccugaagaucuucaagaagccccugaagaaguaa

SEQ ID NO: 24151 - RNA, 1800 nt, Artificial Sequence
  STIM2__Homo_sapiens__NP_001162588
augcuggugcugggccugcugguggccggcgccgccgacggcugcgagcuggugcccagacaccugagaggcagaagagccaccggcagcgccgccaccgccgccagcagccccgccgccgccgccggcgacagccccgcccugaugaccgaccccugcaugagccugagcccccccugcuucaccgaggaggacagauucagccuggaggcccugcagaccauccacaagcagauggacgacgacaaggacggcggcaucgagguggaggagagcgacgaguucaucagagaggacaugaaguacaaggacgccaccaacaagcacagccaccugcacagagaggacaagcacaucaccaucgaggaccuguggaagagauggaagaccagcgaggugcacaacuggacccuggaggacacccugcaguggcugaucgaguucguggagcugccccaguacgagaagaacuucagagacaacaacgugaagggcaccacccugcccagaaucgccgugcacgagcccagcuucaugaucagccagcugaagaucagcgacagaagccacagacagaagcugcagcugaaggcccuggacguggugcuguucggcccccugaccagacccccccacaacuggaugaaggacuucauccugaccgugagcaucgugaucggcgugggcggcugcugguucgccuacacccagaacaagaccagcaaggagcacguggccaagaugaugaaggaccuggagagccugcagaccgccgagcagagccugauggaccugcaggagagacuggagaaggcccaggaggagaacagaaacguggccguggagaagcagaaccuggagagaaagaugauggacgagaucaacuacgccaaggaggaggccugcagacugagagagcugagagagggcgccgagugcgagcugagcagaagacaguacgccgagcaggagcuggagcaggugagaauggcccugaagaaggccgagaaggaguucgagcugagaagcagcuggagcgugcccgacgcccugcagaaguggcugcagcugacccacgagguggaggugcaguacuacaacaucaagagacagaacgccgagaugcagcuggccaucgccaaggacgaggccgagaagaucaagaagaagagaagcaccguguucggcacccugcacguggcccacagcagcagccuggacgagguggaccacaagauccuggaggccaagaaggcccugagcgagcugaccaccugccugagagagagacuguucagauggcagcagaucgagaagaucugcggcuuccagaucgcccacaacagcggccugcccagccugaccagcagccuguacagcgaccacagcuggguggugaugcccagagugagcaucccccccuaccccaucgccggcggcguggacgaccuggacgaggacaccccccccaucgugagccaguuccccggcaccauggccaagccccccggcagccuggccagaagcagcagccugugcagaagcagaagaagcaucgugcccagcagcccccagccccagagagcccagcuggccccccacgccccccaccccagccaccccagacacccccaccacccccagcacaccccccacagccugcccagccccgaccccgacauccugagcgugagcagcugccccgcccuguacagaaacgaggaggaggaggaggccaucuacuucagcgccgagaagcagugcauccaccugggccugggcgccugcaagagcgaguaa

SEQ ID NO: 24152 - RNA, 1632 nt, Artificial Sequence
  STIP1__Homo_sapiens__NP_006810
auggagcaggugaacgagcugaaggagaagggcaacaaggcccugagcgugggcaacaucgacgacgcccugcagugcuacagcgaggccaucaagcuggacccccacaaccacgugcuguacagcaacagaagcgccgccuacgccaagaagggcgacuaccagaaggccuacgaggacggcugcaagaccguggaccugaagcccgacuggggcaagggcuacagcagaaaggccgccgcccuggaguuccugaacagauucgaggaggccaagagaaccuacgaggagggccugaagcacgaggccaacaacccccagcugaaggagggccugcagaacauggaggccagacuggccgagagaaaguucaugaaccccuucaacaugcccaaccuguaccagaagcuggagagcgaccccagaaccagaacccugcugagcgaccccaccuacagagagcugaucgagcagcugagaaacaagcccagcgaccugggcaccaagcugcaggaccccagaaucaugaccacccugagcgugcugcugggcguggaccugggcagcauggacgaggaggaggagaucgccacccccccccccccccccccccccaagaaggagaccaagcccgagcccauggaggaggaccugcccgagaacaagaagcaggcccugaaggagaaggagcugggcaacgacgccuacaagaagaaggacuucgacaccgcccugaagcacuacgacaaggccaaggagcuggaccccaccaacaugaccuacaucaccaaccaggccgccguguacuucgagaagggcgacuacaacaagugcagagagcugugcgagaaggccaucgaggugggcagagagaacagagaggacuacagacagaucgccaaggccuacgccagaaucggcaacagcuacuucaaggaggagaaguacaaggacgccauccacuucuacaacaagagccuggccgagcacagaacccccgacgugcugaagaagugccagcaggccgagaagauccugaaggagcaggagagacuggccuacaucaaccccgaccuggcccuggaggagaagaacaagggcaacgagugcuuccagaagggcgacuacccccaggccaugaagcacuacaccgaggccaucaagagaaaccccaaggacgccaagcuguacagcaacagagccgccugcuacaccaagcugcuggaguuccagcuggcccugaaggacugcgaggagugcauccagcuggagcccaccuucaucaagggcuacaccagaaaggccgccgcccuggaggccaugaaggacuacaccaaggccauggacguguaccagaaggcccuggaccuggacagcagcugcaaggaggccgccgacggcuaccagagaugcaugauggcccaguacaacagacacgacagccccgaggacgugaagagaagagccauggccgaccccgaggugcagcagaucaugagcgaccccgccaugagacugauccuggagcagaugcagaaggacccccaggcccugagcgagcaccugaagaaccccgugaucgcccagaagauccagaagcugauggacgugggccugaucgccaucagauaa

SEQ ID NO: 24153 - RNA, 2907 nt, Artificial Sequence
  STK10__Homo_sapiens__NP_005981
auggccuucgccaacuucagaagaauccugagacugagcaccuucgagaagagaaagagcagagaguacgagcacgugagaagagaccuggaccccaacgaggugugggagaucgugggcgagcugggcgacggcgccuucggcaagguguacaaggccaagaacaaggagaccggcgcccuggccgccgccaaggugaucgagaccaagagcgaggaggagcuggaggacuacaucguggagaucgagauccuggccaccugcgaccaccccuacaucgugaagcugcugggcgccuacuaccacgacggcaagcuguggaucaugaucgaguucugccccggcggcgccguggacgccaucaugcuggagcuggacagaggccugaccgagccccagauccagguggugugcagacagaugcuggaggcccugaacuuccugcacagcaagagaaucauccacagagaccugaaggccggcaacgugcugaugacccuggagggcgacaucagacuggccgacuucggcgugagcgccaagaaccugaagacccugcagaagagagacagcuucaucggcacccccuacuggauggcccccgagguggugaugugcgagaccaugaaggacacccccuacgacuacaaggccgacaucuggagccugggcaucacccugaucgagauggcccagaucgagcccccccaccacgagcugaaccccaugagagugcugcugaagaucgccaagagcgacccccccacccugcugacccccagcaaguggagcguggaguucagagacuuccugaagaucgcccuggacaagaaccccgagaccagacccagcgccgcccagcugcuggagcaccccuucgugagcagcaucaccagcaacaaggcccugagagagcugguggccgaggccaaggccgaggugauggaggagaucgaggacggcagagacgagggcgaggaggaggacgccguggacgccgccagcacccuggagaaccacacccagaacagcagcgaggugagcccccccagccugaacgccgacaagccccuggaggagagccccagcaccccccuggcccccagccagagccaggacagcgugaacgagcccugcagccagcccagcggcgacagaagccugcagaccaccagcccccccgugguggcccccggcaacgagaacggccuggccgugcccgugccccugagaaagagcagacccgugagcauggacgccagaauccagguggcccaggagaagcagguggccgagcagggcggcgaccugagccccgccgccaacagaagccagaaggccagccagagcagacccaacagcagcgcccuggagacccugggcggcgagaagcuggccaacggcagccuggagccccccgcccaggccgcccccggccccagcaagagagacagcgacugcagcagccugugcaccagcgagagcauggacuacggcaccaaccugagcaccgaccugagccugaacaaggagaugggcagccugagcaucaaggaccccaagcuguacaagaagacccugaagagaaccagaaaguucgugguggacggcguggaggugagcaucaccaccagcaagaucaucagcgaggacgagaagaaggacgaggagaugagauuccugagaagacaggagcugagagagcugagacugcugcagaaggaggagcacagaaaccagacccagcugagcaacaagcacgagcugcagcuggagcagaugcacaagagauucgagcaggagaucaacgccaagaagaaguucuucgacaccgagcuggagaaccuggagagacagcagaagcagcagguggagaagauggagcaggaccacgccgugagaagaagagaggaggccagaagaaucagacuggagcaggacagagacuacaccagauuccaggagcagcugaagcugaugaagaaggaggugaagaacgagguggagaagcugcccagacagcagagaaaggagagcaugaagcagaagauggaggagcacacccagaagaagcagcugcuggacagagacuucguggccaagcagaaggaggaccuggagcuggccaugaagagacugaccaccgacaacagaagagagaucugcgacaaggagagagagugccugaugaagaagcaggagcugcugagagacagagaggccgcccugugggagauggaggagcaccagcugcaggagagacaccagcuggugaagcagcagcugaaggaccaguacuuccugcagagacacgagcugcugagaaagcacgagaaggagagagagcagaugcagagauacaaccagagaaugaucgagcagcugaaggugagacagcagcaggagaaggccagacugcccaagauccagagaagcgagggcaagaccagaauggccauguacaagaagagccugcacaucaacggcggcggcagcgccgccgagcagagagagaagaucaagcaguucagccagcaggaggagaagagacagaagagcgagagacugcagcagcagcagaagcacgagaaccagaugagagacaugcuggcccagugcgagagcaacaugagcgagcugcagcagcugcagaacgagaagugccaccugcugguggagcacgagacccagaagcugaaggcccuggacgagagccacaaccagaaccugaaggaguggagagacaagcugagacccagaaagaaggcccuggaggaggaccugaaccagaagaagagagagcaggagauguucuucaagcugagcgaggaggccgagugccccaaccccagcacccccagcaaggccgccaaguucuuccccuacagcagcgccgacgccagcuaa

SEQ ID NO: 24154 - RNA, 1302 nt, Artificial Sequence
  STK11__Homo_sapiens__NP_000446
auggaggugguggacccccagcagcugggcauguucaccgagggcgagcugaugagcgugggcauggacaccuucauccacagaaucgacagcaccgaggugaucuaccagcccagaagaaagagagccaagcugaucggcaaguaccugaugggcgaccugcugggcgagggcagcuacggcaaggugaaggaggugcuggacagcgagacccugugcagaagagccgugaagauccugaagaagaagaagcugagaagaauccccaacggcgaggccaacgugaagaaggagauccagcugcugagaagacugagacacaagaacgugauccagcugguggacgugcuguacaacgaggagaagcagaagauguacauggugauggaguacugcgugugcggcaugcaggagaugcuggacagcgugcccgagaagagauuccccgugugccaggcccacggcuacuucugccagcugaucgacggccuggaguaccugcacagccagggcaucgugcacaaggacaucaagcccggcaaccugcugcugaccaccggcggcacccugaagaucagcgaccugggcguggccgaggcccugcaccccuucgccgccgacgacaccugcagaaccagccagggcagccccgccuuccagccccccgagaucgccaacggccuggacaccuucagcggcuucaagguggacaucuggagcgccggcgugacccuguacaacaucaccaccggccuguaccccuucgagggcgacaacaucuacaagcuguucgagaacaucggcaagggcagcuacgccauccccggcgacugcggccccccccugagcgaccugcugaagggcaugcuggaguacgagcccgccaagagauucagcaucagacagaucagacagcacagcugguucagaaagaagcacccccccgccgaggcccccgugcccaucccccccagccccgacaccaaggacagauggagaagcaugaccguggugcccuaccuggaggaccugcacggcgccgacgaggacgaggaccuguucgacaucgaggacgacaucaucuacacccaggacuucaccgugcccggccaggugcccgaggaggaggccagccacaacggccagagaagaggccugcccaaggccgugugcaugaacggcaccgaggccgcccagcugagcaccaagagcagagccgagggcagagcccccaaccccgccagaaaggccugcagcgccagcagcaagaucagaagacugagcgccugcaagcagcaguaa

SEQ ID NO: 24155 - RNA, 3267 nt, Artificial Sequence
  STK11IP__Homo_sapiens__NP_443134
augaccaccgcccagagagacagccugcuguggaagcuggccggccugcugagagagagcggcgacguggugcugagcggcugcagcacccugagccugcugacccccacccugcagcagcugaaccacguguucgagcugcaccugggccccuggggccccggccagaccggcuucguggcccugcccagccaccccgccgacagccccgugauccugcagcugcaguuccuguucgacgugcugcagaagacccugagccugaagcuggugcacguggccggccccggccccaccggccccaucaagaucuuccccuucaagagccugagacaccuggagcugagaggcgugccccugcacugccugcacggccugagaggcaucuacagccagcuggagacccugaucugcagcagaagccugcaggcccuggaggagcugcugagcgccugcggcggcgacuucugcagcgcccugcccuggcuggcccugcugagcgccaacuucagcuacaacgcccugaccgcccuggacagcagccugagacugcugagcgcccugagauuccugaaccugagccacaaccaggugcaggacugccagggcuuccugauggaccugugcgagcugcaccaccuggacaucagcuacaacagacugcaccuggugcccagaaugggccccagcggcgccgcccugggcgugcugauccugagaggcaacgagcugagaagccugcacggccuggagcagcugagaaaccugagacaccuggaccuggccuacaaccugcuggagggccacagagagcugagcccccuguggcugcuggccgagcugagaaagcuguaccuggagggcaacccccugugguuccaccccgagcacagagccgccaccgcccaguaccugagccccagagccagagacgccgccaccggcuuccugcuggacggcaaggugcugagccugaccgacuuccagacccacaccagccugggccugagccccaugggccccccccugcccuggcccgugggcagcacccccgagaccagcggcggccccgaccugagcgacagccugagcagcggcggcguggugacccagccccugcugcacaaggugaagagcagagugagagugagaagagccagcaucagcgagcccagcgacaccgaccccgagcccagaacccugaaccccagccccgccggcugguucgugcagcagcaccccgagcuggagcugaugagcagcuucagagagagauucggcagaaacuggcugcaguacagaagccaccuggagcccagcggcaacccccugcccgccacccccaccaccagcgcccccagcgccccccccgccagcagccagggccccgacaccgcccccagacccagccccccccaggaggaggccagaggcccccaggagagcccccagaagaugagcgaggaggugagagccgagccccaggaggaggaggaggagaaggagggcaaggaggagaaggaggagggcgagaugguggagcagggcgaggaggaggccggcgaggaggaggaggaggagcaggaccagaaggagguggaggccgagcugugcagaccccugcuggugugcccccuggagggccccgagggcgugagaggcagagagugcuuccugagagugaccagcgcccaccuguucgagguggagcugcaggccgccagaacccuggagagacuggagcugcagagccuggaggccgccgagaucgagcccgaggcccaggcccagagaagccccagacccaccggcagcgaccugcugcccggcgcccccauccugagccugagauucagcuacaucugccccgacagacagcugagaagauaccuggugcuggagcccgacgcccacgccgccgugcaggagcugcuggccgugcugacccccgugaccaacguggccagagagcagcugggcgaggccagagaccugcugcugggcagauuccagugccugagaugcggccacgaguucaagcccgaggagcccagaaugggccuggacagcgaggagggcuggagaccccuguuccagaagaccgagagccccgccgugugccccaacugcggcagcgaccacguggugcugcuggccgugagcagaggcacccccaacagagagagaaagcagggcgagcagagccuggcccccagccccagcgccagccccgugugccacccccccggccacggcgaccaccuggacagagccaagaacagccccccccaggcccccagcaccagagaccacggcagcuggagccugagccccccccccgagagaugcggccugagaagcguggaccacagacugagacuguuccuggacguggagguguucagcgacgcccaggaggaguuccagugcugccugaaggugcccguggcccuggccggccacaccggcgaguucaugugccuggugguggugagcgacagaagacuguaccugcugaaggugaccggcgagaugagagagccccccgccagcuggcugcagcugacccuggccgugccccugcaggaccugagcggcaucgagcugggccuggccggccagagccugagacuggagugggccgccggcgccggcagaugcgugcugcugcccagagacgccagacacugcagagccuuccuggaggagcugcuggacgugcugcagagccugccccccgccuggagaaacugcgugagcgccaccgaggaggaggugaccccccagcacagacuguggccccugcuggagaaggacagcagccuggaggccagacaguucuucuaccugagagccuuccugguggagggccccagcaccugccuggugagccugcugcugacccccagcacccuguuccugcuggacgaggacgccgccggcagccccgccgagcccagcccccccgccgccagcggcgaggccagcgagaaggugccccccagcggccccggccccgccgugagagugagagagcagcagccccugagcagccugagcagcgugcugcuguacagaagcgcccccgaggaccugagacugcuguucuacgacgaggugagcagacuggagagcuucugggcccugagaguggugugccaggagcagcugaccgcccugcuggccuggaucagagagcccugggaggagcuguucagcaucggccugagaaccgugauccaggaggcccuggcccuggacagauaa

SEQ ID NO: 24156 - RNA, 1245 nt, Artificial Sequence
  STK17A__Homo_sapiens__NP_004751
augaucccccuggagaagcccggcagcggcggcagcagccccggcgccaccagcggcagcggcagagccggcagaggccugagcggccccugcagaccccccccccccccccaggccagaggccugcugaccgagaucagagccguggugagaaccgagcccuuccaggacggcuacagccugugccccggcagagagcugggcagaggcaaguucgccguggugagaaagugcaucaagaaggacagcggcaaggaguucgccgccaaguucaugagaaagagaagaaagggccaggacugcagaauggagaucauccacgagaucgccgugcuggagcuggcccaggacaaccccugggugaucaaccugcacgagguguacgagaccgccagcgagaugauccuggugcuggaguacgccgccggcggcgagaucuucgaccagugcguggccgacagagaggaggccuucaaggagaaggacgugcagagacugaugagacagauccuggagggcgugcacuuccugcacaccagagacguggugcaccuggaccugaagccccagaacauccugcugaccagcgagagcccccugggcgacaucaagaucguggacuucggccugagcagaauccugaagaacagcgaggagcugagagagaucaugggcacccccgaguacguggcccccgagauccugagcuacgaccccaucagcauggccaccgacauguggagcaucggcgugcugaccuacgugaugcugaccggcaucagccccuuccugggcaacgacaagcaggagaccuuccugaacaucagccagaugaaccugagcuacagcgaggaggaguucgacgugcugagcgagagcgccguggacuucaucagaacccugcuggugaagaagcccgaggacagagccaccgccgaggagugccugaagcaccccuggcugacccagagcagcauccaggagcccagcuucagaauggagaaggcccuggaggaggccaacgcccugcaggagggccacagcgugcccgagaucaacagcgacaccgacaagagcgagaccaaggagagcaucgugaccgaggagcugaucguggugaccagcuacacccugggccagugcagacagagcgagaaggagaagauggagcagaaggccaucagcaagagauucaaguucgaggagccccugcugcaggagauccccggcgaguucaucuacuaa

SEQ ID NO: 24157 - RNA, 1119 nt, Artificial Sequence
  STK17B__Homo_sapiens__NP_004217
augagcagaagaagauucgacugcagaagcaucagcggccugcugaccaccaccccccagauccccaucaagauggagaacuucaacaacuucuacauccugaccagcaaggagcugggcagaggcaaguucgccguggugagacagugcaucagcaagagcaccggccaggaguacgccgccaaguuccugaagaagagaagaagaggccaggacugcagagccgagauccugcacgagaucgccgugcuggagcuggccaagagcugccccagagugaucaaccugcacgagguguacgagaacaccagcgagaucauccugauccuggaguacgccgccggcggcgagaucuucagccugugccugcccgagcuggccgagauggugagcgagaacgacgugaucagacugaucaagcagauccuggagggcguguacuaccugcaccagaacaacaucgugcaccuggaccugaagccccagaacauccugcugagcagcaucuacccccugggcgacaucaagaucguggacuucggcaugagcagaaagaucggccacgccugcgagcugagagagaucaugggcacccccgaguaccuggcccccgagauccugaacuacgaccccaucaccaccgccaccgacauguggaacaucggcaucaucgccuacaugcugcugacccacaccagccccuucgugggcgaggacaaccaggagaccuaccugaacaucagccaggugaacguggacuacagcgaggagaccuucagcagcgugagccagcuggccaccgacuucauccagagccugcuggugaagaaccccgagaagagacccaccgccgagaucugccugagccacagcuggcugcagcagugggacuucgagaaccuguuccaccccgaggagaccagcagcagcagccagacccaggaccacagcgugagaagcagcgaggacaagaccagcaagagcagcugcaacggcaccugcggcgacagagaggacaaggagaacauccccgaggacagcagcauggugagcaagagauucagauucgacgacagccugcccaacccccacgagcuggugagcgaccugcugugcuaa

SEQ ID NO: 24158 - RNA, 1095 nt, Artificial Sequence
  STK19__Homo_sapiens__NP_004188
augcagaagugguucagcgccuucgacgacgccaucauccagagacaguggagagccaaccccagcagaggcggcggcggcgugagcuucaccaaggagguggacaccaacguggccaccggcgccccccccagaagacagagagugcccggcagagccugccccuggagagagcccaucagaggcagaagaggcgccagacccggcggcggcgacgccggcggcacccccggcgagaccgugagacacugcagcgcccccgaggaccccaucuucagauucagcagccugcacagcuaccccuuccccggcaccaucaagagcagagacaugagcuggaagagacaccaccugauccccgagaccuucggcgugaagagaagaagaaagagaggccccguggagagcgacccccugagaggcgagcccggcagcgccagagccgccgugagcgagcugaugcagcuguuccccagaggccuguucgaggacgcccugccccccaucgugcugagaagccagguguacagccuggugcccgacagaaccguggccgacagacagcugaaggagcugcaggagcagggcgagaucagaaucgugcagcugggcuucgaccuggacgcccacggcaucaucuucaccgaggacuacagaaccagagugcugaaggccugcgacggcagacccuacgccggcgccgugcagaaguuccuggccagcgugcugcccgccugcggcgaccugagcuuccagcaggaccagaugacccagaccuucggcuucagagacagcgagaucacccaccuggugaacgccggcgugcugaccgugagagacgccggcagcugguggcuggccgugcccggcgccggcagauucaucaaguacuucgugaagggcagacaggccgugcugagcauggugagaaaggccaaguacagagagcugcugcugagcgagcugcugggcagaagagcccccgugguggugagacugggccugaccuaccacgugcacgaccugaucggcgcccagcugguggacugcaucagcaccaccagcggcacccugcugagacugcccgagaccuaa

SEQ ID NO: 24159 - RNA, 1296 nt, Artificial Sequence
  STK24__Homo_sapiens__NP_001027467
auggcccacagccccgugcagagcggccugcccggcaugcagaaccugaaggccgaccccgaggagcuguucaccaagcuggagaagaucggcaagggcagcuucggcgagguguucaagggcaucgacaacagaacccagaaggugguggccaucaagaucaucgaccuggaggaggccgaggacgagaucgaggacauccagcaggagaucaccgugcugagccagugcgacagccccuacgugaccaaguacuacggcagcuaccugaaggacaccaagcuguggaucaucauggaguaccugggcggcggcagcgcccuggaccugcuggagcccggcccccuggacgagacccagaucgccaccauccugagagagauccugaagggccuggacuaccugcacagcgagaagaagauccacagagacaucaaggccgccaacgugcugcugagcgagcacggcgaggugaagcuggccgacuucggcguggccggccagcugaccgacacccagaucaagagaaacaccuucgugggcacccccuucuggauggcccccgaggugaucaagcagagcgccuacgacagcaaggccgacaucuggagccugggcaucaccgccaucgagcuggccagaggcgagcccccccacagcgagcugcaccccaugaaggugcuguuccugauccccaagaacaacccccccacccuggagggcaacuacagcaagccccugaaggaguucguggaggccugccugaacaaggagcccagcuucagacccaccgccaaggagcugcugaagcacaaguucauccugagaaacgccaagaagaccagcuaccugaccgagcugaucgacagauacaagagauggaaggccgagcagagccacgacgacagcagcagcgaggacagcgacgccgagaccgacggccaggccagcggcggcagcgacagcggcgacuggaucuucaccaucagagagaaggaccccaagaaccuggagaacggcgcccugcagcccagcgaccuggacagaaacaagaugaaggacauccccaagagacccuucagccagugccugagcaccaucaucagcccccuguucgccgagcugaaggagaagagccaggccugcggcggcaaccugggcagcaucgaggagcugagaggcgccaucuaccuggccgaggaggccugccccggcaucagcgacaccaugguggcccagcuggugcagagacugcagagauacagccugagcggcggcggcaccagcagccacuaa

SEQ ID NO: 24160 - RNA, 1281 nt, Artificial Sequence
  STK25__Homo_sapiens__NP_001258907
auggcccaccugagaggcuucgccaaccagcacagcagaguggaccccgaggagcuguucaccaagcuggacagaaucggcaagggcagcuucggcgagguguacaagggcaucgacaaccacaccaaggaggugguggccaucaagaucaucgaccuggaggaggccgaggacgagaucgaggacauccagcaggagaucaccgugcugagccagugcgacagccccuacaucaccagauacuucggcagcuaccugaagagcaccaagcuguggaucaucauggaguaccugggcggcggcagcgcccuggaccugcugaagcccggcccccuggaggagaccuacaucgccaccauccugagagagauccugaagggccuggacuaccugcacagcgagagaaagauccacagagacaucaaggccgccaacgugcugcugagcgagcagggcgacgugaagcuggccgacuucggcguggccggccagcugaccgacacccagaucaagagaaacaccuucgugggcacccccuucuggauggcccccgaggugaucaagcagagcgccuacgacuucaaggccgacaucuggagccugggcaucaccgccaucgagcuggccaagggcgagccccccaacagcgaccugcaccccaugagagugcuguuccugauccccaagaacagcccccccacccuggagggccagcacagcaagcccuucaaggaguucguggaggccugccugaacaaggaccccagauucagacccaccgccaaggagcugcugaagcacaaguucaucaccagauacaccaagaagaccagcuuccugaccgagcugaucgacagauacaagagauggaagagcgagggccacggcgaggagagcagcagcgaggacagcgacaucgacggcgaggccgaggacggcgagcagggccccaucuggaccuucccccccaccaucagacccagcccccacagcaagcugcacaagggcaccgcccugcacagcagccagaagcccgccgagcccgugaagagacagcccagaagccagugccugagcacccuggugagacccguguucggcgagcugaaggagaagcacaagcagagcggcggcagcgugggcgcccuggaggagcuggagaacgccuucagccuggccgaggagagcugccccggcaucagcgacaagcugauggugcaccugguggagagagugcagagauucagccacaacagaaaccaccugaccagcaccagauaa

SEQ ID NO: 24161 - RNA, 1065 nt, Artificial Sequence
  STK26__Homo_sapiens__NP_001035917
auggcccacagccccguggccgugcaggugcccggcaugcagaacaacaucgccgaccccgaggagcuguucaccaagcuggagagaaucggcaagggcagcuucggcgagguguucaagggcaucgacaacagaacccagcaggugguggccaucaagaucaucgaccuggaggaggccgaggacgagaucgaggacauccagcaggagaucaccgugcugagccagugcgacagcagcuacgugaccaaguacuacggcagcuaccugaagggcagcaagcuguggaucaucauggaguaccugggcggcggcagcgcccuggaccugcugagagccggccccuucgacgaguuccagaucgccaccaugcugaaggagauccugaagggccuggacuaccugcacagcgagaagaagauccacagagacaucaaggccgccaacgugcugcugagcgagcagggcgacgugaagcuggccgacuucggcguggccggccagcugaccgacacccagaucaagagaaacaccuucgugggcacccccuucuggauggcccccgaggugauccagcagagcgccuacgacagcaagagacccaccgccaaggagcugcugaagcacaaguucaucgugaagaacagcaagaagaccagcuaccugaccgagcugaucgacagauucaagagauggaaggccgagggccacagcgacgacgagagcgacagcgagggcagcgacagcgagagcaccagcagagagaacaacacccaccccgaguggagcuucaccaccgugagaaagaagcccgaccccaagaaggugcagaacggcgccgagcaggaccuggugcagacccugagcugccugagcaugaucaucacccccgccuucgccgagcugaagcagcaggacgagaacaacgccagcagaaaccaggccaucgaggagcuggagaagagcaucgccguggccgaggccgccugccccggcaucaccgacaagauggugaagaagcugaucgagaaguuccagaagugcagcgccgacgagagccccuaa

SEQ ID NO: 24162 - RNA, 2991 nt, Artificial Sequence
  STK31__Homo_sapiens__NP_001247433
auggacgaggacacccacuacgacaagguggaggacguggugggcagccacaucgaggacgccgugaccuucugggcccagagcaucaacagaaacaaggacaucaugaagaucggcugcagccugagcgaggugugcccccaggccagcagcgugcugggcaaccuggaccccaacaagaucuacggcggccuguucagcgaggaccagugcugguacagaugcaaggugcugaagaucaucagcguggagaagugccuggugagauacaucgacuacggcaacaccgagauccugaacagaagcgacaucguggagaucccccuggagcugcaguucagcagcguggccaagaaguacaagcuguggggccugcacauccccagcgaccaggaggugacccaguucgaccagggcaccaccuuccugggcagccugaucuucgagaaggagaucaagaugagaaucaaggccaccagcgaggacggcaccgugaucgcccaggccgaguacggcagcguggacaucggcgaggaggugcugaagaagggcuucgccgagaagugcagacuggccagcagaaccgacaucugcgaggagaagaagcuggaccccggccagcuggugcugagaaaccugaagagccccaucccccuguggggccacagaagcaaccagagcaccuucagcagacccaagggccaccugagcgagaagaugacccuggaccugaaggacgagaacgacgccggcaaccugaucaccuuccccaaggagagccuggccgugggcgacuucaaccugggcagcaacgugagccuggagaagaucaagcaggaccagaagcugaucgaggagaacgagaagcugaagaccgagaaggacgcccugcuggagagcuacaaggcccuggagcugaagguggagcagaucgcccaggagcugcagcaggagaaggccgccgccguggaccugaccaaccaccuggaguacacccugaagaccuacaucgacaccagaaugaagaaccuggccgccaagauggagauccugaaggagaugagacacguggacaucagcgugagauucggcaaggaccugagcgacgccauccaggugcuggacgagggcugcuucaccacccccgccagccugaacggccuggagaucaucugggccgaguacagccuggcccaggagaacaucaagaccugcgaguacgugagcgagggcaacauccugaucgcccagagaaacgagaugcagcagaagcuguacaugagcguggaggacuucauccuggagguggacgagagcagccugaacaagagacugaagacccugcaggaccugagcgugagccuggaggccguguacggccaggccaaggagggcgccaacagcgacgagauccugaagaaguucuacgacuggaagugcgacaagagagaggaguucaccagcgugagaagcgagaccgacgccagccugcacagacugguggccugguuccagagaacccugaagguguucgaccugagcguggagggcagccugaucagcgaggacgccauggacaacaucgacgagauccuggagaagaccgagagcagcgugugcaaggagcuggagaucgcccugguggaccagggcgacgccgacaaggagaucaucagcaacaccuacagccaggugcugcagaagauccacagcgaggagagacugaucgccaccgugcaggccaaguacaaggacagcaucgaguucaagaagcagcugaucgaguaccugaacaagagccccagcguggaccaccugcugagcaucaagaagacccugaagagccugaaggcccugcugagauggaagcugguggagaagagcaaccuggaggagagcgacgaccccgacggcagccagaucgagaagaucaaggaggagaucacccagcugagaaacaacguguuccaggagaucuaccacgagagagaggaguacgagaugcugaccagccuggcccagaagugguuccccgagcugccccugcugcaccccgagaucggccugcugaaguacaugaacagcggcggccugcugaccaugagccuggagagagaccugcuggacgccgagcccaugaaggagcugagcagcaagagaccccuggugagaagcgaggugaacggccagaucauccugcugaagggcuacagcguggacguggacaccgaggccaaggugaucgagagagccgccaccuaccacagagccuggagagaggccgagggcgacagcggccugcugccccugaucuuccuguuccugugcaagagcgaccccauggccuaccugauggugcccuacuaccccagagccaaccugaacgccgugcaggccaacaugccccugaacagcgaggagacccugaaggugaugaagggcguggcccagggccugcacacccugcacaaggccgacaucauccacggcagccugcaccagaacaacguguucgcccugaacagagagcagggcaucgugggcgacuucgacuucaccaagagcgugagccagagagccagcgugaacaugauggugggcgaccugagccugaugagccccgagcugaagaugggcaagcccgccagccccggcagcgaccuguacgccuacggcugccugcugcuguggcugagcgugcagaaccaggaguucgagaucaacaaggacggcauccccaagguggaccaguuccaccuggacgacaaggugaagagccugcugugcagccugaucugcuacagaagcagcaugaccgccgagcaggugcugaacgccgagugcuuccugaugcccaaggagcagagcgugcccaaccccgagaaggacaccgaguacacccuguacaagaaggaggaggagaucaagaccgagaaccuggacaagugcauggagaagaccagaaacggcgaggccaacuucgacugcuaa

SEQ ID NO: 24163 - RNA, 1191 nt, Artificial Sequence
  STK32A__Homo_sapiens__NP_001106195
augggcgccaacaccagcagaaagccccccguguucgacgagaacgaggacgugaacuucgaccacuucgagauccugagagccaucggcaagggcagcuucggcaaggugugcaucgugcagaagaacgacaccaagaagauguacgccaugaaguacaugaacaagcagaagugcguggagagaaacgaggugagaaacguguucaaggagcugcagaucaugcagggccuggagcaccccuuccuggugaaccugugguacagcuuccaggacgaggaggacauguucauggugguggaccugcugcugggcggcgaccugagauaccaccugcagcagaacgugcacuucaaggaggagaccgugaagcuguucaucugcgagcuggugauggcccuggacuaccugcagaaccagagaaucauccacagagacaugaagcccgacaacauccugcuggacgagcacggccacgugcacaucaccgacuucaacaucgccgccaugcugcccagagagacccagaucaccaccauggccggcaccaagcccuacauggcccccgagauguucagcagcagaaagggcgccggcuacagcuucgccguggacugguggagccugggcgugaccgccuacgagcugcugagaggcagaagacccuaccacaucagaagcagcaccagcagcaaggagaucgugcacaccuucgagaccaccguggugaccuaccccagcgccuggagccaggagauggugagccugcugaagaagcugcuggagcccaaccccgaccagagauucagccagcugagcgacgugcagaacuuccccuacaugaacgacaucaacugggacgccguguuccagaagagacugauccccggcuucauccccaacaagggcagacugaacugcgaccccaccuucgagcuggaggagaugauccuggagagcaagccccugcacaagaagaagaagagacuggccaagaaggagaaggacaugagaaagugcgacagcagccagaccugccugcugcaggagcaccuggacagcgugcagaaggaguucaucaucuucaacagagagaaggugaacagagacuucaacaagagacagcccaaccuggcccuggagcagaccaaggacccccagggcgaggacggccagaacaacaaccuguaa

SEQ ID NO: 24164 - RNA, 1245 nt, Artificial Sequence
  STK32B__Homo_sapiens__NP_060871
augggcggcaaccacagccacaagccccccguguucgacgagaacgaggaggugaacuucgaccacuuccagauccugagagccaucggcaagggcagcuucggcaaggugugcaucgugcagaagagagacaccaagaagauguacgccaugaaguacaugaacaagcagaagugcaucgagagagacgaggugagaaacguguucagagagcugcagaucaugcagggccuggagcaccccuuccuggugaaccugugguacagcuuccaggacgaggaggacauguucauggugguggaccugcugcugggcggcgaccugagauaccaccugcagcagaacgugcacuucaccgagggcaccgugaagcuguacaucugcgagcuggcccuggcccuggaguaccugcagagauaccacaucauccacagagacaucaagcccgacaacauccugcuggacgagcacggccacgugcacaucaccgacuucaacaucgccaccguggugaagggcgccgagagagccagcagcauggccggcaccaagcccuacauggcccccgagguguuccagguguacauggacagaggccccggcuacagcuaccccguggacugguggagccugggcaucaccgccuacgagcugcugagaggcuggagacccuacgagauccacagcgugacccccaucgacgagauccugaacauguucaagguggagagagugcacuacagcagcaccuggugcaagggcaugguggcccugcugagaaagcugcugaccaaggaccccgagagcagagugagcagccugcacgacauccagagcgugcccuaccuggccgacaugaacugggacgccguguucaagaaggcccugaugcccggcuucgugcccaacaagggcagacugaacugcgaccccaccuucgagcuggaggagaugauccuggagagcaagccccugcacaagaagaagaagagacuggccaagaacagaagcagagacggcaccaaggacagcugcccccugaacggccaccugcagcacugccuggagaccgugagagaggaguucaucaucuucaacagagagaagcugagaagacagcagggccagggcagccagcugcuggacaccgacagcagaggcggcggccaggcccagagcaagcugcaggacggcugcaacaacaaccugcugacccacaccugcaccagaggcugcagcagcuaa

SEQ ID NO: 24165 - RNA, 1461 nt, Artificial Sequence
  STK32C__Homo_sapiens__NP_775846
augagaagcggcgccgagagaagaggcagcagcgccgccgccagccccggcagccccccccccggcagagccagacccgccggcagcgacgcccccagcgcccugcccccccccgccgccggccagcccagagccagagacagcggcgacgugagaagccagcccagaccccuguuccaguggagcaaguggaagaagagaaugggcagcagcaugagcgccgccaccgccagaagacccguguucgacgacaaggaggacgugaacuucgaccacuuccagauccugagagccaucggcaagggcagcuucggcaaggugugcaucgugcagaagagagacaccgagaagauguacgccaugaaguacaugaacaagcagcagugcaucgagagagacgaggugagaaacguguucagagagcuggagauccugcaggagaucgagcacguguuccuggugaaccugugguacagcuuccaggacgaggaggacauguucauggugguggaccugcugcugggcggcgaccugagauaccaccugcagcagaacgugcaguucagcgaggacaccgugagacuguacaucugcgagauggcccuggcccuggacuaccugagaggccagcacaucauccacagagacgugaagcccgacaacauccugcuggacgagagaggccacgcccaccugaccgacuucaacaucgccaccaucaucaaggacggcgagagagccaccgcccuggccggcaccaagcccuacauggcccccgagaucuuccacagcuucgugaacggcggcaccggcuacagcuucgagguggacugguggagcgugggcgugauggccuacgagcugcugagaggcuggagacccuacgacauccacagcagcaacgccguggagagccuggugcagcuguucagcaccgugagcgugcaguacgugcccaccuggagcaaggagaugguggcccugcugagaaagcugcugaccgugaaccccgagcacagacugagcagccugcaggacgugcaggccgcccccgcccuggccggcgugcugugggaccaccugagcgagaagagaguggagcccggcuucgugcccaacaagggcagacugcacugcgaccccaccuucgagcuggaggagaugauccuggagagcagaccccugcacaagaagaagaagagacuggccaagaacaagagcagagacaacagcagagacagcagccagagcgagaacgacuaccugcaggacugccuggacgccauccagcaggacuucgugaucuucaacagagagaagcugaagagaagccaggaccugcccagagagccccugcccgcccccgagagcagagacgccgccgagcccguggaggacgaggccgagagaagcgcccugcccaugugcggccccaucugccccagcgccggcagcggcuaa

SEQ ID NO: 24166 - RNA, 1545 nt, Artificial Sequence
  STK33__Homo_sapiens__NP_001275990
auggccgacagcggccuggacaagaagagcaccaagugccccgacugcagcagcgccagccagaaggacgugcugugcgugugcagcagcaagaccagagugccccccgugcuggugguggagaugagccagaccagcagcaucggcagcgccgagagccugaucagccuggagagaaagaaggagaagaacaucaacagagacaucaccagcagaaaggaccugcccagcagaaccagcaacguggagagaaaggccagccagcagcaguggggcagaggcaacuucaccgagggcaaggugccccacaucagaaucgagaacggcgccgccaucgaggagaucuacaccuucggcagaauccugggcaagggcagcuucggcaucgugaucgaggccaccgacaaggagaccgagaccaagugggccaucaagaaggugaacaaggagaaggccggcagcagcgccgugaagcugcuggagagagaggugaacauccugaagagcgugaagcacgagcacaucauccaccuggagcagguguucgagacccccaagaagauguaccuggugauggagcugugcgaggacggcgagcugaaggagauccuggacagaaagggccacuucagcgagaacgagaccagauggaucauccagagccuggccagcgccaucgccuaccugcacaacaacgacaucgugcacagagaccugaagcuggagaacaucauggugaagagcagccugaucgacgacaacaacgagaucaaccugaacaucaaggugaccgacuucggccuggccgugaagaagcagagcagaagcgaggccaugcugcaggccaccugcggcacccccaucuacauggcccccgaggugaucagcgcccacgacuacagccagcagugcgacaucuggagcaucggcguggugauguacaugcugcugagaggcgagccccccuuccuggccagcagcgaggagaagcuguucgagcugaucagaaagggcgagcugcacuucgagaacgccguguggaacagcaucagcgacugcgccaagagcgugcugaagcagcugaugaagguggaccccgcccacagaaucaccgccaaggagcugcuggacaaccaguggcugaccggcaacaagcugagcagcgugagacccaccaacgugcuggagaugaugaaggaguggaagaacaaccccgagagcguggaggagaacaccaccgaggagaagaacaagcccagcaccgaggagaagcugaagagcuaccagcccuggggcaacgugcccgacgccaacuacaccagcgacgaggaggaggagaagcagagcaccgccuacgagaagcaguuccccgccaccagcaaggacaacuucgacaugugcagcagcagcuucaccagcagcaagcugcugcccgccgagaucaagggcgagauggagaagacccccgugacccccagccagggcaccgccaccaaguaccccgccaagagcggcgcccugagcagaaccaagaagaagcuguaa

SEQ ID NO: 24167 - RNA, 1605 nt, Artificial Sequence
  STK35__Homo_sapiens__NP_543026
augggccaccaggagagcccccuggccagagcccccgccggcggcgccgccuacgugaagagacugugcaagggccugagcuggagagagcacguggagagccacggcagccugggcgcccaggccagccccgccagcgccgccgccgccgagggcagcgccaccagaagagccagagccgccaccagcagagccgccagaagcagaagacagcccggccccggcgccgaccacccccaggccggcgcccccggcggcaagagagccgccagaaaguggagaugcgccggccaggugaccauccagggccccgccccccccagacccagagccggcagaagagacgaggccggcggcgccagagccgccccccugcugcugccccccccccccgccgccauggagaccggcaaggacggcgccagaagaggcacccagagccccgagagaaagagaagaagccccgugcccagagcccccagcaccaagcugagacccgccgccgccgccagagccauggaccccguggccgccgaggcccccggcgaggccuuccuggccagaagaagacccgagggcggcggcggcagcgccagacccagauacagccugcuggccgagaucggcagaggcagcuacggcgugguguacgaggccguggccggcagaagcggcgccagaguggccgugaagaagaucagaugcgacgcccccgagaacguggagcuggcccuggccgaguucugggcccugaccagccugaagagaagacaccagaacguggugcaguucgaggagugcgugcugcagagaaacggccuggcccagagaaugagccacggcaacaagagcagccagcuguaccugagacugguggagaccagccugaagggcgagagaauccugggcuacgccgaggagcccugcuaccugugguucgugauggaguucugcgagggcggcgaccugaaccaguacgugcugagcagaagacccgaccccgccaccaacaagagcuucaugcugcagcugaccagcgccaucgccuuccugcacaagaaccacaucgugcacagagaccugaagcccgacaacauccugaucaccgagagaagcggcacccccauccugaagguggccgacuucggccugagcaaggugugcgccggccuggcccccagaggcaaggagggcaaccaggacaacaagaacgugaacgugaacaaguacuggcugagcagcgccugcggcagcgacuucuacauggcccccgaggugugggagggccacuacaccgccaaggccgacaucuucgcccugggcaucaucaucugggccaugaucgagagaaucaccuucaucgacagcgagaccaagaaggagcugcugggcaccuacaucaagcagggcaccgagaucgugcccgugggcgaggcccugcuggagaaccccaagauggagcugcacaucccccagaagagaagaaccagcaugagcgagggcaucaagcagcugcugaaggacaugcuggccgccaacccccaggacagacccgacgccuucgagcuggagaccagaauggaccaggugaccugcgccgccuaa

SEQ ID NO: 24168 - RNA, 1395 nt, Artificial Sequence
  STK38L__Homo_sapiens__NP_055815
auggccaugaccgccggcaccaccaccaccuuccccaugagcaaccacaccagagagagagugaccguggccaagcugacccuggagaacuucuacagcaaccugauccugcagcacgaggagagagagaccagacagaagaagcuggagguggccauggaggaggagggccuggccgacgaggagaagaagcugagaagaagccagcacgccagaaaggagaccgaguuccugagacugaagagaaccagacugggccuggacgacuucgagagccugaaggugaucggcagaggcgccuucggcgaggugagacuggugcagaagaaggacaccggccacaucuacgccaugaagauccugagaaagagcgacaugcuggagaaggagcagguggcccacaucagagccgagagagacauccugguggaggccgacggcgccuggguggugaagauguucuacagcuuccaggacaagagaaaccuguaccugaucauggaguuccugcccggcggcgacaugaugacccugcugaugaagaaggacacccugaccgaggaggagacccaguucuacaucagcgagaccgugcuggccaucgacgccauccaccagcugggcuucauccacagagacaucaagcccgacaaccugcugcuggacgccaagggccacgugaagcugagcgacuucggccugugcaccggccugaagaaggcccacagaaccgaguucuacagaaaccugacccacaacccccccagcgacuucagcuuccagaacaugaacagcaagagaaaggccgagaccuggaagaagaacagaagacagcuggccuacagcaccgugggcacccccgacuacaucgcccccgagguguucaugcagaccggcuacaacaagcugugcgacugguggagccugggcgugaucauguacgagaugcugaucggcuacccccccuucugcagcgagaccccccaggagaccuacagaaaggugaugaacuggaaggagacccugguguucccccccgaggugcccaucagcgagaaggccaaggaccugauccugagauucugcaucgacagcgagaacagaaucggcaacagcggcguggaggagaucaagggccaccccuucuucgagggcguggacugggagcacaucagagagagacccgccgccauccccaucgagaucaagagcaucgacgacaccagcaacuucgacgacuuccccgagagcgacauccugcagcccgugcccaacaccaccgagcccgacuacaagagcaaggacuggguguuccugaacuacaccuacaagagauucgagggccugacccagagaggcagcauccccaccuacaugaaggccggcaagcuguaa

SEQ ID NO: 24169 - RNA, 1638 nt, Artificial Sequence
  STK39__Homo_sapiens__NP_037365
auggccgagcccagcggcagccccgugcacgugcagcugccccagcaggccgcccccgugaccgccgccgccgccgccgcccccgccgccgccaccgccgcccccgcccccgccgcccccgccgcccccgcccccgcccccgcccccgccgcccaggccgugggcuggcccaucugcagagacgccuacgagcugcaggaggugaucggcagcggcgccaccgccguggugcaggccgcccugugcaagcccagacaggagagaguggccaucaagagaaucaaccuggagaagugccagaccagcauggacgagcugcugaaggagauccaggccaugagccagugcagccaccccaacguggugaccuacuacaccagcuucguggugaaggacgagcuguggcuggugaugaagcugcugagcggcggcagcaugcuggacaucaucaaguacaucgugaacagaggcgagcacaagaacggcgugcuggaggaggccaucaucgccaccauccugaaggaggugcuggagggccuggacuaccugcacagaaacggccagauccacagagaccugaaggccggcaacauccugcugggcgaggacggcagcgugcagaucgccgacuucggcgugagcgccuuccuggccaccggcggcgacgugaccagaaacaaggugagaaagaccuucgugggcacccccugcuggauggcccccgaggugauggagcaggugagaggcuacgacuucaaggccgacauguggagcuucggcaucaccgccaucgagcuggccaccggcgccgcccccuaccacaaguacccccccaugaaggugcugaugcugacccugcagaacgacccccccacccuggagaccggcguggaggacaaggagaugaugaagaaguacggcaagagcuucagaaagcugcugagccugugccugcagaaggaccccagcaagagacccaccgccgccgagcugcugaagugcaaguucuuccagaaggccaagaacagagaguaccugaucgagaagcugcugaccagaacccccgacaucgcccagagagccaagaaggugagaagagugcccggcagcagcggccaccugcacaagaccgaggacggcgacugggaguggagcgacgacgagauggacgagaagagcgaggagggcaaggccgccuucagccaggagaagagcagaagagugaaggaggagaaccccgagaucgccgugagcgccagcaccauccccgagcagauccagagccugagcgugcacgacagccagggcccccccaacgccaacgaggacuacagagaggccagcagcugcgccgugaaccuggugcugagacugagaaacagcagaaaggagcugaacgacaucagauucgaguucacccccggcagagacaccgccgacggcgugagccaggagcuguucagcgccggccugguggacggccacgacguggugaucguggccgccaaccugcagaagaucguggacgaccccaaggcccugaagacccugaccuucaagcuggccagcggcugcgacggcagcgagauccccgacgaggugaagcugaucggcuucgcccagcugagcgugagcuaa

SEQ ID NO: 24170 - RNA, 1476 nt, Artificial Sequence
  STK3__Homo_sapiens__NP_006272
auggagcagccccccgcccccaagagcaagcugaagaagcugagcgaggacagccugaccaagcagcccgaggagguguucgacgugcuggagaagcugggcgagggcagcuacggcagcguguucaaggccauccacaaggagagcggccaggugguggccaucaagcaggugcccguggagagcgaccugcaggagaucaucaaggagaucagcaucaugcagcagugcgacagccccuacguggugaaguacuacggcagcuacuucaagaacaccgaccuguggaucgugauggaguacugcggcgccggcagcgugagcgacaucaucagacugagaaacaagacccugaucgaggacgagaucgccaccauccugaagagcacccugaagggccuggaguaccugcacuucaugagaaagauccacagagacaucaaggccggcaacauccugcugaacaccgagggccacgccaagcuggccgacuucggcguggccggccagcugaccgacaccauggccaagagaaacaccgugaucggcacccccuucuggauggcccccgaggugauccaggagaucggcuacaacugcguggccgacaucuggagccugggcaucaccagcaucgagauggccgagggcaagccccccuacgccgacauccaccccaugagagccaucuucaugauccccaccaaccccccccccaccuucagaaagcccgagcuguggagcgacgacuucaccgacuucgugaagaagugccuggugaagaaccccgagcagagagccaccgccacccagcugcugcagcaccccuucaucaagaacgccaagcccgugagcauccugagagaccugaucaccgaggccauggagaucaaggccaagagacacgaggagcagcagagagagcuggaggaggaggaggagaacagcgacgaggacgagcuggacagccacaccauggugaagaccagcguggagagcgugggcaccaugagagccaccagcaccaugagcgagggcgcccagaccaugaucgagcacaacagcaccaugcuggagagcgaccugggcaccauggugaucaacagcgaggacgaggaggaggaggacggcaccaugaagagaaacgccaccagcccccaggugcagagacccagcuucauggacuacuucgacaagcaggacuucaagaacaagagccacgagaacugcaaccagaacaugcacgagcccuuccccaugagcaagaacguguuccccgacaacuggaaggugccccaggacggcgacuucgacuuccugaagaaccugagccuggaggagcugcagaugagacugaaggcccuggaccccaugauggagagagagaucgaggagcugagacagagauacaccgccaagagacagcccauccuggacgccauggacgccaagaagagaagacagcagaacuucuaa

SEQ ID NO: 24171 - RNA, 1464 nt, Artificial Sequence
  STK4__Homo_sapiens__NP_006273
auggagaccgugcagcugagaaacccccccagaagacagcugaagaagcuggacgaggacagccugaccaagcagcccgaggagguguucgacgugcuggagaagcugggcgagggcagcuacggcagcguguacaaggccauccacaaggagaccggccagaucguggccaucaagcaggugcccguggagagcgaccugcaggagaucaucaaggagaucagcaucaugcagcagugcgacagcccccacguggugaaguacuacggcagcuacuucaagaacaccgaccuguggaucgugauggaguacugcggcgccggcagcgugagcgacaucaucagacugagaaacaagacccugaccgaggacgagaucgccaccauccugcagagcacccugaagggccuggaguaccugcacuucaugagaaagauccacagagacaucaaggccggcaacauccugcugaacaccgagggccacgccaagcuggccgacuucggcguggccggccagcugaccgacaccauggccaagagaaacaccgugaucggcacccccuucuggauggcccccgaggugauccaggagaucggcuacaacugcguggccgacaucuggagccugggcaucaccgccaucgagauggccgagggcaagccccccuacgccgacauccaccccaugagagccaucuucaugauccccaccaaccccccccccaccuucagaaagcccgagcuguggagcgacaacuucaccgacuucgugaagcagugccuggugaagagccccgagcagagagccaccgccacccagcugcugcagcaccccuucgugagaagcgccaagggcgugagcauccugagagaccugaucaacgaggccauggacgugaagcugaagagacaggagagccagcagagagagguggaccaggacgacgaggagaacagcgaggaggacgagauggacagcggcaccauggugagagccgugggcgacgagaugggcaccgugagaguggccagcaccaugaccgacggcgccaacaccaugaucgagcacgacgacacccugcccagccagcugggcaccauggugaucaacgccgaggacgaggaggaggagggcaccaugaagagaagagacgagaccaugcagcccgccaagcccagcuuccuggaguacuucgagcagaaggagaaggagaaccagaucaacagcuucggcaagagcgugcccggcccccugaagaacagcagcgacuggaagaucccccaggacggcgacuacgaguuccugaagagcuggaccguggaggaccugcagaagagacugcuggcccuggaccccaugauggagcaggagaucgaggagaucagacagaaguaccagagcaagagacagcccauccuggacgccaucgaggccaagaagagaagacagcagaacuucuaa

SEQ ID NO: 24172 - RNA, 564 nt, Artificial Sequence
  STMN2__Homo_sapiens__NP_001186143
auggccaagaccgccauggccuacaaggagaagaugaaggagcugagcaugcugagccugaucugcagcugcuucuaccccgagcccagaaacaucaacaucuacaccuacgacgacauggaggugaagcagaucaacaagagagccagcggccaggccuucgagcugauccugaagccccccagccccaucagcgaggcccccagaacccuggccagccccaagaagaaggaccugagccuggaggagauccagaagaagcuggaggccgccgaggagagaagaaagagccaggaggcccaggugcugaagcagcuggccgagaagagagagcacgagagagaggugcugcagaaggcccuggaggagaacaacaacuucagcaagauggccgaggagaagcugauccugaagauggagcagaucaaggagaacagagaggccaaccuggccgccaucaucgagagacugcaggagaagcuggugaaguucaucagcagcgagcugaaggagagcaucgagagccaguuccuggagcugcagagagagggcgagaagcaguaa

SEQ ID NO: 24173 - RNA, 510 nt, Artificial Sequence
  STMN3__Homo_sapiens__NP_001263239
augaaggagcugagcgugcugagccugaucugcagcugcuucuacacccagccccaccccaacaccguguaccaguacggcgacauggaggugaagcagcuggacaagagagccagcggccagagcuucgaggugauccugaagagccccagcgaccugagccccgagagccccaugcugagcagcccccccaagaagaaggacaccagccuggaggagcugcagaagagacuggaggccgccgaggagagaagaaagacccaggaggcccaggugcugaagcagcuggccgagagaagagagcacgagagagaggugcugcacaaggcccuggaggagaacaacaacuucagcagacaggccgaggagaagcugaacuacaagauggagcugagcaaggagaucagagaggcccaccuggccgcccugagagagagacugagagagaaggagcugcacgccgccgaggugagaagaaacaaggagcagagagaggagaugagcggcuaa

SEQ ID NO: 24174 - RNA, 570 nt, Artificial Sequence
  STMN4__Homo_sapiens__NP_001269983
augacccuggccgccuacaaggagaagaugaaggagcugccccuggugagccuguucugcagcugcuuccuggccgacccccugaacaagagcagcuacaaguacgaggccgacaccguggaccugaacuggugcgugaucagcgacauggaggugaucgagcugaacaagugcaccagcggccagagcuucgaggugauccugaagccccccagcuucgacggcgugcccgaguucaacgccagccugcccagaagaagagaccccagccuggaggagauccagaagaagcuggaggccgccgaggagagaagaaaguaccaggaggccgagcugcugaagcaccuggccgagaagagagagcacgagagagaggugauccagaaggccaucgaggagaacaacaacuucaucaagauggccaaggagaagcuggcccagaagauggagagcaacaaggagaacagagaggcccaccuggccgccaugcuggagagacugcaggagaaggacaagcacgccgaggaggugagaaagaacaaggagcugaaggaggaggccagcagauaa

SEQ ID NO: 24175 - RNA, 867 nt, Artificial Sequence
  STOM__Homo_sapiens__NP_004090
auggccgagaagagacacaccagagacagcgaggcccagagacugcccgacagcuucaaggacagccccagcaagggccugggccccugcggcuggauccugguggccuucagcuuccuguucaccgugaucaccuuccccaucagcaucuggaugugcaucaagaucaucaaggaguacgagagagccaucaucuucagacugggcagaauccugcagggcggcgccaagggccccggccuguucuucauccugcccugcaccgacagcuucaucaagguggacaugagaaccaucagcuucgacauccccccccaggagauccugaccaaggacagcgugaccaucagcguggacggcgugguguacuacagagugcagaacgccacccuggccguggccaacaucaccaacgccgacagcgccaccagacugcuggcccagaccacccugagaaacgugcugggcaccaagaaccugagccagauccugagcgacagagaggagaucgcccacaacaugcagagcacccuggacgacgccaccgacgccuggggcaucaagguggagagaguggagaucaaggacgugaagcugcccgugcagcugcagagagccauggccgccgaggccgaggccagcagagaggccagagccaaggugaucgccgccgagggcgagaugaacgccagcagagcccugaaggaggccagcauggugaucaccgagagccccgccgcccugcagcugagauaccugcagacccugaccaccaucgccgccgagaagaacagcaccaucguguucccccugcccaucgacaugcugcagggcaucaucggcgccaagcacagccaccugggcuaa

SEQ ID NO: 24176 - RNA, 1047 nt, Artificial Sequence
  STOML1__Homo_sapiens__NP_001243602
augcugggcagaagcggcuacagagcccugccccugggcgacuucgacagauuccagcagagcagcuucggcuuccugggcagccagaagggcugccugagccccgagagaggcggcgugggcaccggcgccgacgugccccagagcuggcccagcugccugugccacggccugaucagcuuccugggcuuccugcugcugcuggugaccuuccccaucagcggcugguucgcccugaagcuggccagcaaggacggcgccgugcugagcgugggcgccgacgugcaguucagaaucugggaccccgugcugagcgugaugaccgugaaggaccugaacaccgccaccagaaugaccgcccagaacgccaugaccaaggcccugcugaagagaccccugagagagauccagauggagaagcugaagaucagcgaccagcugcugcuggagaucaacgacgugaccagagccuggggccuggagguggacagaguggagcuggccguggaggccgugcugcagcccccccaggacagccccgccggccccaaccuggacagcacccugcagcagcuggcccugcacuuccugggcggcagcaugaacagcauggccggcggcgcccccagccccggccccgccgacaccguggagauggugagcgagguggagccccccgccccccaggugggcgccagaagcagccccaagcagccccuggccgagggccugcugaccgcccugcagcccuuccugagcgaggcccuggugagccaggugggcgccugcuaccaguucaacguggugcugcccagcggcacccagagcgccuacuuccuggaccugaccaccggcagaggcagagugggccacggcgugcccgacggcauccccgacguggugguggagauggccgaggccgaccugagagcccugcugugcagagagcugagaccccugggcgccuacaugagcggcagacugaaggugaagggcgaccuggccauggccaugaagcuggaggccgugcugagagcccugaaguaa

SEQ ID NO: 24177 - RNA, 936 nt, Artificial Sequence
  STOML2__Homo_sapiens__NP_001273960
augcuggccagagccgccagaggcaccggcgcccugcugcugagaggcagccugcuggccagcggcagagcccccagaagagccagcagcggccugcccagaaacaccguggugcuguucgugccccagcaggaggccugggugguggagagaaugggcagauuccacagaauccuggagcccggccugaacauccugauccccgugcuggacagaaucagauacgugcagagccugaaggagaucgugaucaacgugcccgagcagagcgccgugacccuggacaacgugacccugcagaucgacggcgugcuguaccugagaaucauggaccccuacaaggccagcuacggcguggaggaccccgaguacgccgugacccagcuggcccagaccaccaugagaagcgagcugggcaagcugagccuggacaagguguucagaguggaggccgagagaagaaagagagccaccgugcuggagagcgagggcaccagagagagcgccaucaacguggccgagggcaagaagcaggcccagauccuggccagcgaggccgagaaggccgagcagaucaaccaggccgccggcgaggccagcgccgugcuggccaaggccaaggccaaggccgaggccaucagaauccuggccgccgcccugacccagcacaacggcgacgccgccgccagccugaccguggccgagcaguacgugagcgccuucagcaagcuggccaaggacagcaacaccauccugcugcccagcaaccccggcgacgugaccagcaugguggcccaggccaugggcguguacggcgcccugaccaaggcccccgugcccggcacccccgacagccugagcagcggcagcagcagagacgugcagggcaccgacgccagccuggacgaggagcuggacagagugaagaugagcuaa

SEQ ID NO: 24178 - RNA, 849 nt, Artificial Sequence
  STOML3__Homo_sapiens__NP_001137505
augaacagcagaggcgagcuggugggcgugaacaacaagagacugggcgugugcggcuggauccuguucagccugagcuuccugcuggugaucaucaccuuccccaucagcaucuggaugugccugaagaucaucaaggaguacgagagagccgugguguucagacugggcagaauccaggccgacaaggccaagggccccggccugauccuggugcugcccugcaucgacguguucgugaagguggaccugagaaccgugaccugcaacauccccccccaggagauccugaccagagacagcgugaccacccagguggacggcgugguguacuacagaaucuacagcgccgugagcgccguggccaacgugaacgacgugcaccaggccaccuuccugcuggcccagaccacccugagaaacgugcugggcacccagacccugagccagauccuggccggcagagaggagaucgcccacagcauccagacccugcuggacgacgccaccgagcuguggggcaucagaguggccagaguggagaucaaggacgugagaauccccgugcagcugcagagaagcauggccgccgaggccgaggccaccagagaggccagagccaaggugcuggccgccgagggcgagaugaacgccagcaagagccugaagagcgccagcauggugcuggccgagagccccaucgcccugcagcugagauaccugcagacccugagcaccguggccaccgagaagaacagcaccaucguguucccccugcccaugaacauccuggagggcaucggcggcgugagcuacgacaaccacaagaagcugcccaacaaggccuaa

SEQ ID NO: 24179 - RNA, 3477 nt, Artificial Sequence
  STON1-GTF2A1L__Homo_sapiens__NP_001185522
augugcagcaccaaccccggcaagugggugaccuucgacgacgaccccgccgugcagagcagccagaagagcaagaacuucccccuggagaaccagggcgugugcagacccaacggccugaagcugaaccugcccggccugagagaguuccccagcggcagcagcagcaccagcagcaccccccugagcagccccaucguggacuucuacuucagccccggcccccccagcaacagcccccugagcacccccaccaaggacuuccccggcuuccccggcauccccaaggccggcacccacgugcuguaccccauccccgagagcagcagcgacagcccccuggccaucagcggcggcgagagcagccugcugcccaccagacccaccugccugagccacgcccugcugcccagcgaccacagcugcacccaccccacccccaaggugggccugcccgacgaggugaacccccagcaggccgagagccugggcuuccagagcgacgaccugccccaguuccaguacuucagagaggacugcgccuucagcagccccuucuggaaggacgagggcagcgacagccacuucacccuggacccccccggcagcaagaagauguucagcagcagaaacaaggagaugcccaucgaccagaagagccugaacaagugcagccugaacuacaucugcgagaagcuggagcaccugcagagcgccgagaaccaggacagccugagaagccugagcaugcacugccugugcgccgaggagaacgccagcagcuucgugccccacacccuguucagaagccagcccaagagcggcuggagcuucaugcugagaauccccgagaagaagaacaugaugagcagcagacaguggggccccaucuuccugaaggugcugcccggcggcauccugcagauguacuacgagcagggccuggagaagcccuucaaggagauccagcuggaccccuacugcagacugagcgagcccaagguggagaacuucagcguggccggcaagauccacaccgugaagaucgagcacgugagcuacaccgagaagagaaaguaccacagcaagaccgagguggugcacgagcccgacaucgagcagaugcugaagcugggcagcaccagcuaccacgacuuccuggacuuccugaccaccguggaggaggagcugaugaagcugcccgccgugagcaagcccaagaagaacuacgaggagcaggagaucagccuggagaucguggacaacuucuggggcaaggugaccaaggagggcaaguucguggagagcgccgugaucacccagaucuacugccugugcuucgugaacggcaaccuggagugcuuccugacccugaacgaccuggagcugcccaagagagacgagagcuacuacgagaaggacagcgagaagaagggcaucgacauccuggacuaccacuuccacaagugcgugaacgugcaggaguucgagcagagcagaaucaucaaguucgugccccuggacgccugcagauucgagcugaugagauucaagacccuguacaacggcgacaaccugcccuucagccugaagagcguggugguggugcagggcgccuacguggagcugcaggccuucgugaacauggccagccuggcccagagaagcagcuacgccggcagccugagaagcugcgacaacaucagaauccacuuccccgugcccagccaguggaucaaggcccuguggaccaugaaccugcagagacagaagagccugaaggccaagaugaacagaagagccugccugggcagccugcaggagcuggagagcgagcccgugauccaggugaccgugggcagcgccaaguacgagagcgccuaccaggccgugguguggaagaucgacagacugcccgacaagaacagcagccuggaccacccccacugccugagcuacaagcuggagcugggcagcgaccaggagauccccagcgacugguaccccuucgccaccgugcaguucagcgugcccgacaccugcgccagcagaaccgaggugagaagccugggcguggagagcgacgugcagccccagaagcacgugcagcagagagccugcuacaacauccagcccaagcuguacagaagcgugaucgaggacgugaucgagggcgugagaaaccuguucgccgaggagggcaucgaggagcaggugcugaaggaccugaagcagcugugggagaccaaggugcugcagagcaaggccaccgaggacuucuucagaaacagcauccagagcccccuguucacccugcagcugccccacagccugcaccagacccugcagagcagcaccgccagccuggugauccccgccggcagaacccugcccagcuucaccaccgccgagcugggcaccagcaacagcagcgccaacuucaccuuccccggcuaccccauccacgugcccgccggcgugacccugcagaccgugagcggccaccuguacaaggugaacgugcccaucauggugaccgagaccagcggcagagccggcauccugcagcaccccauccagcagguguuccagcagcugggccagcccagcgugauccagaccagcgugccccagcugaaccccuggagccugcaggccaccaccgagaagagccagagaaucgagaccgugcugcagcagcccgccauccugcccagcggccccguggacagaaagcaccuggagaacgccaccagcgacauccuggugagccccggcaacgagcacaagaucgugcccgaggcccugcugugccaccaggagagcagccacuacaucagccugcccggcgugguguucagcccccaggugagccagaccaacagcaacguggagagcgugcugagcggcagcgccagcauggcccagaaccugcacgacgagagccugagcaccagcccccacggcgcccugcaccagcacgugaccgacauccagcugcacauccugaagaacagaauguacggcugcgacagcgugaagcagcccagaaacaucgaggagcccagcaacauccccgugagcgagaaggacagcaacagccagguggaccugagcaucagagugaccgacgacgacaucggcgagaucauccagguggacggcagcggcgacaccagcagcaacgaggagaucggcagcaccagagacgccgacgagaacgaguuccugggcaacaucgacggcggcgaccugaaggugcccgaggaggaggccgacagcaucagcaacgaggacagcgccaccaacagcagcgacaacgaggacccccaggugaacaucguggaggaggacccccugaacagcggcgacgacgugagcgagcaggacgugcccgaccuguucgacaccgacaacgugaucgugugccaguacgacaagcagggcgacaccagagugagacacggccagcaguaa

SEQ ID NO: 24180 - RNA, 2208 nt, Artificial Sequence
  STON1__Homo_sapiens__NP_001185524
augugcagcaccaaccccggcaagugggugaccuucgacgacgaccccgccgugcagagcagccagaagagcaagaacuucccccuggagaaccagggcgugugcagacccaacggccugaagcugaaccugcccggccugagagaguuccccagcggcagcagcagcaccagcagcaccccccugagcagccccaucguggacuucuacuucagccccggcccccccagcaacagcccccugagcacccccaccaaggacuuccccggcuuccccggcauccccaaggccggcacccacgugcuguaccccauccccgagagcagcagcgacagcccccuggccaucagcggcggcgagagcagccugcugcccaccagacccaccugccugagccacgcccugcugcccagcgaccacagcugcacccaccccacccccaaggugggccugcccgacgaggugaacccccagcaggccgagagccugggcuuccagagcgacgaccugccccaguuccaguacuucagagaggacugcgccuucagcagccccuucuggaaggacgagggcagcgacagccacuucacccuggacccccccggcagcaagaagauguucagcagcagaaacaaggagaugcccaucgaccagaagagccugaacaagugcagccugaacuacaucugcgagaagcuggagcaccugcagagcgccgagaaccaggacagccugagaagccugagcaugcacugccugugcgccgaggagaacgccagcagcuucgugccccacacccuguucagaagccagcccaagagcggcuggagcuucaugcugagaauccccgagaagaagaacaugaugagcagcagacaguggggccccaucuuccugaaggugcugcccggcggcauccugcagauguacuacgagcagggccuggagaagcccuucaaggagauccagcuggaccccuacugcagacugagcgagcccaagguggagaacuucagcguggccggcaagauccacaccgugaagaucgagcacgugagcuacaccgagaagagaaaguaccacagcaagaccgagguggugcacgagcccgacaucgagcagaugcugaagcugggcagcaccagcuaccacgacuuccuggacuuccugaccaccguggaggaggagcugaugaagcugcccgccgugagcaagcccaagaagaacuacgaggagcaggagaucagccuggagaucguggacaacuucuggggcaaggugaccaaggagggcaaguucguggagagcgccgugaucacccagaucuacugccugugcuucgugaacggcaaccuggagugcuuccugacccugaacgaccuggagcugcccaagagagacgagagcuacuacgagaaggacagcgagaagaagggcaucgacauccuggacuaccacuuccacaagugcgugaacgugcaggaguucgagcagagcagaaucaucaaguucgugccccuggacgccugcagauucgagcugaugagauucaagacccuguacaacggcgacaaccugcccuucagccugaagagcguggugguggugcagggcgccuacguggagcugcaggccuucgugaacauggccagccuggcccagagaagcagcuacgccggcagccugagaagcugcgacaacaucagaauccacuuccccgugcccagccaguggaucaaggcccuguggaccaugaaccugcagagacagaagagccugaaggccaagaugaacagaagagccugccugggcagccugcaggagcuggagagcgagcccgugauccaggugaccgugggcagcgccaaguacgagagcgccuaccaggccgugguguggaagaucgacagacugcccgacaagaacagcagccuggaccacccccacugccugagcuacaagcuggagcugggcagcgaccaggagauccccagcgacugguaccccuucgccaccgugcaguucagcgugcccgacaccugcgccagcagaaccgaggugagaagccugggcguggagagcgacgugcagccccagaagcacgugcagcagagagccugcuacaacauccagguggagaucgagaagaaguggaucaagaucgacggcgaggaccccgacaagaucggcgacugcaucacccaguaa

SEQ ID NO: 24181 - RNA, 684 nt, Artificial Sequence
  STOX1__Homo_sapiens__NP_001123631
auggccagacccgugcagcuggcccccggcagccuggcccuggugcugugcagacuggaggcccagaaggccgccggcgccgccgaggagcccggcggcagagccguguucagagccuucagaagagccaacgccagaugcuucuggaacgccagacuggccagagccgccagcagacuggccuuccagggcuggcugagaagaggcgugcugcuggugagagccccccccgccugccugcaggugcugagagacgccuggagaagaagagcccugagaccccccagaggcuucagaaucagagccgugggcgacguguuccccgugcagaugaaccccaucacccagagccaguucgugccccugggcgaggugcugugcugcgccaucagcgacaugaacaccgcccagaucguggugacccaggagagccugcuggagagacugaugaagcacuaccccggcaucgccauccccagcgaggacauccuguacaccacccugggcacccugaucaaggagagaaagaucuaccacaccggcgagggcuacuucaucgugaccccccagaccuacuucaucaccaacaccaccacccaggagaacaagagaaugcugcccagcgacgagagcagacugaugcccgccagcaugaccuaccuggacaccgagagcggcaucuaa

SEQ ID NO: 24182 - RNA, 246 nt, Artificial Sequence
  STRA13__Homo_sapiens__NP_001257935
auggagggcgccggcgccggcagcggcuucagaaaggagcuggugagcagacugcugcaccugcacuucaaggacgacaagaccaaggugagcggcgacgcccugcagcugaugguggagcugcugaagguguucgugguggaggccgccgugagaggcgugagacaggcccaggccgaggacgcccugagaguggacguggaccagcuggagaaggugcugccccagcugcugcuggacuucuaa

SEQ ID NO: 24183 - RNA, 1977 nt, Artificial Sequence
  STRA6__Homo_sapiens__NP_001136091
augagcagccagcccgccggcaaccagaccagccccggcgccaccgaggacuacagcuacggcagcugguacaucgacgagccccagggcggcgaggagcugcagcccgagggcgaggugcccagcugccacaccagcaucccccccggccuguaccacgccugccuggccagccugagcauccuggugcugcugcugcuggccaugcuggugagaagaagacagcuguggcccgacugcgugagaggcagacccggccugcccagacccagagccgugcccgccgccguguucauggugcugcugagcagccugugccugcugcugcccgacgaggacgcccugcccuuccugacccuggccagcgcccccagccaggacggcaagaccgaggcccccagaggcgccuggaagauccugggccuguucuacuacgccgcccuguacuacccccuggccgccugcgccaccgccggccacaccgccgcccaccugcugggcagcacccugagcugggcccaccugggcgugcagguguggcagagagccgagugcccccaggugcccaagaucuacaaguacuacagccugcuggccagccugccccugcugcugggccugggcuuccugagccugugguaccccgugcagcuggugagaagcuucagcagaagaaccggcgccggcagcaagggccugcagagcagcuacagcgaggaguaccugagaaaccugcugugcagaaagaagcugggcagcagcuaccacaccagcaagcacggcuuccugagcugggccagagugugccugagacacugcaucuacaccccccagcccggcuuccaccugccccugaagcuggugcugagcgccacccugaccggcaccgccaucuaccagguggcccugcugcugcuggugggcguggugcccaccauccagaaggugagagccggcgugaccaccgacgugagcuaccugcuggccggcuucggcaucgugcugagcgaggacaagcaggaggugguggagcuggugaagcaccaccugugggcccuggaggugugcuacaucagcgcccuggugcugagcugccugcugaccuuccuggugcugaugagaagccuggugacccacagaaccaaccugagagcccugcacagaggcgccgcccuggaccugagcccccugcacagaagcccccaccccagcagacaggccaucuucugcuggaugagcuucagcgccuaccagaccgccuucaucugccugggccugcuggugcagcagaucaucuucuuccugggcaccaccgcccuggccuuccuggugcugaugcccgugcugcacggcagaaaccugcugcuguucagaagccuggagagcagcuggcccuucuggcugacccuggcccuggccgugauccugcagaacauggccgcccacuggguguuccuggagacccacgacggccacccccagcugaccaacagaagagugcuguacgccgccaccuuccugcuguucccccugaacgugcuggugggcgccaugguggccaccuggagagugcugcugagcgcccuguacaacgccauccaccugggccagauggaccugagccugcugccccccagagccgccacccuggaccccggcuacuacaccuacagaaacuuccugaagaucgaggugagccagagccaccccgccaugaccgccuucugcagccugcugcugcaggcccagagccugcugcccagaaccauggccgccccccaggacagccugagacccggcgaggaggacgagggcaugcagcugcugcagaccaaggacagcauggccaagggcgccagacccggcgccagcagaggcagagccagauggggccuggccuacacccugcugcacaaccccacccugcagguguucagaaagaccgcccugcugggcgccaacggcgcccagcccuaa

SEQ ID NO: 24184 - RNA, 993 nt, Artificial Sequence
  STRA8__Homo_sapiens__NP_872295
augggcaagaucgacguggacaagauccuguucuucaaccaggagaucagacuguggcagcugaucauggccacccccgaggagaacagcaacccccacgacagagccaccccccagcugcccgcccagcugcaggagcuggagcacagaguggccagaagaagacugagccaggccagacacagagccacccuggccgcccuguucaacaaccugagaaagaccguguacagccagagcgaccugaucgccagcaaguggcaggugcugaacaaggccaagagccacauccccgagcuggagcagacccuggacaaccugcugaagcugaaggccagcuucaaccuggaggacggccacgccagcagccuggaggaggugaagaaggaguacgccagcauguacagcggcaacgacagcuucccccagaacggcagcagccccugguaccugaacuucuacaagcagaccauggaccugcugaccggcagcggcaucaucaccccccaggaggccgcccugcccaucgugagcgccgccaucagccaccuguggcagaaccugagcgaggagagaaaggccagccugagacaggccugggcccagaagcacagaggccccgccacccuggccgaggccugcagagagcccgccugcgccgagggcagcgugaaggacagcggcguggacagccagggcgccagcugcagccuggugagcacccccgaggagauccuguucgaggacgccuucgacguggccagcuuccuggacaagagcgaggugcccagcaccagcagcagcagcagcgugcuggccagcugcaaccccgagaaccccgaggagaaguuccagcuguacaugcagaucaucaacuucuucaagggccugagcugcgccaacacccaggugaagcaggaggccagcuuccccguggacgaggagaugaucaugcugcagugcaccgagaccuucgacgacgaggaccuguaa

SEQ ID NO: 24185 - RNA, 1296 nt, Artificial Sequence
  STRADA__Homo_sapiens__NP_001003787
augagcuuccuggugagcaagcccgagagaaucagaagaugggugagcgagaaguucaucguggagggccugagagaccuggagcuguucggcgagcagccccccggcgacaccagaagaaagaccaacgacgccagcagcgagagcaucgccagcuucagcaagcaggaggugaugagcagcuuccugcccgagggcggcugcuacgagcugcugaccgugaucggcaagggcuucgaggaccugaugaccgugaaccuggccagauacaagcccaccggcgaguacgugaccgugagaagaaucaaccuggaggccugcagcaacgagauggugaccuuccugcagggcgagcugcacgugagcaagcuguucaaccaccccaacaucgugcccuacagagccaccuucaucgccgacaacgagcuguggguggugaccagcuucauggccuacggcagcgccaaggaccugaucugcacccacuucauggacggcaugaacgagcuggccaucgccuacauccugcagggcgugcugaaggcccuggacuacauccaccacaugggcuacgugcacagaagcgugaaggccagccacauccugaucagcguggacggcaagguguaccugagcggccugagaagcaaccugagcaugaucagccacggccagagacagagaguggugcacgacuuccccaaguacagcgugaaggugcugcccuggcugagccccgaggugcugcagcagaaccugcagggcuacgacgccaagagcgacaucuacagcgugggcaucaccgccugcgagcuggccaacggccacgugcccuucaaggacaugcccgccacccagaugcugcuggagaagcugaacggcaccgugcccugccugcuggacaccagcaccauccccgccgaggagcugaccaugagccccagcagaagcguggccaacagcggccugagcgacagccugaccaccagcacccccagacccagcaacggcgacagccccagccaccccuaccacagaaccuucagcccccacuuccaccacuucguggagcagugccugcagagaaaccccgacgccagacccagcgccagcacccugcugaaccacagcuucuucaagcagaucaagagaagagccagcgaggcccugcccgagcugcugagacccgugacccccaucaccaacuucgagggcagccagagccaggaccacagcggcaucuucggccuggugaccaaccuggaggagcuggagguggacgacugggaguucuaa

SEQ ID NO: 24186 - RNA, 1134 nt, Artificial Sequence
  STRADB__Homo_sapiens__NP_001193793
augagccugcuggacugcuucugcaccagcagaacccagguggagagccugagacccgagaagcagagcgagaccagcauccaccaguaccugguggacgagcccacccugagcuggagcagacccagcaccagagccagcgaggugcugugcagcaccaacgugagccacuacgagcugcagguggagaucggcagaggcuucgacaaccugaccagcgugcaccuggccagacacacccccaccggcacccuggugaccaucaagaucaccaaccuggagaacugcaacgaggagagacugaaggcccugcagaaggccgugauccugagccacuucuucagacaccccaacaucaccaccuacuggaccguguucaccgugggcagcuggcugugggugaucagccccuucauggccuacggcagcgccagccagcugcugagaaccuacuuccccgagggcaugagcgagacccugaucagaaacauccuguucggcgccgugagaggccugaacuaccugcaccagaacggcugcauccacagaagcaucaaggccagccacauccugaucagcggcgacggccuggugacccugagcggccugagccaccugcacagccuggugaagcacggccagagacacagagccguguacgacuucccccaguucagcaccagcgugcagcccuggcugagccccgagcugcugagacaggaccugcacggcuacaacgugaagagcgacaucuacagcgugggcaucaccgccugcgagcuggccagcggccaggugcccuuccaggacaugcacagaacccagaugcugcugcagaagcugaagggcccccccuacagcccccuggacaucagcaucuucccccagagcgagagcagaaugaagaacagccagagcggcguggacagcggcaucggcgagagcgugcuggugagcagcggcacccacaccgugaacagcgacagacugcacacccccagcagcaagaccuucagccccgccuucuucagccuggugcagcugugccugcagcaggaccccgagaagagacccagcgccagcagccugcugagccacguguucuucaagcagcccuacuucgaguuccuguaa

SEQ ID NO: 24187 - RNA, 1053 nt, Artificial Sequence
  STRAP__Homo_sapiens__NP_009109
auggccaugagacagaccccccugaccugcagcggccacaccagacccgugguggaccuggccuucagcggcaucacccccuacggcuacuuccugaucagcgccugcaaggacggcaagcccaugcugagacagggcgacaccggcgacuggaucggcaccuuccugggccacaagggcgccguguggggcgccacccugaacaaggacgccaccaaggccgccaccgccgccgccgacuucaccgccaaggugugggacgccgugagcggcgacgagcugaugacccuggcccacaagcacaucgugaagaccguggacuucacccaggacagcaacuaccugcugaccggcggccaggacaagcugcugagaaucuacgaccugaacaagcccgaggccgagcccaaggagaucagcggccacaccagcggcaucaagaaggcccuguggugcagcgaggacaagcagauccugagcgccgacgacaagaccgugagacugugggaccacgccaccaugaccgaggugaagagccugaacuucaacaugagcgugagcagcauggaguacauccccgagggcgagauccuggugaucaccuacggcagaagcaucgccuuccacagcgccgugagccuggaccccaucaagagcuucgaggcccccgccaccaucaacagcgccagccugcaccccgagaaggaguuccugguggccggcggcgaggacuucaagcuguacaaguacgacuacaacagcggcgaggagcuggagagcuacaagggccacuucggccccauccacugcgugagauucagccccgacggcgagcuguacgccagcggcagcgaggacggcacccugagacuguggcagaccguggugggcaagaccuacggccuguggaagugcgugcugcccgaggaggacagcggcgagcuggccaagcccaagaucggcuuccccgagaccaccgaggaggagcuggaggagaucgccagcgagaacagcgacugcaucuuccccagcgcccccgacgugaaggccuaa

SEQ ID NO: 24188 - RNA, 5328 nt, Artificial Sequence
  STRC__Homo_sapiens__NP_714544
auggcccugagccuguggccccugcugcugcugcugcugcugcugcugcugcugagcuucgccgugacccuggcccccaccggcccccacagccuggaccccggccugagcuuccugaagagccugcugagcacccuggaccaggccccccagggcagccugagcagaagcagauucuucaccuuccuggccaacaucagcagcagcuucgagcccggcagaaugggcgagggccccgugggcgagccccccccccugcagccccccgcccugagacugcacgacuuccuggugacccugagaggcagccccgacugggagcccaugcugggccugcugggcgacaugcuggcccugcugggccaggagcagacccccagagacuuccuggugcaccaggccggcgugcugggcggccugguggaggugcugcugggcgcccuggugcccggcggcccccccacccccaccagaccccccugcaccagagacggccccagcgacugcgugcuggccgccgacuggcugcccagccugcugcugcugcuggagggcaccagauggcaggcccuggugcaggugcagcccagcguggaccccaccaacgccaccggccuggacggcagagaggccgccccccacuuccugcagggccugcugggccugcugacccccaccggcgagcugggcagcaaggaggcccuguggggcggccugcugagaaccgugggcgccccccuguacgccgccuuccaggagggccugcugagagugacccacagccugcaggacgagguguucagcauccugggccagcccgagcccgacaccaacggccagugccagggcggcaaccugcagcagcugcugcuguggggcgugagacacaaccugagcugggacgugcaggcccugggcuuccugagcggcagccccccccccccccccgcccugcugcacugccugagcaccggcgugccccugcccagagccagccagcccagcgcccacaucagccccagacagagaagagccaucaccguggaggcccugugcgagaaccaccugggccccgccccccccuacagcaucagcaacuucagcauccaccugcugugccagcacaccaagcccgccaccccccagccccaccccagcaccaccgccaucugccagaccgccgugugguacgccgugagcugggcccccggcgcccagggcuggcugcaggccugccacgaccaguuccccgacgaguuccuggacgccaucugcagcaaccugagcuucagcgcccugagcggcagcaacagaagacuggugaagagacugugcgccggccugcugcccccccccaccagcugccccgagggccugccccccgugccccugacccccgacaucuucuggggcugcuuccuggagaacgagacccugugggccgagagacugugcggcgaggccagccugcaggccgugccccccagcaaccaggccugggugcagcacgugugccagggccccacccccgacgugaccgccagcccccccugccacaucggccccugcggcgagagaugccccgacggcggcagcuuccuggugauggugugcgccaacgacaccauguacgaggugcuggugcccuucuggcccuggcuggccggccagugcagaaucagcagaggcggcaacgacaccugcuuccuggagggccugcugggcccccugcugcccagccugcccccccugggccccagcccccugugccugacccccggccccuuccugcugggcaugcugagccagcugcccagaugccagagcagcgugcccgcccuggcccaccccaccagacugcacuaccugcugagacugcugaccuuccugcugggccccggcgccggcggcgccgaggcccagggcaugcugggcagagcccugcugcugagcagccugcccgacaacugcagcuucugggacgccuucagacccgagggcagaagaagcgugcugagaaccaucggcgaguaccuggagcaggacgaggagcagcccacccccagcggcuucgagcccaccgugaaccccagcagcggcaucagcaagauggagcugcuggccugcuucagccccgugcugugggaccugcugcagagagagaagagcgugugggcccugcagauccuggugcaggccuaccugcacaugccccccgagaaccugcagcagcuggugcugagcgccgagagagaggccgcccagggcuuccugacccugaugcugcagggcaagcugcagggcaagcugcaggugccccccagcgaggagcaggcccugggcagacugaccgcccugcugcugcagagauaccccagacugaccagccagcuguucaucgaccugagcccccugauccccuuccuggccgugagcgaccugaugagauucccccccagccugcuggccaacgacagcgugcuggccgccaucagagacuacagccccggcaugagacccgagcagaaggaggcccuggccaagagacugcuggcccccgagcuguucggcgaggugcccgccuggccccaggagcugcugugggccgugcugccccugcugccccaccugccccuggagaacuuccugcagcugagcccccaccagauccaggcccuggaggacagcuggcccgccgccggccugggccccggccacgccagacacgugcugagaagccuggugaaccagagcgugcaggacggcgaggagcaggugagaagacugggcccccuggccugcuuccugagccccgaggagcugcagagccuggugccccugagcgaccccaccggccccguggagagaggccugcuggagugcgccgccaacggcacccugagccccgagggcagaguggccuacgagcugcugggcgugcugagaagcagcggcggcgccgugcugagccccagagagcugagagugugggccccccuguucagccagcugggccugagauuccugcaggagcugagcgagccccagcugagagccaugcugcccgugcugcagggcaccagcgugacccccgcccaggccgugcugcugcugggcagacugcugcccagacacgaccugagccuggaggagcugugcagccugcaccugcugcugcccggccugagcccccagacccugcaggccauccccagaagagugcuggugggcgccugcagcugccuggcccccgagcugagcagacugagcgccugccagaccgccgcccugcugcagaccuucagagugaaggacggcgugaagaacaugggcaccaccggcgccggccccgccgugugcauccccggccagcccauccccaccaccuggcccgacugccugcugccccugcugccccugaagcugcugcagcuggacagccuggcccugcuggccaacagaagaagauacugggagcugcccuggagcgagcagcaggcccaguuccuguggaagaagaugcaggugcccaccaaccugacccugagaaaccugcaggcccugggcacccuggccggcggcaugagcugcgaguuccugcagcagaucaacagcaugguggacuuccuggagguggugcacaugaucuaccagcugcccaccagagugagaggcagccugagagccugcaucugggccgagcugcagagaagaauggccaugcccgagcccgaguggaccaccgugggccccgagcugaacggccuggacagcaagcugcugcuggaccugcccauccagcugauggacagacugagcaacgagagcaucaugcuggugguggagcuggugcagagagcccccgagcagcugcuggcccugaccccccugcaccaggccgcccuggccgagagagcccugcagaaccuggcccccaaggagacccccgugagcggcgaggugcuggagacccugggcccccuggugggcuuccugggcaccgagagcaccagacagaucccccugcagauccugcugagccaccugagccagcugcagggcuucugccugggcgagaccuucgccaccgagcugggcuggcugcugcugcaggagagcgugcugggcaagcccgagcuguggagccaggacgagguggagcaggccggcagacugguguucacccugagcaccgaggccaucagccugauccccagagaggcccugggccccgagacccuggagagacugcuggagaagcagcagagcugggagcagagcagagugggccagcugugcagagagccccagcuggccgccaagaaggccgcccugguggccggcguggugagacccgccgccgaggaccugcccgagcccgugcccaacugcgccgacgugagaggcaccuuccccgccgccuggagcgccacccagaucgccgagauggagcugagcgacuucgaggacugccugacccuguucgccggcgaccccggccugggccccgaggagcugagagccgccaugggcaaggccaagcagcuguggggcccccccagaggcuucagacccgagcagauccugcagcugggcagacugcugaucggccugggcgacagagagcugcaggagcugauccugguggacuggggcgugcugagcacccugggccagaucgacggcuggagcaccacccagcugagaaucguggugagcagcuuccugagacagagcggcagacacgugagccaccuggacuucgugcaccugaccgcccugggcuacacccugugcggccugagacccgaggagcugcagcacaucagcagcugggaguucagccaggccgcccuguuccugggcacccugcaccugcagugcagcgaggagcagcuggaggugcuggcccaccugcuggugcugcccggcggcuucggccccaucagcaacuggggccccgagaucuucaccgagaucggcaccaucgccgccggcauccccgaccuggcccugagcgcccugcugagaggccagauccagggcgugaccccccuggccaucagcgugauccccccccccaaguucgccgugguguucagccccauccagcugagcagccugaccagcgcccaggccguggccgugacccccgagcagauggccuuccugagccccgagcagagaagagccguggccugggcccagcacgagggcaaggagagccccgagcagcagggcagaagcaccgccuggggccugcaggacuggagcagacccagcuggagccuggugcugaccaucagcuuccugggccaccugcuguaa

SEQ ID NO: 24189 - RNA, 2394 nt, Artificial Sequence
  STRN3__Homo_sapiens__NP_001077362
auggacgagcuggccggcggcggcggcggcggccccggcauggccgccccccccagacagcagcagggccccggcggcaaccugggccugagccccggcggcaacggcgccgccggcggcggcggcccccccgccagcgagggcgccggccccgccgccggccccgagcugagcagaccccagcaguacaccauccccggcauccugcacuacauccagcacgagugggccagauucgagauggagagagcccacugggagguggagagagccgagcugcaggccagaaucgccuuccugcagggcgagagaaagggccaggagaaccugaagaaggaccuggugagaagaaucaagaugcuggaguacgcccugaagcaggagagagccaaguaccacaagcugaaguacggcaccgagcugaaccagggcgaccugaagaugcccaccuucgagagcgaggagaccaaggacaccgaggcccccaccgccccccagaacagccagcugaccuggaagcagggcagacagcugcugagacaguaccugcaggaggugggcuacaccgacaccauccuggacgugagaagccagagagugagaagccugcugggccugagcaacagcgagcccaacggcagcguggagaccaagaaccuggagcagauccugaacggcggcgagagccccaagcagaagggccaggagaucaagagaagcagcggcgacgugcuggagaccuucaacuuccuggagaacgccgacgacagcgacgaggacgaggagaacgacaugaucgagggcauccccgagggcaaggacaagcacagaaugaacaagcacaagaucggcaacgagggccuggccgccgaccugaccgacgaccccgacaccgaggaggcccugaaggaguucgacuuccuggugaccgccgaggacggcgagggcgccggcgaggccagaagcagcggcgacggcaccgagugggacaaggacgaccugagccccaccgccgaggugugggacguggaccagggccugaucagcaagcugaaggagcaguacaagaaggagagaaagggcaagaagggcgugaagagagccaacagaaccaagcuguacgacaugaucgccgaccugggcgacgacgagcugccccacauccccagcggcaucaucaaccagagcagaagcgccagcaccagaaugaccgaccacgagggcgccagagccgaggaggccgagcccaucaccuuccccagcggcggcggcaagagcuucaucaugggcagcgacgacgugcugcugagcgugcugggccugggcgaccuggccgaccugaccgugaccaacgacgccgacuacagcuacgaccugcccgccaacaaggacgccuucagaaagaccuggaaccccaaguacacccugagaagccacuucgacggcgugagagcccuggccuuccaccccguggagcccgugcuggugaccgccagcgaggaccacacccugaagcuguggaaccugcagaagaccgugcccgccaagaagagcgccagccuggacguggagcccaucuacaccuucagagcccacaucggccccgugcugagccuggccaucagcagcaacggcgagcagugcuucagcggcggcaucgacgccaccauccagugguggaacaugcccagccccagcguggaccccuacgacaccuacgagcccaacgugcuggccggcacccuggugggccacaccgacgccguguggggccuggccuacagcggcaucaagaaccagcugcugagcugcagcgccgacggcaccgugagacuguggaacccccaggagaagcugcccugcaucugcaccuacaacggcgacaagaagcacggcauccccaccagcguggacuucaucggcugcgaccccgcccacauggugaccagcuucaacaccggcagcgccgugaucuacgaccuggagaccagccagagccuggugauccugagcagccagguggacagcggccugcagagcaacaaccacaucaacagaguggugagccaccccacccugcccgugaccaucaccgcccacgaggacagacacaucaaguucuucgacaacaagaccggcaagaugauccacagcaugguggcccaccuggacgccgugaccagccuggccguggaccccaacggcaucuaccugaugagcggcagccacgacugcagcaucagacuguggaaccuggacagcaagaccugcgugcaggagaucaccgcccacagaaagaagcuggacgagagcaucuacgacguggccuuccacagcagcaaggccuacaucgccagcgccggcgccgacgcccuggccaagguguucguguaa

SEQ ID NO: 24190 - RNA, 2283 nt, Artificial Sequence
  STRN4__Homo_sapiens__NP_001034966
augauggaggagagagccgccgccgccguggccgccgccgccagcagcugcagaccccugggcagcggcgccggccccggccccaccggcgccgcccccgugagcgcccccgcccccggccccggccccgccggcaagggcggcggcggcggcggcagccccggccccaccgccggccccgagccccugagccugcccggcauccugcacuucauccagcacgagugggccagauucgaggccgagaaggccagaugggaggccgagagagccgagcugcaggcccagguggccuuccugcagggcgagagaaagggccaggagaaccugaagaccgaccuggugagaagaaucaagaugcuggaguacgcccugaagcaggagagagccaaguaccacaagcugaaguucggcaccgaccugaaccagggcgagaagaaggccgacgugagcgagcaggugagcaacggccccguggagagcgugacccuggagaacagcccccugguguggaaggagggcagacagcugcugagacaguaccuggaggaggugggcuacaccgacaccauccuggacaugagaagcaagagagugagaagccugcugggcagaagccuggagcugaacggcgccguggagcccagcgagggcgcccccagagccccccccggccccgccggccugagcggcggcgagagccugcuggugaagcagaucgaggagcagaucaagagaaacgccgccggcaaggacggcaaggagagacugggcggcagcgugcugggccagauccccuuccugcagaacugcgaggacgaggacagcgacgaggacgacgagcuggacagcgugcagcacaagaagcagagagugaagcugcccagcaaggcccuggugcccgagauggaggacgaggacgaggaggacgacagcgaggacgccaucaacgaguucgacuuccugggcagcggcgaggacggcgagggcgcccccgaccccagaagaugcaccguggacggcagcccccacgagcuggagagcagaagagugaagcugcagggcauccuggccgaccugagagacguggacggccugccccccaaggugaccggccccccccccggcaccccccagcccagaccccacgagggcagcuucggcuucagcagcgacguguucaucauggacaccaucggcggcggcgaggugagccugggcgaccuggccgaccugaccgugaccaacgacaacgaccugagcugcgaccugagcgacagcaaggacgccuucaagaagaccuggaaccccaaguucacccugagaagccacuacgacggcaucagaagccuggccuuccaccacagccagagcgcccugcugaccgccagcgaggacggcacccugaagcuguggaaccugcagaaggccgugaccgccaagaagaacgccgcccuggacguggagcccauccacgccuucagagcccacagaggccccgugcuggccguggccaugggcagcaacagcgaguacugcuacagcggcggcgccgacgccugcauccacagcuggaagauccccgaccugagcauggaccccuacgacggcuacgaccccagcgugcugagccacgugcuggagggccacggcgacgccguguggggccuggccuucagccccaccagccagagacuggccagcugcagcgccgacggcaccgugagaaucugggaccccagcagcagcagccccgccugccugugcaccuuccccaccgccagcgagcacggcgugcccaccagcguggccuucaccagcaccgagcccgcccacaucguggccagcuucagaagcggcgacaccgugcuguacgacauggaggugggcagcgcccugcugacccuggagagcagaggcagcagcggccccacccagaucaaccagguggugagccaccccaaccagccccugaccaucaccgcccacgacgacagaggcaucagauuccuggacaacagaaccggcaagcccgugcacagcaugguggcccaccuggacgccgugaccugccuggccguggaccccaacggcgccuuccugaugagcggcagccacgacugcagccugagacuguggagccuggacaacaagaccugcgugcaggagaucaccgcccacagaaagaagcacgaggaggccauccacgccguggccugccaccccagcaaggcccugaucgccagcgccggcgccgacgcccuggccaagguguucguguaa

SEQ ID NO: 24191 - RNA, 2343 nt, Artificial Sequence
  STRN__Homo_sapiens__NP_003153
auggacgagcaggccggccccggcguguucuucagcaacaaccaccccggcgccggcggcgccaagggccugggcccccuggccgaggccgccgccgccggcgacggcgccgccgccgccggcgccgccagagcccaguacagccugcccggcauccugcacuuccugcagcacgagugggccagauucgagguggagagagcccagugggagguggagagagccgagcugcaggcccagaucgccuuccugcagggcgagagaaagggccaggagaaccugaagaaggaccuggugagaagaaucaagaugcuggaguacgcccugaagcaggagagagccaaguaccacaagcugaaguacggcaccgagcugaaccagggcgacaugaagccccccagcuacgacagcgacgagggcaacgagaccgaggugcagccccagcagaacagccagcugauguggaagcagggcagacagcugcugagacaguaccugcaggaggugggcuacaccgacaccauccuggacgugaagagcaagagagugagagcccugcugggcuucagcagcgacgugaccgacagagaggacgacaagaaccaggacagcguggugaacggcaccgaggccgaggugaaggagaccgccaugaucgccaagagcgagcugaccgacagcgccagcgugcuggacaacuucaaguuccuggagagcgccgccgccgacuucagcgacgaggacgaggacgacgacguggacggcagagagaagagcgugaucgacaccagcaccaucgugagaaagaaggcccugcccgacagcggcgaggacagagacaccaaggaggcccugaaggaguucgacuuccuggugaccagcgaggagggcgacaacgagagcagaagcgccggcgacggcaccgacugggagaaggaggaccagugccugaugcccgaggccuggaacguggaccagggcgugaucaccaagcugaaggagcaguacaagaaggagagaaagggcaagaagggcgugaagagacccaacagaagcaagcugcaggacaugcuggccaaccugagagacguggacgagcugcccagccugcagcccagcgugggcagccccagcagacccagcagcagcagacugcccgagcacgagaucaacagagccgacgagguggaggcccugaccuucccccccagcagcggcaagagcuucaucaugggcgccgacgaggcccuggagagcgagcugggccugggcgagcuggccggccugaccguggccaacgaggccgacagccugaccuacgacaucgccaacaacaaggacgcccugagaaagaccuggaaccccaaguucacccugagaagccacuucgacggcaucagagcccuggccuuccaccccaucgagcccgugcugaucaccgccagcgaggaccacacccugaagauguggaaccugcagaagaccgcccccgccaagaagagcaccagccuggacguggagcccaucuacaccuucagagcccacaagggccccgugcugugcguggugaugagcagcaacggcgagcagugcuacagcggcggcaccgacggccugauccagggcuggaacaccaccaaccccaacaucgaccccuacgacagcuacgaccccagcgugcugagaggcccccugcugggccacaccgacgccguguggggccuggccuacagcgccgcccaccagagacugcugagcugcagcgccgacggcacccugagacuguggaacaccaccgagguggcccccgcccugagcguguucaacgacaccaaggagcugggcauccccgccagcguggaccuggugagcagcgaccccagccacaugguggccagcuucagcaagggcuacaccagcaucuucaacauggagacccagcagagaauccugacccuggagagcaacguggacaccaccgccaacagcagcugccagaucaacagagugaucagccaccccacccugcccaucagcaucaccgcccacgaggacagacacaucaaguucuacgacaacaacaccggcaagcugauccacagcaugguggcccaccuggaggccgugaccagccuggccguggaccccaacggccuguaccugaugagcggcagccacgacugcagcaucagacuguggaaccuggagagcaagaccugcauccaggaguucaccgcccacagaaagaaguucgaggagagcauccacgacguggccuuccaccccagcaagugcuacaucgccagcgccggcgccgacgcccuggccaagguguucguguaa

SEQ ID NO: 24192 - RNA, 1752 nt, Artificial Sequence
  STS__Homo_sapiens__NP_000342
augccccugagaaagaugaagauccccuuccugcugcuguucuuccugugggaggccgagagccacgccgccagcagacccaacaucauccuggugauggccgacgaccugggcaucggcgaccccggcugcuacggcaacaagaccaucagaacccccaacaucgacagacuggccagcggcggcgugaagcugacccagcaccuggccgccagcccccugugcacccccagcagagccgccuucaugaccggcagauaccccgugagaagcggcauggccagcuggagcagaaccggcguguuccuguucaccgccagcagcggcggccugcccaccgacgagaucaccuucgccaagcugcugaaggaccagggcuacagcaccgcccugaucggcaaguggcaccugggcaugagcugccacagcaagaccgacuucugccaccacccccugcaccacggcuucaacuacuucuacggcaucagccugaccaaccugagagacugcaagcccggcgagggcagcguguucaccaccggcuucaagagacugguguuccugccccugcagaucgugggcgugacccugcugacccuggccgcccugaacugccugggccugcugcacgugccccugggcguguucuucagccugcuguuccuggccgcccugauccugacccuguuccugggcuuccugcacuacuucagaccccugaacugcuucaugaugagaaacuacgagaucauccagcagcccaugagcuacgacaaccugacccagagacugaccguggaggccgcccaguucauccagagaaacaccgagacccccuuccugcuggugcugagcuaccugcacgugcacaccgcccuguucagcagcaaggacuucgccggcaagagccagcacggcguguacggcgacgccguggaggagauggacuggagcgugggccagauccugaaccugcuggacgagcugagacuggccaacgacacccugaucuacuucaccagcgaccagggcgcccacguggaggaggugagcagcaagggcgagauccacggcggcagcaacggcaucuacaagggcggcaaggccaacaacugggagggcggcaucagagugcccggcauccugagauggcccagagugauccaggccggccagaagaucgacgagcccaccagcaacauggacaucuuccccaccguggccaagcuggccggcgccccccugcccgaggacagaaucaucgacggcagagaccugaugccccugcuggagggcaagagccagagaagcgaccacgaguuccuguuccacuacugcaacgccuaccugaacgccgugagauggcacccccagaacagcaccagcaucuggaaggccuucuucuucacccccaacuucaaccccgugggcagcaacggcugcuucgccacccacgugugcuucugcuucggcagcuacgugacccaccacgaccccccccugcuguucgacaucagcaaggaccccagagagagaaacccccugacccccgccagcgagcccagauucuacgagauccugaaggugaugcaggaggccgccgacagacacacccagacccugcccgaggugcccgaccaguucagcuggaacaacuuccuguggaagcccuggcugcagcugugcugccccagcaccggccugagcugccagugcgacagagagaagcaggacaagagacugagcagauaa

SEQ ID NO: 24193 - RNA, 2118 nt, Artificial Sequence
  STT3A__Homo_sapiens__NP_001265432
augaccaaguucggcuuccugagacugagcuacgagaagcaggacacccugcugaagcugcugauccugagcauggccgccgugcugagcuucagcaccagacuguucgccgugcugagauucgagagcgugauccacgaguucgaccccuacuucaacuacagaaccaccagauuccuggccgaggagggcuucuacaaguuccacaacugguucgacgacagagccugguacccccugggcagaaucaucggcggcaccaucuaccccggccugaugaucaccagcgccgccaucuaccacgugcugcacuucuuccacaucaccaucgacaucagaaacgugugcguguuccuggccccccuguucagcagcuucaccaccaucgugaccuaccaccugaccaaggagcugaaggacgccggcgccggccugcuggccgccgccaugaucgccguggugcccggcuacaucagcagaagcguggccggcagcuacgacaacgagggcaucgccaucuucugcaugcugcugaccuacuacauguggaucaaggccgugaagaccggcagcaucugcugggccgccaagugcgcccuggccuacuucuacauggugagcagcuggggcggcuacguguuccugaucaaccugaucccccugcacgugcuggugcugaugcugaccggcagauucagccacagaaucuacguggccuacugcaccguguacugccugggcaccauccugagcaugcagaucagcuucgugggcuuccagcccgugcugagcagcgagcacauggccgccuucggcguguucggccugugccagauccacgccuucguggacuaccugagaagcaagcugaacccccagcaguucgaggugcuguucagaagcgugaucagccuggugggcuucgugcugcugaccgugggcgcccugcugaugcugaccggcaagaucagccccuggaccggcagauucuacagccugcuggaccccagcuacgccaagaacaacauccccaucaucgccagcgugagcgagcaccagcccaccaccuggagcagcuacuacuucgaccugcagcugcugguguucauguuccccgugggccuguacuacugcuucagcaaccugagcgacgccagaaucuucaucaucauguacggcgugaccagcauguacuucagcgccgugauggugagacugaugcuggugcuggcccccgugaugugcauccugagcggcaucggcgugagccaggugcugagcaccuacaugaagaaccuggacaucagcagacccgacaagaagagcaagaagcagcaggacagcaccuaccccaucaagaacgagguggccagcggcaugauccuggugauggccuucuuccugaucaccuacaccuuccacagcaccugggugaccagcgaggccuacagcagccccagcaucgugcugagcgccagaggcggcgacggcagcagaaucaucuucgacgacuucagagaggccuacuacuggcugagacacaacacccccgaggacgccaaggugaugagcuggugggacuacggcuaccagaucaccgccauggccaacagaaccauccugguggacaacaacaccuggaacaacacccacaucagcagagugggccaggccauggccagcaccgaggagaaggccuacgagaucaugagagagcuggacgugagcuacgugcuggugaucuucggcggccugaccggcuacagcagcgacgacaucaacaaguuccuguggauggugagaaucggcggcagcaccgacaccggcaagcacaucaaggagaacgacuacuacacccccaccggcgaguucagaguggacagagagggcagccccgugcugcugaacugccugauguacaagaugugcuacuacagauucggccagguguacaccgaggccaagagaccccccggcuucgacagagugagaaacgccgagaucggcaacaaggacuucgagcuggacgugcuggaggaggccuacaccaccgagcacuggcuggugagaaucuacaaggugaaggaccuggacaacagaggccugagcagaaccuaa

SEQ ID NO: 24194 - RNA, 2481 nt, Artificial Sequence
  STT3B__Homo_sapiens__NP_849193
auggccgagcccagcgcccccgagagcaagcacaagagcagccugaacagcagccccuggagcggccugauggcccugggcaacagcagacacggccaccacggccccggcgcccagugcgcccacaaggccgccggcggcgccgccccccccaagcccgcccccgccggccugagcggcggccugagccagcccgccggcuggcagagccugcugagcuucaccauccuguuccuggccuggcuggccggcuucagcagcagacuguucgccgugaucagauucgagagcaucauccacgaguucgaccccugguucaacuacagaagcacccaccaccuggccagccacggcuucuacgaguuccugaacugguucgacgagagagccugguacccccugggcagaaucgugggcggcaccguguaccccggccugaugaucaccgccggccugauccacuggauccugaacacccugaacaucaccgugcacaucagagacgugugcguguuccuggcccccaccuucagcggccugaccagcaucagcaccuuccugcugaccagagagcuguggaaccagggcgccggccugcuggccgccugcuucaucgccaucgugcccggcuacaucagcagaagcguggccggcagcuucgacaacgagggcaucgccaucuucgcccugcaguucaccuacuaccugugggugaagagcgugaagaccggcagcguguucuggaccaugugcugcugccugagcuacuucuacauggugagcgccuggggcggcuacguguucaucaucaaccugaucccccugcacguguucgugcugcugcugaugcagagauacagcaagagaguguacaucgccuacagcaccuucuacaucgugggccugauccugagcaugcagauccccuucgugggcuuccagcccaucagaaccagcgagcacauggccgccgccggcguguucgcccugcugcaggccuacgccuuccugcaguaccugagagacagacugaccaagcaggaguuccagacccuguucuuccugggcgugagccuggccgccggcgccguguuccugagcgugaucuaccugaccuacaccggcuacaucgcccccuggagcggcagauucuacagccugugggacaccggcuacgccaagauccacauccccaucaucgccagcgugagcgagcaccagcccaccaccugggugagcuucuucuucgaccugcacauccuggugugcaccuuccccgccggccugugguucugcaucaagaacaucaacgacgagagaguguucguggcccuguacgccaucagcgccguguacuucgccggcgugauggugagacugaugcugacccugacccccguggugugcaugcugagcgccaucgccuucagcaacguguucgagcacuaccugggcgacgacaugaagagagagaacccccccguggaggacagcagcgacgaggacgacaagagaaaccagggcaaccuguacgacaaggccggcaaggugagaaagcacgccaccgagcaggagaagaccgaggagggccugggccccaacaucaagagcaucgugaccaugcugaugcugaugcugcugaugauguucgccgugcacugcaccugggugaccagcaacgccuacagcagccccagcguggugcuggccagcuacaaccacgacggcaccagaaacauccuggacgacuucagagaggccuacuucuggcugagacagaacaccgacgagcacgccagagugaugagcuggugggacuacggcuaccagaucgccggcauggccaacagaaccacccugguggacaacaacaccuggaacaacagccacaucgcccuggugggcaaggccaugagcagcaacgagaccgccgccuacaagaucaugagaacccuggacguggacuacgugcuggugaucuucggcggcgugaucggcuacagcggcgacgacaucaacaaguuccuguggauggugagaaucgccgagggcgagcaccccaaggacaucagagagagcgacuacuucaccccccagggcgaguucagaguggacaaggccggcagccccacccugcugaacugccugauguacaagaugagcuacuacagauucggcgagaugcagcuggacuucagaaccccccccggcuucgacagaaccagaaacgccgagaucggcaacaaggacaucaaguucaagcaccuggaggaggccuucaccagcgagcacuggcuggugagaaucuacaaggugaaggcccccgacaacagagagacccuggaccacaagcccagagugaccaacaucuuccccaagcagaaguaccugagcaagaagaccaccaagagaaagagaggcuacaucaagaacaagcugguguucaagaagggcaagaagaucagcaagaagaccguguaa

SEQ ID NO: 24195 - RNA, 912 nt, Artificial Sequence
  STUB1__Homo_sapiens__NP_005852
augaagggcaaggaggagaaggagggcggcgccagacugggcgccggcggcggcagccccgagaagagccccagcgcccaggagcugaaggagcagggcaacagacuguucgugggcagaaaguaccccgaggccgccgccugcuacggcagagccaucaccagaaacccccugguggccguguacuacaccaacagagcccugugcuaccugaagaugcagcagcacgagcaggcccuggccgacugcagaagagcccuggagcuggacggccagagcgugaaggcccacuucuuccugggccagugccagcuggagauggagagcuacgacgaggccaucgccaaccugcagagagccuacagccuggccaaggagcagagacugaacuucggcgacgacauccccagcgcccugagaaucgccaagaagaagagauggaacagcaucgaggagagaagaauccaccaggagagcgagcugcacagcuaccugagcagacugaucgccgccgagagagagagagagcuggaggagugccagagaaaccacgagggcgacgaggacgacagccacgugagagcccagcaggccugcaucgaggccaagcacgacaaguacauggccgacauggacgagcuguucagccagguggacgagaagagaaagaagagagacauccccgacuaccugugcggcaagaucagcuucgagcugaugagagagcccugcaucacccccagcggcaucaccuacgacagaaaggacaucgaggagcaccugcagagagugggccacuucgaccccgugaccagaagcccccugacccaggagcagcugauccccaaccuggccaugaaggaggugaucgacgccuucaucagcgagaacggcuggguggaggacuacuaa

SEQ ID NO: 24196 - RNA, 864 nt, Artificial Sequence
  STX11__Homo_sapiens__NP_003755
augaaggacagacuggccgagcugcuggaccugagcaagcaguacgaccagcaguuccccgacggcgacgacgaguucgacagcccccacgaggacaucguguucgagaccgaccacauccuggagagccuguacagagacaucagagacauccaggacgagaaccagcugcugguggccgacgugaagagacugggcaagcagaacgccagauuccugaccagcaugagaagacugagcagcaucaagagagacaccaacagcaucgccaaggccaucaaggccagaggcgaggugauccacugcaagcugagagccaugaaggagcugagcgaggccgccgaggcccagcacggcccccacagcgccguggccagaaucagcagagcccaguacaacgcccugacccugaccuuccagagagccaugcacgacuacaaccaggccgagaugaagcagagagacaacugcaagaucagaauccagagacagcuggagaucaugggcaaggaggugagcggcgaccagaucgaggacauguucgagcagggcaagugggacguguucagcgagaaccugcuggccgacgugaagggcgccagagccgcccugaacgagaucgagagcagacacagagagcugcugagacuggagagcagaaucagagacgugcacgagcuguuccugcagauggccgugcugguggagaagcaggccgacacccugaacgugaucgagcugaacgugcagaagaccguggacuacaccggccaggccaaggcccaggugagaaaggccgugcaguacgaggagaagaaccccugcagaacccugugcugcuucugcugccccugccugaaguaa

SEQ ID NO: 24197 - RNA, 978 nt, Artificial Sequence
  STX16__Homo_sapiens__NP_001001433
auggccaccagaagacugaccgacgccuuccugcugcugagaaacaacagcauccagaacagacagcugcuggccgagcaggugagcagccacaucaccagcagcccccugcacagcagaagcaucgccgccgagcuggacgagcuggccgacgacagaauggcccuggugagcggcaucagccuggaccccgaggccgccaucggcgugaccaagagacccccccccaaguggguggacggcguggacgagauccaguacgacgugggcagaaucaagcagaagaugaaggagcuggccagccugcacgacaagcaccugaacagacccacccuggacgacagcagcgaggaggagcacgccaucgagaucaccacccaggagaucacccagcuguuccacagaugccagagagccgugcaggcccugcccagcagagccagagccugcagcgagcaggagggcagacugcugggcaacgugguggccagccuggcccaggcccugcaggagcugagcaccagcuucagacacgcccagagcggcuaccugaagagaaugaagaacagagaggagagaagccagcacuucuucgacaccagcgugccccugauggacgacggcgacgacaacacccuguaccacagaggcuucaccgaggaccagcuggugcugguggagcagaacacccugaugguggaggagagagagagagagaucagacagaucgugcagagcaucagcgaccugaacgagaucuucagagaccugggcgccaugaucguggagcagggcaccgugcuggacagaaucgacuacaacguggagcagagcugcaucaagaccgaggacggccugaagcagcugcacaaggccgagcaguaccagaagaagaacagaaagaugcuggugauccugauccuguucgugaucaucaucgugcugaucguggugcuggugggcgugaagagcagauaa

SEQ ID NO: 24198 - RNA, 909 nt, Artificial Sequence
  STX17__Homo_sapiens__NP_060389
augagcgaggacgaggagaaggugaagcugagaagacuggagcccgccauccagaaguucaucaagaucgugauccccaccgaccuggagagacugagaaagcaccagaucaacaucgagaaguaccagagaugcagaaucugggacaagcugcacgaggagcacaucaacgccggcagaaccgugcagcagcugagaagcaacaucagagagaucgagaagcugugccugaaggugagaaaggacgaccuggugcugcugaagagaaugaucgaccccgugaaggaggaggccagcgccgccaccgccgaguuccugcagcugcaccuggagagcguggaggagcugaagaagcaguucaacgacgaggagacccugcugcagcccccccugaccagaagcaugaccgugggcggcgccuuccacaccaccgaggccgaggccagcagccagagccugacccagaucuacgcccugcccgagaucccccaggaccagaacgccgccgagagcugggagacccuggaggccgaccugaucgagcugagccagcuggugaccgacuucagccugcuggugaacagccagcaggagaagaucgacagcaucgccgaccacgugaacagcgccgccgugaacguggaggagggcaccaagaaccugggcaaggccgccaaguacaagcuggccgcccugcccguggccggcgcccugaucggcggcauggugggcggccccaucggccugcuggccggcuucaagguggccggcaucgccgccgcccugggcggcggcgugcugggcuucaccggcggcaagcugauccagagaaagaagcagaagaugauggagaagcugaccagcagcugccccgaccugcccagccagaccgacaagaagugcagcuaa

SEQ ID NO: 24199 - RNA, 1008 nt, Artificial Sequence
  STX18__Homo_sapiens__NP_058626
auggccguggacaucacccugcuguucagagccagcgugaagaccgugaagaccagaaacaaggcccugggcguggccgugggcggcggcguggacggcagcagagacgagcuguucagaagaagccccagacccaagggcgacuucagcagcagagccagagaggugaucagccacaucggcaagcugagagacuuccugcuggagcacagaaaggacuacaucaacgccuacagccacaccaugagcgaguacggcagaaugaccgacaccgagagagaccagaucgaccaggacgcccagaucuucaugagaaccugcagcgaggccauccagcagcugagaaccgaggcccacaaggagauccacagccagcaggugaaggagcacagaaccgccgugcuggacuucaucgaggacuaccugaagagagugugcaagcuguacagcgagcagagagccaucagagugaagagagugguggacaagaagagacugagcaagcuggagcccgagcccaacaccaagaccagagagagcaccagcagcgagaaggugagccagagccccagcaaggacagcgaggagaaccccgccaccgaggagagacccgagaagauccuggccgagacccagcccgagcugggcaccuggggcgacggcaagggcgaggacgagcugagccccgaggagauccagauguucgagcaggagaaccagagacugaucggcgagaugaacagccuguucgacgaggugagacagaucgagggcagagugguggagaucagcagacugcaggagaucuucaccgagaaggugcugcagcaggaggccgagaucgacagcauccaccagcugguggugggcgccaccgagaacaucaaggagggcaacgaggacaucagagaggccaucaagaacaacgccggcuucagaguguggauccuguucuuccuggugaugugcagcuucagccugcuguuccuggacugguacgacagcuaa

SEQ ID NO: 24200 - RNA, 756 nt, Artificial Sequence
  STX1A__Homo_sapiens__NP_001159375
augaaggacagaacccaggagcugagaaccgccaaggacagcgacgacgacgacgacguggccgugaccguggacagagacagauucauggacgaguucuucgagcagguggaggagaucagaggcuucaucgacaagaucgccgagaacguggaggaggugaagagaaagcacagcgccauccuggccagccccaaccccgacgagaagaccaaggaggagcuggaggagcugaugagcgacaucaagaagaccgccaacaaggugagaagcaagcugaagagcaucgagcagagcaucgagcaggaggagggccugaacagaagcagcgccgaccugagaaucagaaagacccagcacagcacccugagcagaaaguucguggaggugaugagcgaguacaacgccacccagagcgacuacagagagagaugcaagggcagaauccagagacagcuggagaucaccggcagaaccaccaccagcgaggagcuggaggacaugcuggagagcggcaaccccgccaucuucgccagcggcaucaucauggacagcagcaucagcaagcaggcccugagcgagaucgagaccagacacagcgagaucaucaagcuggagaacagcaucagagagcugcacgacauguucauggacauggccaugcugguggagagccagaccauguggagaggccccugccugacccccagaagacccagcagcaccagagccagaagagccggcagaaagagcuaa

SEQ ID NO: 24201 - RNA, 867 nt, Artificial Sequence
  STX1B__Homo_sapiens__NP_443106
augaaggacagaacccaggagcugagaagcgccaaggacagcgacgacgaggaggagguggugcacguggacagagaccacuucauggacgaguucuucgagcagguggaggagaucagaggcugcaucgagaagcugagcgaggacguggagcaggugaagaagcagcacagcgccauccuggccgcccccaaccccgacgagaagaccaagcaggagcuggaggaccugaccgccgacaucaagaagaccgccaacaaggugagaagcaagcugaaggccaucgagcagagcaucgagcaggaggagggccugaacagaagcagcgccgaccugagaaucagaaagacccagcacagcacccugagcagaaaguucguggaggugaugaccgaguacaacgccacccagagcaaguacagagacagaugcaaggacagaauccagagacagcuggagaucaccggcagaaccaccaccaacgaggagcuggaggacaugcuggagagcggcaagcuggccaucuucaccgacgacaucaagauggacagccagaugaccaagcaggcccugaacgagaucgagaccagacacaacgagaucaucaagcuggagaccagcaucagagagcugcacgacauguucguggacauggccaugcugguggagagccagggcgagaugaucgacagaaucgaguacaacguggagcacagcguggacuacguggagagagccgugagcgacaccaagaaggccgugaaguaccagagcaaggccagaagaaagaagaucaugaucaucaucugcugcguggugcugggcguggugcuggccagcagcaucggcggcacccugggccuguaa

SEQ ID NO: 24202 - RNA, 864 nt, Artificial Sequence
  STX2__Homo_sapiens__NP_001971
augagagacagacugcccgaccugaccgccugcagaaagaacgacgacggcgacaccgugguggugguggagaaggaccacuucauggacgacuucuuccaccagguggaggagaucagaaacagcaucgacaagaucacccaguacguggaggaggugaagaagaaccacagcaucauccugagcgcccccaaccccgagggcaagaucaaggaggagcuggaggaccugaacaaggagaucaagaagaccgccaacaagaucagagccaagcugaaggccaucgagcagagcuucgaccaggacgagagcggcaacagaaccagcguggaccugagaaucagaagaacccagcacagcgugcugagcagaaaguucguggaggccauggccgaguacaacgaggcccagacccuguucagagagagaagcaagggcagaauccagagacagcuggagaucaccggcagaaccaccaccgacgacgagcuggaggagaugcuggagagcggcaagcccagcaucuucaccagcgacaucaucagcgacagccagaucaccagacaggcccugaacgagaucgagagcagacacaaggacaucaugaagcuggagaccagcaucagagagcugcacgagauguucauggacauggccauguucguggagacccagggcgagaugaucaacaacaucgagagaaacgugaugaacgccaccgacuacguggagcacgccaaggaggagaccaagaaggccaucaaguaccagagcaaggccagaagaaagcugauguucaucaucaucugcgugaucgugcugcuggugauccugggcaucauccuggccaccacccugagcuaa

SEQ ID NO: 24203 - RNA, 834 nt, Artificial Sequence
  STX3__Homo_sapiens__NP_001171511
augaaggacagacuggagcagcugaaggccaagcagcugacccaggacgacgacaccgacgccguggagaucgccaucgacaacaccgccuucauggacgaguucuucagcgagaucgaggagaccagacugaacaucgacaagaucagcgagcacguggaggaggccaagaagcuguacagcaucauccugagcgcccccauccccgagcccaagaccaaggacgaccuggagcagcugaccaccgagaucaagaagagagccaacaacgugagaaacaagcugaagagcauggagaagcacaucgaggaggacgaggugagaagcagcgccgaccugagaaucagaaagagccagcacagcgugcugagcagaaaguucguggaggugaugaccaaguacaacgaggcccagguggacuucagagagagaagcaagggcagaauccagagacagcuggagaucaccggcaagaagaccaccgacgaggagcuggaggagaugcuggagagcggcaaccccgccaucuucaccagcggcaucaucgacagccagaucagcaagcaggcccugagcgagaucgagggcagacacaaggacaucgugagacuggagagcagcaucaaggagcugcacgacauguucauggacaucgccaugcugguggagaaccagggcgagaugcuggacaacaucgagcugaacgugaugcacaccguggaccacguggagaaggccagagacgagaccaagaaggccgugaaguaccagagccaggccagaaagaagcugaucagccugcagaccggcguggccacccugguguucagauaa

SEQ ID NO: 24204 - RNA, 888 nt, Artificial Sequence
  STX4__Homo_sapiens__NP_001259025
augggcaugaccgccagaaccaagagaaccagaagcggcagcagaugguggugcaccagagccagacacggcuggggcgccagaaccagaagcagcagcaccagcccccugggccaccccccccaggugagaaccaucagacagaccaucgugaagcugggcaacaaggugcaggagcuggagaagcagcaggugaccauccuggccaccccccugcccgaggagagcaugaagcaggagcugcagaaccugagagacgagaucaagcagcugggcagagagaucagacugcagcugaaggccaucgagccccagaaggaggaggccgacgagaacuacaacagcgugaacaccagaaugagaaagacccagcacggcgugcugagccagcaguucguggagcugaucaacaagugcaacagcaugcagagcgaguacagagagaagaacguggagagaaucagaagacagcugaagaucaccaacgccggcauggugagcgacgaggagcuggagcagaugcuggacagcggccagagcgagguguucgugagcaacauccugaaggacacccaggugaccagacaggcccugaacgagaucagcgccagacacagcgagauccagcagcuggagagaagcaucagagagcugcacgacaucuucaccuuccuggccaccgagguggagaugcagggcgagaugaucaacagaaucgagaagaacauccugagcagcgccgacuacguggagagaggccaggagcacgugaagaccgcccuggagaaccagaagaaggccagaaagaagaaggugcugaucgccaucugcgugagcaucaccguggugcugcuggccgugaucaucggcgugaccguggugggcuaa

SEQ ID NO: 24205 - RNA, 966 nt, Artificial Sequence
  STX5__Homo_sapiens__NP_001231595
augauccccagaaagagauacggcagcaagaacaccgaccagggcguguaccugggccugagcaagacccaggugcugagccccgccaccgccggcagcagcagcagcgacaucgccccccugcccccccccgugacccuggugccccccccccccgacaccaugagcugcagagacagaacccaggaguuccugagcgccugcaagagccugcagaccagacagaacggcauccagaccaacaagcccgcccugagagccgugagacagagaagcgaguucacccugauggccaagagaaucggcaaggaccugagcaacaccuucgccaagcuggagaagcugaccauccuggccaagagaaagagccuguucgacgacaaggccguggagaucgaggagcugaccuacaucaucaagcaggacaucaacagccugaacaagcagaucgcccagcugcaggacuucgugagagccaagggcagccagagcggcagacaccugcagacccacagcaacaccaucguggugagccugcagagcaagcuggccagcaugagcaacgacuucaagagcgugcuggaggugagaaccgagaaccugaagcagcagagaagcagaagagagcaguucagcagagcccccgugagcgcccugccccuggcccccaaccaccugggcggcggcgccguggugcugggcgccgagagccacgccagcaaggacguggccaucgacaugauggacagcagaaccagccagcagcugcagcugaucgacgagcaggacagcuacauccagagcagagccgacaccaugcagaacaucgagagcaccaucguggagcugggcagcaucuuccagcagcuggcccacauggugaaggagcaggaggagaccauccagagcgugcugcuguucccccugcugcccgcccugagccccggcagcaccagaaccugcuaa

SEQ ID NO: 24206 - RNA, 465 nt, Artificial Sequence
  STX6__Homo_sapiens__NP_001273139
augaaggaccagaugagcaccagcagcgugcaggcccuggccgagagaaagaacagacaggcccugcugggcgacagcggcagccagaacuggagcaccggcaccaccgacaaguacggcagacuggacagagagcugcagagagccaacagccacuucaucgaggagcagcaggcccagcagcagcugaucguggagcagcaggacgagcagcuggagcuggugagcggcagcaucggcgugcugaagaacaugagccagagaaucggcggcgagcuggaggagcaggccgugaugcuggaggacuucagccacgagcuggagagcacccagagcagacuggacaacgugaugaagaagcuggccaaggugagccacaugaccagcgacagaagacaguggugcgccaucgccauccuguucgccgugcugcugguggugcugauccuguuccuggugcuguaa

SEQ ID NO: 24207 - RNA, 711 nt, Artificial Sequence
  STX8__Homo_sapiens__NP_004844
auggcccccgaccccugguucagcaccuacgacagcaccugccagaucgcccaggagaucgccgagaagauccagcagagaaaccaguacgagagaaagggcgagaaggcccccaagcugaccgugaccaucagagcccugcugcagaaccugaaggagaagaucgcccugcugaaggaccugcugcugagagccgugagcacccaccagaucacccagcuggagggcgacagaagacagaaccugcuggacgaccuggugaccagagagagacugcugcuggccagcuucaagaacgagggcgccgagcccgaccugaucagaagcagccugaugagcgaggaggccaagagaggcgcccccaaccccuggcuguucgaggagcccgaggagaccagaggccugggcuucgacgagaucagacagcagcagcagaagaucauccaggagcaggacgccggccuggacgcccugagcagcaucaucagcagacagaagcagaugggccaggagaucggcaacgagcuggacgagcagaacgagaucaucgacgaccuggccaaccugguggagaacaccgacgagaagcugagaaacgagaccagaagagugaacaugguggacagaaagagcgccagcugcggcaugaucauggugauccugcugcugcugguggccaucguggugguggccguguggcccaccaacuaa

SEQ ID NO: 24208 - RNA, 1785 nt, Artificial Sequence
  STXBP1__Homo_sapiens__NP_001027392
auggcccccaucggccugaaggccguggugggcgagaagaucaugcacgacgugaucaagaaggugaagaagaagggcgaguggaaggugcuggugguggaccagcugagcaugagaaugcugagcagcugcugcaagaugaccgacaucaugaccgagggcaucaccaucguggaggacaucaacaagagaagagagccccugcccagccuggaggccguguaccugaucacccccagcgagaagagcgugcacagccugaucagcgacuucaaggacccccccaccgccaaguacagagccgcccacguguucuucaccgacagcugccccgacgcccuguucaacgagcuggugaagagcagagccgccaaggugaucaagacccugaccgagaucaacaucgccuuccugcccuacgagagccagguguacagccuggacagcgccgacagcuuccagagcuucuacagcccccacaaggcccagaugaagaaccccauccuggagagacuggccgagcagaucgccacccugugcgccacccugaaggaguaccccgccgugagauacagaggcgaguacaaggacaacgcccugcuggcccagcugauccaggacaagcuggacgccuacaaggccgacgaccccaccaugggcgagggccccgacaaggccagaagccagcugcugauccuggacagaggcuucgaccccagcagccccgugcugcacgagcugaccuuccaggccaugagcuacgaccugcugcccaucgagaacgacguguacaaguacgagaccagcggcaucggcgaggccagagugaaggaggugcugcuggacgaggacgacgaccuguggaucgcccugagacacaagcacaucgccgaggugagccaggaggugaccagaagccugaaggacuucagcagcagcaagagaaugaacaccggcgagaagaccaccaugagagaccugagccagaugcugaagaagaugccccaguaccagaaggagcugagcaaguacagcacccaccugcaccuggccgaggacugcaugaagcacuaccagggcaccguggacaagcugugcagaguggagcaggaccuggccaugggcaccgacgccgagggcgagaagaucaaggaccccaugagagccaucgugcccauccugcuggacgccaacgugagcaccuacgacaagaucagaaucauccugcuguacaucuuccugaagaacggcaucaccgaggagaaccugaacaagcugauccagcacgcccagaucccccccgaggacagcgagaucaucaccaacauggcccaccugggcgugcccaucgugaccgacagcacccugagaagaagaagcaagcccgagagaaaggagagaaucagcgagcagaccuaccagcugagcagauggacccccaucaucaaggacaucauggaggacaccaucgaggacaagcuggacaccaagcacuaccccuacaucagcaccagaagcagcgccagcuucagcaccaccgccgugagcgccagauacggccacuggcacaagaacaaggcccccggcgaguacagaagcggccccagacugaucaucuucauccugggcggcgugagccugaacgagaugagaugcgccuacgaggugacccaggccaacggcaagugggaggugcugaucggcagcacccacauccugaccccccagaagcugcuggacacccugaagaagcugaacaagaccgacgaggagaucagcagcuaa

SEQ ID NO: 24209 - RNA, 1773 nt, Artificial Sequence
  STXBP2__Homo_sapiens__NP_001120868
auggcccccagcggccugaaggccguggugggcgagaagauccugagcggcgugaucagaagcgugaagaaggacggcgaguggaaggugcugaucauggaccaccccagcaugagaauccugagcagcugcugcaagaugagcgacauccuggccgagggcaucaccaucguggaggacaucaacaagagaagagagcccauccccagccuggaggccaucuaccugcugagccccaccgagaaggcccugaucaaggacuuccagggcacccccaccuucaccuacaaggccgcccacaucuucuucaccgacaccugccccgagccccuguucagcgagcugggcagaagcagacuggccaagguggugaagacccugaaggagauccaccuggccuuccugcccuacgaggcccagguguucagccuggacgccccccacagcaccuacaaccuguacugccccuucagagccgaggagagaaccagacagcuggaggugcuggcccagcagaucgccacccugugcgccacccugcaggaguaccccgccaucagauacagaaagggccccgaggacaccgcccagcuggcccacgccgugcuggccaagcugaacgccuucaaggccgacacccccagccugggcgagggccccgagaagaccagaagccagcugcugaucauggacagagccgccgaccccgugagcccccugcugcacgagcugaccuuccaggccauggccuacgaccugcuggacaucgagcaggacaccuacagauacgagaccaccggccugagcgaggccagagagaaggccgugcugcuggacgaggacgacgaccuguggguggagcugagacacaugcacaucgccgacgugagcaagaaggugaccgagcugcugagaaccuucugcgagagcaagagacugaccaccgacaaggccaacaucaaggaccugagccagauccugaagaagaugccccaguaccagaaggagcugaacaaguacagcacccaccugcaccuggccgacgacugcaugaagcacuucaagggcagcguggagaagcugugcagcguggagcaggaccuggccaugggcagcgacgccgagggcgagaagaucaaggacagcaugaagcugaucgugcccgugcugcuggacgccgccgugcccgccuacgacaagaucagagugcugcugcuguacauccugcugagaaacggcgugagcgaggagaaccuggccaagcugauccagcacgccaacgugcaggcccacagcagccugaucagaaaccuggagcagcugggcggcaccgugaccaaccccggcggcagcggcaccagcagcagacuggagcccagagagagaauggagcccaccuaccagcugagcagauggacccccgugaucaaggacgugauggaggacgccguggaggacagacuggacagaaaccuguggcccuucgugagcgaccccgcccccaccgccagcagccaggccgccgugagcgccagauucggccacuggcacaagaacaaggccggcaucgaggccagagccggccccagacugaucguguacgugaugggcggcguggccaugagcgagaugagagccgccuacgaggugaccagagccaccgagggcaagugggaggugcugaucggcagcagccacauccugacccccaccagauuccuggacgaccugaaggcccuggacaagaagcuggaggacaucgcccugcccuaa

SEQ ID NO: 24210 - RNA, 1662 nt, Artificial Sequence
  STXBP4__Homo_sapiens__NP_848604
augaacaagaacaccagcaccguggugagccccagccugcuggagaaggaccccgccuuccagaugaucaccaucgccaaggagaccggccugggccugaaggugcugggcggcaucaacagaaacgagggcccccugguguacauccaggagaucauccccggcggcgacugcuacaaggacggcagacugaagcccggcgaccagcuggugagcgugaacaaggagagcaugaucggcgugagcuucgaggaggccaagagcaucaucaccggcgccaagcugagacuggagagcgccugggagaucgccuucaucagacagaagagcgacaacauccagcccgagaaccugagcugcaccagccugaucgaggccagcggcgaguacggcccccaggccagcacccugagccuguucagcagcccccccgagauccugauccccaagaccagcagcacccccaagaccaacaacgacauccugagcagcugcgagaucaagaccggcuacaacaagaccgugcagauccccaucaccagcgagaacagcaccgugggccugagcaacaccgacguggccagcgccuggaccgagaacuacggccugcaggagaagaucagccugaaccccagcgugagauucaaggccgagaagcuggagauggcccugaacuaccugggcauccagcccaccaaggagcagcaccaggcccugagacagcaggugcaggccgacagcaagggcaccgugagcuucggcgacuucgugcagguggccagaaaccuguucugccugcagcuggacgaggugaacgugggcgcccacgagaucagcaacauccuggacagccagcugcugcccugcgacagcagcgaggccgacgagauggagagacugaagugcgagagagacgacgcccugaaggaggugaacacccugaaggagaagcugcuggagagcgacaagcagagaaagcagcugaccgaggagcugcagaacgugaagcaggaggccaaggccgugguggaggagaccagagcccugagaagcagaauccaccuggccgaggccgcccagagacaggcccacggcauggagauggacuacgaggaggugaucagacugcuggaggccaagaucaccgagcugaaggcccagcuggccgacuacagcgaccagaacaaggagagcgugcaggaccugaagaagagaaucauggugcuggacugccagcugagaaagagcgagauggccagaaagaccuucgaggccagcaccgagaagcugcugcacuucguggaggccauccaggagguguucagcgacaacagcaccccccugagcaaccugagcgagagaagagccgugcuggccagccagaccagccugaccccccugggcagaaacggcagaagcauccccgccacccuggcccuggagagcaaggagcuggugaagagcgugagagcccugcuggacauggacugccugcccuacggcugggaggaggccuacaccgccgacggcaucaaguacuucaucaaccacgugacccagaccaccagcuggauccaccccgugaugagcgugcugaaccugagcagaagcgaggagaacgaggaggacugcagcagagagcugcccaaccagaagagcuaa

SEQ ID NO: 24211 - RNA, 3456 nt, Artificial Sequence
  STXBP5__Homo_sapiens__NP_001121187
augagaaaguucaacaucagaaaggugcuggacggccugaccgccggcagcagcagcgccagccagcagcagcagcagcagcacccccccggcaacagagagcccgagauccaggagacccugcagagcgagcacuuccagcugugcaagaccgugagacacggcuuccccuaccagcccagcgcccuggccuucgaccccgugcagaagauccuggccgugggcacccagaccggcgcccugagacuguucggcagacccggcguggagugcuacugccagcacgacagcggcgccgccgugauccagcugcaguuccugaucaacgagggcgcccuggugagcgcccuggccgacgacacccugcaccuguggaaccugagacagaagagacccgccauccugcacagccugaaguucugcagagagagagugaccuucugccaccugcccuuccagagcaaguggcuguacgugggcaccgagagaggcaacauccacaucgugaacguggagagcuucacccugagcggcuacgugaucauguggaacaaggccaucgagcugagcagcaagagccaccccggccccguggugcacaucagcgacaaccccauggacgagggcaagcugcugaucggcuucgagagcggcaccguggugcugugggaccugaagagcaagaaggccgacuacagauacaccuacgacgaggccauccacagcguggccuggcaccacgagggcaagcaguucaucugcagccacagcgacggcacccugaccaucuggaacgugagaagccccgccaagcccgugcagaccaucaccccccacggcaagcagcugaaggacggcaagaagcccgagcccugcaagcccauccugaagguggaguucaagaccaccagaagcggcgagcccuucaucauccugagcggcggccugagcuacgacaccgugggcagaagacccugccugaccgugaugcacggcaagagcaccgccgugcuggagauggacuacagcaucguggacuuccugacccugugcgagacccccuaccccaacgacuuccaggagcccuacgccgugguggugcugcuggagaaggaccuggugcugaucgaccuggcccagaacggcuaccccaucuucgagaaccccuacccccugagcauccacgagagccccgugaccugcugcgaguacuucgccgacugccccguggaccugauccccgcccuguacagcgugggcgccagacagaagagacagggcuacagcaagaaggaguggcccaucaacggcggcaacuggggccugggcgcccagagcuaccccgagaucaucaucaccggccacgccgacggcagcgugaaguucugggacgccagcgccaucacccugcaggugcuguacaagcugaagaccagcaagguguucgagaagagcagaaacaaggacgacagacccaacaccgacaucguggacgaggaccccuacgccauccagaucaucagcuggugccccgagagcagaaugcugugcaucgccggcgugagcgcccacgugaucaucuacagauucagcaagcaggaggugaucaccgaggugauccccaugcuggaggugagacugcuguacgagaucaacgacguggagacccccgagggcgagcagccccccccccugcccacccccgugggcggcagcaacccccagcccauccccccccagagccaccccagcaccagcagcagcagcagcgacggccugagagacaacgugcccugccugaaggugaagaacagcccccugaagcagagccccggcuaccagaccgagcuggugauccagcuggugugggugggcggcgagcccccccagcagaucaccagccuggccgugaacagcagcuacggccuggugguguucggcaacugcaacggcaucgccaugguggacuaccugcagaaggccgugcugcugaaccugggcaccaucgagcuguacggcagcaacgaccccuacagaagagagcccagaagccccagaaagagcagacagcccagcggcgccggccugugcgacaucagcgagggcaccguggugcccgaggacagaugcaagagccccaccagcggcagcagcagcccccacaacagcgacgacgagcagaagaugaacaacuucaucgagaaggugaagaccaagagcagaaaguucagcaagaugguggccaacgacaucgccaagaugagcagaaagcugagccugcccaccgaccugaagcccgaccuggacgugaaggacaacagcuucagcagaagcagaagcagcagcgugaccagcaucgacaaggagagcagagaggccaucagcgcccugcacuucugcgagaccuucaccagaaagaccgacagcagccccagccccugccugugggugggcaccacccugggcaccgugcuggugaucgcccugaaccugccccccggcggcgagcagagacugcugcagcccgugaucgugagccccagcggcaccauccugagacugaagggcgccauccugagaauggccuuccuggacaccaccggcugccugaucccccccgccuacgagcccuggagagagcacaacgugcccgaggagaaggacgagaaggagaagcugaagaagagaagacccgugagcgugagccccagcagcagccaggagaucagcgagaaccaguacgccgugaucugcagcgagaagcaggccaaggugaucagccugcccacccagaacugcgccuacaagcagaacaucaccgagaccagcuucgugcugagaggcgacaucguggcccugagcaacagcaucugccuggccugcuucugcgccaacggccacaucaugaccuucagccugcccagccugagaccccugcuggacguguacuaccugccccugaccaacaugagaaucgccagaaccuucugcuucaccaacaacggccaggcccuguaccuggugagccccaccgagauccagagacugaccuacagccaggagaccugcgagaaccugcaggagaugcugggcgagcuguucacccccguggagacccccgaggcccccaacagaggcuucuucaagggccuguucggcggcggcgcccagagccuggacagagaggagcuguucggcgagagcagcagcggcaaggccagcagaagccuggcccagcacauccccggccccggcggcaucgagggcgugaagggcgccgccagcggcguggugggcgagcuggccagagccagacuggcccuggacgagagaggccagaagcugggcgaccuggaggagagaaccgccgccaugcugagcagcgccgagagcuucagcaagcacgcccacgagaucaugcugaaguacaaggacaagaagugguaccaguucuaa

SEQ ID NO: 24212 - RNA, 3561 nt, Artificial Sequence
  STXBP5L__Homo_sapiens__NP_055795
augaagaaguucaacuucagaaaggugcuggacggccugaccgccagcagccccggcagcggcagcagcagcggcagcaacagcggcggcggcgccggcagcggcagcgugcaccccgccggcaccgccggcgugcugagagaggagauccaggagacccugaccagcgaguacuuccagaucugcaagaccgugagacacggcuucccccaccagcccaccgcccuggccuucgaccccgugcagaagauccuggccaucggcaccagaaccggcgccaucagaauccugggcagacccggcguggacugcuacugccagcacgagagcggcgccgccgugcugcagcugcaguuccugaucaacgagggcgcccuggugagcgccagcagcgacgacacccugcaccuguggaaccugagacagaagagacccgccauccugcacagccugaaguucaacagagagagaaucaccuacugccaccugcccuuccagagcaaguggcuguacgugggcaccgagagaggcaacacccacaucgugaacaucgagagcuucauccugagcggcuacgugaucauguggaacaaggccaucgagcugagcaccaagacccaccccggccccguggugcaccugagcgacagccccagagacgagggcaagcugcugaucggcuacgagaacggcaccgugguguucugggaccugaagagcaagagagccgagcugagaguguacuacgacgaggccauccacagcaucgacuggcaccacgagggcaagcaguucaugugcagccacagcgacggcagccugacccuguggaaccugaagagccccagcagacccuuccagaccaccaucccccacggcaagagccagagagagggcagaaagagcgagagcugcaagcccauccugaagguggaguacaagaccugcaagaacagcgagcccuucaucaucuucagcggcggccugagcuacgacaaggccugcagaagacccagccugaccaucaugcacggcaaggccaucaccgugcuggagauggaccaccccaucguggaguuccugacccugugcgagacccccuaccccaacgaguuccaggagcccuacgccgugguggugcugcuggagaaggaccugaucgugguggaccugacccagagcaacuuccccaucuucgagaaccccuaccccauggacauccacgagagccccgugaccugcaccgccuacuucgccgacugcccccccgaccugauccuggugcuguacagcaucggcgugaagcacaagaagcagggcuacagcaacaaggaguggcccaucagcggcggcgccuggaaccugggcgcccagaccuaccccgagaucaucaucaccggccacgccgacggcagcaucaaguucugggacgccagcgccaucacccugcagaugcuguacaagcugaagaccagcaagguguucgagaagcagaaggugggcgagggcaagcagaccugcgagaucguggaggaggaccccuucgccauccagaugaucuacuggugccccgagagcagaaucuucugcgugagcggcgugagcgccuacgugaucaucuacaaguucagcagacacgagaucaccaccgagaucgugagccuggaggugagacugcaguacgacguggaggacaucaucacccccgagcccgagaccagcccccccuuccccgaccugagcgcccagcugcccagcagcagaagccugagcggcagcaccaacaccguggccagcgagggcgugaccaaggacagcauccccugccugaacgugaagaccagacccgugagaaugccccccggcuaccaggccgagcuggugauccagcugguguggguggacggcgagcccccccagcagaucaccagccuggccgugagcagcgccuacggcaucguggccuucggcaacugcaacggccuggccgugguggacuucauccagaagaccgugcugcugagcaugggcaccaucgaccuguacagaagcagcgaccuguaccagagacagcccagaagccccagaaagaacaagcaguucaucgccgacaacuucugcaugagaggccugagcaacuucuaccccgaccugaccaagagaaucagaaccagcuaccagagccugaccgagcugaacgacagccccgugccccuggagcuggagagaugcaagagccccaccagcgaccacgugaacggccacugcaccagccccaccagccagagcugcagcagcggcaagagacugagcagcgccgacgugagcaaggugaacagauggggccccggcagaccccccuucagaaaggcccagagcgccgccugcauggagaucagccugcccgugaccaccgaggagaacagagagaacagcuacaacagaagcagaagcagcagcaucagcagcaucgacaaggacagcaaggaggccaucaccgcccuguacuucauggacagcuucgccagaaagaacgacagcaccaucagccccugccuguucgugggcaccagccugggcauggugcugaucaucagccugaaccugccccuggccgacgagcagagauucaccgagcccgugauggugcugcccagcggcaccuuccugagccugaagggcgccgugcugaccuucagcugcauggacagaaugggcggccugaugcagccccccuacgagguguggagagaccccaacaacaucgacgagaacgagaagagcuggagaagaaagguggugaugaacagcagcagcgccagccaggagaucggcgaccaccaguacaccaucaucugcagcgagaagcaggccaagguguucagccugcccagccagaccugccuguacgugcacaacaucaccgagaccagcuucauccugcaggccaacgugguggugaugugcagcagcgccugccuggccugcuucugcgccaacggccacaucaugaucaugagccugcccagccugagacccaugcuggacgugaacuaccugccccugaccgacaugagaaucgccagaaccuucugcuucaccaacgagggccaggcccuguaccuggugagccccaccgagauccagagacugaccuacagccaggagaugugcgacaaccugcaggacaugcugggcgaccuguucacccccaucgagacccccgaggcccagaacagaggcuuccugaagggccuguucggcggcagcggccagaccuucgacagagaggagcuguucggcgaggccagcgccggcaaggccagcagaagccuggcccagcacauccccggccccggcagcaucgagggcaugaagggcgccgccggcggcgugaugggcgagcugaccagagccagaaucgcccuggacgagagaggccagagacugggcgagcuggaggagaagaccgccggcaugaugaccagcgccgaggccuucagcaagcacgcccacgagcugaugcugaaguacaaggacaagaagugguaccaguucuaa

SEQ ID NO: 24213 - RNA, 633 nt, Artificial Sequence
  STXBP6__Homo_sapiens__NP_001291406
augagcgccaagagcgccaucagcaaggagaucuucgccccccuggacgagagaaugcugggcgccgugcaggugaagagaagaaccaagaagaagauccccuuccuggccaccggcggccagggcgaguaccugaccuacaucugccugagcgugaccaacaagaagcccacccaggccagcaucaccaaggugaagcaguucgagggcagcaccagcuucgugagaagaagccaguggaugcuggagcagcugagacaggugaacggcaucgaccccaacggcgacagcgccgaguucgaccugcuguucgagaacgccuucgaccaguggguggccagcaccgccagcgagaagugcaccuucuuccagauccugcaccacaccugccagagauaccugaccgacagaaagcccgaguucaucaacugccagagcaagaucaugggcggcaacagcauccugcacagcgccgccgacagcgugaccagcgccgugcagaaggccagccaggcccugaacgagagaggcgagagacugggcagagccgaggagaagaccgaggaccugaagaacagcgcccagcaguucgccgagaccgcccacaagcuggccaugaagcacaagugcuaa

SEQ ID NO: 24214 - RNA, 1269 nt, Artificial Sequence
  STYK1__Homo_sapiens__XP_005253474
augggcaugaccagaaugcugcuggagugcagccugagcgacaagcugugcgugauccaggagaagcaguacgaggugaucaucgugcccacccugcuggugaccaucuuccugauccugcugggcgugauccuguggcuguucaucagagagcagagaacccagcagcagagaagcggcccccagggcaucgcccccgugcccccccccagagaccugagcugggaggccggccacggcggcaacguggcccugccccugaaggagaccagcguggagaacuuccugggcgccaccacccccgcccuggccaagcugcaggugcccagagagcagcugagcgaggugcuggagcagaucugcagcggcagcugcggccccaucuucagagccaacaugaacaccggcgaccccagcaagcccaagagcgugauccugaaggcccugaaggagcccgccggccugcacgaggugcaggacuuccugggcagaauccaguuccaccaguaccugggcaagcacaagaaccuggugcagcuggagggcugcugcaccgagaagcugccccuguacauggugcuggaggacguggcccagggcgaccugcugagcuuccuguggaccugcagaagagacgugaugaccauggacggccugcuguacgaccugaccgagaagcagguguaccacaucggcaagcaggugcugcuggcccuggaguuccugcaggagaagcaccuguuccacggcgacguggccgccagaaacauccugaugcagagcgaccugaccgccaagcugugcggccugggccuggccuacgagguguacaccagaggcgccaucagcagcacccagaccaucccccugaaguggcuggcccccgagagacugcugcugagacccgccagcaucagagccgacguguggagcuucggcauccugcuguacgagauggugacccugggcgccccccccuaccccgaggugccccccaccagcauccuggagcaccugcagagaagaaagaucaugaagagacccagcagcugcacccacaccauguacagcaucaugaagagcugcuggagauggagagaggccgacagacccagccccagagagcugagacugagacuggaggccgccaucaagaccgccgacgacgaggccgugcugcaggugcccgagcugguggugcccgagcuguacgccgccguggccggcaucagaguggagagccuguucuacaacuacagcaugcuguaa

SEQ ID NO: 24215 - RNA, 672 nt, Artificial Sequence
  STYX__Homo_sapiens__NP_001124173
auggaggacgugaagcuggaguuccccagccugccccagugcaaggaggacgccgaggaguggaccuaccccaugagaagagagaugcaggagauccugcccggccuguuccugggccccuacagcagcgccaugaagagcaagcugcccgugcugcagaagcacggcaucacccacaucaucugcaucagacagaacaucgaggccaacuucaucaagcccaacuuccagcagcuguucagauaccuggugcuggacaucgccgacaaccccguggagaacaucaucagauucuuccccaugaccaaggaguucaucgacggcagccugcagaugggcggcaaggugcuggugcacggcaacgccggcaucagcagaagcgccgccuucgugaucgccuacaucauggagaccuucggcaugaaguacagagacgccuucgccuacgugcaggagagaagauucugcaucaaccccaacgccggcuucgugcaccagcugcaggaguacgaggccaucuaccuggccaagcugaccauccagaugaugagcccccugcagaucgagagaagccugagcgugcacagcggcaccaccggcagccugaagagaacccacgaggaggaggacgacuucggcaccaugcagguggccaccgcccagaacggcuaa

SEQ ID NO: 24216 - RNA, 384 nt, Artificial Sequence
  SUB1__Homo_sapiens__NP_006704
augcccaagagcaaggagcuggugagcagcagcagcagcggcagcgacagcgacagcgagguggacaagaagcugaagagaaagaagcagguggcccccgagaagcccgugaagaagcagaagaccggcgagaccagcagagcccugagcagcagcaagcagagcagcagcagcagagacgacaacauguuccagaucggcaagaugagauacgugagcgugagagacuucaagggcaaggugcugaucgacaucagagaguacuggauggaccccgagggcgagaugaagcccggcagaaagggcaucagccugaaccccgagcaguggagccagcugaaggagcagaucagcgacaucgacgacgccgugagaaagcuguaa

SEQ ID NO: 24217 - RNA, 1392 nt, Artificial Sequence
  SUCLA2__Homo_sapiens__NP_003841
auggccgccagcauguucuacggcagacugguggccguggccacccugagaaaccacagacccagaaccgcccagagagccgccgcccaggugcugggcagcagcggccuguucaacaaccacggccugcaggugcagcagcagcagcagagaaaccugagccugcacgaguacaugagcauggagcugcugcaggaggccggcgugagcgugcccaagggcuacguggccaagagccccgacgaggccuacgccaucgccaagaagcugggcagcaaggacguggugaucaaggcccaggugcuggccggcggcagaggcaagggcaccuucgagagcggccugaagggcggcgugaagaucguguucagccccgaggaggccaaggccgugagcagccagaugaucggcaagaagcuguucaccaagcagaccggcgagaagggcagaaucugcaaccaggugcuggugugcgagagaaaguaccccagaagagaguacuacuucgccaucaccauggagagaagcuuccagggccccgugcugaucggcagcagccacggcggcgugaacaucgaggacguggccgccgagagccccgaggccaucaucaaggagcccaucgacaucgaggagggcaucaagaaggagcaggcccugcagcuggcccagaagaugggcuucccccccaacaucguggagagcgccgccgagaacauggugaagcuguacagccuguuccugaaguacgacgccaccaugaucgagaucaaccccaugguggaggacagcgacggcgccgugcugugcauggacgccaagaucaacuucgacagcaacagcgccuacagacagaagaagaucuucgaccugcaggacuggacccaggaggacgagagagacaaggacgccgccaaggccaaccugaacuacaucggccuggacggcaacaucggcugccuggugaacggcgccggccuggccauggccaccauggacaucaucaagcugcacggcggcacccccgccaacuuccuggacgugggcggcggcgccaccgugcaccaggugaccgaggccuucaagcugaucaccagcgacaagaaggugcuggccauccuggugaacaucuucggcggcaucaugagaugcgacgugaucgcccagggcaucgugauggccgugaaggaccuggagaucaagauccccgugguggugagacugcagggcaccagaguggacgacgccaaggcccugaucgccgacagcggccugaagauccuggccugcgacgaccuggacgaggccgccagaaugguggugaagcugagcgagaucgugacccuggccaagcaggcccacguggacgugaaguuccagcugcccaucuaa

SEQ ID NO: 24218 - RNA, 1041 nt, Artificial Sequence
  SUCLG1__Homo_sapiens__NP_003840
augaccgccacccuggccgccgccgccgacaucgccaccauggugagcggcagcagcggccuggccgccgccagacugcugagcagaagcuuccugcugccccagaacggcaucagacacugcagcuacaccgccagcagacagcaccuguacguggacaagaacaccaagaucaucugccagggcuucaccggcaagcagggcaccuuccacagccagcaggcccuggaguacggcaccaagcuggugggcggcaccacccccggcaagggcggccagacccaccugggccugcccguguucaacaccgugaaggaggccaaggagcagaccggcgccaccgccagcgugaucuacgugcccccccccuucgccgccgccgccaucaacgaggccaucgaggccgagaucccccugguggugugcaucaccgagggcaucccccagcaggacauggugagagugaagcacaagcugcugagacaggagaagaccagacugaucggccccaacugccccggcgugaucaaccccggcgagugcaagaucggcaucaugcccggccacauccacaagaagggcagaaucggcaucgugagcagaagcggcacccugaccuacgaggccgugcaccagaccacccaggugggccugggccagagccugugcgugggcaucggcggcgaccccuucaacggcaccgacuucaucgacugccuggagaucuuccugaacgacagcgccaccgagggcaucauccugaucggcgagaucggcggcaacgccgaggagaacgccgccgaguuccugaagcagcacaacagcggccccaacagcaagcccguggugagcuucaucgccggccugaccgccccccccggcagaagaaugggccacgccggcgccaucaucgccggcggcaagggcggcgccaaggagaagaucagcgcccugcagagcgccggcgugguggugagcaugagccccgcccagcugggcaccaccaucuacaaggaguucgagaagagaaagaugcuguaa

SEQ ID NO: 24219 - RNA, 1323 nt, Artificial Sequence
  SUCLG2__Homo_sapiens__NP_001171070
auggccagccccguggccgcccaggccggcaagcugcugagagcccuggcccugagacccagauuccuggccgccggcagccaggccgugcagcugaccagcagaagauggcugaaccugcaggaguaccagagcaagaagcugaugagcgacaacggcgugagagugcagagauucuucguggccgacaccgccaacgaggcccuggaggccgccaagagacugaacgccaaggagaucgugcugaaggcccagauccuggccggcggcagaggcaagggcguguucaacagcggccugaagggcggcgugcaccugaccaaggaccccaacguggugggccagcuggccaagcagaugaucggcuacaaccuggccaccaagcagacccccaaggagggcgugaaggugaacaaggugaugguggccgaggcccuggacaucagcagagagaccuaccuggccauccugauggacagaagcugcaacggccccgugcuggugggcagcccccagggcggcguggacaucgaggagguggccgccagcaaccccgagcugaucuucaaggagcagaucgacaucuucgagggcaucaaggacagccaggcccagagaauggccgagaaccugggcuucgugggcccccugaagagccaggccgccgaccagaucaccaagcuguacaaccuguuccugaagaucgacgccacccagguggaggugaaccccuucggcgagacccccgagggccagguggugugcuucgacgccaagaucaacuucgacgacaacgccgaguucagacagaaggacaucuucgccauggacgacaagagcgagaacgagcccaucgagaacgaggccgccaaguacgaccugaaguacaucggccuggacggcaacaucgccugcuucgugaacggcgccggccuggccauggccaccugcgacaucaucuuccugaacggcggcaagcccgccaacuuccuggaccugggcggcggcgugaaggaggcccagguguaccaggccuucaagcugcugaccgccgaccccaagguggaggccauccuggugaacaucuucggcggcaucgugaacugcgccaucaucgccaacggcaucaccaaggccugcagagagcuggagcugaaggugccccugguggugagacuggagggcaccuucauggagaagaagggcagcuacaugcacaucaagcaggagaccggcaacagcaacgagaacaucaccggcauccaggagaacguggcccaccagaaccugagcaagugcgccaucagcaucuuccugugcuaa

SEQ ID NO: 24220 - RNA, 1005 nt, Artificial Sequence
  SUCNR1__Homo_sapiens__NP_149039
augcugggcaucauggccuggaacgccaccugcaagaacuggcuggccgccgaggccgcccuggagaaguacuaccugagcaucuucuacggcaucgaguucguggugggcgugcugggcaacaccaucgugguguacggcuacaucuucagccugaagaacuggaacagcagcaacaucuaccuguucaaccugagcgugagcgaccuggccuuccugugcacccugcccaugcugaucagaagcuacgccaacggcaacuggaucuacggcgacgugcugugcaucagcaacagauacgugcugcacgccaaccuguacaccagcauccuguuccugaccuucaucagcaucgacagauaccugaucaucaaguaccccuucagagagcaccugcugcagaagaaggaguucgccauccugaucagccuggccaucugggugcuggugacccuggagcugcugcccauccugccccugaucaaccccgugaucaccgacaacggcaccaccugcaacgacuucgccagcagcggcgaccccaacuacaaccugaucuacagcaugugccugacccugcugggcuuccugaucccccuguucgugaugugcuucuucuacuacaagaucgcccuguuccugaagcagagaaacagacagguggccaccgcccugccccuggagaagccccugaaccuggugaucauggccguggugaucuucagcgugcuguucacccccuaccacgugaugagaaacgugagaaucgccagcagacugggcagcuggaagcaguaccagugcacccagguggugaucaacagcuucuacaucgugaccagaccccuggccuuccugaacagcgugaucaaccccguguucuacuuccugcugggcgaccacuucagagacaugcugaugaaccagcugagacacaacuucaagagccugaccagcuucagcagaugggcccacgagcugcugcugagcuucagagagaaguaa

SEQ ID NO: 24221 - RNA, 3765 nt, Artificial Sequence
  SUCO__Homo_sapiens__NP_055098
augaagaagcacagaagagcccuggcccuggugagcugccuguuccugugcagccugguguggcugcccagcuggagagugugcugcaaggagagcagcagcgccagcgccagcagcuacuacagccaggacgacaacugcgcccuggagaacgaggacgugcaguuccagaagaaggacgagagagagggccccaucaacgccgagagccugggcaagagcggcagcaaccugcccaucagccccaaggagcacaagcugaaggacgacagcaucguggacgugcagaacaccgagagcaagaagcugagcccccccgugguggagacccugcccaccguggaccugcacgaggagagcagcaacgccgugguggacagcgagaccguggagaacaucagcagcagcagcaccagcgagaucacccccaucagcaagcuggacgagaucgagaagagcggcaccauccccaucgccaagcccagcgagaccgagcagagcgagaccgacugcgacgugggcgaggcccuggacgccagcgcccccaucgagcagcccagcuucgugagcccccccgacagccuggugggccagcacaucgagaacgugagcagcagccacggcaagggcaagaucaccaagagcgaguucgagagcaaggugagcgccagcgagcagggcggcggcgaccccaagagcgcccugaacgccagcgacaaccugaagaacgagagcagcgacuacaccaagcccggcgacaucgaccccaccagcguggccagccccaaggaccccgaggacauccccaccuucgacgaguggaagaagaaggugauggagguggagaaggagaagagccagagcaugcacgccagcagcaacggcggcagccacgccaccaagaaggugcagaagaacagaaacaacuacgccagcguggagugcggcgccaagauccuggccgccaaccccgaggccaagagcaccagcgccauccugaucgagaacauggaccuguacaugcugaaccccugcagcaccaagaucugguucgugaucgagcugugcgagcccauccaggugaagcagcuggacaucgccaacuacgagcuguucagcagcacccccaaggacuuccuggugagcaucagcgacagauaccccaccaacaaguggaucaagcugggcaccuuccacggcagagacgagagaaacgugcagagcuucccccuggacgagcagauguacgccaaguacgugaagauguucaucaaguacaucaagguggagcugcugagccacuucggcagcgagcacuucugcccccugagccugaucagaguguucggcaccagcaugguggaggaguacgaggagaucgccgacagccaguaccacagcgagagacaggagcuguucgacgaggacuacgacuacccccuggacuacaacaccggcgaggacaagagcagcaagaaccugcugggcagcgccaccaacgccauccugaacauggugaacaucgccgccaacauccugggcgccaagaccgaggaccugaccgagggcaacaagagcaucagcgagaacgccaccgccaccgccgcccccaagaugcccgagagcacccccgugagcacccccgugcccagccccgaguacgugaccaccgaggugcacacccacgacauggagcccagcacccccgacacccccaaggagagccccaucgugcagcuggugcaggaggaggaggaggaggccagccccagcaccgugacccugcugggcagcggcgagcaggaggacgagagcagccccugguucgagagcgagacccagaucuucugcagcgagcugaccaccaucugcugcaucagcagcuucagcgaguacaucuacaaguggugcagcgugagaguggcccuguacagacagagaagcagaaccgcccugagcaagggcaaggacuaccuggugcuggcccagcccccccugcugcugcccgccgagagcguggacgugagcgugcugcagccccugagcggcgagcuggagaacaccaacaucgagagagaggccgagaccguggugcugggcgaccugagcagcagcaugcaccaggacgaccuggugaaccacaccguggacgccguggagcuggagcccagccacagccagacccugagccagagccugcugcuggacaucacccccgagaucaacccccugcccaagaucgaggugagcgagagcguggaguacgaggccggccacauccccagccccgugaucccccaggagagcagcguggagaucgacaacgagaccgagcagaagagcgagagcuucagcagcaucgagaagcccagcaucaccuacgagaccaacaaggugaacgagcugauggacaacaucaucaaggaggacgugaacagcaugcagaucuucaccaagcugagcgagaccaucgugccccccaucaacaccgccaccgugcccgacaacgaggacggcgaggccaagaugaacaucgccgacaccgccaagcagacccugaucagcgugguggacagcagcagccugcccgaggugaaggaggaggagcagagccccgaggacgcccugcugagaggccugcagagaaccgccaccgacuucuacgccgagcugcagaacagcaccgaccugggcuacgccaacggcaaccuggugcacggcagcaaccagaaggagagcguguucaugagacugaacaacagaaucaaggcccuggaggugaacaugagccugagcggcagauaccuggaggagcugagccagagauacagaaagcagauggaggagaugcagaaggccuucaacaagaccaucgugaagcugcagaacaccagcagaaucgccgaggagcaggaccagagacagaccgaggccauccagcugcugcaggcccagcugaccaacaugacccagcuggugagcaaccugagcgccaccguggccgagcugaagagagaggugagcgacagacagagcuaccuggugaucagccuggugcugugcguggugcugggccugaugcugugcaugcagagaugcagaaacaccagccaguucgacggcgacuacaucagcaagcugcccaagagcaaccaguaccccagccccaagagaugcuucagcagcuacgacgacaugaaccugaagagaagaaccagcuucccccugaugagaagcaagagccugcagcugaccggcaaggagguggaccccaacgaccuguacaucguggagccccugaaguucagccccgagaagaagaagaagagaugcaaguacaagaucgagaagaucgagaccaucaagcccgaggagccccugcaccccaucgccaacggcgacaucaagggcagaaagcccuucaccaaccagagagacuucagcaacaugggcgagguguaccacagcagcuacaagggcccccccagcgagggcagcagcgagaccagcagccagagcgaggagagcuacuucugcggcaucagcgccugcaccagccugugcaacggccagagccagaagaccaagaccgagaagagagcccugaagagaagaagaagcaaggugcaggaccagggcaagcugaucaagacccugauccagaccaagagcggcagccugcccagccugcacgacaucaucaagggcaacaaggagaucaccgugggcaccuucggcgugaccgccgugagcggccacaucuaa

SEQ ID NO: 24222 - RNA, 987 nt, Artificial Sequence
  SUDS3__Homo_sapiens__NP_071936
augagcgccgccggccugcuggcccccgcccccgcccaggccggcgccccccccgcccccgaguacuaccccgaggaggacgaggagcuggagagcgccgaggacgacgagagaagcugcagaggcagagagagcgacgaggacaccgaggacgccagcgagaccgaccuggccaagcacgacgaggaggacuacguggagaugaaggagcagauguaccaggacaagcuggccagccugaagagacagcugcagcagcugcaggagggcacccugcaggaguaccagaagagaaugaagaagcuggaccagcaguacaaggagagaaucagaaacgccgagcuguuccugcagcuggagaccgagcagguggagagaaacuacaucaaggagaagaaggccgccgugaaggaguucgaggacaagaagguggagcugaaggagaaccugaucgccgagcuggaggagaagaagaagaugaucgagaacgagaagcugaccauggagcugaccggcgacagcauggaggugaagcccaucaugaccagaaagcugagaagaagacccaacgaccccgugcccauccccgacaagagaagaaagcccgcccccgcccagcugaacuaccugcugaccgacgagcagaucauggaggaccugagaacccugaacaagcugaagagccccaagagacccgccagccccagcagccccgagcaccugcccgccacccccgccgagagccccgcccagagauucgaggccagaaucgaggacggcaagcuguacuacgacaagagaugguaccacaagagccaggccaucuaccuggagagcaaggacaaccagaagcugagcugcgugaucagcagcgugggcgccaacgagaucugggugagaaagaccagcgacagcaccaagaugagaaucuaccugggccagcugcagagaggccuguucgugaucagaagaagaagcgccgccuaa

SEQ ID NO: 24223 - RNA, 1302 nt, Artificial Sequence
  SUFU__Homo_sapiens__NP_001171604
auggccgagcugagacccagcggcgcccccggccccaccgccccccccgcccccggccccaccgccccccccgccuucgccagccuguucccccccggccugcacgccaucuacggcgagugcagaagacuguaccccgaccagcccaacccccugcaggugaccgccaucgugaaguacuggcugggcggccccgacccccuggacuacgugagcauguacagaaacgugggcagccccagcgccaacauccccgagcacuggcacuacaucagcuucggccugagcgaccuguacggcgacaacagagugcacgaguucaccggcaccgacggccccagcggcuucggcuucgagcugaccuucagacugaagagagagaccggcgagagcgccccccccaccuggcccgccgagcugaugcagggccuggccagauacguguuccagagcgagaacaccuucugcagcggcgaccacgugagcuggcacagcccccuggacaacagcgagagcagaauccagcacaugcugcugaccgaggacccccagaugcagcccgugcagacccccuucggcguggugaccuuccugcagaucgugggcgugugcaccgaggagcugcacagcgcccagcaguggaacggccagggcauccuggagcugcugagaaccgugcccaucgccggcggccccuggcugaucaccgacaugagaagaggcgagaccaucuucgagaucgacccccaccugcaggagagaguggacaagggcaucgagaccgacggcagcaaccugagcggcgugagcgccaagugcgccugggacgaccugagcagaccccccgaggacgacgaggacagcagaagcaucugcaucggcacccagcccagaagacugagcggcaaggacaccgagcagaucagagagacccugagaagaggccuggagaucaacagcaagcccgugcugccccccaucaacccccagagacagaacggccuggcccacgacagagcccccagcagaaaggacagccuggagagcgacagcagcaccgccaucaucccccacgagcugaucagaaccagacagcuggagagcgugcaccugaaguucaaccaggagagcggcgcccugaucccccugugccugagaggcagacugcugcacggcagacacuucaccuacaagagcaucaccggcgacauggccaucaccuucgugagcaccggcguggagggcgccuucgccaccgaggagcaccccuacgccgcccacggccccuggcugcagcuguaa

SEQ ID NO: 24224 - RNA, 1416 nt, Artificial Sequence
  SUGCT__Homo_sapiens__NP_001180240
augcccagcgagacccacgccaugcuggccacccuggccagaguggccgcccugagaagaaccugccuguucagcggcagaggcggcggcagaggccuguggaccggcagaccccagagcgacaugaacaacaucaagccccuggagggcgugaagauccuggaccugaccagagugcuggccggccccuucgccaccaugaaccugggcgaccugggcgccgaggugaucaagguggagagacccggcgccggcgacgacaccagaaccuggggcccccccuucgugggcaccgagagcaccuacuaccugagcgugaacagaaacaagaagagcaucgccgugaacaucaaggaccccaagggcgugaagaucaucaaggagcuggccgccgugugcgacguguucguggagaacuacgugcccggcaagcugagcgccaugggccugggcuacgaggacaucgacgagaucgccccccacaucaucuacugcagcaucaccggcuacggccagaccggccccaucagccagagagccggcuacgacgccguggccagcgccgugagcggccugaugcacaucaccggccccgagaacggcgaccccgugagacccggcguggccaugaccgaccuggccaccggccuguacgccuacggcgccaucauggccggccugauccagaaguacaagaccggcaagggccuguucaucgacugcaaccugcugagcagccagguggccugccugagccacaucgccgccaacuaccugaucggccagaaggaggccaagagauggggcaccgcccacggcagcaucgugcccuaccaggccuucaagaccaaggacggcuacaucguggugggcgccggcaacaaccagcaguucgccaccgugugcaagauccuggaccugcccgagcugaucgacaacagcaaguacaagaccaaccaccugagagugcacaacagaaaggagcugaucaagauccugagcgagagauucgaggaggagcugaccagcaaguggcuguaccuguucgagggcagcggcgugcccuacggccccaucaacaacaugaagaacguguucgccgagccccagaacgccgugagcggcuuccagagccugcugcacagccuggcccacggccccuuccugcaccugcagggcagcgccagagugcugcacaacggccuggugauggagauggagcaccccaccgugggcaagaucagcgugcccggccccgccgugagauacagcaaguucaagaugagcgaggccagaccccccccccugcugggccagcacaccacccacauccugaaggaggugcugagauacgacgacagagccaucggcgagcugcugagcgccggcgugguggaccagcacgagacccacuaa

SEQ ID NO: 24225 - RNA, 1938 nt, Artificial Sequence
  SUGP1__Homo_sapiens__NP_757386
augagccugaagauggacaacagagacguggccggcaaggccaacagaugguucggcguggccccccccaagagcggcaagaugaacaugaacauccugcaccaggaggagcugaucgcccagaagaagagagagaucgaggccaagauggagcagaaggccaagcagaaccagguggccagcccccagcccccccaccccggcgagaucaccaacgcccacaacagcagcugcaucagcaacaaguucgccaacgacggcagcuuccugcagcaguuccugaagcugcagaaggcccagaccagcaccgacgcccccaccagcgcccccagcgccccccccagcacccccacccccagcgccggcaagagaagccugcugaucagcagaagaaccggccugggccuggccagccugcccggccccgugaagagcuacagccacgccaagcagcugcccguggcccacagacccagcguguuccagagccccgacgaggacgaggaggaggacuacgagcaguggcuggagaucaaggugagcccccccgagggcgccgagaccagaaaggugaucgagaagcuggccagauucguggccgagggcggccccgagcuggagaagguggccauggaggacuacaaggacaaccccgccuucgccuuccugcacgacaagaacagcagagaguuccuguacuacagaaagaagguggccgagaucagaaaggaggcccagaagagccaggccgccagccagaaggugagcccccccgaggacgaggaggugaagaaccuggccgagaagcuggccagauucaucgccgacggcggccccgagguggagaccaucgcccugcagaacaacagagagaaccaggccuucagcuuccuguacgagcccaacagccagggcuacaaguacuacagacagaagcuggaggaguucagaaaggccaaggccagcagcaccggcagcuucaccgcccccgaccccggccugaagagaaagagcccccccgaggcccugagcggcagccugccccccgccaccaccugccccgccagcagcacccccgcccccaccaucauccccgcccccgccgcccccggcaagcccgccagcgccgccaccgugaagagaaagagaaagagcagauggggccccgaggaggacaagguggagcugccccccgccgagcuggugcagagagacguggacgccagccccagcccccugagcgugcaggaccugaagggccugggcuacgagaagggcaagcccgugggccuggugggcgugaccgagcugagcgacgcccagaagaagcagcugaaggagcagcaggagaugcagcagauguacgacaugaucaugcagcacaagagagccaugcaggacaugcagcugcugugggagaaggccgugcagcagcaccagcacggcuacgacagcgacgaggagguggacagcgagcugggcaccugggagcaccagcugagaagaauggagauggacaagaccagagagugggccgagcagcugaccaagaugggcagaggcaagcacuucaucggcgacuuccugccccccgacgagcuggagaaguucauggagaccuucaaggcccugaaggagggcagagagcccgacuacagcgaguacaaggaguucaagcugaccguggagaacaucggcuaccagaugcugaugaagaugggcuggaaggagggcgagggccugggcagcgagggccagggcaucaagaaccccgugaacaagggcaccaccaccguggacggcgccggcuucggcaucgacagacccgccgagcugagcaaggaggacgacgaguacgaggccuucagaaagagaaugaugcuggccuacagauucagacccaacccccugaacaaccccagaagacccuacuacuaa

SEQ ID NO: 24226 - RNA, 1098 nt, Artificial Sequence
  SUGT1__Homo_sapiens__NP_001124384
auggccgccgccgccgccggcaccgccaccagccagagauucuuccagagcuucagcgacgcccugaucgacgaggacccccaggccgcccuggaggagcugaccaaggcccuggagcagaagcccgacgacgcccaguacuacugccagagagccuacugccacauccugcugggcaacuacugcguggccguggccgacgccaagaagagccuggagcugaaccccaacaacagcaccgccaugcugagaaagggcaucugcgaguaccacgagaagaacuacgccgccgcccuggagaccuucaccgagggccagaagcuggacaucgagaccggcuuccacagagugggccaggccggccugcagcugcugaccagcagcgacccccccgcccuggacagccagagcgccggcaucaccggcgccgacgccaacuucagcguguggaucaagagaugccaggaggcccagaacggcagcgagagcgagguguggacccaccagagcaagaucaaguacgacugguaccagaccgagagccagguggugaucacccugaugaucaagaacgugcagaagaacgacgugaacguggaguucagcgagaaggagcugagcgcccuggugaagcugcccagcggcgaggacuacaaccugaagcuggagcugcugcaccccaucauccccgagcagagcaccuucaaggugcugagcaccaagaucgagaucaagcugaagaagcccgaggccgugagaugggagaagcuggagggccagggcgacgugcccacccccaagcaguucguggccgacgugaagaaccuguaccccagcagcagccccuacaccagaaacugggacaagcuggugggcgagaucaaggaggaggagaagaacgagaagcuggagggcgacgccgcccugaacagacuguuccagcagaucuacagcgacggcagcgacgaggugaagagagccaugaacaagagcuucauggagagcggcggcaccgugcugagcaccaacuggagcgacgugggcaagagaaagguggagaucaacccccccgacgacauggaguggaagaaguacuaa

SEQ ID NO: 24227 - RNA, 2616 nt, Artificial Sequence
  SULF1__Homo_sapiens__NP_055985
augaaguacagcugcugcgcccuggugcuggccgugcugggcaccgagcugcugggcagccugugcagcaccgugagaagccccagauucagaggcagaauccagcaggagagaaagaacaucagacccaacaucauccuggugcugaccgacgaccaggacguggagcugggcagccugcaggugaugaacaagaccagaaagaucauggagcacggcggcgccaccuucaucaacgccuucgugaccacccccaugugcugccccagcagaagcagcaugcugaccggcaaguacgugcacaaccacaacguguacaccaacaacgagaacugcagcagccccagcuggcaggccaugcacgagcccagaaccuucgccguguaccugaacaacaccggcuacagaaccgccuucuucggcaaguaccugaacgaguacaacggcagcuacaucccccccggcuggagagaguggcugggccugaucaagaacagcagauucuacaacuacaccgugugcagaaacggcaucaaggagaagcacggcuucgacuacgccaaggacuacuucaccgaccugaucaccaacgagagcaucaacuacuucaagaugagcaagagaauguacccccacagacccgugaugauggugaucagccacgccgccccccacggccccgaggacagcgccccccaguucagcaagcuguaccccaacgccagccagcacaucacccccagcuacaacuacgcccccaacauggacaagcacuggaucaugcaguacaccggccccaugcugcccauccacauggaguucaccaacauccugcagagaaagagacugcagacccugaugagcguggacgacagcguggagagacuguacaacaugcugguggagaccggcgagcuggagaacaccuacaucaucuacaccgccgaccacggcuaccacaucggccaguucggccuggugaagggcaagagcaugcccuacgacuucgacaucagagugcccuucuucaucagaggccccagcguggagcccggcagcaucgugccccagaucgugcugaacaucgaccuggcccccaccauccuggacaucgccggccuggacaccccccccgacguggacggcaagagcgugcugaagcugcuggaccccgagaagcccggcaacagauucagaaccaacaagaaggccaagaucuggagagacaccuuccugguggagagaggcaaguuccugagaaagaaggaggagagcagcaagaacauccagcagagcaaccaccugcccaaguacgagagagugaaggagcugugccagcaggccagauaccagaccgccugcgagcagcccggccagaaguggcagugcaucgaggacaccagcggcaagcugagaauccacaagugcaagggccccagcgaccugcugaccgugagacagagcaccagaaaccuguacgccagaggcuuccacgacaaggacaaggagugcagcugcagagagagcggcuacagagccagcagaagccagagaaagagccagagacaguuccugagaaaccagggcacccccaaguacaagcccagauucgugcacaccagacagaccagaagccugagcguggaguucgagggcgagaucuacgacaucaaccuggaggaggaggaggagcugcaggugcugcagcccagaaacaucgccaagagacacgacgagggccacaagggccccagagaccugcaggccagcagcggcggcaacagaggcagaaugcuggccgacagcagcaacgccgugggcccccccaccaccgugagagugacccacaagugcuucauccugcccaacgacagcauccacugcgagagagagcuguaccagagcgccagagccuggaaggaccacaaggccuacaucgacaaggagaucgaggcccugcaggacaagaucaagaaccugagagaggugagaggccaccugaagagaagaaagcccgaggagugcagcugcagcaagcagagcuacuacaacaaggagaagggcgugaagaagcaggagaagcugaagagccaccugcaccccuucaaggaggccgcccaggagguggacagcaagcugcagcuguucaaggagaacaacagaagaagaaagaaggagagaaaggagaagagaagacagagaaagggcgaggagugcagccugcccggccugaccugcuucacccacgacaacaaccacuggcagaccgcccccuucuggaaccugggcagcuucugcgccugcaccagcagcaacaacaacaccuacuggugccugagaaccgugaacgagacccacaacuuccuguucugcgaguucgccaccggcuuccuggaguacuucgacaugaacaccgaccccuaccagcugaccaacaccgugcacaccguggagagaggcauccugaaccagcugcacgugcagcugauggagcugagaagcugccagggcuacaagcagugcaaccccagacccaagaaccuggacgugggcaacaaggacggcggcagcuacgaccugcacagaggccagcugugggacggcugggagggcuaa

SEQ ID NO: 24228 - RNA, 2613 nt, Artificial Sequence
  SULF2__Homo_sapiens__NP_061325
augggcccccccagccuggugcugugccugcugagcgccaccguguucagccugcugggcggcagcagcgccuuccugagccaccacagacugaagggcagauuccagagagacagaagaaacaucagacccaacaucauccuggugcugaccgacgaccaggacguggagcugggcagcaugcaggugaugaacaagaccagaagaaucauggagcagggcggcgcccacuucaucaacgccuucgugaccacccccaugugcugccccagcagaagcagcauccugaccggcaaguacgugcacaaccacaacaccuacaccaacaacgagaacugcagcagccccagcuggcaggcccagcacgagagcagaaccuucgccguguaccugaacagcaccggcuacagaaccgccuucuucggcaaguaccugaacgaguacaacggcagcuacgugccccccggcuggaaggagugggugggccugcugaagaacagcagauucuacaacuacacccugugcagaaacggcgugaaggagaagcacggcagcgacuacagcaaggacuaccugaccgaccugaucaccaacgacagcgugagcuucuucagaaccagcaagaagauguacccccacagacccgugcugauggugaucagccacgccgccccccacggccccgaggacagcgccccccaguacagcagacuguuccccaacgccagccagcacaucacccccagcuacaacuacgcccccaaccccgacaagcacuggaucaugagauacaccggccccaugaagcccauccacauggaguucaccaacaugcugcagagaaagagacugcagacccugaugagcguggacgacagcauggagaccaucuacaacaugcugguggagaccggcgagcuggacaacaccuacaucguguacaccgccgaccacggcuaccacaucggccaguucggccuggugaagggcaagagcaugcccuacgaguucgacaucagagugcccuucuacgugagaggccccaacguggaggccggcugccugaacccccacaucgugcugaacaucgaccuggcccccaccauccuggacaucgccggccuggacauccccgccgacauggacggcaagagcauccugaagcugcuggacaccgagagacccgugaacagauuccaccugaagaagaagaugagaguguggagagacagcuuccugguggagagaggcaagcugcugcacaagagagacaacgacaagguggacgcccaggaggagaacuuccugcccaaguaccagagagugaaggaccugugccagagagccgaguaccagaccgccugcgagcagcugggccagaaguggcagugcguggaggacgccaccggcaagcugaagcugcacaagugcaagggccccaugagacugggcggcagcagagcccugagcaaccuggugcccaaguacuacggccagggcagcgaggccugcaccugcgacagcggcgacuacaagcugagccuggccggcagaagaaagaagcuguucaagaagaaguacaaggccagcuacgugagaagcagaagcaucagaagcguggccaucgagguggacggcagaguguaccacgugggccugggcgacgccgcccagcccagaaaccugaccaagagacacuggcccggcgcccccgaggaccaggacgacaaggacggcggcgacuucagcggcaccggcggccugcccgacuacagcgccgccaaccccaucaaggugacccacagaugcuacauccuggagaacgacaccgugcagugcgaccuggaccuguacaagagccugcaggccuggaaggaccacaagcugcacaucgaccacgagaucgagacccugcagaacaagaucaagaaccugagagaggugagaggccaccugaagaagaagagacccgaggagugcgacugccacaagaucagcuaccacacccagcacaagggcagacugaagcacagaggcagcagccugcaccccuucagaaagggccugcaggagaaggacaagguguggcugcugagagagcagaagagaaagaagaagcugagaaagcugcugaagagacugcagaacaacgacaccugcagcaugcccggccugaccugcuucacccacgacaaccagcacuggcagaccgcccccuucuggacccugggccccuucugcgccugcaccagcgccaacaacaacaccuacuggugcaugagaaccaucaacgagacccacaacuuccuguucugcgaguucgccaccggcuuccuggaguacuucgaccugaacaccgaccccuaccagcugaugaacgccgugaacacccuggacagagacgugcugaaccagcugcacgugcagcugauggagcugagaagcugcaagggcuacaagcagugcaaccccagaaccagaaacauggaccugggccugaaggacggcggcagcuacgagcaguacagacaguuccagagaagaaaguggcccgagaugaagagacccagcagcaagagccugggccagcugugggagggcugggagggcuaa

SEQ ID NO: 24229 - RNA, 888 nt, Artificial Sequence
  SULT1A1__Homo_sapiens__NP_803878
auggagcugauccaggacaccagcagacccccccuggaguacgugaagggcgugccccugaucaaguacuucgccgaggcccugggcccccugcagagcuuccaggccagacccgacgaccugcugaucagcaccuaccccaagagcggcaccaccugggugagccagauccuggacaugaucuaccagggcggcgaccuggagaagugccacagagcccccaucuucaugagagugcccuuccuggaguucaaggcccccggcauccccagcggcauggagacccugaaggacacccccgcccccagacugcugaagacccaccugccccuggcccugcugccccagacccugcuggaccagaaggugaaggugguguacguggccagaaacgccaaggacguggccgugagcuacuaccacuucuaccacauggccaaggugcaccccgagcccggcaccugggacagcuuccuggagaaguucauggugggcgaggugagcuacggcagcugguaccagcacgugcaggaguggugggagcugagcagaacccaccccgugcuguaccuguucuacgaggacaugaaggagaaccccaagagagagauccagaagauccuggaguucgugggcagaagccugcccgaggagaccguggacuucguggugcagcacaccagcuucaaggagaugaagaagaaccccaugaccaacuacaccaccgugccccaggaguucauggaccacagcaucagccccuucaugagaaagggcauggccggcgacuggaagaccaccuucaccguggcccagaacgagagauucgacgccgacuacgccgagaagauggccggcugcagccugagcuucagaagcgagcuguaa

SEQ ID NO: 24230 - RNA, 888 nt, Artificial Sequence
  SULT1A2__Homo_sapiens__NP_803564
auggagcugauccaggacaucagcagacccccccuggaguacgugaagggcgugccccugaucaaguacuucgccgaggcccugggcccccugcagagcuuccaggccagacccgacgaccugcugaucagcaccuaccccaagagcggcaccaccugggugagccagauccuggacaugaucuaccagggcggcgaccuggagaagugccacagagcccccaucuucaugagagugcccuuccuggaguucaaggugcccggcauccccagcggcauggagacccugaagaacacccccgcccccagacugcugaagacccaccugccccuggcccugcugccccagacccugcuggaccagaaggugaaggugguguacguggccagaaacgccaaggacguggccgugagcuacuaccacuucuaccacauggccaagguguacccccaccccggcaccugggagagcuuccuggagaaguucauggccggcgaggugagcuacggcagcugguaccagcacgugcaggaguggugggagcugagcagaacccaccccgugcuguaccuguucuacgaggacaugaaggagaaccccaagagagagauccagaagauccuggaguucgugggcagaagccugcccgaggagaccguggaccugaugguggagcacaccagcuucaaggagaugaagaagaaccccaugaccaacuacaccaccgugagaagagaguucauggaccacagcaucagccccuucaugagaaagggcauggccggcgacuggaagaccaccuucaccguggcccagaacgagagauucgacgccgacuacgccgagaagauggccggcugcagccugagcuucagaagcgagcuguaa

SEQ ID NO: 24231 - RNA, 888 nt, Artificial Sequence
  SULT1A4__Homo_sapiens__NP_001017390
auggagcugauccaggacaccagcagacccccccuggaguacgugaagggcgugccccugaucaaguacuucgccgaggcccugggcccccugcagagcuuccaggccagacccgacgaccugcugaucaacaccuaccccaagagcggcaccaccugggugagccagauccuggacaugaucuaccagggcggcgaccuggagaagugcaacagagcccccaucuacgugagagugcccuuccuggaggugaacgaccccggcgagcccagcggccuggagacccugaaggacacccccccccccagacugaucaagagccaccugccccuggcccugcugccccagacccugcuggaccagaaggugaaggugguguacguggccagaaaccccaaggacguggccgugagcuacuaccacuuccacagaauggagaaggcccaccccgagcccggcaccugggacagcuuccuggagaaguucauggccggcgaggugagcuacggcagcugguaccagcacgugcaggaguggugggagcugagcagaacccaccccgugcuguaccuguucuacgaggacaugaaggagaaccccaagagagagauccagaagauccuggaguucgugggcagaagccugcccgaggagaccauggacuucauggugcagcacaccagcuucaaggagaugaagaagaaccccaugaccaacuacaccaccgugccccaggagcugauggaccacagcaucagccccuucaugagaaagggcauggccggcgacuggaagaccaccuucaccguggcccagaacgagagauucgacgccgacuacgccgagaagauggccggcugcagccugagcuucagaagcgagcuguaa

SEQ ID NO: 24232 - RNA, 891 nt, Artificial Sequence
  SULT1B1__Homo_sapiens__NP_055280
augcugagccccaaggacauccugagaaaggaccugaagcuggugcacggcuaccccaugaccugcgccuucgccagcaacugggagaagaucgagcaguuccacagcagacccgacgacaucgugaucgccaccuaccccaagagcggcaccaccugggugagcgagaucaucgacaugauccugaacgacggcgacaucgagaagugcaagagaggcuucaucaccgagaaggugcccaugcuggagaugacccugcccggccugagaaccagcggcaucgagcagcuggagaagaaccccagccccagaaucgugaagacccaccugcccaccgaccugcugcccaagagcuucugggagaacaacugcaagaugaucuaccuggccagaaacgccaaggacgugagcgugagcuacuaccacuucgaccugaugaacaaccugcagcccuuccccggcaccugggaggaguaccuggagaaguuccugaccggcaagguggccuacggcagcugguucacccacgugaagaacugguggaagaagaaggaggagcaccccauccuguuccuguacuacgaggacaugaaggagaaccccaaggaggagaucaagaagaucaucagauuccuggagaagaaccugaacgacgagauccuggacagaaucauccaccacaccagcuucgaggugaugaaggacaacccccuggugaacuacacccaccugcccaccaccgugauggaccacagcaagagccccuucaugagaaagggcaccgccggcgacuggaagaacuacuucaccguggcccagaacgagaaguucgacgccaucuacgagaccgagaugagcaagaccgcccugcaguucagaaccgagaucuaa

SEQ ID NO: 24233 - RNA, 891 nt, Artificial Sequence
  SULT1C2__Homo_sapiens__NP_001047
auggcccugaccagcgaccugggcaagcagaucaagcugaaggagguggagggcacccugcugcagcccgccaccguggacaacuggagccagauccagagcuucgaggccaagcccgacgaccugcugaucugcaccuaccccaaggccggcaccaccuggauccaggagaucguggacaugaucgagcagaacggcgacguggagaagugccagagagccaucauccagcacagacaccccuucaucgagugggccagacccccccagcccagcggcguggagaaggccaaggccaugcccagccccagaauccugaagacccaccugagcacccagcugcugccccccagcuucugggagaacaacugcaaguuccuguacguggccagaaacgccaaggacugcauggugagcuacuaccacuuccagagaaugaaccacaugcugcccgaccccggcaccugggaggaguacuucgagaccuucaucaacggcaaggugguguggggcagcugguucgaccacgugaagggcuggugggagaugaaggacagacaccagauccuguuccuguucuacgaggacaucaagagagaccccaagcacgagaucagaaaggugaugcaguucaugggcaagaagguggacgagaccgugcuggacaagaucgugcaggagaccagcuucgagaagaugaaggagaaccccaugaccaacagaagcaccgugagcaagagcauccuggaccagagcaucagcagcuucaugagaaagggcaccgugggcgacuggaagaaccacuucaccguggcccagaacgagagauucgacgagaucuacagaagaaagauggagggcaccagcaucaacuucugcauggagcuguaa

SEQ ID NO: 24234 - RNA, 885 nt, Artificial Sequence
  SULT1E1__Homo_sapiens__NP_005411
augaacagcgagcuggacuacuacgagaaguucgaggaggugcacggcauccugauguacaaggacuucgugaaguacugggacaacguggaggccuuccaggccagacccgacgaccuggugaucgccaccuaccccaagagcggcaccaccugggugagcgagaucguguacaugaucuacaaggagggcgacguggagaagugcaaggaggacgugaucuucaacagaauccccuuccuggagugcagaaaggagaaccugaugaacggcgugaagcagcuggacgagaugaacagccccagaaucgugaagacccaccugccccccgagcugcugcccgccagcuucugggagaaggacugcaagaucaucuaccugugcagaaacgccaaggacguggccgugagcuucuacuacuucuuccugaugguggccggccaccccaaccccggcagcuuccccgaguucguggagaaguucaugcagggccaggugcccuacggcagcugguacaagcacgugaagagcuggugggagaagggcaagagccccagagugcuguuccuguucuacgaggaccugaaggaggacaucagaaaggaggugaucaagcugauccacuuccuggagagaaagcccagcgaggagcugguggacagaaucauccaccacaccagcuuccaggagaugaagaacaaccccagcaccaacuacaccacccugcccgacgagaucaugaaccagaagcugagccccuucaugagaaagggcaucaccggcgacuggaagaaccacuucaccguggcccugaacgagaaguucgacaagcacuacgagcagcagaugaaggagagcacccugaaguucagaaccgagaucuaa

SEQ ID NO: 24235 - RNA, 858 nt, Artificial Sequence
  SULT2A1__Homo_sapiens__NP_003158
augagcgacgacuuccugugguucgagggcaucgccuuccccaccaugggcuucagaagcgagacccugagaaaggugagagacgaguucgugaucagagacgaggacgugaucauccugaccuaccccaagagcggcaccaacuggcuggccgagauccugugccugaugcacagcaagggcgacgccaaguggauccagagcgugcccaucugggagagaagccccuggguggagagcgagaucggcuacaccgcccugagcgagaccgagagccccagacuguucagcagccaccugcccauccagcuguuccccaagagcuucuucagcagcaaggccaaggugaucuaccugaugagaaaccccagagacgugcuggugagcggcuacuucuucuggaagaacaugaaguucaucaagaagcccaagagcugggaggaguacuucgagugguucugccagggcaccgugcuguacggcagcugguucgaccacauccacggcuggaugcccaugagagaggagaagaacuuccugcugcugagcuacgaggagcugaagcaggacaccggcagaaccaucgagaagaucugccaguuccugggcaagacccuggagcccgaggagcugaaccugauccugaagaacagcagcuuccagagcaugaaggagaacaagaugagcaacuacagccugcugagcguggacuacgugguggacaaggcccagcugcugagaaagggcgugagcggcgacuggaagaaccacuucaccguggcccaggccgaggacuucgacaagcuguuccaggagaagauggccgaccugcccagagagcuguuccccugggaguaa

SEQ ID NO: 24236 - RNA, 1053 nt, Artificial Sequence
  SULT2B1__Homo_sapiens__NP_004596
auggccagccccccccccuuccacagccagaagcugcccggcgaguacuucagauacaagggcgugcccuuccccgugggccuguacagccuggagagcaucagccuggccgagaacacccaggacgugagagacgacgacaucuucaucaucaccuaccccaagagcggcaccaccuggaugaucgagaucaucugccugauccugaaggagggcgaccccagcuggaucagaagcgugcccaucugggagagagcccccuggugcgagaccaucgugggcgccuucagccugcccgaccaguacagccccagacugaugagcagccaccugcccauccagaucuucaccaaggccuucuucagcagcaaggccaaggugaucuacaugggcagaaaccccagagacgugguggugagccuguaccacuacagcaagaucgccggccagcugaaggaccccggcacccccgaccaguuccugagagacuuccugaagggcgaggugcaguucggcagcugguucgaccacaucaagggcuggcugagaaugaagggcaaggacaacuuccuguucaucaccuacgaggagcugcagcaggaccugcagggcagcguggagagaaucugcggcuuccugggcagaccccugggcaaggaggcccugggcagcgugguggcccacagcaccuucagcgccaugaaggccaacaccaugagcaacuacacccugcugccccccagccugcuggaccacagaagaggcgccuuccugagaaagggcgugugcggcgacuggaagaaccacuucaccguggcccagagcgaggccuucgacagagccuacagaaagcagaugagaggcaugcccaccuuccccugggacgaggaccccgaggaggacggcagccccgaccccgagcccagccccgagcccgagcccaagcccagccuggagcccaacaccagccuggagagagagcccagacccaacagcagccccagccccagccccggccaggccagcgagaccccccaccccagacccagcuaa

SEQ ID NO: 24237 - RNA, 855 nt, Artificial Sequence
  SULT4A1__Homo_sapiens__NP_055166
auggccgagagcgaggccgagacccccagcacccccggcgaguucgagagcaaguacuucgaguuccacggcgugagacugccccccuucugcagaggcaagauggaggagaucgccaacuuccccgugagacccagcgacguguggaucgugaccuaccccaagagcggcaccagccugcugcaggaggugguguaccuggugagccagggcgccgaccccgacgagaucggccugaugaacaucgacgagcagcugcccgugcuggaguacccccagcccggccuggacaucaucaaggagcugaccagccccagacugaucaagagccaccugcccuacagauuccugcccagcgaccugcacaacggcgacagcaaggugaucuacauggccagaaaccccaaggaccugguggugagcuacuaccaguuccacagaagccugagaaccaugagcuacagaggcaccuuccaggaguucugcagaagauucaugaacgacaagcugggcuacggcagcugguucgagcacgugcaggaguucugggagcacagaauggacagcaacgugcuguuccugaaguacgaggacaugcacagagaccuggugaccaugguggagcagcuggccagauuccugggcgugagcugcgacaaggcccagcuggaggcccugaccgagcacugccaccagcugguggaccagugcugcaacgccgaggcccugcccgugggcagaggcagagugggccuguggaaggacaucuucaccgugagcaugaacgagaaguucgaccugguguacaagcagaagaugggcaagugcgaccugaccuucgacuucuaccuguaa

SEQ ID NO: 24238 - RNA, 1050 nt, Artificial Sequence
  SUMF1__Homo_sapiens__NP_001158146
auggccgcccccgcccugggccuggugugcggcagaugccccgagcugggccuggugcugcugcugcugcugcugagccugcugugcggcgccgccggcagccaggaggccggcaccggcgccggcgccggcagccuggccggcagcugcggcugcggcaccccccagagacccggcgcccacggcagcagcgccgccgcccacagauacagcagagaggccaacgcccccggccccgugcccggcgagagacagcuggcccacagcaagauggugcccauccccgccggcguguucaccaugggcaccgacgacccccagaucaagcaggacggcgaggcccccgccagaagagugaccaucgacgccuucuacauggacgccuacgaggugagcaacaccgaguucgagaaguucgugaacagcaccggcuaccugaccgagguggccgccgcccccugguggcugcccgugaagggcgccaacuggagacaccccgagggccccgacagcaccauccugcacagacccgaccaccccgugcugcacgugagcuggaacgacgccguggccuacugcaccugggccggcaagagacugcccaccgaggccgagugggaguacagcugcagaggcggccugcacaacagacuguuccccuggggcaacaagcugcagcccaagggccagcacuacgccaacaucuggcagggcgaguuccccgugaccaacaccggcgaggacggcuuccagggcaccgcccccguggacgccuucccccccaacggcuacggccuguacaacaucgugggcaacgccugggaguggaccagcgacugguggaccgugcaccacagcguggaggagacccugaaccccaagggcccccccagcggcaaggacagagugaagaagggcggcagcuacaugugccacagaagcuacugcuacagauacagaugcgccgccagaagccagaacacccccgacagcagcgccagcaaccugggcuucagaugcgccgccgacagacugcccaccauggacuaa

SEQ ID NO: 24239 - RNA, 918 nt, Artificial Sequence
  SUMF2__Homo_sapiens__NP_001035934
augagagcccacgcccagagaggcagaggcugcaccagaagaagcgccgccgugcugauggccagacacggccugccccugcugccccugcugagccugcuggugggcgccuggcugaagcugggcaacggccaggccaccagcauggugcagcugcagggcggcagauuccugaugggcaccaacagccccgacagcagagacggcgagggccccgugagagaggccaccgugaagcccuucgccaucgacaucuuccccgugaccaacaaggacuucagagacuucgugagagagaagaaguacagaaccgaggccgagauguucggcuggagcuucguguucgaggacuucgugagcgacgagcugagaaacaaggccacccagcccaugaagcccgccggccccggcagcggcaucagagagagacuggagcaccccgugcugcacgugagcuggaacgacgccagagccuacugcgccuggagaggcaagagacugcccaccgaggaggagugggaguucgccgccagaggcggccugaagggccagguguaccccuggggcaacugguuccagcccaacagaaccaaccuguggcagggcaaguuccccaagggcgacaaggccgaggacggcuuccacggcgugagccccgugaacgccuuccccgcccagaacaacuacggccuguacgaccugcugggcaacgugugggaguggaccgccagccccuaccaggccgccgagcaggacaugagagugcugagaggcgccagcuggaucgacaccgccgacggcagcgccaaccacagagccagagugaccaccagaaugggcaacacccccgacagcgccagcgacaaccugggcuucagaugcgccgccgacgccggcagaccccccggcgagcuguaa

SEQ ID NO: 24240 - RNA, 306 nt, Artificial Sequence
  SUMO1__Homo_sapiens__NP_001005781
augagcgaccaggaggccaagcccagcaccgaggaccugggcgacaagaaggagggcgaguacaucaagcugaaggugaucggccaggacagcagcgagauccacuucaaggugaagaugaccacccaccugaagaagcugaaggagagcuacugccagagacagggcgugcccaugaacagccugagauuccuguucgagggccagagaaucgccgacaaccacacccccaaggagcugggcauggaggaggaggacgugaucgagguguaccaggagcagaccggcggccacagcaccguguaa

SEQ ID NO: 24241 - RNA, 216 nt, Artificial Sequence
  SUMO2__Homo_sapiens__NP_001005849
auggccgacgagaagcccaaggagggcgugaagaccgagaacaacgaccacaucaaccugaagguggccggccaggacggcagcguggugcaguucaagaucaagagacacaccccccugagcaagcugaugaaggccuacugcgagagacagcuggagauggaggacgaggacaccaucgacguguuccagcagcagaccggcggcguguacuaa

SEQ ID NO: 24242 - RNA, 426 nt, Artificial Sequence
  SUMO3__Homo_sapiens__NP_001273345
augagcgaggagaagcccaaggagggcgugaagaccgagaacgaccacaucaaccugaagguggccggccaggacggcagcguggugcaguucaagaucaagagacacaccccccugagcaagcugaugaaggccuacugcgagagacaggugagacaccuggcccccccccagagccugcccgugugcgcccuggugcugugcgugcccggcauccccagagccagagccagcagaggcuggacccagaugcagcugcccgagggccugagcaugagacagaucagauucagauucgacggccagcccaucaacgagaccgacacccccgcccagcuggagauggaggacgaggacaccaucgacguguuccagcagcagaccggcggcgugcccgagagcagccuggccggccacagcuucuaa

SEQ ID NO: 24243 - RNA, 288 nt, Artificial Sequence
  SUMO4__Homo_sapiens__NP_001002255
auggccaacgagaagcccaccgaggaggugaagaccgagaacaacaaccacaucaaccugaagguggccggccaggacggcagcguggugcaguucaagaucaagagacagaccccccugagcaagcugaugaaggccuacugcgagcccagaggccugagcgugaagcagaucagauucagauucggcggccagcccaucagcggcaccgacaagcccgcccagcuggagauggaggacgaggacaccaucgacguguuccagcagcccaccggcggcguguacuaa

SEQ ID NO: 24244 - RNA, 2358 nt, Artificial Sequence
  SUN1__Homo_sapiens__NP_001124437
auggacuucagcagacugcacauguacagccccccccagugcgugcccgagaacaccggcuacaccuacgcccugagcagcagcuacagcagcgacgcccuggacuucgagaccgagcacaagcuggaccccguguucgacagccccagaaugagcagaagaagccugagacuggccaccaccgccugcacccugggcgacggcgaggccgugggcgccgacagcggcaccagcagcgccgugagccugaagaacagagccgccagaaccaccaagcagagaagaagcaccaacaagagcgccuucagcaucaaccacgugagcagacaggugaccagcagcggcgugagccacggcggcaccgugagccugcaggacgccgugaccagaagaccccccgugcuggacgagagcuggaucagagagcagaccaccguggaccacuucuggggccuggacgacgacggcgaccugaagggcggcaacaaggccgccauccagggcaacggcgacgugggcgccgccgccgccaccgcccacaacggcuucagcugcagcaacugcagcaugcugagcgagagaaaggacgugcugaccgcccaccccgccgcccccggccccgugagcagaguguacagcagagacagaaaccagaagugcuacuuccugcugcagauccugagaagaaucggcgccgugggccaggccgugagcagaaccgccuggagcgcccuguggcuggccgugguggcccccggcaaggccgccagcggcguguucugguggcugggcaucggcugguaccaguucgugacccugaucagcuggcugaacguguuccugcugaccagaugccugagaaacaucugcaaguuccuggugcugcugaucccccuguuccugcugcuggccggccugagccugagaggccagggcaacuucuucagcuuccugcccgugcugaacugggccagcaugcacagaacccagagaguggacgacccccaggacguguucaagcccaccaccagcagacugaagcagccccugcagggcgacagcgaggccuuccccuggcacuggaugagcggcguggagcagcagguggccagccugagcggccagugccaccaccacggcgagaaccugagagagcugaccacccugcugcagaagcugcaggccagaguggaccagauggagggcggcgccgccggccccagcgccagcgugagagacgccgugggccagccccccagagagaccgacuucauggccuuccaccaggagcacgaggugagaaugagccaccuggaggacauccugggcaagcugagagagaagagcgaggccauccagaaggagcuggagcagaccaagcagaagaccaucagcgccgugggcgagcagcugcugcccaccguggagcaccugcagcuggagcuggaccagcugaagagcgagcugagcagcuggagacacgugaagaccggcugcgagaccguggacgccgugcaggagagaguggacgugcaggugagagagauggugaagcugcuguucagcgaggaccagcagggcggcagccuggagcagcugcugcagagauucagcagccaguucgugagcaagggcgaccugcagaccaugcugagagaccugcagcugcagauccugagaaacgugacccaccacgugagcgugaccaagcagcugcccaccagcgaggccguggugagcgccgugagcgaggccggcgccagcggcaucaccgaggcccaggccagagccaucgugaacagcgcccugaagcuguacagccaggacaagaccggcaugguggacuucgcccuggagagcggcggcggcagcauccugagcaccagaugcagcgagaccuacgagaccaagaccgcccugaugagccuguucggcaucccccugugguacuucagccagagccccagaguggugauccagcccgacaucuaccccggcaacugcugggccuucaagggcagccagggcuaccugguggugagacugagcaugaugauccaccccgccgccuucacccuggagcacauccccaagacccugagccccaccggcaacaucagcagcgcccccaaggacuucgccguguacggccuggagaacgaguaccaggaggagggccagcugcugggccaguucaccuacgaccaggacggcgagagccugcagauguuccaggcccugaagagacccgacgacaccgccuuccagaucguggagcugagaaucuucagcaacuggggccaccccgaguacaccugccuguacagauucagagugcacggcgagcccgugaaguaa

SEQ ID NO: 24245 - RNA, 2217 nt, Artificial Sequence
  SUN2__Homo_sapiens__NP_001186508
augagcagaagaagccagagacugaccagauacagccagggcgacgacgacggcagcagcagcagcggcggcagcagcguggccggcagccagagcacccuguucaaggacagcccccugagaacccugaagagaaagagcagcaacaugaagagacugagccccgccccccagcugggccccagcagcgacgcccacaccagcuacuacagcgagagccuggugcacgagagcugguucccccccagaagcagccuggaggagcugcacggcgacgccaacuggggcgaggaccugagagugagaagaagaagaggcaccggcggcagcgagagcagcagagccagcggccuggugggcagaaaggccaccgaggacuuccugggcagcagcagcggcuacagcagcgaggacgacuacguggaggacagcgagggcagaggcagcaaggugaccgagaccgagcccgugagcagcuuccccgccggcuacagcgacguggaccagcagagcagcagcagcagacugagaagcgccgugagcagagccggcagccugcuguggaugguggccaccagccccggcagacuguucagacugcuguacuggugggccggcaccaccugguacagacugaccaccgccgccagccugcuggacguguucgugcugaccagaagauucagcagccugaagaccuuccugugguuccugcugccccugcugcugcugaccugccugaccuacggcgccugguacuucuaccccuacggccugcagaccuuccaccccgcccuggugagcuggugggccgccaaggacagcagaagacccgacgagggcugggaggccagagacagcagcccccacuuccaggccgagcagagagugaugagcagagugcacagccuggagagaagacuggaggcccuggccgccgaguucagcagcaacuggcagaaggaggccaugagacuggagagacuggagcugagacagggcgcccccggccagggcggcggcggcggccugagccacgaggacacccuggcccugcuggagggccuggugagcagaagagaggccgcccugaaggaggacuucagaagagagaccgccgccagaauccaggaggagcugagcgcccugagagccgagcaccagcaggacagcgaggaccuguucaagaagaucgugagagccagccaggagagcgaggccagaauccagcagcugaagagcgaguggcagagcaugacccaggagagcuuccaggagagcagcgugaaggagcugagaagacuggaggaccagcuggccggccugcagcaggagcuggccgcccuggcccugaagcagagcagcguggccgaggaggugggccugcugccccagcagauccaggccgugagagacgacguggagagccaguuccccgccuggaucagccaguuccuggccagaggcggcggcggcagagugggccugcugcagagagaggagaugcaggcccagcugagagagcuggagagcaagauccugacccacguggccgagaugcagggcaagagcgccagagaggccgccgccagccugagccugacccugcagaaggagggcgugaucggcgugaccgaggagcaggugcaccacaucgugaagcaggcccugcagagauacagcgaggacagaaucggccuggccgacuacgcccuggagagcggcggcgccagcgugaucagcaccagaugcagcgagaccuacgagaccaagaccgcccugcugagccuguucggcaucccccugugguaccacagccagagccccagagugauccugcagcccgacgugcaccccggcaacugcugggccuuccagggcccccagggcuucgccguggugagacugagcgccagaaucagacccaccgccgugacccuggagcacgugcccaaggcccugagccccaacagcaccaucagcagcgcccccaaggacuucgccaucuucggcuucgacgaggaccugcagcaggagggcacccugcugggcaaguucaccuacgaccaggacggcgagcccauccagaccuuccacuuccaggcccccaccauggccaccuaccaggugguggagcugagaauccugaccaacuggggccaccccgaguacaccugcaucuacagauucagagugcacggcgagcccgcccacuaa

SEQ ID NO: 24246 - RNA, 1074 nt, Artificial Sequence
  SUN3__Homo_sapiens__NP_001025190
augagcggcaagaccaaggccagaagagccgccauguucuucagaagaugcagcgaggacgccagcggcagcgccagcggcaacgcccugcugagcgaggacgagaaccccgacgccaacggcgugaccagaagcuggaagaucauccugagcaccaugcugacccugaccuuccugcuggugggccugcugaaccaccaguggcugaaggagaccgacgugccccagaagagcagacagcuguacgccaucaucgccgaguacggcagcagacuguacaaguaccaggccagacugagaaugcccaaggagcagcuggagcugcugaagaaggagagccagaaccuggagaacaacuucagacagauccuguuccugaucgagcagaucgacgugcugaaggcccugcugagagacaugaaggacggcauggacaacaaccacaacuggaacacccacggcgaccccguggaggaccccgaccacaccgaggaggugagcaaccuggugaacuacgugcugaagaagcugagagaggaccagguggagauggccgacuacgcccugaagagcgccggcgccagcaucaucgaggccggcaccagcgagagcuacaagaacaacaaggccaagcuguacuggcacggcaucggcuuccugaaccacgagaugccccccgacaucauccugcagcccgacguguaccccggcaagugcugggccuuccccggcagccagggccacacccugaucaagcuggccaccaagaucauccccaccgccgugaccauggagcacaucagcgagaaggugagccccagcggcaacaucagcagcgcccccaaggaguucagcguguacggcaucaccaagaagugcgagggcgaggagaucuuccugggccaguucaucuacaacaagaccggcaccaccgugcagaccuucgagcugcagcacgccgugagcgaguaccugcugugcgugaagcugaacaucuucagcaacuggggccaccccaaguacaccugccuguacagauucagagugcacggcacccccggcaagcacaucuaa

SEQ ID NO: 24247 - RNA, 1638 nt, Artificial Sequence
  SUOX__Homo_sapiens__NP_000447
augcugcugcugcacagagccguggugcugagacugcagcaggccugcagacugaagagcauccccagcagaaucugcauccaggccugcagcaccaacgacagcuuccagccccagagacccagccugaccuucagcggcgacaacagcagcacccagggcuggagagugaugggcacccugcugggccugggcgccgugcuggccuaccaggaccacagaugcagagccgcccaggagagcacccacaucuacaccaaggaggaggugagcagccacaccagccccgagaccggcaucugggugacccugggcagcgagguguucgacgugaccgaguucguggaccugcaccccggcggccccagcaagcugaugcuggccgccggcggcccccuggagcccuucugggcccuguacgccgugcacaaccagagccacgugagagagcugcuggcccaguacaagaucggcgagcugaaccccgaggacaagguggcccccaccguggagaccagcgaccccuacgccgacgaccccgugagacaccccgcccugaaggugaacagccagagacccuucaacgccgagcccccccccgagcugcugaccgagaacuacaucacccccaaccccaucuucuucaccagaaaccaccugcccgugcccaaccuggaccccgacaccuacagacugcacguggugggcgcccccggcggccagagccugagccugagccuggacgaccugcacaacuuccccagauacgagaucaccgugacccugcagugcgccggcaacagaagaagcgagaugacccaggugaaggaggugaagggccuggaguggagaaccggcgccaucagcaccgccagaugggccggcgccagacugugcgacgugcuggcccaggccggccaccagcugugcgagaccgaggcccacgugugcuucgagggccuggacagcgaccccaccggcaccgccuacggcgccagcaucccccuggccagagccauggaccccgaggccgaggugcugcuggccuacgagaugaacggccagccccugcccagagaccacggcuuccccgugagagugguggugcccggcguggugggcgccagacacgugaaguggcugggcagagugagcgugcagcccgaggagagcuacagccacuggcagagaagagacuacaagggcuucagccccagcguggacugggagaccguggacuucgacagcgcccccagcauccaggagcugcccgugcagagcgccaucaccgagcccagagacggcgagaccguggagagcggcgaggugaccaucaagggcuacgccuggagcggcggcggcagagccgugaucagaguggacgugagccuggacggcggccugaccuggcagguggccaagcuggacggcgaggagcagagacccagaaaggccugggccuggagacuguggcagcugaaggcccccgugcccgccggccagaaggagcugaacaucgugugcaaggccguggacgacggcuacaacgugcagcccgacaccguggcccccaucuggaaccugagaggcgugcugagcaacgccuggcacagagugcacguguacgugagccccuaa

SEQ ID NO: 24248 - RNA, 2340 nt, Artificial Sequence
  SUPT20H__Homo_sapiens__NP_001014308
augcagcaggcccuggagcuggcccuggacagagccgaguacgugaucgagagcgccagacagagaccccccaagagaaaguaccugagcagcggcagaaagagcguguuccagaagcuguacgaccuguacaucgaggagugcgagaaggagcccgaggugaagaagcugagaagaaacgugaaccugcuggagaagcuggugaugcaggagacccugagcugccugguggugaaccuguaccccggcaacgagggcuacagccugaugcugagaggcaagaacggcagcgacagcgagaccaucagacugcccuacgaggagggcgagcugcuggaguaccuggacgccgaggagcugccccccauccugguggaccugcuggagaagagccaggugaacaucuuccacugcggcugcgugaucgccgagaucagagacuacagacagagcagcaacaugaagagccccggcuaccagagcagacacauccugcugagacccaccaugcagacccugaucugcgacgugcacagcaucaccagcgacaaccacaaguggacccaggaggacaagcugcugcuggagagccagcugauccuggccaccgccgagccccugugccuggaccccagcaucgccgugaccugcaccgccaacagacugcuguacaacaagcagaagaugaacaccagacccaugaagagaugcuucaagagauacagcagaagcagccugaacagacagcaggaccugagccacugccccccccccccccagcugagacugcuggacuuccugcagaagagaaaggagagaaaggccggccagcacuacgaccugaagaucagcaaggccggcaacugcguggacauguggaagagaagccccugcaaccuggccauccccagcgagguggacguggagaaguacgccaagguggagaagagcaucaagagcgacgacagccagcccaccguguggcccgcccacgacgugaaggacgacuacguguucgagugcgaggccggcacccaguaccagaagaccaagcugaccauccugcagagccugggcgacccccuguacuacggcaagauccagcccugcaaggccgacgaggagagcgacagccagaugagccccagccacagcagcaccgacgaccacagcaacugguucaucaucggcagcaagaccgacgccgagagaguggugaaccaguaccaggagcuggugcagaacgaggccaagugccccgugaagaugagccacagcagcagcggcagcgccagccugagccaggugagccccggcaaggagaccgaccagaccgagaccgugagcgugcagagcagcgugcugggcaagggcgugaagcacagacccccccccaucaagcugcccagcagcagcggcaacagcagcagcggcaacuacuucaccccccagcagaccagcagcuuccugaagagccccacccccccccccagcagcaagcccagcagcauccccagaaagagcagcguggaccugaaccaggugagcaugcugagccccgccgcccugagccccgccagcagcagccagagaaccaccgccacccaggugauggccaacagcgccggccugaacuucaucaacguggugggcagcgugugcggcgcccaggcccugaugagcggcagcaaccccaugcugggcugcaacaccggcgccaucacccccgccggcaucaaccugagcggccugcugcccagcggcggccugcugcccaacgcccugcccagcgccaugcaggccgccagccaggccggcgugcccuucggccugaagaacaccagcagccugagaccccugaaccugcugcagcugcccggcggcagccugaucuucaacacccugcagcagcagcagcagcagcugagccaguucaccccccagcagccccagcagcccaccaccugcagcccccagcagcccggcgagcagggcagcgagcagggcagcaccagccaggagcaggcccugagcgcccagcaggccgccgugaucaaccugaccggcgugggcagcuucaugcagagccaggccgccgugcugagccagcugggcagcgccgagaacagacccgagcagagccugccccagcagagauuccagcugagcagcgccuuccagcagcagcagcagcagauccagcagcugagauuccugcagcaccagauggccauggccgccgccgccgcccagaccgcccagcugcaccaccacagacacaccggcagccagagcaagagcaagaugaagagaggcacccccaccacccccaaguucuaa

SEQ ID NO: 24249 - RNA, 498 nt, Artificial Sequence
  SUPT3H__Homo_sapiens__NP_001248752
auguucgaggacgacgagaucgacgaggugaagcaggagagaauggagagagccgagagacagaccagaaucauggacagcgcccaguacgccgaguucugcgagagcagacagcugagcuucagcaagaaggccagcaaguucagagacuggcuggacugcagcagcauggagaucaagcccaacgugguggccauggagauccuggccuaccuggccuacgagaccguggcccagcugguggaccuggcccugcuggugagacaggacauggugaccaaggccggcgaccccuucagccacgccaucagcgccaccuucauccaguaccacaacagcgccgagagcaccgccgccugcggcguggaggcccacagcgacgccauccagcccugccacaucagagaggccaucagaagauacagccacagaaucggcccccugagccccuucaccaacgccuacagaagaaacggcauggccuuccuggccugcuaa

SEQ ID NO: 24250 - RNA, 354 nt, Artificial Sequence
  SUPT4H1__Homo_sapiens__NP_003159
auggcccuggagaccgugcccaaggaccugagacaccugagagccugccugcugugcagccuggugaagaccaucgaccaguucgaguacgacggcugcgacaacugcgacgccuaccugcagaugaagggcaacagagagaugguguacgacugcaccagcagcagcuucgacggcaucaucgccaugaugagccccgaggacagcugggugagcaaguggcagagagugagcaacuucaagcccggcguguacgccgugagcgugaccggcagacugccccagggcaucgugagagagcugaagagcagaggcguggccuacaagagcagagacaccgccaucaagaccuaa

SEQ ID NO: 24251 - RNA, 1245 nt, Artificial Sequence
  SUPT7L__Homo_sapiens__NP_001269658
augaaccugcagagauacuggggcgagauccccaucagcagcagccagaccaacagaagcagcuucgaccugcugcccagagaguucagacugguggaggugcacgaccccccccugcaccagcccagcgccaacaagcccaagccccccaccaugcuggacauccccagcgagcccugcagccugaccauccacaccauccagcugauccagcacaacagaagacugagaaaccugaucgccaccgcccaggcccagaaccagcagcagaccgagggcgugaagaccgaggagagcgagccccugcccagcugccccggcagccccccccugcccgacgaccugcugccccuggacugcaagaaccccaacgcccccuuccagaucagacacagcgaccccgagagcgacuucuacagaggcaagggcgagcccgugaccgagcugagcuggcacagcugcagacagcugcuguaccaggccguggccaccauccuggcccacgccggcuucgacugcgccaacgagagcgugcuggagacccugaccgacguggcccacgaguacugccugaaguucaccaagcugcugagauucgccguggacagagaggccagacugggccagacccccuuccccgacgugauggagcagguguuccacgaggugggcaucggcagcgugcugagccugcagaaguucuggcagcacagaaucaaggacuaccacagcuacaugcugcagaucagcaagcagcugagcgaggaguacgagagaaucgugaaccccgagaaggccaccgaggacgccaagcccgugaagaucaaggaggagcccgugagcgacaucaccuuccccgugagcgaggagcuggaggccgaccuggccagcggcgaccagagccugcccaugggcgugcugggcgcccagagcgagagauuccccagcaaccuggagguggaggccagcccccaggccagcagcgccgaggugaacgccagcccccuguggaaccuggcccacgugaagauggagccccaggagagcgaggagggcaacgugagcggccacggcgugcugggcagcgacguguucgaggagcccaugagcggcaugagcgaggccggcaucccccagagccccgacgacagcgacagcagcuacggcagccacagcaccgacagccugaugggcagcagccccguguucaaccagagaugcaagaagagaaugagaaagaucuaa

SEQ ID NO: 24252 - RNA, 2361 nt, Artificial Sequence
  SUPV3L1__Homo_sapiens__NP_003162
augagcuucagcagagcccugcugugggccagacugcccgccggcagacaggccggccacagagccgccaucugcagcgcccugagaccccacuucggccccuuccccggcgugcugggccaggugagcgugcuggccaccgccagcagcagcgccagcggcggcagcaagauccccaacaccagccuguucgugccccugaccgugaagccccagggccccagcgccgacggcgacgugggcgccgagcugaccagaccccuggacaagaacgaggugaagaaggugcuggacaaguucuacaagagaaaggagauccagaagcugggcgccgacuacggccuggacgccagacuguuccaccaggccuucaucagcuucagaaacuacaucaugcagagccacagccuggacguggacauccacaucgugcugaacgacaucugcuucggcgccgcccacgccgacgaccuguuccccuucuuccugagacacgccaagcagaucuuccccgugcuggacugcaaggacgaccugagaaagaucagcgaccugagaaucccccccaacugguaccccgacgccagagccaugcagagaaagaucaucuuccacagcggccccaccaacagcggcaagaccuaccacgccauccagaaguacuucagcgccaagagcggcguguacugcggcccccugaagcugcuggcccacgagaucuucgagaagagcaacgccgccggcgugcccugcgaccuggugaccggcgaggagagagugaccgugcagcccaacggcaagcaggccagccacgugagcugcaccguggagaugugcagcgugaccacccccuacgagguggccgugaucgacgagauccagaugaucagagaccccgccagaggcugggccuggaccagagcccugcugggccugugcgccgaggaggugcaccugugcggcgagcccgccgccaucgaccuggugauggagcugauguacaccaccggcgaggagguggaggugagagacuacaagagacugacccccaucagcgugcuggaccacgcccuggagagccuggacaaccugagacccggcgacugcaucgugugcuucagcaagaacgacaucuacagcgugagcagacagaucgagaucagaggccuggagagcgccgugaucuacggcagccugccccccggcaccaagcuggcccaggccaagaaguucaacgaccccaacgaccccugcaagauccugguggccaccgacgccaucggcaugggccugaaccugagcaucagaagaaucaucuucuacagccugaucaagcccagcaucaacgagaagggcgagagagagcuggagcccaucaccaccagccaggcccugcagaucgccggcagagccggcagauucagcagcagauucaaggagggcgaggugaccaccaugaaccacgaggaccugagccugcugaaggagauccugaagagacccguggaccccaucagagccgccggccugcaccccaccgccgagcagaucgagauguucgccuaccaccugcccgacgccacccugagcaaccugaucgacaucuucguggacuucagccagguggacggccaguacuucgugugcaacauggacgacuucaaguucagcgccgagcugauccagcacaucccccugagccugagagugagauacguguucugcaccgcccccaucaacaagaagcagcccuucgugugcagcagccugcugcaguucgccagacaguacagcagaaacgagccccugaccuucgccuggcugagaagauacaucaaguggccccugcugccccccaagaacaucaaggaccugauggaccuggaggccgugcacgacgugcuggaccuguaccuguggcugagcuacagauucauggacauguuccccgacgccagccugaucagagaccugcagaaggagcuggacggcaucauccaggacggcgugcacaacaucaccaagcugaucaagaugagcgagacccacaagcugcugaaccuggagggcuuccccagcggcagccagagcagacugagcggcacccugaagagccaggccagaagaaccagaggcaccaaggcccugggcagcaaggccaccgagccccccagccccgacgccggcgagcugagccuggccagcagacuggugcagcagggccugcugacccccgacaugcugaagcagcuggagaaggaguggaugacccagcagaccgagcacaacaaggagaagaccgagagcggcacccaccccaagggcaccagaagaaagaagaaggagcccgacagcgacuaa

SEQ ID NO: 24253 - RNA, 903 nt, Artificial Sequence
  SURF1__Homo_sapiens__NP_003163
auggccgccguggccgcccugcagcugggccugagagccgccggccugggcagagcccccgccagcgccgccuggagaagcgugcugagagugagccccagacccggcguggccuggagacccagcagaugcggcagcagcgccgccgaggccagcgccaccaaggccgaggacgacagcuuccugcagugggugcugcugcugauccccgugaccgccuucggccugggcaccuggcaggugcagagaagaaaguggaagcugaaccugaucgccgagcuggagagcagagugcuggccgagcccgugccccugcccgccgaccccauggagcugaagaaccuggaguacagacccgugaaggugagaggcugcuucgaccacagcaaggagcuguacaugaugcccagaaccaugguggaccccgugagagaggccagagagggcggccugaucagcagcagcacccagagcggcgccuacguggugacccccuuccacugcaccgaccugggcgugaccauccuggugaacagaggcuucgugcccagaaagaaggugaaccccgagaccagacagaagggccagaucgagggcgagguggaccugaucggcauggugagacugaccgagaccagacagcccuucgugcccgagaacaaccccgagagaaaccacuggcacuacagagaccuggaggccauggccagaaucaccggcgccgagcccaucuucaucgacgccaacuuccagagcaccgugcccggcggccccaucggcggccagaccagagugacccugagaaacgagcaccugcaguacaucgugaccugguacggccugagcgccgccaccagcuaccugugguucaagaaguuccugagaggcacccccggcguguaa

SEQ ID NO: 24254 - RNA, 480 nt, Artificial Sequence
  SURF4__Homo_sapiens__NP_001267718
augggccagaacgaccugaugggcaccgccgaggacuucgccgaccaguuccugagagugaccaagcaguaccugccccacguggccagacugugccugaucagcaccuuccuggaggacggcaucagaaugugguuccaguggagcgagcagagagacuacaucgacaccaccuggaacugcggcuaccugcuggccagcagcuucguguuccugaaccugcugggccagcugaccggcugcgugcuggugcugagcagaaacuucgugcaguacgccugcuucggccuguucggcaucaucgcccugcagaccaucgccuacagcauccugugggaccugaaguuccugaugagaaaccuggcccugggcggcggccugcugcugcugcuggccgagagcagaagcgagggcaagagcauguucgccggcgugcccaccaugagagagagcagccccaagcaguaccugcccggcuaa

SEQ ID NO: 24255 - RNA, 2274 nt, Artificial Sequence
  SUSD1__Homo_sapiens__NP_001269569
augggcagaggccccugggacgccggccccagcagaagacugcugccccugcugcugcugcugggccuggccagaggcgccgccggcgcccccggccccgacggccuggacgugugcgccaccugccacgagcacgccaccugccagcagagagagggcaagaagaucugcaucugcaacuacggcuucgugggcaacggcagaacccagugcguggacaagaacgagugccaguucggcgccacccuggugugcggcaaccacaccagcugccacaacacccccggcggcuucuacugcaucugccuggagggcuacagagccaccaacaacaacaagaccuucauccccaacgacggcaccuucugcaccgacaucgacgagugcgaggugagcggccugugcagacacggcggcagaugcgugaacacccacggcagcuucgagugcuacugcauggacggcuaccugcccagaaacggccccgagcccuuccaccccaccaccgacgccaccagcugcaccgagaucgacugcggcaccccccccgaggugcccgacggcuacaucaucggcaacuacaccagcagccugggcagccaggugagauacgccugcagagagggcuucuucagcgugcccgaggacaccgugagcagcugcaccggccugggcaccugggagagccccaagcugcacugccaggagaucaacugcggcaacccccccgagaugagacacgccauccuggugggcaaccacagcagcagacugggcggcguggccagauacgugugccaggagggcuucgagagccccggcggcaagaucaccagcgugugcaccgagaagggcaccuggagagagagcacccugaccugcaccgagauccugaccaagaucaacgacgugagccuguucaacgacaccugcgugagauggcagaucaacagcagaagaaucaaccccaagaucagcuacgugaucagcaucaagggccagagacuggaccccauggagagcgugagagaggagaccgugaaccugaccaccgacagcagaacccccgaggugugccuggcccuguaccccggcaccaacuacaccgugaacaucagcaccgccccccccagaagaagcaugcccgccgugaucggcuuccagaccgccgagguggaccugcuggaggacgacggcagcuucaacaucagcaucuucaacgagaccugccugaagcugaacagaagaagcagaaaggugggcagcgagcacauguaccaguucaccgugcugggccagagaugguaccuggccaacuucagccacgccaccagcuucaacuucaccaccagagagcaggugcccguggugugccuggaccuguaccccaccaccgacuacaccgugaacgugacccugcugagaagccccaagagacacagcgugcagaucaccaucgccaccccccccgccgugaagcagaccaucagcaacaucagcggcuucaacgagaccugccugagauggagaagcaucaagaccgccgacauggaggagauguaccuguuccacaucuggggccagagaugguaccagaaggaguucgcccaggagaugaccuucaacaucagcagcagcagcagagaccccgaggugugccuggaccugagacccggcaccaacuacaacgugagccugagagcccugagcagcgagcugcccguggugaucagccugaccacccagaucaccgagcccccccugcccgagguggaguucuucaccgugcacagaggcccccugcccagacugagacugagaaaggccaaggagaagaacggccccaucagcagcuaccaggugcuggugcugccccuggcccugcagagcaccuucagcugcgacagcgagggcgccagcagcuucuucagcaacgccagcgacgccgacggcuacguggccgccgagcugcuggccaaggacgugcccgacgacgccauggagauccccaucggcgacagacuguacuacggcgaguacuacaacgccccccugaagagaggcagcgacuacugcaucauccugagaaucaccagcgaguggaacaaggugagaagacacagcugcgccgugugggcccaggugaaggagauccccugcaacugcaacuuccugagacugcacauccacagagccaacagcggcgacacccagaucagacacagcugcugcugcagauggagagugcuggacugggugcccuggcugcuguaa

SEQ ID NO: 24256 - RNA, 2469 nt, Artificial Sequence
  SUSD2__Homo_sapiens__NP_062547
augaagcccgcccugcugcccugggcccugcugcugcuggccaccgcccugggccccggccccggccccaccgccgacgcccaggagagcugcagcaugagaugcggcgcccuggacggccccugcagcugccaccccaccugcagcggccugggcaccugcugccuggacuucagagacuucugccuggagauccugcccuacagcggcagcaugaugggcggcaaggacuucguggugagacacuucaagaugagcagccccaccgacgccagcgugaucugcagauucaaggacagcauccagacccugggccacguggacagcagcggccaggugcacugcgugagcccccugcuguacgagagcggcagaauccccuucaccgugagccuggacaacggccacagcuuccccagagccggcaccuggcuggccgugcaccccaacaaggugagcaugauggagaagagcgagcuggugaacgagaccagauggcaguacuacggcaccgccaacaccagcggcaaccugagccugaccuggcacgugaagagccugcccacccagaccaucaccaucgagcuguggggcuacgaggagaccggcaugcccuacagccaggaguggaccgccaaguggagcuaccuguacccccuggccacccacauccccaacagcggcagcuucaccuucacccccaagcccgccccccccagcuaccagagauggagagugggcgcccugagaaucaucgacagcaagaacuacgccggccagaaggacgugcaggcccuguggaccaacgaccacgcccuggccuggcaccugagcgacgacuucagagaggaccccguggccugggccagaacccagugccaggccugggaggagcuggaggaccagcugcccaacuuccuggaggagcugcccgacugccccugcacccugacccaggccagagccgacagcggcagauucuucaccgacuacggcugcgacauggagcagggcagcgugugcaccuaccaccccggcgccgugcacugcgugagaagcgugcaggccagccugagauacggcagcggccagcagugcugcuacaccgccgacggcacccagcugcugaccgccgacagcagcggcggcagcacccccgacagaggccacgacuggggcgccccccccuucagaaccccccccagagugcccagcaugagccacuggcuguacgacgugcugagcuucuacuacugcugccugugggcccccgacugccccagauacaugcagagaagacccagcaacgacugcagaaacuacagaccccccagacuggccagcgccuucggcgacccccacuucgugaccuucgacggcaccaacuucaccuucaacggcagaggcgaguacgugcugcuggaggccgcccugaccgaccugagagugcaggccagagcccagcccggcaccaugagcaacggcaccgagaccagaggcaccggccugaccgccguggccgugcaggagggcaacagcgacgugguggaggugagacuggccaacagaaccggcggccuggaggugcugcugaaccaggaggugcugagcuucaccgagcagagcuggauggaccugaagggcauguuccugagcguggccgccggcgacagagugagcaucaugcuggccagcggcgccggccuggaggugagcgugcagggccccuuccugagcgugagcgugcugcugcccgagaaguuccugacccacacccacggccugcugggcacccugaacaacgaccccaccgacgacuucacccugcacagcggcagagugcugccccccggcaccagcccccaggagcuguuccuguucggcgccaacuggaccgugcacaacgccagcagccugcugaccuacgacagcugguuccuggugcacaacuuccuguaccagcccaagcacgaccccaccuucgagccccuguuccccagcgagaccacccugaaccccagccuggcccaggaggccgccaagcugugcggcgacgaccacuucugcaacuucgacguggccgccaccggcagccugagcaccggcaccgccaccagaguggcccaccagcugcaccagagaagaaugcagagccugcagcccguggugagcugcggcuggcuggcccccccccccaacggccagaaggagggcaacagauaccuggccggcagcaccaucuacuuccacugcgacaacggcuacagccuggccggcgccgagaccagcaccugccaggccgacggcaccuggagcagccccacccccaagugccagcccggcagaagcuacgccgugcugcugggcaucaucuucggcggccuggccgugguggccgccguggcccugguguacgugcugcugagaagaagaaagggcaacacccacguguggggcgcccagcccuaa

SEQ ID NO: 24257 - RNA, 873 nt, Artificial Sequence
  SUSD4__Homo_sapiens__NP_001032252
auguaccacggcaugaaccccagcaacggcgacggcuuccuggagcagcagcagcagcagcagcagccccagagcccccagagacugcuggccgugauccugugguuccagcuggcccugugcuucggccccgcccagcugaccggcggcuucgacgaccugcaggugugcgccgaccccggcauccccgagaacggcuucagaacccccagcggcggcguguucuucgagggcagcguggccagauuccacugccaggacggcuucaagcugaagggcgccaccaagagacugugccugaagcacuucaacggcacccugggcuggauccccagcgacaacagcaucugcgugcaggaggacugcagaaucccccagaucgaggacgccgagauccacaacaagaccuacagacacggcgagaagcugaucaucaccugccacgagggcuucaagaucagauaccccgaccugcacaacauggugagccugugcagagacgacggcaccuggaacaaccugcccaucugccagggcugccugagaccccuggccagcagcaacggcuacgugaacaucagcgagcugcagaccagcuuccccgugggcaccgugaucagcuacagaugcuuccccggcuucaagcuggacggcagcgccuaccuggagugccugcagaaccugaucuggagcagcagcccccccagaugccuggcccuggagggcggcagacccgagcaccuguuccccgugcuguacuucccccacaucagacuggccgccgccgugcuguacuucugccccgugcugaagagcagccccacccccgcccccaccugcagcagcaccagcaccaccaccagccuguucuaa

SEQ ID NO: 24258 - RNA, 912 nt, Artificial Sequence
  SUSD6__Homo_sapiens__NP_055549
augugccacggcagaaucgcccccaagagcaccagcguguucgccguggccagcgugggccacggcguguuccugccccuggugauccugugcacccugcugggcgacggccuggccagcgugugcccccugccccccgagcccgagaacggcggcuacaucugccaccccagacccugcagagacccccugaccgccggcagcgugaucgaguaccugugcgccgagggcuacaugcugaagggcgacuacaaguaccugaccugcaagaacggcgaguggaagcccgccauggagaucagcugcagacugaacgaggacaaggacacccacaccagccugggcgugcccacccugagcaucguggccagcaccgccagcagcguggcccugauccugcugcugguggugcuguucgugcugcugcagcccaagcugaagagcuuccaccacagcagaagagaccagggcgugagcggcgaccaggugagcaucaugguggacggcgugcagguggcccugcccagcuacgaggaggccguguacggcagcagcggccacugcgugccccccgccgaccccagagugcagaucgugcugagcgagggcagcggccccagcggcagaagcgugcccagagagcagcagcugcccgaccagggcgccugcagcagcgccggcggcgaggacgaggcccccggccagagcggccugugcgaggccuggggcagcagagccagcgagaccgugauggugcaccaggccaccaccagcagcuggguggccggcagcggcaacagacagcuggcccacaaggagaccgccgacagcgagaacagcgacauccagagccugcugagccugaccagcgaggaguacaccgacgacaucccccugcugaaggaggccuaa

SEQ ID NO: 24259 - RNA, 1272 nt, Artificial Sequence
  SUV39H1__Homo_sapiens__NP_001269095
auggugggcaugagcagacugagaaacgacagacuggccgacccccugaccggcugcagcgugugcugcaagagcagcuggaaccagcugcaggaccugugcagacuggccaagcugagcugccccgcccugggcaucagcaagagaaaccuguacgacuucgagguggaguaccugugcgacuacaagaagaucagagagcaggaguacuaccuggugaaguggagaggcuaccccgacagcgagagcaccugggagcccagacagaaccugaagugcgugagaauccugaagcaguuccacaaggaccuggagagagagcugcugagaagacaccacagaagcaagacccccagacaccuggaccccagccuggccaacuaccuggugcagaaggccaagcagagaagagcccugagaagaugggagcaggagcugaacgccaagagaagccaccugggcagaaucaccguggagaacgagguggaccuggacggcccccccagagccuucguguacaucaacgaguacagagugggcgagggcaucacccugaaccagguggccgugggcugcgagugccaggacugccugugggcccccaccggcggcugcugccccggcgccagccugcacaaguucgccuacaacgaccagggccaggugagacugagagccggccugcccaucuacgagugcaacagcagaugcagaugcggcuacgacugccccaacagaguggugcagaagggcaucagauacgaccugugcaucuucagaaccgacgacggcagaggcuggggcgugagaacccuggagaagaucagaaagaacagcuucgugauggaguacgugggcgagaucaucaccagcgaggaggccgagagaagaggccagaucuacgacagacagggcgccaccuaccuguucgaccuggacuacguggaggacguguacaccguggacgccgccuacuacggcaacaucagccacuucgugaaccacagcugcgaccccaaccugcagguguacaacguguucaucgacaaccuggacgagagacugcccagaaucgccuucuucgccaccagaaccaucagagccggcgaggagcugaccuucgacuacaacaugcagguggaccccguggacauggagagcaccagaauggacagcaacuucggccuggccggccugcccggcagccccaagaagagagugagaaucgagugcaagugcggcaccgagagcugcagaaaguaccuguucuaa

SEQ ID NO: 24260 - RNA, 1233 nt, Artificial Sequence
  SUV39H2__Homo_sapiens__NP_001180353
auggccgccgugggcgccgaggccagaggcgccuggugcgugcccugccuggugagccuggacacccugcaggagcugugcagaaaggagaagcugaccugcaagagcaucggcaucaccaagagaaaccugaacaacuacgagguggaguaccugugcgacuacaagguggugaaggacauggaguacuaccuggugaaguggaagggcuggcccgacagcaccaacaccugggagccccugcagaaccugaagugcccccugcugcugcagcaguucagcaacgacaagcacaacuaccugagccaggugaagaagggcaaggccaucacccccaaggacaacaacaagacccugaagcccgccaucgccgaguacaucgugaagaaggccaagcagagaaucgcccugcagagauggcaggacgagcugaacagaagaaagaaccacaagggcaugaucuucguggagaacaccguggaccuggagggcccccccagcgacuucuacuacaucaacgaguacaagcccgcccccggcaucagccuggugaacgaggccaccuucggcugcagcugcaccgacugcuucuuccagaagugcugccccgccgaggccggcgugcugcuggccuacaacaagaaccagcagaucaagaucccccccggcacccccaucuacgagugcaacagcagaugccagugcggccccgacugccccaacagaaucgugcagaagggcacccaguacagccugugcaucuucagaaccagcaacggcagaggcuggggcgugaagacccuggugaagaucaagagaaugagcuucgugauggaguacgugggcgaggugaucaccagcgaggaggccgagagaagaggccaguucuacgacaacaagggcaucaccuaccuguucgaccuggacuacgagagcgacgaguucaccguggacgccgccagauacggcaacgugagccacuucgugaaccacagcugcgaccccaaccugcagguguucaacguguucaucgacaaccuggacaccagacugcccagaaucgcccuguucagcaccagaaccaucaacgccggcgaggagcugaccuucgacuaccagaugaagggcagcggcgacaucagcagcgacagcaucgaccacagccccgccaagaagagagugagaaccgugugcaagugcggcgccgugaccugcagaggcuaccugaacuaa

SEQ ID NO: 24261 - RNA, 1389 nt, Artificial Sequence
  SUV420H2__Homo_sapiens__NP_116090
augggccccgacagagugaccgccagagagcugugcgagaacgacgaccuggccaccagccuggugcuggaccccuaccugggcuucagaacccacaagaugaacgugagccccgugcccccccugagaagacagcagcaccugagaagcgcccuggagaccuuccugagacagagagaccuggaggccgccuacagagcccugacccugggcggcuggaccgccagauacuuccagagcagaggccccagacaggaggccgcccugaagacccacguguacagauaccugagagccuuccugcccgagagcggcuucaccauccugcccugcaccagauacagcauggagaccaacggcgccaagaucgugagcaccagagccuggaagaagaacgagaagcuggagcugcuggugggcugcaucgccgagcugagagaggccgacgagggccugcugagagccggcgagaacgacuucagcaucauguacagcaccagaaagagaagcgcccagcuguggcugggccccgccgccuucaucaaccacgacugcaagcccaacugcaaguucgugcccgccgacggcaacgccgccugcgugaaggugcugagagacaucgagcccggcgacgaggugaccugcuucuacggcgagggcuucuucggcgagaagaacgagcacugcgagugccacaccugcgagagaaagggcgagggcgccuucagaaccagacccagagagcccgcccugccccccagaccccuggacaaguaccagcugagagagaccaagagaagacugcagcagggccuggacagcggcagcagacagggccugcugggccccagagccugcgugcaccccagcccccugagaagagaccccuucugcgccgccugccagccccugagacugcccgccugcagcgccagacccgacaccagcccccuguggcugcaguggcugccccagccccagcccagagugagacccagaaagagaagaagacccagacccagaagagcccccgugcugagcacccaccacgccgccagagugagccugcacagauggggcggcugcggcccccacugcagacugagaggcgaggcccugguggcccugggccagcccccccacgccagaugggccccccagcaggacuggcacugggccagaagauacggccugcccuacguggugagaguggaccugagaagacuggcccccgccccccccgccacccccgcccccgccggcacccccggccccauccugauccccaagcaggcccuggccuucgcccccuucagcccccccaagagacugagacugguggugagccacggcagcaucgaccuggacgugggcggcgaggagcuguaa

SEQ ID NO: 24262 - RNA, 2220 nt, Artificial Sequence
  SUZ12__Homo_sapiens__NP_056170
auggccccccagaagcacggcggcggcggcggcggcggcagcggccccagcgccggcagcggcggcggcggcuucggcggcagcgccgccguggccgccgccaccgccagcggcggcaagagcggcggcggcagcugcggcggcggcggcagcuacagcgccagcagcagcagcagcgccgccgccgccgccggcgccgccgugcugcccgugaagaagcccaagauggagcacgugcaggccgaccacgagcuguuccugcaggccuucgagaagcccacccagaucuacagauuccugagaaccagaaaccugaucgcccccaucuuccugcacagaacccugaccuacaugagccacagaaacagcagaaccaacaucaagagaaagaccuucaagguggacgacaugcugagcaagguggagaagaugaagggcgagcaggagagccacagccugagcgcccaccugcagcugaccuucaccggcuucuuccacaagaacgacaagcccagccccaacagcgagaacgagcagaacagcgugacccuggaggugcugcuggugaaggugugccacaagaagagaaaggacgugagcugccccaucagacaggugcccaccggcaagaagcaggugccccugaaccccgaccugaaccagaccaagcccggcaacuuccccagccuggccgugagcagcaacgaguucgagcccagcaacagccacauggugaagagcuacagccugcuguucagagugaccagacccggcagaagagaguucaacggcaugaucaacggcgagaccaacgagaacaucgacgugaacgaggagcugcccgccagaagaaagagaaacagagaggacggcgagaagaccuucguggcccagaugaccguguucgacaagaacagaagacugcagcugcuggacggcgaguacgagguggccaugcaggagauggaggagugccccaucagcaagaagagagccaccugggagaccauccuggacggcaagagacugccccccuucgagaccuucagccagggccccacccugcaguucacccugagauggaccggcgagaccaacgacaagagcaccgcccccaucgccaagccccuggccaccagaaacagcgagagccugcaccaggagaacaagcccggcagcgugaagcccacccagaccaucgccgugaaggagagccugaccaccgaccugcagaccagaaaggagaaggacacccccaacgagaacagacagaagcugagaaucuucuaccaguuccuguacaacaacaacaccagacagcagaccgaggccagagacgaccugcacugccccuggugcacccugaacugcagaaagcuguacagccugcugaagcaccugaagcugugccacagcagauucaucuucaacuacguguaccaccccaagggcgccagaaucgacgugagcaucaacgagugcuacgacggcagcuacgccggcaacccccaggacauccacagacagcccggcuucgccuucagcagaaacggccccgugaagagaacccccaucacccacauccuggugugcagacccaagagaaccaaggccagcaugagcgaguuccuggagagcgaggacggcgagguggagcagcagagaaccuacagcagcggccacaacagacuguacuuccacagcgacaccugccugccccugagaccccaggagauggagguggacagcgaggacgagaaggaccccgaguggcugagagagaagaccaucacccagaucgaggaguucagcgacgugaacgagggcgagaaggaggugaugaagcuguggaaccugcacgugaugaagcacggcuucaucgccgacaaccagaugaaccacgccugcaugcuguucguggagaacuacggccagaagaucaucaagaagaaccugugcagaaacuucaugcugcaccuggugagcaugcacgacuucaaccugaucagcaucaugagcaucgacaaggccgugaccaagcugagagagaugcagcagaagcuggagaagggcgagagcgccagccccgccaacgaggagaucaccgaggagcagaacggcaccgccaacggcuucagcgagaucaacagcaaggagaaggcccuggagaccgacagcgugagcggcgugagcaagcagagcaagaagcagaagcuguaa

SEQ ID NO: 24263 - RNA, 2052 nt, Artificial Sequence
  SV2B__Homo_sapiens__NP_055663
auggacgacuacaaguaccaggacaacuacggcggcuacgcccccagcgacggcuacuacagaggcaacgagagcaaccccgaggaggacgcccagagcgacgugaccgagggccacgacgaggaggacgagaucuacgagggcgaguaccagggcaucccccaccccgacgacgugaaggccaagcaggccaagauggcccccagcagaauggacagccugagaggccagaccgaccugauggccgagagacuggaggacgaggagcagcuggcccaccaguacgagaccaucauggacgagugcggccacggcagauuccaguggauccuguucuucgugcugggccuggcccugauggccgacggcguggagguguucguggugagcuucgcccugcccagcgccgagaaggacaugugccugagcagcagcaagaagggcaugcugggcaugaucguguaccugggcaugauggccggcgccuucauccugggcggccuggccgacaagcugggcagaaagagagugcugagcaugagccuggccgugaacgccagcuucgccagccugagcagcuucgugcagggcuacggcgccuuccuguucugcagacugaucagcggcaucggcaucggcggcgcccugcccaucguguucgccuacuucagcgaguuccugagcagagagaagagaggcgagcaccugagcuggcugggcaucuucuggaugaccggcggccuguacgccagcgccauggccuggagcaucaucccccacuacggcuggggcuucagcaugggcaccaacuaccacuuccacagcuggagaguguucgugaucgugugcgcccugcccugcaccgugagcaugguggcccugaaguucaugcccgagagccccagauuccugcuggagaugggcaagcacgacgaggccuggaugauccugaagcaggugcacgacaccaacaugagagccaagggcacccccgagaagguguucaccgugagcaacaucaagacccccaagcagauggacgaguucaucgagauccagagcagcaccggcaccugguaccagagauggcuggugagauucaagaccaucuucaagcaggugugggacaacgcccuguacugcgugaugggccccuacagaaugaacacccugauccuggccguggugugguucgccauggccuucagcuacuacggccugaccgugugguuccccgacaugaucagauacuuccaggacgaggaguacaagagcaagaugaagguguucuucggcgagcacguguacggcgccaccaucaacuucaccauggagaaccagauccaccagcacggcaagcuggugaacgacaaguucaccagaauguacuucaagcacgugcuguucgaggacaccuucuucgacgagugcuacuucgaggacgugaccagcaccgacaccuacuucaagaacugcaccaucgagagcaccaucuucuacaacaccgaccuguacgagcacaaguucaucaacugcagauucaucaacagcaccuuccuggagcagaaggagggcugccacauggaccuggagcaggacaacgacuuccugaucuaccuggugagcuuccugggcagccugagcgugcugcccggcaacaucaucagcgcccugcugauggacagaaucggcagacugaagaugaucggcggcagcaugcugaucagcgccgugugcugcuucuuccuguucuucggcaacagcgagagcgccaugaucggcuggcagugccuguucugcggcaccagcaucgccgccuggaacgcccuggacgugaucaccguggagcuguaccccaccaaccagagagccaccgccuucggcauccugaacggccugugcaaguucggcgccauccugggcaacaccaucuucgccagcuucgugggcaucaccaagguggugcccauccugcuggccgccgccagccuggugggcggcggccugaucgcccugagacugcccgagaccagagagcaggugcugauguaa

SEQ ID NO: 24264 - RNA, 2031 nt, Artificial Sequence
  SV2C__Homo_sapiens__NP_001284645
auggaggacagcuacaaggacagaaccagccugaugaagggcgccaaggacaucgccagagaggugaagaagcagaccgugaagaaggugaaccaggccguggacagagcccaggacgaguacacccagagaagcuacagcagauuccaggacgaggaggacgacgacgacuacuaccccgccggcgagaccuacaacggcgaggccaacgacgacgagggcagcagcgaggccaccgagggccacgacgaggacgacgagaucuacgagggcgaguaccagggcauccccagcaugaaccaggccaaggacagcaucgugagcgugggccagcccaagggcgacgaguacaaggacagaagagagcuggagagcgagagaagagccgacgaggaggagcuggcccagcaguacgagcugaucauccaggagugcggccacggcagauuccagugggcccuguucuucgugcugggcauggcccugauggccgacggcguggagguguucguggugggcuucgugcugcccagcgccgagaccgaccugugcauccccaacagcggcagcggcuggcugggcagcaucguguaccugggcaugauggugggcgccuucuucuggggcggccuggccgacaaggugggcagaaagcagagccugcugaucugcaugagcgugaacggcuucuucgccuuccugagcagcuucgugcagggcuacggcuucuuccuguucugcagacugcugagcggcuucggcaucggcggcgccauccccaccguguucagcuacuucgccgaggugcuggccagagagaagagaggcgagcaccugagcuggcugugcauguucuggaugaucggcggcaucuacgccagcgccauggccugggccaucaucccccacuacggcuggagcuucagcaugggcagcgccuaccaguuccacagcuggagaguguucgugaucgugugcgcccugcccugcgugagcagcgugguggcccugaccuucaugcccgagagccccagauuccugcuggaggugggcaagcacgacgaggccuggaugauccugaagcugauccacgacaccaacaugagagccagaggccagcccgagaagguguucaccgugaacaagaucaagacccccaagcagaucgacgagcugaucgagaucgagagcgacaccggcaccugguacagaagaugcuucgugagaaucagaaccgagcuguacggcaucuggcugaccuucaugagaugcuucaacuaccccgugagagacaacaccaucaagcugaccaucgugugguucacccugagcuucggcuacuacggccugagcgugugguuccccgacgugaucaagccccugcagagcgacgaguacgcccugcugaccagaaacguggagagagacaaguacgccaacuucaccaucaacuucaccauggagaaccagauccacaccggcauggaguacgacaacggcagauucaucggcgugaaguucaagagcgugaccuucaaggacagcguguucaagagcugcaccuucgaggacgugaccagcgugaacaccuacuucaagaacugcaccuucaucgacaccguguucgacaacaccgacuucgagcccuacaaguucaucgacagcgaguucaagaacugcagcuucuuccacaacaagaccggcugccagaucaccuucgacgacgacuacagcgccuacuggaucuacuucgugaacuuccugggcacccuggccgugcugcccggcaacaucgugagcgcccugcugauggacagaaucggcagacugaccaugcugggcggcagcauggugcugagcggcaucagcugcuucuuccugugguucggcaccagcgagagcaugaugaucggcaugcugugccuguacaacggccugaccaucagcgccuggaacagccuggacguggugaccguggagcuguaccccaccgacagaagaagaagagugcugcccugcugccccggcuaa

SEQ ID NO: 24265 - RNA, 10716 nt, Artificial Sequence
  SVEP1__Homo_sapiens__NP_699197
auguggcccagacuggccuucugcugcuggggccuggcccuggugagcggcugggccaccuuccagcagaugagccccagcagaaacuucagcuucagacuguuccccgagaccgcccccggcgcccccggcagcauccccgccccccccgcccccggcgacgaggccgccggcagcagaguggagagacugggccaggccuucagaagaagagugagacugcugagagagcugagcgagagacuggagcugguguuccugguggacgacagcagcagcgugggcgaggugaacuucagaagcgagcugauguucgugagaaagcugcugagcgacuuccccguggugcccaccgccaccagaguggccaucgugaccuucagcagcaagaacuacguggugcccagaguggacuacaucagcaccagaagagccagacagcacaagugcgcccugcugcugcaggagauccccgccaucagcuacagaggcggcggcaccuacaccaagggcgccuuccagcaggccgcccagauccugcugcacgccagagagaacagcaccaaggugguguuccugaucaccgacggcuacagcaacggcggcgaccccagacccaucgccgccagccugagagacagcggcguggagaucuucaccuucggcaucuggcagggcaacaucagagagcugaacgacauggccagcacccccaaggaggagcacugcuaccugcugcacagcuucgaggaguucgaggcccuggccagaagagcccugcacgaggaccugcccagcggcagcuucauccaggacgacauggugcacugcagcuaccugugcgacgagggcaaggacugcugcgacagaaugggcagcugcaagugcggcacccacaccggccacuucgagugcaucugcgagaagggcuacuacggcaagggccugcaguacgagugcaccgccugccccagcggcaccuacaagcccgagggcagccccggcggcaucagcagcugcauccccugccccgacgagaaccacaccagcccccccggcagcaccagccccgaggacugcgugugcagagagggcuacagagccagcggccagaccugcgagcuggugcacugccccgcccugaagccccccgagaacggcuacuucauccagaacaccugcaacaaccacuucaacgccgccugcggcgugagaugccaccccggcuucgaccuggugggcagcagcaucauccugugccugcccaacggccuguggagcggcagcgagagcuacugcagagugagaaccugcccccaccugagacagcccaagcacggccacaucagcugcagcaccagagagaugcuguacaagaccaccugccugguggccugcgacgagggcuacagacuggagggcagcgacaagcugaccugccagggcaacagccagugggacggccccgagcccagaugcguggagagacacugcagcaccuuccagaugcccaaggacgugaucaucagcccccacaacugcggcaagcagcccgccaaguucggcaccaucugcuacgugagcugcagacagggcuucauccugagcggcgugaaggagaugcugagaugcaccaccagcggcaaguggaacgugggcgugcaggccgccgugugcaaggacguggaggccccccagaucaacugccccaaggacaucgaggccaagacccuggagcagcaggacagcgccaacgugaccuggcagauccccaccgccaaggacaacagcggcgagaaggugagcgugcacgugcaccccgccuucaccccccccuaccuguuccccaucggcgacguggccaucguguacaccgccaccgaccugagcggcaaccaggccagcugcaucuuccacaucaaggugaucgacgccgagccccccgugaucgacuggugcagaagccccccccccgugcaggugagcgagaaggugcacgccgccagcugggacgagccccaguucagcgacaacagcggcgccgagcuggugaucaccagaagccacacccagggcgaccuguucccccagggcgagaccaucgugcaguacaccgccaccgaccccagcggcaacaacagaaccugcgacauccacaucgugaucaagggcagccccugcgagauccccuucacccccgugaacggcgacuucaucugcacccccgacaacaccggcgugaacugcacccugaccugccuggagggcuacgacuucaccgagggcagcaccgacaaguacuacugcgccuacgaggacggcguguggaagcccaccuacaccaccgaguggcccgacugcgccaagaagagauucgccaaccacggcuucaagagcuucgagauguucuacaaggccgccagaugcgacgacaccgaccugaugaagaaguucagcgaggccuucgagaccacccugggcaagauggugcccagcuucugcagcgacgccgaggacaucgacugcagacuggaggagaaccugaccaagaaguacugccuggaguacaacuacgacuacgagaacggcuucgccaucggccccggcggcuggggcgccgccaacagacuggacuacagcuacgacgacuuccuggacaccgugcaggagaccgccaccagcaucggcaacgccaagagcagcagaaucaagagaagcgccccccugagcgacuacaagaucaagcugaucuucaacaucaccgccagcgugccccugcccgacgagagaaacgacacccuggagugggagaaccagcagagacugcugcagacccuggagaccaucaccaacaagcugaagagaacccugaacaaggaccccauguacagcuuccagcuggccagcgagauccugaucgccgacagcaacagccuggagaccaagaaggccagccccuucugcagacccggcagcgugcugagaggcagaaugugcgugaacugcccccugggcaccuacuacaaccuggagcacuucaccugcgagagcugcagaaucggcagcuaccaggacgaggagggccagcuggagugcaagcugugccccagcggcauguacaccgaguacauccacagcagaaacaucagcgacugcaaggcccagugcaagcagggcaccuacagcuacagcggccuggagaccugcgagagcugcccccugggcaccuaccagcccaaguucggcagcagaagcugccugagcugccccgagaacaccagcaccgugaagagaggcgccgugaacaucagcgccugcggcgugcccugccccgagggcaaguucagcagaagcggccugaugcccugccaccccugccccagagacuacuaccagcccaacgccggcaaggccuucugccuggccugccccuucuacggcaccacccccuucgccggcagcagaagcaucaccgagugcagcagcuucagcagcaccuucagcgccgccgaggagagcguggugccccccgccagccugggccacaucaagaagagacacgagaucagcagccagguguuccacgagugcuucuucaaccccugccacaacagcggcaccugccagcagcugggcagaggcuacgugugccugugcccccugggcuacaccggccugaagugcgagaccgacaucgacgagugcagcccccugcccugccugaacaacggcgugugcaaggaccuggugggcgaguucaucugcgagugccccagcggcuacaccggccagagaugcgaggagaacaucaacgagugcagcagcagccccugccugaacaagggcaucugcguggacggcguggccggcuacagaugcaccugcgugaagggcuucgugggccugcacugcgagaccgaggugaacgagugccagagcaaccccugccugaacaacgccgugugcgaggaccaggugggcggcuuccugugcaagugcccccccggcuuccugggcaccagaugcggcaagaacguggacgagugccugagccagcccugcaagaacggcgccaccugcaaggacggcgccaacagcuucagaugccugugcgccgccggcuucaccggcagccacugcgagcugaacaucaacgagugccagagcaaccccugcagaaaccaggccaccugcguggacgagcugaacagcuacagcugcaagugccagcccggcuucagcggcaagagaugcgagaccgagcagagcaccggcuucaaccuggacuucgaggugagcggcaucuacggcuacgugaugcuggacggcaugcugcccagccugcacgcccugaccugcaccuucuggaugaagagcagcgacgacaugaacuacggcacccccaucagcuacgccguggacaacggcagcgacaacacccugcugcugaccgacuacaacggcugggugcuguacgugaacggcagagagaagaucaccaacugccccagcgugaacgacggcagauggcaccacaucgccaucaccuggaccagcgccaacggcaucuggaagguguacaucgacggcaagcugagcgacggcggcgccggccugagcgugggccugcccauccccggcggcggcgcccuggugcugggccaggagcaggacaagaagggcgagggcuucagccccgccgagagcuucgugggcagcaucagccagcugaaccugugggacuacgugcugagcccccagcaggugaagagccuggccaccagcugccccgaggagcugagcaagggcaacgugcuggccuggcccgacuuccugagcggcaucgugggcaaggugaagaucgacagcaagagcaucuucugcagcgacugccccagacugggcggcagcgugccccaccugagaaccgccagcgaggaccugaagcccggcagcaaggugaaccuguucugcgaccccggcuuccagcuggugggcaaccccgugcaguacugccugaaccagggccaguggacccagccccugccccacugcgagagaaucagcugcggcgugccccccccccuggagaacggcuuccacagcgccgacgacuucuacgccggcagcaccgugaccuaccagugcaacaacggcuacuaccugcugggcgacagcagaauguucugcaccgacaacggcagcuggaacggcgugagccccagcugccuggacguggacgagugcgccgugggcagcgacugcagcgagcacgccagcugccugaacguggacggcagcuacaucugcagcugcgugccccccuacaccggcgacggcaagaacugcgccgagcccaucaagugcaaggcccccggcaaccccgagaacggccacagcagcggcgagaucuacaccgugggcgccgaggugaccuucagcugccaggagggcuaccagcugaugggcgugaccaagaucaccugccuggagagcggcgaguggaaccaccugauccccuacugcaaggccgugagcugcggcaagcccgccauccccgagaacggcugcaucgaggagcuggccuucaccuucggcagcaaggugaccuacagaugcaacaagggcuacacccuggccggcgacaaggagagcagcugccuggccaacagcagcuggagccacagcccccccgugugcgagcccgugaagugcagcagccccgagaacaucaacaacggcaaguacauccugagcggccugaccuaccugagcaccgccagcuacagcugcgacaccggcuacagccugcagggccccagcaucaucgagugcaccgccagcggcaucugggacagagccccccccgccugccaccugguguucugcggcgagccccccgccaucaaggacgccgugaucaccggcaacaacuucaccuucagaaacaccgugaccuacaccugcaaggagggcuacacccuggccggccuggacaccaucgagugccuggccgacggcaaguggagcagaagcgaccagcagugccuggccgugagcugcgacgagccccccaucguggaccacgccagccccgagaccgcccacagacuguucggcgacaucgccuucuacuacugcagcgacggcuacagccuggccgacaacagccagcugcugugcaacgcccagggcaagugggugccccccgagggccaggacaugcccagaugcaucgcccacuucugcgagaagccccccagcgugagcuacagcauccuggagagcgugagcaaggccaaguucgccgccggcagcguggugagcuucaagugcauggagggcuucgugcugaacaccagcgccaagaucgagugcaugagaggcggccaguggaaccccagccccaugagcauccagugcauccccgugagaugcggcgagccccccagcaucaugaacggcuacgccagcggcagcaacuacagcuucggcgccaugguggccuacagcugcaacaagggcuucuacaucaagggcgagaagaagagcaccugcgaggccaccggccaguggagcagccccauccccaccugccaccccgugagcugcggcgagccccccaagguggagaacggcuuccuggagcacaccaccggcagaaucuucgagagcgaggugagauaccagugcaaccccggcuacaagagcgugggcagccccguguucgugugccaggccaacagacacuggcacagcgagagcccccugaugugcgugccccuggacugcggcaagcccccccccauccagaacggcuucaugaagggcgagaacuucgaggugggcagcaaggugcaguucuucugcaacgagggcuacgagcuggugggcgacagcagcuggaccugccagaagagcggcaaguggaacaagaagagcaaccccaagugcaugcccgccaagugccccgagcccccccugcuggagaaccagcuggugcugaaggagcugaccaccgaggugggcguggugaccuucagcugcaaggagggccacgugcugcagggccccagcgugcugaagugccugcccagccagcaguggaacgacagcuuccccgugugcaagaucgugcugugcaccccccccccccugaucagcuucggcgugcccauccccagcagcgcccugcacuucggcagcaccgugaaguacagcugcgugggcggcuucuuccugagaggcaacagcaccacccugugccagcccgacggcaccuggagcagcccccugcccgagugcgugcccguggagugcccccagcccgaggagauccccaacggcaucaucgacgugcagggccuggccuaccugagcaccgcccuguacaccugcaagcccggcuucgagcuggugggcaacaccaccacccugugcggcgagaacggccacuggcugggcggcaagcccaccugcaaggccaucgagugccugaagcccaaggagauccugaacggcaaguucagcuacaccgaccugcacuacggccagaccgugaccuacagcugcaacagaggcuucagacuggagggccccagcgcccugaccugccuggagaccggcgacugggacguggacgcccccagcugcaacgccauccacugcgacagcccccagcccaucgagaacggcuucguggagggcgccgacuacagcuacggcgccaucaucaucuacagcugcuuccccggcuuccagguggccggccacgccaugcagaccugcgaggagagcggcuggagcagcagcauccccaccugcaugcccaucgacugcggccugcccccccacaucgacuucggcgacugcaccaagcugaaggacgaccagggcuacuucgagcaggaggacgacaugauggaggugcccuacgugaccccccacccccccuaccaccugggcgccguggccaagaccugggagaacaccaaggagagccccgccacccacagcagcaacuuccuguacggcaccauggugagcuacaccugcaaccccggcuacgagcugcugggcaaccccgugcugaucugccaggaggacggcaccuggaacggcagcgcccccagcugcaucagcaucgagugcgaccugcccaccgcccccgagaacggcuuccugagauucaccgagaccagcaugggcagcgccgugcaguacagcugcaagcccggccacauccuggccggcagcgaccugagacugugccuggagaacagaaaguggagcggcgccagccccagaugcgaggccaucagcugcaagaagcccaaccccgugaugaacggcagcaucaagggcagcaacuacaccuaccugagcacccuguacuacgagugcgaccccggcuacgugcugaacggcaccgagagaagaaccugccaggacgacaagaacugggacgaggacgagcccaucugcauccccguggacugcagcagcccccccgugagcgccaacggccaggugagaggcgacgaguacaccuuccagaaggagaucgaguacaccugcaacgagggcuuccugcuggagggcgccagaagcagagugugccuggccaacggcagcuggagcggcgccacccccgacugcgugcccgugagaugcgccacccccccccagcuggccaacggcgugaccgagggccuggacuacggcuucaugaaggaggugaccuuccacugccacgagggcuacauccugcacggcgcccccaagcugaccugccagagcgacggcaacugggacgccgagaucccccugugcaagcccgugaacugcggcccccccgaggaccuggcccacggcuuccccaacggcuucagcuucauccacggcggccacauccaguaccagugcuuccccggcuacaagcugcacggcaacagcagcagaagaugccugagcaacggcagcuggagcggcagcagccccagcugccugcccugcagaugcagcacccccgugaucgaguacggcaccgugaacggcaccgacuucgacugcggcaaggccgccagaauccagugcuucaagggcuucaagcugcugggccugagcgagaucaccugcgaggccgacggccaguggagcagcggcuucccccacugcgagcacaccagcugcggcagccugcccaugauccccaacgccuucaucagcgagaccagcagcuggaaggagaacgugaucaccuacagcugcagaagcggcuacgugauccagggcagcagcgaccugaucugcaccgagaagggcguguggagccagcccuaccccgugugcgagccccugagcugcggcagcccccccagcguggccaacgccguggccaccggcgaggcccacaccuacgagagcgaggugaagcugagaugccuggagggcuacaccauggacaccgacaccgacaccuucaccugccagaaggacggcagaugguuccccgagagaaucagcugcagccccaagaagugcccccugcccgagaacaucacccacauccuggugcacggcgacgacuucagcgugaacagacaggugagcgugagcugcgccgagggcuacaccuucgagggcgugaacaucagcgugugccagcuggacggcaccugggagccccccuucagcgacgagagcugcagccccgugagcugcggcaagcccgagagccccgagcacggcuucguggugggcagcaaguacaccuucgagagcaccaucaucuaccagugcgagcccggcuacgagcuggagggcaacagagagagagugugccaggagaacagacaguggagcggcggcguggccaucugcaaggagaccagaugcgagaccccccuggaguuccugaacggcaaggccgacaucgagaacagaaccaccggccccaacgugguguacagcugcaacagaggcuacagccuggagggccccagcgaggcccacugcaccgagaacggcaccuggagccaccccgugccccugugcaagcccaaccccugccccgugcccuucgugauccccgagaacgcccugcugagcgagaaggaguucuacguggaccagaacgugagcaucaagugcagagagggcuuccugcugcagggccacggcaucaucaccugcaaccccgacgagaccuggacccagaccagcgccaagugcgagaagaucagcugcggcccccccgcccacguggagaacgccaucgccagaggcgugcacuaccaguacggcgacaugaucaccuacagcugcuacagcggcuacaugcuggagggcuuccugagaagcgugugccuggagaacggcaccuggaccagcccccccaucugcagagccgugugcagauuccccugccagaacggcggcaucugccagagacccaacgccugcagcugccccgagggcuggaugggcagacugugcgaggagcccaucugcauccugcccugccugaacggcggcagaugcguggcccccuaccagugcgacugcccccccggcuggaccggcagcagaugccacaccgccgugugccagagccccugccugaacggcggcaagugcgugagacccaacagaugccacugccugagcagcuggaccggccacaacugcagcagaaagagaagaaccggcuucuaa

SEQ ID NO: 24266 - RNA, 5367 nt, Artificial Sequence
  SVIL__Homo_sapiens__NP_003165
augaagagaaaggagagaaucgccagaagacuggagggcaucgagaacgacacccagcccauccugcugcagagcugcaccggccuggugacccacagacugcuggaggaggacacccccagauacaugagagccagcgaccccgccagcccccacaucggcagaagcaacgaggaggaggagaccagcgacagcagccuggagaagcagaccagaagcaaguacugcaccgagaccagcggcgugcacggcgacagccccuacggcagcggcaccauggacacccacagccuggagagcaaggccgagagaaucgccagauacaaggccgagagaagaagacagcuggccgagaaguacggccugacccuggaccccgaggccgacagcgaguaccugagcagauacaccaagagcagaaaggagcccgacgccguggagaagagaggcggcaagagcgacaagcaggaggagagcagcagagacgccagcagccuguaccccggcaccgagaccaugggccugagaaccugcgccggcgagagcaaggacuacgcccugcacgugggcgacggcagcagcgaccccgaggugcugcugaacaucgagaaccagagaagaggccaggagcugagcgccaccagacaggcccacgaccugagccccgccgccgagagcagcagcaccuucagcuucagcggcagagacagcagcuucaccgaggugcccagaagccccaagcacgcccacagcagcagccugcagcaggccgccagcagaagccccagcuucggcgacccccagcugagccccgaggccagacccagaugcaccagccacagcgagacccccaccguggacgacgaggagaagguggacgagagagccaagcugagcguggccgccaagagacugcuguucagagagauggagaagagcuucgacgagcagaacgugcccaagagaagaagcagaaacaccgccguggagcagagacugagaagacugcaggacagaagccugacccagcccaucaccaccgaggagguggugaucgccgccacccugcaggccagcgcccaccagaaggcccuggccaaggaccagaccaacgagggcaaggagcuggccgagcagggcgagcccgacagcagcacccugagccuggccgagaagcuggcccuguucaacaagcugagccagcccgugagcaaggccaucagcaccagaaacagaaucgacaccagacagagaagaaugaacgccagauaccagacccagcccgugacccugggcgagguggagcaggugcagagcggcaagcugauccccuucagccccgccgugaacaccagcgugagcaccguggccagcaccguggcccccauguacgccggcgaccugagaaccaagcccccccuggaccacaacgccagcgccaccgacuacaaguucagcagcagcaucgagaacagcgacagccccgugagaagcauccugaagagccaggccuggcagccccugguggagggcagcgagaacaagggcaugcugagagaguacggcgagaccgagagcaagagagcccugaccggcagagacagcggcauggagaaguacggcagcuucgaggaggccgaggccagcuaccccauccugaacagagccagagagggcgacagccacaaggagagcaaguacgccgugcccagaagaggcagccuggagagagccaacccccccaucacccaccugggcgacgagcccaaggaguucagcauggccaagaugaacgcccagggcaaccuggaccugagagacagacugcccuucgaggagaagguggagguggagaacgugaugaagagaaaguucagccugagagccgccgaguucggcgagcccaccagcgagcagaccggcaccgccgccggcaagaccaucgcccagaccaccgcccccgugagcuggaagccccaggacagcagcgagcagccccaggagaagcugugcaagaaccccugcgccauguucgccgccggcgagaucaagacccccaccggcgagggccugcuggacagccccagcaagaccaugagcaucaaggagagacuggcccugcugaagaagagcggcgaggaggacuggagaaacagacugagcagaagacaggagggcggcaaggcccccgccagcagccugcacacccaggaggccggcagaagccugaucaagaagagagugaccgagagcagagagagccagaugaccaucgaggagagaaagcagcugaucaccgugagagaggaggccuggaagaccagaggcagaggcgccgccaacgacagcacccaguucaccguggccggcagaauggugaagaagggccuggccagccccaccgccaucacccccguggccagccccaucugcggcaagaccagaggcaccacccccgugagcaagccccuggaggacaucgaggccagacccgacaugcagcuggagagcgaccugaagcuggacagacuggagaccuuccugagaagacugaacaacaaggugggcggcaugcacgagaccgugcugaccgugaccggcaagagcgugaaggaggugaugaagcccgacgacgacgagaccuucgccaaguucuacagaagcguggacuacaacaugcccagaagccccguggagauggacgaggacuucgacgugaucuucgaccccuacgcccccaagcugaccagcagcguggccgagcacaagagagccgugagacccaagagaagagugcaggccagcaagaacccccugaagaugcuggccgccagagaggaccugcugcaggaguacaccgagcagagacugaacguggccuucauggagagcaagagaaugaagguggagaagaugagcagcaacagcaacuucagcgaggugacccuggccggccuggccagcaaggagaacuucagcaacgugagccugagaagcgugaaccugaccgagcagaacagcaacaacagcgccgugcccuacaagagacugaugcugcugcagaucaagggcagaagacacgugcagaccagacugguggagcccagagccagcgcccugaacagcggcgacugcuuccugcugcugagcccccacugcugcuuccugugggugggcgaguucgccaacgugaucgagaaggccaaggccagcgagcuggccacccugauccagaccaagagagagcugggcugcagagccaccuacauccagaccaucgaggagggcaucaacacccacacccacgccgccaaggacuucuggaagcugcugggcggccagaccagcuaccagagcgccggcgaccccaaggaggacgagcuguacgaggccgccaucaucgagaccaacugcaucuacagacugauggacgacaagcuggugcccgacgacgacuacuggggcaagauccccaagugcagccugcugcagcccaaggaggugcugguguucgacuucggcagcgagguguacguguggcacggcaaggaggugacccuggcccagagaaagaucgccuuccagcuggccaagcaccuguggaacggcaccuucgacuacgagaacugcgacaucaacccccuggaccccggcgagugcaacccccugauccccagaaagggccagggcagacccgacugggccaucuucggcagacugaccgagcacaacgagaccauccuguucaaggagaaguuccuggacuggaccgagcugaagagaagcaacgagaagaaccccggcgagcuggcccagcacaaggaggaccccagaaccgacgugaaggccuacgacgugaccagaauggugagcaugccccagaccaccgccggcaccauccuggacggcgugaacgugggcagaggcuacggccugguggagggccacgacagaagacaguucgagaucaccagcgugagcguggacguguggcacauccuggaguucgacuacagcagacugcccaagcagagcaucggccaguuccacgagggcgacgccuacguggugaaguggaaguucauggugagcaccgccgugggcagcagacagaagggcgagcacagcgugagagccgccggcaaggagaagugcguguacuucuucuggcagggcagacacagcaccgugagcgagaagggcaccagcgcccugaugaccguggagcuggacgaggagagaggcgcccaggugcaggugcugcagggcaaggagccccccugcuuccugcagugcuuccagggcggcaugguggugcacagcggcagaagagaggaggaggaggagaacgugcagagcgaguggagacuguacugcgugagaggcgaggugcccguggagggcaaccugcuggagguggccugccacugcagcagccugagaagcagaaccagcaugguggugcugaacgugaacaaggcccugaucuaccuguggcacggcugcaaggcccaggcccacaccaaggaggugggcagaaccgccgccaacaagaucaaggagcagugcccccuggaggccggccugcacagcagcagcaaggugaccauccacgagugcgacgagggcagcgagccccugggcuucugggacgcccugggcagaagagacagaaaggccuacgacugcaugcugcaggaccccggcagcuucaacuucgcccccagacuguucauccugagcagcagcagcggcgacuucgccgccaccgaguucguguaccccgccagagcccccagcguggugagcagcaugcccuuccugcaggaggaccuguacagcgccccccagcccgcccuguuccugguggacaaccaccacgagguguaccuguggcagggcugguggcccaucgagaacaagaucaccggcagcgccagaaucagaugggccagcgacagaaagagcgccauggagaccgugcugcaguacugcaagggcaagaaccugaagaagcccgcccccaagagcuaccugauccacgccggccuggagccccugaccuucaccaacauguuccccagcugggagcacagagaggacaucgccgagaucaccgagauggacaccgaggugagcaaccagaucacccugguggaggacgugcuggccaagcugugcaagaccaucuacccccuggccgaccugcuggccagaccccugcccgagggcguggacccccugaagcuggagaucuaccugaccgacgaggacuucgaguucgcccuggacaugaccagagacgaguacaacgcccugcccgccuggaagcaggugaaccugaagaaggccaagggccuguucuaa

SEQ ID NO: 24267 - RNA, 234 nt, Artificial Sequence
  SVIP__Homo_sapiens__NP_683691
augggccugugcuuccccugccccggcgagagcgccccccccacccccgaccuggaggagaagagagccaagcuggccgaggccgccgagagaagacagaaggaggccgccagcagaggcauccuggacgugcagagcgugcaggagaagagaaagaagaaggagaagaucgagaagcagaucgccaccagcggccccccccccgagggcggccugagauggaccgugagcuaa

SEQ ID NO: 24268 - RNA, 1647 nt, Artificial Sequence
  SVOP__Homo_sapiens__NP_061181
auggaggaggaccuguuccagcugagacagcugcccguggugaaguucagaagaaccggcgagagcgccagaagcgaggacgacaccgccagcggcgagcacgaggugcagaucgagggcgugcacgugggccuggaggccguggagcuggacgacggcgccgccgugcccaaggaguucgccaaccccaccgacgacaccuucaugguggaggacgccguggaggccaucggcuucggcaaguuccaguggaagcugagcgugcugaccggccuggccuggauggccgacgccauggagaugaugauccugagcauccuggccccccagcugcacugcgaguggagacugcccagcuggcagguggcccugcugaccagcgugguguucgugggcaugaugagcagcagcacccuguggggcaacaucagcgaccaguacggcagaaagaccggccugaagaucagcgugcuguggacccuguacuacggcauccugagcgccuucgcccccguguacagcuggauccuggugcugagaggccuggugggcuucggcaucggcggcgugccccagagcgugacccuguacgccgaguuccugcccaugaaggccagagccaagugcauccugcugaucgagguguucugggccaucggcaccguguucgagguggugcuggccguguucgugaugcccagccugggcuggagauggcugcugauccugagcgccgugccccugcugcuguucgccgugcugugcuucuggcugcccgagagcgccagauacgacgugcugagcggcaaccaggagaaggccaucgccacccugaagagaaucgccaccgagaacggcgcccccaugccccugggcaagcugaucaucagcagacaggaggacagaggcaagaugagagaccuguucaccccccacuucagauggaccacccugcugcugugguucaucugguucagcaacgccuucagcuacuacggccuggugcugcugaccaccgagcuguuccaggccggcgacgugugcggcaucagcagcagaaagaaggccguggaggccaagugcagccuggccugcgaguaccugagcgaggaggacuacauggaccugcuguggaccacccugagcgaguuccccggcgugcuggugacccuguggaucaucgacagacugggcagaaagaagaccauggcccugugcuucgugaucuucagcuucugcagccugcugcuguucaucugcgugggcagaaacgugcugacccugcugcuguucaucgccagagccuucaucagcggcggcuuccaggccgccuacguguacacccccgagguguaccccaccgccaccagagcccugggccugggcaccugcagcggcauggccagagugggcgcccugaucacccccuucaucgcccaggugaugcuggagagcagcguguaccugacccuggccguguacagcggcugcugccugcuggccgcccuggccagcugcuuccugcccaucgagaccaagggcagaggccugcaggagagcagccacagagaguggggccaggagauggugggcagaggcaugcacggcgccggcgugaccagaagcaacagcggcagccaggaguaa

SEQ ID NO: 24269 - RNA, 1758 nt, Artificial Sequence
  SWAP70__Homo_sapiens__NP_055870
augggcagccugaaggaggagcugcugaaggccaucuggcacgccuucaccgcccuggaccaggaccacagcggcaaggugagcaagagccagcugaaggugcugagccacaaccugugcaccgugcugaaggugccccacgaccccguggcccuggaggagcacuucagagacgacgacgagggccccgugagcaaccagggcuacaugcccuaccugaacagauucauccuggagaaggugcaggacaacuucgacaagaucgaguucaacagaaugugcuggacccugugcgugaagaagaaccugaccaagaacccccugcugaucaccgaggaggacgccuucaagaucugggugaucuucaacuuccugagcgaggacaaguacccccugaucaucgugagcgaggagaucgaguaccugcugaagaagcugaccgaggccaugggcggcggcuggcagcaggagcaguucgagcacuacaagaucaacuucgacgacagcaagaacggccugagcgccugggagcugaucgagcugaucggcaacggccaguucagcaagggcauggacagacagaccgugagcauggccaucaacgagguguucaacgagcugauccuggacgugcugaagcagggcuacaugaugaagaagggccacagaagaaagaacuggaccgagagaugguucgugcugaagcccaacaucaucagcuacuacgugagcgaggaccugaaggacaagaagggcgacauccugcuggacgagaacugcugcguggagagccugcccgacaaggacggcaagaagugccuguuccuggugaagugcuucgacaagaccuucgagaucagcgccagcgacaagaagaagaagcaggaguggauccaggccauccacagcaccauccaccugcugaagcugggcagcccccccccccacaaggaggccagacagagaagaaaggagcugagaaagaagcagcuggccgagcaggaggagcuggagagacagaugaaggagcugcaggccgccaacgagagcaagcagcaggagcuggaggccgugagaaagaagcuggaggaggccgccagcagagccgccgaggaggagaagaagagacugcagacccagguggagcugcaggccagauucagcaccgagcuggagagagagaagcugaucagacagcagauggaggagcagguggcccagaagagcagcgagcuggagcaguaccugcagagagugagagagcuggaggacauguaccugaagcugcaggaggcccuggaggacgagagacaggccagacaggacgaggagaccgugagaaagcugcaggccagacugcuggaggaggagagcagcaagagagccgagcuggagaaguggcaccuggagcagcagcaggccauccagaccaccgaggccgagaagcaggagcuggagaaccagagagugcugaaggagcaggcccugcaggaggccauggagcagcuggagcagcuggagcuggagagaaagcaggcccuggagcaguacgaggaggugaagaagaagcuggagauggccaccaacaagaccaagagcuggaaggacaagguggcccaccacgagggccugaucagacugaucgagcccggcagcaagaacccccaccugaucaccaacuggggccccgccgccuucaccgaggccgagcuggaggagagagagaagaacuggaaggagaagaagaccaccgaguaa

SEQ ID NO: 24270 - RNA, 2703 nt, Artificial Sequence
  SWT1__Homo_sapiens__NP_060143
augagcagcaaggagagcugcggcaagaaggagaccagccagagaaaggacaccaccaccagcagccccaacuucggcgagaaggacaagaaggagagaaagacccccgccagcagcaccagcagcagcagcaucagaagcgugagcagcgagaagagaaagcugaagagcgaccacaccgacgugcuguacuacaacaucaagagaagacagggccugaagagacugagcguggagaucgacacccugagaagaagacccaagaucggcagcagcagccagagacccaucaagcugaaggaggccagcuacagcaacgacaaccagaucauccugcagagccccagcagcaacggcaccaagaaggacauccacaagugcguggacuucaagcccaaggacaucaagcugaccaacgccggcagcaagcuggaccacggcaucaagagccugagcagccccaagaucgccagcgacgugaagcccaaggccgagggccaggccagcgagaacaaguggagccaccugcuggugcagagagagaagaugaaggagcugaagaagggcagaaacagcaaguucagagacaacagcgagaagugcgugcuggagaaguggaagagaaaccaguucagccaggacuacaacagcaacaagaucaucaaggagccccugggcagcagaagacagaagaucagcuucaagauccccaucaagagcagagacacccugcagaagcugguggaggagaacguguucaacaucgacagcaacaacagcaagaccaagcaggaggagagagaguaccuggagagcagccaggugagccugaacgugaccagacagaagaccgagcaccugcugagcgacuucaccuacaagagaaccgugcacgaguggaagagaaagcaccacuacgaccaccaggagagcaacgacagccacagcagagagaaccugacccagagcuucgaggcccccugcugcagcgugagcagcgagagcauccaggacgccgaccaggagaugcagaucguggaggagcugcacgccgccagagugggcaagagcguggaccugcccggcgagcugaugagcauggagaucgaccuggaggacgacgugcacagcagcagcgccaacaacaccagcgacagaaagcugcugaucgugaucgacaccaacauccugaugaaccaccugaaguucgugagaauccugaagaccaccgaggugcccggcuucgacaagcuggugcugaucauccccuggguggugaugcaggagcuggacagaaugaaggagggcaagcugcugaagagagcccagcacaaggccauccccgccgugcacuucaucaacgacagccugaagaaccaggacagaaagcuguggggccagagcauccagcuggccagccagaagcacuacggccugagcgacgagaacaacgacgacagagugcugaagugcugccugcagcaccaggagcuguuccccugcagcuucgugauccugugcaccgacgacagaaaccugagaaacaagggccugaucagcggcgugaagagccugagcaaggaggagcugagcgccgagcugcugcaccugagccugaacaccgacgugugccaccagcccugcauccccaagcagcagcugaaggccgagaccaccccccugaaggagagcuacaaggaggagagcaccaacagcggccugagcauccugcuggagagcaucgugagcgaccuggagaagagccugggcaccggccugagcagcauccuggagaccgagaugaagaucgccuucggcaaccuguggauggagauccuguaccugaagccccccuggacccugcugcaccugcugcagugcuucaagaagcacuggcuggccguguucggccuggugauggagaagaaccugcugcugaccaucgagagccuguacaagaaccugagaaaggccaacaaggccguggacuucaccaccgugaaguuccugcugcaggacagcagaagccugcugcacgccuucagcaccagaagcaacuacgacggcauccugccccagaccuucgcccaggugaacaaccugcugcagaccuucgccgaggugaagaccaagcugaagcccaacagcagcgagaacaccgugaccaagaagcaggagggcaccagccugaagaacagccacaaccaggagaucaccguguucagcagcagccaccugccccagcccagcagacaccaggagaucuggagcauccuggagagcguguggaucaccaucuaccagaacagcaccgacguguuccagagacugggcagcaacagcgcccugaccaccagcaacaucgccagcuucgaggaggccuucaucugccugcagaagcugauggccgccgugagagacauccuggagggcauccagagaauccuggcccccaacagcaacuaccaggacguggagacccuguacaacuuccugaucaaguacgaggugaacaagaacgugaaguucaccgcccaggagaucuacgacugcgugagccagaccgaguacagagagaagcugaccaucggcugcagacagcugguggagauggaguacaccaugcagcagugcaacgccagcguguacauggaggccaagaacagaggcuggugcgaggacaugcugaacuacagaaucuaa

SEQ ID NO: 24271 - RNA, 1989 nt, Artificial Sequence
  SYBU__Homo_sapiens__NP_001093213
augggcccccugagagagagcaaggagcacagagugcagcaccacgacaaggagaucagcagaagcagaauccccagacugauccugagaccccacaugccccagcagcagcacaaggugagccccgccagcgagagccccuucagcgaggaggagagcagagaguucaaccccagcagcagcggcagaagcgccagaaccgugagcagcaacagcuucugcagcgacgacaccggcugccccagcagccagagcgugagccccgugaagacccccagcgacgccggcaacagccccaucggcuucugccccggcagcgacgagggcuucaccagaaagaagugcaccaucggcauggugggcgagggcagcauccagagcagcagauacaagaaggagagcaagagcggccuggugaagcccggcagcgaggccgacuucagcagcagcagcagcaccggcagcaucagcgcccccgaggugcacaugagcaccgccggcagcaagagaagcagcagcagcagaaacagaggcccccacggcagaagcaacggcgccagcagccacaagcccggcagcagccccagcagccccagagagaaggaccugcugagcaugcugugcagaaaccagcugagccccgugaacauccaccccagcuacgcccccagcagccccagcagcagcaacagcggcagcuacaagggcagcgacugcagccccaucaugagaagaagcggcagauacaugagcugcggcgagaaccacggcgugagaccccccaaccccgagcaguaccugaccccccugcagcagaaggaggugaccgugagacaccugaagaccaagcugaaggagagcgagagaagacugcacgagagagagagcgagaucguggagcugaagagccagcuggccagaaugagagaggacuggaucgaggaggagugccacagaguggaggcccagcuggcccugaaggaggccagaaaggagaucaagcagcugaagcaggugaucgagaccaugagaagcagccuggccgacaaggacaagggcauccagaaguacuucguggacaucaacauccagaacaagaagcuggagagccugcugcagagcauggagauggcccacagcggcagccugagagacgagcugugccuggacuuccccugcgacagccccgagaagagccugacccugaaccccccccuggacaccauggccgacggccugagccuggaggagcaggugaccggcgagggcgccgacagagagcugcuggugggcgacagcaucgccaacagcaccgaccuguucgacgagaucgugaccgccaccaccaccgagagcggcgaccuggagcuggugcacagcacccccggcgccaacgugcuggagcugcugcccaucgugaugggccaggaggagggcagcguggugguggagagagccgugcagaccgacguggugcccuacagccccgccaucagcgagcugauccagagcgugcugcagaagcugcaggaccccugccccagcagccuggccagccccgacgagagcgagcccgacagcauggagagcuuccccgagagccugagcgcccuggugguggaccugacccccagaaaccccaacagcgccauccugcugagccccguggagacccccuacgccaacguggacgccgaggugcacgccaacagacugaugagagagcuggacuucgccgccugcguggaggagagacuggacggcgugaucccccuggccagaggcggcguggugagacaguacuggagcagcagcuuccugguggaccugcuggccguggccgcccccguggugcccaccgugcugugggccuucagcacccagagaggcggcaccgaccccguguacaacaucggcgcccugcugagaggcugcugcgugguggcccugcacagccugagaagaaccgccuucagaaucaagaccuaa

SEQ ID NO: 24272 - RNA, 957 nt, Artificial Sequence
  SYCE1__Homo_sapiens__NP_001137235
auggccggcagaagccugaccagcaaggccgagcccaccgccggcgccguggacagagccgagaaggccggcggccaggacaccagcagccagaagaucgaggaccugauggagauggugcagaagcugcagaaggugggcagccuggagcccagaguggaggugcugaucaacagaaucaacgaggugcagcaggccaagaagaaggccaacaaggaccugggcgaggccagaaccaucugcgaggcccugcagaaggagcuggacagccugcacggcgagaaggugcaccugaaggagauccugagcaagaagcaggagacccugagaauccugagacugcacugccaggagaaggagagcgaggcccacagaaagcacaccaugcugcaggagugcaaggagagaaucagcgcccugaaccugcagaucgaggaggagaagaacaagcagagacagcugagacuggccuucgaggagcagcuggaggaccugaugggccagcacaaggaccugugggacuuccacaugcccgagagacuggccaaggagaucugcgcccuggacagcagcaaggagcagcugcugaaggaggagaagcuggugaaggccacccuggaggacgugaagcaccagcugugcagccugugcggcgccgagggccccagcacccuggacgagggccuguuccugagaagccaggaggccgccgccaccgugcagcuguuccaggaggagcacagaaaggccgaggagcugcuggccgccgccgcccagagacaccagcagcugcagcagaagugccagcagcagcagcagaagagacagagacugaaggaggagcuggagaagcacggcaugcaggugcccgcccaggcccagagcacccaggaggaggaggccggccccggcgacguggcccccagacccggcagacccgugaccugguggagcuaa

SEQ ID NO: 24273 - RNA, 729 nt, Artificial Sequence
  SYCE1L__Homo_sapiens__NP_001123451
auggccggcaagcugaagccccugaacguggaggcccccgaggccaccgaggaggccgagggccaggccaagagccugaagaccgaggaccugcuggccauggugaucaagcugcagaaggagggcagccuggagccccagaucgaggaccugaucagcagaaucaacgaccugcagcaggccaagaagaagagcagcgaggagcugagagagacccacagccugugggaggcccugcacagagagcuggacagccugaacggcgagaaggugcaccuggaggaggugcugggcaagaagcaggaggcccugagaauccugcagaugcacugccaggagaaggagagcgaggcccagagacuggacgugagaggccagcuggaggaccugaugggccagcacaaggaccugugggaguuccacaugcuggagcagagacuggccagagagaucagagcccuggagagaagcaaggagcagcugcugagcgagagaagacuggugagagccaagcugagagagguggagagaagacugcacagcccccccgagguggagggcgccauggccgugaacgacggccugaaggccgagcuggagaucuucggcgagcaggugagaagcgcccccgaggugggcgccggcgagggcgaggccggccccgagcugcccagagccagagacgaggaggaccccgagccccccguggccgcccccgacgcccuguaa

SEQ ID NO: 24274 - RNA, 4593 nt, Artificial Sequence
  SYCP2__Homo_sapiens__NP_055073
augcccaucagacccgaccugcagcagcuggagaagugcaucgacgacgcccugagaaagaacgacuucaagccccugaagacccugcugcagaucgacaucugcgaggacgugaagaucaagugcagcaagcaguucuuccacaagguggacaaccugaucugcagagagcugaacaaggaggacauccacaacgugagcgccauccuggugagcgugggcagaugcggcaagaacaucagcgugcugggccaggccggccugcugaccaugaucaagcagggccugauccagaagaugguggccugguucgagaagagcaaggacaucauccagagccagggcaacagcaaggacgaggccgugcugaacaugaucgaggaccugguggaccugcugcuggugauccacgacgugagcgacgagggcaagaagcaggugguggagagcuucgugcccagaaucugcagccuggugaucgacagcagagugaacaucugcauccagcaggagaucaucaagaagaugaacgccaugcuggacaagaugccccaggacgccagaaagauccugagcaaccaggagaugcugauccugaugagcagcaugggcgagagaauccuggacgccggcgacuacgaccugcaggugggcaucguggaggcccugugcagaaugaccaccgagaagcagagacaggagcuggcccaccagugguucagcauggacuucaucgccaaggccuucaagagaaucaaggacagcgaguucgagaccgacugcagaaucuuccugaaccuggugaacggcaugcugggcgacaagagaagaguguucaccuuccccugccugagcgccuuccuggacaaguacgagcugcagauccccagcgacgagaagcuggaggaguucuggaucgacuucaaccugggcagccagacccugagcuucuacaucgccggcgacaacgacgaccaccagugggaggccgugaccgugcccgaggagaaggugcagaucuacagcaucgaggugagagagagcaagaagcugcugaccaucauccugaagaacaccgugaagaucagcaagagagagggcaaggagcugcugcuguacuucgacgccagccuggagaucaccaacgugacccagaagaucuucggcgccaccaagcacagagagagcaucagaaagcagggcaucagcguggccaagaccagccugcacauccuguucgacgccagcggcagccagauccuggugcccgagagccagaucagccccgugggcgaggagcuggugagccugaaggagaagagcaagagccccaaggaguucgccaagcccagcaaguacaucaagaacagcgacaagggcaacagaaacaacagccagcuggagaagaccacccccagcaagagaaagaugagcgaggccagcaugaucgugagcggcgccgacagauacaccaugagaagccccgugcuguucagcaacaccagcaucccccccagaagaagaagaaucaagcccccccugcagaugaccagcagcgccgagaagcccagcgugagccagaccagcgagaacagaguggacaacgccgccagccugaagagcagaagcagcgagggcagacacagaagagacaacaucgacaagcacaucaagaccgccaagugcguggagaacaccgagaacaagaacguggaguuccccaaccagaacuucagcgagcugcaggacgugauccccgacagccaggccgccgagaagagagaccacaccauccugcccggcgugcuggacaacaucugcggcaacaagauccacagcaagugggccugcuggacccccgugaccaacaucgagcugugcaacaaccagagagccagcaccagcagcggcgacacccugaaccaggacaucgugaucaacaagaagcugaccaagcagaagagcagcagcagcaucagcgaccacaacagcgagggcaccggcaaggugaaguacaagaaggagcagaccgaccacaucaagaucgacaaggccgagguggaggugugcaagaagcacaaccagcagcagaaccaccccaaguacagcggccagaagaacaccgagaacgccaagcagagcgacuggcccguggagagcgagaccaccuucaagagcgugcugcugaacaagaccaucgaggagagccugaucuacagaaagaaguacauccugagcaaggacgugaacaccgccaccugcgacaagaaccccagcgccagcaagaacgugcagagccacagaaaggccgagaaggagcugaccagcgagcugaacagcugggacagcaagcagaagaagaugagagagaagagcaagggcaaggaguucaccaacguggccgagagccugaucagccagaucaacaagagauacaagaccaaggacgacaucaagagcaccagaaagcugaaggagagccugaucaacagcggcuucagcaacaagcccguggugcagcugagcaaggagaaggugcagaagaagagcuacagaaagcugaagaccaccuucgugaacgugaccagcgagugccccgugaacgacguguacaacuucaaccugaacggcgccgacgaccccaucaucaagcugggcauccaggaguuccaggccaccgccaaggaggccugcgccgacagaagcaucagacuggugggccccagaaaccacgacgagcugaagagcagcgugaagaccaaggacaagaagaucaucaccaaccaccagaagaagaaccuguucagcgacaccgagaccgaguacagaugcgacgacagcaagaccgacaucagcuggcugagagagcccaagagcaagccccagcugaucgacuacagcagaaacaagaacgugaagaaccacaagagcggcaagagcagaagcagccuggagaagggccagcccagcagcaagaugacccccagcaagaacaucaccaagaagauggacaagaccauccccgagggcagaaucagacugcccagaaaggccaccaagaccaagaagaacuacaaggaccugagcaacagcgagagcgagugcgagcaggaguucagccacagcuucaaggagaacauccccgugaaggaggagaacauccacagcagaaugaagaccgugaagcugcccaagaagcagcagaagguguucugcgccgagaccgagaaggagcugagcaagcaguggaagaacagcagccugcugaaggacgccaucagagacaacugccuggaccugagccccagaagccugagcggcagccccagcagcaucgaggugaccagaugcaucgagaagaucaccgagaaggacuucacccaggacuacgacugcaucaccaagagcaucagccccuaccccaagaccagcagccuggagagccugaacagcaacagcggcgugggcggcaccaucaagagccccaagaacaacgagaagaacuuccugugcgccagcgagagcugcagccccauccccagaccccuguuccugcccagacacacccccaccaagagcaacaccaucgugaacagaaagaagaucagcagccuggugcugacccaggagacccagaacagcaacagcuacagcgacgugagcagcuacagcagcgaggagagauucauggagaucgagagcccccacaucaacgagaacuacauccagagcaagagagaggagagccaccuggccagcagccugagcaagagcagcgagggcagagagaagaccugguucgacaugcccugcgacgccacccacgugagcggccccacccagcaccugagcagaaagagaaucuacaucgaggacaaccugagcaacagcaacgagguggagauggaggagaagggcgagagaagagccaaccugcugcccaagaagcugugcaagaucgaggacgccgaccaccacauccacaagaugagcgagagcgugagcagccugagcaccaacgacuucagcauccccugggagaccuggcagaacgaguucgccggcaucgagaugaccuacgagaccuacgagagacugaacagcgaguucaagagaagaaacaacaucagacacaagaugcugagcuacuucaccacccagagcuggaagaccgcccagcagcaccugagaaccaugaaccaccagagccaggacagcagaaucaagaagcuggacaaguuccaguucaucaucaucgaggagcuggagaacuucgagaaggacagccagagccugaaggaccuggagaaggaguucguggacuucugggagaagaucuuccagaaguucagcgccuaccagaagagcgagcagcagagacugcaccugcugaagaccagccuggccaagagcguguucugcaacaccgacagcgaggagaccguguucaccagcgagaugugccugaugaaggaggacaugaaggugcugcaggacagacugcugaaggacaugcuggaggaggagcugcugaacgugagaagagagcugaugagcguguucaugagccacgagagaaacgccaacguguaa

SEQ ID NO: 24275 - RNA, 2439 nt, Artificial Sequence
  SYCP2L__Homo_sapiens__NP_001035364
augcaggccaagaacaaggacgcccugcagcccaucaaggaggacagaaccggcaaggcccaggacgacgccuucuggcugcagagccugaucaccgacgccuuccacgacaagggcuuccagaagaucaaggaguacuuccagcagaaggagagccacuucccccagaaguacaacagacugcugcuguacagacuggacagaagcaucaacaaggagcuggacaagaacgaguuccagagcgugagccugcugcugaagugcauccagagauuccugguggacggccugaaggaggacgagccccugcugaucagacagggccugauccccaagcuggugagcugguucgagagaaccaccggcauccugaccagcgagggccuggccagcgacaccagccugaucugcgugaucgaggacuucuucgacaccgcccugaucaucagcagaagcagcagcgagggcaagauccagaugcuggacagcuuccugcugagccugggcuuccuggugaccgagaagaccgugaaccaccugcugcagcaggagggccugaagaccuucaacugcauccugcacgccgugcccagagaggagagaaagaaguucccccugagcgagggcaugugccaccugaugaaggaccuggccagaacccugcugaccgugggcgacuacgaccagcagguggccaucagcgaggcccugugcagacugaccaucaagaagagcagagacgagcuggugcacaagugguucgacgacgaggugaucgccgaggccuucaaggagaucaaggacagagaguucgagaccgacagcagaagauuccugaaccaccugaacaacagacugggcgaccagagaagaguguacagcuuccccugcaucgccgccuucgccgacgagcacgagaugagaaagcccgccgacgagaagcuggagaaguucuggaucgacuucaaccugggcagccagagcgugaccuucuacaucgacaacgccgagaacacccugugggacagcgugacccugcccaaggaggccgugaugaacuucagcaucaccgagaccgagaagaucaagaucuucaucaucuaccugaagaagcccaugaucaucagcuacaaggaggugaugaagaucgagauccacuucgaccugcaguucaacaucagccaggugagcauccaggcccugggcgaggacaagcagaugcugcccgaccagaccaagaucagcagcgagcuguucagcaagagcgacaaggaggacagagagagccccagcggccuggagagagagaccgagcaggccgaggagagcaccaacaugguggaguucaugagcgccgaggacgacagaugccugaucacccugcaccugaacgaccagagcgagccccccgugaucggcgagcccgccagcgacagccaccugcagcccgugccccccuucggcgugcccgacuucccccagcagcccaagagccacuacagaaagcaccuguucagcgagagcaaccaggacagcagcaccagcgagcugagcuggaccagcaaccagaagaagaagagccugaagagcuacagcagcagaaagaagaccagaaccagaagcaaccugagaauccugcccguguucccccccagcagcggcagcggccacgagaaggaccaggccaagcugcugagccccagcgagaaggagauccccgagcagaacaacaccaccagccccaagaccagcgagcagaaguuccaggacagcuucgccuuccugaccgccgaggacagcgcccagaagaccgagcugcaggacccccacagccugagcgagcugagcagccugaagcacagcgaggacgaggagaagcccaagaucgugaaccaggagagccugaccgagagcaccagccugaagcacaagcugagaaaccuggaggacaaggacauccccgagggcagcuucgccaagagccagcagagcagacuggaggaggagguggcccccggcagccccuucagcaucaccgaggagagagagcugcccgagggcaucagcaccagcagccuggagguggugcccgagaaccugaacggcagcgccauccugcccaccuucgagaacuucaccaagaagagaaagagaaaguacgagcugagauacagaaagagacccuucaacagcgagaacgccaagaaggcccccgacugccugaucaagcugcugaaccagaugcagcuguucagacugaacaagcuggagagauuccagaaccuggugcugcaggagcugagcagccugaagcaggacauccaggcccuggagcaccuggagaaggaggugcuggaguucuggggcaagcagagcgccgaccugcagagcuucugcgaccugcaggugcugagauucaacagcacccagaccagcuaa

SEQ ID NO: 24276 - RNA, 711 nt, Artificial Sequence
  SYCP3__Homo_sapiens__NP_001171420
auggugagcagcggcaagaaguacagcagaaagagcggcaagcccagcguggaggaccaguucaccagagccuacgacuucgagaccgaggacaagaaggaccugagcggcagcgaggaggacgugaucgagggcaagaccgccgugaucgagaagagaagaaagaagagaagcagcgccggcgugguggaggacaugggcggcgaggugcagaacaugcuggagggcgugggcguggacaucaacaaggcccugcuggccaagagaaagagacuggagauguacaccaaggccagccugaagaccagcaaccagaagaucgagcacguguggaagacccagcaggaccagagacagaagcugaaccaggaguacagccagcaguuccugacccuguuccagcagugggaccuggacaugcagaaggccgaggagcaggaggagaagauccugaacauguucagacagcagcagaagauccugcagcagagcagaaucgugcagagccagagacugaagaccaucaagcagcuguacgagcaguucaucaagagcauggaggagcuggagaagaaccacgacaaccugcugaccggcgcccagaacgaguucaagaaggagauggccaugcugcagaagaagaucaugauggagacccagcagcaggagaucgccagcgugagaaagagccugcagagcaugcuguucuaa

SEQ ID NO: 24277 - RNA, 1908 nt, Artificial Sequence
  SYK__Homo_sapiens__XP_011517248
auggccagcagcggcauggccgacagcgccaaccaccugcccuucuucuucggcaacaucaccagagaggaggccgaggacuaccuggugcagggcggcaugagcgacggccuguaccugcugagacagagcagaaacuaccugggcggcuucgcccugagcguggcccacggcagaaaggcccaccacuacaccaucgagagagagcugaacggcaccuacgccaucgccggcggcagaacccacgccagccccgccgaccugugccacuaccacagccaggagagcgacggccuggugugccugcugaagaagcccuucaacagaccccagggcgugcagcccaagaccggccccuucgaggaccugaaggagaaccugaucagagaguacgugaagcagaccuggaaccugcagggccaggcccuggagcaggccaucaucagccagaagccccagcuggagaagcugaucgccaccaccgcccacgagaagaugcccugguuccacggcaagaucagcagagaggagagcgagcagaucgugcugaucggcagcaagaccaacggcaaguuccugaucagagccagagacaacaacggcagcuacgcccugugccugcugcacgagggcaaggugcugcacuacagaaucgacaaggacaagaccggcaagcugagcauccccgagggcaagaaguucgacacccuguggcagcugguggagcacuacagcuacaaggccgacggccugcugagagugcugaccgugcccugccagaagaucggcacccagggcaacgugaacuucggcggcagaccccagcugcccggcagccaccccgccaccuggagcgccggcggcaucaucagcagaaucaagagcuacagcuuccccaagcccggccacagaaagagcagccccgcccagggcaacagacaggagagcaccgugagcuucaaccccuacgagcccgagcuggcccccugggccgccgacaagggcccccagagagaggcccugcccauggacaccgagguguacgagagccccuacgccgaccccgaggagaucagacccaaggagguguaccuggacagaaagcugcugacccuggaggacaaggagcugggcagcggcaacuucggcaccgugaagaagggcuacuaccagaugaagaagguggugaagaccguggccgugaagauccugaagaacgaggccaacgaccccgcccugaaggacgagcugcuggccgaggccaacgugaugcagcagcuggacaaccccuacaucgugagaaugaucggcaucugcgaggccgagagcuggaugcuggugauggagauggccgagcugggcccccugaacaaguaccugcagcagaacagacacgugaaggacaagaacaucaucgagcuggugcaccaggugagcaugggcaugaaguaccuggaggagagcaacuucgugcacagagaccuggccgccagaaacgugcugcuggugacccagcacuacgccaagaucagcgacuucggccugagcaaggcccugagagccgacgagaacuacuacaaggcccagacccacggcaaguggcccgugaagugguacgcccccgagugcaucaacuacuacaaguucagcagcaagagcgacguguggagcuucggcgugcugaugugggaggccuucagcuacggccagaagcccuacagaggcaugaagggcagcgaggugaccgccaugcuggagaagggcgagagaaugggcugccccgccggcugccccagagagauguacgaccugaugaaccugugcuggaccuacgacguggagaacagacccggcuucgccgccguggagcugagacugagaaacuacuacuacgacguggugaacuaa

SEQ ID NO: 24278 - RNA, 3825 nt, Artificial Sequence
  SYMPK__Homo_sapiens__XP_011525656
auggccagcggcagcggcgacagcgugaccagaagaagcguggccagccaguucuucacccaggaggagggccccggcaucgacggcaugaccaccagcgagagagugguggaccugcugaaccaggccgcccugaucaccaacgacagcaagaucaccgugcugaagcaggugcaggagcugaucaucaacaaggaccccacccugcuggacaacuuccuggacgagaucaucgccuuccaggccgacaagagcaucgaggugagaaaguucgugaucggcuucaucgaggaggccugcaagagagacaucgagcugcugcugaagcugaucgccaaccugaacaugcugcugagagacgagaacgugaacguggugaagaaggccauccugaccaugacccagcuguacaagguggcccugcaguggauggugaagagcagagugaucagcgagcugcaggaggccugcugggacauggugagcgccauggccggcgacaucauccugcugcuggacagcgacaacgacggcaucagaacccacgccaucaaguucguggagggccugaucgugacccugagccccagaauggccgacagcgagauccccagaagacaggagcacgacaucagccuggacagaauccccagagaccaccccuacauccaguacaacgugcugugggaggagggcaaggccgcccuggagcagcugcugaaguucauggugcaccccgccaucagcagcaucaaccugaccaccgcccugggcagccuggccaacaucgccagacagagacccauguucaugagcgaggugauccaggccuacgagacccugcacgccaaccugccccccacccuggccaagagccaggugagcagcgugagaaagaaccugaagcugcaccugcugagcgugcugaagcaccccgccagccuggaguuccaggcccagaucaccacccugcugguggaccugggcaccccccaggccgagaucgccagaaacaugcccagcagcaaggacaccagaaagagacccagagacgacagcgacagcacccugaagaagaugaagcuggagcccaaccugggcgaggacgacgaggacaaggaccuggagcccggccccagcggcaccagcaaggccagcgcccagaucagcggccagagcgacaccgacaucaccgccgaguuccugcagccccugcugacccccgacaacguggccaaccuggugcugaucagcaugguguaccugcccgaggccaugcccgccagcuuccaggccaucuacacccccguggagagcgccggcaccgaggcccagaucaagcaccuggccagacugauggccacccagaugaccgccgccggccugggccccggcguggagcagaccaagcagugcaaggaggagcccaaggaggagaagguggugaagaccgagagcgugcugaucaagagaagacugagcgcccagggccaggccaucagcguggugggcagccugagcagcaugagcccccuggaggaggaggccccccaggccaagagaagacccgagcccaucauccccgugacccagcccagacuggccggcgccggcggcagaaagaagaucuucagacugagcgacgugcugaagccccugaccgacgcccagguggaggccaugaagcugggcgccgugaagagaauccugagagccgagaaggccguggccugcagcggcgccgcccaggugagaaucaagauccuggccagccuggugacccaguucaacagcggccugaaggccgaggugcugagcuucauccuggaggacgugagagccagacuggaccuggccuucgccuggcuguaccaggaguacaacgccuaccuggccgccggcgccagcggcagccuggacaaguacgaggacugccugaucagacugcugagcggccugcaggagaagcccgaccagaaggacggcaucuucaccaagguggugcuggaggccccccugaucaccgagagcgcccuggagguggugagaaaguacugcgaggacgagagcagaaccuaccugggcaugagcacccugagagaccugaucuucaagagacccagcagacaguuccaguaccugcacgugcugcuggaccugagcagccacgagaaggacaaggugagaagccaggcccugcuguucaucaagagaauguacgagaaggagcagcugagagaguacguggagaaguucgcccugaacuaccugcagcugcuggugcaccccaacccccccagcgugcuguucggcgccgacaaggacaccgagguggccgcccccuggaccgaggagaccgugaagcagugccuguaccuguaccuggcccugcugccccagaaccacaagcugauccacgagcuggccgccguguacaccgaggccaucgccgacaucaagagaaccgugcugagagugaucgagcagcccaucagaggcaugggcaugaacagccccgagcugcugcugcugguggagaacugccccaagggcgccgagacccuggugaccagaugccugcacagccugaccgacaaggugccccccagccccgagcuggugaagagagugagagaccuguaccacaagagacugcccgacgugagauuccugauccccgugcugaacggccuggagaagaaggaggugauccaggcccugcccaagcugaucaagcugaaccccaucguggugaaggagguguucaacagacugcugggcacccagcacggcgagggcaacagcgcccugagcccccugaaccccggcgagcugcugaucgcccugcacaacaucgacagcgugaagugcgacaugaagagcaucaucaaggccaccaaccugugcuucgccgagagaaacguguacaccagcgaggugcuggccguggugaugcagcagcugauggagcagagcccccugcccaugcugcugaugagaaccgugauccagagccugaccauguaccccagacugggcggcuucgugaugaacauccugagcagacugaucaugaagcagguguggaaguaccccaaggugugggagggcuucaucaagugcugccagagaaccaagccccagagcuuccaggugauccugcagcugcccccccagcagcugggcgccguguucgacaagugccccgagcugagagagccccugcuggcccacgugagaagcuucaccccccaccagcaggcccacauccccaacagcaucaugaccauccuggaggccagcggcaagcaggagcccgaggccaaggaggcccccgccggcccccuggaggaggacgaccuggagccccugacccuggcccccgcccccgcccccagacccccccaggaccugaucggccugagacuggcccaggagaaggcccugaagagacagcuggaggaggagcagaagcugaagcccggcggcgugggcgcccccagcagcagcagccccagccccagccccagcgccagacccggccccccccccagcgaggaggccauggacuucagagaggagggccccgagugcgagacccccggcaucuucaucagcauggacgacgacagcggccugaccgaggccgcccugcuggacagcagccuggagggcccccugcccaaggagaccgccgccggcggccugacccugaaggaggagagaagcccccagacccuggcccccgugggcgaggacgccaugaagacccccagccccgccgccgaggacgccagagagcccgaggccaagggcaacagcuaa

SEQ ID NO: 24279 - RNA, 2118 nt, Artificial Sequence
  SYN1__Homo_sapiens__NP_008881
augaacuaccugagaagaagacugagcgacagcaacuucauggccaaccugcccaacggcuacaugaccgaccugcagagaccccagccccccccccccccccccggcgcccacagccccggcgccacccccggccccggcaccgccaccgccgagagaagcagcggcguggcccccgccgccagccccgccgcccccagccccggcagcagcggcggcggcggcuucuucagcagccugagcaacgccgugaagcagaccaccgccgccgccgccgccaccuucagcgagcaggugggcggcggcagcggcggcgccggcagaggcggcgccgccagcagagugcugcuggugaucgacgagccccacaccgacugggccaaguacuucaagggcaagaagauccacggcgagaucgacaucaagguggagcaggccgaguucagcgaccugaaccugguggcccacgccaacggcggcuucagcguggacauggaggugcugagaaacggcgugaagguggugagaagccugaagcccgacuucgugcugaucagacagcacgccuucagcauggccagaaacggcgacuacagaagccuggugaucggccugcaguacgccggcauccccagcgugaacagccugcacagcguguacaacuucugcgacaagcccuggguguucgcccagauggugagacugcacaagaagcugggcaccgaggaguucccccugaucgaccagaccuucuaccccaaccacaaggagaugcugagcagcaccaccuaccccgugguggugaagaugggccacgcccacagcggcaugggcaaggugaagguggacaaccagcacgacuuccaggacaucgccagcgugguggcccugaccaagaccuacgccaccgccgagcccuucaucgacgccaaguacgacgugagagugcagaagaucggccagaacuacaaggccuacaugagaaccagcgugagcggcaacuggaagaccaacaccggcagcgccaugcuggagcagaucgccaugagcgacagauacaagcuguggguggacaccugcagcgagaucuucggcggccuggacaucugcgccguggaggcccugcacggcaaggacggcagagaccacaucaucgagguggugggcagcagcaugccccugaucggcgaccaccaggacgaggacaagcagcugaucguggagcugguggugaacaagauggcccaggcccugcccagacagagacagagagacgccagccccggcagaggcagccacggccagacccccagccccggcgcccugccccugggcagacagaccagccagcagcccgccggcccccccgcccagcagagaccccccccccagggcggccccccccagcccggccccggcccccagagacagggccccccccugcagcagagaccccccccccagggccagcagcaccugagcggccugggcccccccgccggcagcccccugccccagagacugcccagccccaccagcgccccccagcagcccgccagccaggccgccccccccacccagggccagggcagacagagcagacccguggccggcggccccggcgccccccccgccgccagaccccccgccagccccagcccccagagacaggccggccccccccaggccaccagacagaccagcgugagcggccccgccccccccaaggccagcggcgccccccccggcggccagcagagacagggccccccccagaagccccccggccccgccggccccaccagacaggccagccaggccggccccgugcccagaaccggcccccccaccacccagcagcccagacccagcggccccggccccgccggcagacccaagccccagcuggcccagaagcccagccaggacgugcccccccccgccaccgccgccgccggcggccccccccacccccagcugaacaagagccagagccugaccaacgccuucaaccugcccgagcccgccccccccagacccagccugagccaggacgaggugaaggccgagaccaucagaagccugagaaagagcuucgccagccuguucagcgacuaa

SEQ ID NO: 24280 - RNA, 1437 nt, Artificial Sequence
  SYN2__Homo_sapiens__NP_003169
augaugaacuuccugagaagaagacugagcgacagcagcuucaucgccaaccugcccaacggcuacaugaccgaccugcagagacccgagccccagcagcccccccccccccccccccccggccccggcgccgccagcgccagcgccgccccccccaccgccagccccggccccgagagaagacccccccccgccagcgcccccgccccccagcccgcccccacccccagcgugggcagcagcuucuucagcagccugagccaggccgugaagcagaccgccgccagcgccggccugguggacgcccccgcccccgcccccgccgccgccagaaaggccaaggugcugcuggugguggacgagccccacgccgacugggccaagugcuucagaggcaagaaggugcugggcgacuacgacaucaagguggagcaggccgaguucagcgagcugaaccugguggcccacgccgacggcaccuacgccguggacaugcaggugcugagaaacggcaccaagguggugagaagcuucagacccgacuucgugcugaucagacagcacgccuucggcauggccgagaacgaggacuucagacaccugaucaucggcaugcaguacgccggccugcccagcaucaacagccuggagagcaucuacaacuucugcgacaagcccuggguguucgcccagcugguggccaucuacaagacccugggcggcgagaaguucccccugaucgagcagaccuacuaccccaaccacaaggagaugcugacccugcccaccuuccccgugguggugaagaucggccacgcccacagcggcaugggcaaggugaagguggagaaccacuacgacuuccaggacaucgccagcgugguggcccugacccagaccuacgccaccgccgagcccuucaucgacagcaaguacgacaucagagugcagaagaucggcaacaacuacaaggccuacaugagaaccagcaucagcggcaacuggaagaccaacaccggcagcgccaugcuggagcagaucgccaugagcgacagauacaagcuguggguggacaccugcagcgagauguucggcggccuggacaucugcgccgugaaggccgugcacggcaaggacggcaaggacuacaucuucgaggugauggacugcagcaugccccugaucggcgagcaccagguggaggacagacagcugaucaccgagcuggugaucagcaagaugaaccagcugcugagcagaacccccgcccugagcccccagagaccccugaccacccagcagccccagagcggcacccugaaggaccccgacagcagcaagacccccccccagagaccccccccccagggcugccugcaguacauccuggacugcaacggcaucgccgugggccccaagcaggugcaggccagcuaa

SEQ ID NO: 24281 - RNA, 1335 nt, Artificial Sequence
  SYN3__Homo_sapiens__NP_598344
augaacuuccugagaagaagacugagcgacagcagcuucauggccaaccugcccaacggcuacaugaccgaccugcagagacccgacagcagcaccagcagccccgccagccccgccauggagagaagacacccccagccccuggccgccagcuucagcagccccggcagcagccuguucagcagccugagcagcgccaugaagcaggccccccaggccaccagcggccugauggagccccccggccccagcacccccaucgugcagagacccagaauccugcuggugaucgacgacgcccacaccgacuggagcaaguacuuccacggcaagaaggugaacggcgagaucgagaucagaguggagcaggccgaguucagcgagcugaaccuggccgccuacgugaccggcggcugcaugguggacaugcagguggugagaaacggcaccaagguggugagcagaagcuucaagcccgacuucauccuggugagacagcacgccuacagcauggcccugggcgaggacuacagaagccuggugaucggccugcaguacggcggccugcccgccgugaacagccuguacagcguguacaacuucugcagcaagcccuggguguucagccagcugaucaagaucuuccacagccugggccccgagaaguucccccugguggagcagaccuucuuccccaaccacaagcccauggugaccgccccccacuuccccgugguggugaagcugggccacgcccacgccggcaugggcaagaucaagguggagaaccagcuggacuuccaggacaucaccagcgugguggccauggccaagaccuacgccaccaccgaggccuucaucgacagcaaguacgacaucagaauccagaagaucggcagcaacuacaaggccuacaugagaaccagcaucagcggcaacuggaaggccaacaccggcagcgccaugcuggagcagguggccaugaccgagagauacagacuguggguggacagcugcagcgagauguucggcggccuggacaucugcgccgugaaggccgugcacagcaaggacggcagagacuacaucaucgaggugauggacagcagcaugccccugaucggcgagcacguggaggaggacagacagcugauggccgaccugguggugagcaagaugagccagcugcccaugcccggcggcaccgcccccagcccccugagacccugggccccccagaucaagagcgccaagagccccggccaggcccagcugggcccccagcugggccagccccagcccagaccccccccccaggccaaccugagccccuaa

SEQ ID NO: 24282 - RNA, 1584 nt, Artificial Sequence
  SYNCRIP__Homo_sapiens__NP_001153146
auggccaccgagcacgugaacggcaacggcaccgaggagcccauggacaccaccagcgccgugauccacagcgagaacuuccagacccugcuggacgccggccugccccagaagguggccgagaagcuggacgagaucuacguggccggccugguggcccacagcgaccuggacgagagagccaucgaggcccugaaggaguucaacgaggacggcgcccuggccgugcugcagcaguucaaggacagcgaccugagccacgugcagaacaagagcgccuuccugugcggcgugaugaagaccuacagacagagagagaagcagggcaccaagguggccgacagcagcaagggccccgacgaggccaagaucaaggcccugcuggagagaaccggcuacacccuggacgugaccaccggccagagaaaguacggcggccccccccccgacagcguguacagcggccagcagcccagcgugggcaccgagaucuucgugggcaagauccccagagaccuguucgaggacgagcuggugccccuguucgagaaggccggccccaucugggaccugagacugaugauggacccccugaccggccugaacagaggcuacgccuucgugaccuucugcaccaaggaggccgcccaggaggccgugaagcuguacaacaaccacgagaucagaagcggcaagcacaucggcgugugcaucagcguggccaacaacagacuguucgugggcagcauccccaagagcaagaccaaggagcagauccuggaggaguucagcaaggugaccgagggccugaccgacgugauccuguaccaccagcccgacgacaagaagaagaacagaggcuucugcuuccuggaguacgaggaccacaagaccgccgcccaggugaaggugcuguucgugagaaaccuggccaacaccgugaccgaggagauccuggagaaggccuucagccaguucggcaagcuggagagagugaagaagcugaaggacuacgccuucauccacuucgacgagagagacggcgccgugaaggccauggaggagaugaacggcaaggaccuggagggcgagaacaucgagaucguguucgccaagccccccgaccagaagagaaaggagagaaaggcccagagacaggccgccaagaaccagauguacgacgacuacuacuacuacggccccccccacaugcccccccccaccagaggcagaggcagaggcggcagaggcggcuacggcuacccccccgacuacuacggcuacgaggacuacuacgacuacuacggcuacgacuaccacaacuacagaggcggcuacgaggaccccuacuacggcuacgaggacuuccaggugggcgccagaggcagaggcggcagaggcgccagaggcgccgcccccagcagaggcagaggcgccgccccccccagaggcagagccggcuacagccagagaggcggccccggcagcgccagaggcgugagaggcgccagaggcggcgcccagcagcagagaggcagaggccagggcaagggcguggaggccggccccgaccugcugcaguaa

SEQ ID NO: 24283 - RNA, 777 nt, Artificial Sequence
  SYNDIG1__Homo_sapiens__NP_079169
auggacggcaucaucgagcagaagagcaugcuggugcacagcaagaucagcgacgccggcaagagaaacggccugaucaacaccagaaaccugauggccgagagcagagacggccuggugagcguguaccccgccccccaguaccagagccacagagugggcgccagcaccgugcccgccagccuggacagcagcagaagcgagcccaugcagcagcugcuggaccccaacacccugcagcagagcguggagagcagauacagacccaacaucauccuguacagcgagggcgugcugagaagcuggggcgacggcguggccgccgacugcugcgagaccaccuucaucgaggacagaagccccaccaaggacagccuggaguaccccgacggcaaguucaucgaccugagcgccgacgacaucaagauccacacccugagcuacgacguggaggaggaggaggaguuccaggagcuggagagcgacuacagcagcgacaccgagagcgaggacaacuuccugaugaugccccccagagaccaccugggccugagcguguucagcaugcugugcugcuucuggccccugggcaucgccgccuucuaccugagccacgagaccaacaaggccguggccaagggcgaccugcaccaggccagcaccagcagcagaagagcccuguuccuggccgugcugagcaucaccaucggcaccggcguguacgugggcguggccguggcccugaucgccuaccugagcaagaacaaccaccuguaa

SEQ ID NO: 24284 - RNA, 26250 nt, Artificial Sequence
  SYNE1__Homo_sapiens__NP_149062
auggccaccagcagaggcgccagcagaugccccagagacaucgccaacgugaugcagagacugcaggacgagcaggagaucgugcagaagagaaccuucaccaaguggaucaacagccaccuggccaagagaaagccccccauggugguggacgaccuguucgaggacaugaaggacggcgugaagcugcuggcccugcuggaggugcugagcggccagaagcugcccugcgagcagggcagaagaaugaagagaauccacgccguggccaacaucggcaccgcccugaaguuccuggagggcagaaagagcaugcacagaggcagccccaucaagcuggugaacaucaacagcaccgacaucgccgacggcagacccagcaucgugcugggccugauguggaccaucauccuguacuuccagaucgaggagcugaccagcaaccugccccagcugcagagccugagcagcagcgccagcagcguggacagcaucgugagcagcgagacccccagcccccccagcaagagaaaggugaccaccaagauccagggcaacgccaagaaggcccugcugaagugggugcaguacaccgccggcaagcagaccggcaucgaggugaaggacuucggcaagagcuggagaagcggcguggccuuccacagcgugauccacgccaucagacccgagcugguggaccuggagaccgugaagggcagaagcaacagagagaaccuggaggacgccuucaccaucgccgagaccgagcugggcauccccagacugcuggaccccgaggacguggacguggacaagcccgacgagaagagcaucaugaccuacguggcccaguuccugaagcacuaccccgacauccacaacgccagcaccgacggccaggaggacgacgagauccugcccggcuuccccagcuucgccaacagcgugcagaacuucaagagagaggacagagugaucuucaaggagaugaagguguggaucgagcaguucgagagagaccugaccagagcccagaugguggagagcaaccugcaggacaaguaccagagcuucaagcacuucagagugcaguacgagaugaagagaaagcagaucgagcaccugauccagccccugcacagagacggcaagcugagccuggaccaggcccuggugaagcagagcugggacagagugaccagcagacuguucgacuggcacauccagcuggacaagagccugcccgccccccugggcaccaucggcgccuggcuguacagagccgagguggcccugagagaggagaucaccgugcagcaggugcacgaggagaccgccaacaccauccagagaaagcuggagcagcacaaggaccugcugcagaacaccgacgcccacaagagagccuuccacgagaucuacagaaccagaagcgugaacggcauccccgugccccccgaccagcuggaggacauggccgagagauuccacuucgugagcagcaccagcgagcugcaccugaugaagauggaguuccuggagcugaaguacagacugcugagccugcuggugcuggccgagagcaagcugaagagcuggaucaucaaguacggcagaagagagagcguggagcagcugcugcagaacuacgugagcuucaucgagaacagcaaguucuucgagcaguacgaggugaccuaccagauccugaagcagaccgccgagauguacgugaaggccgacggcagcguggaggaggccgagaacgugaugaaguucaugaacgagaccaccgcccaguggagaaaccugagcguggaggugagaagcgugagaagcaugcuggaggaggugaucagcaacugggacagauacggcaacaccguggccagccugcaggccuggcuggaggacgccgagaagaugcugaaccagagcgagaacgccaagaaggacuucuucagaaaccugccccacuggauccagcagcacaccgccaugaacgacgccggcaacuuccugaucgagaccugcgacgagauggugagcagagaccugaagcagcagcugcugcugcugaacggcagauggagagagcuguucauggaggugaagcaguacgcccaggccgacgagauggacagaaugaagaaggaguacaccgacugcguggugacccugagcgccuucgccaccgaggcccacaagaagcugagcgagccccuggaggugagcuucaugaacgugaagcugcugauccaggaccuggaggacaucgagcagagagugcccgugauggacgcccaguacaagaucaucaccaagaccgcccaccugaucaccaaggagagcccccaggaggagggcaaggagauguucgccaccaugagcaagcugaaggagcagcugaccaaggugaaggagugcuacagcccccugcuguacgagagccagcagcugcugaucccccuggaggagcuggagaagcagaugaccagcuucuacgacagccugggcaagaucaacgagaucaucaccgugcuggagagagaggcccagagcagcgcccuguucaagcagaagcaccaggagcugcuggccugccaggagaacugcaagaagacccugacccugaucgagaagggcagccagagcgugcagaaguucgugacccugagcaacgugcugaagcacuucgaccagaccagacugcagagacagaucgccgacauccacguggccuuccagagcauggugaagaagaccggcgacuggaagaagcacguggagaccaacagcagacugaugaagaaguucgaggagagcagagccgagcuggagaaggugcugagaaucgcccaggagggccuggaggagaagggcgaccccgaggagcugcugagaagacacaccgaguucuucagccagcuggaccagagagugcugaacgccuuccugaaggccugcgacgagcugaccgacauccugcccgagcaggagcagcagggccugcaggaggccgugagaaagcugcacaagcaguggaaggaccugcagggcgaggcccccuaccaccugcugcaccugaagaucgacguggagaagaacagauuccuggccagcguggaggagugcagaaccgagcuggacagagagaccaagcugaugccccaggagggcagcgagaagaucaucaaggagcacagaguguucuucagcgacaagggcccccaccaccugugcgagaagagacugcagcugaucgaggagcugugcgugaagcugcccgugagagaccccgugagagacacccccggcaccugccacgugacccugaaggagcugagagccgccaucgacagcaccuacagaaagcugauggaggaccccgacaaguggaaggacuacaccagcagauucagcgaguucagcagcuggaucagcaccaacgagacccagcugaagggcaucaagggcgaggccaucgacaccgccaaccacggcgaggugaagagagccguggaggagaucagaaacggcgugaccaagagaggcgagacccugagcuggcugaagagcagacugaaggugcugaccgaggugagcagcgagaacgaggcccagaagcagggcgacgagcuggccaagcugagcagcagcuucaaggcccuggugacccugcugagcgagguggagaagaugcugagcaacuucggcgacugcgugcaguacaaggagaucgugaagaacagccuggaggagcugaucagcggcagcaaggaggugcaggagcaggccgagaagauccuggacaccgagaaccuguucgaggcccagcagcugcugcugcaccaccagcagaagaccaagagaaucagcgccaagaagagagacgugcagcagcagaucgcccaggcccagcagggcgagggcggccugcccgacagaggccacgaggagcugagaaagcuggagagcacccuggacggccuggagagaagcagagagagacaggagagaagaauccaggugacccugagaaagugggagagauucgagaccaacaaggagaccguggugagauaccuguuccagaccggcagcagccacgagagauuccugagcuucagcagccuggagagccugagcagcgagcuggagcagaccaaggaguucagcaagagaaccgagagcaucgccgugcaggccgagaaccuggugaaggaggccagcgagaucccccugggcccccagaacaagcagcugcugcagcagcaggccaagagcaucaaggagcaggugaagaagcuggaggacacccuggaggaggacaucaagaccauggagauggugaagaccaagugggaccacuucggcagcaacuucgagacccugagcguguggaucaccgagaaggagaaggagcugaacgcccuggagaccagcagcagcgccauggacaugcagaucagccagaucaaggugaccauccaggagaucgagagcaagcugagcagcaucgugggccuggaggaggaggcccagagcuucgcccaguucgugaccaccggcgagagcgccagaaucaaggccaagcugacccagaucagaagauacggcgaggagcugagagagcacgcccagugccuggagggcaccauccugggccaccugagccagcagcagaaguucgaggagaaccugagaaagauccagcagagcgugagcgaguucgaggacaagcuggccgugcccaucaagaucugcagcagcgccaccgagaccuacaaggugcugcaggagcacauggaccugugccaggcccuggagagccugagcagcgccaucaccgccuucagcgccagcgccagaaagguggugaacagagacagcugcgugcaggaggccgccgcccugcagcagcaguacgaggacauccugagaagagccaaggagagacagaccgcccuggagaaccugcuggcccacuggcagagacuggagaaggagcugagcagcuuccugaccuggcuggagagaggcgaggccaaggccagcagccccgagauggacaucagcgccgacagagugaagguggagggcgagcugcagcugauccaggcccugcagaacgagguggugagccaggccagcuucuacagcaagcugcugcagcugaaggagagccuguucagcguggccagcaaggacgacgugaagaugaugaagcugcaccuggagcagcuggacgagagauggagagaccugccccagaucaucaacaagagaaucaacuuccugcagagcgugguggccgagcaccagcaguucgacgagcugcugcugagcuucagcguguggaucaagcuguuccugagcgagcugcagaccaccagcgagaucagcaucauggaccaccagguggcccugaccagacacaaggaccacgccgccgagguggagagcaagaagggcgagcugcagagccugcagggccaccuggccaagcugggcagccugggcagagccgaggaccugcaccugcugcagggcaaggccgaggacugcuuccagcuguucgaggaggccagccaggugguggagagaagacagcuggcccugagccaccuggccgaguuccugcagagccacgccagccugagcggcauccugagacagcugagacagaccguggaggccaccaacagcaugaacaagaacgagagcgaccugaucgagaaggaccugaacgacgcccugcagaacgccaaggcccuggagagcgccgccgugagccuggacggcauccugagcaaggcccaguaccaccugaagaucggcagcagcgagcagagaaccagcugcagagccaccgccgaccagcugugcggcgagguggagagaauccagaaccugcugggcaccaagcagagcgaggccgacgcccuggccgugcugaagaaggccuuccaggaccagaaggaggagcugcugaagagcaucgaggacaucgaggagagaaccgacaaggagagacugaaggagcccaccagacaggcccugcagcagagacugagaguguucaaccagcuggaggacgagcugaacagccacgagcacgagcugugcuggcugaaggacaaggccaagcagaucgcccagaaggacguggccuucgcccccgagguggacagagagaucaacagacuggaggugaccugggacgacaccaagagacugauccacgagaaccagggccagugcugcggccugaucgaccugaugagagaguaccagaaccugaagagcgccgugagcaaggugcuggagaacgccagcagcgugaucgugaccagaaccaccaucaaggaccaggaggaccugaagugggccuucagcaagcacgagaccgccaagaacaagaugaacuacaagcagaaggaccuggacaacuucaccagcaagggcaagcaccugcugagcgagcugaagaagauccacagcagcgacuucagccuggugaagaccgacauggagagcaccguggacaaguggcuggacgugagcgagaagcuggaggagaacauggacagacugagagugagccugagcaucugggacgacgugcugagcaccagagacgagaucgagggcuggagcaacaacugcgugccccagauggccgagaacaucagcaaccuggacaaccaccugagagccgaggagcugcugaaggaguucgagagcgaggugaagaacaaggcccugagacuggaggagcugcacagcaaggugaacgaccugaaggagcugaccaagaaccuggagaccccccccgaccugcaguucaucgaggccgaccugaugcagaagcuggagcacgccaaggagaucaccgagguggccaagggcacccugaaggacuucaccgcccagagcacccagguggagaaguucaucaacgacaucaccaccugguucaccaagguggaggagagccugaugaacugcgcccagaacgagaccugcgaggcccugaagaaggugaaggacauccagaaggagcugcagagccagcagagcaacaucagcagcacccaggagaaccugaacagccugugcagaaaguaccacagcgccgagcuggagagccugggcagagccaugaccggccugaucaagaagcacgaggccgugagccagcugugcagcaagacccaggccagccugcaggagagccuggagaagcacuucagcgagagcaugcaggaguuccaggagugguuccugggcgccaaggccgccgccaaggagagcagcgacagaaccggcgacagcaaggugcuggaggccaagcugcacgaccugcagaacauccuggacagcgugagcgacggccagagcaagcuggacgccgugacccaggagggccagacccuguacgcccaccugagcaagcagaucgugagcagcauccaggagcagaucaccaaggccaacgaggaguuccaggccuuccugaagcagugccugaaggacaagcaggcccugcaggacugcgccagcgagcugggcagcuucgaggaccagcacagaaagcugaaccuguggauccacgagauggaggagagauucaacaccgagaaccugggcgagagcaagcagcacauccccgagaagaagaacgaggugcacaagguggagauguuccugggcgagcugcuggccgccagagagagccuggacaagcugagccagagaggccagcugcugagcgaggagggccacggcgccggccaggagggcagacugugcagccagcugcugaccagccaccagaaccugcugagaaugaccaaggagaagcugagaagcugccagguggcccugcaggagcacgaggcccuggaggaggcccugcagagcaugugguucugggugaaggccauccaggacagacuggccugcgccgagagcacccugggcagcaaggacacccuggagaagagacugagccagauccaggacauccugcugaugaagggcgagggcgaggugaagcugaacauggccaucggcaagggcgagcaggcccugagaagcagcaacaaggagggccagagagugauccagacccagcuggagacccugaaggaggugugggccgacaucaugagcagcagcgugcacgcccagagcacccuggagagcgugaucagccaguggaacgacuacguggagagaaagaaccagcuggagcaguggauggagagcguggaccagaagaucgagcacccccugcagccccagcccggccugaaggagaaguucgugcugcuggaccaccugcagagcauccugagcgaggccgaggaccacaccagagcccugcacagacugaucgccaagagcagagagcuguacgagaagaccgaggacgagagcuucaaggacaccgcccaggaggagcugaagacccaguucaacgacaucaugaccguggccaaggagaagaugagaaagguggaggagaucgugaaggaccaccugauguaccuggacgccgugcacgaguucaccgacuggcugcacagcgccaaggaggagcugcacagauggagcgacaugagcggcgacagcagcgccacccagaagaagcugagcaagaucaaggagcugaucgacagcagagagaucggcgccagcagacugagcagaguggagagccuggcccccgaggugaagcagaacaccaccgccagcggcugcgagcugaugcacaccgagaugcaggcccugagagccgacuggaagcagugggaggacagcguguuccagacccagagcugccuggagaaccuggugagccagauggcccugagcgagcaggaguucagcggccagguggcccagcuggagcaggcccuggagcaguucagcgcccugcugaagaccugggcccagcagcugacccugcuggagggcaagaacaccgacgaggagaucguggagugcuggcacaagggccaggagauccuggacgcccugcagaaggccgagcccagaaccgaggaccugaagagccagcugaacgagcugugcagauucagcagagaccugagcaccuacagcggcaaggugagcggccugaucaaggaguacaacugccugugccugcaggccagcaagggcugccagaacaaggagcagauccugcagcagagauucagaaaggccuucagagacuuccagcaguggcuggugaacgccaagaucaccaccgccaagugcuucgacaucccccagaacaucagcgaggugagcaccagccugcagaagauccaggaguuccugagcgagagcgagaacggccagcacaagcugaacaugaugcugagcaagggcgagcugcugagcacccugcugaccaaggagaaggccaagggcauccaggccaaggugaccgccgccaaggaggacuggaagaacuuccacagcaaccugcaccagaaggagagcgcccuggagaaccugaagauccagaugaaggacuucgaggugagcgccgagcccauccaggacuggcugagcaagaccgagaagauggugcacgagagcagcaacagacuguacgaccugcccgccaagagaagagagcagcagaagcugcagagcgugcuggaggagauccacugcuacgagccccagcugaacagacugaaggagaaggcccagcagcugugggagggccaggccgccagcaagagcuucagacacagagugagccagcugagcagccaguaccuggcccugagcaaccugaccaaggagaaggugagcagacuggacagaaucguggccgagcacaaccaguucagccugggcaucaaggagcugcaggacuggaugaccgacgccauccacaugcuggacagcuacugccaccccaccagcgacaagagcgugcuggacagcagaacccugaagcuggaggcccugcugagcgugaagcaggagaaggagauccagaugaagaugaucgugaccagaggcgagagcgugcugcagaacaccagccccgagggcauccccaccauccagcagcagcugcagagcgugaaggacaugugggccagccugcugagcgccggcaucagaugcaagagccagcuggagggcgcccugagcaaguggaccagcuaccaggacggcgugagacaguucagcggcuggauggacagcauggaggccaaccugaacgagagcgagagacagcacgccgagcugagagacaagaccaccaugcugggcaaggccaagcugcugaacgaggaggugcugagcuacagcagccugcuggagaccaucgaggugaagggcgccggcaugaccgagcacuacgugacccagcuggagcugcaggaccugcaggagagauacagagccauccaggagagagccaaggaggccgugaccaagagcgagaagcuggugagacugcaccaggaguaccagagagaccugaaggccuucgagguguggcugggccaggagcaggagaagcuggaccaguacagcgugcuggagggcgacgcccacacccacgagaccacccugagagaccugcaggagcugcaggugcacugcgccgagggccaggcccugcugaacagcgugcugcacaccagagaggacgugauccccagcggcaucccccaggccgaggacagagcccuggagagccugagacaggacuggcaggccuaccagcacagacugagcgagaccagaacccaguucaacaacguggugaacaagcugagacugauggagcagaaguuccagcagguggacgaguggcugaagaccgccgaggagaagaaguggcacgaggaggugaccgccuacagagacgagguggaggaggugggcgccagagcccaggagauccuggacgagagccacgugaacagcagaaugggcugccaggccacccagcugaccagcagauaccaggcccugcugcugcaggugcuggagcagaucaaguuccuggaggaggagauccagagccuggaggagagcgagagcagccugagcagcuacagcgacugguacggcagcacccacaagaacuucaagaacguggccaccaagaucgacaagguggacaccgugaugaugggcaagaagcugaagacccuggaggugcugcugaaggacauggagaagggccacagccugcugaagagcgccagagagaagggcgagagagccgugaaguaccuggaggagggcgaggccgagagacugagaaaggagauccacgaccacauggagcagcugaaggagcugaccagcaccgugagaaaggagcacaugacccuggagaagggccugcaccuggccaaggaguucagcgacaagugcaaggcccugacccaguggaucgccgaguaccaggagauccugcacgugcccgaggagcccaagauggagcuguacgagaagaaggcccagcugagcaaguacaagagccugcagcagaccgugcugagccacgagcccagcgugaagagcgugagagagaagggcgaggcccugcuggagcuggugcaggacgugacccugaaggacaagaucgaccagcugcagagcgacuaccaggaccugugcagcaucggcaaggccaugauggaggagaucgccggcuucgaggacagacugaacaaccugcagaugaagggcgacacccugaucggccagugcgccgaccaccugcaggccaagcugaagcagaacgugcacgcccaccugcagggcaccaaggacagcuacagcgccaucugcagcaccgcccagagaauguaccagagccuggagcacgagcugcagaagcacgugagcagacaggacacccugcagcagugccaggccuggcugagcgccgugcagcccgaccuggagcccagcccccagcccccccugagcagagccgaggccaucaagcaggugaagcacuucagagcccugcaggagcaggccagaaccuaccuggaccugcugugcagcaugugcgaccugagcaacgccagcgugaagaccaccgccaaggacauccagcagaccgagcagaccaucgagcagaagcuggugcaggcccagaaccugacccagggcugggaggagaucaagcaccugaagagcgagcuguggaucuaccugcaggacgccgaccagcagcugcagaacaugaagagaagacacagcgagcuggagcugaacaucgcccagaacauggugagccaggugaaggacuucgugaagaagcugcagagcaagcaggccagcgugaacaccaucaucgagaaggugaacaagcugaccaagaaggaggagagccccgagcacaaggagaucaaccaccugaacgaccaguggcuggaccugugcagacagagcaacaaccugugccugcagagagaggaggaccugcagagaaccagagacuaccacgacugcaugaacgugguggagguguuccuggagaaguucaccaccgagugggacaaccuggccagaagcgacgccgagagcaccgccgugcaccuggaggcccugaagaagcuggcccuggcccugcaggagagaaaguacgccaucgaggaccugaaggaccagaagcagaagaugaucgagcaccugaaccuggacgacaaggagcuggugaaggagcagaccagccaccuggagcagagaugguuccagcuggaggaccugaucaagagaaagauccaggugagcgugaccaaccuggaggagcugaacguggugcagagcagauuccaggagcugauggagugggccgaggagcagcagcccaacaucgccgaggcccugaagcagagccccccccccgacauggcccagaaccugcugauggaccaccuggccaucugcagcgagcuggaggccaagcagaugcugcugaagagccugaucaaggacgccgacagagugauggccgaccugggccugaacgagagacaggugauccagaaggcccugagcgacgcccagagccacgugaacugccugagcgaccuggugggccagagaagaaaguaccugaacaaggcccugagcgagaagacccaguuccugauggccguguuccaggccaccagccagauccagcagcacgagagaaagaucauguucagagagcacaucugccugcugcccgacgacgugagcaagcaggugaagaccugcaagagcgcccaggccagccugaagaccuaccagaacgaggugaccggccugugggcccagggcagagagcugaugaaggaggugaccgagcaggagaagagcgaggugcugggcaagcugcaggagcugcagagcguguacgacagcgugcugcagaagugcagccacagacugcaggagcuggagaagaaccuggugagcagaaagcacuucaaggaggacuucgacaaggccugccacuggcugaagcaggccgacaucgugaccuuccccgagaucaaccugaugaacgagagcagcgagcugcacacccagcuggccaaguaccagaacauccuggagcagagccccgaguacgagaaccugcugcugacccugcagagaaccggccagaccauccugcccagccugaacgagguggaccacagcuaccugagcgagaagcugaacgcccugcccagacaguucaacgugaucguggcccuggccaaggacaaguucuacaaggugcaggaggccauccuggccagaaaggaguacgccagccugaucgagcugaccacccagagccugagcgagcuggaggcccaguuccugagaaugagcaaggugcccaccgaccuggccguggaggaggcccugagccugcaggacggcugcagagccauccuggacgagguggccggccugggcgaggccguggacgagcugaaccagaagaaggagggcuucagaagcaccggccagcccuggcagcccgacaagaugcugcaccuggugacccuguaccacagacugaagagacagaccgagcagagagugagccugcuggaggacaccaccagcgccuaccaggagcacgagaagaugugccagcagcuggagagacagcugaagagcgugaaggaggagcagagcaaggugaacgaggagacccugcccgccgaggagaagcugaagauguaccacagccuggccggcagccugcaggacagcggcaucgugcugaagagagugaccauccaccuggaggaccuggccccccaccuggacccccuggccuacgagaaggccagacaccagauccagagcuggcagggcgagcugaagcugcugaccagcgccaucggcgagaccgugaccgagugcgagagcagaauggugcagagcaucgacuuccagaccgagaugagcagaagccuggacuggcugagaagagugaaggccgagcugagcggccccguguaccuggaccugaaccugcaggacauccaggaggagaucagaaagauccagauccaccaggaggaggugcagagcagccugagaaucaugaacgcccugagccacaaggagaaggagaaguucaccaaggccaaggagcugaucagcgccgaccuggagcacagccuggccgagcugagcgagcuggacggcgacauccaggaggcccugagaaccagacaggccacccugaccgagaucuacagccagugccagagauacuaccagguguuccaggccgccaacgacuggcuggaggacgcccaggagcugcugcagcuggccggcaacggccuggacguggagagcgccgaggagaaccugaagagccacauggaguucuucagcaccgaggaccaguuccacagcaaccuggaggagcugcacagccugguggccacccuggacccccugaucaagcccaccggcaaggaggaccuggagcagaagguggccagccuggagcugagaagccagagaaugagcagagacagcggcgcccagguggaccugcugcagagaugcaccgcccaguggcacgacuaccagaaggccagagaggaggugaucgagcugaugaacgacaccgagaagaagcugagcgaguucagccugcugaagaccagcagcagccacgaggccgaggagaagcugagcgagcacaaggcccuggugagcguggugaacagcuuccacgagaagaucguggcccuggaggagaaggccagccagcuggagaagaccggcaacgacgccagcaaggccacccugagcagaagcaugaccaccguguggcagagauggaccagacugagagccguggcccaggaccaggagaagauccuggaggacgccguggacgaguggaccggcuucaacaacaaggugaagaaggccaccgagaugaucgaccagcugcaggacaagcugcccggcagcagcgccgagaaggccagcaaggccgagcugcugacccugcuggaguaccacgacaccuucgugcuggagcuggagcagcagcagagcgcccugggcaugcugagacagcagacccugagcaugcugcaggacggcgccgcccccacccccggcgaggagcccccccugaugcaggagaucaccgccaugcaggacagaugccugaacaugcaggagaaggugaagaccaacggcaagcuggugaagcaggagcugaaggacagagagaugguggagacccagaucaacagcgugaagugcugggugcaggagaccaaggaguaccugggcaaccccaccaucgagaucgacgcccagcuggaggagcugcagauccugcugaccgaggccaccaaccacagacagaacaucgagaagauggccgaggagcagaaggagaaguaccugggccuguacaccauccugcccagcgagcugagccugcagcuggccgagguggcccuggaccugaagaucagagaccagauccaggacaagaucaaggagguggagcagagcaaggccaccagccaggagcugagcagacagauccagaagcuggccaaggaccugaccaccauccugaccaagcugaaggccaagaccgacaacguggugcaggccaagaccgaccagaaggugcugggcgaggagcuggacggcugcaacagcaagcugauggagcuggacgccgccgugcagaaguuccuggagcagaacggccagcugggcaagccccuggccaagaagaucggcaagcugaccgagcugcaccagcagaccaucagacaggccgagaacagacugagcaagcugaaccaggccgccagccaccuggaggaguacaacgagaugcuggagcugauccugaaguggaucgagaaggccaaggugcuggcccacggcaccaucgccuggaacagcgccagccagcugagagagcaguacauccugcaccagacccugcuggaggagagcaaggagaucgacagcgagcuggaggccaugaccgagaagcugcaguaccugaccagcguguacugcaccgagaagaugagccagcagguggccgagcugggcagagagaccgaggagcugagacagaugaucaagaucagacugcagaaccugcaggacgccgccaaggacaugaagaaguucgaggccgagcugaagaagcugcaggccgcccuggagcaggcccaggccacccugaccagccccgaggugggcagacugagccugaaggagcagcugagccacagacagcaccugcugagcgagauggagagccugaagcccaaggugcaggccgugcagcugugccagagcgcccugagaauccccgaggacgugguggccagccugccccugugccacgccgcccugagacugcaggaggaggccagcagacugcagcacaccgccauccagcagugcaacaucaugcaggccgccguggugcaguacgagcaguacgagcaggagaugaagcaccugcagcagcugaucgagggcgcccacagagagaucgaggacaagcccguggccaccagcaacauccaggagcugcaggcccagaucagcagacacgaggagcuggcccagaagaucaagggcuaccaggagcagaucgccagccugaacagcaagugcaagaugcugaccaugaaggccaagcacgccaccaugcugcugaccgugaccgagguggagggccuggccgagggcaccgaggaccuggacggcgagcugcugcccacccccagcgcccaccccagcguggugaugaugaccgccggcagaugccacacccugcugagccccgugaccgaggagagcggcgaggagggcaccaacagcgagaucagcagcccccccgccugcagaagccccagccccguggccaacaccgacgccagcgugaaccaggacaucgccuacuaccaggcccugagcgccgagagacugcagaccgacgccgccaagauccaccccagcaccagcgccagccaggaguucuacgagcccggccuggagcccagcgccaccgccaagcugggcgaccugcagagaagcugggagacccugaagaacgugaucagcgagaagcagagaacccuguacgaggcccuggagagacagcagaaguaccaggacagccugcagagcaucagcaccaagauggaggccaucgagcugaagcugagcgagagccccgagcccggcagaagccccgagagccagauggccgagcaccaggcccugauggacgagauccugaugcugcaggacgagaucaacgagcugcagagcagccuggccgaggagcuggugagcgagagcugcgaggccgaccccgccgagcagcuggcccugcagagcacccugaccgugcuggccgagagaaugagcaccaucagaaugaaggccagcggcaagagacagcugcuggaggagaagcugaacgaccagcuggaggagcagagacaggagcaggcccugcagagauacagaugcgaggccgacgagcuggacagcuggcugcugagcaccaaggccacccuggacaccgcccugagcccccccaaggagcccauggacauggaggcccagcugauggacugccagaacaugcugguggagaucgagcagaaggugguggcccugagcgagcugagcgugcacaacgagaaccugcugcuggagggcaaggcccacaccaaggacgaggccgagcagcuggccggcaagcugagaagacugaagggcagccugcuggagcugcagagagcccugcacgacaagcagcugaacaugcagggcaccgcccaggagaaggaggagagcgacguggaccugaccgccacccagagccccggcgugcaggaguggcuggcccaggccagaaccaccuggacccagcagagacagagcagccugcagcagcagaaggagcuggagcaggagcuggccgagcagaagagccugcugagaagcguggccagcagaggcgaggagauccugauccagcacagcgccgccgagaccagcggcgacgccggcgagaagcccgacgugcugagccaggagcugggcauggagggcgagaagagcagcgccgaggaccagaugagaaugaagugggagagccugcaccaggaguucagcaccaagcagaagcugcugcagaacgugcuggagcaggagcaggagcaggugcuguacagcagacccaacagacugcugagcggcgugccccuguacaagggcgacgugcccacccaggacaagagcgccgugaccagccugcuggacggccugaaccaggccuucgaggaggugagcagccagagcggcggcgccaagagacagagcauccaccuggagcagaagcuguacgacggcgugagcgccaccagcaccuggcuggacgacguggaggagagacuguucguggccaccgcccugcugcccgaggagaccgagaccugccuguucaaccaggagauccuggccaaggacaucaaggagaugagcgaggagauggacaagaacaagaaccuguucagccaggccuuccccgagaacggcgacaacagagacgugaucgaggacacccugggcugccugcugggcagacugagccugcuggacagcguggugaaccagagaugccaccagaugaaggagagacugcagcagauccugaacuuccagaacgaccugaaggugcuguucaccagccuggccgacaacaaguacaucauccugcagaagcuggccaacguguucgagcagcccguggccgagcagaucgaggccauccagcaggccgaggacggccugaaggaguucgacgccggcaucaucgagcugaagagaagaggcgacaagcugcagguggagcagcccagcaugcaggagcugagcaagcugcaggacauguacgacgagcugaugaugaucaucggcagcagaagaagcggccugaaccagaaccugacccugaagagccaguacgagagagcccugcaggaccuggccgaccugcuggagaccggccaggagaagauggccggcgaccagaagaucaucgugagcagcaaggaggagauccagcagcugcuggacaagcacaaggaguacuuccagggccuggagagccacaugauccugaccgagacccuguucagaaagaucaucagcuucgccgugcagaaggagacccaguuccacaccgagcugauggcccaggccagcgccgugcugaagagagcccacaagagaggcguggagcuggaguacauccuggagaccuggagccaccuggacgaggaccagcaggagcugagcagacagcuggaggugguggagagcagcauccccagcgugggccugguggaggagaacgaggacagacugaucgacagaaucacccuguaccagcaccugaagagcagccugaacgaguaccagcccaagcuguaccaggugcuggacgacggcaagagacugcugaucagcaucagcugcagcgaccuggagagccagcugaaccagcugggcgagugcuggcugagcaacaccaacaagaugagcaaggagcugcacagacuggagaccauccugaagcacuggaccagauaccagagcgagagcgccgaccugauccacuggcugcagagcgccaaggacagacuggaguucuggacccagcagagcgugaccgugccccaggagcuggagauggugagagaccaccugaacgccuuccuggaguucagcaaggagguggacgcccagagcagccugaagagcagcgugcugagcaccggcaaccagcugcugagacugaagaagguggacaccgccacccugagaagcgagcugagcagaaucgacagccaguggaccgaccugcugaccaacauccccgccgugcaggagaagcugcaccagcugcagauggacaagcugcccagcagacacgccaucagcgaggugaugagcuggaucagccugauggagaacgugauccagaaggacgaggacaacaucaagaacagcaucggcuacaaggccauccacgaguaccugcagaaguacaagggcuucaagaucgacaucaacugcaagcagcugaccguggacuucgugaaccagagcgugcugcagaucagcagccaggacguggagagcaagagaagcgacaagaccgacuucgccgagcagcugggcgccaugaacaagagcuggcagauccugcagggccuggugaccgagaagauccagcugcuggagggccugcuggagagcuggagcgaguacgagaacaacgugcagugccugaagaccugguucgagacccaggagaagagacugaagcagcagcacagaaucggcgaccaggccagcgugcagaacgcccugaaggacugccaggaccuggaggaccugaucaaggccaaggagaaggagguggagaagaucgagcagaacggccuggcccugauccagaacaagaaggaggacgugagcagcaucgugaugagcacccugagagagcugggccagaccugggccaaccuggaccacauggugggccagcugaagauccugcugaagagcgugcuggaccaguggagcagccacaagguggccuucgacaagaucaacagcuaccugauggaggccagauacagccugagcagauucagacugcugaccggcagccuggaggccgugcaggugcagguggacaaccugcagaaccugcaggacgaccuggagaagcaggagagaagccugcagaaguucggcagcaucaccaaccagcugcugaaggagugccacccccccgugaccgagacccugaccaacacccugaaggaggugaacaugagauggaacaaccugcuggaggagaucgccgagcagcugcagagcagcaaggcccugcugcagcuguggcagagauacaaggacuacagcaagcagugcgccagcaccgugcagcagcaggaggacagaaccaacgagcugcugaaggccgccaccaacaaggacaucgccgacgacgagguggccaccuggauccaggacugcaacgaccugcugaagggccugggcaccgugaaggacagccuguucuuccugcacgagcugggcgagcagcugaagcagcagguggacgccagcgccgccagcgccauccagagcgaccagcugagccugagccagcaccugugcgcccuggagcaggcccugugcaagcagcagaccagccugcaggccggcgugcuggacuacgagaccuucgccaagagccuggaggcccuggaggccuggaucguggaggccgaggagauccugcagggccaggaccccagccacagcagcgaccugagcaccauccaggagagaauggaggagcugaagggccagaugcugaaguucagcagcauggcccccgaccuggacagacugaacgagcugggcuacagacugccccugaacgacaaggagaucaagagaaugcagaaccugaacagacacuggagccugaucagcagccagaccaccgagagauucagcaagcugcagagcuuccugcugcagcaccagaccuuccuggagaagugcgagaccuggauggaguuccuggugcagaccgagcagaagcuggccguggagaucagcggcaacuaccagcaccugcuggagcagcagagagcccacgagcuguuccaggccgagauguucagcagacagcagauccugcacagcaucaucaucgacggccagagacugcuggagcagggccagguggacgacagagacgaguucaaccugaagcugacccugcugagcaaccaguggcagggcgugaucagaagagcccagcagagaagaggcaucaucgacagccagaucagacaguggcagagauacagagagauggccgagaagcugagaaaguggcugguggaggugagcuaccugcccaugagcggccugggcagcgugcccaucccccugcagcaggccagaacccuguucgacgaggugcaguucaaggagaagguguuccugagacagcagggcagcuacauccugaccguggaggccggcaagcagcugcugcugagcgccgacagcggcgccgaggccgcccugcaggccgagcuggccgagauccaggagaaguggaagagcgccagcaugagacuggaggagcagaagaagaagcuggccuuccugcugaaggacugggagaagugcgagaagggcaucgccgacagccuggagaagcugagaaccuucaagaagaagcugagccagagccugcccgaccaccacgaggagcugcacgccgagcagaugagaugcaaggagcuggagaacgccgugggcagcuggaccgacgaccugacccagcugagccugcugaaggacacccugagcgccuacaucagcgccgacgacaucagcauccugaacgagagaguggagcugcugcagagacagugggaggagcugugccaccagcugagccugagaagacagcagaucggcgagagacugaacgagugggccguguucagcgagaagaacaaggagcugugcgaguggcugacccagauggagagcaaggugagccagaacggcgacauccugaucgaggagaugaucgagaagcugaagaaggacuaccaggaggagaucgccaucgcccaggagaacaagauccagcugcagcagaugggcgagagacuggccaaggccagccacgagagcaaggccagcgagaucgaguacaagcugggcaaggugaacgacagauggcagcaccugcuggaccugaucgccgccagagugaagaagcugaaggagacccugguggccgugcagcagcuggacaagaacaugagcagccugagaaccuggcuggcccacaucgagagcgagcuggccaagcccaucguguacgacagcugcaacagcgaggagauccagagaaagcugaacgagcagcaggagcugcagagagacaucgagaagcacagcaccggcguggccagcgugcugaaccugugcgaggugcugcugcacgacugcgacgccugcgccaccgacgccgagugcgacagcauccagcaggccaccagaaaccuggacagaagauggagaaacaucugcgccaugagcauggagagaagacugaagaucgaggagaccuggagacuguggcagaaguuccuggacgacuacagcagauucgaggacuggcugaagagcagcgagagaaccgccgccuuccccagcagcagcggcgugaucuacaccguggccaaggaggagcugaagaaguucgaggccuuccagagacaggugcacgagugccugacccagcuggagcugaucaacaagcaguacagaagacuggccagagagaacagaaccgacagcgccugcagccugaagcagauggugcacgagggcaaccagagaugggacaaccugcagaagagagugaccagcauccugagaagacugaagcacuucaucggccagagagaggaguucgagaccgccagagacagcauccugguguggcugaccgagauggaccugcagcugaccaacaucgagcacuucagcgagugcgacgugcaggccaagaucaagcagcugaaggccuuccagcaggagaucagccugaaccacaacaagaucgagcagaucaucgcccagggcgagcagcugaucgagaagagcgagccccuggacgccgccaucaucgaggaggagcuggacgagcugagaagauacugccaggagguguucggcagaguggagagauaccacaagaagcugaucagacugccccugcccgacgacgagcacgaccugagcgacagagagcuggagcuggaggacagcgccgcccugagcgaccugcacuggcacgacagaagcgccgacagccugcugagcccccagcccagcagcaaccugagccugagccuggcccagccccugagaagcgagagaagcggcagagacacccccgccagcguggacagcaucccccuggagugggaccacgacuacgaccugagcagagaccuggagagcgccaugagcagagcccugcccagcgaggacgaggagggccaggacgacaaggacuucuaccugagaggcgccgugggccugagcgacgugaugauccccgagagccccgaggccuacgugaagcugaccgagaacgccaucaagaacaccagcggcgaccacagcgcccuggagagccagaucagacagcugggcaaggcccuggacgacagcagauuccagauccagcagaccgagaacaucaucagaagcaagacccccaccggccccgagcuggacaccagcuacaagggcuacaugaagcugcugggcgagugcagcagcagcaucgacagcgugaagagacuggagcacaagcugaaggaggaggaggagagccugcccggcuucgugaaccugcacagcaccgagacccagaccgccggcgugaucgacagaugggagcugcugcaggcccaggcccugagcaaggagcugagaaugaagcagaaccugcagaaguggcagcaguucaacagcgaccugaacagcaucugggccuggcugggcgacaccgaggaggagcuggagcagcugcagagacuggagcugagcaccgacauccagaccaucgagcugcagaucaagaagcugaaggagcugcagaaggccguggaccacagaaaggccaucauccugagcaucaaccugugcagccccgaguucacccaggccgacagcaaggagagcagagaccugcaggacagacugagccagaugaacggcagaugggacagagugugcagccugcuggaggaguggagaggccugcugcaggacgcccugaugcagugccagggcuuccacgagaugagccacggccugcugcugaugcuggagaacaucgacagaagaaagaacgagaucgugcccaucgacagcaaccuggacgccgagauccugcaggaccaccacaagcagcugaugcagaucaagcacgagcugcuggagagccagcugagaguggccagccugcaggacaugagcugccagcugcuggugaacgccgagggcaccgacugccuggaggccaaggagaaggugcacgugaucggcaacagacugaagcugcugcugaaggaggugagcagacacaucaaggagcuggagaagcugcuggacgugagcagcagccagcaggaccugagcagcuggagcagcgccgacgagcuggacaccagcggcagcgugagccccaccagcggcagaagcacccccaacagacagaagacccccagaggcaagugcagccugagccagcccggccccagcgugagcagcccccacagcagaagcaccaagggcggcagcgacagcagccugagcgagcccggccccggcagaagcggcagaggcuuccuguucagagugcugagagccgcccugccccugcagcugcugcugcugcugcugaucggccuggccugccuggugcccaugagcgaggaggacuacagcugcgcccugagcaacaacuucgccagaagcuuccaccccaugcugagauacaccaacggcccccccccccuguaa

SEQ ID NO: 24285 - RNA, 20658 nt, Artificial Sequence
  SYNE2__Homo_sapiens__NP_055995
auggccagcagccccgagcugcccaccgaggacgagcagggcagcuggggcaucgacgaccugcacaucagccugcaggccgagcaggaggacacccagaagaaggccuucaccugcuggaucaacagccagcuggccagacacaccagccccagcgugaucagcgaccuguucaccgacaucaagaagggccacgugcugcuggaccugcuggaggugcugagcggccagcagcugcccagagacaagggcagcaacaccuuccagugcagaaucaacaucgagcacgcccugaccuuccugagaaacagaagcaucaagcugaucaacauccacgugaccgacaucaucgacggcaaccccagcaucauccugggccugaucuggaccaucauccugcacuuccacaucgagaagcuggcccagacccugagcugcaacuacaaccagcccagccuggacgacgugagcgugguggacagcagccccgccagcagcccccccgccaagaagugcagcaaggugcaggccagauggcagaugagcgccagaaaggcccugcugcugugggcccaggagcagugcgccaccuacgagagcgugaacgugaccgacuucaagagcagcuggagaaacggcauggccuuccuggccaucauccacgcccugagacccgaccugaucgacaugaagagcgugaagcacagaagcaacaaggacaaccugagagaggccuucagaaucgccgagcaggagcugaagauccccagacugcuggagcccgaggacguggacgugguggaccccgacgagaagagcaucaugaccuacguggcccaguuccugcaguacagcaaggacgcccccggcaccggcgaggaggcccagggcaaggugaaggacgccaugggcuggcugacccugcagaaggagaagcugcagaagcugcugaaggacagcgagaacgacaccuacuucaagaaguacaacagccugcugagcuucauggagagcuucaacgaggagaagaagagcuuccuggacgugcugagcaucaagagagaccuggacgagcuggacaaggaccaccugcagcugagagaggccugggacggccuggaccaccagaucaacgccuggaagaucaagcugaacuacgcccugccccccccccugcaccagaccgaggccuggcugcaggagguggaggagcugauggacgaggaccugagcgccagccaggaccacagccaggccgugacccugauccaggagaagaugacccuguucaagagccugauggacagauucgagcaccacagcaacauccugcugaccuucgagaacaaggacgagaaccaccugccccuggugccccccaacaagcuggaggagaugaagagaagaaucaacaacauccuggagaagaaguucauccugcugcuggaguuccacuacuacaagugccuggugcugggccugguggacgaggugaagagcaagcuggacaucuggaacaucaaguacggcagcagagagagcguggagcugcugcuggaggacuggcacaaguucaucgaggagaaggaguuccuggccagacuggacaccagcuuccagaagugcggcgagaucuacaagaaccuggccggcgagugccagaacaucaacaagcaguacaugauggugaagagcgacgugugcauguacagaaagaacaucuacaacgugaagagcacccugcagaaggugcuggccugcugggccaccuacguggagaaccugagacugcugagagccugcuucgaggagaccaagaaggaggagaucaaggaggugcccuucgagacccuggcccaguggaaccuggagcacgccacccugaacgaggccggcaacuuccugguggaggugagcaacgacguggugggcagcagcaucagcaaggagcugagaagacugaacaagagauggagaaagcuggugagcaagacccagcuggagaugaaccugccccugaugaucaagaagcaggaccagcccaccuucgacaacagcggcaacauccugagcaaggaggagaaggccaccguggaguucagcaccgacaugagcguggagcugcccgagaacuacaaccagaacaucaaggccggcgagaagcacgagaaggagaacgaggaguucaccggccagcugaagguggccaaggacguggagaagcugaucggccagguggagaucugggaggccgaggccaagagcgugcuggaccaggacgacguggacaccagcauggaggagagccugaagcaccugaucgccaagggcagcauguucgacgagcugauggccagaagcgaggacaugcugcagauggacauccagaacaucagcagccaggagagcuuccagcacgugcugaccaccggccugcaggccaagauccaggaggccaaggagaaggugcagaucaacguggugaagcugaucgccgcccugaagaaccugaccgacgugagccccgaccuggacaucagacugaagauggaggagagccagaaggagcuggagagcuacaugaugagagcccagcagcugcugggccagagagagagccccggcgagcugaucagcaagcacaaggaggcccugaucaucagcaacaccaagagccuggccaaguaccugaaggccguggaggagcugaagaacaacgugaccgaggacaucaagaugagccuggaggagaagagcagagacgugugcgccaagugggagagccugcaccacgagcugagccuguacgugcagcagcugaagaucgacaucgagaagggcaagcugagcgacaacauccugaagcuggagaagcagaucaacaaggagaagaagcugaucagaagaggcagaaccaagggccugaucaaggagcacgaggccugcuucagcgaggagggcugccuguaccagcugaaccaccacauggaggugcugagagagcugugcgaggagcugcccagccagaagagccagcaggaggugaagagacugcugaaggacuacgagcagaagaucgagagacugcugaagugcgccagcgagauccacaugacccugcagcccaccgccggcggcaccagcaagaacgagggcaccaucaccaccagcgagaacagaggcggcgacccccacagcgaggcccccuucgccaagagcgacaaccagcccagcaccgagaaggccauggagcccaccaugaaguucagccuggccagcgugcugagaccccugcaggaggagagcaucauggagaaggacuacagcgccagcaucaacagccugcuggagagauacgacaccuacagagacauccuggagcaccaccugcagaacaacaaguucagaaucaccagcgacuucagcagcgaggaggacagaagcagcagcugccugcaggccaagcugaccgaccugcaggugaucaagaacgagaccgacgccagauggaaggaguucgagaucaucagccugaagcuggagaaccacgugaacgacaucaagaagcccuucgugaucaaggagagagacacccugaaggagagagagagagagcugcagaugacccugaacaccagaauggagagccuggagaccgcccugagacuggugcugcccguggagaaggccagccugcugcugugcggcagcgaccugccccugcacaagauggccauccagggcuuccaccugaucgacgccgacagaaucuaccagcaccugagaaacauccaggacagcaucgccaagcagaucgagaucugcaacagacuggaggagcccggcaacuucgugcugaaggagcugcaccccuucgaccugcacgccaugcagaacaucauccugaaguacaagacccaguucgagggcaugaaccacagagugcagagaagcgaggacacccugaaggcccuggaggacuuccuggccagccugagaaccgccaagcugagcgccgagcccgugaccgaccugagcgccagcgacacccagguggcccaggagaacacccugaccgugaagaacaaggagggcgagauccaccugaugaaggacaaggccaagcaccuggacaagugccugaagaugcuggacaugagcuucaaggacgccgagagaggcgacgacaccagcugcgagaaccugcuggacgccuucagcaucaagcugagcgagacccacggcuacggcgugcaggaggaguucaccgaggagaacaagcugcuggaggccugcaucuucaagaacaacgagcugcugaagaacauccaggacgugcagagccagaucagcaagaucggccugaaggaccccaccgugcccgccgugaagcacagaaagaagagccugaucagacuggacaaggugcuggacgaguacgaggaggagaagagacaccugcaggagauggccaacagccugccccacuucaaggacggcagagagaagaccgugaaccagcagugccagaacaccguggugcugugggagaacaccaaggcccuggugaccgagugccuggagcagugcggcagagugcuggagcugcugaagcaguaccagaacuucaagagcauccugaccacccugauccagaaggaggagagcgugaucagccugcaggccagcuacaugggcaaggagaaccugaagaagagaaucgccgagaucgagaucgugaaggaggaguucaacgagcaccuggaggugguggacaagaucaaccaggugugcaagaaccugcaguucuaccugaacaagaugaagaccuucgaggagccccccuucgagaaggaggccaacaucaucguggacagauggcuggacaucaacgagaagaccgaggacuacuacgagaaccugggcagagcccuggcccugugggacaagcuguucaaccugaagaacgugaucgacgaguggaccgagaaggcccugcagaagauggagcugcaccagcugaccgaggaggacagagagagacugaaggaggagcugcaggugcacgagcagaagaccagcgaguucagcagaagaguggccgagauccaguuccugcugcagagcagcgagaucccccuggagcugcaggugauggagagcagcauccugaacaagauggagcacgugcagaagugccugaccggcgagagcaacugccacgcccugagcggcagcaccgccgagcugagagaggaccuggaccaggccaagacccagaucggcaugaccgagagccugcugaaggcccugagccccagcgacagccuggagaucuucaccaagcuggaggagauccagcagcagauccugcagcagaagcacagcaugauccugcuggagaaccagaucggcugccugacccccgagcugagcgagcugaagaagcaguacgagagcgugagcgaccuguucaacaccaagaagagcgugcugcaggaccacuucagcaagcugcugaacgaccagugcaagaacuucaacgacugguucagcaacaucaaggugaaccugaaggagugcuucgagagcagcgagaccaagaagagcguggagcagaagcugcagaagcugagcgacuuccugacccuggagggcagaaacagcaagaucaagcagguggacagcgugcugaagcacgugaagaagcaccugcccaaggcccacgugaaggagcugaucagcuggcuggugggccaggaguucgagcuggagaagauggagagcaucugccaggccagagccaaggagcuggaggacagccugcagcagcugcugagacugcaggacgaccacagaaaccugagaaaguggcugaccaaccaggaggagaaguggaagggcauggaggagcccggcgagaagaccgagcuguucugccaggcccuggccagaaagagagagcaguucgagagcguggcccagcugaacaacagccugaaggaguacggcuucaccgaggaggaggagaucaucauggaggccaccugccugauggacagauaccagacccugcugagacagcugagcgagaucgaggaggaggacaagcugcugcccaccgaggaccagagcuucaacgaccuggcccacgacgugauccacuggaucaaggagaucaaggagagccugauggugcugaacagcagcgagggcaagaugccccuggaggagagaauccagaagaucaaggagaucauccugcugaagcccgagggcgacgccagaaucgagaccaucaugaagcaggccgagagcagcgaggccccccuggugcagaagacccugaccgacaucagcaaccagugggacaacacccugcaccuggccagcaccuaccugagccaccaggagaagcugcugcuggagggcgagaaguaccugcagagcaaggaggaccugagacugaugcugaucgagcugaagaagaagcaggaggccggcuucgcccugcagcacggccugcaggagaagaaggcccagcugaagaucuacaagaaguuccugaagaaggcccaggaccugaccagccugcugaaggagcugaagagccagggcaacuaccugcuggagugcaccaagaaccccagcuucagcgaggagcccuggcuggagaucaagcaccugcacgagagccugcugcagcagcugcaggacagcgugcagaaccuggacggccacgugagagagcacgacagcuaccaggugugcgugaccgaccugaacaccacccuggacaacuucagcaaggaguucgugagcuucagcgacaagcccguggaccagaucgccguggaggagaagcugcagaagcugcaggagcuggagaacagacugagccugcaggacggcacccugaagaagauccuggcccuggccaagagcgugaagcagaacaccagcagcgugggccagaagaucaucaaggacgacaucaagagccugcagugcaagcagaaggaccuggagaacagacuggccagcgccaagcaggagauggagugcugccugaacagcauccugaagagcaagagaagcaccgagaagaagggcaaguucacccugcccggcagagagaagcaggccaccagcgacgugcaggagagcacccaggagagcgccgccguggagaagcuggaggaggacugggagaucaacaaggacagcgccguggagauggccaugagcaagcagcugagccugaacgcccaggagagcaugaagaacaccgaggacgagagaaaggugaacgagcugcagaaccagccccuggagcuggacaccaugcugagaaacgagcagcuggaggagaucgagaagcuguacacccagcuggaggccaagaaggccgccaucaagccccuggagcagaccgagugccugaacaagaccgagaccggcgcccuggugcugcacaacaucggcuacagcgcccagcaccuggacaaccugcugcaggcccugaucacccugaagaagaacaaggagagccaguacugcgugcugagagacuuccaggaguaccuggccgccguggagagcagcaugaaggcccugcugaccgacaaggagagccugaaggugggcccccuggacagcgugaccuaccuggacaagaucaagaaguucaucgccagcaucgagaaggagaaggacagccugggcaaccugaagaucaagugggagaaccugagcaaccacgugaccgacauggacaagaagcugcuggagagccagaucaagcagcuggagcacggcugggagcagguggagcagcagauccagaagaaguacagccagcaggugguggaguacgacgaguucaccacccugaugaacaaggugcaggacaccgagaucagccugcagcagcagcagcagcaccugcagcugagacugaagagccccgaggagagagccggcaaccagagcaugaucgcccugaccaccgaccugcaggccaccaagcacggcuucagcgugcugaagggccaggccgagcugcagaugaagagaaucuggggcgagaaggagaagaagaaccuggaggacggcaucaacaaccugaagaagcagugggagacccuggagccccugcaccuggaggccgagaaccagaucaagaagugcgacaucagaaacaagaugaaggagaccauccugugggccaagaaccugcugggcgagcugaaccccagcaucccccugcugcccgacgacauccugagccagaucagaaagugcaaggugacccacgacggcauccuggccagacagcagagcguggagagccuggccgaggaggugaaggacaaggugcccagccugaccaccuacgagggcagcgaccugaacaacacccuggaggaccugagaaaccaguaccagaugcuggugcugaagagcacccagagaagccagcagcuggaguucaagcuggaggagagaagcaacuucuucgccaucaucagaaaguuccagcugauggugcaggagagcgagacccugaucauccccagaguggagaccgccgccaccgaggccgagcugaagcaccaccacgugacccuggaggccagccagaaggagcugcaggagaucgacagcggcaucagcacccaccugcaggagcugaccaacaucuacgaggagcugaacguguucgagagacuguuccuggaggaccagcugaagaaccugaagaucagaaccaacagaauccagagauucauccagaacaccugcaacgagguggagcacaagaucaaguucugcagacaguuccacgagaagaccagcgcccugcaggaggaggccgacagcauccagagaaacgagcugcugcugaaccaggaggugaacaagggcgugaaggaggagaucuacaaccugaaggacagacugaccgccaucaagugcugcauccugcaggugcugaagcugaagaagguguucgacuacaucggccugaacugggacuucagccagcuggaccagcugcagacccagguguucgagaaggagaaggagcuggaggagaagaucaagcagcuggacaccuucgaggaggagcacggcaaguaccaggcccugcugagcaagaugagagccaucgaccugcagaucaagaagaugaccgagguggugcugaaggcccccgacagcagccccgagagcagaagacugaacgcccagauccugagccagagaaucgagaaggccaagugccugugcgacgagaucaucaagaagcugaacgagaacaagaccuucgacgacagcuucaaggagaaggagauccugcagaucaagcugaacgccgaggagaacgacaagcuguacaaggugcugcagaacauggugcuggagcugagccccaaggagcuggacgagaagaacugccaggacaagcuggagaccagccugcacgugcugaaccagaucaagagccagcugcagcagccccugcugaucaaccuggagaucaagcacauccagaacgagaaggacaacugcgaggccuuccaggagcaggugugggccgagaugugcagcaucaaggccgugaccgccaucgagaagcagagagaggagaacagcagcgaggccagcgacguggagaccaagcugagagaguucgaggaccugcagaugcagcugaacaccagcaucgaccugagaaccaacgugcugaacgacgccuacgagaaccugaccagauacaaggaggccgugaccagagccguggagagcaucaccagccuggaggccaucaucauccccuacagaguggacgugggcaaccccgaggagagccuggagaugccccugagaaagcaggaggagcuggagagcaccguggcccacauccaggaccugaccgagaagcugggcaugaucagcagccccgaggccaagcugcagcugcaguacacccugcaggagcuggugagcaagaacagcgccaugaaggaggccuucaaggcccaggagaccgaggccgagagauaccuggagaacuacaagugcuacagaaagauggaggaggacaucuacaccaaccugagcaagauggagaccgugcugggccagagcaugagcagccugccccugagcuacagagaggcccuggagagacuggagcagagcaaggcccuggugagcaaccugaucagcaccaaggaggagcugaugaagcugagacagauccugagacugcugagacugagaugcaccgagaacgacggcaucugccugcugaagaucgugagcgcccugugggagaaguggcugagccugcuggaggccgccaaggagugggagauguggugcgaggagcugaagcaggaguggaaguucgugagcgaggagaucgagagagaggccaucauccuggacaaccugcaggaggagcugcccgagaucagcaagaccaaggaggccgccaccaccgaggagcugagcgagcugcuggacugccugugccaguacggcgagaacguggagaagcagcagcugcugcugacccugcugcugcagagaaucagaagcauccagaacgugcccgagagcagcggcgccguggagaccgugcccgccuuccaggagaucaccagcaugaaggagagaugcaacaagcugcugcagaaggugcagaagaacaaggagcuggugcagaccgagauccaggagagacacagcuucaccaaggagaucaucgcccugaagaacuucuuccagcagaccaccaccagcuuccagaacauggccuuccaggaccaccccgagaagagcgagcaguucgaggagcugcagagcauccugaagaagggcaagcugaccuucgagaacaucauggagaagcugagaaucaaguacagcgagauguacaccaucgugcccgccgagaucgagagccagguggaggagugcagaaaggcccuggaggacaucgacgagaagaucagcaacgaggugcugaagagcagccccagcuacgccaugagaagaaagaucgaggagaucaacaacggccugcacaacguggagaagaugcugcagcagaagagcaagaacaucgagaaggcccaggagauccagaagaagaugugggacgagcuggaccuguggcacagcaagcugaacgagcuggacagcgaggugcaggacaucguggagcaggaccccggccaggcccaggaguggauggacaaccugaugauccccuuccagcaguaccagcaggugagccagagagccgagugcagaaccagccagcugaacaaggccaccgugaagauggaggaguacagcgaccugcugaagagcaccgaggccuggaucgagaacaccagccaccugcuggccaaccccgccgacuacgacagccugagaacccugagccaccacgccagcaccgugcagauggcccuggaggacagcgagcagaagcacaaccugcugcacagcaucuucauggaccuggaggaccugagcaucaucuucgagaccgacgagcugacccagagcauccaggagcugagcaaccaggugaccgcccugcagcagaagaucauggagagccugccccagauccagagaauggccgacgacgugguggccaucgagagcgaggugaagagcauggagaagagagugagcaagaucaagaccauccugcugagcaaggagaucuucgacuucagccccgaggagcaccugaagcacggcgaggugauccuggagaacaucagacccaugaagaagaccaucgccgagaucgugagcuaccagguggagcugagacugccccagaccggcaugaagccccugcccguguuccagagaaccaaccagcugcugcaggacaucaagcugcuggagaacgugacccaggagcagaacgagcugcugaagguggugaucaagcagaccaacgagugggacgaggagaucgagaaccugaagcagauccugaacaacuacagcgcccaguucagccuggagcacaugagccccgaccaggccgacaagcugccccagcugcagggcgagaucgagagaauggagaagcagauccugagccugaaccagagaaaggaggaccugcugguggaccugaaggccaccgugcugaaccugcaccagcaccugaagcaggagcaggagggcguggagagagacagacugcccgccgugaccagcgaggagggcggcguggccgagagagacgccagcgagagaaagcugaacagaagaggcagcaugagcuaccuggccgccguggaggaggagguggaggagagcagcgugaagagcgacaacggcgacgagaaggccgagcccagcccccagagcuggagcagccuguggaagcacgacaaggacauggaggaggacagagccagcagcagcagcggcaccaucgugcaggaggccuacggcaagaucagcaccagcgacaacagcauggcccagauccugacccccgacagccugaacaccgagcagggccccgagugcagccugagacccaaccagaccgaggagggcaccaccccccccaucgaggccgacacccuggacagcagcgacgcccagggcggccuggagcccagaguggagaagaccagacccgagcccaccgaggugcugcacgccugcaagacccagguggccgagcuggagcuguggcugcagcaggccaacguggccguggagcccgagacccugaacgccgacaugcagcaggugcuggagcagcagcuggugggcugccaggccaugcugaccgagaucgagcacaagguggccuuccugcuggagaccugcaaggaccagggccugggcgacaacggcgccacccagcacgaggccgaggcccugagccugaagcugaagaccgugaagugcaaccuggagaaggugcagaugaugcugcaggagaagcacagcgaggaccagcaccccaccauccugaagaagagcagcgagcccgagcaccaggaggcccugcagcccgugaaccugagcgagcuggagagcaucgugaccgagagaccccaguucagcagacagaaggacuuccagcagcagcaggugcuggagcugaagcccauggagcagaaggacuucaucaaguucaucgaguucaacgccaagaagauguggccccaguacugccagcacgacaacgacaccacccaggagagcagcgccagcaaccaggccagcagccccgagaacgacgugcccgacagcauccugagcccccagggccagaacggcgacaaguggcaguaccugcaccacgagcugagcagcaagaucaagcugccccugccccagcugguggagccccaggugagcaccaacaugggcauccugcccagcgugaccauguacaacuucagauaccccaccaccgaggagcugaagaccuacaccacccagcuggaggaccugagacaggaggccagcaaccugcagacccaggagaacaugaccgaggaggccuacaucaaccuggacaagaagcuguucgagcuguuccugacccugagccagugccugagcagcguggaggagaugcuggagaugcccagacuguacagagaggacggcagcggccagcaggugcacuacgagacccuggcccuggagcugaagaagcuguaccuggcccugagcgacaagaagggcgaccugcugaaggccaugaccuggcccggcgagaacaccaaccugcugcuggagugcuucgacaaccugcaggugugccuggagcacacccaggccgccgccgugugcagaagcaagagccugaaggccggccuggacuacaacagaagcuaccagaacgagaucaagagacuguaccaccagcugaucaagagcaagaccagccugcagcagagccugaacgagaucagcggccagagcguggccgagcagcugcagaaggccgacgccuacaccguggagcuggagaacgccgagagcagaguggccaagcugagagacgagggcgagagacugcaccugcccuacgcccugcugcaggagguguacaagcuggaggacgugcuggacagcauguggggcaugcugagagccagauacaccgagcugagcagccccuucgugaccgagagccagcaggacgcccugcugcagggcaugguggagcuggugaagaucggcaaggagaagcuggcccacggccaccugaagcagaccaagagcaagguggcccugcaggcccagaucgagaaccacaagguguucuuccagaagcugguggccgacaugcugcugauccaggccuacagcgccaagauccugcccagccugcugcagaacagagagaccuucugggccgagcaggugaccgaggugaagauccuggaggagaagagcagacagugcggcaugaagcugcagagccugcugcagaagugggaggaguucgacgagaacuacgccagccuggagaaggaccuggagauccugaucagcacccugcccagcgugagccugguggaggagaccgaggagagacugguggagagaaucagcuucuaccagcagaucaagagaaacaucggcggcaagcacgccagacuguaccagacccugaacgagggcaagcagcugguggccagcgugagcugccccgagcuggagggccagaucgccaagcuggaggagcaguggcugagccugaacaagaagaucgaccacgagcugcacagacugcaggcccugcugaagcaccugcugagcuacaacagagacagcgaccagcugaccaaguggcuggagagcagccagcacacccugaacuacuggaaggagcagagccugaacgugagccaggaccuggacaccaucagaagcaacaucaacaacuucuucgaguucagcaaggagguggacgagaagagcagccugaagaccgccgugaucagcaucggcaaccagcugcugcaccugaaggagaccgacaccgccacccugagagccagccuggcccaguucgagcagaaguggaccaugcugaucacccagcugcccgacauccaggagaagcugcaccagcugcagauggagaagcugcccagcagaaaggccaucaccgagaugaucagcuggaugaacaacguggagcaccagaccagcgacgaggacagcgugcacagccccagcagcgccagccaggugaagcaccugcugcagaagcacaaggaguucagaauggagauggacuacaagcaguggaucguggacuucgugaaccagagccugcugcagcugagcaccugcgacguggagagcaagagauacgagagaaccgaguucgccgagcaccugggcgagaugaacagacaguggcacagagugcacggcaugcugaacagaaagauccagcaccuggagcagcugcuggagagcaucaccgagagcgagaacaagauccagauccugaacaacuggcuggaggcccaggaggagagacugaagacccugcagaagcccgagagcgugaucagcgugcagaagcugcugcuggacugccaggacaucgagaaccagcuggccaucaagagcaaggcccuggacgagcugaagcagagcuaccugacccuggagagcggcgccgugccccugcuggaggacaccgccagcagaaucgacgagcuguuccagaagagaagcagcgugcugacccaggugaaccagcugaagaccagcaugcagagcgugcugcaggaguggaagaucuacgaccagcuguacgacgaggugaacaugaugaccaucagauucugguacugcauggagcacagcaagcccguggugcugagccuggagacccugagaugccagguggagaaccugcagagccugcaggacgaggccgagagcagcgagggcagcugggagaagcugcaggaggugaucggcaagcugaagggccugugccccagcguggccgagaucaucgaggagaagugccagaacacccacaagagauggacccaggugaaccaggccaucgccgaccagcugcagaaggcccagagccugcugcagcuguggaaggccuacagcaacgcccacggcgaggccgccgccagacugaagcagcaggaggccaaguuccagcagcuggccaacaucagcaugagcggcaacaaccuggccgagauccugccccccgcccugcaggacaucaaggagcugcagcacgacgugcagaagaccaaggaggccuuccugcagaacagcagcgugcuggacagacugccccagcccgccgagagcagcacccacaugcugcugcccggcccccugcacagccugcagagagccgccuaccuggagaagaugcugcuggugaaggccaacgaguucgaguucgugcugagccaguucaaggacuucggcgugagacuggagagccugaagggccugaucaugcacgaggaggagaaccuggacagacugcaccagcaggagaaggagaaccccgacagcuuccugaaccacgugcuggcccugaccgcccagagccccgacaucgagcaccugaacgaggugagccugaagcugccccugagcgacguggccgugaagacccugcagaacaugaacagacaguggaucagagccaccgccaccgcccuggagagaugcagcgagcugcagggcaucggccugaacgagaaguuccuguacugcugcgagaaguggauccagcugcuggagaagaucgaggaggcccugaagguggacguggccaacagccugcccgagcugcuggagcagcagaagaccuacaagaugcuggaggccgaggugagcaucaaccagaccaucgccgacagcuacgugacccagagccugcagcugcuggacaccaccgagaucgagaacagacccgaguucaucaccgaguucagcaagcugaccgacagauggcagaacgccgugcagggcgugagacagagaaagggcgacguggacggccuggugagacaguggcaggacuucaccaccagcguggagaaccuguucagauuccugaccgacaccagccaccugcugagcgccgugaagggccaggagagauucagccuguaccagaccagaagccugauccacgagcugaagaacaaggagauccacuuccagagaagaagaaccaccugcgcccugacccuggaggccggcgagaagcugcugcugaccaccgaccugaagaccaaggagagcgugggcagaagaaucagccagcugcaggacagcuggaaggacauggagccccagcuggccgagaugaucaagcaguuccagagcaccguggagaccugggaccagugcgagaagaagaucaaggagcugaagagcagacugcaggugcugaaggcccagagcgaggacccccugcccgagcugcacgaggaccugcacaacgagaaggagcugaucaaggagcuggagcagagccuggccagcuggacccagaaccugaaggagcugcagaccaugaaggccgaccugaccagacacgugcugguggaggacgugauggugcugaaggagcagaucgagcaccugcacagacagugggaggaccugugccugagaguggccaucagaaagcaggagaucgaggacagacugaacaccugggugguguucaacgagaagaacaaggagcugugcgccuggcuggugcagauggagaacaaggugcugcagaccgccgacaucagcaucgaggagaugaucgagaagcugcagaaggacugcauggaggagaucaaccuguucagcgagaacaagcugcagcugaagcagaugggcgaccagcugaucaaggccagcaacaagagcagagccgccgagaucgacgacaagcugaacaagaucaacgacagauggcagcaccuguucgacgugaucggcagcagagugaagaagcugaaggagaccuucgccuucauccagcagcuggacaagaacaugagcaaccugagaaccuggcuggccagaaucgagagcgagcugagcaagcccgugguguacgacgugugcgacgaccaggagauccagaagagacuggccgagcagcaggaccugcagagagacaucgagcagcacagcgccggcguggagagcguguucaacaucugcgacgugcugcugcacgacagcgacgccugcgccaacgagaccgagugcgacagcauccagcagaccaccagaagccuggacagaagauggagaaacaucugcgccaugagcauggagagaagaaugaagaucgaggagaccuggagacuguggcagaaguuccuggacgacuacagcagauucgaggacuggcugaagagcgccgagagaaccgccgccugccccaacagcagcgaggugcuguacaccagcgccaaggaggagcugaagagauucgaggccuuccagagacagauccacgagagacugacccagcuggagcugaucaacaagcaguacagaagacuggccagagagaacagaaccgacaccgccagcagacugaagcagauggugcacgagggcaaccagagaugggacaaccugcagagaagagugaccgccgugcugagaagacugagacacuucaccaaccagagagaggaguucgagggcaccagagagagcauccugguguggcugaccgagauggaccugcagcugaccaacguggagcacuucagcgagagcgacgccgacgacaagaugagacagcugaacggcuuccagcaggagaucacccugaacaccaacaagaucgaccagcugaucguguucggcgagcagcugauccagaagagcgagccccuggacgccgugcugaucgaggacgagcuggaggagcugcacagauacugccaggagguguucggcagagugagcagauuccacagaagacugaccagcugcacccccggccuggaggacgagaaggaggccagcgagaacgagaccgacauggaggaccccagagagauccagaccgacagcuggagaaagagaggcgagagcgaggagcccagcagcccccagagccugugccaccugguggcccccggccacgagagaagcggcugcgagacccccgugagcguggacagcaucccccuggagugggaccacaccggcgacgugggcggcagcagcagccacgaggaggacgaggagggccccuacuacagcgcccugagcggcaagagcaucagcgacggccacagcuggcacgugcccgacagccccagcugccccgagcaccacuacaagcagauggagggcgacagaaacgugccccccgugccccccgccagcagcacccccuacaagccccccuacggcaagcugcugcugccccccggcaccgacggcggcaaggagggccccagagugcugaacggcaacccccagcaggaggacggcggccuggccggcaucaccgagcagcagagcggcgccuucgacagaugggagaugauccaggcccaggagcugcacaacaagcugaagaucaagcagaaccugcagcagcugaacagcgacaucagcgccaucaccaccuggcugaagaagaccgaggccgagcuggagaugcugaagauggccaagccccccagcgacauccaggagaucgagcugagagugaagagacugcaggagauccugaaggccuucgacaccuacaaggcccugguggugagcgugaacgugagcagcaaggaguuccugcagaccgagagccccgagagcaccgagcugcagagcagacugagacagcugagccugcugugggaggccgcccagggcgccguggacagcuggagaggcggccugagacagagccugaugcagugccaggacuuccaccagcugagccagaaccugcugcuguggcuggccagcgccaagaacagaagacagaaggcccacgugaccgaccccaaggccgaccccagagcccugcuggagugcagaagagagcugaugcagcuggagaaggagcugguggagagacagccccagguggacaugcugcaggagaucagcaacagccugcugaucaagggccacggcgaggacugcaucgaggccgaggagaaggugcacgugaucgagaagaagcugaagcagcugagagagcaggugagccaggaccugauggcccugcagggcacccagaaccccgccagcccccugcccagcuucgacgagguggacagcggcgaccagccccccgccaccagcgugcccgcccccagagccaagcaguucagagccgugagaaccaccgagggcgaggaggagaccgagagcagagugcccggcagcaccagaccccagagaagcuuccugagcagaguggugagagccgcccugccccugcagcugcugcugcugcugcugcugcugcuggccugccugcugcccagcagcgaggaggacuacagcugcacccaggccaacaacuucgccagaagcuucuaccccaugcugagauacaccaacggccccccccccaccuaa

SEQ ID NO: 24286 - RNA, 1215 nt, Artificial Sequence
  SYNE4__Homo_sapiens__NP_001034965
auggcccugagccugccccugggccccagacugggcagcgagccccugaaccacccccccggcgcccccagagaggccgacaucgugggcugcaccgugugccccgccagcggcgaggagagcaccagccccgagcaggcccagacccugggccaggacagccugggcccccccgagcacuuccagggcggccccagaggcaacgagcccgccgcccacccccccagauggagcacccccagcagcuacgaggaccccgccggcggcaagcacugcgagcaccccaucagcggccuggaggugcuggaggccgagcagaacagccugcaccugugccugcugggccugggcagaagacugcaggaccuggagcagggccugggccacugggcccuggcccagagcggcauggugcagcugcaggcccugcagguggaccugagaggcgccgccgagagaguggaggcccugcuggccuucggcgagggccuggcccagagaagcgagcccagagccugggccgcccuggagcagauccugagagcccugggcgccuacagagacagcaucuucagaagacuguggcagcugcaggcccagcuggugagcuacagccugguguucgaggaggccaacacccuggaccaggaccuggagguggagggcgacagcgacuggcccggccccggcggcguguggggccccugggcccccagcagccugcccaccagcaccgagcuggagugggaccccgccggcgacaucggcggccugggcccccugggccagaagaccgccagaacccugggcgugcccugcgagcugugcggccagagaggcccccagggcagaggccagggccuggaggaggccgacaccagccacagcagacaggacaugcuggagagcggccugggccaccagaagagacuggccagacaccagagacacagccugcugagaaagccccaggacaagaagagacaggccagcccccaccugcaggacgugagacuggagggcaaccccggcgcccccgaccccgccagcagacagccccugaccuuccugcugauccuguuccugcuguuccugcugcuggugggcgccauguuccugcugcccgccagcggcggccccugcugcagccacgccagaauccccagaacccccuaccuggugcugagcuacgugaacggccugccccccguguaa

SEQ ID NO: 24287 - RNA, 4032 nt, Artificial Sequence
  SYNGAP1__Homo_sapiens__NP_006763
augagcagaagcagagccagcauccacagaggcagcauccccgccaugagcuacgcccccuucagagacgugagaggccccagcaugcacagaacccaguacgugcacagccccuacgacagacccggcuggaaccccagauucugcaucaucagcggcaaccagcugcugaugcuggacgaggacgagauccacccccugcugaucagagacagaagaagcgagagcagcagaaacaagcugcugagaagaaccgugagcgugcccguggagggcagaccccacggcgagcacgaguaccaccugggcagaagcagaagaaagagcgugcccggcggcaagcaguacagcauggagggcgcccccgccgcccccuucagacccagccagggcuuccugagcagaagacugaagagcagcaucaagagaaccaagagccagcccaagcuggacagaaccagcagcuucagacagauccugcccagauucagaagcgccgaccacgacagagccagacugaugcagagcuucaaggagagccacagccacgagagccugcugagccccagcagcgccgccgaggcccuggagcugaaccuggacgaggacagcaucaucaagcccgugcacagcagcauccugggccaggaguucugcuucgaggugaccaccagcagcggcaccaagugcuucgccugcagaagcgccgccgagagagacaaguggaucgagaaccugcagagagccgugaagcccaacaaggacaacagcagaagaguggacaacgugcugaagcuguggaucaucgaggccagagagcugccccccaagaagagauacuacugcgagcugugccuggacgacaugcuguacgccagaaccaccagcaagcccagaagcgccagcggcgacaccguguucuggggcgagcacuucgaguucaacaaccugcccgccgugagagcccugagacugcaccuguacagagacagcgacaagaagagaaagaaggacaaggccggcuacgugggccuggugaccgugcccguggccacccuggccggcagacacuucaccgagcagugguaccccgugacccugcccaccggcagcggcggcagcggcggcaugggcagcggcggcggcggcggcagcggcggcggcagcggcggcaagggcaagggcggcugccccgccgugagacugaaggccagauaccagaccaugagcauccugcccauggagcuguacaaggaguucgccgaguacgugaccaaccacuacagaaugcugugcgccgugcuggagcccgcccugaacgugaagggcaaggaggagguggccagcgcccuggugcacauccugcagagcaccggcaaggccaaggacuuccugagcgacauggccaugagcgagguggacagauucauggagagagagcaccugaucuucagagagaacacccuggccaccaaggccaucgaggaguacaugagacugaucggccagaaguaccugaaggacgccaucggcgaguucaucagagcccuguacgagagcgaggagaacugcgagguggaccccaucaagugcaccgccagcagccuggccgagcaccaggccaaccugagaaugugcugcgagcuggcccugugcaagguggugaacagccacugcguguuccccagagagcugaaggagguguucgccagcuggagacugagaugcgccgagagaggcagagaggacaucgccgacagacugaucagcgccagccuguuccugagauuccugugccccgccaucaugagccccagccuguucggccugaugcaggaguaccccgacgagcagaccagcagaacccugacccugaucgccaaggugauccagaaccuggccaacuucagcaaguucaccagcaaggaggacuuccugggcuucaugaacgaguuccuggagcuggaguggggcagcaugcagcaguuccuguacgagaucagcaaccuggacacccugaccaacagcagcagcuucgagggcuacaucgaccugggcagagagcugagcacccugcacgcccugcugugggaggugcugccccagcugagcaaggaggcccugcugaagcugggcccccugcccagacugcugaacgacaucagcaccgcccugagaaaccccaacauccagagacagcccagcagacagagcgagagacccagaccccagcccguggugcugagaggccccagcgccgagaugcagggcuacaugaugagagaccugaacagcagcaucgaccugcagagcuucauggccagaggccugaacagcagcauggacauggccagacugcccagccccaccaaggagaagccccccccccccccccccggcggcggcaaggaccuguucuacgugagcagacccccccuggccagaagcagccccgccuacugcaccagcagcagcgacaucaccgagcccgagcagaagaugcugagcgugaacaagagcgugagcaugcuggaccugcagggcgacggccccggcggcagacugaacagcagcagcgugagcaaccuggccgccgugggcgaccugcugcacagcagccaggccagccugaccgccgcccugggccugagacccgcccccgccggcagacugagccagggcagcggcagcagcaucaccgccgccggcaugagacugagccagaugggcgugaccaccgacggcgugcccgcccagcagcugagaaucccccugagcuuccagaacccccuguuccacauggccgccgacggccccggcccccccggcggccacggcggcggcggcggccacggcccccccagcagccaccaccaccaccaccaccaccaccaccacagaggcggcgagccccccggcgacaccuucgcccccuuccacggcuacagcaagagcgaggaccugagcagcggcgugcccaagccccccgccgccagcauccugcacagccacagcuacagcgacgaguucggccccagcggcaccgacuucaccagaagacagcugagccugcaggacaaccugcagcacaugcugagccccccccagaucaccaucggcccccagagacccgcccccagcggccccggcggcggcagcggcggcggcagcggcggcggcggcggcggccagccccccccccugcagagaggcaagagccagcagcugaccgugagcgccgcccagaagcccagacccagcagcggcaaccugcugcagagccccgagcccagcuacggccccgccagacccagacagcagagccugagcaaggagggcagcaucggcggcagcggcggcagcggcggcggcggcggcggcggccugaagcccagcaucaccaagcagcacagccagacccccagcacccugaaccccaccaugcccgccagcgagagaaccguggccugggugagcaacaugccccaccugagcgccgacaucgagagcgcccacaucgagagagaggaguacaagcugaaggaguacagcaagagcauggacgagagcagacuggacagagugaaggaguacgaggaggagauccacagccugaaggagagacugcacaugagcaacagaaagcuggaggaguacgagagaagacugcugagccaggaggagcagaccagcaagauccugaugcaguaccaggccagacuggagcagagcgagaagagacugagacagcagcaggccgagaaggacagccagaucaagagcaucaucggcagacugaugcugguggaggaggagcugagaagagaccaccccgccauggccgagccccugcccgagcccaagaagagacugcuggacgcccaggagagacagcugcccccccugggccccaccaaccccagagugacccuggccccccccuggaacggccuggccccccccgcccccccccccccccccagacugcagaucaccgagaacggcgaguucagaaacaccgccgaccacuaa

SEQ ID NO: 24288 - RNA, 702 nt, Artificial Sequence
  SYNGR1__Homo_sapiens__NP_004702
auggagggcggcgccuacggcgccggcaaggccggcggcgccuucgaccccuacacccuggugagacagccccacaccauccugagaguggugagcuggcuguucagcaucgugguguucggcagcaucgugaacgagggcuaccugaacagcgccagcgagggcgaggaguucugcaucuacaacagaaaccccaacgccugcagcuacggcguggccgugggcgugcuggccuuccugaccugccugcuguaccuggcccuggacguguacuucccccagaucagcagcgugaaggacagaaagaaggccgugcugagcgacaucggcgugagcgccuucugggccuuccugugguucgugggcuucugcuaccuggccaaccaguggcaggugagcaagcccaaggacaacccccugaacgagggcaccgacgccgccagagccgccaucgccuucagcuucuucagcaucuucaccugggccggccaggccgugcuggccuuccagagauaccagaucggcgccgacagcgcccuguucagccaggacuacauggaccccagccaggacagcagcaugcccuacgcccccuacguggagcccaccggccccgaccccgccggcaugggcggcaccuaccagcagcccgccaacaccuucgacaccgagccccagggcuaccagagccagggcuacuaa

SEQ ID NO: 24289 - RNA, 675 nt, Artificial Sequence
  SYNGR2__Homo_sapiens__NP_004701
auggagagcggcgccuacggcgccgccaaggccggcggcagcuucgaccugagaagauuccugacccagccccaggugguggccagagccgugugccugguguucgcccugaucguguucagcugcaucuacggcgagggcuacagcaacgcccacgagagcaagcagauguacugcguguucaacagaaacgaggacgccugcagauacggcagcgccaucggcgugcuggccuuccuggccagcgccuucuuccuggugguggacgccuacuucccccagaucagcaacgccaccgacagaaaguaccuggugaucggcgaccugcuguucagcgcccuguggaccuuccugugguucgugggcuucugcuuccugaccaaccagugggccgugaccaaccccaaggacgugcuggugggcgccgacagcgugagagccgccaucaccuucagcuucuucagcaucuucagcuggggcgugcuggccagccuggccuaccagagauacaaggccggcguggacgacuucauccagaacuacguggaccccacccccgaccccaacaccgccuacgccagcuaccccggcgccagcguggacaacuaccagcagccccccuucacccagaacgccgagaccaccgagggcuaccagcccccccccguguacuaa

SEQ ID NO: 24290 - RNA, 3888 nt, Artificial Sequence
  SYNJ1__Homo_sapiens__NP_001153774
auggccuucagcaagggcuucagaaucuaccacaagcuggaccccccccccuucagccugaucguggagaccagacacaaggaggagugccugauguucgagagcggcgccguggccgugcugagcagcgccgagaaggaggccaucaagggcaccuacagcaaggugcuggacgccuacggccugcugggcgugcugagacugaaccugggcgacaccaugcugcacuaccuggugcuggugaccggcugcaugagcgugggcaagauccaggagagcgagguguucagagugaccagcaccgaguucaucagccugagaaucgacagcagcgacgaggacagaaucagcgaggugagaaaggugcugaacagcggcaacuucuacuucgccuggagcgccagcggcaucagccuggaccugagccugaacgcccacagaagcaugcaggagcagaccaccgacaacagauucuucuggaaccagagccugcaccugcaccugaagcacuacggcgugaacugcgacgacuggcugcugagacugaugugcggcggcguggagaucagaaccaucuacgccgcccacaagcaggccaaggccugccugaucagcagacugagcugcgagagagccggcaccagauucaacgugagaggcaccaacgacgacggccacguggccaacuucguggagaccgagcaggugguguaccuggacgacagcgugagcagcuucauccagaucagaggcagcgugccccuguucugggagcagcccggccugcaggugggcagccacagagugagaaugagcagaggcuucgaggccaacgcccccgccuucgacagacacuucagaacccugaagaaccuguacggcaagcagaucaucgugaaccugcugggcagcaaggagggcgagcacaugcugagcaaggccuuccagagccaccugaaggccagcgagcacgccgccgacauccagauggugaacuucgacuaccaccagauggugaagggcggcaaggccgagaagcugcacagcgugcugaagccccaggugcagaaguuccuggacuacggcuucuucuacuucaacggcagcgaggugcagagaugccagagcggcaccgugagaaccaacugccuggacugccuggacagaaccaacagcgugcaggccuuccugggccuggagaugcuggccaagcagcuggaggcccugggccuggccgagaagccccagcuggugaccagauuccaggagguguucagaagcauguggagcgugaacggcgacagcaucagcaagaucuacgccggcaccggcgcccuggagggcaaggccaagcugaaggacggcgccagaagcgugaccagaaccauccagaacaacuucuucgacagcagcaagcaggaggccaucgacgugcugcugcugggcaacacccugaacagcgaccuggccgacaaggccagagcccugcugaccaccggcagccugagagugagcgagcagacccugcagagcgccagcagcaaggugcugaagagcaugugcgagaacuucuacaaguacagcaagcccaagaagaucagagugugcgugggcaccuggaacgugaacggcggcaagcaguucagaagcaucgccuucaagaaccagacccugaccgacuggcugcuggacgcccccaagcuggccggcauccaggaguuccaggacaagagaagcaagcccaccgacaucuucgccaucggcuucgaggagaugguggagcugaacgccggcaacaucgugagcgccagcaccaccaaccagaagcugugggccguggagcugcagaagaccaucagcagagacaacaaguacgugcugcuggccagcgagcagcuggugggcgugugccuguucguguucaucagaccccagcacgcccccuucaucagagacguggccguggacaccgugaagaccggcaugggcggcgccaccggcaacaagggcgccguggccaucagaaugcuguuccacaccaccagccugugcuucgugugcagccacuucgccgccggccagagccaggugaaggagagaaacgaggacuucaucgagaucgccagaaagcugagcuuccccaugggcagaaugcuguucagccacgacuacguguucuggugcggcgacuucaacuacagaaucgaccugcccaacgaggaggugaaggagcugaucagacagcagaacugggacagccugaucgccggcgaccagcugaucaaccagaagaacgccggccagguguucagaggcuuccuggagggcaaggugaccuucgcccccaccuacaaguacgaccuguucagcgacgacuacgacaccagcgagaagugcagaacccccgccuggaccgacagagugcuguggagaagaagaaaguggcccuucgacagaagcgccgaggaccuggaccugcugaacgccagcuuccaggacgagagcaagauccuguacaccuggacccccggcacccugcugcacuacggcagagccgagcugaagaccagcgaccacagacccgugguggcccugaucgacaucgacaucuucgagguggaggccgaggagagacagaacaucuacaaggaggugaucgccgugcagggcccccccgacggcaccgugcuggugagcaucaagagcagccugcccgagaacaacuucuucgacgacgcccugaucgacgagcugcugcagcaguucgccagcuucggcgaggugauccugaucagauucguggaggacaagaugugggugaccuuccuggagggcagcagcgcccugaacgugcugagccugaacggcaaggagcugcugaacagaaccaucaccaucgcccugaagagccccgacuggaucaagaaccuggaggaggagaugagccuggagaagaucagcaucgcccugcccagcagcaccagcagcacccugcugggcgaggacgccgagguggccgccgacuucgacauggagggcgacguggacgacuacagcgccgagguggaggagcugcugccccagcaccugcagcccagcagcagcagcggccugggcaccagccccagcagcagccccagaaccagccccugccagagccccaccaucagcgagggccccgugcccagccugcccaucagacccagcagagcccccagcagaacccccggcccccccagcgcccagagcagccccaucgacgcccagcccgccaccccccugccccagaaggaccccgcccagccccuggagcccaagagaccccccccccccagacccguggccccccccaccagacccgcccccccccagagaccccccccccccagcggcgccagaagccccgcccccaccagaaaggaguucggcgcccccaagagccccggcaccaccagaaaggacaacaucggcagaagccagcccagcccccaggccggccuggccggccccggccccgccggcuacagcaccgccagacccaccaucccccccagagccggcgugaucagcgccccccagagccacgccagagccagcgccggcagacugacccccgagagccagagcaagaccagcgagaccagcaagggcagcaccuuccugcccgagccccugaagccccaggccgccuuccccccccagagcagccugcccccccccgcccagagacugcaggagccccuggugcccguggccgcccccaugccccagagcggcccccagcccaaccuggagacccccccccagcccccccccagaagcagaagcagccacagccugcccagcgaggccagcagccagccccagcaggagcagcccagcggcuaa

SEQ ID NO: 24291 - RNA, 438 nt, Artificial Sequence
  SYNJ2BP__Homo_sapiens__NP_060843
augaacggcagaguggacuaccuggugaccgaggaggagaucaaccugaccagaggccccagcggccugggcuucaacaucgugggcggcaccgaccagcaguacgugagcaacgacagcggcaucuacgugagcagaaucaaggagaacggcgccgccgcccuggacggcagacugcaggagggcgacaagauccugagcgugaacggccaggaccugaagaaccugcugcaccaggacgccguggaccuguucagaaacgccggcuacgccgugagccugagagugcagcacagacugcaggugcagaacggccccaucggccacagaggcgagggcgaccccagcggcauccccaucuucauggugcuggugcccguguucgcccugaccaugguggccgccugggccuucaugagauacagacagcagcuguaa

SEQ ID NO: 24292 - RNA, 3780 nt, Artificial Sequence
  SYNJ2__Homo_sapiens__NP_001171559
augaucuacauggacgacggcgugagcagcuucgugcagaucagaggcagcgugccccuguucugggagcagcccggccugcaggugggcagccaccaccugagacugcacagaggccuggaggccaacgcccccgccuucgacagacacauggugcugcugaaggagcaguacggccagcaggugguggugaaccugcugggcagcagaggcggcgaggaggugcugaacagagccuucaagaagcugcugugggccagcugccacgccggcgacacccccaugaucaacuucgacuuccaccaguucgccaagggcggcaagcuggagaagcuggagacccugcugagaccccagcugaagcugcacugggaggacuucgacguguucaccaagggcgagaacgugagccccagauuccagaagggcacccugagaaugaacugccuggacugccuggacagaaccaacaccgugcagagcuucaucgcccuggaggugcugcaccugcagcugaagacccugggccugagcagcaagcccaucguggacagauucguggagagcuucaaggccauguggagccugaacggccacagccugagcaagguguucaccggcagcagagcccuggagggcaaggccaaggugggcaagcugaaggacggcgccagaagcaugagcagaaccauccagagcaacuucuucgacggcgugaagcaggaggccaucaagcugcugcuggugggcgacguguacggcgaggagguggccgacaagggcggcaugcugcuggacagcaccgcccugcuggugacccccagaauccugaaggccaugaccgagagacagagcgaguucaccaacuucaagagaaucagaaucgccaugggcaccuggaacgugaacggcggcaagcaguucagaagcaacgugcugagaaccgccgagcugaccgacuggcugcuggacagcccccagcugagcggcgccaccgacagccaggacgacagcagccccgccgacaucuucgccgugggcuucgaggagaugguggagcugagcgccggcaacaucgugaacgccagcaccaccaacaagaagauguggggcgagcagcugcagaaggccaucagcagaagccacagauacauccugcugaccagcgcccagcuggugggcgugugccuguacaucuucgugagacccuaccacgugcccuucaucagagacguggccaucgacaccgugaagaccggcaugggcggcaaggccggcaacaagggcgccgugggcaucagauuccaguuccacagcaccagcuucugcuucaucugcagccaccugaccgccggccagagccaggugaaggagagaaacgaggacuacaaggagaucacccagaagcugugcuuccccaugggcagaaacguguucagccacgacuacguguucuggugcggcgacuucaacuacagaaucgaccugaccuacgaggagguguucuacuucgugaagagacaggacuggaagaagcugcuggaguucgaccagcugcagcugcagaagagcagcggcaagaucuucaaggacuuccacgagggcgccaucaacuucggccccaccuacaaguacgacgugggcagcgccgccuacgacaccagcgacaagugcagaacccccgccuggaccgacagagugcugugguggagaaagaagcaccccuucgacaagaccgccggcgagcugaaccugcuggacagcgaccuggacguggacaccaaggugagacacaccuggagccccggcgcccugcaguacuacggcagagccgagcugcaggccagcgaccacagacccgugcuggccaucguggagguggaggugcaggagguggacgugggcgccagagagagaguguuccaggaggugagcagcuuccagggcccccuggacgccaccgugguggugaaccugcagagccccacccuggaggagaagaacgaguuccccgaggaccugagaaccgagcugaugcagacccugggcagcuacggcaccaucgugcuggugagaaucaaccagggccagaugcuggugaccuucgccgacagccacagcgcccugagcgugcuggacguggacggcaugaaggugaagggcagagccgugaagaucagacccaagaccaaggacuggcugaagggccugagagaggagaucaucagaaagagagacagcauggcccccgugagccccaccgccaacagcugccugcuggaggagaacuucgacuucaccagccuggacuacgagagcgagggcgacauccuggaggacgacgaggacuaccugguggacgaguucaaccagcccggcgugagcgacagcgagcugggcggcgacgaccugagcgacgugcccggccccaccgcccuggccccccccagcaagagccccgcccugaccaagaagaagcagcaccccaccuacaaggacgacgccgaccugguggagcugaagagagagcuggaggccgugggcgaguucagacacagaagccccagcagaagccugagcgugcccaacagacccagacccccccagcccccccagagaccccccccccccaccggccugauggugaagaagagcgccagcgacgccagcaucagcagcggcacccacggccaguacagcauccugcagaccgccagacugcugcccggcgccccccagcagccccccaaggccagaaccggcaucagcaagcccuacaacgugaagcagaucaagaccaccaacgcccaggaggccgaggccgccaucagaugccugcuggaggccagaggcggcgccagcgaggaggcccugagcgccguggcccccagagaccuggaggccagcagcgagcccgagcccacccccggcgccgccaagcccgagaccccccaggcccccccccugcugcccagaagacccccccccagagugcccgccaucaagaagcccacccugagaagaaccggcaagccccugagccccgaggagcaguucgagcagcagaccgugcacuucaccaucggcccccccgagaccagcguggaggccccccccguggugaccgcccccagagugccccccgugcccaagcccagaaccuuccagcccggcaaggccgccgagagacccagccacagaaagcccgccagcgacgaggccccccccggcgccggcgccagcgugccccccccccuggaggcccccccccuggugcccaaggugccccccagaagaaagaagagcgcccccgccgccuuccaccugcaggugcugcagagcaacagccagcugcugcagggccugaccuacaacagcagcgacagccccagcggccacccccccgccgccggcaccguguucccccagggcgacuuccugagcaccagcagcgccaccagccccgacagcgacggcaccaaggccaugaagcccgaggccgccccccugcugggcgacuaccaggaccccuucuggaaccugcugcaccaccccaagcugcugaacaacaccuggcugagcaagagcagcgacccccuggacagcggcaccagaagccccaagagagaccccaucgaccccgugagcgccggcgccagcgccgccaaggccgagcugccccccgaccacgagcacaagacccugggccacugggugaccaucagcgaccaggagaagagaaccgcccugcagguguucgacccccuggccaagaccuaa

SEQ ID NO: 24293 - RNA, 3762 nt, Artificial Sequence
  SYNM__Homo_sapiens__NP_056101
augcugagcuggagacugcagaccggccccgagaaggccgagcugcaggagcugaacgccagacuguacgacuacgugugcagagugagagagcuggagagagagaaccugcugcuggaggaggagcugagaggcagaagaggcagagagggccugugggccgagggccaggccagaugcgccgaggaggccagaagccugagacagcagcuggacgagcugagcugggccaccgcccuggccgagggcgagagagacgcccugagaagagagcugagagagcugcagagacuggacgccgaggagagagccgccagaggcagacuggacgccgagcugggcgcccagcagagagagcugcaggaggcccugggcgccagagccgcccuggaggcccugcugggcagacugcaggccgagagaagaggccuggacgccgcccacgagagagacgugagagagcugagagccagagccgccagccugaccaugcacuucagagccagagccaccggccccgccgcccccccccccagacugagagaggugcacgacagcuacgcccugcugguggccgagagcuggagagagaccgugcagcuguacgaggacgaggugagagagcuggaggaggcccugagaagaggccaggagagcagacugcaggccgaggaggagaccagacugugcgcccaggaggccgaggcccugagaagagaggcccugggccuggagcagcugagagccagacuggaggacgcccugcugagaaugagagaggaguacggcauccaggccgaggagagacagagagugaucgacugccuggaggacgagaaggccacccugacccuggccauggccgacuggcugagagacuaccaggaccugcugcaggugaagaccggccugagccuggagguggccaccuacagagcccugcuggagggcgagagcaaccccgagaucgugaucugggccgagcacguggagaacaugcccagcgaguucagaaacaagagcuaccacuacaccgacagccugcugcagagagagaacgagagaaaccuguucagcagacagaaggccccccuggccagcuucaaccacagcagcgcccuguacagcaaccugagcggccacagaggcagccagaccggcaccagcaucggcggcgacgccagaagaggcuuccugggcagcggcuacagcagcagcgccaccacccagcaggagaacagcuacggcaaggccgugagcagccagaccaacgugagaaccuucagccccaccuacggccugcugagaaacaccgaggcccaggugaagaccuuccccgacagacccaaggccggcgacaccagagaggugcccguguacaucggcgaggacagcaccaucgccagagagagcuacagagacagaagagacaagguggccgccggcgccagcgagagcaccagaagcaacgagagaaccgugauccugggcaagaagaccgaggugaaggccaccagagagcaggagagaaacagacccgagaccaucagaaccaagcccgaggagaagauguucgacagcaaggagaaggccagcgaggagagaaaccugagaugggaggagcugaccaagcuggacaaggaggccagacagagagagagccagcagaugaaggagaaggccaaggagaaggacagccccaaggagaagagcgugagagagagagaggugcccaucagccuggaggugagccaggacagaagagccgaggugagccccaagggccugcagacccccgugaaggacgccggcggcggcaccggcagagaggccgaggccagagagcugagauucagacugggcaccagcgacgccaccggcagccugcagggcgacagcaugaccgagaccguggccgagaacaucgugaccagcauccugaagcaguucacccagagccccgagaccgaggccagcgccgacagcuuccccgacaccaaggugaccuacguggacagaaaggagcugcccggcgagagaaagaccaagaccgagaucgugguggagagcaagcugaccgaggacguggacgugagcgacgaggccggccuggacuaccugcugagcaaggacaucaaggaggugggccugaagggcaagagcgccgagcagaugaucggcgacaucaucaaccugggccugaagggcagagagggcagagccaagguggugaacguggagaucguggaggagcccgugagcuacgugagcggcgagaagcccgaggaguucagcgugcccuucaagguggaggagguggaggacgugagccccggccccuggggccuggugaaggaggaggagggcuacggcgagagcgacgugaccuucagcgugaaccagcacagaagaaccaagcagccccaggagaacaccacccacguggaggaggugaccgaggccggcgacagcgagggcgagcagagcuacuucgugagcacccccgacgagcaccccggcggccacgacagagacgacggcagcguguacggccagauccacaucgaggaggagagcaccaucagauacagcuggcaggacgagaucgugcagggcaccagaagaagaacccagaaggacggcgccgugggcgagaagguggugaagccccuggacgugcccgcccccagccuggagggcgaccugggcagcacccacuggaaggagcaggccagaagcggcgaguuccacgccgagcccaccgugaucgagaaggagaucaagaucccccacgaguuccacaccagcaugaagggcaucagcagcaaggagcccagacagcagcugguggaggugaucggccagcuggaggagacccugcccgagagaaugagagaggagcugagcgcccugaccagagagggccagggcggccccggcagcgugagcguggacgugaagaaggugcagggcgccggcggcagcagcgugacccugguggccgaggugaacgugagccagaccguggacgccgacagacuggaccuggaggagcugagcaaggacgaggccagcgagauggagaaggccguggagagcguggugagagagagccugagcagacagagaagccccgcccccggcagccccgacgaggagggcggcgccgaggcccccgccgccggcaucagauucagaagaugggccaccagagagcuguacauccccagcggcgagagcgagguggccggcggcgccagccacagcagcggccagagaaccccccagggccccgugagcgccaccguggaggugagcagccccaccggcuucgcccagagccaggugcuggaggacgugagccaggccgccagacacaucaagcugggccccagcgagguguggagaaccgagagaaugagcuacgagggccccaccgccgaggugguggagauggacgugagcaacguggaggccaucagaagcagaacccaggaggccggcgcccugggcgugagcgacagaggcagcuggagagacgccgacagcagaaacgaccaggccgugggcgugagcuucaaggccagcgccggcgagggcgaccaggcccacagagagcagggcaaggagcaggccauguucgacaagaaggugcagcugcagagaaugguggaccagagaagcgugaucagcgacgagaagaagguggcccugcuguaccuggacaacgaggaggaggagaacgacggccacugguucuaa

SEQ ID NO: 24294 - RNA, 3282 nt, Artificial Sequence
  SYNPO2__Homo_sapiens__NP_001122405
augggcaccggcgacuucaucugcaucagcaugaccggcggcgcccccuggggcuucagacugcagggcggcaaggagcagaagcagccccugcagguggccaagaucagaaaccagagcaaggccagcggcagcggccugugcgagggcgacgagguggugagcaucaacggcaaccccugcgccgaccugaccuaccccgaggugaucaagcugauggagagcaucaccgacagccugcagaugcugaucaagagacccagcagcggcaucagcgaggcccugaucagcgagaacgagaacaagaaccuggagcaccugacccacggcggcuacguggagagcaccacccugcagaucagacccgccaccaagacccagugcaccgaguucuuccuggcccccgugaagaccgaggugccccuggccgagaaccagagaagcggccccgacugcgccggcagccugaaggaggagaccggccccagcuaccagagagccccccagaugcccgacagccagagaggcagaguggccgaggagcugauccugagagagaagguggaggccgugcagcccggccccgugguggagcugcagcugagccugagccaggagagacacaagggcgccagcggcccccugguggcccugcccggcgccgagaagagcaagagccccgaccccgaccccaaccugagccacgacagaaucgugcacaucaacagcauccccaccaacgagaaggccgaccccuuccugagaagcagcaagaucauccagaucagcagcggcagagagcugagagugauccaggagagcgaggccggcgacgccggccugcccagaguggaggugauccuggacugcagcgacagacagaagaccgagggcugcagacugcaggccggcaaggagugcguggacagccccguggagggcggccagagcgaggccccccccagccuggugagcuucgccgugagcagcgagggcaccgagcagggcgaggaccccagaagcgagaaggaccacagcagaccccacaagcacagagccagacacgccagacugagaagaagcgagagccugagcgagaagcaggugaaggaggccaagagcaagugcaagagcaucgcccugcugcugaccgacgcccccaaccccaacagcaagggcgugcugauguucaagaagagaagaagaagagccagaaaguacacccuggugagcuacggcaccggcgagcuggagagagaggccgacgaggaggaggagggcgacaaggaggacaccugcgagguggccuuccugggcgccagcgagagcgagguggacgaggagcugcugagcgacguggacgacaacacccagguggugaacuucgacugggacagcggccugguggacaucgagaagaagcugaacagaggcgacaagauggagaugcugcccgacaccaccggcaagggcgcccugauguucgccaagagaagagagagaauggaccagaucaccgcccagaaggaggaggacaaggugggcggcacccccagcagagagcaggacgccgcccagaccgacggccugagaaccaccaccagcuaccagagaaaggaggaggagagcgugagaacccagagcagcgugagcaagagcuacaucgaggugagccacggccugggccacgugccccagcagaacggcuucagcggcaccagcgagaccgccaacauccagagaauggugcccaugaacagaaccgccaagcccuuccccggcagcgugaaccagcccgccacccccuucagccccaccagaaacaugaccagccccaucgccgacuuccccgcccccccccccuacagcgccgugacccccccccccgacgccuucagcagaggcgugagcagccccaucgccggccccgcccagcccccccccuggccccagcccgcccccuggagccagcccgccuucuacgacagcagcgagagaaucgccagcagagacgagagaaucagcgugcccgccaagagaaccggcauccugcaggaggccaagagaagaagcaccaccaagcccauguucaccuucaaggagcccaaggugagccccaaccccgagcugcugagccugcugcagaacagcgagggcaagagaggcaccggcgccggcggcgacagcggccccgaggaggacuaccugagccugggcgccgaggccugcaacuucaugcagagcagcagcgccaagcagaagacccccccccccguggcccccaagcccgccgugaagagcagcagcagccagcccgugacccccgugagccccguguggagccccggcguggcccccacccagccccccgccuuccccaccagcaaccccagcaagggcaccguggugagcagcaucaagaucgcccagcccagcuacccccccgccagacccgccagcacccugaacguggccggccccuucaagggcccccaggccgccguggccagccagaacuacacccccaagcccaccgugagcacccccaccgugaacgccgugcagcccggcgccgugggccccagcaacgagcugcccggcaugagcggcagaggcgcccagcuguucgccaagagacagagcagaauggagaaguacgugguggacagcgacaccgugcaggcccacgccgccagagcccagagccccacccccagccugcccgccagcuggaaguacagcagcaacgugagagcccccccccccguggccuacaaccccauccacagccccagcuacccccuggccgcccugaagagccagcccagcgccgcccagcccagcaagaugggcaagaagaagggcaagaagccccugaacgcccuggacgugaugaagcaccagcccuaccagcugaacgccagccuguucaccuuccagccccccgacgccaaggacggccugccccagaagagcagcgugaaggugaacagcgcccuggccaugaagcaggcccugccccccagacccgugaacgccgccagccccaccaacgugcaggccagcagcguguacagcgugcccgccuacaccagcccccccagcuucuucgccgaggccagcagccccgugagcgccagccccgugcccgugggcauccccaccagccccaagcaggagagcgccagcagcagcuacuucguggcccccagacccaaguucagcgccaagaagagcggcgugaccauccagguguggaagcccagcgugguggaggaguaa

SEQ ID NO: 24295 - RNA, 2058 nt, Artificial Sequence
  SYNPO__Homo_sapiens__NP_001103444
auggagggcuacagcgaggaggccagccugcugagacaccuggagaagguggccagcgaggaggaggaggugccccuggugguguaccugaaggagaacgccgcccugcugaccgccaacggccugcaccugagccagaacagagaggcccagcagagcagccccgcccccccccccgccgaggugcacagccccgccgccgacgugaaccagaaccuggccagccccagcgccacccugaccacccccaccagcaacagcagccacaacccccccgccaccgacgugaaccagaacccccccgccaccguggugccccagagccugccccugagcagcauccagcagaacagcagcgaggcccagcugcccagcaacggcaccggccccgccagcaagcccagcacccugugcgccgacggccagccccaggcccccgccgaggaggugagaugcagcacccugcugaucgacaaggugagcacccccgccaccaccaccagcaccuucagcagagaggccacccugauccccagcagcagaccccccgccagcgacuucaugagcagcagccugcugaucgacauccagcccaacacccugguggugagcgccgaccaggagaugagcggcagagccgccgccaccacccccaccaagguguacagcgaggugcacuucacccuggccaagccccccagcguggugaacagaaccgccagacccuucggcauccaggcccccggcggcaccagccagauggagagaagccccaugcuggagagaagacacuucggcgagaaggcccccgccccccagccccccagccugcccgacagaagccccagaccccagagacacaucaugagcagaagccccaugguggagagaagaaugaugggccagagaagccccgccagcgagagaagaccccugggcaacuucaccgccccccccaccuacaccgagacccugagcaccgccccccuggccagcugggugagaagcccccccagcuacagcgugcuguaccccagcagcgaccccaagagcagccaccugaagggccaggccgugcccgccagcaagaccggcauccuggaggagagcauggccagaagaggcagcagaaagagcauguucaccuucguggagaagcccaaggugacccccaaccccgaccugcuggaccuggugcagaccgccgacgagaagagaagacagagagaccagggcgaggugggcguggaggaggagcccuucgcccugggcgccgaggccagcaacuuccagcaggagcccgcccccagagacagagccagccccgccgccgccgaggagguggugcccgagugggccagcugccugaagagccccagaauccaggccaagcccaagcccaagcccaaccagaaccugagcgaggccagcggcaagggcgccgagcuguacgccagaagacagagcagaauggagaaguacgugaucgagagcagcagccacacccccgagcuggccagaugccccagccccaccaugagccugcccagcagcuggaaguaccccaccaacgcccccggcgccuucagaguggccagcagaagccccgccagaaccccccccgccagccuguaccacggcuaccugcccgagaacggcgugcugagacccgagcccaccaagcagccccccuaccagcugagacccagccuguucgugcugagccccaucaaggagcccgccaaggugagccccagagccgccagccccgccaagcccagcagccuggaccuggugcccaaccugcccaagggcgcccugccccccagccccgcccugcccagacccagcagaagcagccccggccuguacaccagccccggccaggacagccugcagcccaccgccgugagcccccccuacggcggcgacaucagccccgugagccccagcagagccuggagccccagagccaagcaggcccccagacccagcuucagcaccagaaacgccggcaucgaggcccagguguggaagcccagcuucugcuucaaguaa

SEQ ID NO: 24296 - RNA, 858 nt, Artificial Sequence
  SYNPR__Homo_sapiens__NP_001123475
auggaccccgugagccagcuggccagcgccggcaccuucagagugcugaaggagccccuggccuuccugagagcccuggagcugcuguucgccaucuucgccuucgccaccugcggcggcuacagcggcggccugagacugagcguggacugcgugaacaagaccgagagcaaccugagcaucgacaucgccuucgccuaccccuucagacugcaccaggugaccuucgaggugcccaccugcgagggcaaggagagacagaagcuggcccugaucggcgacagcagcagcagcgccgaguucuucgugaccguggccguguucgccuuccuguacagccuggccgccaccgugguguacaucuucuuccagaacaaguacagagagaacaacagaggcccccugaucgacuucaucgugaccgugguguucagcuuccuguggcuggugggcagcagcgccugggccaagggccugagcgacgugaagguggccaccgaccccaaggaggugcugcugcugaugagcgccugcaagcagcccagcaacaagugcauggccauccacagccccgugaugagcagccugaacaccagcgugguguucggcuuccugaacuucauccugugggccggcaacaucugguucguguucaaggagaccggcuggcacagcagcggccagagauaccugagcgaccccauggagaagcacagcagcagcuacaaccagggcggcuacaaccaggacagcuacggcagcagcagcggcuacagccagcaggccagccugggccccaccagcgacgaguucggccagcagcccaccggccccaccagcuucaccaaccagaucuaa

SEQ ID NO: 24297 - RNA, 942 nt, Artificial Sequence
  SYP__Homo_sapiens__NP_003170
augcugcugcuggccgacauggacguggugaaccagcugguggccggcggccaguucagaguggugaaggagccccugggcuucgugaaggugcugcaguggguguucgccaucuucgccuucgccaccugcggcagcuacagcggcgagcugcagcugagcguggacugcgccaacaagaccgagagcgaccugagcaucgagguggaguucgaguaccccuucagacugcaccagguguacuucgacgcccccaccugcagaggcggcaccaccaagguguuccuggugggcgacuacagcagcagcgccgaguucuucgugaccguggccguguucgccuuccuguacagcaugggcgcccuggccaccuacaucuuccugcagaacaaguacagagagaacaacaagggccccaugcuggacuuccuggccaccgccguguucgccuucauguggcuggugagcagcagcgccugggccaagggccugagcgacgugaagauggccaccgaccccgagaacaucaucaaggagaugcccgugugcagacagaccggcaacaccugcaaggagcugagagaccccgugaccagcggccugaacaccagcgugguguucggcuuccugaaccuggugcugugggugggcaaccugugguucguguucaaggagaccggcugggccgcccccuuccugagagccccccccggcgcccccgagaagcagcccgcccccggcgacgccuacggcgacgccggcuacggccagggccccggcggcuacggcccccaggacagcuacggcccccagggcggcuaccagcccgacuacggccagcccgccggcagcggcggcagcggcuacggcccccagggcgacuacggccagcagggcuacggcccccagggcgcccccaccagcuucagcaaccagauguaa

SEQ ID NO: 24298 - RNA, 780 nt, Artificial Sequence
  SYPL1__Homo_sapiens__NP_006745
auggcccccaacaucuaccuggugagacagagaaucagcagacugggccagagaaugagcggcuuccagaucaaccugaacccccugaaggagccccugggcuucaucaaggugcuggaguggaucgccagcaucuucgccuucgccaccugcggcggcuucaagggccagaccgagauccaggugaacugcccccccgccgugaccgagaacaagaccgugaccgccaccuucggcuaccccuucagacugaacgaggccagcuuccagcccccccccggcgugaacaucugcgacgugaacuggaaggacuacgugcugaucggcgacuacagcagcagcgcccaguucuacgugaccuucgccguguucguguuccuguacugcaucgccgcccugcugcuguacgugggcuacaccagccuguaccuggacagcagaaagcugcccaugaucgacuucguggugacccugguggccaccuuccuguggcuggugagcaccagcgccugggccaaggcccugaccgacaucaagaucgccaccggccacaacaucaucgacgagcugccccccugcaagaagaaggccgugcugugcuacuucggcagcgugaccagcaugggcagccugaacgugagcgugaucuucggcuuccugaacaugauccuguggggcggcaacgccugguucguguacaaggagaccagccugcacagccccagcaacaccagcgccccccacagccagggcggcauccccccccccaccggcaucuaa

SEQ ID NO: 24299 - RNA, 831 nt, Artificial Sequence
  SYPL2__Homo_sapiens__XP_011539585
augagcagcaccgagagcgccggcagaaccgccgacaagagccccagacagcagguggacagacugcuggugggccugagauggagaagacuggaggagccccugggcuucaucaaggugcugcaguggcuguucgccaucuucgccuucggcagcugcggcagcuacagcggcgagaccggcgccauggugagaugcaacaacgaggccaaggacgugagcagcaucaucguggccuucggcuaccccuucagacugcacagaauccaguacgagaugccccugugcgacgaggagagcagcagcaagaccaugcaccugaugggcgacuucagcgcccccgccgaguucuucgugacccugggcaucuucagcuucuucuacaccauggccgcccuggugaucuaccugagauuccacaaccuguacaccgagaacaagagauucccccugguggacuucugcgugaccgugagcuucaccuucuucuggcugguggccgccgccgccuggggcaagggccugaccgacgugaagggcgccaccagacccagcagccugaccgccgccaugagcgugugccacggcgaggaggccgugugcagcgccggcgccacccccagcaugggccuggccaacaucagcgugcuguucggcuucaucaacuucuuccugugggccggcaacugcugguucguguucaaggagacccccuggcacggccagggccagggccaggaccaggaccaggaccaggaccagggccagggccccagccaggagagcgccgccgagcagggcgccguggagaagcagauccaccacguguaa

SEQ ID NO: 24300 - RNA, 1296 nt, Artificial Sequence
  SYT11__Homo_sapiens__NP_689493
auggccgagaucaccaacaucagacccagcuucgacgugagccccgugguggccggccugaucggcgccagcgugcugguggugugcgugagcgugaccguguucguguggagcugcugccaccagcaggccgagaagaagcagaagaacccccccuacaaguucauccacaugcugaagggcaucagcaucuaccccgagacccugagcaacaagaagaagaucaucaaggugagaagagacaaggacggccccggcagagagggcggcagaagaaaccugcugguggacgccgccgaggccggccugcugagcagagacaaggaccccagaggccccagcagcggcagcugcaucgaccagcugcccaucaagauggacuacggcgaggagcugagaagccccaucaccagccugacccccggcgagagcaagaccaccagccccagcagccccgaggaggacgugaugcugggcagccugaccuucagcguggacuacaacuuccccaagaaggcccugguggugaccauccaggaggcccacggccugcccgugauggacgaccagacccagggcagcgaccccuacaucaagaugaccauccugcccgacaagagacacagagugaagaccagagugcugagaaagacccuggaccccguguucgacgagaccuucaccuucuacggcauccccuacagccagcugcaggaccuggugcugcacuuccuggugcugagcuucgacagauucagcagagacgacgugaucggcgaggugauggugccccuggccggcguggaccccagcaccggcaaggugcagcugaccagagacaucaucaagagaaacauccagaagugcaucagcagaggcgagcugcaggugagccugagcuaccagcccguggcccagagaaugaccgugguggugcugaaggccagacaccugcccaagauggacaucaccggccugagcggcaaccccuacgugaaggugaacguguacuacggcagaaagagaaucgccaagaagaagacccacgugaagaagugcacccugaaccccaucuucaacgagagcuucaucuacgacauccccaccgaccugcugcccgacaucagcaucgaguuccuggugaucgacuucgacagaaccaccaagaacgagguggugggcagacugauccugggcgcccacagcgugaccgccagcggcgccgagcacuggagagaggugugcgagagccccagaaagcccguggccaaguggcacagccugagcgaguacuaa

SEQ ID NO: 24301 - RNA, 1266 nt, Artificial Sequence
  SYT12__Homo_sapiens__NP_001171351
auggccguggacguggccgaguaccaccugagcgugaucaagagcccccccggcugggaggugggcguguacgccgccggcgcccuggcccugcugggcaucgccgccgugagccuguggaagcuguggaccagcggcagcuuccccagccccagccccuuccccaacuacgacuacagauaccugcagcagaaguacggcgagagcugcgccgaggccagagagaagagagugcccgccuggaacgcccagagagccagcaccagaggcccccccagcagaaagggcagccugagcaucgaggacaccuucgagagcaucagcgagcugggcccccuggagcugaugggcagagagcuggaccuggcccccuacggcacccugagaaagagccagagcgccgacagccugaacagcaucagcagcgugagcaacaccuucggccaggacuucacccugggccagguggaggugagcauggaguacgacaccgccagccacacccugaacguggccgugaugcagggcaaggaccugcuggagagagaggaggccagcuucgagagcugcuucaugagagugagccugcugcccgacgagcagaucgugggcaucagcagaauccagagaaacgccuacagcaucuucuucgacgagaaguucagcaucccccuggaccccaccgcccuggaggagaagagccugagauucagcguguucggcaucgacgaggacgagagaaacgugagcaccggcgugguggagcugaagcugagcgugcuggaccugccccugcagcccuucagcggcuggcuguaccugcaggaccagaacaaggccgccgacgccgugggcgagauccugcugagccugagcuaccugcccaccgccgagagacugaccguggugguggugaaggccaagaaccugaucuggaccaacgacaagaccaccgccgaccccuucgugaagguguaccugcugcaggacggcagaaagaugagcaagaagaagaccgccgugaagagagacgaccccaaccccguguucaacgaggccaugaucuucagcgugcccgccaucgugcugcaggaccugagccugagagugaccguggccgagagcagcagcgacggcagaggcgacaacgugggccacgugaucaucggccccagcgccagcggcaugggcaccacccacuggaaccagaugcuggccacccugagaagacccgugagcauguggcacgccgugagaagaaacuaa

SEQ ID NO: 24302 - RNA, 1281 nt, Artificial Sequence
  SYT13__Homo_sapiens__NP_065877
auggugcugagcgugcccgugaucgcccugggcgccacccugggcaccgccaccagcauccuggcccugugcggcgugaccugccugugcagacacaugcaccccaagaagggccugcugcccagagaccaggaccccgaccuggagaaggccaagcccagccugcugggcagcgcccagcaguucaacgugaagaagagcaccgagcccgugcagcccagagcccugcugaaguuccccgacaucuacggccccagacccgccgugaccgcccccgaggugaucaacuacgccgacuacagccugagaagcaccgaggagcccaccgcccccgccagcccccagccccccaacgacagcagacugaagagacaggugaccgaggagcuguucauccugccccagaacggcgugguggaggacgugugcgugauggagaccuggaaccccgagaaggccgccagcuggaaccaggcccccaagcugcacuacugccuggacuacgacugccagaaggccgagcuguucgugaccagacuggaggccgugaccagcaaccacgacggcggcugcgacugcuacgugcagggcagcguggccaacagaaccggcagcguggaggcccagaccgcccugaagaagagacagcugcacaccaccugggaggagggccuggugcugccccuggccgaggaggagcugcccaccgccacccugacccugacccugagaaccugcgacagauucagcagacacagcguggccggcgagcugagacugggccuggacggcaccagcgugccccugggcgccgcccaguggggcgagcugaagaccagcgccaaggagcccagcgccggcgccggcgaggugcugcugagcaucagcuaccugcccgccgccaacagacugcugguggugcugaucaaggccaagaaccugcacagcaaccagagcaaggagcugcugggcaaggacgugagcgugaaggugacccugaagcaccaggccagaaagcugaagaagaagcagaccaagagagccaagcacaagaucaaccccguguggaacgagaugaucauguucgagcugcccgacgaccugcugcaggccagcagcguggagcuggaggugcugggccaggacgacagcggccagagcugcgcccugggccacugcagccugggccugcacaccagcggcagcgagagaagccacugggaggagaugcugaagaaccccagaagacagaucgccauguggcaccagcugcaccuguaa

SEQ ID NO: 24303 - RNA, 1860 nt, Artificial Sequence
  SYT14__Homo_sapiens__NP_001139733
auggccagcgccagcuggagacugaagguggagagagagcccguggaguacaugaaccugagcgugcuggagaagaucggcuacuucagcguggccagacuggaguacagcggcaccauccuggcccacugcaacuucagacugcugggcagcaacgacagcagcgccagcgccagccaggugaccggcaccaccgugagccccgaggccgugggcuuccugagcgccgugggcguguucaucauccugaugcugcugcuguuccuguacaucaacaagaaguucugcuucgagaacgugggcggcuuccccgaccugggcagcgaguacagcaccagaaagaacagccaggacaagaucuacaacagcuacauggacaaggacgagcacggcagcagcagcgagagcgaggacgaggcccugggcaaguaccacgaggcccugagcagaacccacaacagcagacugccccuggccgacagcagacagagaaacuacgccugggagaccagacagaaguacagcccccugagcgccgaguacgacggcuacagcagcgaggccagcaucgacgagggcaacugcauccagagaaugagaagaacccccccccuggacgagcugcagcccccccccuaccaggacgacagcggcagcccccaccugagcugcacccccagcgagaucggcgacagcaagugcgaguucagccacugcagcaacagccccagaugcagcuacaacaagugccccagcgagggcagcaccggccacgagaucgagagcuuccacaacaagggcuacgaggaggacgugcccagcgacagcaccgccgugcugagccccgaggacaugagcgcccagggcagcagcagccagcugcccaagcccuucgaccccgagcccgaggccaaguacggcacccuggacgugaccuucgacuacgacagccaggagcagaagcugcuggugaccgugaccgccgugaccgacauccccaccuacaacagaaccggcggcaacagcuggcaggugcaccuggugcugcugcccaucaagaagcagagagccaagaccagcauccagagaggccccugccccguguucaccgagaccuucaaguucaaccacguggagagcgagaugaucggcaacuacgccgugagauucagacuguacggcgugcacagaaugaagaaggagaagaucgugggcgagaagaucuucuaccugaccaagcugaaccugcagggcaagaugagccugcccgugauccuggagcccagcuacaaccacagcggcugcgacagccagaugagcgugagcgagaugagcugcagcgagagcaccagcagcugccagagccuggagcacggcagcgugcccgagauccugaucggccugcuguacaacgccaccaccggcagacugagcgccgaggugaucaagggcagccacuucaagaaccuggccgccaacagaccccccaacggccuguucugcugccugaagcaccugaucggcggccagguguacaucaucagagacaccuacgugaagcugacccugcugaacagcaugggccaggagaugagcaagugcaagaccagcaucagaagaggccagcccaaccccguguacaaggagaccuucguguuccagguggcccuguuccagcugagcgacgugacccugauccugagcguguacaacaagagaagcaugaagagaaaggagaugaucggcuggaucagccugggccugaacagcagcggcgaggaggagcugaaccacuggaccgagaugaaggagagcaagggccagcaggugugcagauggcacgcccugcuggagagcuaa

SEQ ID NO: 24304 - RNA, 1260 nt, Artificial Sequence
  SYT1__Homo_sapiens__NP_001278830
auggugagcgagagccaccacgaggcccuggccgccccccccgugaccaccguggccaccgugcugcccagcaacgccaccgagcccgccagccccggcgagggcaaggaggacgccuucagcaagcugaaggagaaguucaugaacgagcugcacaagaucccccugccccccugggcccugaucgccaucgccaucguggccgugcugcuggugcugaccugcugcuucugcaucugcaagaagugccuguucaagaagaagaacaagaagaagggcaaggagaagggcggcaagaacgccaucaacaugaaggacgugaaggaccugggcaagaccaugaaggaccaggacgacgacgccgagaccggccugaccgacggcgaggagaaggaggagcccaaggaggaggagaagcugggcaagcugcaguacagccuggacuacgacuuccagaacaaccagcugcuggugggcaucauccaggccgccgagcugcccgcccuggacaugggcggcaccagcgaccccuacgugaagguguuccugcugcccgacaagaagaagaaguucgagaccaaggugcacagaaagacccugaaccccguguucaacgagcaguucaccuucaaggugcccuacagcgagcugggcggcaagacccuggugauggccguguacgacuucgacagauucagcaagcacgacaucaucggcgaguucaaggugcccaugaacaccguggacuucggccacgugaccgaggaguggagagaccugcagagcgccgagaaggaggagcaggagaagcugggcgacaucugcuucagccugagauacgugcccaccgccggcaagcugaccguggugauccuggaggccaagaaccugaagaagauggacgugggcggccugagcgaccccuacgugaagauccaccugaugcagaacggcaagagacugaagaagaagaagaccaccaucaagaagaacacccugaaccccuacuacaacgagagcuucagcuucgaggugcccuucgagcagauccagaaggugcaggugguggugaccgugcuggacuacgacaagaucggcaagaacgacgccaucggcaagguguucgugggcuacaacagcaccggcgccgagcugagacacuggagcgacaugcuggccaaccccagaagacccaucgcccaguggcacacccugcagguggaggaggagguggacgccaugcuggccgugaagaaguaa

SEQ ID NO: 24305 - RNA, 1278 nt, Artificial Sequence
  SYT4__Homo_sapiens__NP_065834
auggcccccaucaccaccagcagagaggaguucgacgagauccccaccguggugggcaucuucagcgccuucggccugguguucaccgugagccuguucgccuggaucugcugccagagaaagagcagcaagagcaacaagaccccccccuacaaguucgugcacgugcugaagggcguggacaucuaccccgagaaccugaacagcaagaagaaguucggcgccgacgacaagaacgaggugaagaacaagcccgccgugcccaagaacagccugcaccuggaccuggagaagagagaccugaacggcaacuuccccaagaccaaccugaagcccggcagccccagcgaccuggagaacgccacccccaagcuguuccuggagggcgagaaggagagcgugagccccgagagccugaagagcagcaccagccugaccagcgaggagaagcaggagaagcugggcacccuguucuucagccuggaguacaacuucgagagaaaggccuucguggugaacaucaaggaggccagaggccugcccgccauggacgagcagagcaugaccagcgaccccuacaucaagaugaccauccugcccgagaagaagcacaaggugaagaccagagugcugagaaagacccuggaccccgccuucgacgagaccuucaccuucuacggcauccccuacacccagauccaggagcuggcccugcacuucaccauccugagcuucgacagauucagcagagacgacaucaucggcgaggugcugaucccccugagcggcaucgagcugagcgagggcaagaugcugaugaacagagagaucaucaagagaaacgugagaaagagcagcggcagaggcgagcugcugaucagccugugcuaccagagcaccaccaacacccugaccgugguggugcugaaggccagacaccugcccaagagcgacgugagcggccugagcgaccccuacgugaaggugaaccuguaccacgccaagaagagaaucagcaagaagaagacccacgugaagaagugcacccccaacgccguguucaacgagcuguucguguucgacauccccugcgagggccuggaggacaucagcguggaguuccuggugcuggacagcgagagaggcagcagaaacgaggugaucggccagcuggugcugggcgccgccgccgagggcaccggcggcgagcacuggaaggagaucugcgacuaccccagaagacagaucgccaaguggcacgugcugugcgacggcuaa

SEQ ID NO: 24306 - RNA, 900 nt, Artificial Sequence
  SYT6__Homo_sapiens__XP_011539054
augcccuggagaaacaaggaggccagcagccccagcagcgccaaccccccccuggaggcccugcagagccccagcuucagaggcaacauggccgacaagcugaaggaccccagcacccugggcuuccuggaggccgccgugaagaucagccacaccagccccgacauccccgccgaggugcagaugagcgugaaggagcacaucaugagacacaccagacugcagagacagaccaccgagcccgccagcagcaccagacacaccagcuucaagagacaccugcccagacagaugcacgugagcagcguggacuacggcaacgagcugccccccgccgccgagcagcccaccagcaucggcagaaucaagcccgagcuguacaagcagaagagcguggacggcgaggacgccaagagcgaggccaccaagagcugcggcaagaucaacuucagccugagauacgacuacgagaccgagacccugaucgugagaauccugaaggccuucgaccugcccgccaaggacuucugcggcagcagcgaccccuacgugaagaucuaccugcugcccgacagaaagugcaagcugcagaccagagugcacagaaagacccugaaccccaccuucgacgagaacuuccacuuccccgugcccuacgaggagcuggccgacagaaagcugcaccugagcguguucgacuucgacagauucagcagacacgacaugaucggcgaggugauccuggacaaccuguucgaggccagcgaccugagcagagagaccagcaucuggaaggacauccaguacgccaccagccuggacuggggccugugcagcacccugcugcccggcgaccccagccagcagagacugcaccuggacaccggcccccacagcuaa

SEQ ID NO: 24307 - RNA, 1476 nt, Artificial Sequence
  SYT9__Homo_sapiens__NP_783860
augcccggcgccagagacgcccugugccaccaggcccugcagcugcuggccgagcugugcgccagaggcgcccuggagcacgacagcugccaggacuucaucuaccaccugagagacagagccagacccagacugagagaccccgacaucagcgugagccugcugacccugguggugaccgccugcggccuggcccuguucggcgugagccuguucgugagcuggaagcugugcugggugcccuggagagagagaggccugcccagcggcagcaaggacaacaaccaggagccccugaacuacauggacaccgagaccaacgagcaggagaacagcgaggacuuccuggacccccccacccccugccccgacagcagcaugaagaucagccacaccagccccgacaucccccugagcacccagaccggcauccaggagaacugcgcccacggcgugagagugcagagacaggugaccgagcccaccagcagcgccagacacaacagcaucagaagacagcugaaccugagcaaccccgacuucaacauccagcagcugcagaagcaggagcagcugaccggcaucggcagaaucaagcccgagcuguacaagcagagaagccuggacaacgacgacggcagaagaagcaacagcaaggccugcggcaagcugaacuucauccugaaguacgacugcgaccuggagcagcugaucgugaagauccacaaggccgugaaccugcccgccaaggacuucagcggcaccagcgaccccuacgugaagaucuaccugcugcccgacagaaagaccaagcaccagaccaaggugcacagaaagacccugaaccccguguucgacgagguguuccuguuccccgugcccuacaacgaccuggaggccagaaagcugcacuucagcguguacgacuucgacagauucagcagacacgaccugaucggccagguggugguggaccacuuccuggaccuggccgacuuccccagagagugcauccuguggaaggacaucgaguacgugaccaacgacaacguggaccugggcgagcugauguucagccugugcuaccugcccaccgccggcagacugaccaucaccaucaucaaggccagaaaccugaaggccauggacaucaccggcgccagcgaccccuacgugaaggugagccugaugugcgacggcagaagacugaagaagagaaagaccagcaccaagagaaacacccugaaccccguguacaacgaggccaucguguucgacgugccccccgagaacaucgaccagauccaccugagcaucgccgugauggacuacgacagagugggccacaacgagaucaucggcgugugccaggugggcaacgaggccgagagacugggcagagaccacuggagcgagaugcugagcuaccccagaaagcccaucgcccacuggcacagccugguggagaagagauaa

SEQ ID NO: 24308 - RNA, 954 nt, Artificial Sequence
  SYTL1__Homo_sapiens__XP_011540618
augagaccccugagaagaggcagcggcagacugagacugcagauccugagaagaagacccagacccagaaagauccuggccaaggagaccaacagaagcgugcccagaagacugaccagaagcuggagccccagaagaggcgagagcagaagcagaggccccagcaagcccagcuacgugaagagcuaccugcugcccgacaagcagagcaagagaaagaccgccgugaagaagagaaaccugaaccccguguucaacgagacccugagauacagcgugccccaggccgagcugcagggcagagugcugagccugagcguguggcacagagagagccugggcagaaacaucuuccugggcgagguggaggugccccuggacaccugggacuggggcagcgagcccaccuggcugccccugcagcccagagugccccccagccccgacgaccugcccagcagaggccugcuggcccugagccugaaguacgugcccgccggcagcgagggcgccggccugccccccagcggcgagcugcacuucugggugaaggaggccagagaccugcugccccugagagccggcagccuggacaccuacgugcagugcuucgugcugcccgacgacagccaggccagcagacagagaaccagaguggugagaagaagccugagccccguguucaaccacaccaugguguacgacggcuucggccccgccgaccugagacaggccugcgccgagcugagccugugggaccacggcgcccuggccaacagacagcugggcggcaccagacugagccugggcaccggcagcagcuacggccugcaggugcccuggauggacagcacccccgaggagaagcagcuguggcaggcccugcuggagcagcccugcgaguggguggacggccugcugccccugagaaccaaccuggcccccagaaccuaa

SEQ ID NO: 24309 - RNA, 2805 nt, Artificial Sequence
  SYTL2__Homo_sapiens__NP_001156423
augaucgaccugagcuuccugaccgaggaggagcaggaggccaucaugaaggugcugcagagagacgccgcccugaagagagccgaggaggagagagugagacaccugcccgagaagaucaaggacgaccagcagcugaagaacaugagcggccagugguucuacgaggccaaggccaagagacacagagacaagauccacggcgccgacaucaucagagccagcaugagaaagaagagaccccagaucgccgccgagcagagcaaggacagagagaacggcgccaaggagagcugggugaacaacgugaacaaggacgccuuccugccccccgagcuggccggcgugguggaggagcccgaggaggacgccgcccccgccagccccagcagcagcguggugaaccccgccagcagcgugaucgacaugagccaggagaacaccagaaagcccaacgugagccccgagaagagaaagaaccccuucaacagcagcaagcugcccgagggccacagcagccagcagaccaagaacgagcagagcaagaacggcagaaccggccuguuccagaccagcaaggaggacgagcugagcgagagcaaggagaagagcaccguggccgacaccagcauccagaagcuggagaagagcaagcagacccugcccggccugagcaacggcagccagaucaaggcccccauccccaaggccagaaagaugaucuacaagagcaccgaccugaacaaggacgacaaccagagcuuccccagacagagaaccgacagccugaaggccagaggcgcccccagaggcauccugaagagaaacagcagcagcagcagcaccgacagcgagacccugagauacaaccacaacuucgagcccaagagcaagaucgugagccccggccugaccauccacgagagaaucagcgagaaggagcacagccuggaggacaacagcagccccaacagccuggagccccugaagcacgugagauucagcgccgugaaggacgagcugccccagagccccggccugauccacggcagagaggugggcgaguucagcgugcuggagagcgacagacugaagaacggcauggaggacgccggcgacaccgaggaguuccagagcgaccccaagcccagccaguacagaaagcccagccuguuccaccagagcaccagcagccccuacgugagcaagagcgagacccaccagcccaugaccagcggcagcuuccccaucaacggccugcacagccacagcgaggugcugaccgccagaccccagagcauggagaacagccccaccaucaacgagcccaaggacaagagcagcgagcugaccagacuggagagcgugcugcccagaagccccgccgacgagcugagccacugcguggagcccgagcccagccaggugcccggcggcagcagcagagacagacagcagggcagcgaggaggagcccagccccgugcugaagacccuggagagaagcgccgccagaaagaugcccagcaagagccuggaggacaucagcagcgacagcagcaaccaggccaagguggacaaccagcccgaggagcuggugagaagcgccgaggacgugagcaccgugcccacccagcccgacaaccccuucagccaccccgacaagcugaagagaaugagcaagagcgugcccgccuuccugcaggacgagagcgacgacagagagaccgacaccgccagcgagagcagcuaccagcugagcagacacaagaagagccccagcagccugaccaaccugagcagcagcagcggcaugaccagccugagcagcgugagcggcagcgugaugagcguguacagcggcgacuucggcaaccuggaggugaagggcaacauccaguucgccaucgaguacguggagagccugaaggagcugcacguguucguggcccagugcaaggaccuggccgccgccgacgugaagaagcagagaagcgaccccuacgugaaggccuaccugcugcccgacaagggcaagaugggcaagaagaagacccugguggugaagaagacccugaaccccguguacaacgagauccugagauacaagaucgagaagcagauccugaagacccagaagcugaaccugagcaucuggcacagagacaccuucaagagaaacagcuuccugggcgagguggagcuggaccuggagaccugggacugggacaacaagcagaacaagcagcugagaugguacccccugaagagaaagaccgcccccguggcccuggaggccgagaacagaggcgagaugaagcuggcccugcaguacgugcccgagcccgugcccggcaagaagcugcccaccaccggcgaggugcacaucugggugaaggagugccuggaccugccccugcugagaggcagccaccugaacagcuucgugaagugcaccauccugcccgacaccagcagaaagagcagacagaagaccagagccgugggcaagaccaccaaccccaucuucaaccacaccaugguguacgacggcuucagacccgaggaccugauggaggccugcguggagcugaccgugugggaccacuacaagcugaccaaccaguuccugggcggccugagaaucggcuucggcaccggcaagagcuacggcaccgagguggacuggauggacagcaccagcgaggagguggcccugugggagaagauggugaacagccccaacaccuggaucgaggccacccugccccugagaaugcugcugaucgccaagaucagcaaguaa

SEQ ID NO: 24310 - RNA, 2259 nt, Artificial Sequence
  SYTL5__Homo_sapiens__NP_001156806
augagcaagaacagcgaguucaucaaccugagcuuccugcuggaccacgagaaggagaugauccugggcgugcugaagagagacgaguaccugaagaagguggaggacaagagaaucagaaagcugaagaacgagcugcuggaggccaagagaagaagcggcaagacccagcaggaggccagcagagugugcgugcacugccacagaaaccugggccugaucuucgacagaggcgaccccugccaggccugcagccugagagugugcagagagugcagaguggccggccccaacggcagcuggaagugcaccgugugcgacaagaucgcccagcugagaaucaucaccggcgagugguucuucgaggagaaggccaagagauucaagcaggugaacgugcugggcaccgacguggugagacagagcauccugagaagaagccccggcgccgaggaggugcagagccaggagcagaccagacaggacgccgagaagagcgacaccagccccguggccggcaagaaggccagccacgacggccccaagagaaagggcuuccugcugagcaaguucagaagcgccaccagaggcgagaucaucacccccaagaccgacaccggcagaagcuacagccuggaccuggacggccagcacuucagaagccugaagagcccccccggcagcgacagaggcagcaccggcagcagcgaccugaacgaccaggagcccggccccagaacccccaagagcagcagaagcaacggcgugacccccggcacccagagcagccccgcccccagcaccagaaccgugaccagcgugaucagcagagaguacggcuucgagaacagcauggaccuggccgccaucgagggcaccagccaggagcugaccaagagccacagaagaaacaccagcggcacccccagcaucgccgugagcggcaccagccugagcagcgaccagagcagaagcgagcuggaccugagcgagagcuucaccgaggacagcgaggacaccgugagcaucagaagcaagagcgugcccggcgcccuggacaaggacagccuggaggagaccgaggagagcaucgacgcccuggugagcagccagcugagcaccaacacccacagacuggccagcggccugagcaccagcagccaggccggcagcgacagaaaguggaccuaccugaacgugcccgacgccgacagcgacaccaccagccugaacagcaugaugagcguguacagcgagaccggcgacuacggcaacgugaaggugagcggcgagauccugcugcacaucagcuacugcuacaagaccggcggccuguacaucuucgugaagaacugcagaaaccuggccaucggcgacgagaagaagcagagaaccgacgccuacgugaagagcuaccugcugcccgacaagagcagaaacaacaagagaaagaccaagaucagaaccggcaccaaccccgaguucaacgagacccugaaguacaccaucagccacacccagcuggagaccagaacccugcagcugagcguguggcacuacgacagauucggcagaaacagcuuccugggcgagguggagauccccuucgacagcuggaacuucgagaaccccaccgacgagugguucgugcugcagcccaagguggaguucgcccccgacaucggccugcaguacaagggcgagcugaccguggugcugagauacaucccccccgaggagaaccugaugcugccccccgagcagcugcagggcaacaagaccuucaagaagggcaagaagaaggagagccccgugaucagcggcggcauccuggagguguucaucaaggaggccaagaaccugaccgccgugaagagcggcggcaccagcgacagcuucgugaagggcuaccugcugcccgacgacagcaaggccaccaagcacaagacccuggugaucaagaagagcgugaacccccaguggaaccacaccuucauguucagcggcauccacccccaggacaucaagaacgugugccuggagcugaccaucugggacaaggaggccuucagcagcaacaucuuccugggcggcgugagacugaacagcggcagcggcgugagccacggcaagaacguggacuggauggacagccagggcgaggagcagagacuguggcagaagauggccaacaaccccggcacccccuucgagggcgugcugaugcugagaagcagcaugggcaagugcagacuguaa

SEQ ID NO: 24311 - RNA, 1851 nt, Artificial Sequence
  SYVN1__Homo_sapiens__NP_115807
auguucagaaccgccgugaugauggccgccagccuggcccugaccggcgccgugguggcccacgccuacuaccugaagcaccaguucuaccccaccgugguguaccugaccaagagcagccccagcauggccgugcuguacauccaggccuucgugcugguguuccugcugggcaaggugaugggcaagguguucuucggccagcugagagccgccgagauggagcaccugcuggagagaagcugguacgccgugaccgagaccugccuggccuucaccguguucagagacgacuucagccccagauucguggcccuguucacccugcugcuguuccugaagugcuuccacuggcuggccgaggacagaguggacuucauggagagaagccccaacaucagcuggcuguuccacugcagaaucgugagccugauguuccugcugggcauccuggacuuccuguucgugagccacgccuaccacagcauccugaccagaggcgccagcgugcagcugguguucggcuucgaguacgccauccugaugaccauggugcugaccaucuucaucaaguacgugcugcacagcguggaccugcagagcgagaaccccugggacaacaaggccguguacaugcuguacaccgagcuguucaccggcuucaucaaggugcugcuguacauggccuucaugaccaucaugaucaaggugcacaccuucccccuguucgccaucagacccauguaccuggccaugagacaguucaagaaggccgugaccgacgccaucaugagcagaagagccaucagaaacaugaacacccuguaccccgacgccacccccgaggagcugcaggccauggacaacgugugcaucaucugcagagaggagauggugaccggcgccaagagacugcccugcaaccacaucuuccacaccagcugccugagaagcugguuccagagacagcagaccugccccaccugcagaauggacgugcugagagccagccugcccgcccagagcccccccccccccgagcccgccgaccagggccccccccccgccccccacccccccccccugcugccccagccccccaacuucccccagggccugcugccccccuucccccccggcauguucccccuguggccccccaugggccccuucccccccgugccccccccccccagcagcggcgaggccguggccccccccagcaccagcgccgcccugagcagacccagcggcgccgccaccaccaccgccgccggcaccagcgccaccgccgccagcgccaccgccagcggccccggcagcggcagcgcccccgaggccggccccgcccccggcuuccccuuccccccccccuggaugggcaugccccugcccccccccuucgccuucccccccaugcccgugccccccgccggcuucgccggccugacccccgaggagcugagagcccuggagggccacgagagacagcaccuggaggccagacugcagagccugagaaacauccacacccugcuggacgccgccaugcugcagaucaaccaguaccugaccgugcuggccagccugggcccccccagacccgccaccagcgugaacagcaccgaggagaccgccaccaccgugguggccgccgccagcagcaccagcauccccagcagcgaggccaccacccccacccccggcgccagcccccccgcccccgagauggagagaccccccgcccccgagagcgugggcaccgaggagaugcccgaggacggcgagcccgacgccgccgagcugagaagaagaagacugcagaagcuggagagccccguggcccacuaa

SEQ ID NO: 24312 - RNA, 1020 nt, Artificial Sequence
  TAAR1__Homo_sapiens__NP_612200
augaugcccuucugccacaacaucaucaacaucagcugcgugaagaacaacuggagcaacgacgugagagccagccuguacagccugauggugcugaucauccugaccacccuggugggcaaccugaucgugaucgugagcaucagccacuucaagcagcugcacacccccaccaacuggcugauccacagcauggccaccguggacuuccugcugggcugccuggugaugcccuacagcauggugagaagcgccgagcacugcugguacuucggcgagguguucugcaagauccacaccagcaccgacaucaugcugagcagcgccagcaucuuccaccugagcuucaucagcaucgacagauacuacgccgugugcgacccccugagauacaaggccaagaugaacauccuggugaucugcgugaugaucuucaucagcuggagcgugcccgccguguucgccuucggcaugaucuuccuggagcugaacuucaagggcgccgaggagaucuacuacaagcacgugcacugcagaggcggcugcagcguguucuucagcaagaucagcggcgugcugaccuucaugaccagcuucuacauccccggcagcaucaugcugugcguguacuacagaaucuaccugaucgccaaggagcaggccagacugaucagcgacgccaaccagaagcugcagaucggccuggagaugaagaacggcaucagccagagcaaggagagaaaggccgugaagacccugggcaucgugaugggcguguuccugaucugcuggugccccuucuucaucugcaccgugauggaccccuuccugcacuacaucaucccccccacccugaacgacgugcugaucugguucggcuaccugaacagcaccuucaaccccaugguguacgccuucuucuaccccugguucagaaaggcccugaagaugaugcuguucggcaagaucuuccagaaggacagcagcagaugcaagcuguuccuggagcugagcagcuaa

SEQ ID NO: 24313 - RNA, 1056 nt, Artificial Sequence
  TAAR2__Homo_sapiens__NP_001028252
auggccgugagcagcgagcagcacgagcugagccacuucaagagaacccagaccaagaaggagaaguucaacugcagcgaguacggcaacagaagcugccccgagaacgagagaagccugggcgugagaguggccauguacagcuucauggccggcagcaucuucaucaccaucuucggcaaccuggccaugaucaucagcaucagcuacuucaagcagcugcacacccccaccaacuuccugauccugagcauggccaucaccgacuuccugcugggcuucaccaucaugcccuacagcaugaucagaagcguggagaacugcugguacuucggccugaccuucugcaagaucuacuacagcuucgaccugaugcugagcaucaccagcaucuuccaccugugcagcguggccaucgacagauucuacgccaucugcuacccccugcuguacagcaccaagaucaccauccccgugaucaagagacugcugcugcugugcuggagcgugcccggcgccuucgccuucggcgugguguucagcgaggccuacgccgacggcaucgagggcuacgacauccugguggccugcagcagcagcugccccgugauguucaacaagcuguggggcaccacccuguucauggccggcuucuucacccccggcagcaugauggugggcaucuacggcaagaucuucgccgugagcagaaagcacgcccacgccaucaacaaccugagagagaaccagaacaaccaggugaagaaggacaagaaggccgccaagacccugggcaucgugaucggcguguuccugcugugcugguuccccugcuucuucaccauccugcuggaccccuuccugaacuucagcacccccguggugcuguucgacgcccugaccugguucggcuacuucaacagcaccugcaacccccugaucuacggcuucuucuaccccugguucagaagagcccugaaguacauccugcugggcaagaucuucagcagcugcuuccacaacaccauccugugcaugcagaaggagagcgaguaa

SEQ ID NO: 24314 - RNA, 1014 nt, Artificial Sequence
  TAAR5__Homo_sapiens__NP_003958
augagagccguguucauccagggcgccgaggagcaccccgccgccuucugcuaccaggugaacggcagcugccccagaaccgugcacacccugggcauccagcuggugaucuaccuggccugcgccgccggcaugcugaucaucgugcugggcaacguguucguggccuucgccgugagcuacuucaaggcccugcacacccccaccaacuuccugcugcugagccuggcccuggccgacauguuccugggccugcuggugcugccccugagcaccaucagaagcguggagagcugcugguucuucggcgacuuccugugcagacugcacaccuaccuggacacccuguucugccugaccagcaucuuccaccugugcuucaucagcaucgacagacacugcgccaucugcgacccccugcuguaccccagcaaguucaccgugagaguggcccugagauacauccuggccggcuggggcgugcccgccgccuacaccagccuguuccuguacaccgacgugguggagaccagacugagccaguggcuggaggagaugcccugcgugggcagcugccagcugcugcugaacaaguucuggggcuggcugaacuucccccuguucuucgugcccugccugaucaugaucagccuguacgugaagaucuucgugguggccaccagacaggcccagcagaucaccacccugagcaagagccuggccggcgccgccaagcacgagagaaaggccgccaagacccugggcaucgccgugggcaucuaccugcugugcuggcugcccuucaccaucgacaccaugguggacagccugcugcacuucaucacccccccccugguguucgacaucuucaucugguucgccuacuucaacagcgccugcaaccccaucaucuacguguucagcuaccagugguucagaaaggcccugaagcugacccugagccagaagguguucagcccccagaccagaaccguggaccuguaccaggaguaa

SEQ ID NO: 24315 - RNA, 1038 nt, Artificial Sequence
  TAAR6__Homo_sapiens__NP_778237
augagcagcaacagcagccugcugguggccgugcagcugugcuacgccaacgugaacggcagcugcgugaagauccccuucagccccggcagcagagugauccuguacaucguguucggcuucggcgccgugcuggccguguucggcaaccugcuggugaugaucagcauccugcacuucaagcagcugcacagccccaccaacuuccugguggccagccuggccugcgccgacuuccuggugggcgugaccgugaugcccuucagcauggugagaaccguggagagcugcugguacuucggcagaagcuucugcaccuuccacaccugcugcgacguggccuucugcuacagcagccuguuccaccugugcuucaucagcaucgacagauacaucgccgugaccgacccccugguguaccccaccaaguucaccgugagcgugagcggcaucugcaucagcgugagcuggauccugccccugauguacagcggcgccguguucuacaccggcguguacgacgacggccuggaggagcugagcgacgcccugaacugcaucggcggcugccagaccguggugaaccagaacugggugcugaccgacuuccugagcuucuucauccccaccuucaucaugaucauccuguacggcaacaucuuccugguggccagaagacaggccaagaagaucgagaacaccggcagcaagaccgagagcagcagcgagagcuacaaggccagaguggccagaagagagagaaaggccgccaagacccugggcgugaccgugguggccuucaugaucagcuggcugcccuacagcaucgacagccugaucgacgccuucaugggcuucaucacccccgccugcaucuacgagaucugcugcuggugcgccuacuacaacagcgccaugaacccccugaucuacgcccuguucuaccccugguucagaaaggccaucaaggugaucgugaccggccaggugcugaagaacagcagcgccaccaugaaccuguucagcgagcacaucuaa

SEQ ID NO: 24316 - RNA, 1515 nt, Artificial Sequence
  TAB1__Homo_sapiens__NP_006107
auggccgcccagagaagaagccugcugcagagcgagcagcagcccagcuggaccgacgaccugccccugugccaccugagcggcgugggcagcgccagcaacagaagcuacagcgccgacggcaagggcaccgagagccacccccccgaggacagcuggcugaaguucagaagcgagaacaacugcuuccuguacggcguguucaacggcuacgacggcaacagagugaccaacuucguggcccagagacugagcgccgagcugcugcugggccagcugaacgccgagcacgccgaggccgacgugagaagagugcugcugcaggccuucgacgugguggagagaagcuuccuggagagcaucgacgacgcccuggccgagaaggccagccugcagagccagcugcccgagggcgugccccagcaccagcugcccccccaguaccagaagauccuggagagacugaagacccuggagagagagaucagcggcggcgccauggccgugguggccgugcugcugaacaacaagcuguacguggccaacgugggcaccaacagagcccugcugugcaagagcaccguggacggccugcaggugacccagcugaacguggaccacaccaccgagaacgaggacgagcuguucagacugagccagcugggccuggacgccggcaagaucaagcaggugggcaucaucugcggccaggagagcaccagaagaaucggcgacuacaaggugaaguacggcuacaccgacaucgaccugcugagcgccgccaagagcaagcccaucaucgccgagcccgagauccacggcgcccagccccuggacggcgugaccggcuuccuggugcugaugagcgagggccuguacaaggcccuggaggccgcccacggccccggccaggccaaccaggagaucgccgccaugaucgacaccgaguucgccaagcagaccagccuggacgccguggcccaggccgugguggacagagugaagagaauccacagcgacaccuucgccagcggcggcgagagagccagauucugccccagacacgaggacaugacccugcuggugagaaacuucggcuacccccugggcgagaugagccagcccacccccagccccgcccccgccgccggcggcagaguguaccccgugagcgugcccuacagcagcgcccagagcaccagcaagaccagcgugacccugagccuggugaugcccagccagggccagauggugaacggcgcccacagcgccagcacccuggacgaggccacccccacccugaccaaccagagccccacccugacccugcagagcaccaacacccacacccagagcagcagcagcagcagcgacggcggccuguucagaagcagacccgcccacagccugccccccggcgaggacggcagaguggagcccuacguggacuucgccgaguucuacagacuguggagcguggaccacggcgagcagagcguggugaccgcccccuaa

SEQ ID NO: 24317 - RNA, 1986 nt, Artificial Sequence
  TAB2__Homo_sapiens__NP_001278964
augcagaacaacaacaaccuggacgccugcugcgccgugcugagccaggagagcaccagauaccuguacggcgagggcgaccugaacuucagcgacgacagcggcaucagcggccugagaaaccacaugaccagccugaaccuggaccugcagagccagaacaucuaccaccacggcagagagggcagcagaaugaacggcagcagaacccugacccacagcaucagcgacggccagcugcagggcggccagagcaacagcgagcuguuccagcaggagccccagaccgcccccgcccaggugccccagggcuucaacguguucggcaugagcagcagcagcggcgccagcaacagcgccccccaccugggcuuccaccugggcagcaagggcaccagcagccugagccagcagacccccagauucaaccccaucauggugacccuggcccccaacauccagaccggcagaaacacccccaccagccugcacauccacggcgugcccccccccgugcugaacagcccccagggcaacagcaucuacaucagacccuacaucaccacccccggcggcaccaccagacagacccagcagcacagcggcugggugagccaguucaaccccaugaacccccagcagguguaccagcccagccagcccggccccuggaccaccugccccgccagcaacccccugagccacaccagcagccagcagcccaaccagcagggccaccagaccagccacguguacaugcccaucagcagccccaccaccagccagccccccaccauccacagcagcggcagcagccagagcagcgcccacagccaguacaacauccagaacaucagcaccggccccagaaagaaccagaucgagaucaagcuggagcccccccagagaaacaacagcagcaagcugagaagcagcggccccagaaccagcagcaccagcagcagcgugaacagccagacccugaacagaaaccagcccaccguguacaucgccgccagcccccccaacaccgacgagcugaugagcagaagccagcccaagguguacaucagcgccaacgccgccaccggcgacgagcaggugaugagaaaccagcccacccuguucaucagcaccaacagcggcgccagcgccgccagcagaaacaugagcggccaggugagcaugggccccgccuucauccaccaccacccccccaagagcagagccaucggcaacaacagcgccaccagccccagagugguggugacccagcccaacaccaaguacaccuucaagaucaccgugagccccaacaagccccccgccgugagccccggcguggugagccccaccuucgagcugaccaaccugcugaaccaccccgaccacuacguggagaccgagaacauccagcaccugaccgaccccacccuggcccacguggacagaaucagcgagaccagaaagcugagcaugggcagcgacgacgccgccuacacccaggcccugcuggugcaccagaaggccagaauggagagacugcagagagagcuggagauccagaagaagaagcuggacaagcugaagagcgaggugaacgagauggagaacaaccugaccagaagaagacugaagagaagcaacagcaucagccagauccccagccuggaggagaugcagcagcugagaagcugcaacagacagcugcagaucgacaucgacugccugaccaaggagaucgaccuguuccaggccagaggcccccacuucaaccccagcgccauccacaacuucuacgacaacaucggcuucgugggccccgugccccccaagcccaaggaccagagaagcaucaucaagacccccaagacccaggacaccgaggacgacgagggcgcccaguggaacugcaccgccugcaccuuccugaaccaccccgcccugaucagaugcgagcagugcgagaugcccagacacuucuaa

SEQ ID NO: 24318 - RNA, 2139 nt, Artificial Sequence
  TAB3__Homo_sapiens__XP_005274539
auggcccagagcagcccccagcuggacauccaggugcugcacgaccugagacagagauuccccgagauccccgagggcguggugagccagugcaugcugcagaacaacaacaaccuggaggccugcugcagagcccugagccaggagagcagcaaguaccuguacauggaguaccacagccccgacgacaacagaaugaacagaaacagacugcugcacaucaaccugggcauccacagccccagcagcuaccaccccggcgacggcgcccagcugaacggcggcagaacccuggugcacagcagcagcgacggccacaucgacccccagcacgccgccggcaagcagcugaucugccuggugcaggagccccacagcgcccccgccgugguggccgccacccccaacuacaaccccuucuucaugaacgagcagaacagaagcgccgccaccccccccagccagcccccccagcagcccagcagcaugcagaccggcaugaaccccagcgccaugcagggccccagcccccccccccccccccccagcuacaugcacauccccagauacagcaccaaccccaucaccgugaccgugagccagaaccugcccagcggccagaccgugcccagagcccugcagauccugccccagauccccagcaaccuguacggcagccccggcagcaucuacaucagacagaccagccagagcagcagcggcagacagaccccccagagcacccccuggcagagcagcccccagggccccgugccccacuacagccagagaccccugcccguguacccccaccagcagaacuaccagcccagccaguacagccccaagcagcagcagaucccccagagcgccuaccacagccccccccccagccagugccccagccccuucagcagcccccagcaccaggugcagcccagccagcugggccacaucuucaugccccccagccccagcaccacccccccccaccccuaccagcagggcccccccagcuaccagaagcagggcagccacagcguggccuaccugcccuacaccgccagcagccugagcaagggcagcaugaagaagaucgagaucaccguggagcccagccagagacccggcaccgccaucaacagaagccccagccccaucagcaaccagcccagccccagaaaccagcacagccuguacaccgccaccaccccccccagcagcagccccagcagaggcaucagcagccagcccaagccccccuucagcgugaaccccguguacaucaccuacacccagcccaccggccccagcugcacccccagccccagccccagagugauccccaaccccaccaccguguucaagaucaccgugggcagagccaccaccgagaaccugcugaaccugguggaccaggaggagagaagcgccgcccccgagcccauccagcccaucagcgugauccccggcagcggcggcgagaagggcagccacaaguaccagagaagcagcagcagcggcagcgacgacuacgccuacacccaggcccugcugcugcaccagagagccagaauggagagacuggccaagcagcugaagcuggagaaggaggagcuggagagacugaagagcgaggugaacggcauggagcacgaccugaugcagagaagacugagaagagugagcugcaccaccgccauccccacccccgaggagaugaccagacugagaagcaugaacagacagcugcagaucaacguggacugcacccugaaggagguggaccugcugcagagcagaggcaacuucgaccccaaggccaugaacaacuucuacgacaacaucgagcccggccccguggugccccccaagcccagcaagaaggacagcagcgaccccugcaccaucgagagaaaggccagaagaaucagcgugaccagcaaggugcaggccgacauccacgacacccaggccgccgccgccgacgagcacagaaccggcagcacccagagccccagaacccagcccagagacgaggacuacgagggcgcccccuggaacugcgacagcugcaccuuccugaaccaccccgcccugaacagaugcgagcagugcgagaugcccagauacaccuaa

SEQ ID NO: 24319 - RNA, 390 nt, Artificial Sequence
  TAC1__Homo_sapiens__NP_003173
augaagauccugguggcccuggccguguucuuccuggugagcacccagcuguucgccgaggagaucggcgccaacgacgaccugaacuacuggagcgacugguacgacagcgaccagaucaaggaggagcugcccgagcccuucgagcaccugcugcagagaaucgccagaagacccaagccccagcaguucuucggccugaugggcaagagagacgccgacagcagcaucgagaagcagguggcccugcugaaggcccuguacggccacggccagaucagccacaagagacacaagaccgacagcuucgugggccugaugggcaagagagcccugaacagcguggccuacgagagaagcgccaugcagaacuacgagagaagaagauaa

SEQ ID NO: 24320 - RNA, 312 nt, Artificial Sequence
  TAC3__Homo_sapiens__NP_001171525
augagaaucaugcugcuguucaccgccauccuggccuucagccuggcccagagcuucggcgccgugugcaaggagccccaggaggagguggugcccggcggcggcagaagcaagagagaccccgaccuguaccagcugcugcagagacuguucaagagccacagcagccuggagggccugcugaaggcccugagccaggccagcaccgaccccaaggagagcaccagccccgagaagcacagccccaccgacgugaaccaggagaacgugcccagcuucggcauccugaaguacccccccagagccgaguaa

SEQ ID NO: 24321 - RNA, 291 nt, Artificial Sequence
  TAC4__Homo_sapiens__NP_001070971
augcugcccugccuggcccugcugcugcugauggagcugagcgugugcaccguggccggcgacggcggcgaggagcagacccugagcaccgaggccgagaccugggagggcgccggccccagcauccagcugcagcugcaggaggugaagaccggcaaggccagccaguucuucggccugaugggcaagagagugggcgccuaccagcuggagcacaccuuccagggccugcugggcaagagaagccuguucaccgagggcagagaggacgaggcccagggcagcgaguaa

SEQ ID NO: 24322 - RNA, 1188 nt, Artificial Sequence
  TACC1__Homo_sapiens__NP_001116296
auggccuucagccccuggcagauccugagccccgugcagugggccaaguggaccuggagcgccgugagaggcggcgccgccggcgaggacgaggccggcggccccgagggcgaccccgaggaggaggacagccaggccgagaccaagagccugagcuucagaagcggcugcaaggugaagaagcacgagacccagagccuggcccuggacgccugcagcagagacgagggcgccgugaucagccagaucagcgacaucagcaacagagacggccacgccaccgacgaggagaagcuggccagcaccagcugcggccagaagagcgccggcgccgaggugaagggcgagcccgaggaggaccuggaguacuucgagugcagcaacgugcccgugagcaccaucaaccacgccuucagcagcagcgaggccggcaucgagaaggagaccugccagaagauggaggaggacggcagcaccgugcugggccugcuggagagcagcgccgagaaggcccccgugagcgugagcugcggcggcgagagcccccuggacggcaucugccugagcgagagcgacaagaccgccgugcugacccugaucagagaggagaucaucaccaaggagaucgaggccaacgaguggaagaagaaguacgaggagaccagacaggaggugcuggagaugagaaagaucguggccgaguacgagaagaccaucgcccagaugaucgaggacgagcagagaaccagcaugaccagccagaagagcuuccagcagcugaccauggagaaggagcaggcccuggccgaccugaacagcguggagagaagccugagcgaccuguucagaagauacgagaaccugaagggcgugcuggagggcuucaagaagaacgaggaggcccugaagaagugcgcccaggacuaccuggccagagugaagcaggaggagcagagauaccaggcccugaagauccacgccgaggagaagcuggacaaggccaacgaggagaucgcccaggugagaaccaaggccaaggccgagagcgccgcccugcacgccggccugagaaaggagcagaugaagguggagagccuggagagagcccugcagcagaagaaccaggagaucgaggagcugaccaagaucugcgacgagcugaucgccaagcugggcaagaccgacuaa

SEQ ID NO: 24323 - RNA, 8481 nt, Artificial Sequence
  TACC2__Homo_sapiens__NP_001278805
augggcaacgagaacagcaccagcgacaaccagagaacccugagcgcccagacccccagaagcgcccagccccccggcaacagccagaacaucaagagaaagcagcaggacacccccggcagccccgaccacagagacgccagcagcaucggcagcgugggccugggcggcuucugcaccgccagcgagagcagcgccagccuggaccccugccuggugagccccgaggugaccgagcccagaaaggacccccagggcgccagaggccccgagggcagccugcugcccagccccccccccagccaggagagagagcaccccagcagcagcaugcccuucgccgagugcccccccgagggcugccuggccagccccgccgccgcccccgaggacggcccccagacccagagccccagaagagagcccgcccccaacgcccccggcgacaucgccgccgccuuccccgccgagagagacagcagcacccccuaccaggagaucgccgccgugcccagcgccggcagagagagacagcccaaggaggagggccagaagagcagcuucagcuucagcagcggcaucgaccagagccccggcaugagccccgugccccugagagagcccaugaaggccccccugugcggcgagggcgaccagcccggcggcuucgagagccaggagaaggaggccgccggcggcuucccccccgccgagagcagacagggcguggccagcgugcaggugacccccgaggcccccgccgccgcccagcagggcaccgagagcagcgccgugcuggagaagagcccccugaagcccauggcccccaucccccaggaccccgcccccagagccagcgacagagagagaggccagggcgaggcccccccccaguaccugaccgacgaccuggaguuccugagagccugccaccugcccagaagcaacagcggcgccgcccccgaggccgaggugaacgccgccagccaggagagcugccagcagcccgugggcgccuaccugccccacgccgagcugcccuggggccugcccagccccgcccuggugcccgaggccggcggcagcggcaaggaggcccuggacaccaucgacgugcagggccacccccagaccggcaugagaggcaccaagcccaaccagguggugugcguggccgccggcggccagcccgagggcggccugcccgugagccccgagcccagccugcugacccccaccgaggaggcccaccccgccagcagccuggccagcuuccccgccgcccagauccccaucgccguggaggagcccggcagcagcagcagagagagcgugagcaaggccggcaugcccgugagcgccgacgccgccaaggaggugguggacgccggccuggugggccuggagagacaggugagcgaccugggcagcaagggcgagcaccccgagggcgaccccggcgaggugcccgcccccagcccccaggagagaggcgagcaccugaacaccgagcagagccacgaggugcagcccggcgugcccccccccccccugcccaaggagcagagccacgaggugcagcccggcgcccccccccccccccugcccaaggcccccagcgagagcgccagaggcccccccggccccaccgacggcgccaaggugcacgaggacagcaccagccccgccguggccaaggagggcagcagaagccccggcgacagccccggcggcaaggaggaggcccccgagccccccgacggcggcgaccccggcaaccugcagggcgaggacagccaggccuucagcagcaagagagaccccgaggugggcaaggacgagcugagcaagcccagcagcgacgccgagagcagagaccaccccagcagccacagcgcccagccccccagaaagggcggcgccggccacaccgacggcccccacagccagaccgccgaggccgacgccagcggccugccccacaagcugggcgaggaggaccccgugcugccccccgugcccgacggcgccggcgagcccaccgugcccgagggcgccaucugggagggcagcggccugcagcccaagugccccgacacccugcagagcagagagggccugggcagaauggagagcuuccugacccuggagagcgagaagagcgacuucccccccacccccguggccgagguggcccccaaggcccaggagggcgagagcacccuggagaucagaaagaugggcagcugcgacggcgagggccugcugaccagccccgaccagcccagaggccccgccugcgacgccagcagacaggaguuccacgccggcgugccccaccccccccagggcgagaaccuggccgccgaccugggccugaccgcccugauccuggaccaggaccagcagggcauccccagcugccccggcgagggcuggaucagaggcgccgccagcgaguggccccugcugagcagcgagaagcaccugcagcccagccaggcccagcccgagaccagcaucuucgacgugcugaaggagcaggcccagccccccgagaacggcaaggagaccagccccagccaccccggcuucaaggaccagggcgccgacagcagccagauccacgugcccguggagccccaggaggacaacaaccugcccacccacggcggccaggagcaggcccugggcagcgagcugcagagccagcugcccaagggcacccugagcgacacccccaccagcagccccaccgacauggugugggagagcagccugaccgaggagagcgagcugagcgcccccaccagacagaagcugcccgcccugggcgagaagagacccgagggcgccugcggcgacggccagagcagcagagugagcccccccgccgccgacgugcugaaggacuucagccuggccggcaacuucagcagaaaggagaccugcugcaccggccagggccccaacaagagccagcaggcccuggccgacgcccuggaggagggcagccagcacgaggaggccugccagagacaccccggcgccagcgaggccgccgacggcugcagcccccuguggggccugagcaagagagagauggccagcggcaacaccggcgaggccccccccugccagcccgacagcguggcccugcuggacgccgugcccugccugcccgcccuggcccccgccagccccggcgugacccccacccaggacgcccccgagaccgaggccugcgacgagacccaggagggcagacagcagcccgugcccgccccccagcagaagauggagugcagagccaccagcgacgccgagagccccaagcugcuggccagcuuccccagcgccggcgagcagggcggcgaggccggcgccgccgagaccggcggcagcgccggcgccggcgaccccggcaagcagcaggcccccgagaagcccggcgaggccacccugagcugcggccugcugcagaccgagcacugccugaccagcggcgaggaggccagcaccagcgcccugagagagagcugccaggccgagcaccccauggccagcugccaggacgcccugcugcccgccagagagcugggcggcauccccagaagcaccauggacuucagcacccaccaggccgugcccgaccccaaggagcugcugcugagcggcccccccgagguggccgcccccgacacccccuaccugcacguggacagcgccgcccagagaggcgccgaggacagcggcgugaaggccgugagcagcgccgaccccagagcccccggcgagagccccugccccgugggcgagcccccccuggcccuggagaacgccgccagccugaagcuguucgccggcagccuggccccccugcugcagcccggcgccgccggcggcgagauccccgccgugcaggccagcagcggcagccccaaggccagaaccaccgagggccccguggacagcaugcccugccuggacagaaugccccugcuggccaagggcaagcaggccaccggcgaggagaaggccgccaccgcccccggcgccggcgccaaggccagcggcgagggcauggccggcgacgccgccggcgagaccgagggcagcauggagagaaugggcgagcccagccaggaccccaagcagggcaccagcggcggcguggacaccagcagcgagcagaucgccacccugaccggcuuccccgacuucagagagcacaucgccaagaucuucgagaagcccgugcugggcgcccuggccacccccggcgagaaggccggcgccggcagaagcgccgugggcaaggaccugaccagaccccugggccccgagaagcugcuggacggcccccccggcguggacgugacccugcugcccgccccccccgccagacugcagguggagaagaagcagcagcuggccggcgaggccgagaucagccaccuggcccugcaggaccccgccagcgacaagcugcugggccccgccggccugaccugggagagaaaccugcccggcgccggcgugggcaaggagauggccggcgugccccccacccugagagaggacgagagacccgagggccccggcgccgccuggcccggccuggagggccaggccuacagccagcuggagagaagcagacaggagcuggccagcggccugcccagccccgccgccacccaggagcugcccguggagagagccgccgccuuccagguggccccccacagccacggcgaggaggccguggcccaggacagaauccccagcggcaagcagcaccaggagaccagcgccugcgacagcccccacggcgaggacggccccggcgacuucgcccacaccggcgugcccggccacgugcccagaagcaccugcgcccccagcccccagagagaggugcugaccgugcccgaggccaacagcgagcccuggacccuggacacccugggcggcgagagaagacccggcgugaccgccggcauccuggagaugagaaacgcccugggcaaccagagcacccccgccccccccaccggcgagguggccgacaccccccuggagcccggcaagguggccggcgccgccggcgaggccgagggcgacaucacccugagcaccgccgagacccaggccugcgccagcggcgaccugcccgaggccggcaccaccagaaccuucagcgugguggccggcgaccuggugcugcccggcagcugccaggaccccgccugcagcgacaaggcccccggcauggagggcaccgccgcccugcacggcgacagccccgccagaccccagcaggccaaggagcagcccggccccgagagacccauccccgccggcgacggcaaggugugcgugagcagcccccccgagcccgacgagacccacgaccccaagcugcagcaccuggcccccgaggagcugcacaccgacagagagagccccagacccggccccagcaugcugcccagcgugcccaagaaggacgcccccagagugauggacaaggugaccagcgacgagaccagaggcgccgagggcaccgagagcagccccguggccgacgacaucauccagcccgccgcccccgccgaccuggagagccccacccuggccgccagcagcuaccacggcgacguggugggccaggugagcaccgaccugaucgcccagagaagcagcgacagcgaggaggccuucgagacccccgagagcaccacccccgugaaggccccccccgccccccccccccccccccccgaggugauccccgagcccgaggugagcacccagcccccccccgaggagcccggcugcggcagcgagaccgugcccgugcccgacggccccagaagcgacagcguggagggcagccccuucagaccccccagccacagcuucagcgccguguucgacgaggacaagcccaucgccagcagcggcaccuacaaccuggacuucgacaacaucgagcugguggacaccuuccagacccuggagcccagagccagcgacgccaagaaccaggagggcaaggugaacaccagaagaaagagcaccgacagcgugcccaucagcaagagcacccugagcagaagccugagccugcaggccagcgacuucgacggcgccagcagcagcggcaaccccgaggccguggcccuggcccccgacgccuacagcaccggcagcagcagcgccagcagcacccugaagagaaccaagaagcccagaccccccagccugaagaagaagcagaccaccaagaagcccaccgagaccccccccgugaaggagacccagcaggagcccgacgaggagagccuggugcccagcggcgagaaccuggccagcgagaccaagaccgagagcgccaagaccgagggccccagccccgcccugcuggaggagaccccccuggagcccgccgugggccccaaggccgccugcccccuggacagcgagagcgccgagggcguggugccccccgccagcggcggcggcagagugcagaacagcccccccgugggcagaaagacccugccccugaccaccgcccccgaggccggcgaggugacccccagcgacagcggcggccaggaggacagccccgccaagggccugagcgugagacuggaguucgacuacagcgaggacaagagcagcugggacaaccagcaggagaaccccccccccaccaagaagaucggcaagaagcccguggccaagaugccccugagaagacccaagaugaagaagacccccgagaagcuggacaacacccccgccagcccccccagaagccccgccgagcccaacgacauccccaucgccaagggcaccuacaccuucgacaucgacaagugggacgaccccaacuucaaccccuucagcagcaccagcaagaugcaggagagccccaagcugccccagcagagcuacaacuucgaccccgacaccugcgacgagagcguggaccccuucaagaccagcagcaagacccccagcagccccagcaagagccccgccagcuucgagauccccgccagcgccauggaggccaacggcguggacggcgacggccugaacaagcccgccaagaagaagaagaccccccugaagaccgacaccuucagagugaagaagagccccaagagaagcccccugagcgacccccccagccaggaccccacccccgccgccacccccgagaccccccccgugaucagcgccguggugcacgccaccgacgaggagaagcuggccgugaccaaccagaaguggaccugcaugaccguggaccuggaggccgacaagcaggacuacccccagcccagcgaccugagcaccuucgugaacgagaccaaguucagcagccccaccgaggagcuggacuacagaaacagcuacgagaucgaguacauggagaagaucggcagcagccugccccaggacgacgacgcccccaagaagcaggcccuguaccugauguucgacaccagccaggagagccccgugaagagcagccccgugagaaugagcgagagccccacccccugcagcggcagcagcuucgaggagaccgaggcccuggugaacaccgccgccaagaaccagcaccccgugcccagaggccuggcccccaaccaggagagccaccugcaggugcccgagaagagcagccagaaggagcuggaggccaugggccugggcacccccagcgaggccaucgagaucagagaggccgcccaccccaccgacgugagcaucagcaagaccgcccuguacagcagaaucggcaccgccgagguggagaagcccgccggccugcuguuccagcagcccgaccuggacagcgcccugcagaucgccagagccgagaucaucaccaaggagagagaggugagcgaguggaaggacaaguacgaggagagcagaagagaggugauggagaugagaaagaucguggccgaguacgagaagaccaucgcccagaugaucgaggacgagcagagagagaagagcgugagccaccagaccgugcagcagcuggugcuggagaaggagcaggcccuggccgaccugaacagcguggagaagagccuggccgaccuguucagaagauacgagaagaugaaggaggugcuggagggcuucagaaagaacgaggaggugcugaagagaugcgcccaggaguaccugagcagagugaagaaggaggagcagagauaccaggcccugaaggugcacgccgaggagaagcuggacagagccaacgccgagaucgcccaggugagaggcaaggcccagcaggagcaggccgcccaccaggccagccugagaaaggagcagcugagaguggacgcccuggagagaacccuggagcagaagaacaaggagaucgaggagcugaccaagaucugcgacgagcugaucgccaagaugggcaagagcuaa

SEQ ID NO: 24324 - RNA, 2517 nt, Artificial Sequence
  TACC3__Homo_sapiens__NP_006333
augagccugcaggugcugaacgacaagaacgugagcaacgagaagaacaccgagaacugcgacuuccuguucagcccccccgaggugaccggcagaagcagcgugcugagagugagccagaaggagaacgugccccccaagaaccuggccaaggccaugaaggugaccuuccagaccccccugagagacccccagacccacagaauccugagccccagcauggccagcaagcuggaggcccccuucacccaggacgacacccugggccuggagaacagccaccccguguggacccagaaggagaaccagcagcugaucaaggagguggacgccaagaccacccacggcauccugcagaagcccguggaggccgacaccgaccugcugggcgacgccagccccgccuucggcagcggcagcagcagcgagagcggccccggcgcccuggccgaccuggacugcagcagcagcagccagagccccggcagcagcgagaaccagauggugagccccggcaaggugagcggcagccccgagcaggccguggaggagaaccugagcagcuacagccuggacagaagagugacccccgccagcgagacccuggaggaccccugcagaaccgagagccagcacaaggccgagaccccccacggcgccgaggaggagugcaaggccgagaccccccacggcgccgaggaggagugcagacacggcggcgugugcgcccccgccgccguggccaccagcccccccggcgccauccccaaggaggccugcggcggcgccccccugcagggccugcccggcgaggcccugggcugccccgccggcgugggcacccccgugcccgccgacggcacccagacccugaccugcgcccacaccagcgcccccgagagcaccgcccccaccaaccaccugguggccggcagagccaugacccugagcccccaggaggagguggccgccggccagauggccagcagcagcagaagcggccccgugaagcuggaguucgacgugagcgacggcgccaccagcaagagagcccccccccccagaagacugggcgagagaagcggccugaagcccccccugagaaaggccgccgugagacagcagaaggccccccaggagguggaggaggacgacggcagaagcggcgccggcgaggacccccccaugcccgccagcagaggcagcuaccaccuggacugggacaagauggacgaccccaacuucauccccuucggcggcgacaccaagagcggcugcagcgaggcccagccccccgagagccccgagaccagacugggccagcccgccgccgagcagcugcacgccggccccgccaccgaggagcccggccccugccugagccagcagcugcacagcgccagcgccgaggacacccccguggugcagcuggccgccgagacccccaccgccgagagcaaggagagagcccugaacagcgccagcaccagccugcccaccagcugccccggcagcgagcccgugcccacccaccagcagggccagcccgcccuggagcugaaggaggagagcuucagagaccccgccgaggugcugggcaccggcgccgagguggacuaccuggagcaguucggcaccagcagcuucaaggagagcgcccugagaaagcagagccuguaccugaaguucgacccccugcugagagacagccccggcagacccgugcccguggccaccgagaccagcagcaugcacggcgccaacgagacccccagcggcagacccagagaggccaagcugguggaguucgacuuccugggcgcccuggacauccccgugcccggccccccccccggcgugcccgcccccggcggccccccccugagcaccggccccaucguggaccugcugcaguacagccagaaggaccuggacgccguggugaaggccacccaggaggagaacagagagcugagaagcagaugcgaggagcugcacggcaagaaccuggagcugggcaagaucauggacagauucgaggaggugguguaccaggccauggaggaggugcagaagcagaaggagcugagcaaggccgagauccagaaggugcugaaggagaaggaccagcugaccaccgaccugaacagcauggagaagagcuucagcgaccuguucaagagauucgagaagcagaaggaggugaucgagggcuacagaaagaacgaggagagccugaagaagugcguggaggacuaccuggccagaaucacccaggagggccagagauaccaggcccugaaggcccacgccgaggagaagcugcagcuggccaacgaggagaucgcccaggugagaagcaaggcccaggccgaggcccuggcccugcaggccagccugagaaaggagcagaugagaauccagagccuggagaagaccguggagcagaagaccaaggagaacgaggagcugaccagaaucugcgacgaccugaucagcaagauggagaagaucuaa

SEQ ID NO: 24325 - RNA, 894 nt, Artificial Sequence
  TACO1__Homo_sapiens__NP_057444
augagcgccugggccgccgccagccugagcagagccgccgccagaugccugcuggccagaggccccggcgugagagccgccccccccagagaccccagacccagccaccccgagcccagaggcugcggcgccgcccccggcagaacccugcacuucaccgccgccgugcccgccggccacaacaaguggagcaaggugagacacaucaagggccccaaggacguggagagaagcagaaucuucagcaagcugugccugaacaucagacuggccgugaaggagggcggccccaaccccgagcacaacagcaaccuggccaacauccuggaggugugcagaagcaagcacaugcccaagagcaccaucgagaccgcccugaagauggagaagagcaaggacaccuaccugcuguacgagggcagaggccccggcggcagcagccugcugaucgaggcccugagcaacagcagccacaagugccaggccgacaucagacacauccugaacaagaacggcggcgugauggccgugggcgccagacacagcuucgacaagaagggcgugaucgugguggagguggaggacagagagaagaaggccgugaaccuggagagagcccuggagauggccaucgaggccggcgccgaggacgugaaggagaccgaggacgaggaggagagaaacguguucaaguucaucugcgacgccagcagccugcaccaggugagaaagaagcuggacagccugggccugugcagcgugagcugcgcccuggaguucauccccaacagcaaggugcagcuggccgagcccgaccuggagcaggccgcccaccugauccaggcccugagcaaccacgaggacgugauccacguguacgacaacaucgaguaa

SEQ ID NO: 24326 - RNA, 1224 nt, Artificial Sequence
  TACR1__Homo_sapiens__NP_001049
auggacaacgugcugcccguggacagcgaccugagccccaacaucagcaccaacaccagcgagcccaaccaguucgugcagcccgccuggcagaucgugcugugggccgccgccuacaccgugaucguggugaccagcguggugggcaacgugguggugauguggaucauccuggcccacaagagaaugagaaccgugaccaacuacuuccuggugaaccuggccuucgccgaggccagcauggccgccuucaacaccguggugaacuucaccuacgccgugcacaacgagugguacuacggccuguucuacugcaaguuccacaacuucuuccccaucgccgccguguucgccagcaucuacagcaugaccgccguggccuucgacagauacauggccaucauccacccccugcagcccagacugagcgccaccgccaccaagguggugaucugcgugaucugggugcuggcccugcugcuggccuucccccagggcuacuacagcaccaccgagaccaugcccagcagaguggugugcaugaucgaguggcccgagcaccccaacaagaucuacgagaagguguaccacaucugcgugaccgugcugaucuacuuccugccccugcuggugaucggcuacgccuacaccguggugggcaucacccugugggccagcgagauccccggcgacagcagcgacagauaccacgagcaggugagcgccaagagaaagguggugaagaugaugaucgugguggugugcaccuucgccaucugcuggcugcccuuccacaucuucuuccugcugcccuacaucaaccccgaccuguaccugaagaaguucauccagcagguguaccuggccaucauguggcuggccaugagcagcaccauguacaaccccaucaucuacugcugccugaacgacagauucagacugggcuucaagcacgccuucagaugcugccccuucaucagcgccggcgacuacgagggccuggagaugaagagcaccagauaccugcagacccagggcagcguguacaaggugagcagacuggagaccaccaucagcaccguggugggcgcccacgaggaggagcccgaggacggccccaaggccacccccagcagccuggaccugaccagcaacugcagcagcagaagcgacagcaagaccaugaccgagagcuucagcuucagcagcaacgugcugagcuaa

SEQ ID NO: 24327 - RNA, 1197 nt, Artificial Sequence
  TACR2__Homo_sapiens__NP_001048
augggcaccugcgacaucgugaccgaggccaacaucagcagcggccccgagagcaacaccaccggcaucaccgccuucagcaugcccagcuggcagcuggcccugugggccaccgccuaccuggcccuggugcugguggccgugaccggcaacgccaucgugaucuggaucauccuggcccacagaagaaugagaaccgugaccaacuacuucaucgugaaccuggcccuggccgaccugugcauggccgccuucaacgccgccuucaacuucguguacgccagccacaacaucugguacuucggcagagccuucugcuacuuccagaaccuguuccccaucaccgccauguucgugagcaucuacagcaugaccgccaucgccgccgacagauacauggccaucgugcaccccuuccagcccagacugagcgcccccagcaccaaggccgugaucgccggcaucuggcugguggcccuggcccuggccagcccccagugcuucuacagcaccgugaccauggaccagggcgccaccaagugcgugguggccuggcccgaggacagcggcggcaagacccugcugcuguaccaccugguggugaucgcccugaucuacuuccugccccuggccgugauguucguggccuacagcgugaucggccugacccuguggagaagagccgugcccggccaccaggcccacggcgccaaccugagacaccugcaggccaugaagaaguucgugaagaccauggugcugguggugcugaccuucgccaucugcuggcugcccuaccaccuguacuucauccugggcagcuuccaggaggacaucuacugccacaaguucauccagcagguguaccuggcccuguucuggcuggccaugagcagcaccauguacaaccccaucaucuacugcugccugaaccacagauucagaagcggcuucagacuggccuucagaugcugccccugggugacccccaccaaggaggacaagcuggagcugacccccaccaccagccugagcaccagagugaacagaugccacaccaaggagacccuguucauggccggcgacaccgcccccagcgaggccaccagcggcgaggccggcagaccccaggacggcagcggccugugguucggcuacggccugcuggcccccaccaagacccacguggagaucuaa

SEQ ID NO: 24328 - RNA, 1398 nt, Artificial Sequence
  TACR3__Homo_sapiens__NP_001050
auggccacccugcccgccgccgagaccuggaucgacggcggcggcggcgugggcgccgacgccgugaaccugaccgccagccuggccgccggcgccgccaccggcgccguggagaccggcuggcugcagcugcuggaccaggccggcaaccugagcagcagccccagcgcccugggccugcccguggccagccccgcccccagccagcccugggccaaccugaccaaccaguucgugcagcccagcuggagaaucgcccuguggagccuggccuacggcguggugguggccguggccgugcugggcaaccugaucgugaucuggaucauccuggcccacaagagaaugagaaccgugaccaacuacuuccuggugaaccuggccuucagcgacgccagcauggccgccuucaacacccuggugaacuucaucuacgcccugcacagcgagugguacuucggcgccaacuacugcagauuccagaacuucuuccccaucaccgccguguucgccagcaucuacagcaugaccgccaucgccguggacagauacauggccaucaucgacccccugaagcccagacugagcgccaccgccaccaagaucgugaucggcagcaucuggauccuggccuuccugcuggccuucccccagugccuguacagcaagaccaaggugaugcccggcagaacccugugcuucgugcaguggcccgagggccccaagcagcacuucaccuaccacaucaucgugaucauccugguguacugcuucccccugcugaucaugggcaucaccuacaccaucgugggcaucacccuguggggcggcgagauccccggcgacaccugcgacaaguaccacgagcagcugaaggccaagagaaagguggugaagaugaugaucaucguggugaugaccuucgccaucugcuggcugcccuaccacaucuacuucauccugaccgccaucuaccagcagcugaacagauggaaguacauccagcagguguaccuggccagcuucuggcuggccaugagcagcaccauguacaaccccaucaucuacugcugccugaacaagagauucagagccggcuucaagagagccuucagauggugccccuucaucaaggugagcagcuacgacgagcuggagcugaagaccaccagauuccaccccaacagacagagcagcauguacaccgugaccagaauggagagcaugaccgugguguucgaccccaacgacgccgacaccaccagaagcagcagaaagaagagagccacccccagagaccccagcuucaacggcugcagcagaagaaacagcaagagcgccagcgccaccagcagcuucaucagcagccccuacaccagcguggacgaguacagcuaa

SEQ ID NO: 24329 - RNA, 1008 nt, Artificial Sequence
  TADA1__Homo_sapiens__NP_444281
auggccaccuucgugagcgagcuggaggccgccaagaagaaccugagcgaggcccugggcgacaacgugaagcaguacugggccaaccugaagcugugguucaagcagaagaucagcaaggaggaguucgaccuggaggcccacagacugcugacccaggacaacgugcacagccacaacgacuuccugcuggccauccugaccagaugccagauccuggugagcacccccgacggcgccggcagccugcccuggcccggcggcagcgccgccaagcccggcaagcccaagggcaagaagaagcugagcagcgugagacagaaguucgaccacagauuccagccccagaacccccugagcggcgcccagcaguucguggccaaggacccccaggacgacgacgaccugaagcugugcagccacaccaugaugcugcccaccagaggccagcuggagggcagaaugaucgugaccgccuacgagcacggccuggacaacgugaccgaggaggccgugagcgccgugguguacgccguggagaaccaccugaaggacauccugaccagcguggugagcagaagaaaggccuacagacugagagacggccacuucaaguacgccuucggcagcaacgugaccccccagcccuaccugaagaacagcgugguggccuacaacaaccugaucgagagcccccccgccuucaccgcccccugcgccggccagaaccccgccagccaccccccccccgacgacgccgagcagcaggccgcccugcugcuggccugcagcggcgacacccugcccgccagccugccccccgugaacauguacgaccuguucgaggcccugcaggugcacagagaggugauccccacccacaccguguacgcccugaacaucgagagaaucaucaccaagcuguggcaccccaaccacgaggagcugcagcaggacaaggugcacagacagagacuggccgccaaggagggccugcugcugugcuaa

SEQ ID NO: 24330 - RNA, 1332 nt, Artificial Sequence
  TADA2A__Homo_sapiens__NP_001159577
auggacagacugggcagcuucagcaacgaccccagcgacaagccccccugcagaggcugcagcagcuaccugauggagcccuacaucaagugcgccgagugcggccccccccccuucuuccugugccugcagugcuucaccagaggcuucgaguacaagaagcaccagagcgaccacaccuacgagaucaugaccagcgacuuccccgugcuggaccccagcuggaccgcccaggaggagauggcccugcuggaggccgugauggacugcggcuucggcaacuggcaggacguggccaaccagaugugcaccaagaccaaggaggagugcgagaagcacuacaugaagcacuucaucaacaacccccuguucgccagcacccugcugaaccugaagcaggccgaggaggccaagaccgccgacaccgccauccccuuccacagcaccgacgacccccccagacccaccuucgacagccugcugagcagagacauggccggcuacaugcccgccagagccgacuucaucgaggaguucgacaacuacgccgagugggaccugagagacaucgacuucguggaggacgacagcgacauccugcacgcccugaagauggccgugguggacaucuaccacagcagacugaaggagagacagagaagaaagaagaucaucagagaccacggccugaucaaccugagaaaguuccagcugauggagagaagauaccccaaggaggugcaggaccuguacgagaccaugagaagauucgccagaaucgugggccccguggagcacgacaaguucaucgagagccacgcccuggaguucgagcugagaagagagaucaagagacugcaggaguacagaaccgccggcaucaccaacuucugcagcgccagaaccuacgaccaccugaagaagaccagagaggaggagagacugaagagaaccaugcugagcgaggugcugcaguacauccaggacagcagcgccugccagcaguggcugagaagacaggccgacaucgacagcggccugagccccagcauccccauggccagcaacagcggcagaagaagcgcccccccccugaaccugaccggccugcccggcaccgagaagcugaacgagaaggagaaggagcugugccagauggugagacuggugcccggcgccuaccuggaguacaagagcgcccugcugaacgagugcaacaagcagggcggccugagacuggcccaggccagagcccugaucaagaucgacgugaacaagaccagaaagaucuacgacuuccugaucagagagggcuacaucaccaagggcuaa

SEQ ID NO: 24331 - RNA, 1299 nt, Artificial Sequence
  TADA3__Homo_sapiens__NP_006345
augagcgagcugaaggacugcccccugcaguuccacgacuucaagagcguggaccaccugaaggugugccccagauacaccgccgugcuggccagaagcgaggacgacggcaucggcaucgaggagcuggacacccugcagcuggagcuggagacccugcugagcagcgccagcagaagacugagagugcuggaggccgagacccagauccugaccgacuggcaggacaagaagggcgacagaagauuccugaagcugggcagagaccacgagcugggcgccccccccaagcacggcaagcccaagaagcagaagcuggagggcaaggccggccacggccccggccccggccccggcagacccaagagcaagaaccugcagcccaagauccaggaguacgaguucaccgacgaccccaucgacgugcccagaauccccaagaacgacgcccccaacagauucugggccagcguggagcccuacugcgccgacaucaccagcgaggaggugagaacccuggaggagcugcugaagccccccgaggacgaggccgagcacuacaagauccccccccugggcaagcacuacagccagagaugggcccaggaggaccugcuggaggagcagaaggacggcgccagagccgccgccguggccgacaagaagaagggccugaugggcccccugaccgagcuggacaccaaggacguggacgcccugcugaagaagagcgaggcccagcacgagcagcccgaggacggcugccccuucggcgcccugacccagagacugcugcaggcccugguggaggagaacaucaucagccccauggaggacagccccauccccgacaugagcggcaaggagagcggcgccgacggcgccagcaccagccccagaaaccagaacaagcccuucagcgugccccacaccaagagccuggagagcagaaucaaggaggagcugaucgcccagggccugcuggagagcgaggacagacccgccgaggacagcgaggacgaggugcuggccgagcugagaaagagacaggccgagcugaaggcccugagcgcccacaacagaaccaagaagcacgaccugcugagacuggccaaggaggaggugagcagacaggagcugagacagagagugagaauggccgacaacgaggugauggacgccuucagaaagaucauggccgccagacagaagaagagaacccccaccaagaaggagaaggaccaggccuggaagacccugaaggagagagagagcauccugaagcugcuggacggcuaa

SEQ ID NO: 24332 - RNA, 1779 nt, Artificial Sequence
  TAF15__Homo_sapiens__NP_631961
augagcgacagcggcagcuacggccagagcggcggcgagcagcagagcuacagcaccuacggcaaccccggcagccagggcuacggccaggccagccagagcuacagcggcuacggccagaccaccgacagcagcuacggccagaacuacagcggcuacagcagcuacggccagagccagagcggcuacagccagagcuacggcggcuacgagaaccagaagcagagcagcuacagccagcagcccuacaacaaccagggccagcagcagaacauggagagcagcggcagccagggcggcagagcccccagcuacgaccagcccgacuacggccagcaggacagcuacgaccagcagagcggcuacgaccagcaccagggcagcuacgacgagcagagcaacuacgaccagcagcacgacagcuacagccagaaccagcagagcuaccacagccagagagagaacuacagccaccacacccaggacgacagaagagacgugagcagauacggcgaggacaacagaggcuacggcggcagccagggcggcggcagaggcagaggcggcuacgacaaggacggcagaggccccaugaccggcagcagcggcggcgacagaggcggcuucaagaacuucggcggccacagagacuacggccccagaaccgacgccgacagcgagagcgacaacagcgacaacaacaccaucuucgugcagggccugggcgagggcgugagcaccgaccaggugggcgaguucuucaagcagaucggcaucaucaagaccaacaagaagaccggcaagcccaugaucaaccuguacaccgacaaggacaccggcaagcccaagggcgaggccaccgugagcuucgacgacccccccagcgccaaggccgccaucgacugguucgacggcaaggaguuccacggcaacaucaucaaggugagcuucgccaccagaagacccgaguucaugagaggcggcggcagcggcggcggcagaagaggcagaggcggcuacagaggcagaggcggcuuccagggcagaggcggcgaccccaagagcggcgacugggugugccccaaccccagcugcggcaacaugaacuucgccagaagaaacagcugcaaccagugcaacgagcccagacccgaggacagcagacccagcggcggcgacuucagaggcagaggcuacggcggcgagagaggcuacagaggcagaggcggcagaggcggcgacagaggcggcuacggcggcgacagaagcggcggcggcuacggcggcgacagaagcagcggcggcggcuacagcggcgacagaagcggcggcggcuacggcggcgacagaagcggcggcggcuacggcggcgacagaggcggcggcuacggcggcgacagaggcggcggcuacggcggcgacagaggcggcggcuacggcggcgacagaggcggcuacggcggcgacagaggcggcggcuacggcggcgacagaggcggcuacggcggcgacagaggcggcuacggcggcgacagaggcggcuacggcggcgacagaggcggcuacggcggcgacagaagcagaggcggcuacggcggcgacagaggcggcggcagcggcuacggcggcgacagaagcggcggcuacggcggcgacagaagcggcggcggcuacggcggcgacagaggcggcggcuacggcggcgacagaggcggcuacggcggcaagaugggcggcagaaacgacuacagaaacgaccagagaaacagacccuacuaa

SEQ ID NO: 24333 - RNA, 1767 nt, Artificial Sequence
  TAF1B__Homo_sapiens__NP_005671
auggaccuggaggaggccgaggaguucaaggagagaugcacccagugcgccgccgugagcuggggccugaccgacgagggcaaguacuacugcaccagcugccacaacgugaccgagagauaccaggaggugaccaacaccgaccugauccccaacacccagaucaaggcccugaacagaggccugaagaagaagaacaacaccgagaagggcugggacugguacgugugcgagggcuuccaguacauccuguaccagcaggccgaggcccugaagaaccugggcgugggccccgagcugaagaacgacgugcugcacaacuucuggaagagauaccugcagaagagcaagcaggccuacugcaagaaccccguguacaccaccggcagaaagcccaccgugcuggaggacaaccugagccacagcgacugggccagcgagcccgagcugcugagcgacgugagcugcccccccuuccuggagagcggcgccgagagccagagcgacauccacaccagaaagcccuuccccgugagcaaggccagccagagcgagaccagcgugugcagcggcagccuggacggcguggaguacagccagagaaaggagaagggcaucgugaagaugaccaugccccagacccuggccuucugcuaccugagccugcuguggcagagagaggccaucacccugagcgaccugcugagauucguggaggaggaccacauccccuacaucaacgccuuccagcacuuccccgagcagaugaagcuguacggcagagacagaggcaucuucggcaucgagagcuggcccgacuacgaggacaucuacaagaagaccaucgaggugggcaccuuccuggaccugcccagauuccccgacaucaccgaggacugcuaccugcaccccaacauccugugcaugaaguaccugauggaggugaaccugcccgacgagaugcacagccugaccugccacguggugaagaugaccggcaugggcgagguggacuuccugaccuucgaccccaucgccaagauggccaagaccgugaaguacgacgugcaggccguggccaucaucgugguggugcugaagcugcuguuccugcuggacgacagcuucgaguggagccugagcaaccuggccgagaagcacaacgagaagaacaagaaggacaagcccugguucgacuucagaaagugguaccagaucaugaagaaggccuucgacgagaagaagcagaagugggaggaggccagagccaaguaccuguggaagagcgagaagccccuguacuacagcuucguggacaagcccguggccuacaagaagagagagaugguggugaaccugcagaagcaguucagcacccugguggagagcaccgccaccgccggcaagaagagccccagcagcuuccaguucaacuggaccgaggaggacaccgacagaaccugcuuccacggccacagccugcagggcgugcugaaggagaagggccagagccugcugaccaagaacagccuguacuggcugagcacccagaaguucugcagaugcuacugcacccacgugaccaccuacgaggagagcaacuacagccugagcuaccaguucauccugaaccuguucagcuuccugcugagaaucaagaccagccugcugcacgaggaggugagccugguggagaagaagcuguucgagaagaaguacagcgugaagagaaagaagagcagaagcaagaaggugagaagacacuaa

SEQ ID NO: 24334 - RNA, 1179 nt, Artificial Sequence
  TAF1C__Homo_sapiens__NP_001230089
augcugaaguggaaccacggccugcccagcccccugcugcuggccagacugcugcccccccccagacccagcugcgugcagccccugcugcugggcggccagggcggccagcugcagcugcugcaccuggccgagggcgccagcgugcccagacuggccggccccccccagagccugcccagcagaaucgacagccugcccgccuucccccugcuggagcccaagauccaguggagacugcaggagagacugaaggcccccaccaucggccuggccgccguggugcccccccugcccagcgcccccacccccggccuggugcuguuccagcugagcgccgccggcgacguguucuaccagcagcugagaccccagguggacagcagccugagaagagacgccggcccccccggcgacacccagcccgacugccacgcccccaccgccagcuggaccagccaggacaccgccggcugcagccaguggcugaaggcccugcugaaggugccccuggccccccccguguggaccgcccccaccuucacccacagacagaugcugggcagcaccgagcugagaagagaggaggaggagggccagagacugggcgugcugagaaaggccauggccagaggccagcugcugcugcagagagaccugggcagccugcccgccgccgagcccccccccgcccccgagagcggccuggaggacaagcugagcgagagacugggcgaggccugggccggcagaggcgccgccuggugggagagacagcagggcagaaccagcgagcccggcagacagaccagaagacccaagagaagaacccagcugagcagcagcuucagccugagcggccacguggaccccagcgaggacaccagcagcccccacagccccgaguggccccccgccgacgcccugccccugccccccaccaccccccccagccaggagcugacccccgacgccugcgcccagggcgugcccagcgagcagagacagaugcugagagacuacauggccaagcugcccccccagagagacacccccggcugcgccaccacccccccccacagccaggccagcagcgugagagccaccagaagccagcagcacacccccgugcugagcagcagccagccccugagaaagaagcccagaaugggcuucuaa

SEQ ID NO: 24335 - RNA, 837 nt, Artificial Sequence
  TAF1D__Homo_sapiens__NP_077021
auggacaagagcggcaucgacagccuggaccacgugaccagcgacgccguggagcuggccaacagaagcgacaacagcagcgacagcagccuguucaagacccagugcauccccuacagccccaagggcgagaagagaaaccccaucagaaaguucgugagaacccccgagagcgugcacgccagcgacagcagcagcgacagcagcuucgagcccaucccccugaccaucaaggccaucuucgagagauucaagaacagaaagaagagauacaagaagaagaagaagagaagauaccagcccaccggcagacccagaggcagacccgagggcagaagaaaccccaucuacagccugaucgacaagaagaagcaguucagaagcagaggcagcggcuuccccuuccuggagagcgagaacgagaagaacgcccccuggagaaagauccugaccuucgagcaggccguggccagaggcuucuucaacuacaucgagaagcugaaguacgagcaccaccugaaggagagccugaagcagaugaacgugggcgaggaccuggagaacgaggacuucgacagcagaagauacaaguuccuggacgacgacggcagcaucagccccaucgaggagagcaccgccgaggacgaggacgccacccaccuggaggacaacgagugcgacaucaagcuggccggcgacagcuucaucgugagcagcgaguuccccgugagacugagcguguaccuggaggaggaggacaucaccgaggaggccgcccugagcaagaagagagccaccaaggccaagaacaccggccagagaggccugaagauguaa

SEQ ID NO: 24336 - RNA, 5688 nt, Artificial Sequence
  TAF1__Homo_sapiens__NP_001273003
augggccccggcugcgaccugcugcugagaaccgccgccaccaucaccgccgccgccaucaugagcgacaccgacagcgacgaggacagcgccggcggcggccccuucagccuggccggcuuccuguucggcaacaucaacggcgccggccagcuggagggcgagagcgugcuggacgacgagugcaagaagcaccuggccggccugggcgcccugggccugggcagccugaucaccgagcugaccgccaacgaggagcugaccggcaccgacggcgcccuggugaacgacgagggcugggugagaagcaccgaggacgccguggacuacagcgacaucaacgagguggccgaggacgagagcagaagauaccagcagaccaugggcagccugcagccccugugccacagcgacuacgacgaggacgacuacgacgccgacugcgaggacaucgacugcaagcugaugcccccccccccccccccccccggccccaugaagaaggacaaggaccaggacagcaucaccggcgugagcgagaacggcgagggcaucauccugcccagcaucaucgcccccagcagccuggccagcgagaagguggacuucagcagcagcagcgacagcgagagcgagaugggcccccaggaggccacccaggccgagagcgaggacggcaagcugacccugccccuggccggcaucaugcagcacgacgccaccaagcugcugcccagcgugaccgagcuguuccccgaguucagacccggcaaggugcugagauuccugagacuguucggccccggcaagaacgugcccagcguguggagaagcgccagaagaaagagaaagaagaagcacagagagcugauccaggaggagcagauccaggagguggagugcagcguggagagcgaggugagccagaagagccuguggaacuacgacuacgcccccccccccccccccgagcagugccugagcgacgacgagaucaccaugauggcccccguggagagcaaguucagccagagcaccggcgacaucgacaaggugaccgacaccaagcccagaguggccgaguggagauacggccccgccagacugugguacgacaugcugggcgugcccgaggacggcagcggcuucgacuacggcuucaagcugagaaagaccgagcacgagcccgugaucaagagcagaaugaucgaggaguucagaaagcuggaggagaacaacggcaccgaccugcuggccgacgagaacuuccugauggugacccagcugcacugggaggacgacaucaucugggacggcgaggacgugaagcacaagggcaccaagccccagagagccagccuggccggcuggcugcccagcagcaugaccagaaacgccauggccuacaacgugcagcagggcuucgccgccacccuggacgacgacaagcccugguacagcaucuuccccaucgacaacgaggaccugguguacggcagaugggaggacaacaucaucugggacgcccaggccaugcccagacugcuggagccccccgugcugacccuggaccccaacgacgagaaccugauccuggagauccccgacgagaaggaggaggccaccagcaacagccccagcaaggagagcaagaaggagagcagccugaagaagagcagaauccugcugggcaagaccggcgugaucaaggaggagccccagcagaacaugagccagcccgaggugaaggaccccuggaaccugagcaacgacgaguacuacuaccccaagcagcagggccugagaggcaccuucggcggcaacaucauccagcacagcauccccgccguggagcugagacagcccuucuuccccacccacaugggccccaucaagcugagacaguuccacagacccccccugaagaaguacagcuucggcgcccugagccagcccggcccccacagcgugcagccccugcugaagcacaucaagaagaaggccaagaugagagagcaggagagacaggccagcggcggcggcgagauguucuucaugagaaccccccaggaccugaccggcaaggacggcgaccugauccuggccgaguacagcgaggagaacggcccccugaugaugcaggugggcauggccaccaagaucaagaacuacuacaagagaaagcccggcaaggaccccggcgcccccgacugcaaguacggcgagaccguguacugccacaccagccccuuccugggcagccugcaccccggccagcugcugcaggccuucgagaacaaccuguucagagcccccaucuaccugcacaagaugcccgagaccgacuuccugaucaucagaaccagacagggcuacuacaucagagagcugguggacaucuucguggugggccagcagugcccccuguucgaggugcccggccccaacagcaagagagccaacacccacaucagagacuuccugcagguguucaucuacagacuguucuggaagagcaaggacagacccagaagaaucagaauggaggacaucaagaaggccuuccccagccacagcgagagcagcaucagaaagagacugaagcugugcgccgacuucaagagaaccggcauggacagcaacuggugggugcugaagagcgacuucagacugcccaccgaggaggagaucagagccauggugagccccgagcagugcugcgccuacuacagcaugaucgccgccgagcagagacugaaggacgccggcuacggcgagaagagcuucuucgcccccgaggaggagaacgaggaggacuuccagaugaagaucgacgacgaggugagaaccgcccccuggaacaccaccagagccuucaucgccgccaugaagggcaagugccugcuggaggugaccggcguggccgaccccaccggcugcggcgagggcuucagcuacgugaagauccccaacaagcccacccagcagaaggacgacaaggagccccagcccgugaagaagaccgugaccggcaccgacgccgaccugagaagacugagccugaagaacgccaagcagcugcugagaaaguucggcgugcccgaggaggagaucaagaagcugagcagaugggaggugaucgacguggugagaaccaugagcaccgagcaggccagaagcggcgagggccccaugagcaaguucgccagaggcagcagauucagcguggccgagcaccaggagagauacaaggaggagugccagagaaucuucgaccugcagaacaaggugcugagcagcaccgaggugcugagcaccgacaccgacagcagcagcgccgaggacagcgacuucgaggagaugggcaagaacaucgagaacaugcugcagaacaagaagaccagcagccagcugagcagagagagagaggagcaggagagaaaggagcugcagagaaugcugcuggccgccggcagcgccgccagcggcaacaaccacagagacgacgacaccgccagcgugaccagccugaacagcagcgccaccggcagaugccugaagaucuacagaaccuucagagacgaggagggcaaggaguacgugagaugcgagaccgugagaaagcccgccgugaucgacgccuacgugagaaucagaaccaccaaggacgaggaguucaucagaaaguucgcccuguucgacgagcagcacagagaggagaugagaaaggagagaagaagaauccaggagcagcugagaagacugaagagaaaccaggagaaggagaagcugaagggcccccccgagaagaagcccaagaagaugaaggagagacccgaccugaagcugaagugcggcgccugcggcgccaucggccacaugagaaccaacaaguucugcccccuguacuaccagaccaacgccccccccagcaaccccguggccaugaccgaggagcaggaggaggagcuggagaagaccgugauccacaacgacaacgaggagcugaucaagguggagggcaccaagaucgugcugggcaagcagcugaucgagagcgccgacgaggugagaagaaagagccuggugcugaaguuccccaagcagcagcugccccccaagaagaagagaagagugggcaccaccgugcacugcgacuaccugaacagaccccacaagagcauccacagaagaagaaccgaccccauggugacccugagcagcauccuggagagcaucaucaacgacaugagagaccugcccaacaccuaccccuuccacacccccgugaacgccaagguggugaaggacuacuacaagaucaucaccagacccauggaccugcagacccugagagagaacgugagaaagagacuguaccccagcagagaggaguucagagagcaccuggagcugaucgugaagaacagcgccaccuacaacggccccaagcacagccugacccagaucagccagagcaugcuggaccugugcgacgagaagcugaaggagaaggaggacaagcuggccagacuggagaaggccaucaacccccugcuggacgacgacgaccagguggccuucagcuucauccuggacaacaucgugacccagaagaugauggccgugcccgacagcuggcccuuccaccaccccgugaacaagaaguucgugcccgacuacuacaaggugaucgugaaccccauggaccuggagaccaucagaaagaacaucagcaagcacaaguaccagagcagagagagcuuccuggacgacgugaaccugauccuggccaacagcgugaaguacaacggccccgagagccaguacaccaagaccgcccaggagaucgugaacgugugcuaccagacccugaccgaguacgacgagcaccugacccagcuggagaaggacaucugcaccgccaaggaggccgcccuggaggaggccgagcuggagagccuggaccccaugacccccggccccuacaccccccaggccaagccccccgaccuguacgacaccaacaccagccugagcaugagcagagacgccagcguguuccaggacgagagcaacaugagcgugcuggacauccccagcgccacccccgagaagcaggugacccaggagggcgaggacggcgacggcgaccuggccgacgaggaggagggcaccgugcagcagccccaggccagcgugcuguacgaggaccugcugaugagcgagggcgaggacgacgaggaggacgccggcagcgacgaggagggcgacaaccccuucagcgccauccagcugagcgagagcggcagcgacagcgacgugggcagcggcggcaucagacccaagcagcccagaaugcugcaggagaacaccagaauggacauggagaacgaggagagcaugaugagcuacgagggcgacggcggcgaggccagccacggccuggaggacagcaacaucagcuacggcagcuacgaggagcccgaccccaagagcaacacccaggacaccagcuucagcagcaucggcggcuacgaggugagcgaggaggaggaggacgaggaggaggaggagcagagaagcggccccagcgugcugagccaggugcaccugagcgaggacgaggaggacagcgaggacuuccacagcaucgccggcgacagcgaccuggacagcgacgaguaa

SEQ ID NO: 24337 - RNA, 3600 nt, Artificial Sequence
  TAF2__Homo_sapiens__NP_003175
augccccugaccggcguggagcccgccagaaugaacagaaagaagggcgacaagggcuucgagagccccagacccuacaagcugacccaccagguggugugcaucaacaacaucaacuuccagagaaagagcguggugggcuucguggagcugaccaucuuccccaccguggccaaccugaacagaaucaagcugaacagcaagcagugcagaaucuacagagugagaaucaacgaccuggaggccgccuucaucuacaacgaccccacccuggaggugugccacagcgagagcaagcagagaaaccugaacuacuucagcaacgccuacgccgccgccgugagcgccguggaccccgacgccggcaacggcgagcugugcaucaaggugcccagcgagcuguggaagcacguggacgagcugaaggugcugaagauccacaucaacuucagccuggaccagcccaagggcggccugcacuucguggugcccagcguggagggcagcauggccgagagaggcgcccacguguucagcugcggcuaccagaacagcaccagauucugguuccccugcguggacagcuacagcgagcugugcaccuggaagcuggaguucaccguggacgccgccaugguggccgugagcaacggcgaccugguggagaccguguacacccacgacaugagaaagaagaccuuccacuacaugcugaccauccccaccgccgccagcaacaucagccuggccaucggccccuucgagauccugguggaccccuacaugcacgaggugacccacuucugccugccccagcugcugccccugcugaagcacaccaccagcuaccugcacgagguguucgaguucuacgaggagauccugaccugcagauaccccuacagcugcuucaagaccguguucaucgacgaggccuacguggagguggccgccuacgccagcaugagcaucuucagcaccaaccugcugcacagcgccaugaucaucgacgagaccccccugaccagaagaugccuggcccagagccuggcccagcaguucuucggcugcuucaucagcagaaugagcuggagcgacgagugggugcugaagggcaucagcggcuacaucuacggccuguggaugaagaagaccuucggcgugaacgaguacagacacuggaucaaggaggagcuggacaagaucguggccuacgagcugaagaccggcggcgugcugcugcaccccaucuucggcggcggcaaggagaaggacaaccccgccagccaccugcacuucagcaucaagcacccccacacccugagcugggaguacuacaccauguuccagugcaaggcccaccuggugaugagacugaucgagaacagaaucagcauggaguucaugcugcagguguucaacaagcugcugagccuggccagcaccgccagcagccagaaguuccagagccacauguggagccagaugcuggugagcaccagcggcuuccugaagagcaucagcaacgugagcggcaaggacauccagccccugaucaagcaguggguggaccagagcggcguggugaaguucuacggcagcuucgccuucaacagaaagagaaacgugcuggagcuggagaucaagcaggacuacaccagccccggcacccagaaguacgugggcccccugaaggugaccgugcaggagcuggacggcagcuucaaccacacccugcagaucgaggagaacagccugaagcacgacauccccugccacagcaagagcagaagaaacaagaagaagaagaucccccugaugaacggcgaggagguggacauggaccugagcgccauggacgccgacagcccccugcuguggaucagaaucgaccccgacaugagcgugcugagaaagguggaguucgagcaggccgacuucauguggcaguaccagcugagauacgagagagacgugguggcccagcaggagagcauccuggcccuggagaaguuccccacccccgccagcagacuggcccugaccgacauccuggagcaggagcagugcuucuacagagugagaaugagcgccugcuucugccuggccaagaucgccaacagcauggugagcaccuggaccggcccccccgccaugaagagccuguucaccagaauguucugcugcaagagcugccccaacaucgugaagaccaacaacuucaugagcuuccagagcuacuuccugcagaagaccaugcccguggccauggcccugcugagagacgugcacaaccugugccccaaggaggugcugaccuucauccuggaccugaucaaguacaacgacaacagaaagaacaaguucagcgacaacuacuacagagccgagaugaucgacgcccuggccaacagcgugacccccgccgugagcgugaacaacgaggugagaacccuggacaaccugaaccccgacgugagacugauccuggaggagaucaccagauuccugaacauggagaagcugcugcccagcuacagacacaccaucaccgugagcugccugagagccaucagagugcugcagaagaacggccacgugcccagcgaccccgcccuguucaagagcuacgccgaguacggccacuucguggacaucagaaucgccgcccuggaggccgugguggacuacaccaagguggacagaagcuacgaggagcugcaguggcugcugaacaugauccagaacgaccccgugcccuacgugagacacaagauccugaacaugcugaccaagaacccccccuucaccaagaacauggagagcccccugugcaacgaggcccugguggaccagcuguggaagcugaugaacagcggcaccagccacgacuggagacugagaugcggcgccguggaccuguacuucacccuguucggccugagcagacccagcugccugccccugcccgagcugggccuggugcugaaccugaaggagaagaaggccgugcugaaccccaccaucauccccgagagcguggccggcaaccaggaggccgccaacaaccccagcagccacccccagcuggugggcuuccagaaccccuucagcagcagccaggacgaggaggagaucgacauggacaccgugcacgacagccaggccuucaucagccaccaccugaacaugcuggagagacccagcacccccggccugagcaaguacagacccgccagcagcagaagcgcccugaucccccagcacagcgccggcugcgacagcacccccaccaccaagccccaguggagccuggagcuggccagaaagggcaccggcaaggagcaggccccccuggagaugagcaugcaccccgccgccagcgccccccugagcguguucaccaaggagagcaccgccagcaagcacagcgaccaccaccaccaccaccaccacgagcacaagaagaagaagaagaagcacaagcacaagcacaagcacaagcacaagcacgacagcaaggagaaggacaaggagcccuucaccuucagcagccccgccagcggcagaagcaucagaagccccagccugagcgacuaa

SEQ ID NO: 24338 - RNA, 2790 nt, Artificial Sequence
  TAF3__Homo_sapiens__NP_114129
augugcgagagcuacagcagaagccugcugagagugagcguggcccagaucugccaggcccugggcugggacagcgugcagcugagcgccugccaccugcugaccgacgugcugcagagauaccugcagcagcugggcagaggcugccacagauacagcgagcuguacggcagaaccgaccccauccuggacgacgugggcgaggccuuccagcugaugggcgugagccugcacgagcuggaggacuacauccacaacaucgagcccgugaccuucccccaccagauccccagcuuccccgugagcaagaacaacgugcugcaguucccccagcccggcagcaaggacgccgaggagagaaaggaguacauccccgacuaccugccccccaucgugagcagccaggaggaggaggaggaggagcaggugcccaccgacggcggcaccagcgccgaggccaugcaggugccccuggaggaggacgacgagcuggaggaggaggagaucaucaacgacgagaacuuccugggcaagagaccccuggacagccccgaggccgaggagcugcccgccaugaagagacccagacugcugagcaccaagggcgacacccuggacguggugcugcuggaggccagagagccccugagcagcaucaacacccagaagaucccccccaugcugagccccgugcacgugcaggacagcaccgaccuggccccccccagccccgagccccccaugcuggcccccguggccaagagccagaugcccaccgccaagccccuggagaccaagagcuucacccccaagaccaagaccaagaccagcagccccggccagaagaccaagagccccaagaccgcccagagccccgccauggugggcagccccaucagaagccccaagaccgugagcaaggagaagaagagccccggcagaagcaagagccccaagagccccaagagccccaaggugaccacccacaucccccagacccccgugagacccgagacccccaacagaacccccagcgccacccugagcgagaagaucagcaaggagaccauccaggugaagcagauccagaccccccccgacgccggcaagcugaacagcgagaaccagcccaagaaggccgugguggccgacaagaccaucgaggccagcaucgacgccgugaucgccagagccugcgccgagagagagcccgaccccuucgaguucagcagcggcagcgagagcgagggcgacaucuucaccagccccaagagaaucagcggccccgagugcaccacccccaaggccagcaccagcgccaacaacuucaccaagagcggcagcaccccccugccccugagcggcggcaccagcagcagcgacaacagcuggaccauggacgccagcaucgacgagguggugagaaaggccaagcugggcacccccagcaacaugccccccaacuuccccuacaucagcagccccagcgugagcccccccacccccgagccccugcacaagguguacgaggagaagaccaagcugcccagcagcguggaggugaagaagaagcugaagaaggagcugaagaccaagaugaagaagaaggagaagcagagagacagagagagagagaaggacaagaacaaggacaagagcaaggagaaggacaaggugaaggagaaggagaaggacaaggagaccggcagagagaccaaguaccccuggaaggaguuccugaaggaggaggaggccgaccccuacaaguucaagaucaaggaguucgaggacguggaccccaaggugaagcugaaggacggccuggugagaaaggagaaggagaagcacaaggacaagaagaaggacagagagaagggcaagaaggacaaggacaagagagagaaggagaaggugaaggacaagggcagagaggacaagaugaaggcccccgcccccccccuggugcugccccccaaggagcuggcccugccccuguucagccccgccaccgccagcagagugcccgccaugcugcccagccugcugcccgugcugcccgagaagcuguucgaggagaaggagaaggugaaggagaaggagaagaagaaggacaagaaggagaagaagaagaagaaggagaaggagaaggagaagaaggagaaggagagagagaaggagaagagagagagagagaagagagagaaggagaaggagaagcacaagcacgagaagaucaagguggagcccguggcccuggcccccagccccgugauccccagacugacccugagagugggcgccggccaggacaagaucgugaucagcaagguggugcccgcccccgaggccaagcccgcccccagccagaacagacccaagacccccccccccgcccccgcccccgcccccggccccaugcuggugagccccgcccccgugccccugccccugcuggcccaggccgccgccggccccgcccugcugcccagccccggccccgccgccagcggcgccagcgccaaggcccccgugagaagcguggugaccgagaccgugagcaccuacgugaucagagacgaguggggcaaccagaucuggaucugccccggcugcaacaagcccgacgacggcagccccaugaucggcugcgacgacugcgacgacugguaccacuggcccugcgugggcaucaugaccgccccccccgaggagaugcagugguucugccccaagugcgccaacaagaagaaggacaagaagcacaagaagagaaagcacagagcccacuaa

SEQ ID NO: 24339 - RNA, 2604 nt, Artificial Sequence
  TAF4B__Homo_sapiens__NP_001280654
augcccgccggccugaccgagcccgccggcgccgccccccccgccgccgugagcgccagcggcaccgugaccauggcccccgccggcgcccugcccgugagaguggagagcacccccguggcccugggcgccgugaccaaggcccccgugagcgugugcguggagcccaccgccagccagccccugagaagccccgugggcacccuggugaccaagguggcccccgugagcgccccccccaaggugagcagcggccccagacugcccgccccccagaucguggccgugaaggcccccaacaccaccaccauccaguuccccgccaaccugcagcugccccccggcaccgugcugaucaagagcaacagcggcccccugaugcuggugagcccccagcagaccgugaccagagccgagaccaccagcaacaucaccagcagacccgccgugcccgccaacccccagaccgugaagaucugcaccgugcccaacagcagcagccagcugaucaagaagguggccgugacccccgugaagaagcuggcccagaucggcaccaccguggugaccaccgugcccaagcccagcagcgugcagagcguggccgugcccaccagcguggugaccgugacccccggcaagccccugaacaccgugaccacccugaagcccagcagccugggcgccagcagcacccccagcaacgagcccaaccugaaggccgagaacagcgccgccgugcagaucaaccugagccccaccaugcuggagaacgugaagaagugcaagaacuuccuggccaugcugaucaagcuggccugcagcggcagccagagccccgagaugggccagaacgugaagaagcugguggagcagcugcuggacgccaagaucgaggccgaggaguucaccagaaagcuguacguggagcugaagagcagcccccagccccaccuggugcccuuccugaagaagagcgugguggcccugagacagcugcugcccaacagccagagcuucauccagcagugcgugcagcagaccagcagcgacauggugaucgccaccugcaccaccaccgugaccaccagccccguggugaccaccaccgugagcagcagccagagcgagaagagcaucaucgugagcggcgccaccgcccccagaaccgugagcgugcagacccugaacccccuggccggccccgugggcgccaaggccggcguggugacccugcacagcgugggccccaccgccgccaccggcggcaccaccgccggcaccggccugcugcagaccagcaagccccuggugaccagcguggccaacaccgugaccaccgugagccugcagcccgagaagcccguggugagcggcaccgccgugacccugagccugcccgccgugaccuucggcgagaccagcggcgccgccaucugccugcccagcgugaagcccguggugagcagcgccggcaccaccagcgacaagcccgugaucggcacccccgugcagaucaagcuggcccagcccggccccgugcugagccagcccgccggcaucccccaggccgugcaggugaagcagcuguucagccuguuccagguggugcagcagcccagcggcggcaacgagaagcaggugaccaccaucagccacagcagcacccugaccauccagaagugcggccagaagaccaugcccgugaacaccaucauccccaccagccaguucccccccgccagcauccugaagcagaucacccugcccggcaacaagauccugagccugcaggccagccccacccagaagaacagaaucaaggagaacgugaccagcugcuucagagacgaggacgacaucaacgacgugaccagcauggccggcgugaaccugaacgaggagaacgccugcauccuggccaccaacagcgagcuggugggcacccugauccagagcugcaaggacgagcccuuccuguucaucggcgcccugcagaagagaauccuggacaucggcaagaagcacgacaucaccgagcugaacagcgacgccgugaaccugaucagccaggccacccaggagagacugagaggccugcuggagaagcugaccgccaucgcccagcacagaaugaccaccuacaaggccagcgagaacuacauccugugcagcgacaccagaagccagcugaaguuccuggagaagcuggaccagcuggagaagcagagaaaggaccuggaggagagagagaugcugcugaaggccgccaagagcagaagcaacaaggaggaccccgagcagcugagacugaagcagaaggccaaggagcugcagcagcuggagcuggcccagauccagcacagagacgccaaccugaccgcccuggccgccaucggccccagaaagaagagaccccuggagagcggcaucgagggccugaaggacaaccugcuggccagcggcaccagcagccugaccgccaccaagcagcugcacagacccagaaucaccagaaucugccugagagaccugaucuucugcauggagcaggagagagagaugaaguacagcagagcccuguaccuggcccugcugaaguaa

SEQ ID NO: 24340 - RNA, 3258 nt, Artificial Sequence
  TAF4__Homo_sapiens__NP_003176
auggccgccggcagcgaccugcuggacgagguguucuucaacagcgagguggacgagaagguggugagcgaccuggugggcagccuggagagccagcuggccgccagcgccgcccaccaccaccaccuggcccccagaacccccgaggugagagccgccgccgccggcgcccugggcaaccacguggugagcggcagccccgccggcgccgccggcgccggccccgccgcccccgccgagggcgcccccggcgccgcccccgagcccccccccgccggcagagccagacccggcggcggcggcccccagagacccggcccccccagccccagaagaccccuggugcccgccggccccgccccccccgccgccaagcugagacccccccccgagggcagcgccggcagcugcgcccccgugcccgccgccgccgccguggccgccggccccgagcccgcccccgccggccccgccaagcccgccggccccgccgcccuggccgccagagccggccccggccccggccccggccccggccccggccccggccccggccccggcaagcccgccggccccggcgccgcccagacccugaacggcagcgccgcccugcugaacagccaccacgccgccgcccccgccgugagccuggugaacaacggccccgccgcccugcugccccugcccaagcccgccgcccccggcaccgugauccagaccccccccuucgugggcgccgccgccccccccgcccccgccgcccccagcccccccgccgcccccgcccccgccgcccccgccgccgccccccccccccccccccccgcccccgccacccuggccagaccccccggccaccccgccggcccccccaccgccgcccccgccgugcccccccccgccgccgcccagaacggcggcagcgccggcgccgcccccgcccccgcccccgccgccggcggccccgccggcgugagcggccagcccggccccggcgccgccgccgccgcccccgcccccggcgugaaggccgagagccccaagagaguggugcaggccgccccccccgccgcccagacccuggccgccagcggccccgccagcaccgccgccagcauggugaucggccccaccaugcagggcgcccugcccagccccgccgccgugcccccccccgcccccggcacccccaccggccugcccaagggcgccgccggcgccgugacccagagccugagcagaacccccaccgccaccaccagcggcaucagagccacccugacccccaccgugcuggcccccagacugccccagcccccccagaaccccaccaacauccagaacuuccagcugccccccggcauggugcuggugagaagcgagaacggccagcugcugaugaucccccagcaggcccuggcccagaugcaggcccaggcccacgcccagccccagaccaccauggcccccagacccgccacccccaccagcgccccccccgugcagaucagcaccgugcaggcccccggcacccccaucaucgccagacaggugacccccaccaccaucaucaagcaggugagccaggcccagaccaccgugcagcccagcgccacccugcagagaagccccggcgugcagccccagcuggugcugggcggcgccgcccagaccgccagccugggcaccgccaccgccgugcagaccggcaccccccagagaaccgugcccggcgccaccaccaccagcagcgccgccaccgagaccauggagaacgugaagaagugcaagaacuuccugagcacccugaucaagcuggccagcagcggcaagcagagcaccgagaccgccgccaacgugaaggagcuggugcagaaccugcuggacggcaagaucgaggccgaggacuucaccagcagacuguacagagagcugaacagcagcccccagcccuaccuggugcccuuccugaagagaagccugcccgcccugagacagcugacccccgacagcgccgccuucauccagcagagccagcagcagccccccccccccaccagccaggccaccaccgcccugaccgccguggugcugagcagcagcgugcagagaaccgccggcaagaccgccgccaccgugaccagcgcccugcagccccccgugcugagccugacccagcccacccaggugggcgugggcaagcagggccagcccaccccccuggugauccagcagccccccaagcccggcgcccugaucagacccccccaggugacccugacccagacccccaugguggcccugagacagccccacaacagaaucaugcugaccaccccccagcagauccagcugaacccccugcagcccgugcccguggugaagcccgccgugcugcccggcaccaaggcccugagcgccgugagcgcccaggccgccgccgcccagaagaacaagcugaaggagcccggcggcggcagcuucagagacgacgacgacaucaacgacguggccagcauggccggcgugaaccugagcgaggagagcgccagaauccuggccaccaacagcgagcuggugggcacccugaccagaagcugcaaggacgagaccuuccugcugcaggccccccugcagagaagaauccuggagaucggcaagaagcacggcaucaccgagcugcaccccgacguggugagcuacgugagccacgccacccagcagagacugcagaaccugguggagaagaucagcgagaccgcccagcagaagaacuucagcuacaaggacgacgacagauacgagcaggccagcgacgugagagcccagcugaaguucuucgagcagcuggaccagaucgagaagcagagaaaggacgagcaggagagagagauccugaugagagccgccaagagcagaagcagacaggaggaccccgagcagcugagacugaagcagaaggccaaggagaugcagcagcaggagcuggcccagaugagacagagagacgccaaccugaccgcccuggccgccaucggccccagaaagaagagaaagguggacugccccggccccggcagcggcgccgagggcagcggccccggcagcguggugcccggcagcagcggcgugggcacccccagacaguucaccagacagagaaucaccagagugaaccugagagaccugaucuucugccuggagaacgagagagagaccagccacagccugcugcuguacaaggccuuccugaaguaa

SEQ ID NO: 24341 - RNA, 978 nt, Artificial Sequence
  TAF5L__Homo_sapiens__NP_001020418
augaagagagugagaaccgagcagauccagauggccgugagcugcuaccugaagagaagacaguacguggacagcgacggcccccugaagcagggccugagacugagccagaccgccgaggagauggccgccaaccugaccgugcagagcgagagcggcugcgccaacaucgugagcgccgcccccugccaggccgagccccagcaguacgaggugcaguucggcagacugagaaacuuccugaccgacagcgacagccagcacagccacgaggugaugccccugcuguacccccuguucguguaccugcaccugaaccuggugcagaacagccccaagagcaccguggagagcuucuacagcagauuccacggcauguuccugcagaacgccagccagaaggacgugaucgagcagcugcagaccacccagaccauccaggacauccugagcaacuucaagcugagagccuuccuggacaacaaguacguggugagacugcaggaggacagcuacaacuaccugaucagauaccugcagagcgacaacaacaccgcccugugcaaggugcugacccugcacauccaccuggacgugcagcccgccaagagaaccgacuaccagcuguacgccagcggcagcagcagcagaagcgagaacaacggccuggagccccccgacaugcccagccccauccugcagaacgaggccgcccuggaggugcugcaggagagcaucaagagagugaaggacggcccccccagccugaccaccaucugcuucuacgccuucuacaacaccgagcagcugcugaacaccgccgagaucagccccgacagcaagcugcuggccgccggcuucgacaacagcugcaucaagcuguggagccugagaagcaagaagcugaagagcgagccccaccagguggacgugagcagaauccaccuggccugcgacauccuggaggaggagguguaa

SEQ ID NO: 24342 - RNA, 2145 nt, Artificial Sequence
  TAF6__Homo_sapiens__NP_001177344
augaccaagagaagacugcagaccaucaccgccugccugcagcugagagagggcagccccagccugcacagaggccugcaccccagcagagaggagaagagagacagcagaauggccgaggagaagaagcugaagcugagcaacaccgugcugcccagcgagagcaugaaggugguggccgagagcaugggcaucgcccagauccaggaggagaccugccagcugcugaccgacgaggugagcuacagaaucaaggagaucgcccaggacgcccugaaguucaugcacaugggcaagagacagaagcugaccaccagcgacaucgacuacgcccugaagcugaagaacguggagccccuguacggcuuccacgcccaggaguucauccccuucagauucgccagcggcggcggcagagagcuguacuucuacgaggagaaggagguggaccugagcgacaucaucaacaccccccugcccagagugccccuggacgugugccugaaggcccacuggcugagcaucgagggcugccagcccgccauccccgagaaccccccccccgcccccaaggagcagcagaaggccgaggccaccgagccccugaagagcgccaagcccggccaggaggaggacggcccccugaagggcaagggccagggcgccaccaccgccgacggcaagggcaaggagaagaaggcccccccccugcuggagggcgccccccugagacugaagcccagaagcauccacgagcugagcguggagcagcagcuguacuacaaggagaucaccgaggccugcgugggcagcugcgaggccaagagagccgaggcccugcagagcaucgccaccgaccccggccuguaccagaugcugcccagauucagcaccuucaucagcgagggcgugagagugaacguggugcagaacaaccuggcccugcugaucuaccugaugagaauggugaaggcccugauggacaaccccacccuguaccuggagaaguacgugcacgagcugauccccgccgugaugaccugcaucgugagcagacagcugugccugagacccgacguggacaaccacugggcccugagagacuucgccgccagacugguggcccagaucugcaagcacuucagcaccaccaccaacaacauccagagcagaaucaccaagaccuucaccaagagcuggguggacgagaagacccccuggaccaccagauacggcagcaucgccggccuggccgagcugggccacgacgugaucaagacccugauccugcccagacugcagcaggagggcgagagaaucagaagcgugcuggacggccccgugcugagcaacaucgacagaaucggcgccgaccacgugcagagccugcugcugaagcacugcgcccccgugcuggccaagcugagacccccccccgacaaccaggacgccuacagagccgaguucggcagccugggcccccugcugugcagccagguggugaaggccagagcccaggccgcccugcaggcccagcaggugaacagaaccacccugaccaucacccagcccagacccacccugacccugagccaggccccccagcccggccccagaacccccggccugcugaaggugcccggcagcaucgcccugcccgugcagacccuggugagcgccagagccgccgcccccccccagcccagccccccccccaccaaguucaucgugaugagcagcagcagcagcgcccccagcacccagcaggugcugagccugagcaccagcgcccccggcagcggcagcaccaccaccagccccgugaccaccaccgugcccagcgugcagcccaucgugaagcuggugagcaccgccaccaccgccccccccagcaccgcccccagcggccccggcagcgugcagaaguacaucguggugagccugccccccaccggcgagggcaagggcggccccaccagccaccccagccccgugcccccccccgccagcagccccagcccccugagcggcagcgcccugugcggcggcaagcaggaggccggcgacagccccccccccgcccccggcacccccaaggccaacggcagccagcccaacagcggcagcccccagcccgcccccuaa

SEQ ID NO: 24343 - RNA, 1050 nt, Artificial Sequence
  TAF7__Homo_sapiens__NP_005633
augagcaagagcaaggacgacgccccccacgagcuggagagccaguucauccugagacugccccccgaguacgccagcaccgugagaagagccgugcagagcggccacgugaaccugaaggacagacugaccaucgagcugcaccccgacggcagacacggcaucgugagaguggacagagugccccuggccagcaagcugguggaccugcccugcgugauggagagccugaagaccaucgacaagaagaccuucuacaagaccgccgacaucugccagaugcuggugagcaccguggacggcgaccuguacccccccguggaggagcccguggccagcaccgaccccaaggccagcaagaagaaggacaaggacaaggagaagaaguucaucuggaaccacggcaucacccugccccugaagaacgugagaaagagaagauucagaaagaccgccaagaagaaguacaucgagagccccgacguggagaaggaggugaagagacugcugagcaccgacgccgaggccgugagcaccagaugggagaucaucgccgaggacgagaccaaggaggccgagaaccagggccuggacaucagcagccccggcaugagcggccacagacagggccacgacagccuggagcacgacgagcugagagagaucuucaacgaccugagcagcagcagcgaggacgaggacgagacccagcaccaggacgaggaggacaucaacaucaucgacaccgaggaggaccuggagagacagcugcaggacaagcugaacgagagcgacgagcagcaccaggagaacgagggcaccaaccagcuggugaugggcauccagaagcagaucgacaacaugaagggcaagcugcaggagacccaggacagagccaagagacaggaggaccugaucaugaagguggagaaccuggcccugaagaacagauuccaggccgugcuggacgagcugaagcagaaggaggacagagagaaggagcagcugagcagccugcaggaggagcuggagagccugcuggagaaguaa

SEQ ID NO: 24344 - RNA, 1131 nt, Artificial Sequence
  TAF7L__Homo_sapiens__NP_001161946
augagcgagagccaggacgaggugcccgacgagguggagaaccaguucauccugagacugccccuggagcacgccugcaccgugagaaaccuggccagaagccagagcgugaagaugaaggacaagcugaagaucgaccugcugcccgacggcagacacgccgugguggagguggaggacgugccccuggccgccaagcugguggaccugcccugcgugaucgagagccugagaacccuggacaagaagaccuucuacaagaccgccgacaucagccagaugcuggugugcaccgccgacggcgacauccaccugagccccgaggagcccgccgccagcaccgaccccaacaucgugagaaagaaggagagaggcagagaggagaagugcguguggaagcacggcaucacccccccccugaagaacgugagaaagaagagauucagaaagacccagaagaaggugcccgacgugaaggagauggagaagagcagcuucaccgaguacaucgagagccccgacguggagaacgaggugaagagacugcugagaagcgacgccgaggccgugagcaccagaugggaggugaucgccgaggacggcaccaaggagaucgagagccagggcagcauccccggcuuccugaucagcagcggcaugagcagccacaagcagggccacaccagcagcgaguacgacaugcugagagagauguucagcgacagcagaagcaacaacgacgacgacgaggacgaggacgacgaggacgaggacgaggacgaggacgaggacgaggacgaggacaaggaggaggaggaggaggacugcagcgaggaguaccuggagagacagcugcaggccgaguucaucgagagcggccaguacagagccaacgagggcaccagcagcaucgugauggagauccagaagcagaucgagaagaaggagaagaagcugcacaagauccagaacaaggcccagagacagaaggaccugaucaugaagguggagaaccugacccugaagaaccacuuccagagcgugcuggagcagcuggagcugcaggagaagcagaagaacgagaagcugaucagccugcaggagcagcugcagagauuccugaagaaguaa

SEQ ID NO: 24345 - RNA, 933 nt, Artificial Sequence
  TAF8__Homo_sapiens__NP_612639
auggccgacgccgccgccaccgccggcgccggcggcagcggcaccagaagcggcagcaagcagagcaccaaccccgccgacaacuaccaccuggccagaagaagaacccugcaggugguggugagcagccugcugaccgaggccggcuucgagagcgccgagaaggccagcguggagacccugaccgagaugcugcagagcuacaucagcgagaucggcagaagcgccaagagcuacugcgagcacaccgccagaacccagcccacccugagcgacaucguggugacccugguggagaugggcuucaacguggacacccugcccgccuacgccaagagaagccagagaauggugaucaccgccccccccgugaccaaccagcccgugacccccaaggcccugaccgccggccagaacagaccccaccccccccacauccccagccacuuccccgaguuccccgacccccacaccuacaucaagacccccaccuacagagagcccgugagcgacuaccaggugcugagagagaaggccgccagccagagaagagacguggagagagcccugaccagauucauggccaagaccggcgagacccagagccuguucaaggacgacgugagcaccuucccccugaucgccgccagacccuucaccauccccuaccugaccgcccugcugcccagcgagcuggagaugcagcagauggaggagaccgacagcagcgagcaggacgagcagaccgacaccgagaaccuggcccugcacaucagcauggaggacagcggcgccgagaaggagaacaccagcgugcugcagcagaaccccagccugagcggcagcagaaacggcgaggagaacaucaucgacaaccccuaccugagacccgugaagaagcccaagaucagaagaaagaagagccugagcuaa

SEQ ID NO: 24346 - RNA, 795 nt, Artificial Sequence
  TAF9__Homo_sapiens__NP_003178
auggagagcggcaagaccgccagccccaagagcaugcccaaggacgcccagaugauggcccagauccugaaggacaugggcaucaccgaguacgagcccagagugaucaaccagaugcuggaguucgccuucagauacgugaccaccauccuggacgacgccaagaucuacagcagccacgccaagaaggccaccguggacgccgacgacgugagacuggccauccagugcagagccgaccagagcuucaccagccccccccccagagacuuccugcuggacaucgccagacagagaaaccagaccccccugccccugaucaagcccuacagcggccccagacugccccccgacagauacugccugaccgcccccaacuacagacugaagagccugcagaagaaggccagcaccagcgccggcagaaucaccgugcccagacugagcgugggcagcgugaccagcagacccagcacccccacccugggcacccccaccccccagaccaugagcgugagcaccaaggugggcacccccaugagccugaccggccagagauucaccgugcagaugcccaccagccagagccccgccgugaaggccagcauccccgccaccagcgccgugcagaacgugcugaucaaccccagccugaucggcagcaagaacauccugaucaccaccaacaugaugagcagccagaacaccgccaacgagagcagcaacgcccugaagagaaagagagaggacgacgacgacgacgacgacgacgacgacgacuacgacaaccuguaa

SEQ ID NO: 24347 - RNA, 2007 nt, Artificial Sequence
  TAGAP__Homo_sapiens__NP_001265662
augagaagacugagccccgccagcgacuucagcggcgcccuggagaccgaccugaaggccagccuguucgaccagccccugagcaucaucugcggcgacagcgacacccugcccagacccauccaggacauccugaccauccugugccugaagggccccagcaccgagggcaucuucagaagagccgccaacgagaaggccagaaaggagcugaaggaggagcugaacagcggcgacgccguggaccuggagagacugcccgugcaccugcuggccgugguguucaaggacuuccugagaagcauccccagaaagcugcugagcagcgaccuguucgaggaguggaugggcgcccuggagaugcaggacgaggaggacagaaucgaggcccugaagcagguggccgacaagcugcccagacccaaccugcugcugcugaagcaccugguguacgugcugcaccugaucagcaagaacagcgaggugaacagaauggacagcagcaaccuggccaucugcaucggccccaacaugcugacccuggagaacgaccagagccugagcuucgaggcccagaaggaccugaacaacaaggugaagacccugguggaguuccugaucgacaacugcuucgagaucuucggcgagaacauccccgugcacagcagcaucaccagcgacgacagccuggagcacaccgacagcagcgacgugagcacccugcagaacgacagcgccuacgacagcaacgaccccgacguggagagcaacagcagcagcggcaucagcagccccagcagacagccccaggugcccauggccaccgccgccggccuggacagcgccggcccccaggacgccagagaggugagccccgagcccaucgugagcaccguggccagacugaagagcagccuggcccagcccgacagaagauacagcgagcccagcaugcccagcagccaggagugccuggagagcagagugaccaaccagacccugaccaagagcgagggcgacuuccccgugcccagagugggcagcagacuggagagcgaggaggccgaggaccccuuccccgaggagguguuccccgccgugcagggcaagaccaagagacccguggaccugaagaucaagaaccuggcccccggcagcgugcugcccagagcccuggugcugaaggccuucagcagcagcagccuggacgccagcagcgacagcagccccguggccagccccagcagccccaagagaaacuucuucagcagacaccagagcuucaccaccaagaccgagaagggcaagcccagcagagagaucaagaagcacagcaugagcuucaccuucgccccccacaagaaggugcugaccaagaaccugagcgccggcagcggcaagagccaggacuucaccagagaccacgugcccagaggcgugagaaaggagagccagcuggccggcagaaucgugcaggagaacggcugcgagacccacaaccagaccgccagaggcuucugccugagaccccacgcccugagcguggacgacguguuccagggcgccgacugggagagacccggcagcccccccagcuacgaggaggccaugcagggccccgccgccagacugguggccagcgagagccagaccgugggcagcaugaccgugggcagcaugagagccagaaugcuggaggcccacugccugcugcccccccugccccccgcccaccacguggaggacagcagacacagaggcagcaaggagccccugcccggccacggccugagcccccugcccgagagauggaagcagagcagaaccgugcacgccagcggcgacagccugggccacgugagcggccccggcagacccgagcugcugccccugagaaccgugagcgagagcgugcagagaaacaagagagacugccuggugagaagaugcagccagcccguguucgaggccgaccaguuccaguacgccaaggagagcuacaucuaa

SEQ ID NO: 24348 - RNA, 663 nt, Artificial Sequence
  TAGLN2__Homo_sapiens__NP_001264153
augagcgccuucagccuggcccuggcccuggugagcagcccccagccccccccccccaucggcauggccaacagaggccccgccuacggccugagcagagaggugcagcagaagaucgagaagcaguacgacgccgaccuggagcagauccugauccaguggaucaccacccagugcagaaaggacgugggcagaccccagcccggcagagagaacuuccagaacuggcugaaggacggcaccgugcugugcgagcugaucaacgcccuguaccccgagggccaggcccccgugaagaagauccaggccagcaccauggccuucaagcagauggagcagaucagccaguuccugcaggccgccgagagauacggcaucaacaccaccgacaucuuccagaccguggaccugugggagggcaagaacauggccugcgugcagagaacccugaugaaccugggcggccuggccguggccagagacgacggccuguucagcggcgaccccaacugguuccccaagaagagcaaggagaaccccagaaacuucagcgacaaccagcugcaggagggcaagaacgugaucggccugcagaugggcaccaacagaggcgccagccaggccggcaugaccggcuacggcaugcccagacagauccuguaa

SEQ ID NO: 24349 - RNA, 606 nt, Artificial Sequence
  TAGLN__Homo_sapiens__NP_001001522
auggccaacaagggccccagcuacggcaugagcagagaggugcagagcaagaucgagaagaaguacgacgaggagcuggaggagagacugguggaguggaucaucgugcagugcggccccgacgugggcagacccgacagaggcagacugggcuuccagguguggcugaagaacggcgugauccugagcaagcuggugaacagccuguaccccgacggcagcaagcccgugaaggugcccgagaacccccccagcaugguguucaagcagauggagcagguggcccaguuccugaaggccgccgaggacuacggcgugaucaagaccgacauguuccagaccguggaccuguucgagggcaaggacauggccgccgugcagagaacccugauggcccugggcagccuggccgugaccaagaacgacggccacuacagaggcgaccccaacugguucaugaagaaggcccaggagcacaagagagaguucaccgagagccagcugcaggagggcaagcacgugaucggccugcagaugggcagcaacagaggcgccagccaggccggcaugaccggcuacggcagacccagacagaucaucagcuaa

SEQ ID NO: 24350 - RNA, 996 nt, Artificial Sequence
  TAL1__Homo_sapiens__NP_001277334
augaccgagagaccccccagcgaggccgccagaagcgacccccagcuggagggcagagacgccgccgaggccagcauggcccccccccaccuggugcugcugaacggcguggccaaggagaccagcagagccgccgccgccgagccccccgugaucgagcugggcgccagaggcggccccggcggcggccccgccggcggcggcggcgccgccagagaccugaagggcagagacgccgccaccgccgaggccagacacagagugcccaccaccgagcugugcagaccccccggccccgcccccgcccccgcccccgccagcgugaccgccgagcugcccggcgacggcagaauggugcagcugagcccccccgcccuggccgcccccgccgcccccggcagagcccugcuguacagccugagccagccccuggccagccugggcagcggcuucuucggcgagcccgacgccuuccccauguucaccaccaacaacagagugaagagaagacccagccccuacgagauggagaucaccgacggcccccacaccaagguggugagaagaaucuucaccaacagcagagagagauggagacagcagaacgugaacggcgccuucgccgagcugagaaagcugauccccacccacccccccgacaagaagcugagcaagaacgagauccugagacuggccaugaaguacaucaacuuccuggccaagcugcugaacgaccaggaggaggagggcacccagagagccaagaccggcaaggaccccguggugggcgccggcggcggcggcggcggcggcggcggcggcgccccccccgacgaccugcugcaggacgugcugagccccaacagcagcugcggcagcagccuggacggcgccgccagccccgacagcuacaccgaggagcccgcccccaagcacaccgccagaagccugcaccccgccaugcugcccgccgccgacggcgccggccccagauaa

SEQ ID NO: 24351 - RNA, 327 nt, Artificial Sequence
  TAL2__Homo_sapiens__NP_005412
augaccagaaagaucuucaccaacaccagagagagauggagacagcagaacgugaacagcgccuucgccaagcugagaaagcugauccccacccacccccccgacaagaagcugagcaagaacgagacccugagacuggccaugagauacaucaacuuccuggugaaggugcugggcgagcagagccugcagcagaccggcguggccgcccagggcaacauccugggccuguucccccagggcccccaccugcccggccuggaggacagaacccugcuggagaacuaccaggugcccagccccggccccagccaccacauccccuaa

SEQ ID NO: 24352 - RNA, 1014 nt, Artificial Sequence
  TALDO1__Homo_sapiens__NP_006746
augagcagcagccccgugaagagacagagaauggagagcgcccuggaccagcugaagcaguucaccaccgugguggccgacaccggcgacuuccacgccaucgacgaguacaagccccaggacgccaccaccaaccccagccugauccuggccgccgcccagaugcccgccuaccaggagcugguggaggaggccaucgccuacggcagaaagcugggcggcagccaggaggaccagaucaagaacgccaucgacaagcuguucgugcuguucggcgccgagauccugaagaagauccccggcagagugagcaccgagguggacgccagacugagcuucgacaaggacgccaugguggccagagccagaagacugaucgagcuguacaaggaggccggcaucagcaaggacagaauccugaucaagcugagcagcaccugggagggcauccaggccggcaaggagcuggaggagcagcacggcauccacugcaacaugacccugcuguucagcuucgcccaggccguggccugcgccgaggccggcgugacccugaucagccccuucgugggcagaauccuggacuggcacguggccaacaccgacaagaagagcuacgagccccuggaggaccccggcgugaagagcgugaccaagaucuacaacuacuacaagaaguucagcuacaagaccaucgugaugggcgccagcuucagaaacaccggcgagaucaaggcccuggccggcugcgacuuccugaccaucagccccaagcugcugggcgagcugcugcaggacaacgccaagcuggugcccgugcugagcgccaaggccgcccaggccagcgaccuggagaagauccaccuggacgagaagagcuucagauggcugcacaacgaggaccagauggccguggagaagcugagcgacggcaucagaaaguucgccgccgacgccgugaagcuggagagaaugcugaccgagagaauguucaacgccgagaacggcaaguaa

SEQ ID NO: 24353 - RNA, 951 nt, Artificial Sequence
  TAMM41__Homo_sapiens__NP_620162
auggcccugcagacccugcagagcagcugggugaccuucagaaagauccugagccacuuccccgaggagcugagccuggccuucguguacggcagcggcguguacagacaggccggccccagcagcgaccagaagaacgccaugcuggacuucguguucaccguggacgaccccguggccuggcacagcaagaaccugaagaagaacuggagccacuacagcuuccugaaggugcugggccccaagaucaucaccagcauccagaacaacuacggcgccggcguguacuacaacagccugaucaugugcaacggcagacugaucaaguacggcgugaucagcaccaacgugcugaucgaggaccugcugaacuggaacaaccuguacaucgccggcagacugcagaagcccgugaagaucaucagcgugaacgaggacgugacccugagaagcgcccuggacagaaaccugaagagcgccgugaccgccgccuuccugaugcugcccgagagcuucagcgaggaggaccuguucaucgagaucgccggccugagcuacagcggcgacuucagaaugguggugggcgaggacaagaccaaggugcugaacaucgugaagcccaacaucgcccacuucagagagcuguacggcagcauccugcaggagaacccccaggugguguacaagagccagcagggcuggcuggagaucgacaagagccccgagggccaguucacccagcugaugacccugcccaagacccugcagcagcagaucaaccacaucauggacccccccggcaagaacagagacguggaggagacccuguuccagguggcccacgaccccgacugcggcgacguggugagacugggccugaagaagagcgugaucuacagcagccugaagcugcacaagauguggaagggcuggcugagaaagaccagcuaa

SEQ ID NO: 24354 - RNA, 5586 nt, Artificial Sequence
  TANC1__Homo_sapiens__NP_203752
augcugaaggccgugcugaagaagagcagagagggcggcaagggcggcaagaaggaggccggcagcgacuucggccccgagaccagccccgugcugcaccuggaccacagcgccgacagccccgugagcagccugcccaccgccgaggacaccuacagagugagccuggccaagggcgugagcaugagccugcccagcagcccccugcugcccagacagagccaccuggugcagagcagagugaacaagaagagccccggccccgugagaaagcccaaguacguggagagccccagagugcccggcgacgccgugaucaugcccuucagagagguggccaagcccaccgagcccgacgagcacgaggccaaggccgacaacgagcccagcugcagccccgccgcccaggagcugcugaccagacugggcuuccugcugggcgagggcauccccagcgccacccacaucaccaucgaggacaagaacgagaccaugugcaccgcccugagccagggcaucagccccugcagcacccugaccagcagcaccgccagccccagcaccgacagccccugcagcacccugaacagcugcgugagcaagaccgccgccaacaagagccccugcgagaccaucagcagccccagcagcacccuggagagcaaggacagcggcaucaucgccaccaucaccagcagcagcgagaacgacgacagaagcggcagcagccuggaguggaacaaggacggcaaccugagacugggcgugcagaagggcgugcugcacgacagaagagccgacaacugcagccccguggccgaggaggagaccaccggcagcgccgagagcacccugcccaaggccgagagcagcgccggcgacggccccgugcccuacagccagggcagcagcagccugaucaugcccagacccaacagcguggccgccaccagcagcaccaagcuggaggaccugagcuaccuggacggccagagaaacgccccccugagaaccagcaucagacugcccuggcacaacaccgccggcggcagagcccaggaggugaaggccagauucgcccccuacaagccccaggacauccugcugaagccccugcuguucgaggugcccagcaucaccaccgacagcguguucgugggcagagacuggcuguuccaccagaucgaggagaaccugagaaacaccgagcuggccgagaacagaggcgccgugguggugggcaacgugggcuucggcaagaccgccaucaucagcaagcugguggcccugagcugccacggcagcagaaugagacagaucgccagcaacagccccggcagcagccccaagaccagcgaccccacccaggaccugcacuucaccccccugcugagccccagcagcagcaccagcgccagcagcaccgccaagaccccccugggcagcaucagcgccgagaaccagagacccagagaggacgccgugaaguaccuggccagcaaggugguggccuaccacuacugccaggccgacaacaccuacaccugccuggugcccgaguucgugcacagcaucgccgcccugcugugcagaagccaccagcuggccgccuacagagaccugcugaucaaggagccccagcugcagagcaugcugagccugagaagcugcgugcaggaccccguggccgccuucaagagaggcgugcuggagccccugaccaaccugagaaacgagcagaagauccccgaggaggaguacaucauccugaucgacggccugaacgaggccgaguuccacaagcccgacuacggcgacacccugagcagcuucaucaccaagaucaucagcaaguuccccgccuggcugaagcugaucgugaccgugagagccaacuuccaggagaucaucagcgcccugcccuucgugaagcugagccuggacgacuuccccgacaacaaggacauccacagcgaccugcacgccuacgugcagcacagagugcacagcagccaggacauccugagcaacaucagccugaacggcaaggccgacgccacccugaucggcaaggugagcagccaccuggugcugagaagccugggcagcuaccuguaccugaagcugacccuggaccuguuccagagaggccaccuggugaucaagagcgccagcuacaagguggugcccgugagccugagcgagcuguaccugcugcagugcaacaugaaguucaugacccagagcgccuucgagagagcccugcccauccugaacguggcccuggccagccugcaccccaugaccgacgagcagaucuuccaggccaucaacgccggccacauccagggcgagcagggcugggaggacuuccagcagagaauggacgcccugagcugcuuccugaucaagagaagagacaagaccagaauguucugccaccccagcuucagagaguggcugguguggagagccgacggcgagaacaccgccuuccugugcgagcccagaaacggccacgcccugcuggccuucauguucagcagacaggagggcaagcugaacagacagcagaccauggagcugggccaccacauccugaaggcccacaucuucaagggccugagcaagaagaccggcaucagcagcagccaccugcaggcccuguggaucggcuacagcaccgagggccugagcgccgcccuggccagccugagaaaccuguacacccccaacgugaaggugagcagacugcugauccugggcggcgccaacgugaacuacagaaccgaggugcugaacaacgcccccauccugugcgugcagagccaccugggccacgaggagguggugacccugcugcuggaguucggcgccugccuggacggcaccagcgagaacggcaugaccgcccugugcuacgccgccgccgccggccacaugaagcuggugugccugcugaccaagaagggcgugagaguggaccaccuggacaagaagggccagugcgcccuggugcacagcgcccugagaggccacggcgacauccugcaguaccugcugaccugcgaguggagccccggccccccccagcccggcacccugagaaagagccacgcccugcagcaggcccugaccgccgccgccagcaugggccacagcagcguggugcagugccugcugggcauggagaaggagcacgagguggaggugaacggcaccgacacccuguggggcgagaccgcccugaccgccgccgccggcagaggcaagcuggaggugugcgagcugcugcugggccacggcgccgccgugagcagaaccaacagaagaggcgugcccccccuguucugcgccgccagacagggccacuggcagaucgugagacugcugcuggagagaggcugcgacgugaaccugagcgacaagcagggcagaaccccccugaugguggccgccugcgagggccaccugagcaccguggaguuccugcugagcaagggcgccgcccugagcagccuggacaaggagggccugagcgcccugagcugggccugccugaagggccacagagccguggugcaguaccugguggaggagggcgccgccaucgaccagaccgacaagaacggcagaaccccccuggaccuggccgccuucuacggcgacgccgagaccgugcuguaccugguggagaagggcgccgugaucgagcacguggaccacagcggcaugagaccccuggacagagccaucggcugcagaaacaccagcguggugguggcccugcugagaaagggcgccaagcugggcaacgccgccugggccauggccaccagcaagcccgacauccugaucauccugcugcagaagcugauggaggagggcaacgugauguacaagaagggcaagaugaaggaggccgcccagagauaccaguacgcccugagaaaguuccccagagagggcuucggcgaggacaugagacccuucaacgagcugagagugagccuguaccugaaccugagcagaugcagaagaaagaccaacgacuucggcauggccgaggaguucgccagcaaggcccuggagcugaagcccaagagcuacgaggccuucuacgccagagccagagccaagagaaacagcagacaguucguggccgcccuggccgaccugcaggaggccgugaagcugugccccaccaaccaggaggugaagagacugcuggccagaguggaggaggagugcaagcagcugcagagaagccagcagcagaagcagcagggcccccugcccgccccccugaacgacagcgagaacgaggaggacacccccacccccggccugagcgaccacuuccacagcgaggagaccgaggaggaggagaccagcccccaggaggagagcgugagccccacccccagaagccagcccagcagcagcgugcccagcagcuacaucagaaaccugcaggagggccugcagagcaagggcagacccgugagcccccagagcagagccggcaucggcaagagccugagagagcccguggcccagcccggccugcugcugcagcccagcaagcaggcccagaucgugaagaccagccagcaccugggcagcggccagagcgccgugagaaacggcagcaugaaggugcagaucagcagccagaaccccccccccagccccaugcccggcagaaucgccgccacccccgccggcagcagaacccagcaccuggagggcaccggcaccuucaccaccagagccggcugcggccacuucggcgacagacugggccccagccagaacgugagacugcagugcggcgagaacggccccgcccacccccugcccagcaagaccaagaccaccgagagacugcugagccacagcagcguggccguggacgccgccccccccaaccagggcggccuggccaccugcagcgacgugagacaccccgccagccugaccagcagcggcagcagcggcagccccagcagcagcaucaagaugagcagcagcaccagcagccugaccagcagcagcagcuucagcgacggcuucaaggugcagggccccgacaccagaaucaaggacaagguggugacccacgugcagagcggcaccgccgagcacagacccagaaacacccccuucaugggcaucauggacaagaccgccagauuccagcagcagagcaacccccccagcagaagcuggcacugccccgcccccgagggccugcugaccaacaccagcagcgccgccggccugcagagcgccaacaccgagaagcccagccugaugcaggugggcggcuacaacaaccaggccaagaccugcagcgugagcacccugagcgccagcgugcacaacggcgcccaggugaaggagcuggaggagagcaagugccagauccccgugcacagccaggagaacagaaucaccaagaccgugagccaccuguaccaggagagcaucagcaagcagcagccccacaucagcaacgaggcccacagaagccaccugaccgccgccaagcccaagagaagcuucaucgagagcaacguguaa

SEQ ID NO: 24355 - RNA, 5973 nt, Artificial Sequence
  TANC2__Homo_sapiens__XP_005257260
auguucagaaacagccugaagaugcugcugaccggcggcaagagcagcagaaagaacagaagcagcgacggcggcagcgaggagccccccgacagaagacagagcagcguggacagcagacagagcagaagcggccagggcggcaucagcaccgagagcgacugcgccuucgagcccgacuacgccgugcccccccugcccgugagcgagggcgacgccgagcaggagcugggccccccccccagcguggacgaggccgccaacacccugaugaccagacugggcuuccugcugggcgagaaggugaccgaggugcagcccggcgaccaguacagcauggaggugcaggacgagaaccagaccagcgccaucacccagagaaucagccccugcagcacccugaccagcagcaccgccagcccccccgccagcagccccugcagcacccugccccccaucagcaccaacgccaccgccaaggacugcagcuacggcgccgugaccagccccaccagcacccuggagagcagagacagcggcaucaucgccacccugaccagcuacagcgagaacguggagagaaccaaguacgccggcgagagcagcaaggagcugggcagcggcggcaacaucaagcccuggcagagccagaagagcagcauggacagcugccuguacagaguggacgagaacaugaccgccagcaccuacagccugaacaagauccccgagagaaaccuggagaccgugcugagccagagcgugcagagcaucccccuguaccugaugcccagacccaacagcguggccgccaccagcagcgcccaccuggaggaccuggccuaccuggacgagcagagacacaccccccugagaaccagccugagaaugcccagacagagcaugggcggcgccagaacccagcaggaccugagagugagauucgcccccuacagaccccccgacaucagccugaagccccugcuguucgaggugcccagcaucaccaccgagagcguguucgugggcagagacuggguguuccacgagaucgacgcccagcugcagagcagcaacgccagcgugaaccagggcguggugaucgugggcaacaucggcuucggcaagaccgccaucaucagcagacugguggcccugagcugccacggcaccagaaugagacagaucgccagcgacagcccccacgccagccccaagcacguggacgccaacagagagcugccccugacccagccccccagcgcccacagcagcaucaccagcggcagcugccccggcacccccgagaugagaagaagacaggaggaggccaugagaagacuggccagccaggugguggccuaccacuacugccaggccgacaacgccuacaccugccuggugcccgaguucgugcacaacguggccgcccugcugugcagaagcccccagcugaccgccuacagagagcagcugcugagagagccccaccugcagagcaugcugagccugagaagcugcgugcaggaccccauggccagcuucagaagaggcgugcuggagccccuggagaaccugcacaaggagagaaagauccccgacgaggacuucaucauccugaucgacggccugaacgaggccgaguuccacaagcccgacuacggcgacaccaucgugagcuuccugagcaagaugaucggcaaguuccccagcuggcugaagcugaucgugaccgugagaaccagccugcaggagaucaccaagcugcugcccuuccacagaaucuuccuggacagacuggaggagaacgaggccaucgaccaggaccugcaggccuacauccugcacagaauccacagcagcagcgagauccagaacaacaucagccugaacggcaagauggacaacaccaccuucggcaagcugagcagccaccugaagacccugagccagggcagcuaccuguaccugaagcugaccuucgaccugaucgagaagggcuaccuggugcugaagagcagcagcuacaagguggugcccgugagccugagcgagguguaccugcugcagugcaacaugaaguuccccacccagagcagcuucgacagagugaugccccugcugaacguggccguggccagccugcacccccugaccgacgagcacaucuuccaggccaucaacgccggcagcaucgagggcacccuggagugggaggacuuccagcagagaauggagaaccugagcauguuccugaucaagagaagagacaugaccagaauguucgugcaccccagcuucagagaguggcugaucuggagagaggagggcgagaagaccaaguuccugugcgaccccagaagcggccacacccugcuggccuucugguucagcagacaggagggcaagcugaacagacagcagaccaucgagcugggccaccacauccugaaggcccacaucuucaagggccugagcaagaaggugggcgugagcagcagcauccugcagggccuguggaucagcuacagcaccgagggccugagcauggcccuggccagccugagaaaccuguacacccccaacaucaaggugagcagacugcugauccugggcggcgccaacaucaacuacagaaccgaggugcugaacaacgcccccauccugugcgugcagagccaccugggcuacaccgagaugguggcccugcugcuggaguucggcgccaacguggacgccagcagcgagagcggccugaccccccugggcuacgccgccgccgccggcuaccugagcaucguggugcugcugugcaagaagagagccaagguggaccaccuggacaagaacggccagugcgcccuggugcacgccgcccugagaggccaccuggagguggugaaguuccugauccagugcgacuggaccauggccggccagcagcagggcguguucaagaagagccacgccauccagcaggcccugaucgccgccgccagcaugggcuacaccgagaucgugagcuaccugcuggaccugcccgagaaggacgaggaggagguggagagagcccagaucaacagcuucgacagccuguggggcgagaccgcccugaccgccgccgccggcagaggcaagcuggaggugugcagacugcugcuggagcagggcgccgccguggcccagcccaacagaagaggcgccgugccccuguucagcaccgugagacagggccacuggcagaucguggaccugcugcugacccacggcgccgacgugaacauggccgacaagcagggcagaaccccccugaugauggccgccagcgagggccaccugggcaccguggacuuccugcuggcccagggcgccagcaucgcccugauggacaaggagggccugaccgcccugagcugggccugccugaagggccaccugagcguggugagaagccugguggacaacggcgccgccaccgaccacgccgacaagaacggcagaaccccccuggaccuggccgccuucuacggcgacgccgagguggugcaguuccugguggaccacggcgccaugaucgagcacguggacuacagcggcaugagaccccuggacagagccgugggcugcagaaacaccagcgugguggugacccugcugaagaagggcgccaagaucggccccgccaccugggccauggccaccagcaagcccgacaucaugaucauccugcugagcaagcugauggaggagggcgacauguucuacaagaagggcaaggugaaggaggccgcccagagauaccaguacgcccugaagaaguuccccagagagggcuucggcgaggaccugaagaccuucagagagcugaaggugagccugcugcugaaccugagcagaugcagaagaaagaugaacgacuucggcauggccgaggaguucgccaccaaggcccuggagcugaagcccaagagcuacgaggccuacuacgccagagccagagccaagagaagcagcagacaguucgccgccgcccuggaggaccugaacgaggccaucaagcugugccccaacaacagagagauccagagacugcugcugagaguggaggaggagugcagacagaugcagcagccccagcagccccccccccccccccagccccagcagcagcugcccgaggaggccgagcccgagccccagcacgaggacaucuacagcgugcaggacaucuucgaggaggaguaccuggagcaggacguggagaacgugagcaucggccugcagaccgaggccagacccagccagggccugcccgugauccagagcccccccagcagccccccccacagagacagcgccuacaucagcagcagcccccugggcagccaccagguguucgacuucagaagcagcagcagcgugggcagccccaccagacagaccuaccagagcaccagccccgcccugagccccacccaccagaacagccacuacagacccagccccccccacaccagccccgcccaccagggcggcagcuacagauucagccccccccccgugggcggccagggcaaggaguaccccagccccccccccagcccccugagaagaggcccccaguacagagccagcccccccgccgagagcaugagcguguacagaagccagagcggcagccccgugagauaccagcaggagaccagcgugagccagcugcccggcagacccaagagcccccugagcaagauggcccagagacccuaccagaugccccagcugcccguggccgugccccagcagggccugagacugcagcccgccaaggcccagaucgugagaagcaaccagcccagccccgccgugcacagcagcaccgugauccccaccggcgccuacggccagguggcccacagcauggccagcaaguaccagagcagccagggcgacaucggcgugagccagagcagacugguguaccagggcagcaucggcggcaucgugggcgacggcagacccgugcagcacgugcaggccagccugagcgccggcgccaucugccagcacggcggccugaccaaggaggaccugccccagagacccagcagcgccuacagaggcggcgugagauacagccagaccccccagaucggcagaagccagagcgccagcuacuaccccgugugccacagcaagcuggaccuggagagaagcagcagccagcugggcagccccgacgugagccaccugaucagaagacccaucagcgugaaccccaacgagaucaagccccacccccccacccccagaccccugcugcacagccagagcgugggccugagauucagccccagcagcaacagcaucagcagcaccagcaaccugacccccaccuucagacccagcagcagcauccagcagauggagaucccccugaagcccgccuacgagagaagcugcgacgagcugagccccgugagccccacccagggcggcuaccccagcgagcccaccagaagcagaaccacccccuucaugggcaucaucgacaagaccgccagaacccagcaguacccccaccugcaccagcagaacagaaccugggccgugagcagcguggacaccgugcugagccccaccagccccggcaaccugccccagcccgagagcuucagcccccccagcagcaucagcaacaucgccuucuacaacaagaccaacaacgcccagaacggccaccugcuggaggacgacuacuacagcccccacggcaugcuggccaacggcagcagaggcgaccugcuggagagagugagccaggccagcagcuaccccgacgugaagguggccagaacccugcccguggcccaggccuaccaggacaaccuguacagacagcugagcagagacagcagacagggccagaccagccccaucaagcccaagagacccuucguggagagcaacguguaa

SEQ ID NO: 24356 - RNA, 831 nt, Artificial Sequence
  TANGO2__Homo_sapiens__NP_001270045
augugcaucaucuucuucaaguucgaccccagacccgugagcaagaacgccuacagacugauccuggccgccaacagagacgaguucuacagcagacccagcaagcuggccgacuucuggggcaacaacaacgagauccugagcggccuggacauggaggagggcaaggagggcggcaccuggcugggcaucagcaccagaggcaagcuggccgcccugaccaacuaccugcagccccagcuggacuggcaggccagaggcagaggcgagcuggugacccacuuccugaccaccgacguggacagccugagcuaccugaagaaggugagcauggagggccaccuguacaacggcuucaaccugaucgccgccgaccugagcaccgccaagggcgacgugaucugcuacuacggcaacagaggcgagcccgaccccaucgugcugacccccggcaccuacggccugagcaacgcccugcuggagacccccuggagaaagcugugcuucggcaagcagcuguuccuggaggccguggagagaagccaggcccugcccaaggacgugcugaucgccagccugcuggacgugcugaacaacgaggaggcccagcugcccgaccccgccaucgaggaccagggcggcgaguacgugcagcccaugcugagcaaguacgccgccgugugcgugagaugccccggcuacggcaccagaaccaacaccaucauccugguggacgccgacggccacgugaccuucaccgagagaagcaugauggacaaggaccugagccacugggagaccagaaccuacgaguucacccugcagagcuaa

SEQ ID NO: 24357 - RNA, 1278 nt, Artificial Sequence
  TANK__Homo_sapiens__NP_004171
auggacaagaacaucggcgagcagcugaacaaggccuacgaggccuucagacaggccugcauggacagagacagcgccgugaaggagcugcagcagaagaccgagaacuacgagcagagaaucagagagcagcaggagcagcugagccugcagcagaccaucaucgacaagcugaagagccagcugcugcuggugaacagcacccaggacaacaacuacggcugcgugccccugcuggaggacagcgagaccagaaagaacaaccugacccuggaccagccccaggacaaggugaucagcggcaucgccagagagaagcugcccaaggugagaagacaggaggugagcagccccagaaaggagaccagcgccagaagccugggcagcccccugcugcacgagagaggcaacaucgagaagaccuucugggaccugaaggaggaguuccacaagaucugcaugcuggccaaggcccagaaggaccaccugagcaagcugaacauccccgacaccgccaccgagacccagugcagcgugcccauccagugcaccgacaagaccgacaagcaggaggcccuguucaagccccaggccaaggacgacaucaacagaggcgcccccagcaucaccagcgugacccccagaggccugugcagagacgaggaggacaccagcuucgagagccugagcaaguucaacgugaaguucccccccauggacaacgacagcaccuuccugcacagcacccccgagagacccggcauccugagccccgccaccagcgaggccgugugccaggagaaguucaacauggaguucagagacaaccccggcaacuucgugaagaccgaggagacccuguucgagauccagggcaucgaccccaucgccagcgccauccagaaccugaagaccaccgacaagaccaagcccagcaaccuggugaacaccugcaucagaaccacccuggacagagccgccugccugccccccggcgaccacaacgcccuguacgugaacagcuucccccugcuggaccccagcgacgcccccuuccccagccuggacagccccggcaaggccaucagaggcccccagcagcccaucuggaagcccuuccccaaccaggacagcgacagcguggugcugagcggcaccgacagcgagcugcacauccccagagugugcgaguucugccaggccguguucccccccagcaucaccagcagaggcgacuuccugagacaccugaacagccacuucaacggcgagaccuaa

SEQ ID NO: 24358 - RNA, 2562 nt, Artificial Sequence
  TAOK1__Homo_sapiens__NP_079418
augcccagcaccaacagagccggcagccugaaggaccccgagaucgccgagcuguucuucaaggaggaccccgagaagcuguucaccgaccugagagagaucggccacggcagcuucggcgccguguacuucgccagagacgugagaaccaacgaggugguggccaucaagaagaugagcuacagcggcaagcagagcaccgagaaguggcaggacaucaucaaggaggugaaguuccugcagagaaucaagcaccccaacagcaucgaguacaagggcugcuaccugagagagcacaccgccuggcuggugauggaguacugccugggcagcgccagcgaccugcuggaggugcacaagaagccccugcaggagguggagaucgccgccaucacccacggcgcccugcagggccuggccuaccugcacagccacaccaugauccacagagacaucaaggccggcaacauccugcugaccgagcccggccaggugaagcuggccgacuucggcagcgccagcauggccagccccgccaacagcuucgugggcacccccuacuggauggcccccgaggugauccuggccauggacgagggccaguacgacggcaagguggacguguggagccugggcaucaccugcaucgagcuggccgagagaaagcccccccuguucaacaugaacgccaugagcgcccuguaccacaucgcccagaacgagagccccacccugcagagcaacgaguggagcgacuacuucagaaacuucguggacagcugccugcagaagaucccccaggacagacccaccagcgaggagcugcugaagcacaucuucgugcugagagagagacccgagaccgugcugaucgaccugauccagagaaccaaggacgccgugagagagcuggacaaccugcaguacagaaagaugaagaagcugcuguuccaggaggcccacaacggccccgccguggaggcccaggaggaggaggaggagcaggaccacggcgugggcagaaccggcaccgugaacagcgugggcagcaaccagagcauccccagcaugagcaucagcgccagcagccagagcagcagcgugaacagccugcccgacgugagcgacgacaagagcgagcuggacaugauggagggcgaccacaccgugaugagcaacagcagcgugauccaccugaagcccgaggaggagaacuacagagaggagggcgaccccagaaccagagccagcgacccccagagccccccccaggugagcagacacaagagccacuacagaaacagagagcacuucgccaccaucagaaccgccagccuggugaccagacagaugcaggagcacgagcaggacagcgagcugagagagcagaugagcggcuacaagagaaugagaagacagcaccagaagcagcugaugacccuggagaacaagcugaaggccgagauggacgagcacagacugagacuggacaaggaccuggagacccagagaaacaacuucgccgccgagauggagaagcugaucaagaagcaccaggccgccauggagaaggaggccaaggugaugagcaacgaggagaagaaguuccagcagcacauccaggcccagcagaagaaggagcugaacagcuuccuggagagccagaagagagaguacaagcugagaaaggagcagcugaaggagagcaaggagcugcagaucaagaagcaguuccaggacaccugcaagauccagaccagacaguacaaggcccugagaaaccaccugcuggagaccacccccaagagcgagcacaaggccgugcugaagagacugaaggaggagcagaccagaaagcuggccauccuggccgagcaguacgaccacagcaucaacgagaugcugagcacccaggcccugagacuggacgaggcccaggaggccgagugccaggugcugaagaugcagcugcagcaggagcuggagcugcugaacgccuaccagagcaagaucaagaugcaggccgaggcccagcacgacagagagcugagagagcuggagcagagagugagccugagaagagcccugcuggagcagaagaucgaggaggagaugcuggcccugcagaacgagagaaccgagagaaucagaagccugcuggagagacaggccagagagaucgaggccuucgacagcgagagcaugagacugggcuucagcaacauggugcugagcaaccugagccccgaggccuucagccacagcuaccccggcgccagcggcuggagccacaaccccaccggcggccccggcccccacuggggccaccccaugggcggccccccccaggccuggggccaccccaugcagggcggcccccagcccuggggccaccccagcggccccaugcagggcgugcccagaggcagcagcaugggcgugagaaacagcccccaggcccugagaagaaccgccagcggcggcagaaccgagcagggcaugagcagaagcaccagcgugaccagccagaucagcaacggcagccacaugagcuacaccuaa

SEQ ID NO: 24359 - RNA, 3369 nt, Artificial Sequence
  TAOK2__Homo_sapiens__NP_001238972
augcccgccggcggcagagccggcagccugaaggaccccgacguggccgagcuguucuucaaggacgaccccgagaagcuguucagcgaccugagagagaucggccacggcagcuucggcgccguguacuucgccagagacgugagaaacagcgaggugguggccaucaagaagaugagcuacagcggcaagcagagcaacgagaaguggcaggacaucaucaaggaggugagauuccugcagaagcugagacaccccaacaccauccaguacagaggcugcuaccugagagagcacaccgccuggcuggugauggaguacugccugggcagcgccagcgaccugcuggaggugcacaagaagccccugcaggagguggagaucgccgccgugacccacggcgcccugcagggccuggccuaccugcacagccacaacaugauccacagagacgugaaggccggcaacauccugcugagcgagcccggccuggugaagcugggcgacuucggcagcgccagcaucauggcccccgccaacagcuucgugggcacccccuacuggauggcccccgaggugauccuggccauggacgagggccaguacgacggcaagguggacguguggagccugggcaucaccugcaucgagcuggccgagagaaagcccccccuguucaacaugaacgccaugagcgcccuguaccacaucgcccagaacgagagccccgugcugcagagcggccacuggagcgaguacuucagaaacuucguggacagcugccugcagaagaucccccaggacagacccaccagcgaggugcugcugaagcacagauucgugcugagagagagaccccccaccgugaucauggaccugauccagagaaccaaggacgccgugagagagcuggacaaccugcaguacagaaagaugaagaagauccuguuccaggaggcccccaacggccccggcgccgaggcccccgaggaggaggaggaggccgagcccuacaugcacagagccggcacccugaccagccuggagagcagccacagcgugcccagcaugagcaucagcgccagcagccagagcagcagcgugaacagccuggccgacgccagcgacaacgaggaggaggaggaggaggaggaggaggaggaggaggaggaggagggccccgaggccagagagauggccaugaugcaggagggcgagcacaccgugaccagccacagcagcaucauccacagacugcccggcagcgacaaccuguacgacgaccccuaccagcccgagaucacccccagcccccugcagccccccgccgcccccgcccccaccagcaccaccagcagcgccagaagaagagccuacugcagaaacagagaccacuucgccaccaucagaaccgccagccuggugagcagacagauccaggagcacgagcaggacagcgcccugagagagcagcugagcggcuacaagagaaugagaagacagcaccagaagcagcugcuggcccuggagagcagacugagaggcgagagagaggagcacagcgccagacugcagagagagcuggaggcccagagagccggcuucggcgccgaggccgagaagcuggccagaagacaccaggccaucggcgagaaggaggccagagccgcccaggccgaggagagaaaguuccagcagcacauccugggccagcagaagaaggagcuggccgcccugcuggaggcccagaagagaaccuacaagcugagaaaggagcagcugaaggaggagcugcaggagaaccccagcacccccaagagagagaaggccgaguggcugcugagacagaaggagcagcugcagcagugccaggccgaggaggaggccggccugcugagaagacagagacaguacuucgagcugcagugcagacaguacaagagaaagaugcugcuggccagacacagccuggaccaggaccugcugagagaggaccugaacaagaagcagacccagaaggaccuggagugcgcccugcugcugagacagcacgaggccaccagagagcuggagcugagacagcugcaggccgugcagagaaccagagccgagcugaccagacugcagcaccagaccgagcugggcaaccagcuggaguacaacaagagaagagagcaggagcugagacagaagcacgccgcccaggugagacagcagcccaagagccugaaggagagaagcaucgugggccaggaggaggccggcaccuggagccuguggggcaaggaggacgagagccugcuggacgaggaguucgagcugggcugggugcagggccccgcccugacccccgugcccgaggaggaggaggaggaggaggagggcgcccccaucggcacccccagagaccccggcgacggcugccccagccccgacaucccccccgagcccccccccacccaccugagacccugccccgccagccagcugcccggccugcugagccacggccugcuggccggccugagcuucgccgugggcagcagcagcggccugcugccccugcugcugcugcugcugcugccccugcuggccgcccagggcggcggcggccugcaggccgcccugcuggcccuggaggugggccuggugggccugggcgccagcuaccugcugcugugcaccgcccugcaccugcccagcagccuguuccugcugcuggcccagggcaccgcccugggcgccgugcugggccugagcuggagaagaggccugaugggcgugccccugggccugggcgccgccuggcugcuggccuggcccggccuggcccugccccugguggccauggccgccggcggcagaugggugagacagcagggccccagagugagaagaggcaucagcagacuguggcugagagugcugcugagacugagccccauggccuucagagcccugcagggcugcggcgccgugggcgacagaggccuguucgcccuguaccccaagaccaacaaggacggcuucagaagcagacugcccgugcccggccccagaagaagaaaccccagaaccacccagcacccccuggcccugcuggccagagugugggugcugugcaagggcuggaacuggagacuggccagagccagccagggccuggccagccaccugccccccugggccauccacacccuggccagcuggggccugcugagaggcgagagacccaccagaauccccagacugcugcccagaagccagagacagcugggcccccccgccagcagacagccccugcccggcacccuggccggcagaagaagcagaaccagacagagcagagcccugccccccuggagauaa

SEQ ID NO: 24360 - RNA, 2697 nt, Artificial Sequence
  TAOK3__Homo_sapiens__NP_057365
augagaaagggcgugcugaaggaccccgagaucgccgaccuguucuacaaggacgaccccgaggagcuguucaucggccugcacgagaucggccacggcagcuucggcgccguguacuucgccaccaacgcccacaccagcgaggugguggccaucaagaagaugagcuacagcggcaagcagacccacgagaaguggcaggacauccugaaggaggugaaguuccugagacagcugaagcaccccaacaccaucgaguacaagggcugcuaccugaaggagcacaccgccuggcuggugauggaguacugccugggcagcgccagcgaccugcuggaggugcacaagaagccccugcaggagguggagaucgccgccaucacccacggcgcccugcacggccuggccuaccugcacagccacgcccugauccacagagacaucaaggccggcaacauccugcugaccgagcccggccaggugaagcuggccgacuucggcagcgccagcauggccagccccgccaacagcuucgugggcacccccuacuggauggcccccgaggugauccuggccauggacgagggccaguacgacggcaagguggacaucuggagccugggcaucaccugcaucgagcuggccgagagaaagcccccccuguucaacaugaacgccaugagcgcccuguaccacaucgcccagaacgacagccccacccugcagagcaacgaguggaccgacagcuucagaagauucguggacuacugccugcagaagaucccccaggagagacccaccagcgccgagcugcugagacacgacuucgugagaagagacagaccccugagagugcugaucgaccugauccagagaaccaaggacgccgugagagagcuggacaaccugcaguacagaaagaugaagaagauccuguuccaggagaccagaaacggcccccugaacgagagccaggaggacgaggaggacagcgagcacggcaccagccugaacagagagauggacagccugggcagcaaccacagcauccccagcaugagcgugagcaccggcagccagagcagcagcgugaacagcaugcaggaggugauggacgagagcagcagcgagcuggugaugaugcacgacgacgagagcaccaucaacagcagcagcagcguggugcacaagaaggaccacguguucaucagagacgaggccggccacggcgaccccagacccgagcccagacccacccagagcgugcagagccaggcccugcacuacagaaacagagagagauucgccaccaucaagagcgccagccuggugaccagacagauccacgagcacgagcaggagaacgagcugagagagcagaugagcggcuacaagagaaugagaagacagcaccagaagcagcugaucgcccuggagaacaagcugaaggccgagauggacgagcacagacugaagcugcagaaggagguggagacccacgccaacaacagcagcaucgagcuggagaagcuggccaagaagcagguggccaucaucgagaaggaggccaagguggccgccgccgacgagaagaaguuccagcagcagauccuggcccagcagaagaaggaccugaccaccuuccuggagagccagaagaagcaguacaagaucugcaaggagaagaucaaggaggagaugaacgaggaccacagcacccccaagaaggagaagcaggagagaaucagcaagcacaaggagaaccugcagcacacccaggccgaggaggaggcccaccugcugacccagcagagacuguacuacgacaagaacugcagauucuucaagagaaagaucaugaucaagagacacgagguggagcagcagaacaucagagaggagcugaacaagaagagaacccagaaggagauggagcacgccaugcugaucagacacgacgagagcaccagagagcuggaguacagacagcugcacacccugcagaagcugagaauggaccugaucagacugcagcaccagaccgagcuggagaaccagcuggaguacaacaagagaagagagagagagcugcacagaaagcacgugauggagcugagacagcagcccaagaaccugaaggccauggagaugcagaucaagaagcaguuccaggacaccugcaaggugcagaccaagcaguacaaggcccugaagaaccaccagcuggaggugacccccaagaacgagcacaagaccauccugaagacccugaaggacgagcagaccagaaagcuggccauccuggccgagcaguacgagcagagcaucaacgagaugauggccagccaggcccugagacuggacgaggcccaggaggccgagugccaggcccugagacugcagcugcagcaggagauggagcugcugaacgccuaccagagcaagaucaagaugcagaccgaggcccagcacgagagagagcugcagaagcuggagcagagagugagccugagaagagcccaccuggagcagaagaucgaggaggagcuggccgcccugcagaaggagagaagcgagagaaucaagaaccugcuggagagacaggagagagagaucgagaccuucgacauggagagccugagaaugggcuucggcaaccuggugacccuggacuuccccaaggaggacuacagauaa

SEQ ID NO: 24361 - RNA, 2427 nt, Artificial Sequence
  TAP1__Homo_sapiens__NP_000584
auggccgagcugcuggccagcgccggcagcgccugcagcugggacuuccccagagccccccccagcuuccccccccccgccgccagcagaggcggccugggcggcaccagaagcuucagaccccacagaggcgccgagagccccagacccggcagagacagagacggcgugagagugcccauggccagcagcagaugccccgcccccagaggcugcagaugccugcccggcgccagccuggccuggcugggcaccgugcugcugcugcuggccgacugggugcugcugagaaccgcccugcccagaaucuucagccugcuggugcccaccgcccugccccugcugagagugugggccgugggccugagcagaugggccgugcuguggcugggcgccugcggcgugcugagagccaccgugggcagcaagagcgagaacgccggcgcccagggcuggcuggccgcccugaagccccuggccgccgcccugggccuggcccugcccggccuggcccuguucagagagcugaucagcuggggcgcccccggcagcgccgacagcaccagacugcugcacuggggcagccaccccaccgccuucguggugagcuacgccgccgcccugcccgccgccgcccuguggcacaagcugggcagccugugggugcccggcggccagggcggcagcggcaaccccgugagaagacugcugggcugccugggcagcgagaccagaagacugagccuguuccuggugcugguggugcugagcagccugggcgagauggccauccccuucuucaccggcagacugaccgacuggauccugcaggacggcagcgccgacaccuucaccagaaaccugacccugaugagcauccugaccaucgccagcgccgugcuggaguucgugggcgacggcaucuacaacaacaccaugggccacgugcacagccaccugcagggcgagguguucggcgccgugcugagacaggagaccgaguucuuccagcagaaccagaccggcaacaucaugagcagagugaccgaggacaccagcacccugagcgacagccugagcgagaaccugagccuguuccugugguaccuggugagaggccugugccugcugggcaucaugcuguggggcagcgugagccugaccauggugacccugaucacccugccccugcuguuccugcugcccaagaaggugggcaagugguaccagcugcuggaggugcaggugagagagagccuggccaagagcagccagguggccaucgaggcccugagcgccaugcccaccgugagaagcuucgccaacgaggagggcgaggcccagaaguucagagagaagcugcaggagaucaagacccugaaccagaaggaggccguggccuacgccgugaacagcuggaccaccagcaucagcggcaugcugcugaaggugggcauccuguacaucggcggccagcuggugaccagcggcgccgugagcagcggcaaccuggugaccuucgugcuguaccagaugcaguucacccaggccguggaggugcugcugagcaucuaccccagagugcagaaggccgugggcagcagcgagaagaucuucgaguaccuggacagaacccccagaugcccccccagcggccugcugaccccccugcaccuggagggccuggugcaguuccaggacgugagcuucgccuaccccaacagacccgacgugcuggugcugcagggccugaccuucacccugagacccggcgaggugaccgcccuggugggccccaacggcagcggcaagagcaccguggccgcccugcugcagaaccuguaccagcccaccggcggccagcugcugcuggacggcaagccccugccccaguacgagcacagauaccugcacagacagguggccgccgugggccaggagccccagguguucggcagaagccugcaggagaacaucgccuacggccugacccagaagcccaccauggaggagaucaccgccgccgccgugaagagcggcgcccacagcuucaucagcggccugccccagggcuacgacaccgagguggacgaggccggcagccagcugagcggcggccagagacaggccguggcccuggccagagcccugaucagaaagcccugcgugcugauccuggacgacgccaccagcgcccuggacgccaacagccagcugcagguggagcagcugcuguacgagagccccgagagauacagcagaagcgugcugcugaucacccagcaccugagccugguggagcaggccgaccacauccuguuccuggagggcggcgccaucagagagggcggcacccaccagcagcugauggagaagaagggcugcuacugggccauggugcaggcccccgccgacgcccccgaguaa

SEQ ID NO: 24362 - RNA, 2112 nt, Artificial Sequence
  TAP2__Homo_sapiens__NP_000535
augagacugcccgaccugagacccuggaccagccugcugcugguggacgccgcccugcuguggcugcugcagggcccccugggcacccugcugccccagggccugcccggccuguggcuggagggcacccugagacugggcggccuguggggccugcugaagcugagaggccugcugggcuucgugggcacccugcugcugccccugugccuggccaccccccugaccgugagccugagagcccugguggccggcgccagcagagccccccccgccagaguggccagcgcccccuggagcuggcugcuggugggcuacggcgccgccggccugagcuggagccugugggccgugcugagcccccccggcgcccaggagaaggagcaggaccaggugaacaacaaggugcugauguggagacugcugaagcugagcagacccgaccugccccugcugguggccgccuucuucuuccuggugcuggccgugcugggcgagacccugaucccccacuacagcggcagagugaucgacauccugggcggcgacuucgacccccacgccuucgccagcgccaucuucuucaugugccuguucagcuucggcagcagccugagcgccggcugcagaggcggcugcuucaccuacaccaugagcagaaucaaccugagaaucagagagcagcuguucagcagccugcugagacaggaccugggcuucuuccaggagaccaagaccggcgagcugaacagcagacugagcagcgacaccacccugaugagcaacuggcugccccugaacgccaacgugcugcugagaagccuggugaagguggugggccuguacggcuucaugcugagcaucagccccagacugacccugcugagccugcugcacaugcccuucaccaucgccgccgagaagguguacaacaccagacaccaggaggugcugagagagauccaggacgccguggccagagccggccagguggugagagaggccgugggcggccugcagaccgugagaagcuucggcgccgaggagcacgaggugugcagauacaaggaggcccuggagcagugcagacagcuguacuggagaagagaccuggagagagcccuguaccugcuggugagaagagugcugcaccugggcgugcagaugcugaugcugagcugcggccugcagcagaugcaggacggcgagcugacccagggcagccugcugagcuucaugaucuaccaggagagcgugggcagcuacgugcagacccugguguacaucuacggcgacaugcugagcaacgugggcgccgccgagaagguguucagcuacauggacagacagcccaaccugcccagccccggcacccuggcccccaccacccugcagggcguggugaaguuccaggacgugagcuucgccuaccccaacagacccgacagacccgugcugaagggccugaccuucacccugagacccggcgaggugaccgcccuggugggccccaacggcagcggcaagagcaccguggccgcccugcugcagaaccuguaccagcccaccggcggccaggugcugcuggacgagaagcccaucagccaguacgagcacugcuaccugcacagccagguggugagcgugggccaggagcccgugcuguucagcggcagcgugagaaacaacaucgccuacggccugcagagcugcgaggacgacaaggugauggccgccgcccaggccgcccacgccgacgacuucauccaggagauggagcacggcaucuacaccgacgugggcgagaagggcagccagcuggccgccggccagaagcagagacuggccaucgccagagcccuggugagagaccccagagugcugauccuggacgaggccaccagcgcccuggacgugcagugcgagcaggcccugcaggacuggaacagcagaggcgacagaaccgugcuggugaucgcccacagacugcaggccgugcagagagcccaccagauccuggugcugcaggagggcaagcugcagaagcuggcccagcugcaggagggccaggaccuguacagcagacuggugcagcagagacugauggacuaa

SEQ ID NO: 24363 - RNA, 1347 nt, Artificial Sequence
  TAPBP__Homo_sapiens__NP_003181
augaagagccugagccugcugcuggccguggcccugggccuggccaccgccgugagcgccggccccgccgugaucgagugcugguucguggaggacgccagcggcaagggccuggccaagagacccggcgcccugcugcugagacagggccccggcgagcccccccccagacccgaccuggaccccgagcuguaccugagcgugcacgaccccgccggcgcccugcaggccgccuucagaagauaccccagaggcgcccccgccccccacugcgagaugagcagauucgugccccugcccgccagcgccaagugggccagcggccugacccccgcccagaacugccccagagcccuggacggcgccuggcugauggugagcaucagcagccccgugcugagccugagcagccugcugagaccccagcccgagccccagcaggagcccgugcugaucaccauggccaccguggugcugaccgugcugacccacacccccgcccccagagugagacugggccaggacgcccugcuggaccugagcuucgccuacaugccccccaccagcgaggccgccagcagccuggcccccggccccccccccuucggccuggaguggagaagacagcaccugggcaagggccaccugcugcuggccgccacccccggccugaacggccagaugcccgccgcccaggagggcgccguggccuucgccgccugggacgacgacgagcccuggggccccuggaccggcaacggcaccuucuggcugcccaccgugcagcccuuccaggagggcaccuaccuggccaccauccaccugcccuaccugcagggccaggugacccuggagcuggccguguacaagccccccaaggugagccugaugcccgccacccuggccagagccgcccccggcgaggccccccccgagcugcugugccuggugagccacuucuaccccagcggcggccuggagguggagugggagcugagaggcggccccggcggcagaagccagaaggccgagggccagagauggcugagcgcccugagacaccacagcgacggcagcgugagccugagcggccaccugcagcccccccccgugaccaccgagcagcacggcgccagauacgccugcagaauccaccaccccagccugcccgccagcggcagaagcgccgaggugacccuggagguggccggccugagcggccccagccuggaggacagcgugggccuguuccugagcgccuuccugcugcugggccuguucaaggcccugggcugggccgccguguaccugagcaccugcaaggacagcaagaagaaggccgaguaa

SEQ ID NO: 24364 - RNA, 1407 nt, Artificial Sequence
  TAPBPL__Homo_sapiens__NP_060479
augggcacccaggagggcuggugccugcugcugugccuggcccugagcggcgccgccgagaccaagccccaccccgccgagggccaguggagagccguggacguggugcuggacugcuuccuggccaaggacggcgcccacagaggcgcccuggccagcagcgaggacagagccagagccagccuggugcugaagcaggugcccgugcuggacgacggcagccuggaggacuucaccgacuuccagggcggcacccuggcccaggacgacccccccaucaucuucgaggccagcguggaccuggugcagaucccccaggccgaggcccugcugcacgccgacugcagcggcaaggaggugaccugcgagaucagcagauacuuccugcagaugaccgagaccaccgugaagaccgccgccugguucauggccaacaugcaggugagcggcggcggccccagcaucagccuggugaugaagacccccagagugaccaagaacgaggcccuguggcaccccacccugaaccugccccugagcccccagggcaccgugagaaccgccguggaguuccaggugaugacccagacccagagccugagcuuccugcugggcagcagcgccagccuggacugcggcuucagcauggcccccggccuggaccugaucagcguggaguggagacugcagcacaagggcagaggccagcugguguacagcuggaccgccggccagggccaggccgugagaaagggcgccacccuggagcccgcccagcugggcauggccagagacgccagccugacccugcccggccugaccauccaggacgagggcaccuacaucugccagaucaccaccagccuguacagagcccagcagaucauccagcugaacauccaggccagccccaaggugagacugagccuggccaacgaggcccugcugcccacccugaucugcgacaucgccggcuacuacccccuggacgugguggugaccuggaccagagaggagcugggcggcagccccgcccaggugagcggcgccagcuucagcagccugagacagagcguggccggcaccuacagcaucagcagcagccugaccgccgagcccggcagcgccggcgccaccuacaccugccaggugacccacaucagccuggaggagccccugggcgccagcacccagguggugccccccgagagaagaaccgcccugggcgugaucuucgccagcagccuguuccugcuggcccugauguuccugggccugcagagaagacaggcccccaccggccugggccugcugcaggccgagagaugggagaccaccagcugcgccgacacccagagcagccaccugcacgaggacagaaccgccagagugagccagcccagcuaa

SEQ ID NO: 24365 - RNA, 4866 nt, Artificial Sequence
  TARBP1__Homo_sapiens__NP_005637
auggagugggugcuggccgaggcccugcugagccagagcagagaccccagagcccugcugggcgcccugugccagggcgaggccagcgccgagagaguggagacccugagauuccugcugcagagacuggaggacgaggaggccagaggcagcggcggcgccggcgcccugcccgaggccgccagagagguggccgccggcuaccuggugccccugcugagaagccugagaggcagacccgccggcggccccgaccccagccugcagcccagacacagaagaagagugcugagagccgccggcgccgcccugagaagcugcgugagacuggccggcagaccccagcuggccgccgcccuggccgaggaggcccugagagaccugcuggccggcuggagagcccccggcgccgaggccgccguggaggugcuggccgccgugggccccugccugagacccagagaggacggcccccugcuggagagaguggccggcaccgccguggcccuggcccugggcggcggcggcgacggcgacgaggccggccccgccgaggacgccgccgcccugguggccggcagacugcugcccgugcuggugcagugcggcggcgccgcccugagagccguguggggcggccuggccgcccccggcgccagccugggcagcggcagaguggaggagaagcugcuggugcugagcgcccuggccgagaagcugcugcccgagcccggcggcgacagagccagaggcgccagagaggccggccccgacgccagaagaugcuggagauucuggagaaccgugcaggccggccugggccaggccgacgcccugaccagaaagagagccagauaccugcugcagagagccguggaggugagcgccgagcugggcgccgacugcaccugcggcccccaggagggcaacggccccagccuguucugguggagcgagagaaagaaggacgagcugcugaaguucugggagaacuacauccugaucauggagacccuggagggcaaccagauccacgugaucaagcccgugcugcccaagcugaacaaccuguucgaguacgccgugagcgaggagaacggcugcuggcuguuccaccccagcuggcacaugugcaucuacaagagaauguucgagagcgagaacaagauccugagcaaggagggcgugauccacuuccuggagcuguacgagaccaagauccugcccuucagccccgaguucagcgaguucaucaucggcccccugauggacgcccugagcgagagcagccuguacagcagaagccccggccagcccaucggcagcugcagcccccugggccugaagcugcagaaguuccuggugaccuacaucagccugcugcccgaggagaucaagagcagcuuccugcugaaguucaucagaaagaugaccagcagacacuggugcgccgugcccauccuguuccugagcaaggcccuggccaacgugcccagacacaaggcccugggcaucgacggccugcuggcccugagagacgugauccacugcaccaugaucacccaccagauccugcugagaggcgccgcccagugcuaccugcugcagaccgccaugaaccugcuggacguggagaaggugagccugagcgacgugagcaccuuccugaugagccugagacaggaggagagccugggcagaggcaccagccuguggaccgagcugugcgacuggcugagagugaacgagagcuacuucaagcccagccccaccugcagcagcaucggccugcacaagaccagccugaacgccuacgugaagagcaucgugcaggaguacgugaagagcagcgccugggagaccggcgagaacugcuucaugcccgacugguucgaggccaagcuggugagccugauggugcugcuggccguggacguggagggcaugaagacccaguacagcggcaagcagagaaccgagaacgugcugagaaucuuccuggacccccugcuggacgugcugaugaaguucagcaccaacgccuacaugccccugcugaagaccgacagaugccugcagcugcugcugaagcugcugaacaccugcagacugaagggcagcagcgcccaggacgacgaggugagcaccgugcugcagaacuucuucaugagcaccaccgagagcaucagcgaguucauccugagaagacugaccaugaacgagcugaacagcgugagcgaccuggacagaugccaccuguaccugauggugcugaccgagcugaucaaccugcaccugaaggugggcuggaagagaggcaaccccaucuggagagugaucagccugcugaagaacgccagcauccagcaccugcaggagauggacagcggccaggagcccaccgugggcagccagauccagagaguggugagcauggccgcccuggccauggugugcgaggccaucgaccagaagcccgagcugcagcuggacagccugcacgccggcccccuggagagcuuccugagcagccugcagcugaaccagacccugcagaagccccacgccgaggagcagagcagcuacgcccacccccuggagugcagcagcgugcuggaggagagcagcagcagccagggcuggggcaagaucguggcccaguacauccacgaccagugggugugccugagcuuccugcugaagaaguaccacacccugauccccaccaccggcagcgagauccuggagcccuuccugcccgccgugcagaugcccaucagaacccugcagagcgcccuggaggcccugaccgugcugagcagcgaccaggugcugcccguguuccacugccugaaggugcuggugcccaagcugcugaccagcagcgagagccugugcaucgagagcuucgacauggccuggaagaucaucagcagccugagcaacacccagcugaucuucugggccaaccugaaggccuucgugcaguucguguucgacaacaaggugcugaccaucgccgccaagaucaagggccaggccuacuucaagaucaaggagaucauguacaagaucaucgagaugagcgccaucaagaccggcguguucaacacccugaucagcuacugcugccagagcuggaucgugagcgccagcaacgugagccagggcagccugagcagcgccaagaacuacagcgagcugauccuggaggccugcaucuucggcaccguguucagaagagaccagagacuggugcaggacgugcagaccuucaucgagaaccugggccacgacugcgccgccaacaucgugauggagaacaccaagagagaggaccacuacgugagaaucugcgccgugaaguuccugugccugcuggacggcagcaacaugagccacaagcuguucaucgaggaccuggccaucaagcugcuggacaaggacgagcuggugagcaagagcaagaagagauacuacgugaacagccugcagcacagagugaagaacagaguguggcagacccugcuggugcuguuccccagacuggaccagaacuuccugaacggcaucaucgacagaaucuuccaggccggcuucaccaacaaccaggccagcaucaaguacuucaucgaguggaucaucauccugauccugcacaaguucccccaguuccugcccaaguucugggacugcuucagcuacggcgaggagaaccugaagaccagcaucugcaccuuccuggccgugcugagccaccuggacaucaucacccagaacauccccgagaagaagcugauccugaagcaggcccugaucguggugcugcaguggugcuucaaccacaacuucagcgugagacuguacgcccugguggcccugaagaagcuguggaccgugugcaaggugcugagcguggaggaguucgacgcccugacccccgugaucgagagcagccugcaccagguggagagcaugcacggcgccggcaacgccaagaagaacuggcagagaauccaggagcacuucuucuucgccaccuuccacccccugaaggacuacugccuggagaccaucuucuacauccugcccagacugagcggccugaucgaggacgaguggaucaccaucgacaaguucaccagauucaccgacgugccccuggccgccggcuuccagugguaccugagccagacccagcugagcaagcugaagcccggcgacuggagccagcaggacaucggcaccaaccugguggaggccgacaaccaggccgaguggaccgacgugcagaagaagaucauccccuggaacagcagagugagcgaccuggaccuggagcugcuguuccaggacagagccgccagacugggcaagagcaucagcagacugaucgugguggccagccugaucgacaagcccaccaaccugggcggccugugcagaaccugcgagguguucggcgccagcgugcugguggugggcagccugcagugcaucagcgacaagcaguuccagcaccugagcgugagcgccgagcaguggcugccccugguggaggugaagcccccccagcugaucgacuaccugcagcagaagaagaccgagggcuacaccaucaucggcguggagcagaccgccaagagccuggaccugacccaguacugcuuccccgagaagagccugcugcugcugggcaacgagagagagggcauccccgccaaccugauccagcagcuggacgugugcguggagaucccccagcagggcaucaucagaagccugaacgugcacgugagcggcgcccugcugaucugggaguacaccagacagcagcugcugagccacggcgacaccaagcccuaa

SEQ ID NO: 24366 - RNA, 1101 nt, Artificial Sequence
  TARBP2__Homo_sapiens__NP_599150
augagcgaggaggagcagggcagcggcaccaccaccggcugcggccugcccagcaucgagcagaugcuggccgccaaccccggcaagacccccaucagccugcugcaggaguacggcaccagaaucggcaagacccccguguacgaccugcugaaggccgagggccaggcccaccagcccaacuucaccuucagagugaccgugggcgacaccagcugcaccggccagggccccagcaagaaggccgccaagcacaaggccgccgagguggcccugaagcaccugaagggcggcagcaugcuggagcccgcccuggaggacagcagcagcuucagcccccuggacagcagccugcccgaggacauccccguguucaccgccgccgccgccgccacccccgugcccagcguggugcugaccagaagcccccccauggagcugcagccccccgugagcccccagcagagcgagugcaaccccgugggcgcccugcaggagcugguggugcagaagggcuggagacugcccgaguacaccgugacccaggagagcggccccgcccacagaaaggaguucaccaugaccugcagaguggagagauucaucgagaucggcagcggcaccagcaagaagcuggccaagagaaacgccgccgccaagaugcugcugagagugcacaccgugccccuggacgccagagacggcaacgagguggagcccgacgacgaccacuucagcaucggcgugggcagcagacuggacggccugagaaacagaggccccggcugcaccugggacagccugagaaacagcgugggcgagaagauccugagccugagaagcugcagccugggcagccugggcgcccugggccccgccugcugcagagugcugagcgagcugagcgaggagcaggccuuccacgugagcuaccuggacaucgaggagcugagccugagcggccugugccagugccugguggagcugagcacccagcccgccaccgugugccacggcagcgccaccaccagagaggccgccagaggcgaggccgccagaagagcccugcaguaccugaagaucauggccggcagcaaguaa

SEQ ID NO: 24367 - RNA, 924 nt, Artificial Sequence
  TARP__Homo_sapiens__XP_011513708
auguucaucggcaacagcccccugcugcugaccgugggccugggccugagcaagguggagcaguuccagcugagcaucagcaccgaggugaagaagagcaucgacauccccugcaagaucagcagcaccagauucgagaccgacgugauccacugguacagacagaagcccaaccaggcccuggagcaccugaucuacaucgugagcaccaagagcgccgccagaagaagcaugggcaagaccagcaacaagguggaggccagaaagaacagccagacccugaccagcauccugaccaucaagagcguggagaaggaggacauggccguguacuacugcgccgccugggacuucggccacuacaagaagcuguucggcagcggcaccacccugguggugaccgacaagcagcuggacgccgacgugagccccaagcccaccaucuuccugcccagcaucgccgagaccaagcugcagaaggccggcaccuaccugugccugcuggagaaguucuuccccgacgugaucaagauccacuggcaggagaagaagagcaacaccauccugggcagccaggagggcaacaccaugaagaccaacgacaccuacaugaaguucagcuggcugaccgugcccgagaagagccuggacaaggagcacagaugcaucgugagacacgagaacaacaagaacggcguggaccaggagaucaucuucccccccaucaagaccgacgugaucaccauggaccccaaggacaacugcagcaaggacgccaacgacacccugcugcugcagcugaccaacaccagcgccuacuacauguaccugcugcugcugcugaagagcgugguguacuucgccaucaucaccugcugccugcugagaagaaccgccuucugcugcaacggcgagaagagcuaa

SEQ ID NO: 24368 - RNA, 2172 nt, Artificial Sequence
  TARS__Homo_sapiens__NP_001245366
auguucgaggagaaggccagcagccccagcggcaagaugggcggcgaggagaagcccaucggcgccggcgaggagaagcagaaggagggcggcaagaagaagaacaaggagggcagcggcgacggcggcagagccgagcugaaccccuggcccgaguacaucuacaccagacuggagauguacaacauccugaaggccgagcacgacagcauccuggccgagaaggccgagaaggacagcaagcccaucaaggugacccugcccgacggcaagcagguggacgccgagagcuggaagaccacccccuaccagaucgccugcggcaucagccagggccuggccgacaacaccgugaucgccaaggugaacaacguggugugggaccuggacagaccccuggaggaggacugcacccuggagcugcugaaguucgaggacgaggaggcccaggccguguacuggcacagcagcgcccacaucaugggcgaggccauggagagaguguacggcggcugccugugcuacggcccccccaucgagaacggcuucuacuacgacauguaccuggaggagggcggcgugagcagcaacgacuucagcagccuggaggcccugugcaagaagaucaucaaggagaagcaggccuucgagagacuggaggugaagaaggagacccugcuggccauguucaaguacaacaaguucaagugcagaauccugaacgagaaggugaacacccccaccaccaccguguacagaugcggcccccugaucgaccugugcagaggcccccacgugagacacaccggcaagaucaaggcccugaagauccacaagaacagcagcaccuacugggagggcaaggccgacauggagacccugcagagaaucuacggcaucagcuuccccgaccccaagaugcugaaggagugggagaaguuccaggaggaggccaagaacagagaccacagaaagaucggcagagaccaggagcuguacuucuuccacgagcugagccccggcagcugcuucuuccugcccaagggcgccuacaucuacaacgcccugaucgaguucaucagaagcgaguacagaaagagaggcuuccaggagguggugacccccaacaucuucaacagcagacuguggaugaccagcggccacuggcagcacuacagcgagaacauguucagcuucgagguggagaaggagcuguucgcccugaagcccaugaacugccccggccacugccugauguucgaccacagacccagaagcuggagagagcugccccugagacuggccgacuucggcgugcugcacagaaacgagcugagcggcgcccugaccggccugaccagagugagaagauuccagcaggacgacgcccacaucuucugcgccauggagcagaucgaggacgagaucaagggcugccuggacuuccugagaaccguguacagcguguucggcuucagcuucaagcugaaccugagcaccagacccgagaaguuccugggcgacaucgaggugugggaccaggccgagaagcagcuggagaacagccugaacgaguucggcgagaagugggagcugaacagcggcgacggcgccuucuacggccccaagaucgacauccagaucaaggacgccaucggcagauaccaccagugcgccaccauccagcuggacuuccagcugcccaucagauucaaccugaccuacgugagccacgacggcgacgacaagaagagacccgugaucgugcacagagccauccugggcagcguggagagaaugaucgccauccugaccgagaacuacggcggcaaguggcccuucuggcugagccccagacaggugaugguggugcccgugggccccaccugcgacgaguacgcccagaaggugagacagcaguuccacgacgccaaguucauggccgacaucgaccuggaccccggcugcacccugaacaagaagaucagaaacgcccagcuggcccaguacaacuucauccugguggugggcgagaaggagaagaucagcggcaccgugaacaucagaaccagagacaacaaggugcacggcgagagaaccaucagcgagaccaucgagagacugcagcagcugaaggaguucagaagcaagcaggccgaggaggaguucuaa

SEQ ID NO: 24369 - RNA, 2409 nt, Artificial Sequence
  TARSL2__Homo_sapiens__NP_689547
auggccgccgaggcccuggccgccgaggccguggccagcagacuggagagacaggaggaggacaucagauggcuguggagcgagguggagagacugagagacgagcagcugaacgcccccuacagcugccaggccgagggccccugccugaccagagagguggcccagcugagagccgagaacugcgaccugagacacagacugugcagccugagacugugccuggccgaggagagaagcagacaggccacccuggagagcgccgagcuggaggccgcccaggaggccggcgcccagcccccccccagccagagccaggacaaggacaugaagaagaagaagaugaaggagagcgaggccgacagcgaggugaagcaccagcccaucuucaucaaggagagacugaagcuguucgagauccugaagaaggaccaccagcugcugcuggccaucuacggcaagaagggcgacaccagcaacaucaucaccgugagaguggccgacggccagaccgugcagggcgagguguggaagaccacccccuaccagguggccgccgagaucagccaggagcuggccgagagcaccgugaucgccaaggugaacggcgagcugugggaccuggacagaccccuggagggcgacagcagccuggagcugcugaccuucgacaacgaggaggcccaggccguguacuggcacagcagcgcccacauccugggcgaggccauggagcuguacuacggcggccaccugugcuacggcccccccaucgagaacggcuucuacuacgacauguucaucgaggacagagccgugagcagcaccgagcugagcgcccuggagaacaucugcaaggccaucaucaaggagaagcagcccuucgagagacuggaggugagcaaggagauccugcuggagauguucaaguacaacaaguucaagugcagaauccugaacgagaaggugaacaccgccaccaccaccguguacagaugcggcccccugaucgaccugugcaagggcccccacgugagacacaccggcaagaucaagaccaucaagaucuucaagaacagcagcaccuacugggagggcaaccccgagauggagacccugcagagaaucuacggcaucagcuuccccgacaacaagaugaugagagacugggagaaguuccaggaggaggccaagaacagagaccacagaaagaucggcaaggagcaggagcuguucuucuuccacgaccugagccccggcagcugcuucuuccugcccagaggcgccuucaucuacaacacccugaccgacuucaucagagaggaguaccacaagagagacuucaccgaggugcugagccccaacauguacaacagcaagcugugggaggccagcggccacuggcagcacuacagcgagaacauguucaccuucgagaucgagaaggacaccuucgcccugaagcccaugaacugccccggccacugccugauguucgcccacagacccagaagcuggagagagaugcccaucagauucgccgacuucggcgugcugcacagaaacgagcugagcggcacccugagcggccugaccagagugagaagauuccagcaggacgacgcccacaucuucugcaccguggagcagaucgaggaggagaucaagggcugccugcaguuccugcagagcguguacagcaccuucggcuucagcuuccagcugaaccugagcaccagacccgagaacuuccugggcgagaucgagauguggaacgaggccgagaagcagcugcagaacagccugauggacuucggcgagcccuggaagaugaaccccggcgacggcgccuucuacggccccaagaucgacaucaagaucaaggacgccaucggcagauaccaccagugcgccaccauccagcuggacuuccagcugcccaucagauucaaccugaccuacgugagcaaggacggcgacgacaagaagagacccgugaucauccacagagccauccugggcagcguggagagaaugaucgccauccugagcgagaacuacggcggcaaguggcccuucuggcugagccccagacaggugauggugauccccgugggccccaccugcgagaaguacgcccugcaggugagcagcgaguucuucgaggagggcuucauggccgacguggaccuggaccacagcugcacccugaacaagaagaucagaaacgcccagcuggcccaguacaacuucauccugguggugggcgagaaggagaagaucgacaacgccgugaacgugagaaccagagacaacaagauccacggcgagauccuggugaccagcgccaucgacaagcugaagaaccugagaaagaccagaacccugaacgccgaggaggccuucuaa

SEQ ID NO: 24370 - RNA, 924 nt, Artificial Sequence
  TAS2R10__Homo_sapiens__NP_076410
augcugagagugguggagggcaucuucaucuucgugguggugagcgagagcguguucggcgugcugggcaacggcuucaucggccuggugaacugcaucgacugcgccaagaacaagcugagcaccaucggcuucauccugaccggccuggccaucagcagaaucuuccugaucuggaucaucaucaccgacggcuucauccagaucuucagccccaacaucuacgccagcggcaaccugaucgaguacaucagcuacuucugggugaucggcaaccagagcagcaugugguucgccaccagccugagcaucuucuacuuccugaagaucgccaacuucagcaacuacaucuuccuguggcugaagagcagaaccaacauggugcugcccuucaugaucguguuccugcugaucagcagccugcugaacuucgccuacaucgccaagauccugaacgacuacaagaccaagaacgacaccgugugggaccugaacauguacaagagcgaguacuucaucaagcagauccugcugaaccugggcgugaucuucuucuucacccugagccugaucaccugcaucuuccugaucaucagccuguggagacacaacagacagaugcagagcaacgugaccggccugagagacagcaacaccgaggcccacgugaaggccaugaaggugcugaucagcuucaucauccuguucauccuguacuucaucggcauggccaucgagaucagcugcuucaccgugagagagaacaagcugcugcugauguucggcaugaccaccaccgccaucuaccccuggggccacagcuucauccugauccugggcaacagcaagcugaagcaggccagccugagagugcugcagcagcugaagugcugcgagaagagaaagaaccugagagugaccuaa

SEQ ID NO: 24371 - RNA, 912 nt, Artificial Sequence
  TAS2R13__Homo_sapiens__NP_076409
auggagagcgcccugcccagcaucuucacccuggugaucaucgccgaguucaucaucggcaaccugagcaacggcuucaucgugcugaucaacugcaucgacugggugagcaagagagagcugagcagcguggacaagcugcugaucauccuggccaucagcagaaucggccugaucugggagauccuggugagcugguuccuggcccugcacuaccuggccaucuucgugagcggcaccggccugagaaucaugaucuucagcuggaucgugagcaaccacuucaaccuguggcuggccaccaucuucagcaucuucuaccugcugaagaucgccagcuucagcagccccgccuuccuguaccugaaguggagagugaacaaggugauccugaugauccugcugggcacccugguguuccuguuccugaaccugauccagaucaacaugcacaucaaggacuggcuggacagauacgagagaaacaccaccuggaacuucagcaugagcgacuucgagaccuucagcgugagcgugaaguucaccaugaccauguucagccugacccccuucaccguggccuucaucagcuuccugcugcugaucuucagccugcagaagcaccugcagaagaugcagcugaacuacaagggccacagagaccccagaaccaaggugcacaccaacgcccugaagaucgugaucagcuuccugcuguucuacgccagcuucuuccugugcgugcugaucagcuggaucagcgagcuguaccagaacaccgugaucuacaugcugugcgagaccaucggcguguucagccccagcagccacagcuuccugcugauccugggcaacgccaagcugagacaggccuuccugcugguggccgccaaggugugggccaagagauaa

SEQ ID NO: 24372 - RNA, 954 nt, Artificial Sequence
  TAS2R14__Homo_sapiens__NP_076411
augggcggcgugaucaagagcaucuucaccuucgugcugaucguggaguucaucaucggcaaccugggcaacagcuucaucgcccuggugaacugcaucgacugggugaagggcagaaagaucagcagcguggacagaauccugaccgcccuggccaucagcagaaucagccugguguggcugaucuucggcagcuggugcgugagcguguucuuccccgcccuguucgccaccgagaagauguucagaaugcugaccaacaucuggaccgugaucaaccacuucagcguguggcuggccaccggccugggcaccuucuacuuccugaagaucgccaacuucagcaacagcaucuuccuguaccugaaguggagagugaagaagguggugcuggugcugcugcuggugaccagcguguuccuguuccugaacaucgcccugaucaacauccacaucaacgccagcaucaacggcuacagaagaaacaagaccugcagcagcgacagcagcaacuucaccagauucagcagccugaucgugcugaccagcaccguguucaucuucauccccuucacccugagccuggccauguuccugcugcugaucuucagcauguggaagcacagaaagaagaugcagcacaccgugaagaucagcggcgacgccagcaccaaggcccacagaggcgugaagagcgugaucaccuucuuccugcuguacgccaucuucagccugagcuucuucaucagcguguggaccagcgagagacuggaggagaaccugaucauccugagccaggugaugggcauggccuaccccagcugccacagcugcgugcugauccugggcaacaagaagcugagacaggccagccugagcgugcugcuguggcugagauacauguucaaggacggcgagcccagcggccacaaggaguucagagagagcagcuaa

SEQ ID NO: 24373 - RNA, 876 nt, Artificial Sequence
  TAS2R16__Homo_sapiens__NP_058641
augauccccauccagcugaccguguucuucaugaucaucuacgugcuggagagccugaccaucaucgugcagagcagccugaucguggccgugcugggcagagaguggcugcaggugagaagacugaugcccguggacaugauccugaucagccugggcaucagcagauucugccugcagugggccagcaugcugaacaacuucugcagcuacuucaaccugaacuacgugcugugcaaccugaccaucaccugggaguucuucaacauccugaccuucuggcugaacagccugcugaccguguucuacugcaucaaggugagcagcuucacccaccacaucuuccuguggcugagauggagaauccugagacuguuccccuggauccugcugggcagccugaugaucaccugcgugaccaucauccccagcgccaucggcaacuacauccagauccagcugcugaccauggagcaccugcccagaaacagcaccgugaccgacaagcuggagaacuuccaccaguaccaguuccaggcccacaccguggcccuggugauccccuucauccuguuccuggccagcaccaucuuccugauggccagccugaccaagcagauccagcaccacagcaccggccacugcaaccccagcaugaaggccagauucaccgcccugagaagccuggccgugcuguucaucguguucaccagcuacuuccugaccauccugaucaccaucaucggcacccuguucgacaagagaugcuggcugugggugugggaggccuucguguacgccuucauccugaugcacagcaccagccugaugcugagcagccccacccugaagagaauccugaagggcaagugcuaa

SEQ ID NO: 24374 - RNA, 900 nt, Artificial Sequence
  TAS2R1__Homo_sapiens__NP_062545
augcuggagagccaccugaucaucuacuuccugcuggccgugauccaguuccugcugggcaucuucaccaacggcaucaucgugguggugaacggcaucgaccugaucaagcacagaaagauggccccccuggaccugcugcugagcugccuggccgugagcagaaucuuccugcagcuguucaucuucuacgugaacgugaucgugaucuucuucaucgaguucaucaugugcagcgccaacugcgccauccugcuguucaucaacgagcuggagcuguggcuggccaccuggcugggcguguucuacugcgccaagguggccagcgugagacacccccuguucaucuggcugaagaugagaaucagcaagcuggugcccuggaugauccugggcagccugcuguacgugagcaugaucugcguguuccacagcaaguacgccggcuucauggugcccuacuuccugagaaaguucuucagccagaacgccaccauccagaaggaggacacccuggccauccagaucuucagcuucguggccgaguucagcgugccccugcugaucuuccuguucgccgugcugcugcugaucuucagccugggcagacacaccagacagaugagaaacaccguggccggcagcagagugcccggcagaggcgcccccaucagcgcccugcugagcauccugagcuuccugauccuguacuucagccacugcaugaucaagguguuccugagcagccugaaguuccacaucagaagauucaucuuccuguucuucauccuggugaucggcaucuaccccagcggccacagccugauccugauccugggcaaccccaagcugaagcagaacgccaagaaguuccugcugcacagcaagugcugccaguaa

SEQ ID NO: 24375 - RNA, 1002 nt, Artificial Sequence
  TAS2R38__Homo_sapiens__NP_789787
augcugacccugaccagaaucagaaccgugagcuacgaggugagaagcaccuuccuguucaucagcgugcuggaguucgccgugggcuuccugaccaacgccuucguguuccuggugaacuucugggacguggugaagagacaggcccugagcaacagcgacugcgugcugcugugccugagcaucagcagacuguuccugcacggccugcuguuccugagcgccauccagcugacccacuuccagaagcugagcgagccccugaaccacagcuaccaggccaucaucaugcuguggaugaucgccaaccaggccaaccuguggcuggccgccugccugagccugcuguacugcagcaagcugaucagauucagccacaccuuccugaucugccuggccagcugggugagcagaaagaucagccagaugcugcugggcaucauccugugcagcugcaucugcaccgugcugugcguguggugcuucuucagcagaccccacuucaccgugaccaccgugcuguucaugaacaacaacaccagacugaacuggcagaucaaggaccugaaccuguucuacagcuuccuguucugcuaccuguggagcgugccccccuuccugcuguuccuggugagcagcggcaugcugaccgugagccugggcagacacaugagaaccaugaagguguacaccagaaacagcagagaccccagccuggaggcccacaucaaggcccugaagagccuggugagcuucuucugcuucuucgugaucagcagcugcguggccuucaucagcgugccccugcugauccuguggagagacaagaucggcgugauggugugcgugggcaucauggccgccugccccagcggccacgccgccauccugaucagcggcaacgccaagcugagaagagccgugaugaccauccugcugugggcccagagcagccugaaggugagagccgaccacaaggccgacagcagaacccugugcuaa

SEQ ID NO: 24376 - RNA, 900 nt, Artificial Sequence
  TAS2R50__Homo_sapiens__NP_795371
augaucaccuuccuguacaucuucuucagcauccugaucauggugcuguucgugcugggcaacuucgccaacggcuucaucgcccuggugaacuucaucgacugggugaagagaaagaagaucagcagcgccgaccagauccugaccgcccuggccgugagcagaaucggccugcugugggcccugcugcugaacugguaccugaccgugcugaaccccgccuucuacagcguggagcugagaaucaccagcuacaacgccuggguggugaccaaccacuucagcauguggcuggccgccaaccugagcaucuucuaccugcugaagaucgccaacuucagcaaccugcuguuccugcaccugaagagaagagugagaagcgugauccuggugauccugcugggcacccugaucuuccuggugugccaccugcugguggccaacauggacgagagcaugugggccgaggaguacgagggcaacaugaccggcaagaugaagcugagaaacaccgugcaccugagcuaccugaccgugaccacccuguggagcuucauccccuucacccugagccugaucagcuuccugaugcugaucugcagccugugcaagcaccugaagaagaugcagcugcacggcgagggcagccaggaccugagcaccaaggugcacaucaaggcccugcagacccugaucagcuuccugcugcugugcgccaucuucuuccuguuccugaucgugagcguguggagccccagaagacugagaaacgaccccguggugauggugagcaaggccgugggcaacaucuaccuggccuucgacagcuucauccugaucuggagaaccaagaagcugaagcacaccuuccugcugauccugugccagaucagaugcuaa

SEQ ID NO: 24377 - RNA, 957 nt, Artificial Sequence
  TAS2R60__Homo_sapiens__NP_803186
augaacggcgaccacauggugcugggcagcagcgugaccgacaagaaggccaucauccuggugaccauccugcugcugcugagacugguggccaucgccggcaacggcuucaucaccgccgcccugggcguggagugggugcugagaagaaugcugcugcccugcgacaagcugcuggugagccugggcgccagcagauucugccugcagagcguggugaugggcaagaccaucuacguguuccugcaccccauggccuuccccuacaaccccgugcugcaguuccuggccuuccagugggacuuccugaacgccgccacccuguggagcagcaccuggcugagcguguucuacugcgugaagaucgccaccuucacccaccccguguucuucuggcugaagcacaagcugagcggcuggcugcccuggaugcuguucagcagcgugggccugagcagcuucaccaccauccuguucuucaucggcaaccacagaauguaccagaacuaccugagaaaccaccugcagcccuggaacgugaccggcgacagcaucagaagcuacugcgagaaguucuaccuguucccccugaagaugaucaccuggaccaugcccaccgccguguucuucaucugcaugauccugcugaucaccagccugggcagacacagaaagaaggcccugcugaccaccagcggcuucagagagcccagcgugcaggcccacaucaaggcccugcuggcccugcugagcuucgccaugcuguucaucagcuacuuccugagccugguguucagcgccgccggcaucuuccccccccuggacuucaaguucugggugugggagagcgugaucuaccugugcgccgccgugcaccccaucauccugcuguucagcaacugcagacugagagccgugcugaagagcagaagaagcagcagaugcggcacccccuaa

SEQ ID NO: 24378 - RNA, 939 nt, Artificial Sequence
  TAS2R9__Homo_sapiens__NP_076406
augcccagcgccaucgaggccaucuacaucauccugaucgccggcgagcugaccaucggcaucuggggcaacggcuucaucgugcuggugaacugcaucgacuggcugaagagaagagacaucagccugaucgacaucauccugaucagccuggccaucagcagaaucugccugcugugcgugaucagccuggacggcuucuucaugcugcuguuccccggcaccuacggcaacagcgugcuggugagcaucgugaacgugguguggaccuucgccaacaacagcagccugugguucaccagcugccugagcaucuucuaccugcugaagaucgccaacaucagccaccccuucuucuucuggcugaagcugaagaucaacaaggugaugcuggccauccugcugggcagcuuccugaucagccugaucaucagcgugcccaagaacgacgacaugugguaccaccuguucaaggugagccacgaggagaacaucaccuggaaguucaaggugagcaagauccccggcaccuucaagcagcugacccugaaccugggcgugauggugcccuucauccugugccugaucagcuucuuccugcugcuguucagccuggugagacacaccaagcagaucagacugcacgccaccggcuucagagaccccagcaccgaggcccacaugagagccaucaaggccgugaucaucuuccugcugcugcugaucguguacuaccccguguuccuggugaugaccagcagcgcccugaucccccagggcaagcuggugcugaugaucggcgacaucgugaccgugaucuuccccagcagccacagcuucauccugaucaugggcaacagcaagcugagagaggccuuccugaagaugcugagauucgugaagugcuuccugagaagaagaaagcccuucgugcccuaa

SEQ ID NO: 24379 - RNA, 1263 nt, Artificial Sequence
  TASP1__Homo_sapiens__NP_060184
augaccauggagaagggcaugagcagcggcgagggccugcccagcagaagcagccaggugagcgccggcaagaucaccgccaaggagcuggagaccaagcagagcuacaaggagaagagaggcggcuucgugcuggugcacgccggcgccggcuaccacagcgagagcaaggccaaggaguacaagcacgugugcaagagagccugccagaaggccaucgagaagcugcaggccggcgcccuggccaccgacgccgugaccgccgcccugguggagcuggaggacagccccuucaccaacgccggcaugggcagcaaccugaaccugcugggcgagaucgagugcgacgccagcaucauggacggcaagagccugaacuucggcgccgugggcgcccugagcggcaucaagaaccccgugagcguggccaacagacugcugugcgagggccagaagggcaagcugagcgccggcagaaucccccccugcuuccuggugggcgagggcgccuacagaugggccguggaccacggcauccccagcugcccccccaacaucaugaccaccagauucagccuggccgccuucaagagaaacaagagaaagcuggagcuggccgagagaguggacaccgacuucaugcagcugaagaagagaagacagagcagcgagaaggagaacgacagcggcacccuggacaccgugggcgccguggugguggaccacgagggcaacguggccgccgccgugagcagcggcggccuggcccugaagcaccccggcagagugggccaggccgcccuguacggcugcggcugcugggccgagaacaccggcgcccacaaccccuacagcaccgccgugagcaccagcggcugcggcgagcaccuggugagaaccauccuggccagagagugcagccacgcccugcaggccgaggacgcccaccaggcccugcuggagaccaugcagaacaaguucaucagcagccccuuccuggccagcgaggacggcgugcugggcggcgugaucgugcugagaagcugcagaugcagcgccgagcccgacagcagccagaacaagcagacccugcugguggaguuccuguggagccacaccaccgagagcaugugcgugggcuacaugagcgcccaggacggcaaggccaagacccacaucagcagacugccccccggcgccguggccggccagagcguggccaucgagggcggcgugugcagacuggagagccccgugaacuaa

SEQ ID NO: 24380 - RNA, 753 nt, Artificial Sequence
  TATDN1__Homo_sapiens__NP_001139632
augaucaccggcggcaaccugcaggacagcaaggacgcccugcaccuggcccagaccaacggcauguucuucagcaccgugggcugccaccccaccagaugcggcgaguucgagaagaacaaccccgaccuguaccugaaggagcugcugaaccuggccgagaacaacaagggcaaggugguggccaucggcgagugcggccuggacuucgacagacugcaguucugccccaaggacacccagcugaaguacuucgagaagcaguucgagcugagcgagcagaccaagcugcccauguuccugcacugcagaaacagccacgccgaguuccuggacaucaugaagagaaacagagacagaugcgugggcggcguggugcacagcuucgacggcaccaaggaggccgccgccgcccugaucgaccuggaccuguacaucggcuucaacggcugcagccugaagaccgaggccaaccuggaggugcugaagagcauccccagcgagaagcugaugaucgagaccgacgcccccuggugcggcgugaagagcacccacgccggcagcaaguacaucagaaccgccuuccccaccaagaagaagugggagagcggccacugccugaaggacagaaacgagcccugccacaucauccagauccuggagaucaugagcgccgugagagacgaggacccccuggagcuggccaacacccuguacaacaacaccaucaagguguucuuccccggcaucuaa

SEQ ID NO: 24381 - RNA, 1365 nt, Artificial Sequence
  TAT__Homo_sapiens__NP_000344
auggaccccuacaugauccagaugagcagcaagggcaaccugcccagcauccuggacgugcacgugaacgugggcggcagaagcagcgugcccggcaagaugaagggcagaaaggccagauggagcgugagacccagcgacauggccaagaagaccuucaaccccaucagagccaucguggacaacaugaaggugaagcccaaccccaacaagaccaugaucagccugagcaucggcgaccccaccguguucggcaaccugcccaccgaccccgaggugacccaggccaugaaggacgcccuggacagcggcaaguacaacggcuacgcccccagcaucggcuuccugagcagcagagaggagaucgccagcuacuaccacugccccgaggccccccuggaggccaaggacgugauccugaccagcggcugcagccaggccaucgaccugugccuggccgugcuggccaaccccggccagaacauccuggugcccagacccggcuucagccuguacaagacccuggccgagagcaugggcaucgaggugaagcuguacaaccugcugcccgagaagagcugggagaucgaccugaagcagcuggaguaccugaucgacgagaagaccgccugccugaucgugaacaaccccagcaaccccugcggcagcguguucagcaagagacaccugcagaagauccuggccguggccgccagacagugcgugcccauccuggccgacgagaucuacggcgacaugguguucagcgacugcaaguacgagccccuggccacccugagcaccgacgugcccauccugagcugcggcggccuggccaagagauggcuggugcccggcuggagacugggcuggauccugauccacgacagaagagacaucuucggcaacgagaucagagacggccuggugaagcugagccagagaauccugggccccugcaccaucgugcagggcgcccugaagagcauccugugcagaacccccggcgaguucuaccacaacacccugagcuuccugaagagcaacgccgaccugugcuacggcgcccuggccgccauccccggccugagacccgugagacccagcggcgccauguaccugauggugggcaucgagauggagcacuuccccgaguucgagaacgacguggaguucaccgagagacugguggccgagcagagcgugcacugccugcccgccaccugcuucgaguaccccaacuucaucagaguggugaucaccgugcccgaggugaugaugcuggaggccugcagcagaauccaggaguucugcgagcagcacuaccacugcgccgagggcagccaggaggagugcgacaaguaa

SEQ ID NO: 24382 - RNA, 2244 nt, Artificial Sequence
  TAX1BP1__Homo_sapiens__NP_001073333
augaccagcuuccaggaggugccccugcagaccagcaacuucgcccacgugaucuuccagaacguggccaagagcuaccugcccaacgcccaccuggagugccacuacacccugacccccuacauccacccccaccccaaggacugggugggcaucuucaaggugggcuggagcaccgccagagacuacuacaccuuccuguggagccccaugcccgagcacuacguggagggcagcaccgugaacugcgugcuggccuuccagggcuacuaccugcccaacgacgacggcgaguucuaccaguucugcuacgugacccacaagggcgagaucagaggcgccagcacccccuuccaguucagagccagcagccccguggaggagcugcugaccauggaggacgagggcaacagcgacaugcugguggugaccaccaaggccggccugcuggagcugaagaucgagaagaccaugaaggagaaggaggagcugcugaagcugaucgccgugcuggagaaggagaccgcccagcugagagagcaggugggcagaauggagagagagcugaaccacgagaaggagagaugcgaccagcugcaggccgagcagaagggccugaccgaggugacccagagccugaagauggagaacgaggaguucaagaagagauucagcgacgccaccagcaaggcccaccagcuggaggaggacaucgugagcgugacccacaaggccaucgagaaggagaccgagcuggacagccugaaggacaagcugaagaaggcccagcacgagagagagcagcuggagugccagcugaagaccgagaaggacgagaaggagcuguacaaggugcaccugaagaacaccgagaucgagaacaccaagcugaugagcgaggugcagacccugaagaaccuggacggcaacaaggagagcgugaucacccacuucaaggaggagaucggcagacugcagcugugccuggccgagaaggagaaccugcagagaaccuuccugcugaccaccagcagcaaggaggacaccugcuuccugaaggagcagcugagaaaggccgaggagcaggugcaggccaccagacaggaggugguguuccuggccaaggagcugagcgacgccgugaacgugagagacagaaccauggccgaccugcacaccgccagacuggagaacgagaaggugaagaagcagcuggccgacgccguggccgagcugaagcugaacgccaugaagaaggaccaggacaagaccgacacccuggagcacgagcugagaagagagguggaggaccugaagcugagacugcagauggccgccgaccacuacaaggagaaguucaaggagugccagagacugcagaagcagaucaacaagcugagcgaccagagcgccaacaacaacaacguguucaccaagaagaccggcaaccagcagaaggugaacgacgccagcgugaacaccgaccccgccaccagcgccagcaccguggacgugaagcccagccccagcgccgccgaggccgacuucgacaucgugaccaagggccaggugugcgagaugaccaaggagaucgccgacaagaccgagaaguacaacaagugcaagcagcugcugcaggacgagaaggccaagugcaacaaguacgccgacgagcuggccaagauggagcugaaguggaaggagcaggugaagaucgccgagaacgugaagcuggagcuggccgaggugcaggacaacuacaaggagcugaagagaagccuggagaaccccgccgagagaaagauggaggacggcgccgacggcgccuucuaccccgacgagauccagagaccccccgugagagugcccagcuggggccuggaggacaacguggugugcagccagcccgccagaaacuucagcagacccgacggccuggaggacagcgaggacagcaaggaggacgagaacgugcccaccgcccccgacccccccagccagcaccugagaggccacggcaccggcuucugcuucgacagcagcuucgacgugcacaagaagugcccccugugcgagcugauguucccccccaacuacgaccagagcaaguucgaggagcacguggagagccacuggaaggugugccccaugugcagcgagcaguucccccccgacuacgaccagcagguguucgagagacacgugcagacccacuucgaccagaacgugcugaacuucgacuaa

SEQ ID NO: 24383 - RNA, 375 nt, Artificial Sequence
  TAX1BP3__Homo_sapiens__NP_055419
augagcuacauccccggccagcccgugaccgccguggugcagagaguggagauccacaagcugagacagggcgagaaccugauccugggcuucagcaucggcggcggcaucgaccaggaccccagccagaaccccuucagcgaggacaagaccgacaagggcaucuacgugaccagagugagcgagggcggccccgccgagaucgccggccugcagaucggcgacaagaucaugcaggugaacggcugggacaugaccauggugacccacgaccaggccagaaagagacugaccaagagaagcgaggagguggugagacugcuggugaccagacagagccugcagaaggccgugcagcagagcaugcugagcuaa

SEQ ID NO: 24384 - RNA, 879 nt, Artificial Sequence
  TAZ__Homo_sapiens__NP_000107
augccccugcacgugaaguggcccuuccccgccgugcccccccugaccuggacccuggccagcagcguggugaugggccuggugggcaccuacagcugcuucuggaccaaguacaugaaccaccugaccgugcacaacagagaggugcuguacgagcugaucgagaagagaggccccgccaccccccugaucaccgugagcaaccaccagagcugcauggacgacccccaccuguggggcauccugaagcugagacacaucuggaaccugaagcugaugagauggacccccgccgccgccgacaucugcuucaccaaggagcugcacagccacuucuucagccugggcaagugcgugcccgugugcagaggcgccgaguucuuccaggccgagaacgagggcaagggcgugcuggacaccggcagacacaugcccggcgccggcaagagaagagagaagggcgacggcguguaccagaagggcauggacuucauccuggagaagcugaaccacggcgacugggugcacaucuuccccgagggcaaggugaacaugagcagcgaguuccugagauucaaguggggcaucggcagacugaucgccgagugccaccugaaccccaucauccugccccuguggcacgugggcaugaacgacgugcugcccaacagcccccccuacuuccccagauucggccagaagaucaccgugcugaucggcaagcccuucagcgcccugcccgugcuggagagacugagagccgagaacaagagcgccguggagaugagaaaggcccugaccgacuucauccaggaggaguuccagcaccugaagacccaggccgagcagcugcacaaccaccugcagcccggcagauaa

SEQ ID NO: 24385 - RNA, 1482 nt, Artificial Sequence
  TBATA__Homo_sapiens__XP_011537769
auggccaccgacgugcagcuggccgacuacccccugaugagccccagaagccugagaggcgaguggagaauggagcaggagacccagggccccagccaguggagcccccagagagugagaggcagacacgcccugcugagcaccagcagagugcaccuguacagcaagagaacccccuucagccagggccacagagagaagggcaugcagaccgccaucagccccaaggccgagcugaagcuggagaagaagagcggcagaaagcccagaagccccagagacagcggcccccagaaggagcuggugauccccggcaucguggacuucgagagaaucagaagagcccugagaacccccaagccccagacccccggcaccuacugcuucggcagacugagccaccacagcuucuucagcagacaccacccccacccccagcacgugacccacauccaggaccugaccggcaagcccgugugcguggugagagacuuccccgccccccugcccgagagcaccguguucagcggcugccagaugggcauccccaccaucagcgugcccaucggcgacccccagagcaacagaaacccccagcugagcagcgccuggaagaaggagcugaaggagcuggccagcagaguggccuuccugaccaaggaggacgagcugaagaagaaggaggacaccaccagccugaacuggaacugcaagagcagaagaccccaggcccccggccugagcggcaccgaccugggcgccgccgagcugggcaucaagaaggagcagaaggaggagccccugagagagcagggcgccaaguacagcgccgagaccggcagacugauccccgccagcaccagagccgugggcagaagaagaagccaccagggccagcagagccagagcagcagcagacacgagggcgugcaggccuuccugcugcaggaccaggagcugcuggugcuggagcugcugugcagaauccuggagaccgaccugcugagcgccauccaguucuggcugcuguacgccccccccaaggagaaggaccuggcccugggccugcugcagaccgccguggcccagcugcugccccagccccuggugagcauccccaccgagaagcugcugagccagcugcccgaggugcacgagcccccccaggagaagcaggagccccccugcagaugggccccccaccccgcccugcccuucugcagccugcugagcagccagagcauccccgaggagaacgaggacaucaccuucuacaagaagagaaagaccagagugcacuggagaagcagcagcccccccgacgccuucaagcccgagcacagagaggaggacaucgaggccgagggcagagagcugagaggccccaacaccugcaccugccuggcccaggagcagccccagggcuucagaggcgugagcgugagcaccaccuucaccgccgugcccgacagccugcccuaa

SEQ ID NO: 24386 - RNA, 2025 nt, Artificial Sequence
  TBC1D15__Homo_sapiens__NP_001139685
auggccgccgccggcguggugagcggcaagaucaucuacgagcaggagggcguguacauccacagcagcugcggcaagaccaacgaccaggacggccugaucagcggcauccugagagugcuggagaaggacgccgaggugaucguggacuggagaccccuggacgacgcccuggacagcagcagcauccuguacgccagaaaggacagcagcagcgugguggaguggacccaggcccccaaggagagaggccacagaggcagcgagcaccugaacagcuacgaggccgagugggacauggugaacaccgugagcuucaagagaaagccccacaccaacggcgacgcccccagccacagaaacggcaagagcaaguggagcuuccuguucagccugaccgaccugaagagcaucaagcagaacaaggagggcaugggcuggagcuaccugguguucugccugaaggacgacguggugcugcccgcccugcacuuccaccagggcgacagcaagcugcugaucgagagccuggagaaguacguggugcugugcgagagcccccaggacaagagaacccugcuggugaacugccagaacaagagccugagccagagcuucgagaaccugcuggacgagcccgccuacggccugauccagaagaucaagaaggaccccuacaccgccaccaugaucggcuucagcaaggugaccaacuacaucuucgacagccugagaggcagcgaccccagcacccaccagagaccccccagcgagauggccgacuuccugagcgacgccauccccggccugaagaucaaccagcaggaggagcccggcuucgaggugaucaccagaaucgaccugggcgagagacccguggugcagagaagagagcccgugagccuggaggaguggaccaagaacaucgacagcgagggcagaauccugaacguggacaacaugaagcagaugaucuucagaggcggccugagccacgcccugagaaagcaggccuggaaguuccugcugggcuacuuccccugggacagcaccaaggaggagagaacccagcugcagaagcagaagaccgacgaguacuucagaaugaagcugcaguggaagagcaucagccaggagcaggagaagagaaacagcagacugagagacuacagaagccugaucgagaaggacgugaacagaaccgacagaaccaacaaguucuacgagggccaggacaaccccggccugauccugcugcacgacauccugaugaccuacugcauguacgacuucgaccugggcuacgugcagggcaugagcgaccugcugagcccccugcuguacgugauggagaacgagguggacgccuucuggugcuucgccagcuacauggaccagaugcaccagaacuucgaggagcagaugcagggcaugaagacccagcugauccagcugagcacccugcugagacugcuggacagcggcuucugcagcuaccuggagagccaggacagcggcuaccuguacuucugcuucagauggcugcugaucagauucaagagagaguucagcuuccuggacauccugagacugugggaggugauguggaccgagcugcccugcaccaacuuccaccugcugcugugcugcgccauccuggagagcgagaagcagcagaucauggagaagcacuacggcuucaacgagauccugaagcacaucaacgagcugagcaugaagaucgacguggaggacauccugugcaaggccgaggccaucagccugcagauggugaagugcaaggagcugccccaggccgugugcgagauccugggccugcagggcagcgaggugaccacccccgacagcgacgugggcgaggacgagaacguggugaugacccccugccccaccagcgccuuccagagcaacgcccugcccacccugagcgccagcggcgccagaaacgacagccccacccagauccccgugagcagcgacgugugcagacugacccccgccuaa

SEQ ID NO: 24387 - RNA, 1218 nt, Artificial Sequence
  TBC1D16__Homo_sapiens__NP_001258774
augaagguggcccccgacaagaccugcaugcaguucagcaucagaagacccaagcugcccagcagcgagacccaccccgaggagagcauguacaagagacugggcgugagcgccuggcugaaccaccugaacgagcugggccagguggaggaggaguacaagcugagaaaggccaucuucuucggcggcaucgacgugagcaucagaggcgagguguggcccuuccugcugagauacuacagccacgagagcaccagcgaggagagagaggcccugagacugcagaagagaaaggaguacagcgagauccagcagaagagacugagcaugacccccgaggagcacagagccuucuggagaaacgugcaguucaccguggacaaggacguggugagaaccgacagaaacaaccaguucuucagaggcgaggacaaccccaacguggagagcaugagaagaauccugcugaacuacgccguguacaaccccgccgugggcuacagccagggcaugagcgaccugguggcccccauccuggccgaggugcuggacgagagcgacaccuucuggugcuucgugggccugaugcagaacaccaucuucgugagcagccccagagacgaggacauggagaagcagcugcuguaccugagagagcugcugagacugacccacgugagauucuaccagcaccuggugagccugggcgaggacggccugcagaugcuguucugccacagauggcugcugcugugcuucaagagagaguuccccgaggccgaggcccugagaaucugggaggccugcugggcccacuaccagaccgacuacuuccaccuguucaucugcguggccaucguggccaucuacggcgacgacgugaucgagcagcagcuggccaccgaccagaugcugcugcacuucggcaaccuggccaugcacaugaacggcgagcuggugcugagaaaggccagaagccugcuguaccaguucagacugcugcccagaauccccugcagccugcacgaccugugcaagcugugcggcagcggcaugugggacagcggcagcaugcccgccguggagugcaccggccaccaccccggcagcgagagcugccccuacggcggcaccguggagaugcccagccccaagagccugagagagggcaagaagggccccaagaccccccaggacggcuucggcuucagaagauaa

SEQ ID NO: 24388 - RNA, 3480 nt, Artificial Sequence
  TBC1D1__Homo_sapiens__NP_001240841
auggagcccaucaccuucaccgccagaaagcaccugcugagcaacgaggugagcguggacuucggccugcagcuggugggcagccugcccgugcacagccugaccaccaugcccaugcugcccugggugguggccgaggugagaagacugagcagacagagcaccagaaaggagcccgugaccaagcaggugagacugugcgugagccccagcggccugagaugcgagcccgagcccggcagaagccagcagugggacccccugaucuacagcagcaucuucgagugcaagccccagagagugcacaagcugauccacaacagccacgaccccagcuacuucgccugccugaucaaggaggacgccgugcacagacagagcaucugcuacguguucaaggccgacgaccagaccaaggugcccgagaucaucagcagcaucagacaggccggcaagaucgccagacaggaggagcugcacugccccagcgaguucgacgacaccuucagcaagaaguucgaggugcuguucugcggcagagugaccguggcccacaagaaggccccccccgcccugaucgacgagugcaucgagaaguucaaccacgugagcggcagcagaggcagcgagagccccagacccaaccccccccacgccgcccccaccggcagccaggagcccgugagaagacccaugagaaagagcuucagccagcccggccugagaagccuggccuucagaaaggagcugcaggacggcggccugagaagcagcggcuucuucagcagcuucgaggagagcgacaucgagaaccaccugaucagcggccacaacaucgugcagcccaccgacaucgaggagaacagaaccaugcuguucaccaucggccagagcgagguguaccugaucagccccgacaccaagaagaucgcccuggagaagaacuucaaggagaucagcuucugcagccagggcaucagacacguggaccacuucggcuucaucugcagagagagcagcggcggcggcggcuuccacuucgugugcuacguguuccagugcaccaacgaggcccugguggacgagaucaugaugacccugaagcaggccuucaccguggccgccgugcagcagaccgccaaggcccccgcccagcugugcgagggcugcccccugcagagccugcacaagcugugcgagagaaucgagggcaugaacagcagcaagaccaagcuggagcugcagaagcaccugaccacccugaccaaccaggagcaggccaccaucuucgaggaggugcagaagcugagacccagaaacgagcagagagagaacgagcugaucaucagcuuccugagaugccuguacgaggagaagcagaaggagcacauccacaucggcgagaugaagcagaccagccagauggccgccgagaacaucggcagcgagcugccccccagcgccaccagauucagacuggacaugcugaagaacaaggccaagagaagccugaccgagagccuggagagcauccugagcagaggcaacaaggccagaggccugcaggagcacagcaucagcguggaccuggacagcagccugagcagcacccugagcaacaccagcaaggagcccagcgugugcgagaaggaggcccugcccaucagcgagagcagcuucaagcugcugggcagcagcgaggaccugagcagcgacagcgagagccaccugcccgaggagcccgccccccugagcccccagcaggccuucagaagaagagccaacacccugagccacuuccccaucgagugccaggagcccccccagcccgccagaggcagccccggcgugagccagagaaagcugaugagauaccacagcgugagcaccgagaccccccacgagagaaacguggaccccagccccgugggcgagagcaagcacagacccggccagagcagcgcccccgcccccccccccagacugaaccccagcgccagcagccccaacuucuucaaguaccugaagcacaacagcagcggcgagcagagcggcaacgccgugcccaagagcaucagcuacagaaacgcccugagaaagaagcugcacagcagcagcagcgugcccaacuuccugaaguuccuggcccccguggacgagaacaacaccagcgacuucaugaacaccaagagagacuucgagagcaaggccaaccaccugggcgacagcggcggcacccccgugaagaccagaagacacagcuggagacagcagaucuuccugagaguggccaccccccagaaggccugcgacagcagcagcagauacgaggacuacagcgagcugggcgagcugccccccagaagcccccuggagcccgugugcgaggacggccccuucggccccccccccgaggagaagaagagaaccagcagagagcugagagagcuguggcagaaggccauccugcagcagauccugcugcugagaauggagaaggagaaccagaagcugcaggccagcgagaacgaccugcugaacaagagacugaagcuggacuacgaggagaucacccccugccugaaggaggugaccaccgugugggagaagaugcugagcacccccggcagaagcaagaucaaguucgacauggagaagaugcacagcgccgugggccagggcgugcccagacaccacagaggcgagaucuggaaguuccuggccgagcaguuccaccugaagcaccaguuccccagcaagcagcagcccaaggacgugcccuacaaggagcugcugaagcagcugaccagccagcagcacgccauccugaucgaccugggcagaaccuuccccacccaccccuacuucagcgcccagcugggcgccggccagcugagccuguacaacauccugaaggccuacagccugcuggaccaggaggugggcuacugccagggccugagcuucguggccggcauccugcugcugcacaugagcgaggaggaggccuucaagaugcugaaguuccugauguucgacaugggccugagaaagcaguacagacccgacaugaucauccugcagauggagaagaccaucaaccagguguucgagauggacaucgccaagcagcugcaggccuacgagguggaguaccacgugcugcaggaggagcugaucgacagcagcccccugagcgacaaccagagaauggacaagcuggagaagaccaacagcagccugagaaagcagaaccuggaccugcuggagcagcugcagguggccaacggcagaauccagagccuggaggccaccaucgagaagcugcugagcagcgagagcaagcugaagcaggccaugcugacccuggagcuggagagaagcgcccugcugcagaccguggaggagcugagaagaagaagcgccgagcccagcgacagagagcccgagugcacccagcccgagcccaccggcgacuaa

SEQ ID NO: 24389 - RNA, 1212 nt, Artificial Sequence
  TBC1D20__Homo_sapiens__NP_653229
auggcccugagaagcgcccagggcgacggccccaccagcggccacugggacggcggcgccgagaaggccgacuucaacgccaagagaaagaagaagguggccgagauccaccaggcccugaacagcgaccccaccgacguggccgcccugagaagaauggccaucagcgagggcggccugcugaccgacgagaucagaagaaagguguggcccaagcugcugaacgugaacgccaacgaccccccccccaucagcggcaagaaccugagacagaugagcaaggacuaccagcaggugcugcuggacgugagaagaagccugagaagauucccccccggcaugcccgaggagcagagagagggccugcaggaggagcugaucgacaucauccugcugauccuggagagaaacccccagcugcacuacuaccagggcuaccacgacaucguggugaccuuccugcugguggugggcgagagacuggccaccagccugguggagaagcugagcacccaccaccugagagacuucauggaccccaccauggacaacaccaagcacauccugaacuaccugaugcccaucaucgaccaggugaaccccgagcugcacgacuucaugcagagcgccgaggugggcaccaucuucgcccugagcuggcugaucaccugguucggccacgugcugagcgacuucagacacguggugagacuguacgacuucuuccuggccugccacccccugaugcccaucuacuucgccgccgugaucgugcuguacagagagcaggaggugcuggacugcgacugcgacauggccagcgugcaccaccugcugagccagaucccccaggaccugcccuacgagacccugaucagcagagccggcgaccuguucgugcaguucccccccagcgagcuggccagagaggccgccgcccagcagcaggccgagagaaccgccgccagcaccuucaaggacuucgagcuggccagcgcccagcagagacccgacauggugcugagacagagauucagaggccugcugagacccgaggacagaaccaaggacgugcugaccaagcccagaaccaacagauucgugaagcuggccgugaugggccugaccguggcccugggcgccgccgcccuggccguggugaagagcgcccuggagugggcccccaaguuccagcugcagcuguuccccuaa

SEQ ID NO: 24390 - RNA, 1320 nt, Artificial Sequence
  TBC1D22A__Homo_sapiens__NP_001271232
auggccagcgacggcgccagaaagcaguucuggaagagaagcaacagcaagcugcccggcagccugcugagaagcaccgccaagaugcccaccacccccgugaaggccaagagagugagcaccuuccaggaguucgagagcaacaccagcgacgccugggacgccggcgaggacgacgacgagcugcuggccauggccgccgagagccugaacagcgagguggugauggagaccgccaacagagugcugagaaaccacagccagagacagggcagacccacccugcaggagggccccggccugcagcagaagcccagacccgaggccgagccccccagcccccccagcggcgaccugagacuggugaagagcgugagcgagagccacaccagcugccccgccgaggagcugagaagacugagcuggagcggcauccccaagcccgugagacccaugaccuggaagcugcugagcggcuaccugcccgccaacguggacagaagacccgccacccugcagagaaagcagaaggaguacuucgccuucaucgagcacuacuacgacagcagaaacgacgaggugcaccaggacaccuacagacagauccacaucgacauccccagaaugagccccgaggcccugauccugcagcccaaggugaccgagaucuucgagagaauccuguucaucugggccaucagacaccccgccagcggcuacgugcagggcaucaacgaccuggugacccccuucuucgugguguucaucugcgaguacaucgaggccgaggagguggacaccguggacgugagcggcgugcccgccgaggugcugugcaacaucgaggccgacaccuacuggugcaugagcaagcugcuggacggcauccaggacaacuacaccuucgcccagcccggcauccagaugaaggugaagaugcuggaggagcuggugagcagaaucgacgagcaggugcacagacaccuggaccagcacgaggugagauaccugcaguucgccuucagauggaugaacaaccugcugaugagagaggugccccugagaugcaccaucagacugugggacaccuaccagagcgagcccgacggcuucagccacuuccaccuguacgugugcgccgccuuccuggugagauggagaaaggagauccuggaggagaaggacuuccaggagcugcugcuguuccugcagaaccugcccaccgcccacugggacgacgaggacaucagccugcugcuggccgaggccuacagacugaaguucgccuucgccgacgcccccaaccacuacaagaaguaa

SEQ ID NO: 24391 - RNA, 1518 nt, Artificial Sequence
  TBC1D22B__Homo_sapiens__NP_060242
auggccgccgagaacagcaagcaguucuggaagagaagcgccaagcugcccggcagcauccagcccguguacggcgcccagcaccccccccuggaccccagacugaccaagaacuucaucaaggagagaagcaaggugaacaccgugccccugaagaacaagaaggccagcagcuuccacgaguucgccagaaacaccagcgacgccugggacaucggcgacgacgaggaggaggacuucagcagccccagcuuccagacccugaacagcaagguggcccuggccaccgccgcccaggugcuggagaaccacagcaagcugagagugaagcccgagagaagccagagcaccaccagcgacgugcccgccaacuacaaggugaucaagagcagcagcgacgcccagcugagcagaaacagcagcgacaccugccugagaaacccccugcacaagcagcagagccugccccugagacccaucaucccccugguggccagaaucagcgaccagaacgccagcggcgccccccccaugaccgugagagagaagaccagacuggagaaguucagacagcugcugagcagccagaacaccgaccuggacgagcugagaaagugcagcuggcccggcgugcccagagaggugagacccaucaccuggagacugcugagcggcuaccugcccgccaacaccgagagaagaaagcugacccugcagagaaagagagaggaguacuucggcuucaucgagcaguacuacgacagcagaaacgaggagcaccaccaggacaccuacagacagauccacaucgacauccccagaaccaacccccugaucccccuguuccagcagccccuggugcaggagaucuucgagagaauccuguucaucugggccaucagacaccccgccagcggcuacgugcagggcaucaacgaccuggugacccccuucuucgugguguuccugagcgaguacguggaggaggacguggagaacuucgacgugaccaaccugagccaggacaugcugagaagcaucgaggccgacagcuucuggugcaugagcaagcugcuggacggcauccaggacaacuacaccuucgcccagcccggcauccagaagaaggugaaggcccuggaggagcuggugagcagaaucgacgagcaggugcacaaccacuucagaagauacgagguggaguaccugcaguucgccuucagauggaugaacaaccugcugaugagagagcugccccugagaugcaccaucagacugugggacaccuaccagagcgagcccgagggcuucagccacuuccaccuguacgugugcgccgccuuccugaucaaguggagaaaggagauccuggacgaggaggacuuccagggccugcugaugcugcugcagaaccugcccaccauccacuggggcaacgaggagaucggccugcugcuggccgaggccuacagacugaaguacauguucgccgacgcccccaaccacuacagaagauaa

SEQ ID NO: 24392 - RNA, 1680 nt, Artificial Sequence
  TBC1D24__Homo_sapiens__NP_001186036
auggacagccccggcuacaacugcuucguggacaaggacaagauggacgccgccauccaggaccugggccccaaggagcugagcugcaccgagcugcaggagcugaagcagcuggccagacagggcuacugggcccagagccacgcccugagaggcaagguguaccagagacugaucagagacauccccugcagaaccgugacccccgacgccagcguguacagcgacaucgugggcaagaucgugggcaagcacagcagcagcugccugccccugcccgaguucguggacaacacccaggugcccagcuacugccugaacgccagaggcgagggcgccgugagaaagauccugcugugccuggccaaccaguuccccgacaucagcuucugccccgcccugcccgccgugguggcccugcugcugcacuacagcaucgacgaggccgagugcuucgagaaggccugcagaauccuggccugcaacgaccccggcagaagacugaucgaccagagcuuccuggccuucgagagcagcugcaugaccuucggcgaccuggugaacaaguacugccaggccgcccacaagcugaugguggccgugagcgaggacgugcugcagguguacgccgacuggcagagauggcuguucggcgagcugccccugugcuacuucgccagaguguucgacguguuccugguggagggcuacaaggugcuguacagaguggcccuggccauccugaaguucuuccacaaggugagagccggccagccccuggagagcgacagcgugaagcaggacaucagaaccuucgugagagacaucgccaagaccgugagccccgagaagcugcuggagaaggccuucgccaucagacuguucagcagaaaggagauccagcugcugcagauggccaacgagaaggcccugaagcagaagggcaucaccgugaagcagaagagcgugagccugagcaagagacaguucgugcaccuggccgugcacgccgagaacuucagaagcgagaucgugagcgugagagagaugagagacaucuggagcugggugcccgagagauucgcccugugccagccccugcugcuguucagcagccugcagcacggcuacagccuggccagauucuacuuccagugcgagggccacgagcccacccugcugcugaucaagaccacccagaaggaggugugcggcgccuaccugagcaccgacuggagcgagagaaacaaguucggcggcaagcugggcuucuucggcaccggcgagugcuucguguucagacugcagcccgaggugcagagauacgaguggguggugaucaagcaccccgagcugaccaagccccccccccugauggccgccgagcccaccgccccccugagccacagcgccagcagcgaccccgccgacagacugagccccuuccuggccgccagacacuucaaccugcccagcaagaccgagagcauguucauggccggcggcagcgacugccugaucgugggcggcggcggcggccaggcccuguacaucgacggcgaccugaacagaggcagaaccagccacugcgacaccuucaacaaccagccccugugcagcgagaacuuccugaucgccgccguggaggccuggggcuuccaggaccccgacacccaguaa

SEQ ID NO: 24393 - RNA, 2067 nt, Artificial Sequence
  TBC1D25__Homo_sapiens__NP_002527
auggccaccgccagcggcgccagcgaccugagcggcagcggcgcccccccccccggcgugggcgcccaggccgccgccgccgccgaggaggaggagagagagguggugagagugagagugaagaagugcgagagcuuccugccccccgaguucagaagcuucgccguggacccccagaucaccagccuggacgugcugcagcacauccugaucagagccuucgaccugagcggcaagaagaacuucggcaucagcuaccugggcagagacagacugggccaggagguguaccugagccugcugagcgacugggaccugagcaccgccuucgccaccgccagcaagcccuaccugcagcugagaguggacaucagacccagcgaggacagcccccugcuggaggacugggacaucaucagccccaaggacgugaucggcagcgacgugcugcuggccgagaagagaagcagccugaccaccgccgcccugcccuucacccagagcauccugacccaggugggcagaacccugagcaaggugcagcaggugcugagcuggagcuacggcgaggacgugaagcccuucaagcccccccugagcgacgccgaguuccacaccuaccugaaccacgagggccagcugagcagacccgaggagcugagacugagaaucuaccacggcggcguggagcccagccugagaaaggugguguggagauaccugcugaacguguaccccgacggccugaccggcagagagagaauggacuacaugaagagaaagagcagagaguacgagcagcugaagagcgagugggcccagagagccaaccccgaggaccuggaguucaucagaagcaccgugcugaaggacgugcugagaaccgacagagcccaccccuacuacgccggccccgaggacggcccccaccugagagcccugcacgaccugcugaccaccuacgccgugacccacccccaggugagcuacugccagggcaugagcgaccuggccagccccauccuggccgugauggaccacgagggccacgccuucgugugcuucugcggcaucaugaagagacuggccgccaacuuccaccccgacggcagagccauggccaccaaguucgcccaccugaagcugcugcugagacacgccgaccccgacuucuaccaguaccugcaggaggccggcgccgacgaccuguucuucugcuacagauggcugcugcuggagcugaagagagaguucgccuucgacgacgcccugagaaugcuggaggugaccuggagcagccugccccccgacccccccgagcacgagguggagcuggugggcccccccagccagguggccgacgccggcuucggcggccacagaggcuggcccgugagacagagacacaugcugagacccgccggcggcggcggcagcaccuucgaggacgccguggaccaccuggccaccgccagccagggccccggcggcggcggcagacugcugagacaggccagccuggacggccugcagcagcugagagacaacaugggcagcagaagagacccccuggugcagcugccccaccccgccgcccugaucagcagcaagagccugagcgagccccugcugaacagccccgacccccugcugagcagcuucagccaccccgacagccccagcagcagcagcccccccagcacccaggaggccagccccaccggcgacauggccgugggcagcccccugaugcaggaggugggcagccccaaggaccccggcaagagccugccccccgugccccccaugggccugccccccccccaggaguucggcagaggcaaccccuucaugcuguuccugugccuggccauccugcuggagcacagagaccacaucaugagaaacggccuggacuacaacgagcuggccaugcacuucgacagacuggugagaaagcaccaccugggcagagugcugagaagagccagagcccuguucgccgacuaccugcagagcgaggugugggacagcgaggagggcgccgaggccaccgccgccagcuaa

SEQ ID NO: 24394 - RNA, 2787 nt, Artificial Sequence
  TBC1D2__Homo_sapiens__NP_001254500
auggagggcgccggcgagaacgcccccgagagcagcagcagcgcccccggcagcgaggagagcgccagagacccccaggugcccccccccgaggaggagagcggcgacugcgccagaagccuggaggccgugcccaagaagcugugcggcuaccugagcaaguucggcggcaagggccccaucagaggcuggaagagcagaugguucuucuacgacgagagaaagugccagcuguacuacagcagaaccgcccaggacgccaacccccuggacagcaucgaccugagcagcgccguguucgacugcaaggccgacgccgaggagggcaucuucgagaucaagacccccagcagagugaucacccugaaggccgccaccaagcaggccaugcuguacuggcugcagcagcugcagaugaagagaugggaguuccacaacagcccccccgccccccccgccacccccgacgccgcccuggccggcaacggccccgugcugcaccuggagcugggccaggaggaggccgagcuggaggaguuccugugccccgugaagaccccccccggccuggugggcguggccgccgcccugcagcccuuccccgcccugcagaacaucagccugaagcaccugggcaccgagauccagaacaccaugcacaacaucagaggcaacaagcaggcccagggcaccggccacgagccccccggcgaggacagcccccagagcggcgagccccagagagaggagcagccccuggccagcgacgccagcacccccggcagagagcccgaggacagccccaagcccgcccccaagcccagccugaccaucagcuucgcccagaaggccaagagacagaacaacaccuuccccuucuucagcgagggcaucaccagaaacagaaccgcccaggagaagguggccgcccuggagcagcaggugcugaugcugaccaaggagcugaagagccagaaggagcuggugaagauccugcacaaggcccuggaggccgcccagcaggagaagagagccagcagcgccuaccuggccgccgccgaggacaaggacagacuggagcuggugagacacaaggugagacagaucgccgagcugggcagaagaguggaggcccuggagcaggagagagagagccuggcccacaccgccagccugagagagcagcaggugcaggagcugcagcagcacgugcagcugcugauggacaagaaccacgccaagcagcaggugaucugcaagcugagcgagaaggugacccaggacuucacccacccccccgaccagagcccccugagacccgacgccgccaacagagacuuccugagccagcagggcaagaucgagcaccugaaggacgacauggaggccuacagaacccagaacugcuuccugaacagcgagauccaccaggugaccaagaucuggagaaagguggccgagaaggagaaggcccugcugaccaagugcgccuaccugcaggccagaaacugccagguggagagcaaguaccuggccggccugagaagacugcaggaggcccugggcgacgaggccagcgagugcagcgagcugcugagacagcuggugcaggaggcccugcagugggaggccggcgaggccagcagcgacagcaucgagcugagccccaucagcaaguacgacgaguacggcuuccugaccgugcccgacuacgagguggaggaccugaagcugcuggccaagauccaggcccuggagagcagaagccaccaccugcugggccuggaggccguggacagaccccugagagagagaugggccgcccugggcgaccuggugcccagcgccgagcugaagcagcugcugagagccggcgugcccagagagcacagacccagaguguggagauggcuggugcaccugagagugcagcaccugcacacccccggcugcuaccaggagcugcugagcagaggccaggccagagagcaccccgccgccagacagaucgagcuggaccugaacagaaccuuccccaacaacaagcacuucaccugccccaccagcagcuuccccgacaagcugagaagagugcugcuggccuucagcuggcagaaccccaccaucggcuacugccagggccugaacagacuggccgccaucgcccugcuggugcuggaggaggaggagagcgccuucuggugccugguggccaucguggagaccaucaugcccgccgacuacuacugcaacacccugaccgccagccagguggaccagagagugcugcaggaccugcugagcgagaagcugcccagacugauggcccaccugggccagcaccacguggaccugagccuggugaccuucaacugguuccuggugguguucgccgacagccugaucagcaacauccugcugagagugugggacgccuuccuguacgagggcaccaaggugguguucagauacgcccuggccaucuucaaguacaacgagaaggagauccugagacugcagaacggccuggagaucuaccaguaccugagauucuucaccaagaccaucagcaacagcagaaagcugaugaacaucgccuucaacgacaugaaccccuucagaaugaagcagcugagacagcugagaauggugcacagagagagacuggaggccgagcugagagagcuggagcagcugaaggccgaguaccuggagagaagagccagcagaagaagagccgugagcgagggcugcgccagcgaggacgagguggagggcgaggccuaa

SEQ ID NO: 24395 - RNA, 3774 nt, Artificial Sequence
  TBC1D32__Homo_sapiens__NP_689943
auggcccacuucagcagcgaggaccaggccaugcugcaggccaugcugagaagacuguuccagagcgugaaggagaagaucaccggcgcccccagccuggagugcgccgaggagauccugcugcaccuggaggagaccgacgagaacuuccacaacuacgaguucgugaaguaccugagacagcacaucggcaacacccugggcagcaugaucgaggaggagauggagaagugcaccagcgacagaaaccagggcgaggagugcggcuacgacaccguggugcagcaggugaccaagagaacccaggagagcaaggaguacaaggagaugaugcacuaccugaagaacaucaugaucgccgugguggagagcaugaucaacaaguucgaggaggacgagaccagaaaccaggagagacagaagaagauccagaaggagaagagccacagcuacagaaccgacaacugcagcgacagcgacagcagccugaaccagagcuacaaguucugccagggcaagcugcagcugauccuggaccagcuggaccccggccagcccaaggaggugagauacgaggcccugcagacccugugcagcgccccccccagcgacgugcugaacugcgagaacuggaccacccugugcgagaagcugaccgugagccugagcgaccccgaccccguguucagcgacagaauccugaaguucugcgcccagaccuuccugcugagcccccugcacaugaccaaggagaucuacaccagccuggccaaguaccuggagagcuacuuccugagcagagagaaccacauccccacccugagcgccggcguggacaucaccaaccccaacaugaccagacugcugaagaaggugagacugcugaacgaguaccagaaggaggcccccagcuucuggaucagacaccccgagaaguacauggaggagaucguggagagcacccugagccugcugaccgugaagcacaaccagagccacguggugagccagaagauccuggaccccaucuacuucuucgcccugguggacaccaaggccgugugguucaagaaguggaugcacgcccacuacagcagaaccaccgugcugagacugcuggagaccaaguacaagagccuggugaccaccgccauccagcagugcgugcaguacuucgagaugugcaagaccagaaaggccgacgagacccugggccacagcaagcacugcagaaacaagcagaagaccuucuacuaccugggccaggagcugcaguacaucuacuucauccacagccugugccugcugggcagacugcugaucuacaagcagggcagaaagcuguuccccaucaagcugaagaacaagaagggccuggugagccugaucgaccugcuggugcuguucacccagcugaucuacuacagccccagcugccccaagaugaccagcgccgcccacagcgagaacuacagccccgccagcauggugaccgaggugcuguggauccugagcgaccagaaggagugcgccguggagugccuguacaacaacaucgugaucgagacccugcugcagcccauccacaaccugaugaagggcaacgaggccagccccaacugcagcgagaccgcccugauccacaucgccggcauccuggccagaaucgccagcguggaggagggccugauccugcugcuguacggcgccaacaugaacagcagcgaggagagccccaccggcgcccacaucaucgcccaguucagcaagaagcugcuggacgaggacaucagcaucuucagcggcagcgagaugcugcccguggugaagggcgccuucaucagcgugugcagacacaucuacagcaccugcgagggccugcaggugcugaucaccuacaaccugcacgagagcaucgccaaggccuggaagaagaccagccugcugagcgagagaauccccacccccguggagggcagcgacagcgugagcagcgugagccaggagagccagaacaucauggccugggaggacaaccugcuggacgaccugcugcacuucgccgccacccccaagggccugcugcugcugcagagaaccggcgccaucaacgagugcgugaccuucaucuucaacagauacgccaagaagcugcaggugagcagacacaagaaguucggcuacggcgugcuggugaccagaguggccagcaccgccgccggcggcaucgcccugaagaagagcggcuucaucaacgagcugaucaccgagcuguggagcaaccuggaguacggcagagacgacgugagagugacccaccccagaaccacccccguggaccccaucgacagaagcugccagaagagcuuccuggcccuggugaaccugcugagcuaccccgccaucuacgagcuggugagaaaccaggaccugcccaacaagaccgaguacagccugagagaggugcccaccugcgugaucgacaucaucgacagacugaucauccugaacagcgaggccaagaucagaagccuguucaacuacgagcagagccacaucuucggccugagagacuucaucaucgacggccugagcguggagagaaaccacgugcuggugagaaucaaccuggugggcggcccccuggagagaauccugccccccagacugcuggagaagagcgacaaccccuaccccuggcccauguucagcagcuacccccugcccaacugcuaccugagcgacaucaccagaaacgccggcaucaagcaggacaacgaccuggacaagcugcugcugugccugaagaucagcgacaagcagaccgaguggaucgagaacugccagagacaguucugcaagaugaugaaggccaagcccgacaucaucagcggcgaggcccugaucgagcugcuggagaaguucgugcugcaccugaccgagagccccagcgagugcuacuuccccagcguggaguacaccgccaccgacgccaacgugaagaacgagagccugagcagcgugcagcagcugggcaucaagaugaccgugagauacggcaaguuccugagccugcugaaggacggcgccgagaacgaccugaccugggugcugaagcacugcgagagauuccugaagcagcagcagaccagcaucaagagcagccugcugugccugcagggcaacuacgccggccacgacugguucgugagcagccuguucaugaucaugcugggcgacaaggagaagaccuuccaguuccugcaccaguucagcagacugcugaccagcgccuuccuguggcugcccagacugcacaucagcagcuaccugcccaacgacaccguggagagcggcauccaccccguguacuucugcagcacccacuacaucgagaugcugcugaaggccgagcugccccugguguucagcgccuuccacaugagcggcuucgcccccagccagaucugccugcaguggaucacccagugcuucuggaacuaccuggacuggaucgagaucugccacuacaucgccaccugcguguuccugggccccgacuaccagguguacaucugcaucgccguguucaagcaccugcagcaggacauccugcagcacacccagacccaggaccugcagguguuccugaaggaggaggcccugcacggcuucagagugagcgacuacuucgaguacauggagauccuggagcagaacuacagaaccgugcugcugagagacaugagaaacaucagacugcagagcaccuaa

SEQ ID NO: 24396 - RNA, 1584 nt, Artificial Sequence
  TBC1D3C__Homo_sapiens__XP_006721970
auggacgugguggagguggccggcagcuggugggcccaggagagagaggacaucaucaugaaguacgagaagggccacagagccggccugcccgaggacaagggccccaagcccuucagaagcuacaacaacaacguggaccaccugggcaucgugcacgagaccgagcugcccccccugaccgccagagaggccaagcagaucagaagagagaucagcagaaagagcaaguggguggacaugcugggcgacugggagaaguacaagagcagcagaaagcugaucgacagagccuacaagggcaugcccaugaacaucagaggccccauguggagcgugcugcugaacaccgaggagaugaagcugaagaaccccggcagauaccagaucaugaaggagaagggcaagagaagcagcgagcacauccagagaaucgacagagacgugagcggcacccugagaaagcacaucuucuucagagacagauacggcaccaagcagagagagcugcugcacauccugcuggccuacgaggaguacaaccccgaggugggcuacugcagagaccugagccacaucgccgcccuguuccugcuguaccugcccgaggaggacgccuucugggcccuggugcagcugcuggccagcgagagacacagccugcagggcuuccacagccccaacggcggcaccgugcagggccugcaggaccagcaggagcacgugguggccaccagccagcccaagaccaugggccaccagaucagccugggccugacccugagacugugggacguguaccugguggagggcgagcaggcccugaugcccaucaccagaaucgccuucaaggugcagcagaagagacugaccaagaccagcagaugcggccccugggccagauucugcaacagauucguggacaccugggccagagacgaggacaccgugcugaagcaccugagagccagcaugaagaagcugaccagaaagaagggcgaccugcccccccccgccaagcccgagcagggcagcagcgccagcagacccgugcccgccagcagaggcggcaagacccugugcaagggcgacagacaggccccccccggcccccccgccagauuccccagacccaucuggagcgccagcccccccagagcccccagaagcagcacccccugccccggcggcgccgugagagaggacaccuaccccgugggcacccagggcgugcccagccccgcccuggcccagggcggcccccagggcagcuggagauuccugcaguggaacagcaugcccagacugcccaccgaccuggacguggagggccccugguucagacacuacgacuucagacagagcugcugggugagagccaucagccaggaggaccagcuggcccccugcuggcaggccgagcaccccgccgagagagugagaagcgccuucgccgcccccagcaccgacagcgaccagggcacccccuucagagccagagacgagcagcagugcgcccccaccagcggccccugccugugcggccugcaccuggagagcagccaguucccccccggcuucuaa

SEQ ID NO: 24397 - RNA, 1650 nt, Artificial Sequence
  TBC1D3F__Homo_sapiens__NP_115634
auggacgugguggagguggccggcagcuggugggcccaggagagagaggacaucaucaugaaguacgagaagggccacagagccggccugcccgaggacaagggccccaagcccuucagaagcuacaacaacaacguggaccaccugggcaucgugcacgagaccgagcugcccccccugaccgccagagaggccaagcagaucagaagagagaucagcagaaagagcaaguggguggacaugcugggcgacugggagaaguacaagagcagcagaaagcugaucgacagagccuacaagggcaugcccaugaacaucagaggccccauguggagcgugcugcugaacaucgaggagaugaagcugaagaaccccggcagauaccagaucaugaaggagaagggcaagagaagcagcgagcacauccagagaaucgacagagacgugagcggcacccugagaaagcacaucuucuucagagacagauacggcaccaagcagagagagcugcugcacauccugcuggccuacgaggaguacaaccccgaggugggcuacugcagagaccugagccacaucgccgcccuguuccugcuguaccugcccgaggaggacgccuucugggcccuggugcagcugcuggccagcgagagacacagccugcagggcuuccacagccccaacggcggcaccgugcagggccugcaggaccagcaggagcacgugguggccaccagccagcccaagaccaugggccaccaggacaagaaggaccugugcggccagugcagcccccugggcugccugaucagaauccugaucgacggcaucagccugggccugacccugagacugugggacguguaccugguggagggcgagcaggcccugaugcccaucaccagaaucgccuucaaggugcagcagaagagacugaccaagaccagcagaugcggccccugggccagauucugcaacagauucguggacaccugggccagagacgaggacaccgugcugaagcaccugagagccagcaugaagaagcugaccagaaagaagggcgacgugcccccccccgccaagcccgagcagggcagcagcgccagcagacccgugcccgccagcagaggcggcaagacccugugcaagggcgacagacaggccccccccggcccccccgccagauuccccagacccaucuggagcgccagcccccccagagcccccagaagcagcacccccugccccggcggcgccgugagagaggacaccuaccccgugggcacccagggcgugcccagccccgcccuggcccagggcggcccccagggcagcuggagauuccugcaguggaacagcaugcccagacugcccaccgaccuggacguggagggccccugguucagacacuacgacuucagacagagcugcugggugagagccaucagccaggaggaccagcuggcccccugcuggcaggccgagcaccccgccgagagagugagaagcgccuucgccgcccccagcaccgacagcgaccagggcacccccuucagagccagagacgagcagcagugcgcccccaccagcggccccugccugugcggccugcaccuggagagcagccaguucccccccggcuucuaa

SEQ ID NO: 24398 - RNA, 3873 nt, Artificial Sequence
  TBC1D4__Homo_sapiens__NP_001273587
auggagccccccagcugcauccaggacgagcccuucccccacccccuggagcccgagcccggcgugagcgcccagcccggccccggcaagcccagcgacaagagauucagacugugguacgugggcggcagcugccuggaccacagaaccacccugcccaugcugcccuggcugauggccgagaucagaagaagaagccagaagcccgaggccggcggcugcggcgcccccgccgccagagaggugauccuggugcugagcgcccccuuccugagaugcgugcccgcccccggcgccggcgccagcggcggcaccagccccagcgccacccagcccaaccccgccguguucaucuucgagcacaaggcccagcacaucagcagauucauccacaacagccacgaccugaccuacuucgccuaccugaucaaggcccagcccgacgaccccgagagccagauggccugccacguguucagagccaccgaccccagccaggugcccgacgugaucagcagcaucagacagcugagcaaggccgccaugaaggaggacgccaagcccagcaaggacaacgaggacgccuucuacaacagccagaaguucgaggugcuguacugcggcaaggugaccgugacccacaagaaggcccccagcagccugaucgacgacugcauggagaaguucagccugcacgagcagcagagacugaagauccagggcgagcagagaggccccgaccccggcgaggaccuggccgaccuggaggugguggugcccggcagccccggcgacugccugcccgaggaggccgacggcaccgacacccaccugggccugcccgccggcgccagccagcccgcccugaccagcagcagagugugcuuccccgagagaauccuggaggacagcggcuucgacgagcagcaggaguucagaagcagaugcagcagcgugaccggcgugcagagaagagugcacgagggcagccagaagagccagcccagaagaagacacgccagcgcccccagccacgugcagcccagcgacagcgagaagaacagaaccaugcuguuccaggugggcagauucgagaucaaccugaucagccccgacaccaagagcguggugcuggagaagaacuucaaggacaucagcagcugcagccagggcaucaagcacguggaccacuucggcuucaucugcagagagagccccgagcccggccugagccaguacaucugcuacguguuccagugcgccagcgagagccugguggacgaggugaugcugacccugaagcaggccuucagcaccgccgccgcccugcagagcgccaagacccagaucaagcugugcgaggccugccccaugcacagccugcacaagcugugcgagagaaucgagggccuguacccccccagagccaagcuggugauccagagacaccugagcagccugaccgacaacgagcaggccgacaucuucgagagagugcagaagaugaagcccgugagcgaccaggaggagaacgagcuggugauccugcaccugagacagcugugcgaggccaagcagaagacccacgugcacaucggcgagggccccagcaccaucagcaacagcaccauccccgagaacgccaccagcagcggcagauucaagcuggacauccugaagaacaaggccaagagaagccugaccagcagccuggagaacaucuucagcagaggcgccaacagaaugagaggcagacugggcagcguggacagcuucgagagaagcaacagccuggccagcgagaaggacuacagccccggcgacagcccccccggcaccccccccgccagcccccccagcagcgccuggcagaccuuccccgaggaggacagcgacagcccccaguucagaagaagagcccacaccuucagccacccccccagcagcaccaagagaaagcugaaccugcaggacggcagagcccagggcgugagaagcccccugcugagacagagcagcagcgagcagugcagcaaccugagcagcgugagaagaauguacaaggagagcaacagcagcagcagccugcccagccugcacaccagcuucagcgcccccagcuucaccgcccccagcuuccugaagagcuucuaccagaacagcggcagacugagcccccaguacgagaacgagaucagcgacggcgagggcagaaagagaaccagcagcaccugcagcaacgagagccugagcgugggcggcaccagcgugacccccagaagaaucagcuggagacagagaaucuuccugagaguggccagccccaugaacaagagccccagcgccaugcagcagcaggacggccuggacagaaacgagcugcugccccugagcccccugagccccaccauggaggaggagccccuggugguguuccugagcggcgaggacgaccccgagaagaucgaggagagaaagaagagcaaggagcugagaagccuguggagaaaggccauccaccagcagauccugcugcugagaauggagaaggagaaccagaagcuggaggccagcagagacgagcugcagagcagaaaggugaagcuggacuacgaggaggugggcgccugccagaaggaggugcugaucaccugggacaagaagcugcugaacugcagagccaagaucagaugcgacauggaggacauccacacccugcugaaggagggcgugcccaagagcagaagaggcgagaucuggcaguuccuggcccugcaguacagacugagacacagacugcccaacaagcagcagccccccgacaucagcuacaaggagcugcugaagcagcugaccgcccagcagcacgccauccugguggaccugggcagaaccuuccccacccaccccuacuucagcgugcagcugggccccggccagcugagccuguucaaccugcugaaggccuacagccugcuggacaaggaggugggcuacugccagggcaucagcuucguggccggcgugcugcugcugcacaugagcgaggagcaggccuucgagaugcugaaguuccugauguacgaccugggcuucagaaagcaguacagacccgacaugaugagccugcagauccagauguaccagcugagcagacugcugcacgacuaccacagagaccuguacaaccaccuggaggagaacgagaucagccccagccuguacgccgcccccugguuccugacccuguucgccagccaguucagccugggcuucguggccagaguguucgacaucaucuuccugcagggcaccgaggugaucuucaagguggcccugagccugcugagcagccaggagacccugaucauggagugcgagagcuucgagaacaucguggaguuccugaagaacacccugcccgacaugaacaccagcgagauggagaagaucaucacccagguguucgagauggacaucagcaagcagcugcacgccuacgagguggaguaccacgugcugcaggacgagcugcaggagagcagcuacagcugcgaggacagcgagacccuggagaagcuggagagagccaacagccagcugaagagacagaacauggaccugcuggagaagcugcagguggcccacaccaagauccaggcccuggagagcaaccuggagaaccugcugaccagagagaccaagaugaagagccugaucagaacccuggagcaggagaagauggccuaccagaagaccguggagcagcugagaaagcugcugcccgccgacgcccuggugaacugcgaccugcugcugagagaccugaacugcaaccccaacaacaaggccaagaucggcaacaagcccuaa

SEQ ID NO: 24399 - RNA, 2454 nt, Artificial Sequence
  TBC1D5__Homo_sapiens__NP_001127853
auguaccacagccugagcgagaccagacacccccugcagcccgaggagcaggaggugggcaucgacccccugagcagcuacagcaacaagagcggcggcgacagcaacaagaacggcagaagaaccagcagcacccuggacagcgagggcaccuucaacagcuacagaaaggagugggaggagcuguucgugaacaacaacuaccuggccaccaucagacagaagggcaucaacggccagcugagaagcagcagauucagaagcaucugcuggaagcuguuccugugcgugcugccccaggacaagagccaguggaucagcagaaucgaggagcugagagccugguacagcaacaucaaggagauccacaucaccaaccccagaaagguggugggccagcaggaccugaugaucaacaacccccugagccaggacgagggcagccuguggaacaaguucuuccaggacaaggagcugagaagcaugaucgagcaggacgugaagagaaccuuccccgagaugcaguucuuccagcaggagaacgugagaaagauccugaccgacgugcuguucugcuacgccagagagaacgagcagcugcuguacaagcagggcaugcacgagcugcuggcccccaucguguucgugcugcacugcgaccaccaggccuuccugcacgccagcgagagcgcccagcccagcgaggagaugaagaccgugcugaaccccgaguaccuggagcacgacgccuacgccguguucagccagcugauggagaccgccgagcccugguucagcaccuucgagcacgacggccagaagggcaaggagacccugaugacccccauccccuucgccagaccccaggaccugggccccaccaucgccaucgugaccaaggugaaccagauccaggaccaccugcugaagaagcacgacaucgagcuguacaugcaccugaacagacuggagaucgccccccagaucuacggccugagaugggugagacugcuguucggcagagaguucccccugcaggaccugcugguggugugggacgcccuguucgccgacggccugagccugggccugguggacuacaucuucguggccaugcugcuguacaucagagacgcccugaucagcagcaacuaccagaccugccugggccugcugaugcacuaccccuucaucggcgacgugcacagccugauccugaaggcccuguuccugagagaccccaagagaaaccccagacccgugaccuaccaguuccaccccaaccuggacuacuacaaggccagaggcgccgaccugaugaacaagagcagaaccaacgccaagggcgccccccugaacaucaacaaggugagcaacagccugaucaacuucggcagaaagcugaucagccccgccauggcccccggcagcgccggcggccccgugcccggcggcaacagcagcagcagcagcagcguggugauccccaccagaaccagcgccgaggcccccagccaccaccugcagcagcagcagcagcagcagagacugaugaagagcgagagcaugcccgugcagcugaacaagggcgacguggugaccggcagcgacgcccaggugagcgugcccgugcagacccugaccgaccugcagggccugagcagcaagaacaucagcagcagccccagcguggagagccugcccggcggcagagaguucaccggcagcccccccagcagcgccaccaagaaggacagcuucuucagcaacaucagcagaagcagaagccacagcaagaccaugggcagaaaggagagcgaggaggagcuggaggcccagaucagcuuccugcagggccagcugaacgaccuggacgccaugugcaaguacugcgccaaggugauggacacccaccuggugaacauccaggacgugauccugcaggagaaccuggagaaggaggaccagauccuggugagccuggccggccugaagcagaucaaggacauccugaagggcagccugagauucaaccagagccagcuggaggccgaggagaacgagcagaucaccaucgccgacaaccacuacugcagcagcggccagggccagggcagaggccagggccagagcgugcagaugagcggcgccaucaagcaggccagcagcgagacccccggcugcaccgacagaggcaacagcgacgacuucauccugaucagcaaggacgacgacggcagcagcgccagaggcagcuucagcggccaggcccagccccugagaacccugagaagcaccagcggcaagagccaggcccccgugugcagcccccugguguucagcgacccccugaugggccccgccagcgccagcagcagcaaccccagcagcagccccgacgacgacagcagcaaggacagcggcuucaccaucgugagcccccuggacaucuaa

SEQ ID NO: 24400 - RNA, 801 nt, Artificial Sequence
  TBC1D7__Homo_sapiens__NP_001137438
augaccgaggacagccagagaaacuucagaagcguguacuacgagaaggugggcuucagaggcguggaggagaagaagagccuggagauccugcugaaggacgacagacugggcauccugcccccccaccacgagagccacgccaaggugaugauguacagaaaggagcaguaccuggacgugcugcacgcccugaagguggugagauucgugagcgacgccaccccccaggccgagguguaccugagaauguaccagcuggagagcggcaagcugcccagaagccccagcuucccccuggagcccgacgacgagguguuccuggccaucgccaaggccauggaggagaugguggaggacagcguggacugcuacuggaucaccagaagauucgugaaccagcugaacaccaaguacagagacagccugccccagcugcccaaggccuucgagcaguaccugaaccuggaggacggcagacugcugacccaccugagaaugugcagcgccgcccccaagcugcccuacgaccugugguucaagagaugcuucgccggcugccugcccgagagcagccugcagagagugugggacaagguggugagcggcagcugcaagauccugguguucguggccguggagauccugcugaccuucaagaucaaggugauggcccugaacagcgccgagaagaucaccaaguuccuggagaacaucccccaggacagcagcgacgccaucgugagcaaggccaucgaccuguggcacaagcacugcggcacccccgugcacagcagcuaa

SEQ ID NO: 24401 - RNA, 3423 nt, Artificial Sequence
  TBC1D8__Homo_sapiens__NP_001095896
auguggcugaagcccgaggaggugcugcugaagaacgcccugaagcugugggugacccagaagagcagcugcuacuucauccugcagagaagaagaggccacggcgagggcggcggcagacugaccggcagacuggugggcgcccuggacgccgugcuggacagcaacgccagaguggcccccuucagaauccugcugcaggugcccggcagccagguguacagccccaucgccugcggcgccacccuggaggagaucaaccagcacugggacuggcuggagcagaaccugcugcacacccugagcguguucgacaacaaggacgacaucgccagcuucgugaagggcaaggugaaggcccugaucgccgaggagaccagcagcagacuggccgagcaggaggaggagcccgagaaguucagagaggcccuggugaaguucgaggccagauucaacuuccccgaggccgagaagcuggugaccuacuacagcugcugcugcuggaagggcagagugcccagacagggcuggcuguaccugagcaucaaccaccugugcuucuacagcuucuuccugggcaaggagcugaagcugguggugcccuggguggacauccagaagcuggagagaaccagcaacguguuccugaccgacaccaucagaaucaccacccagaacaaggagagagacuucagcauguuccugaaccuggacgagguguucaaggugauggagcagcuggccgacgugacccugagaagacugcuggacaacgagguguucgaccuggaccccgaccugcaggagcccagccagaucaccaagagagaccuggaggccagagcccagaacgaguucuucagagccuucuucagacugcccagaaaggagaagcugcacgccgugguggacugcagccuguggacccccuucagcagaugccacaccaccggcagaauguucgccagcgacagcuacaucugcuucgccagcagagaggacggcugcugcaagaucauccugccccugagagagguggugagcaucgagaagauggaggacaccagccugcugccccaccccaucaucgugagcaucagaagcaagguggccuuccaguucaucgagcugagagacagagacagccugguggaggcccugcuggccagacugaagcaggugcacgccaaccaccccgugcacuacgacaccagcgccgacgacgacauggccagccugguguuccacagcaccagcaugugcagcgaccacagauucggcgaccuggagaugaugagcagccagaacagcgaggagagcgagaaggagaagagcccccugaugcaccccgacgcccuggugaccgccuuccagcagagcggcagccagagccccgacagcagaaugagcagagagcagaucaagaucagccuguggaacgaccacuucguggaguacggcagaaccgugugcauguucagaaccgagaagaucagaaagcugguggccaugggcauccccgagagccugagaggcagacuguggcugcuguucagcgacgccgugaccgaccuggccagccaccccggcuacuacggcaaccugguggaggagagccugggcaagugcugccuggugaccgaggagaucgagagagaccugcacagaagccugcccgagcaccccgccuuccagaacgagaccggcaucgccgcccugagaagagugcugaccgccuacgcccacagaaaccccaagaucggcuacugccagagcaugaacauccugaccagcgugcugcugcuguacaccaaggaggaggaggccuucuggcugcugguggccgugugcgagagaaugcugcccgacuacuucaaccacagagugaucggcgcccagguggaccagagcguguucgaggagcugaucaagggccaccugcccgagcuggccgagcacaugaacgaccugagcgcccuggccagcgugagccugagcugguuccugacccuguuccugagcaucaugccccuggagagcgccgugaacgugguggacugcuucuucuacgacggcaucaaggccaucuuccagcugggccuggccgugcuggaggccaacgccgaggaccugugcagcagcaaggacgacggccaggcccugaugauccugagcagauuccuggaccacaucaagaacgaggacagccccggcccccccgugggcagccaccacgccuucuucagcgacgaccaggagcccuaccccgugaccgacaucagcgaccugaucagagacagcuacgagaaguucggcgaccagagcguggagcagaucgagcaccugagauacaagcacagaaucagagugcugcagggccacgaggacaccaccaagcagaacgugcugagaguggugauccccgaggugagcauccugcccgaggaccuggaggagcuguacgaccuguucaagagagagcacaugaugagcugcuacugggagcagcccagacccauggccagcagacacgaccccagcagacccuacgccgagcaguacagaaucgacgccagacaguucgcccaccuguuccagcuggugagccccuggaccugcggcgcccacaccgagauccuggccgagagaaccuucagacugcuggacgacaacauggaccagcugaucgaguucaaggccuucgugagcugccuggacaucauguacaacggcgagaugaacgagaagaucaagcugcuguacagacugcacaucccccccgcccugaccgagaacgacagagacagccagagcccccugagaaacccccugcugagcaccagcagaccccugguguucggcaagcccaacggcgacgccguggacuaccagaagcagcugaagcagaugaucaaggaccuggccaaggagaaggacaagaccgagaaggagcugcccaagaugagccagagagaguucauccaguucugcaagacccuguacagcauguuccacgaggaccccgaggagaacgaccuguaccaggccaucgccaccgugaccacccugcugcugcagaucggcgaggugggccagagaggcagcagcagcggcagcugcagccaggagugcggcgaggagcugagagccagcgcccccagccccgaggacagcguguucgccgacaccggcaagaccccccaggacagccaggccuuccccgaggccgccgagagagacuggaccgugagccuggagcacauccuggccagccugcugaccgagcagagccuggugaacuucuucgagaagccccuggacaugaagagcaagcuggagaacgccaagaucaaccaguacaaccugaagaccuucgagaugagccaccagagccagagcgagcugaagcugagcaaccuguaa

SEQ ID NO: 24402 - RNA, 3801 nt, Artificial Sequence
  TBC1D9__Homo_sapiens__NP_055945
augugggugaaccccgaggaggugcugcuggccaacgcccuguggaucaccgagagagccaaccccuacuucauccugcagagaagaaagggccacgccggcgacggcggcggcggcggcggccuggccggccugcuggugggcacccuggacguggugcuggacagcagcgccagaguggcccccuacagaauccuguaccagacccccgacagccugguguacuggaccaucgccugcggcggcagcagaaaggagaucaccgagcacugggaguggcuggagcagaaccugcugcagacccugagcaucuucgagaacgagaacgacaucaccaccuucgugagaggcaagauccagggcaucaucgccgaguacaacaagaucaacgacgugaaggaggacgacgacaccgagaaguucaaggaggccaucgugaaguuccacagacuguucggcaugcccgaggaggagaagcuggugaacuacuacagcugcagcuacuggaagggcaaggugcccagacagggcuggauguaccugagcaucaaccaccugugcuucuacagcuuccugaugggcagagaggccaagcuggugaucagauggguggacaucacccagcuggagaagaacgccacccugcugcugcccgacgugaucaaggugagcaccagaagcagcgagcacuucuucagcguguuccugaacaucaacgagaccuucaagcugauggagcagcuggccaacaucgccaugagacagcugcuggacaacgagggcuucgagcaggacagaagccugcccaagcugaagagaaagagccccaagaaggugagcgcccugaagagagaccuggacgccagagccaagagcgagagauacagagcccuguucagacugcccaaggacgagaagcuggacggccacaccgacugcacccuguggacccccuucaacaagaugcacauccugggccagauguucgugagcaccaacuacaucugcuucaccagcaaggaggagaaccugugcagccugaucaucccccugagagaggugaccaucguggagaaggccgacagcagcagcgugcugcccagcccccugagcaucagcaccagaaacagaaugaccuuccuguucgccaaccugaaggacagagacuuccuggugcagagaaucagcgacuuccugcagcagaccaccagcaagaucuacagcgacaaggaguucgccggcagcuacaacagcagcgacgacgagguguacagcagacccagcagccuggugagcagcagcccccagagaagcaccagcagcgacgccgacggcgagagacaguucaaccugaacggcaacagcgugcccaccgccacccagacccugaugaccauguacagaagaagaagccccgaggaguucaaccccaagcuggccaaggaguuccugaaggagcaggccuggaagauccacuucgccgaguacggccagggcaucugcauguacagaaccgagaagaccagagagcuggugcugaagggcauccccgagagcaugagaggcgagcuguggcugcugcugagcggcgccaucaacgagaaggccacccaccccggcuacuacgaggaccugguggagaagagcaugggcaaguacaaccuggccaccgaggagaucgagagagaccugcacagaagccugcccgagcaccccgccuuccagaacgagaugggcaucgccgcccugagaagagugcugaccgccuacgccuucagaaaccccaacaucggcuacugccaggccaugaacaucgugaccagcgugcugcugcuguacgccaaggaggaggaggccuucuggcugcugguggcccugugcgagagaaugcugcccgacuacuacaacaccagaguggugggcgcccugguggaccagggcguguucgaggagcuggccagagacuacgugccccagcuguacgacugcaugcaggaccugggcgugaucagcaccaucagccugagcugguuccugacccuguuccugagcgugaugcccuucgagagcgccgugguggugguggacugcuucuucuacgagggcaucaaggugaucuuccagcuggcccuggccgugcuggacgccaacguggacaagcugcugaacugcaaggacgacggcgaggccaugaccgugcugggcagauaccuggacagcgugaccaacaaggacagcacccugccccccaucccccaccugcacagccugcugagcgacgacguggagcccuaccccgagguggacaucuucagacugaucagaaccagcuacgagaaguucggcaccaucagagccgaccugaucgagcagaugagauucaagcagagacugaaggugauccagacccuggaggacaccaccaagagaaacguggugagaaccaucgugaccgagaccagcuucaccaucgacgagcuggaggagcuguacgcccuguucaaggccgagcaccugaccagcugcuacuggggcggcagcagcaacgcccuggacagacacgaccccagccugcccuaccuggagcaguacagaaucgacuucgagcaguucaagggcauguucgcccugcuguuccccugggccugcggcacccacagcgacgugcuggccagcagacuguuccagcugcuggacgagaacggcgacagccugaucaacuucagagaguucgugagcggccugagcgccgccugccacggcgaccugaccgagaagcugaagcugcuguacaagaugcacgugcugcccgagcccagcagcgaccaggacgagcccgacagcgccuucgaggccacccaguacuucuucgaggacaucacccccgagugcacccacguggugggccuggacagcagaagcaagcagggcgccgacgacggcuucgugaccgugagccugaagcccgacaagggcaagagagccaacagccaggagaacagaaacuaccugagacuguggacccccgagaacaagagcaagagcaagaacgccaaggaccugcccaagcugaaccagggccaguucaucgagcugugcaagaccauguacaacauguucagcgaggaccccaacgagcaggagcuguaccacgccaccgccgccgugaccagccugcugcuggagaucggcgaggugggcaagcuguucguggcccagcccgccaaggagggcggcagcggcggcagcggccccagcugccaccagggcauccccggcgugcuguuccccaagaagggccccggccagcccuacgugguggagagcguggagccccugcccgccagccuggcccccgacagcgaggagcacagccugggcggccagauggaggacaucaagcuggaggacagcagccccagagacaacggcgccugcagcagcaugcugaucagcgacgacgacaccaaggacgacagcagcaugagcagcuacagcgugcugagcgccggcagccacgaggaggacaagcugcacugcgaggacaucggcgaggacaccgugcuggugagaagcggccagggcaccgccgcccugcccagaagcaccagccuggacagagacugggccaucaccuucgagcaguuccuggccagccugcugaccgagcccgcccuggugaaguacuucgacaagcccgugugcaugauggccagaaucaccagcgccaagaacaucagaaugaugggcaagccccugaccagcgccagcgacuacgagaucagcgccaugagcggcuaa

SEQ ID NO: 24403 - RNA, 390 nt, Artificial Sequence
  TBCA__Homo_sapiens__NP_001284667
auggccgaccccagagugagacagaucaagaucaagaccggcguggugaagagacuggugaaggagaaggugauguacgagaaggaggccaagcagcaggaggagaagaucgagaagaugagagccgaggacggcgagaacuacgacaucaagaagcaggccgagauccugcaggagagcagaaugaugauccccgacugccagagaagacuggaggccgccuaccuggaccugcagagaauccuggugagcaaggacuucugcgugauguucaaguucuucuucagcauccaguacauggagagccagaaguucaaguaccugacccugagaaccagcuggcaguacuuccuguucaccugcccccuguacagauacauccugaaguaa

SEQ ID NO: 24404 - RNA, 1041 nt, Artificial Sequence
  TBCC__Homo_sapiens__NP_003183
auggagagcgugagcugcagcgccgccgccgugagaaccggcgacauggagagccagagagaccugagccuggugcccgagagacugcagagaagagagcaggagagacagcuggagguggagagaagaaagcagaagagacagaaccaggagguggagaaggagaacagccacuucuucguggccaccuucgccagagagagagccgccguggaggagcugcuggagagagccgagagcguggagagacuggaggaggccgccagcagacugcagggccugcagaagcugaucaacgacagcguguucuuccuggccgccuacgaccugagacagggccaggaggcccuggccagacugcaggccgcccuggccgagagaagaagaggccugcagcccaagaagagauucgccuucaagaccagaggcaaggacgccgccagcagcaccaagguggacgccgcccccggcaucccccccgccguggagagcauccaggacagcccccugcccaagaaggccgagggcgaccugggccccagcugggugugcggcuucagcaaccuggagagccaggugcuggagaagagagccagcgagcugcaccagagagacgugcugcugaccgagcugagcaacugcaccgugagacuguacggcaaccccaacacccugagacugaccaaggcccacagcugcaagcugcugugcggccccgugagcaccagcguguuccuggaggacugcagcgacugcgugcuggccguggccugccagcagcugagaauccacagcaccaaggacaccagaaucuuccugcaggugaccagcagagccaucguggaggacugcagcggcauccaguucgcccccuacaccuggagcuaccccgagaucgacaaggacuucgagagcagcggccuggacagaagcaagaacaacuggaacgacguggacgacuucaacuggcuggccagagacauggccagccccaacuggagcauccugcccgaggaggagagaaacauccagugggacuaa

SEQ ID NO: 24405 - RNA, 3579 nt, Artificial Sequence
  TBCD__Homo_sapiens__NP_005984
auggcccugagcgacgagcccgccgccggcggccccgaggaggaggccgaggacgagacccuggccuucggcgccgcccuggaggccuucggcgagagcgccgagaccagagcccugcugggcagacugagagaggugcacggcggcggcgccgagagagagguggcccuggagagauucagagugaucauggacaaguaccaggagcagccccaccugcuggacccccaccuggaguggaugaugaaccugcugcuggacaucgugcaggaccagaccagccccgccagccuggugcaccuggccuucaaguuccuguacaucaucaccaaggugagaggcuacaagaccuuccugagacuguucccccacgagguggccgacguggagcccgugcuggaccuggugaccauccagaaccccaaggaccacgaggccugggagaccagauacaugcugcugcuguggcugagcgugaccugccugauccccuucgacuucagcagacuggacggcaaccugcugacccagcccggccaggccagaaugagcaucauggacagaauccugcagaucgccgagagcuaccugaucgugagcgacaaggccagagacgccgccgccgugcuggugagcagauucaucaccagacccgacgugaagcagagcaagauggccgaguuccuggacuggagccugugcaaccuggccagaagcagcuuccagaccaugcagggcgugaucaccauggacggcacccugcaggcccuggcccagaucuucaagcacggcaagagagaggacugccugcccuacgccgccaccgugcugagaugccuggacggcugcagacugcccgagagcaaccagacccugcugagaaagcugggcgugaagcuggugcagagacugggccugaccuuccugaagcccaagguggccgccuggagauaccagagaggcugcagaagccuggccgccaaccugcagcugcugacccagggccagagcgagcagaagccccugauccugaccgaggacgacgacgaggacgacgacgugcccgagggcguggagagagugaucgagcagcugcuggugggccugaaggacaaggacaccguggugagauggagcgccgccaagggcaucggcagaauggccggcagacugcccagagcccuggccgacgacguggugggcagcgugcuggacugcuucagcuuccaggagaccgacaaggccuggcacggcggcugccuggcccuggccgagcugggcagaagaggccugcugcugcccagcagacugguggacgugguggccgugauccugaaggcccugaccuacgacgagaagagaggcgccugcagcgugggcaccaacgugagagacgccgccugcuacgugugcugggccuucgccagagccuacgagccccaggagcugaagcccuucgugaccgccaucagcagcgcccuggugaucgccgccguguucgacagagacaucaacugcagaagagccgccagcgccgccuuccaggagaacgugggcagacagggcaccuucccccacggcaucgacauccugaccaccgccgacuacuucgccgugggcaacagaagcaacugcuuccuggugaucagcguguucaucgccggcuuccccgaguacacccagcccaugaucgaccaccuggugaccaugaagaucagccacugggacggcgugaucagagagcuggccgccagagcccugcacaaccuggcccagcaggcccccgaguucagcgccacccagguguuccccagacugcugagcaugacccugagccccgaccugcacaugagacacggcagcauccuggccugcgccgagguggccuacgcccuguacaagcuggccgcccaggagaacagacccgugaccgaccaccuggacgagcaggccgugcagggccugaagcagauccaccagcagcuguacgacagacagcuguacagaggccugggcggccagcugaugagacaggccgugugcgugcugaucgagaagcugagccugagcaagaugcccuucagaggcgacaccgugaucgacggcuggcaguggcugaucaacgacacccugagacaccugcaccugaucagcagccacagcagacagcagaugaaggacgccgccgugagcgcccuggccgcccugugcagcgaguacuacaugaaggagcccggcgaggccgaccccgccauccaggaggagcugaucacccaguaccuggccgagcugagaaaccccgaggagaugaccagaugcggcuucagccuggcccugggcgcccugcccggcuuccugcugaagggcagacugcagcaggugcugaccggccugagagccgugacccacaccagccccgaggacgugagcuucgccgagagcagaagagacggccugaaggccaucgccagaaucugccagaccgugggcgugaaggccggcgcccccgacgaggccgugugcggcgagaacgugagccagaucuacugcgcccugcugggcugcauggacgacuacaccaccgacagcagaggcgacgugggcaccugggugagaaaggccgccaugaccagccugauggaccugacccugcugcuggccagaagccagcccgagcugaucgaggcccacaccugcgagagaaucaugugcugcguggcccagcaggccagcgagaagaucgacagauucagagcccacgccgccagcguguuccugacccugcugcacuucgacagcccccccaucccccacgugccccacagaggcgagcuggagaagcuguuccccagaagcgacguggccagcgugaacuggagcgcccccagccaggccuuccccagaaucacccagcugcugggccugcccaccuacagauaccacgugcugcugggccugguggugagccugggcggccugaccgagagcaccaucagacacagcacccagagccuguucgaguacaugaagggcauccagagcgacccccaggcccugggcagcuucagcggcacccugcugcagaucuucgaggacaaccugcugaacgagagagugagcgugccccugcugaagacccuggaccacgugcugacccacggcugcuucgacaucuucaccaccgaggaggaccaccccuucgccgugaagcugcuggcccugugcaagaaggagaucaagaacagcaaggacauccagaagcugcugagcggcaucgccguguucugcgagauggugcaguuccccggcgacgugagaagacaggcccugcugcagcugugccugcugcugugccacagauucccccugaucagaaagaccaccgccagccagguguacgagacccugcugaccuacagcgacguggugggcgccgacgugcuggacgagguggugaccgugcugagcgacaccgccugggacgccgagcuggccguggugagagagcagagaaacagacugugcgaccugcugggcgugcccagaccccagcuggugccccagcccggcgccugcuaa

SEQ ID NO: 24406 - RNA, 1584 nt, Artificial Sequence
  TBCE__Homo_sapiens__NP_001072983
augagcgacacccugaccgccgacgugaucggcagaagaguggaggugaacggcgagcacgccaccgugagauucgccggcguggugccccccguggccggccccuggcugggcguggagugggacaaccccgagagaggcaagcacgacggcagccacgagggcaccguguacuucaagugcagacaccccaccggcggcagcuucaucagacccaacaaggugaacuucggcaccgacuuccugaccgccaucaagaacagauacgugcuggaggacggccccgaggaggacagaaaggagcagaucgugaccaucggcaacaagcccguggagaccaucggcuucgacagcaucaugaagcagcagagccagcugagcaagcugcaggaggugagccugagaaacugcgccgugagcugcgccggcgagaagggcggcguggccgaggccugccccaacaucagaaagguggaccugagcaagaaccugcugagcagcugggacgaggugauccacaucgccgaccagcugagacaccuggaggugcugaacgugagcgagaacaagcugaaguuccccagcggcagcgugcugaccggcacccugagcgugcugaaggugcuggugcugaaccagaccggcaucaccugggccgaggugcugagaugcguggccggcugccccggccuggaggagcuguaccuggagagcaacaacaucuucaucagcgagagacccaccgacgugcugcagaccgugaagcugcuggaccugagcagcaaccagcugaucgacgagaaccagcuguaccugaucgcccaccugcccagacuggagcagcugauccugagcgacaccggcaucagcagccugcacuuccccgacgccggcaucggcugcaagaccagcauguuccccagccugaaguaccugguggugaacgacaaccagaucagccaguggagcuucuucaacgagcuggagaagcugcccagccugagagcccugagcugccugagaaacccccugaccaaggaggacaaggaggccgagaccgccagacugcugaucaucgccagcaucggccagcugaagacccugaacaagugcgagauccugcccgaggagagaagaagagccgagcuggacuacagaaaggccuucggcaacgaguggaagcaggccggcggccacaaggaccccgagaagaacagacugagcgaggaguuccugaccgcccaccccagauaccaguuccugugccugaaguacggcgcccccgaggacugggagcugaagacccagcagccccugaugcugaagaaccagcugcugacccugaagaucaaguacccccaccagcuggaccagaaggugcuggagaagcagcugcccggcagcaugaccauccagaaggugaagggccugcugagcagacugcugaaggugcccgugagcgaccugcugcugagcuacgagagccccaagaagcccggcagagagaucgagcuggagaacgaccugaagagccugcaguucuacagcguggagaacggcgacugccugcuggugagaugguaa

SEQ ID NO: 24407 - RNA, 1275 nt, Artificial Sequence
  TBCEL__Homo_sapiens__NP_001123519
auggaccagcccagcggcagaagcuucaugcaggugcugugcgagaaguacagccccgagaacuuccccuacagaagaggccccggcaugggcgugcacgugcccgccaccccccagggcagccccaugaaggacagacugaaccugcccagcgugcuggugcugaacagcugcggcaucaccugcgccggcgacgagaaggagaucgccgccuucugcgcccacgugagcgagcuggaccugagcgacaacaagcuggaggacuggcacgaggugagcaagaucgugagcaacgugccccagcuggaguuccugaaccugagcagcaacccccugaaccugagcgugcuggagagaaccugcgccggcagcuucagcggcgugagaaagcuggugcugaacaacagcaaggccagcugggagaccgugcacaugauccugcaggagcugcccgaccuggaggagcuguuccugugccugaacgacuacgagaccgugagcugccccagcaucugcugccacagccugaagcugcugcacaucaccgacaacaaccugcaggacuggaccgagaucagaaagcugggcgugauguuccccagccuggacacccuggugcuggccaacaaccaccugaacgccaucgaggagcccgacgacagccuggccagacuguuccccaaccugagaagcaucagccugcacaagagcggccugcagagcugggaggacaucgacaagcugaacagcuuccccaagcuggaggaggugagacugcugggcaucccccugcugcagcccuacaccaccgaggagagaagaaagcuggugaucgccagacugcccagcgugagcaagcugaacggcagcguggugaccgacggcgagagagaggacagcgagagauucuucaucagauacuacguggacgugccccaggaggaggugcccuucagauaccacgagcugaucaccaaguacggcaagcuggagccccuggccgagguggaccugagaccccagagcagcgccaagguggaggugcacuucaacgaccagguggaggagaugagcaucagacuggaccagaccguggccgagcugaagaagcagcugaagacccuggugcagcugcccaccagcaacaugcugcuguacuacuucgaccacgaggcccccuucggccccgaggagaugaaguacagcagcagagcccugcacagcuucggcaucagagacggcgacaagaucuacguggagagcaagaccaaguaa

SEQ ID NO: 24408 - RNA, 2190 nt, Artificial Sequence
  TBK1__Homo_sapiens__XP_005268867
augcagagcaccagcaaccaccuguggcugcugagcgacauccugggccagggcgccaccgccaacguguucagaggcagacacaagaagaccggcgaccuguucgccaucaagguguucaacaacaucagcuuccugagacccguggacgugcagaugagagaguucgaggugcugaagaagcugaaccacaagaacaucgugaagcuguucgccaucgaggaggagaccaccaccagacacaaggugcugaucauggaguucugccccugcggcagccuguacaccgugcuggaggagcccagcaacgccuacggccugcccgagagcgaguuccugaucgugcugagagacguggugggcggcaugaaccaccugagagagaacggcaucgugcacagagacaucaagcccggcaacaucaugagagugaucggcgaggacggccagagcguguacaagcugaccgacuucggcgccgccagagagcuggaggacgacgagcaguucgugagccuguacggcaccgaggaguaccugcaccccgacauguacgagagagccgugcugagaaaggaccaccagaagaaguacggcgccaccguggaccuguggagcaucggcgugaccuucuaccacgccgccaccggcagccugcccuucagacccuucgagggccccagaagaaacaaggaggugauguacaagaucaucaccggcaagcccagcggcgccaucagcggcgugcagaaggccgagaacggccccaucgacuggagcggcgacaugcccgugagcugcagccugagcagaggccugcaggugcugcugacccccgugcuggccaacauccuggaggccgaccaggagaagugcuggggcuucgaccaguucuucgccgagaccagcgacauccugcacagaauggugauccacguguucagccugcagcagaugaccgcccacaagaucuacauccacagcuacaacaccgccaccaucuuccacgagcugguguacaagcagaccaagaucaucagcagcaaccaggagcugaucuacgagggcagaagacuggugcuggagcccggcagacuggcccagcacuuccccaagaccaccgaggagaaccccaucuucguggugagcagagagccccugaacaccaucggccugaucuacgagaagaucagccugcccaaggugcaccccagauacgaccuggacggcgacgccagcauggccaaggccaucaccggcguggugugcuacgccugcagaaucgccagcacccugcugcuguaccaggagcugaugagaaagggcaucagauggcugaucgagcugaucaaggacgacuacaacgagaccgugcacaagaagaccgagguggugaucacccuggacuucugcaucagaaacaucgagaagaccgugaagguguacgagaagcugaugaagaucaaccuggaggccgccgagcugggcgagaucagcgacauccacaccaagcugcugagacugagcagcagccagggcaccaucgagaccagccugcaggacaucgacagcagacugagccccggcggcagccuggccgacgccugggcccaccaggagggcacccaccccaaggacagaaacguggagaagcugcaggugcugcugaacugcaugaccgagaucuacuaccaguucaagaaggacaaggccgagagaagacuggccuacaacgaggagcagauccacaaguucgacaagcagaagcuguacuaccacgccaccaaggccaugacccacuucaccgacgagugcgugaagaaguacgaggccuuccugaacaagagcgaggaguggaucagaaagaugcugcaccugagaaagcagcugcugagccugaccaaccagugcuucgacaucgaggaggaggugagcaaguaccaggaguacaccaacgagcugcaggagacccugccccagaagauguucaccgccagcagcggcaucaagcacaccaugacccccaucuaccccagcagcaacacccugguggagaugacccugggcaugaagaagcugaaggaggagauggagggcguggugaaggagcuggccgagaacaaccacauccuggagagauucggcagccugaccauggacggcggccugagaaacguggacugccuguaa

SEQ ID NO: 24409 - RNA, 1848 nt, Artificial Sequence
  TBKBP1__Homo_sapiens__NP_055541
auggagagcauguucgaggacgacaucagcauccugacccaggaggcccugggccccagcgagguguggcuggacagccccggcgaccccagccugggcggcgacaugugcagcgccagccacuucgcccugaucaccgccuacggcgacaucaaggagagacugggcggccuggagagagagaacgccacccugagaagaagacugaagguguacgagaucaaguacccccugaucagcgacuucggcgaggagcacggcuucagccuguacgagaucaaggacggcagccugcuggagguggagaaggugagccugcagcagagacugaaccaguuccagcacgagcugcagaagaacaaggagcaggaggagcagcugggcgagaugauccaggccuacgagaagcugugcguggagaagagcgaccuggagaccgagcugagagagaugagagcccugguggagacccaccugagacagaucugcggccuggagcagcagcugagacagcagcagggccugcaggacgccgccuucagcaaccugagccccccccccgcccccgccccccccugcaccgaccuggaccugcacuaccuggcccugagaggcggcagcggccugagccacgccggcuggcccggcagcacccccagcgugagcgaccuggagagaagaagacuggaggaggcccuggaggccgcccagggcgaggccagaggcgcccagcugagagaggagcagcugcaggccgagugcgagagacugcagggcgagcugaagcagcugcaggagaccagagcccaggaccuggccagcaaccagagcgagagagacauggccugggugaagagagugggcgacgaccaggugaaccuggcccuggccuacaccgagcugaccgaggagcugggcagacugagagagcugagcagccugcagggcagaauccugagaacccugcugcaggagcaggccagaagcggcggccagagacacagcccccugagccagagacacagccccgccccccagugccccagccccagcccccccgccagagccgccccccccugcccccccugccagagccccgugccccagagaagaagccccgugccccccugccccagcccccagcagagaagaagccccgccagccccagcugccccagccccgugccccagagaagaagccccgugccccccagcugccagagccccagcccccagagaagaagccccgugccccccagcugccccgccccccagcccagacccccccccccccccccccccggcgagagaacccuggccgagagagccuacgccaagccccccagccaccacgugaaggccggcuuccagggcagaagaagcuacagcgagcuggccgagggcgccgccuacgccggcgccagcccccccuggcugcaggccgaggccgccacccugcccaagcccagagccuacggcagcgagcuguacggccccggcagaccccugagccccagaagagccuucgagggcaucagacugagauucgagaagcagcccagcgaggaggacgagugggccgugcccaccagcccccccagccccgaggugggcaccaucagaugcgccagcuucugcgccggcuuccccauccccgagagccccgccgccaccgccuacgcccacgccgagcacgcccagagcuggcccagcaucaaccugcugauggagaccgugggcagcgacaucagaagcugcccccugugccagcugggcuuccccgugggcuaccccgacgacgcccugaucaagcacaucgacagccaccuggagaacagcaagaucuaa

SEQ ID NO: 24410 - RNA, 1734 nt, Artificial Sequence
  TBL1X__Homo_sapiens__NP_001132938
augaccgagcuggccggcgccagcagcagcugcugccacagacccgccggcagaggcgccaugcagagcgugcugcaccacuuccagagacugagaggcagagagggcggcagccacuucaucaacaccagcagccccagaggcgaggccaagaugagcaucaccagcgacgaggugaacuuccugguguacagauaccugcaggagagcggcuucagccacagcgccuucaccuucggcaucgagagccacaucagccagagcaacaucaacggcacccuggugccccccgccgcccugaucagcauccugcagaagggccugcaguacguggaggccgagaucagcaucaacgaggacggcaccguguucgacggcagacccaucgagagccugagccugaucgacgccgugaugcccgacguggugcagaccagacagcaggccuucagagagaagcuggcccagcagcaggccagcgccgccgccgccgccgccgccgccaccgccgccgccaccgccgccaccaccaccagcgccggcgugagccaccagaaccccagcaagaacagagaggccaccgugaacggcgaggagaacagagcccacagcgugaacaaccacgccaagcccauggagaucgacggcgagguggagauccccagcagcaaggccaccgugcugagaggccacgagagcgagguguucaucugcgccuggaaccccgugagcgaccugcuggccagcggcagcggcgacagcaccgccagaaucuggaaccugaacgagaacagcaacggcggcagcacccagcuggugcugagacacugcaucagagagggcggccacgacgugcccagcaacaaggacgugaccagccuggacuggaacaccaacggcacccugcuggccaccggcagcuacgacggcuucgccagaaucuggaccgaggacggcaaccuggccagcacccugggccagcacaagggccccaucuucgcccugaaguggaacagaaagggcaacuacauccugagcgccggcguggacaagaccaccaucaucugggacgcccacaccggcgaggccaagcagcaguuccccuuccacagcgcccccgcccuggacguggacuggcagaacaacaccaccuucgccagcugcagcaccgacaugugcauccacgugugcagacugggcugcgacagacccgugaagaccuuccagggccacaccaacgaggugaacgccaucaagugggaccccagcggcaugcugcuggccagcugcagcgacgacaugacccugaagaucuggagcaugaagcaggaggugugcauccacgaccugcaggcccacaacaaggagaucuacaccaucaaguggagccccaccggccccgccaccagcaaccccaacagcaacaucaugcuggccagcgccagcuucgacagcaccgugagacugugggacaucgagagaggcgugugcacccacacccugaccaagcaccaggagcccguguacagcguggccuucagccccgacggcaaguaccuggccagcggcagcuucgacaagugcgugcacaucuggaacacccagagcggcaaccuggugcacagcuacagaggcaccggcggcaucuucgaggugugcuggaacgccagaggcgacaaggugggcgccagcgccagcgacggcagcgugugcgugcuggaccugagaaaguaa

SEQ ID NO: 24411 - RNA, 1575 nt, Artificial Sequence
  TBL1XR1__Homo_sapiens__XP_005247828
augggcgugaagcaccagcagcagcagcuggugaucggcggcgacagaaucuucagcugcaccagcccccaccagugcaccgccaacggcuucagccacagcgccuucaccuucggcaucgagagccacaucagccagagcaacaucaacggcgcccuggugccccccgccgcccugaucagcaucauccagaagggccugcaguacguggaggccgaggugagcaucaacgaggacggcacccuguucgacggcagacccaucgagagccugagccugaucgacgccgugaugcccgacguggugcagaccagacagcaggccuacagagacaagcuggcccagcagcaggccgccgccgccgccgccgccgccgccgccgccagccagcagggcagcgccaagaacggcgagaacaccgccaacggcgaggagaacggcgcccacaccaucgccaacaaccacaccgacaugauggagguggacggcgacguggagaucccccccaacaaggccguggugcugagaggccacgagagcgagguguucaucugcgccuggaaccccgugagcgaccugcuggccagcggcagcggcgacagcaccgccagaaucuggaaccugagcgagaacagcaccagcggcagcacccagcuggugcugagacacugcaucagagagggcggccaggacgugcccagcaacaaggacgugaccagccuggacuggaacagcgagggcacccugcuggccaccggcagcuacgacggcuucgccagaaucuggaccaaggacggcaaccuggccagcacccugggccagcacaagggccccaucuucgcccugaaguggaacaagaagggcaacuucauccugagcgccggcguggacaagaccaccaucaucugggacgcccacaccggcgaggccaagcagcaguuccccuuccacagcgcccccgcccuggacguggacuggcagagcaacaacaccuucgccagcugcagcaccgacaugugcauccacgugugcaagcugggccaggacagacccaucaagaccuuccagggccacaccaacgaggugaacgccaucaagugggaccccaccggcaaccugcuggccagcugcagcgacgacaugacccugaagaucuggagcaugaagcaggacaacugcgugcacgaccugcaggcccacaacaaggagaucuacaccaucaaguggagccccaccggccccggcaccaacaaccccaacgccaaccugaugcuggccagcgccagcuucgacagcaccgugagacugugggacguggacagaggcaucugcauccacacccugaccaagcaccaggagcccguguacagcguggccuucagccccgacggcagauaccuggccagcggcagcuucgacaagugcgugcacaucuggaacacccagaccggcgcccuggugcacagcuacagaggcaccggcggcaucuucgaggugugcuggaacgccgccggcgacaaggugggcgccagcgccagcgacggcagcgugugcgugcuggaccugagaaaguaa

SEQ ID NO: 24412 - RNA, 1569 nt, Artificial Sequence
  TBL1Y__Homo_sapiens__NP_599021
augagcaucaccagcgacgaggugaacuuccugguguacagauaccugcaggagagcggcuucagccacagcgccuucaccuucggcaucgagagccacaucagccagagcaacaucaacggcacccuggugccccccagcgcccugaucagcauccugcagaagggccugcaguacguggaggccgagaucagcaucaacaaggacggcaccguguucgacagcagacccaucgagagccugagccugaucguggccgugauccccgacguggugcagaugagacagcaggccuucggcgagaagcugacccagcagcaggccagcgccgccgccaccgaggccagcgccauggccaaggccgccaccaugacccccgccgccaucagccagcagaacccccccaagaacagagaggccaccgugaacggcgaggagaacggcgcccacgagaucaacaaccacagcaagcccauggagaucgacggcgacguggagaucccccccaacaaggccaccgugcugagaggccacgagagcgagguguucaucugcgccuggaaccccgugagcgaccugcuggccagcggcagcggcgacagcaccgccagaaucuggaaccugaacgagaacagcaacggcggcagcacccagcuggugcugagacacugcaucagagagggcggccacgacgugcccagcaacaaggacgugaccagccuggacuggaacagcgacggcacccugcuggccaugggcagcuacgacggcuucgccagaaucuggaccgagaacggcaaccuggccagcacccugggccagcacaagggccccaucuucgcccugaaguggaacaagaagggcaacuacgugcugagcgccggcguggacaagaccaccaucaucugggacgcccacaccggcgaggccaagcagcaguuccccuuccacagcgcccccgcccuggacguggacuggcagaacaacaugaccuucgccagcugcagcaccgacaugugcauccacgugugcagacugggcugcgaccaccccgugaagaccuuccagggccacaccaacgaggugaacgccaucaagugggaccccagcggcaugcugcuggccagcugcagcgacgacaugacccugaagaucuggagcaugaagcaggacgccugcgugcacgaccugcaggcccacagcaaggagaucuacaccaucaaguggagccccaccggccccgccaccagcaaccccaacagcagcaucaugcuggccagcgccagcuucgacagcaccgugagacugugggacguggagcagggcgugugcacccacacccugaugaagcaccaggagcccguguacagcguggccuucagccccgacggcaaguaccuggccagcggcagcuucgacaaguacgugcacaucuggaacacccagagcggcagccuggugcacagcuaccagggcaccggcggcaucuucgaggugugcuggaacgccagaggcgacaaggugggcgccagcgccagcgacggcagcgugugcgugcuggaccuguaa

SEQ ID NO: 24413 - RNA, 1344 nt, Artificial Sequence
  TBL2__Homo_sapiens__NP_036585
auggagcugagccagaugagcgagcugaugggccugagcgugcugcugggccugcuggcccugauggccaccgccgccguggccagaggcuggcugagagccggcgaggagagaagcggcagacccgccugccagaaggccaacggcuucccccccgacaagagcagcggcagcaagaagcagaagcaguaccagagaaucagaaaggagaagccccagcagcacaacuucacccacagacugcuggccgccgcccugaagagccacagcggcaacaucagcugcauggacuucagcagcaacggcaaguaccuggccaccugcgccgacgacagaaccaucagaaucuggagcaccaaggacuuccugcagagagagcacagaagcaugagagccaacguggagcuggaccacgccacccuggugagauucagccccgacugcagagccuucaucguguggcuggccaacggcgacacccugagaguguucaagaugaccaagagagaggacggcggcuacaccuucaccgccacccccgaggacuuccccaagaagcacaaggcccccgugaucgacaucggcaucgccaacaccggcaaguucaucaugaccgccagcagcgacaccaccgugcugaucuggagccugaagggccaggugcugagcaccaucaacaccaaccagaugaacaacacccacgccgccgugagccccugcggcagauucguggccagcugcggcuucacccccgacgugaaggugugggaggugugcuucggcaagaagggcgaguuccaggagguggugagagccuucgagcugaagggccacagcgccgccgugcacagcuucgccuucagcaacgacagcagaagaauggccagcgugagcaaggacggcaccuggaagcugugggacaccgacguggaguacaagaagaagcaggaccccuaccugcugaagaccggcagauucgaggaggccgccggcgccgcccccugcagacuggcccugagccccaacgcccaggugcuggcccuggccagcggcagcagcauccaccuguacaacaccagaagaggcgagaaggaggagugcuucgagagagugcacggcgagugcaucgccaaccugagcuucgacaucaccggcagauuccuggccagcugcggcgacagagccgugagacuguuccacaacacccccggccacagagccaugguggaggagaugcagggccaccugaagagagccagcaacgagagcaccagacagagacugcagcagcagcugacccaggcccaggagacccugaagagccugggcgcccugaagaaguaa

SEQ ID NO: 24414 - RNA, 2427 nt, Artificial Sequence
  TBL3__Homo_sapiens__NP_006444
auggccgagaccgccgccggcgugggcagauucaagaccaacuacgccguggagagaaagaucgagcccuucuacaagggcggcaaggcccagcuggaccagaccggccagcaccuguucugcgugugcggcaccagagugaacauccuggagguggccagcggcgccgugcugagaagccuggagcaggaggaccaggaggacaucaccgccuucgaccugagccccgacaacgaggugcuggugaccgccagcagagcccugcugcuggcccagugggccuggcaggagggcagcgugaccagacuguggaaggccauccacaccgcccccguggccaccauggccuucgaccccaccagcacccugcuggccaccggcggcugcgacggcgccgugagagugugggacaucgugagacacuacggcacccaccacuucagaggcagccccggcguggugcaccugguggccuuccaccccgaccccaccagacugcugcuguucagcagcgccaccgacgccgccaucagaguguggagccugcaggacagaagcugccuggccgugcugaccgcccacuacagcgccgugaccagccuggccuucagcgccgacggccacaccaugcugagcagcggcagagacaagaucugcaucaucugggaccugcagagcugccaggccaccagaaccgugcccguguucgagagcguggaggccgccgugcugcugcccgaggagcccgugagccagcugggcgugaagagccccggccuguacuuccugaccgccggcgaccagggcacccugagagugugggaggccgccagcggccagugcguguacacccaggcccagccccccggccccggccaggagcugacccacugcacccuggcccacaccgccggcguggugcugaccgccaccgccgaccacaaccugcugcuguacgaggccagaagccugagacugcagaagcaguucgccggcuacagcgaggaggugcuggacgugagauuccugggccccgaggacagccacguggugguggccagcaacagccccugccugaagguguucgagcugcagaccagcgccugccagauccugcacggccacaccgacaucgugcuggcccuggacguguucagaaagggcuggcuguucgccagcugcgccaaggaccagagcgugagaaucuggagaaugaacaaggccggccaggugaugugcguggcccagggcagcggccacacccacagcgugggcaccgugugcugcagcagacugaaggagagcuuccuggugaccggcagccaggacugcaccgugaagcuguggccccugcccaaggcccugcugagcaagaacaccgcccccgacaacggccccauccugcugcaggcccagaccacccagagaugccacgacaaggacaucaacagcguggccaucgcccccaacgacaagcugcuggccaccggcagccaggacagaaccgccaagcugugggcccugccccagugccagcugcugggcguguucagcggccacagaagaggccuguggugcgugcaguucagccccauggaccaggugcuggccaccgccagcgccgacggcaccaucaagcugugggcccugcaggacuucagcugccugaagaccuucgagggccacgacgccagcgugcugaagguggccuucgugagcagaggcacccagcugcugagcagcggcagcgacggccuggugaagcuguggaccaucaagaacaacgagugcgugagaacccuggacgcccacgaggacaagguguggggccugcacugcagcagacuggacgaccacgcccugaccggcgccagcgacagcagagugauccuguggaaggacgugaccgaggccgagcaggccgaggagcaggccagacaggaggagcagguggugagacagcaggagcuggacaaccugcugcacgagaagagauaccugagagcccugggccuggccaucagccuggacagaccccacaccgugcugaccgugauccaggccaucagaagagaccccgaggccugcgagaagcuggaggccaccaugcugagacugagaagagaccagaaggaggcccugcugagauucugcgugaccuggaacaccaacagcagacacugccacgaggcccaggccgugcugggcgugcugcugagaagagaggcccccgaggagcugcuggccuacgagggcgugagagccgcccuggaggcccugcugcccuacaccgagagacacuuccagagacugagcagaacccugcaggccgccgccuuccuggacuuccuguggcacaacaugaagcugcccgugcccgccgccgcccccacccccugggagacccacaagggcgcccugcccuaa

SEQ ID NO: 24415 - RNA, 960 nt, Artificial Sequence
  TBP__Homo_sapiens__NP_001165556
augacccccggcauccccaucuucagccccaugaugcccuacggcaccggccugaccccccagcccauccagaacaccaacagccugagcauccuggaggagcagcagagacagcagcagcagcagcagcagcagcagcagcagcagcagcagcagcagcagcagcagcagcagcagcagcagcagcagcagcagcagcagcagcagcagcagcagcagcagcaggccguggccgccgccgccgugcagcagagcaccagccagcaggccacccagggcaccagcggccaggccccccagcuguuccacagccagacccugaccaccgccccccugcccggcaccaccccccuguaccccagccccaugacccccaugacccccaucacccccgccacccccgccagcgagagcagcggcaucgugccccagcugcagaacaucgugagcaccgugaaccugggcugcaagcuggaccugaagaccaucgcccugagagccagaaacgccgaguacaaccccaagagauucgccgccgugaucaugagaaucagagagcccagaaccaccgcccugaucuucagcagcggcaagauggugugcaccggcgccaagagcgaggagcagagcagacuggccgccagaaaguacgccagaguggugcagaagcugggcuuccccgccaaguuccuggacuucaagauccagaacauggugggcagcugcgacgugaaguuccccaucagacuggagggccuggugcugacccaccagcaguucagcagcuacgagcccgagcuguuccccggccugaucuacagaaugaucaagcccagaaucgugcugcugaucuucgugagcggcaagguggugcugaccggcgccaaggugagagccgagaucuacgaggccuucgagaacaucuaccccauccugaagggcuucagaaagaccaccuaa

SEQ ID NO: 24416 - RNA, 561 nt, Artificial Sequence
  TBPL1__Homo_sapiens__NP_004856
auggacgccgacagcgacguggcccuggacauccugaucaccaacguggugugcguguucagaaccagaugccaccugaaccugagaaagaucgcccuggagggcgccaacgugaucuacaagagagacgugggcaaggugcugaugaagcugagaaagcccagaaucaccgccaccaucuggagcagcggcaagaucaucugcaccggcgccaccagcgaggaggaggccaaguucggcgccagaagacuggccagaagccugcagaagcugggcuuccaggugaucuucaccgacuucaagguggugaacgugcuggccgugugcaacaugcccuucgagaucagacugcccgaguucaccaagaacaacagaccccacgccagcuacgagcccgagcugcaccccgccgugugcuacagaaucaagagccugagagccacccugcagaucuucagcaccggcagcaucaccgugaccggccccaacgugaaggccguggccaccgccguggagcagaucuaccccuucguguucgagagcagaaaggagauccuguaa

SEQ ID NO: 24417 - RNA, 1128 nt, Artificial Sequence
  TBPL2__Homo_sapiens__NP_950248
auggccagcgcccccuggcccgagagagugcccagacugcuggcccccagacugcccagcuaccccccccccccccccaccgugggccugagaagcauggagcaggaggagaccuaccuggagcuguaccuggaccagugcgccgcccaggacggccuggccccccccagaagcccccuguucagccccguggugcccuacgacauguacauccugaacgccagcaaccccgacaccgccuucaacagcaaccccgaggugaaggagaccagcggcgacuucagcagcguggaccugagcuuccugcccgacgaggugacccaggagaacaaggaccagcccgugaucagcaagcacgagaccgaggagaacagcgagagccagagcccccagagcagacugcccagccccagcgagcaggacgugggccugggccugaacagcagcagccugagcaacagccacagccagcugcaccccggcgacaccgacagcgugcagcccagccccgagaagcccaacagcgacagccugagccuggccagcaucacccccaugacccccaugacccccaucagcgagugcugcggcaucgugccccagcugcagaacaucgugagcaccgugaaccuggccugcaagcuggaccugaagaagaucgcccugcacgccaagaacgccgaguacaaccccaagagauucgccgccgugaucaugagaaucagagagcccagaaccaccgcccugaucuucagcagcggcaagauggugugcaccggcgccaagagcgaggagcagagcagacuggccgccagaaaguacgccagaguggugcagaagcugggcuuccccgccagauuccuggacuucaagauccagaacauggugggcagcugcgacgugagauuccccaucagacuggagggccuggugcugacccaccagcaguucagcagcuacgagcccgagcuguuccccggccugaucuacagaauggugaagcccagaaucgugcugcugaucuucgugagcggcaagguggugcugaccggcgccaaggagagaagcgagaucuacgaggccuucgagaacaucuaccccauccugaagggcuucaagaaggccuaa

SEQ ID NO: 24418 - RNA, 2049 nt, Artificial Sequence
  TBR1__Homo_sapiens__NP_006584
augcagcuggagcacugccugagccccagcaucaugcugagcaagaaguuccugaacgugagcagcagcuacccccacagcggcggcagcgagcuggugcugcacgaccaccccaucaucagcaccaccgacaaccuggagagaagcagcccccugaagaagaucaccagaggcaugaccaaccagagcgacaccgacaacuuccccgacagcaaggacagccccggcgacgugcagagaagcaagcugagccccgugcuggacggcgugagcgagcugagacacagcuucgacggcagcgccgccgacagauaccugcugagccagagcagccagccccagagcgccgccaccgcccccagcgccauguuccccuaccccggccagcacggccccgcccaccccgccuucagcaucggcagccccagcagauacauggcccaccaccccgugaucaccaacggcgccuacaacagccugcugagcaacagcagcccccagggcuaccccaccgccggcuaccccuacccccagcaguacggccacagcuaccagggcgcccccuucuaccaguucagcagcacccagcccggccuggugcccggcaaggcccagguguaccugugcaacagaccccuguggcugaaguuccacagacaccagaccgagaugaucaucaccaagcagggcagaagaauguuccccuuccugagcuucaacaucagcggccuggaccccaccgcccacuacaacaucuucguggacgugauccuggccgaccccaaccacuggagauuccagggcggcaagugggugcccugcggcaaggccgacaccaacgugcagggcaacagaguguacaugcaccccgacagccccaacaccggcgcccacuggaugagacaggagaucagcuucggcaagcugaagcugaccaacaacaagggcgccagcaacaacaacggccagaugguggugcugcagagccugcacaaguaccagcccagacugcacgugguggaggugaacgaggacggcaccgaggacaccagccagcccggcagagugcagaccuucaccuuccccgagacccaguucaucgccgugaccgccuaccagaacaccgacaucacccagcugaagaucgaccacaaccccuucgccaagggcuucagagacaacuacgacaccaucuacaccggcugcgacauggacagacugacccccagccccaacgacagccccagaagccagaucgugcccggcgccagauacgccauggccggcagcuuccugcaggaccaguucgugagcaacuacgccaaggccagauuccaccccggcgccggcgccggccccggccccggcaccgacagaagcgugccccacaccaacggccugcugagcccccagcaggccgaggaccccggcgcccccagcccccagagaugguucgugacccccgccaacaacagacuggacuucgccgccagcgccuacgacaccgccaccgacuucgccggcaacgccgccacccugcugagcuacgccgccgccggcgugaaggcccugccccugcaggccgccggcugcaccggcagaccccugggcuacuacgccgaccccagcggcuggggcgccagaagccccccccaguacugcggcaccaagagcggcagcgugcugcccugcuggcccaacagcgccgccgccgccgccagaauggccggcgccaaccccuaccugggcgaggaggccgagggccuggccgccgagagaagcccccugccccccggcgccgccgaggacgccaagcccaaggaccugagcgacagcagcuggaucgagacccccagcagcaucaagagcaucgacagcagcgacagcggcaucuacgagcaggccaagagaagaagaaucagccccgccgacacccccgugagcgagagcagcagcccccugaagagcgaggugcuggcccagagagacugcgagaagaacugcgccaaggacaucagcggcuacuacggcuucuacagccacagcuaa

SEQ ID NO: 24419 - RNA, 1236 nt, Artificial Sequence
  TBRG1__Homo_sapiens__NP_116200
augagccugcuggacggccuggccagcagccccagagccccccugcagagcagcaaggccagaaugaagaagcugcccaagaagagccagaacgagaaguacagacugaaguaccugagacugagaaaggccgccaaggccaccguguucgagaacgccgccaucugcgacgagaucgccagacuggaggagaaguuccugaaggccaaggaggagagaagauaccugcugaagaagcugcugcagcugcaggcccugaccgagggcgaggugcaggccgccgcccccagccacagcagcagccugccccugaccuacggcguggccagcagcgugggcaccauccagggcgccggccccaucagcggccccagcaccggcgccgaggagcccuucggcaagaagaccaagaaggagaagaaggagaagggcaaggagaacaacaagcuggaggugcugaagaagaccugcaagaagaagaagauggccggcggcgccagaaagcuggugcagcccaucgcccuggaccccagcggcagacccguguuccccaucggccugggcggccugaccguguacagccugggcgagaucaucaccgacagacccggcuuccacgacgagagcgccaucuaccccgugggcuacugcagcaccagaaucuacgccagcaugaagugccccgaccagaagugccuguacaccugccagaucaaggacggcggcgugcagccccaguucgagaucgugcccgaggacgacccccagaacgccaucgugagcagcagcgccgacgccugccacgccgagcugcugagaaccaucagcaccaccaugggcaagcugaugcccaaccugcugcccgccggcgccgacuucuucggcuucagccaccccgccauccacaaccugauccagagcugccccggcgccagaaagugcaucaacuaccagugggugaaguucgacgugugcaagcccggcgacggccagcugcccgagggccugcccgagaacgacgccgccaugagcuucgaggccuuccagagacagaucuucgacgaggaccagaacgacccccugcugcccggcagccuggaccugcccgagcugcagcccgccgccuucgugagcagcuaccagcccauguaccugacccacgagccccugguggacacccaccugcagcaccugaagagccccagccagggcagccccauccagagcagcgacuaa

SEQ ID NO: 24420 - RNA, 1158 nt, Artificial Sequence
  TBX10__Homo_sapiens__NP_005986
auggccgccuuccugagcgccggccugggcauccuggcccccagcgagaccuacccccugcccaccaccagcagcggcugggagcccagacugggcagccccuuccccagcggccccugcaccagcagcaccggcgcccaggccguggccgagcccaccggccagggccccaagaaccccagagugagcagagugaccgugcagcuggagaugaagccccugugggaggaguucaaccagcugggcaccgagaugaucgugaccaaggccggcagaagaauguucccccccuuccaggugaagauccugggcauggacagccuggccgacuacgcccugcugauggacuucaucccccuggacgacaagagauacagauacgccuuccacagcagcgccuggcugguggccggcaaggccgaccccgccacccccggcagagugcacuuccaccccgacagccccgccaagggcgcccaguggaugagacagaucgugagcuucgacaagcugaagcugaccaacaaccugcuggacgacaacggccacaucauccugaacagcaugcacagauaccagcccagauuccacgugguguucguggaccccagaaaggacagcgagagauacgcccaggagaacuucaagagcuucaucuucaccgagacccaguucaccgccgugaccgccuaccagaaccacagaaucacccagcugaagaucgccagcaaccccuucgccaagggcuucagagagagcgaccuggacagcuggcccguggcccccagaccccugcugagcgugcccgccagaagccacagcagccugagccccugcgugcugaagggcgccaccgacagagagaaggaccccaacaaggccagcgccagcaccagcaagacccccgccuggcugcaccaccagcugcugcccccccccgaggugcugcuggcccccgccaccuacagacccgugaccuaccagagccuguacagcggcgcccccagccaccugggcauccccagaaccagacccgcccccuacccccugcccaacaucagagccgacagagaccagggcggccugccccugcccgccggccugggccugcugagccccaccguggugugccugggccccggccaggacagccaguaa

SEQ ID NO: 24421 - RNA, 1824 nt, Artificial Sequence
  TBX18__Homo_sapiens__NP_001073977
auggccgagaagagaagaggcagccccugcagcaugcugagccugaaggcccacgccuucagcguggaggcccugaucggcgccgagaagcagcagcagcugcagaagaagagaagaaagcugggcgccgaggaggccgccggcgccguggacgacggcggcugcagcagaggcggcggcgccggcgagaagggcagcagcgagggcgacgagggcgccgcccugcccccccccgccggcgccaccagcggccccgccagaagcggcgccgaccuggagagaggcgccgccggcggcugcgaggacggcuuccagcagggcgccagcccccuggccagccccggcggcagccccaagggcagccccgccagaagccuggccagacccggcaccccccugcccagcccccaggcccccagaguggaccugcagggcgccgagcuguggaagagauuccacgagaucggcaccgagaugaucaucaccaaggccggcagaagaauguuccccgccaugagagugaagaucagcggccuggacccccaccagcaguacuacaucgccauggacaucgugcccguggacaacaagagauacagauacguguaccacagcagcaaguggaugguggccggcaacgccgacagccccgugccccccagaguguacauccaccccgacagccccgccagcggcgagaccuggaugagacaggugaucagcuucgacaagcugaagcugaccaacaacgagcuggacgaccagggccacaucauccugcacagcaugcacaaguaccagcccagagugcacgugaucagaaaggacugcggcgacgaccugagccccaucaagcccgugcccagcggcgagggcgugaaggccuucagcuuccccgagaccguguucaccaccgugaccgccuaccagaaccagcagaucaccagacugaagaucgacagaaaccccuucgccaagggcuucagagacagcggcagaaacagaaugggccuggaggcccugguggagagcuacgccuucuggagacccagccugagaacccugaccuucgaggacauccccggcauccccaagcagggcaacgccagcagcagcacccugcugcagggcaccggcaacggcgugcccgccacccacccccaccugcugagcggcagcagcugcagcagccccgccuuccaccugggccccaacaccagccagcugugcagccuggcccccgccgacuacagcgccugcgccagaagcggccugacccugaacagauacagcaccagccuggccgagaccuacaacagacugaccaaccaggccggcgagaccuucgccccccccagaacccccagcuacgugggcgugagcagcagcaccagcgugaacaugagcaugggcggcaccgacggcgacaccuucagcugcccccagaccagccugagcaugcagaucagcggcaugagcccccagcugcaguacaucaugcccagccccagcagcaacgccuucgccaccaaccagacccaccagggcagcuacaacaccuucagacugcacagccccugcgcccuguacggcuacaacuucagcaccagccccaagcuggccgccagccccgagaagaucgugagcagccagggcagcuuccugggcagcagccccagcggcaccaugaccgacagacagaugcugccccccguggagggcgugcaccugcugagcagcggcggccagcagagcuucuucgacagcagaacccugggcagccugacccugagcagcagccaggugagcgcccacaugguguaa

SEQ ID NO: 24422 - RNA, 1347 nt, Artificial Sequence
  TBX19__Homo_sapiens__NP_005140
auggccaugagcgagcugggcaccagaaagcccagcgacggcaccgugagccaccugcugaacgugguggagagcgagcugcaggccggcagagagaagggcgaccccaccgagaagcagcugcagaucauccuggaggacgccccccuguggcagagauucaaggaggugaccaacgagaugaucgugaccaagaacggcagaagaauguuccccgugcugaagaucagcgugaccggccuggaccccaacgccauguacagccugcugcuggacuucgugcccaccgacagccacagauggaaguacgugaacggcgagugggugcccgccggcaagcccgaggugagcagccacagcugcguguacauccaccccgacagccccaacuucggcgcccacuggaugaaggcccccaucagcuucagcaaggugaagcugaccaacaagcugaacggcggcggccagaucaugcugaacagccugcacaaguacgagccccaggugcacaucgugagagugggcagcgcccacagaauggugaccaacugcagcuuccccgagacccaguucaucgccgugaccgccuaccagaacgaggagaucaccgcccugaagaucaaguacaaccccuucgccaaggccuuccuggacgccaaggagagaaaccaccugagagacgugcccgaggccaucagcgagagccagcacgugaccuacagccaccugggcggcuggaucuucagcaaccccgacggcgugugcaccgccggcaacagcaacuaccaguacgccgccccccugccccugcccgccccccacacccaccacggcugcgagcacuacagcggccugagaggccacagacaggcccccuaccccagcgccuacaugcacagaaaccacagccccagcgugaaccugaucgagagcagcagcaacaaccugcagguguucagcggccccgacagcuggaccagccugagcagcaccccccacgccagcauccugagcgugccccacaccaacggccccaucaaccccggccccagccccuaccccugccuguggaccaucagcaacggcgccggcggccccagcggccccggccccgaggugcacgccagcacccccggcgccuuccugcugggcaaccccgccgugaccagcccccccagcgugcugagcacccaggcccccaccagcgccggcguggaggugcugggcgagcccagccugaccagcaucgccgugagcaccuggaccgccguggccagccaccccuucgccggcuggggcggccccggcgccggcggccaccacagccccagcagccuggacggcuaa

SEQ ID NO: 24423 - RNA, 1119 nt, Artificial Sequence
  TBX1__Homo_sapiens__NP_005983
augcacuucagcaccgugaccagagacauggaggccuucaccgccagcagccugagcagccugggcgccgccggcggcuuccccggcgccgccagccccggcgccgaccccuacggccccagagagccccccccccccccccccagauacgaccccugcgccgccgccgcccccggcgcccccggcccccccccccccccccacgccuaccccuucgcccccgccgccggcgccgccaccagcgccgccgccgagcccgagggccccggcgccagcugcgccgccgccgccaaggcccccgugaagaagaacgccaagguggccggcgugagcgugcagcuggagaugaaggcccugugggacgaguucaaccagcugggcaccgagaugaucgugaccaaggccggcagaagaauguuccccaccuuccaggugaagcuguucggcauggaccccauggccgacuacaugcugcugauggacuucgugcccguggacgacaagagauacagauacgccuuccacagcagcagcuggcugguggccggcaaggccgaccccgccacccccggcagagugcacuaccaccccgacagccccgccaagggcgcccaguggaugaagcagaucgugagcuucgacaagcugaagcugaccaacaaccugcuggacgacaacggccacaucauccugaacagcaugcacagauaccagcccagauuccacgugguguacguggaccccagaaaggacagcgagaaguacgccgaggagaacuucaagaccuucguguucgaggagaccagauucaccgccgugaccgccuaccagaaccacagaaucacccagcugaagaucgccagcaaccccuucgccaagggcuucagagacugcgaccccgaggacuggcccagaaaccacagacccggcgcccugccccugaugagcgccuucgccagaagcagaaaccccguggccagccccacccagcccagcggcaccgagaagggccuggugaccgagggcagcggccugcagcccggccugcuggacgugcugcugaagccccccagcaagaagagcgagagccugagacccccccacugcaaggacaccuaa

SEQ ID NO: 24424 - RNA, 1344 nt, Artificial Sequence
  TBX20__Homo_sapiens__NP_001071121
auggaguucaccgccagccccaagccccagcugagcagcagagccaacgccuucagcaucgccgcccugaugagcagcggcggcagcaaggagaaggaggccaccgagaacaccaucaagccccuggagcaguucguggagaagagcagcugcgcccagccccugggcgagcugaccagccuggacgcccacggcgaguucggcggcggcagcggcagcagccccagcagcagcagccugugcaccgagccccugauccccaccacccccaucauccccagcgaggagauggccaagaucgccugcagccuggagaccaaggagcugugggacaaguuccacgagcugggcaccgagaugaucaucaccaagagcggcagaagaauguuccccaccaucagagugagcuucagcggcguggaccccgaggccaaguacaucgugcugauggacaucgugcccguggacaacaagagauacagauacgccuaccacagaagcagcuggcugguggccggcaaggccgaccccccccugcccgccagacuguacgugcaccccgacagccccuucaccggcgagcagcugcugaagcagauggugagcuucgagaaggugaagcugaccaacaacgagcuggaccagcacggccacaucauccugaacagcaugcacaaguaccagcccagagugcacaucaucaagaagaaggaccacaccgccagccugcugaaccugaagagcgaggaguucagaaccuucaucuuccccgagaccguguucaccgccgugaccgccuaccagaaccagcugaucaccaagcugaagaucgacagcaaccccuucgccaagggcuucagagacagcagcagacugaccgacaucgagagagagagcguggagagccugauccagaagcacagcuacgccagaagccccaucagaaccuacggcggcgaggaggacgugcugggcgacgagagccagaccacccccaacagaggcagcgccuucaccaccagcgacaaccugagccugagcagcugggugagcagcagcagcagcuuccccggcuuccagcacccccagagccugaccgcccugggcaccagcaccgccagcaucgccacccccaucccccaccccauccagggcagccugccccccuacagcagacugggcaugccccugacccccagcgccaucgccagcagcaugcagggcagcggccccaccuuccccagcuuccacaugcccagauaccaccacuacuuccagcagggccccuacgccgccauccagggccugagacacagcagcgccgugaugacccccuucguguaa

SEQ ID NO: 24425 - RNA, 1608 nt, Artificial Sequence
  TBX21__Homo_sapiens__NP_037483
augggcaucguggagcccggcugcggcgacaugcugaccggcaccgagcccaugcccggcagcgacgagggcagagcccccggcgccgacccccagcacagauacuucuaccccgagcccggcgcccaggacgccgacgagagaagaggcggcggcagccugggcagccccuaccccggcggcgcccuggugcccgccccccccagcagauuccugggcgccuacgccuacccccccagaccccaggccgccggcuuccccggcgccggcgagagcuuccccccccccgccgacgccgagggcuaccagcccggcgagggcuacgccgcccccgaccccagagccggccuguaccccggccccagagaggacuacgcccugcccgccggccuggaggugagcggcaagcugagaguggcccugaacaaccaccugcuguggagcaaguucaaccagcaccagaccgagaugaucaucaccaagcagggcagaagaauguuccccuuccugagcuucaccguggccggccuggagcccaccagccacuacagaauguucguggacguggugcugguggaccagcaccacuggagauaccagagcggcaagugggugcagugcggcaaggccgagggcagcaugcccggcaacagacuguacgugcaccccgacagccccaacaccggcgcccacuggaugagacaggaggugagcuucggcaagcugaagcugaccaacaacaagggcgccagcaacaacgugacccagaugaucgugcugcagagccugcacaaguaccagcccagacugcacaucguggaggugaacgacggcgagcccgaggccgccugcaacgccagcaacacccacaucuucaccuuccaggagacccaguucaucgccgugaccgccuaccagaacgccgagaucacccagcugaagaucgacaacaaccccuucgccaagggcuucagagagaacuucgagagcauguacaccagcguggacaccagcauccccagcccccccggccccaacugccaguuccugggcggcgaccacuacagcccccugcugcccaaccaguaccccgugcccagcagauucuaccccgaccugcccggccaggccaaggacguggugccccaggccuacuggcugggcgcccccagagaccacagcuacgaggccgaguucagagccgugagcaugaagcccgccuuccugcccagcgcccccggccccaccaugagcuacuacagaggccaggaggugcuggcccccggcgccggcuggcccguggccccccaguacccccccaagaugggccccgccagcugguucagacccaugagaacccugcccauggagcccggccccggcggcagcgagggcagaggccccgaggaccagggccccccccugguguggaccgagaucgcccccaucagacccgagagcagcgacagcggccugggcgagggcgacagcaagagaagaagagugagccccuaccccagcagcggcgacagcagcagccccgccggcgcccccagccccuucgacaaggaggccgagggccaguucuacaacuacuuccccaacuaa

SEQ ID NO: 24426 - RNA, 1563 nt, Artificial Sequence
  TBX22__Homo_sapiens__NP_001103348
auggcccugagcagcagagccagagccuucagcguggaggcccuggugggcagacccagcaagagaaagcugcaggaccccauccaggccgagcagcccgagcugagagagaagaagggcggcgaggaggaggaggagagaagaagcagcgccgccggcaagagcgagccccuggagaagcagcccaagaccgagcccagcaccagcgccagcagcggcugcggcagcgacagcggcuacggcaacagcagcgagagccuggaggagaaggacauccagauggagcugcagggcagcgagcuguggaagagauuccacgacaucggcaccgagaugaucaucaccaaggccggcagaagaauguuccccagcgugagagugaaggugaagggccuggaccccggcaagcaguaccacguggccaucgacguggugcccguggacagcaagagauacagauacguguaccacagcagccaguggaugguggccggcaacaccgaccaccugugcaucauccccagauucuacgugcaccccgacagccccugcagcggcgagaccuggaugagacagaucaucagcuucgacagaaugaagcugaccaacaacgagauggacgacaagggccacaucauccugcagagcaugcacaaguacaagcccagagugcacgugaucgagcagggcagcagcguggaccugagccagauccagagccugcccaccgagggcgugaagaccuucagcuucaaggagaccgaguucaccaccgugaccgccuaccagaaccagcagaucaccaagcugaagaucgagagaaaccccuucgccaagggcuucagagacaccggcagaaacagaggcgugcuggacggccugcuggagaccuaccccuggagacccagcuucacccuggacuucaagaccuucggcgccgacacccagagcggcagcagcggcagcagccccgugaccagcagcggcggcgcccccagcccccugaacagccugcugagcccccugugcuucagccccauguuccaccugcccaccagcagccugggcaugcccugccccgaggccuaccugcccaacgugaaccugccccugugcuacaagaucugccccaccaacuucuggcagcagcagccccuggugcugcccgcccccgagagacuggccagcagcaacagcagccagagccuggccccccugaugauggaggugcccaugcugagcagccugggcgugaccaacagcaagagcggcagcagcgaggacagcagcgaccaguaccugcaggcccccaacagcaccaaccagaugcuguacggccugcagagccccggcaacaucuuccugcccaacagcaucacccccgaggcccugagcugcagcuuccaccccagcuacgacuucuacagauacaacuucagcaugcccagcagacugaucagcggcagcaaccaccugaaggugaacgacgacagccaggugagcuucggcgagggcaagugcaaccacgugcacugguaccccgccaucaaccacuaccuguaa

SEQ ID NO: 24427 - RNA, 2139 nt, Artificial Sequence
  TBX2__Homo_sapiens__XP_011523460
augagagagcccgcccuggccgccagcgccauggccuaccaccccuuccacgcccccagacccgccgacuuccccaugagcgccuuccuggccgccgcccagcccagcuucuuccccgcccuggcccugccccccggcgcccuggccaagccccugcccgaccccggccuggccggcgccgccgccgccgccgccgccgccgccgccgccgccgaggccggccugcacgugagcgcccugggcccccacccccccgccgcccaccugagaagccugaagagccuggagcccgaggacgagguggaggacgaccccaaggugacccuggaggccaaggagcugugggaccaguuccacaagcugggcaccgagauggugaucaccaagagcggcagaagaauguucccccccuucaaggugagagugagcggccuggacaagaaggccaaguacauccugcugauggacaucguggccgccgacgacugcagauacaaguuccacaacagcagauggaugguggccggcaaggccgaccccgagaugcccaagagaauguacauccaccccgacagccccgccaccggcgagcaguggauggccaagcccguggccuuccacaagcugaagcugaccaacaacaucagcgacaagcacggcuucaccauccugaacagcaugcacaaguaccagcccagauuccacaucgugagagccaacgacauccugaagcugcccuacagcaccuucagaaccuacguguuccccgagaccgacuucaucgccgugaccgccuaccagaacgacaagaucacccagcugaagaucgacaacaaccccuucgccaagggcuucagagacaccggcaacggcagaagagagaagagaaagcagcugacccugcccagccugagacuguacgaggagcacugcaagcccgagagagacggcgccgagagcgacgccagcagcugcgaccccccccccgccagagagccccccaccagccccggcgccgcccccagcccccugagacugcacagagccagagccgaggagaagagcugcgccgccgacagcgaccccgagcccgagagacugagcgaggagagagccggcgccccccugggcagaagccccgcccccgacagcgccagccccaccagacugaccgagcccgagagagccagagagagaagaagccccgagagaggcaaggagcccgccgagagcggcggcgacggccccuucggccugagaagccuggagaaggagagagccgaggccagaagaaaggacgagggcagaaaggaggccgccgagggcaaggagcagggccuggccccccugguggugcagaccgacagcgccagcccccugggcgccggccaccugcccggccuggccuucagcagccaccugcacggccagcaguucuucggcccccugggcgccggccagccccuguuccugcaccccggccaguucaccaugggccccggcgccuucagcgccaugggcaugggccaccugcuggccagcguggccggcggcggcaacggcggcggcggcggccccggcaccgccgccggccuggacgccggcggccugggccccgccgccagcgccgccagcaccgccgcccccuuccccuuccaccugagccagcacaugcuggccagccagggcauccccaugcccaccuucggcggccuguuccccuaccccuacaccuacauggccgccgccgccgccgccgccagcgcccugcccgccaccagcgccgccgccgccgccgccgccgccgccggcagccugagcagaagccccuuccugggcagcgccagacccagacugagauucagccccuaccagauccccgugaccaucccccccagcaccagccugcugaccaccggccuggccagcgagggcagcaaggccgccggcggcaacagcagagagcccagcccccugcccgagcuggcccugagaaaggugggcgcccccagcagaggcgcccugagccccagcggcagcgccaaggaggccgccaacgagcugcagagcauccagagacuggugagcggccuggagagccagagagcccugagccccggcagagagagccccaaguaa

SEQ ID NO: 24428 - RNA, 2172 nt, Artificial Sequence
  TBX3__Homo_sapiens__NP_005987
augagccugagcaugagagaccccgugauccccggcaccagcauggccuaccaccccuuccugccccacagagcccccgacuucgccaugagcgccgugcugggccaccagccccccuucuuccccgcccugacccugccccccaacggcgccgccgcccugagccugcccggcgcccuggccaagcccaucauggaccagcuggugggcgccgccgagaccggcauccccuucagcagccugggcccccaggcccaccugagaccccugaagaccauggagcccgaggaggagguggaggacgaccccaaggugcaccuggaggccaaggagcugugggaccaguuccacaagagaggcaccgagauggugaucaccaagagcggcagaagaauguucccccccuucaaggugagaugcagcggccuggacaagaaggccaaguacauccugcugauggacaucaucgccgccgacgacugcagauacaaguuccacaacagcagauggaugguggccggcaaggccgaccccgagaugcccaagagaauguacauccaccccgacagccccgccaccggcgagcaguggaugagcaagguggugaccuuccacaagcugaagcugaccaacaacaucagcgacaagcacggcuucaccauccugaacagcaugcacaaguaccagcccagauuccacaucgugagagccaacgacauccugaagcugcccuacagcaccuucagaaccuaccuguuccccgagaccgaguucaucgccgugaccgccuaccagaacgacaagaucacccagcugaagaucgacaacaaccccuucgccaagggcuucagagacaccggcaacggcagaagagagaagagaaagcagcugacccugcagagcaugagaguguucgacgagagacacaagaaggagaacggcaccagcgacgagagcagcagcgagcaggccgccuucaacugcuucgcccaggccagcagccccgccgccagcaccgugggcaccagcaaccugaaggaccugugccccagcgagggcgagagcgacgccgaggccgagagcaaggaggagcacggccccgaggccugcgacgccgccaagaucagcaccaccaccagcgaggagcccugcagagacaagggcagccccgccgugaaggcccaccuguucgccgccgagagacccagagacagcggcagacuggacaaggccagccccgacagcagacacagccccgccaccaucagcagcagcaccagaggccugggcgccgaggagagaagaagccccgugagagagggcaccgcccccgccaagguggaggaggccagagcccugcccggcaaggaggccuucgccccccugaccgugcagaccgacgccgccgccgcccaccuggcccagggcccccugcccggccugggcuucgcccccggccuggccggccagcaguucuucaacggccacccccuguuccugcaccccagccaguucgccaugggcggcgccuucagcagcauggccgccgccggcaugggcccccugcuggccaccgugagcggcgccagcaccggcgugagcggccuggacagcaccgccauggccagcgccgccgccgcccagggccugagcggcgccagcgccgccacccugcccuuccaccugcagcagcacgugcuggccagccagggccuggccaugagccccuucggcagccuguuccccuaccccuacaccuacauggccgccgccgccgccgccagcagcgccgccgccagcagcagcgugcacagacaccccuuccugaaccugaacaccaugagacccagacugagauacagccccuacagcauccccgugcccgugcccgacggcagcagccugcugaccaccgcccugcccagcauggccgccgccgccggcccccuggacggcaagguggccgcccuggccgccagccccgccagcguggccguggacagcggcagcgagcugaacagcagaagcagcacccugagcagcagcagcaugagccugagccccaagcugugcgccgagaaggaggccgccaccagcgagcugcagagcauccagagacuggugagcggccuggaggccaagcccgacagaagcagaagcgccagccccuaa

SEQ ID NO: 24429 - RNA, 1638 nt, Artificial Sequence
  TBX4__Homo_sapiens__NP_060958
augcugcaggacaagggccugagcgagagcgaggaggccuucagagcccccggccccgcccugggcgaggccagcgccgccaacgcccccgagcccgcccuggccgcccccggccugagcggcgccgcccugggcagcccccccggccccggcgccgacgugguggccgccgccgccgccgagcagaccaucgagaacaucaaggugggccugcacgagaaggagcuguggaagaaguuccacgaggccggcaccgagaugaucaucaccaaggccggcagaagaauguuccccagcuacaaggugaaggugaccggcaugaaccccaagaccaaguacauccugcugaucgacaucgugcccgccgacgaccacagauacaaguucugcgacaacaaguggaugguggccggcaaggccgagcccgccaugcccggcagacuguacgugcaccccgacagccccgccaccggcgcccacuggaugagacagcuggugagcuuccagaagcugaagcugaccaacaaccaccuggaccccuucggccacaucauccugaacagcaugcacaaguaccagcccagacugcacaucgugaaggccgacgagaacaacgccuucggcagcaagaacaccgccuucugcacccacguguuccccgagaccagcuucaucagcgugaccagcuaccagaaccacaagaucacccagcugaagaucgagaacaaccccuucgccaagggcuucagaggcagcgacgacagcgaccugagaguggccagacugcagagcaaggaguaccccgugaucagcaagagcaucaugagacagagacugaucagcccccagcugagcgccacccccgacgugggcccccugcugggcacccaccaggcccugcagcacuaccagcacgagaacggcgcccacagccagcuggccgagccccaggaccugccccugagcaccuuccccacccagagagacagcagccuguucuaccacugccugaagagaagagacggcaccagacaccuggaccugcccugcaagagaagcuaccuggaggcccccagcagcgugggcgaggaccacuacuucagaagccccccccccuacgaccagcagaugcugagccccagcuacugcagcgaggugacccccagagaggccugcauguacagcggcagcggccccgagaucgccggcgugagcggcguggacgaccugcccccccccccccugagcugcaacauguggaccagcgugagccccuacaccagcuacagcgugcagaccauggagaccgugcccuaccagcccuuccccacccacuucaccgccaccaccaugaugcccagacugcccacccugagcgcccagagcagccagccccccggcaacgcccacuucagcguguacaaccagcugagccagagccaggugagagagagaggccccagcgccagcuuccccagagagagaggccugccccagggcugcgagagaaagccccccagcccccaccugaacgccgccaacgaguuccuguacagccagaccuucagccugagcagagagagcagccugcaguaccacagcggcaugggcaccguggagaacuggaccgacggcuaa

SEQ ID NO: 24430 - RNA, 1407 nt, Artificial Sequence
  TBX5__Homo_sapiens__NP_542448
auggagggcaucaagguguuccugcacgagagagagcuguggcugaaguuccacgaggugggcaccgagaugaucaucaccaaggccggcagaagaauguuccccagcuacaaggugaaggugaccggccugaaccccaagaccaaguacauccugcugauggacaucgugcccgccgacgaccacagauacaaguucgccgacaacaaguggagcgugaccggcaaggccgagcccgccaugcccggcagacuguacgugcaccccgacagccccgccaccggcgcccacuggaugagacagcuggugagcuuccagaagcugaagcugaccaacaaccaccuggaccccuucggccacaucauccugaacagcaugcacaaguaccagcccagacugcacaucgugaaggccgacgagaacaacggcuucggcagcaagaacaccgccuucugcacccacguguuccccgagaccgccuucaucgccgugaccagcuaccagaaccacaagaucacccagcugaagaucgagaacaaccccuucgccaagggcuucagaggcagcgacgacauggagcugcacagaaugagcagaaugcagagcaaggaguaccccguggugcccagaagcaccgugagacagaagguggccagcaaccacagccccuucagcagcgagagcagagcccugagcaccagcagcaaccugggcagccaguaccagugcgagaacggcgugagcggccccagccaggaccugcugcccccccccaaccccuacccccugccccaggagcacagccagaucuaccacugcaccaagagaaaggaggaggagugcagcaccaccgaccaccccuacaagaagcccuacauggagaccagccccagcgaggaggacagcuucuacagaagcagcuacccccagcagcagggccugggcgccagcuacagaaccgagagcgcccagagacaggccugcauguacgccagcagcgccccccccagcgagcccgugcccagccuggaggacaucagcugcaacaccuggcccagcaugcccagcuacagcagcugcaccgugaccaccgugcagcccauggacagacugcccuaccagcacuucagcgcccacuucaccagcggcccccuggugcccagacuggccggcauggccaaccacggcagcccccagcugggcgagggcauguuccagcaccagaccagcguggcccaccagcccguggugagacagugcggcccccagaccggccugcagagccccggcacccugcagccccccgaguuccuguacagccacggcgugcccagaacccugagcccccaccaguaccacagcgugcacggcgugggcauggugcccgaguggagcgacaacagcuaa

SEQ ID NO: 24431 - RNA, 1311 nt, Artificial Sequence
  TBX6__Homo_sapiens__NP_004599
auguaccaccccagagagcuguaccccagccugggcgccggcuacagacugggccccgcccagcccggcgccgacagcagcuucccccccgcccuggccgagggcuacagauaccccgagcuggacacccccaagcuggacugcuuccugagcggcauggaggccgcccccagaacccuggccgcccaccccccccugccccugcugccccccgccaugggcaccgagcccgcccccagcgcccccgaggcccugcacagccugcccggcgugagccugagccuggagaacagagagcuguggaaggaguucagcagcgugggcaccgagaugaucaucaccaaggccggcagaagaauguuccccgccugcagagugagcgugaccggccuggaccccgaggccagauaccuguuccugcuggacgugauccccguggacggcgccagauacagauggcagggcagaagaugggagcccagcggcaaggccgagcccagacugcccgacagaguguacauccaccccgacagccccgccaccggcgcccacuggaugagacagcccgugagcuuccacagagugaagcugaccaacagcacccuggacccccacggccaccugauccugcacagcaugcacaaguaccagcccagaauccaccuggugagagccgcccagcugugcagccagcacuggggcggcauggccagcuucagauuccccgagaccaccuucaucagcgugaccgccuaccagaacccccagaucacccagcugaagaucgccgccaaccccuucgccaagggcuucagagagaacggcagaaacugcaagagagagagagacgccagagugaagagaaagcugagaggccccgagcccgccgccaccgaggccuacggcagcggcgacacccccggcggccccugcgacagcacccugggcggcgacaucagagagagcgaccccgagcaggcccccgcccccggcgaggccaccgccgcccccgccccccugugcggcggccccagcgccgaggccuaccugcugcaccccgccgccuuccacggcgcccccagccaccugcccaccagaagccccagcuuccccgaggcccccgacagcggcagaagcgcccccuacagcgccgccuuccuggagcugccccacggcagcggcggcagcggcuaccccgccgccccccccgccgugcccuucgccccccacuuccugcagggcggccccuucccccugcccuacaccgcccccggcggcuaccuggacgugggcagcaagcccauguacuaa

SEQ ID NO: 24432 - RNA, 1224 nt, Artificial Sequence
  TBXA2R__Homo_sapiens__NP_963998
auguggcccaacggcagcagccugggccccugcuucagacccaccaacaucacccuggaggagagaagacugaucgccagccccugguucgccgccagcuucugcguggugggccuggccagcaaccugcuggcccugagcgugcuggccggcgccagacagggcggcagccacaccagaagcagcuuccugaccuuccugugcggccuggugcugaccgacuuccugggccugcuggugaccggcaccaucguggugagccagcacgccgcccuguucgaguggcacgccguggaccccggcugcagacugugcagauucaugggcguggugaugaucuucuucggccugagcccccugcugcugggcgccgccauggccagcgagagauaccugggcaucaccagacccuucagcagacccgccguggccagccagagaagagccugggccaccgugggccuggugugggccgccgcccuggcccugggccugcugccccugcugggcgugggcagauacaccgugcaguaccccggcagcuggugcuuccugacccugggcgccgagagcggcgacguggccuucggccugcuguucagcaugcugggcggccugagcgugggccugagcuuccugcugaacaccgugagcguggccacccugugccacguguaccacggccaggaggccgcccagcagagacccagagacagcgagguggagaugauggcccagcugcugggcaucauggugguggccagcgugugcuggcugccccugcugguguucaucgcccagaccgugcugagaaacccccccgccaugagccccgccggccagcugagcagaaccaccgagaaggagcugcugaucuaccugagaguggccaccuggaaccagauccuggaccccuggguguacauccuguucagaagagccgugcugagaagacugcagcccagacugagcaccagacccagaagaagccugacccuguggcccagccuggaguacagcggcaccaucagcgcccacugcaaccugagacugcccggcagcagcgacagcagagccagcgccagcagagccgccggcaucaccggcgugagccacugcgccagacccugcaugcuguucgaccccgaguucgaccugcuggccggcgugcagcugcugcccuucgagccccccaccggcaaggcccugagcagaaaggacuaa

SEQ ID NO: 24433 - RNA, 1605 nt, Artificial Sequence
  TBXAS1__Homo_sapiens__NP_001052
augauggaggcccugggcuuccugaagcuggaggugaacggccccauggugaccguggcccugagcguggcccugcuggcccugcugaagugguacagcaccagcgccuucagcagacuggagaagcugggccugagacaccccaagcccagccccuucaucggcaaccugaccuucuucagacagggcuucugggagagccagauggagcugagaaagcuguacggcccccugugcggcuacuaccugggcagaagaauguucaucgugaucagcgagcccgacaugaucaagcaggugcugguggagaacuucagcaacuucaccaacagaauggccagcggccuggaguucaagagcguggccgacagcgugcuguuccugagagacaagagaugggaggaggugagaggcgcccugaugagcgccuucagccccgagaagcugaacgagauggugccccugaucagccaggccugcgaccugcugcuggcccaccugaagagauacgccgagagcggcgacgccuucgacauccagagaugcuacugcaacuacaccaccgacgugguggccagcguggccuucggcacccccguggacagcuggcaggcccccgaggaccccuucgugaagcacugcaagagauucuucgaguucugcauccccagacccauccuggugcugcugcugagcuuccccagcaucauggugccccuggccagaauccugcccaacaagaacagagacgagcugaacggcuucuucaacaagcugaucagaaacgugaucgcccugagagaccagcaggccgccgaggagagaagaagagacuuccugcagauggugcuggacgccagacacagcgccagccccaugggcgugcaggacuucgacaucgugagagacguguucagcagcaccggcugcaagcccaaccccagcagacagcaccagcccagccccauggccagaccccugaccguggacgagaucgugggccaggccuucaucuuccugaucgccggcuacgagaucaucaccaacacccugagcuucgccaccuaccugcuggccaccaaccccgacugccaggagaagcugcugagagagguggacguguucaaggagaagcacauggcccccgaguucugcagccuggaggagggccugcccuaccuggacauggugaucgccgagacccugagaauguacccccccgccuucagauucaccagagaggccgcccaggacugcgaggugcugggccagagaauccccgccggcgccgugcuggagauggccgugggcgcccugcaccacgaccccgagcacuggcccagccccgagaccuucaaccccgagagauucaccgccgaggccagacagcagcacagacccuucaccuaccugcccuucggcgccggccccagaagcugccugggcgugagacugggccugcuggaggugaagcugacccugcugcacgugcugcacaaguucagauuccaggccugccccgagacccaggugccccugcagcuggagagcaagagcgcccugggccccaagaacggcguguacaucaagaucgugagcagauaa

SEQ ID NO: 24434 - RNA, 213 nt, Artificial Sequence
  TCAIM__Homo_sapiens__NP_001025010
auguucugccaccugagacccaugagaagacugugccuggagaagaucuucccccacugguuccccuucagcagagcccugagcggcgccgaggccgugaacgcccugagacccuucuacuucgccgugcaccccgacuucuucggccagcaccccguggagagagacgacaccuggaagagcuuccagugccccagcgacuucagccuguaa

SEQ ID NO: 24435 - RNA, 504 nt, Artificial Sequence
  TCAP__Homo_sapiens__NP_003664
auggccaccagcgagcugagcugcgaggugagcgaggagaacugcgagagaagagaggccuucugggccgaguggaaggaccugacccugagcaccagacccgaggagggcugcagccugcacgaggaggacacccagagacacgagaccuaccaccagcagggccagugccaggugcuggugcagagaagccccuggcugaugaugagaaugggcauccugggcagaggccugcaggaguaccagcugcccuaccagagagugcugccccugcccaucuucacccccgccaagaugggcgccaccaaggaggagagagaggacacccccauccagcugcaggagcugcuggcccuggagaccgcccugggcggccagugcguggacagacaggagguggccgagaucaccaagcagcugccccccguggugcccgugagcaagcccggcgcccugagaagaagccugagcagaagcaugagccaggaggcccagagaggcuaa

SEQ ID NO: 24436 - RNA, 906 nt, Artificial Sequence
  TCEA1__Homo_sapiens__NP_006747
auggaggacgagguggugagauucgccaagaagauggacaagauggugcagaagaagaacgccgccggcgcccuggaccugcugaaggagcugaagaacauccccaugacccuggagcugcugcagagcaccagaaucggcaugagcgugaacgccaucagaaagcagagcaccgacgaggaggugaccagccuggccaagagccugaucaagagcuggaagaagcugcuggacggccccagcaccgagaaggaccuggacgagaagaagaaggagcccgccaucaccagccagaacagccccgaggccagagaggagagcaccagcagcggcaacgugagcaacagaaaggacgagaccaacgccagagacaccuacgugagcagcuuccccagagcccccagcaccagcgacagcgugagacugaagugcagagagaugcuggccgccgcccugagaaccggcgacgacuacaucgccaucggcgccgacgaggaggagcugggcagccagaucgaggaggccaucuaccaggagaucagaaacaccgacaugaaguacaagaacagagugagaagcagaaucagcaaccugaaggacgccaagaaccccaaccugagaaagaacgugcugugcggcaacaucccccccgaccuguucgccagaaugaccgccgaggagauggccagcgacgagcugaaggagaugagaaagaaccugaccaaggaggccaucagagagcaccagauggccaagaccggcggcacccagaccgaccuguucaccugcggcaagugcaagaagaagaacugcaccuacacccaggugcagaccagaagcgccgacgagcccaugaccaccuucguggugugcaacgagugcggcaacagauggaaguucugcuaa

SEQ ID NO: 24437 - RNA, 900 nt, Artificial Sequence
  TCEA2__Homo_sapiens__NP_003186
augaugggcaaggaggaggagaucgccagaaucgccagaagacuggacaagauggugaccaagaagagcgccgagggcgccauggaccugcugagagagcugaaggccaugcccaucacccugcaccugcugcagagcaccagagugggcaugagcgugaacgcccugagaaagcagagcagcgacgaggaggugaucgcccuggccaagagccugaucaagagcuggaagaagcugcuggacgccagcgacgccaaggccagagagagaggcagaggcaugccccugcccaccagcagcagagacgccagcgaggcccccgaccccagcagaaagagacccgagcugcccagagcccccagcacccccagaaucaccaccuucccccccgugcccgugaccugcgacgccgugagaaacaagugcagagagaugcugaccgccgcccugcagaccgaccacgaccacguggccaucggcgccgacugcgagagacugagcgcccagaucgaggagugcaucuucagagacgugggcaacaccgacaugaaguacaagaacagagugagaagcagaaucagcaaccugaaggacgccaagaaccccgaccugagaagaaacgugcugugcggcgccaucaccccccagcagaucgccgugaugaccagcgaggagauggccagcgacgagcugaaggagaucagaaaggccaugaccaaggaggccaucagagagcaccagauggccagaaccggcggcacccagaccgaccuguucaccugcggcaagugcagaaagaagaacugcaccuacacccaggugcagaccagaagcagcgacgagcccaugaccaccuucguggugugcaacgagugcggcaacagauggaaguucugcuaa

SEQ ID NO: 24438 - RNA, 1032 nt, Artificial Sequence
  TCEA3__Homo_sapiens__XP_011540358
augggccaggaggaggagcugcugagaaucgccaagaagcuggagaagaugguggccagaaagaacaccgagggcgcccuggaccugcugaagaagcugcacagcugccagaugagcauccagcugcugcagaccaccagaaucggcguggccgugaacggcgugagaaagcacugcagcgacaaggagguggugagccuggccaaggugcugaucaagaacuggaagagacugcuggacagccccggcccccccaagggcgagaagggcgaggagagagagaaggccaagaagaaggagaagggccuggagugcagcgacuggaagcccgaggccggccugagcccccccagaaagaagagagaggaccccaagaccagaagcaacagcagcaagagcaaggccgagagccccaagacccccagcagcccccugacccccaccuucgccagcagcaugugccugcuggcccccugcuaccugaccggcgacagcgugagagacaagugcguggagaugcugagcgccgcccugaaggccgacgacgacuacaaggacuacggcgugaacugcgacaagauggccagcgagaucgaggaccacaucuaccaggagcugaagagcaccgacaugaaguacagaaacagagugagaagcagaaucagcaaccugaaggaccccagaaaccccggccugagaagaaacgugcugagcggcgccaucagcgccggccugaucgccaagaugaccgccgaggagauggccagcgacgagcugagagagcugagaaacgccaugacccaggaggccaucagagagcaccagauggccaagaccggcggcaccaccaccgaccuguuccagugcagcaagugcaagaagaagaacugcaccuacaaccaggugcagaccagaagcgccgacgagcccaugaccaccuucgugcugugcaacgagugcggcaacagauggaagccccccuggagaaugcccagaaaccugagcaacuucguggccuuccuggugcuguaa

SEQ ID NO: 24439 - RNA, 480 nt, Artificial Sequence
  TCEAL1__Homo_sapiens__NP_001006641
auggacaagcccagaaaggagaacgaggaggagccccagagcgcccccaagaccgacgaggagagaccccccguggagcacagccccgagaagcagagccccgaggagcagagcagcgaggagcagagcagcgaggaggaguucuuccccgaggagcugcugcccgagcugcugcccgagaugcugcugagcgaggagagacccccccaggagggccugagcagaaaggaccuguucgagggcagaccccccauggagcagccccccugcggcgugggcaagcacaagcuggaggagggcagcuucaaggagagacuggccagaagcagaccccaguucagaggcgacauccacggcagaaaccugagcaacgaggagaugauccaggccgccgacgagcuggaggagaugaagagagugagaaacaagcugaugaucaugcacuggaaggccaagagaagcagacccuaccccaucuaa

SEQ ID NO: 24440 - RNA, 684 nt, Artificial Sequence
  TCEAL2__Homo_sapiens__NP_525129
auggagaagcuguucaacgagaacgagggcaugcccagcaaccagggcaagaucgacaacgaggagcagcccccccacgagggcaagcccgagguggccugcauccuggaggacaagaagcuggagaacgagggcaacaccgagaacaccggcaagagaguggaggagccccugaaggacaaggagaagcccgagagcgccggcaaggccaagggcgagggcaagagcgagagaaagggcaagagcgagaugcagggcggcagcaagaccgagggcaagcccgagagaggcggcagagccgagggcgagggcgagcccgacagcgagagagagcccgagagcgagggcgagcccgagagcgagaccagagccgccggcaagagacccgccgaggacgacauccccagaaaggccaagagaaagaccaacaagggccuggcccaguaccugaagcaguacaaggaggccauccacgacaugaacuucagcaacgaggacaugaucagagaguucgacaacauggccagaguggaggacaagagaagaaagagcaagcagaagcugggcgccuuccuguggaugcagagaaaccugcaggaccccuucuaccccagaggccccagagaguucagaggcggcugcagagcccccagaagagacaccgaggacauccccuacguguaa

SEQ ID NO: 24441 - RNA, 1077 nt, Artificial Sequence
  TCEAL4__Homo_sapiens__NP_001287830
augcccgccggcggccaggccccccagcugacccccgugauccccgccuucugggaggccagaggccugcccaacagcaagggcagagacaaggugcacaucugccagugcgaggaguggaagggccacaucagcuacguggagagagacaucaccaccagcgagaucaagagccugccccaggugagcgugagagccuuccacgccgccagcggcacccuggaguggagaaagggcaacggcuacggcagaggcaagggcuggggcuggggcagaguggagagcagagaggccggccccagcguggacagagacggcggccugagagugugcugcagccagagaagcgccaagcccgagaaggaggagcagcccgugcagaaccccagaagaagcgugaaggacagaaagagaagaggcaaccuggacauggagaagcuguacagcgagaacgagggcauggccagcaaccagggcaagauggagaacgaggagcagccccaggacgagagaaagcccgaggugaccugcacccuggaggacaagaagcuggagaacgagggcaagaccgagaacaagggcaagaccggcgacgaggagaugcugaaggacaagggcaagcccgagagcgagggcgaggccaaggagggcaagagcgagagagagggcgagagcgagauggagggcggcagcgagagagagggcaagcccgagaucgagggcaagcccgagagcgagggcgagcccggcagcgagaccagagccgccggcaagagacccgccgaggacgacgugcccagaaaggccaagagaaagaccaacaagggccuggcccacuaccugaaggaguacaaggaggccauccacgacaugaacuucagcaacgaggacaugaucagagaguucgacaacauggccaaggugcaggacgagaagagaaagagcaagcagaagcugggcgccuuccuguggaugcagagaaaccugcaggaccccuucuaccccagaggccccagagaguucagaggcggcugcagagcccccagaagagacaucgaggacauccccuacguguaa

SEQ ID NO: 24442 - RNA, 303 nt, Artificial Sequence
  TCEAL7__Homo_sapiens__NP_689491
augcagaagcccugcaaggagaacgagggcaagcccaagugcagcgugcccaagagagaggagaagagacccuacggcgaguucgagagacagcagaccgagggcaacuucagacagagacugcugcagagccuggaggaguucaaggaggacaucgacuacagacacuucaaggacgaggagaugaccagagagggcgacgagauggagagaugccuggaggagaucagaggccugagaaagaaguucagagcccugcacagcaaccacagacacagcagagacagacccuaccccaucuaa

SEQ ID NO: 24443 - RNA, 291 nt, Artificial Sequence
  TCEB1__Homo_sapiens__NP_001191793
auguacgugaagcugaucagcagcgacggccacgaguucaucgugaagagagagcacgcccugaccagcggcaccaucaaggccaugcugagcggccccggccaguucgccgagaacgagaccaacgaggugaacuucagagagauccccagccacgugcugagcaaggugugcauguacuucaccuacaaggugagauacaccaacagcagcaccgagauccccgaguuccccaucgcccccgagaucgcccuggagcugcugauggccgccaacuuccuggacugcuaa

SEQ ID NO: 24444 - RNA, 357 nt, Artificial Sequence
  TCEB2__Homo_sapiens__NP_009039
auggacguguuccugaugaucagaagacacaagaccaccaucuucaccgacgccaaggagagcagcaccguguucgagcugaagagaaucguggagggcauccugaagagaccccccgacgagcagagacuguacaaggacgaccagcugcuggacgacggcaagacccugggcgagugcggcuucaccagccagaccgccagaccccaggcccccgccaccgugggccuggccuucagagccgacgacaccuucgaggcccugugcaucgagcccuucagcagcccccccgagcugcccgacgugaugaagccccaggacagcggcagcagcgccaacgagcaggccgugcaguaa

SEQ ID NO: 24445 - RNA, 1641 nt, Artificial Sequence
  TCEB3C__Homo_sapiens__NP_663628
auggccgccggcagcaccacccugagagccgugggcaagcugcaggugagacuggccaccaagaccgagcccaagaagcuggagaaguaccugcagaagcugagcgcccugcccaugaccgccgacauccuggccgagaccggcaucagaaagaccgugaagagacugagaaagcaccagcacgugggcgacuucgccagagaccuggccgccagauggaagaagcuggugcugguggacagaaacaccggccccgacccccaggaccccgaggagagcgccagcagacagagauucggcgaggcccugcaggagagagagaaggccuggggcuuccccgagaacgccaccgcccccagaagccccagccacagccccgagcacagaagaaccgccagaagaaccccccccggccagcagagaccccaccccagaagccccagcagagagcccagagccgagagaaagagacccagaauggcccccgccgacagcggcccccacagagacccccccaccagaaccgccccccugcccaugcccgagggccccgagcccgccgugcccggcgagcagcccggcagaggccacgcccacgccgcccagggcggcccccugcugggccagggcugccagggccagccccagggcgaggccgugggcagccacagcaagggccacaagagcagcagaggcgccagcgcccagaagagcccccccgugcaggagagccagagcgagagacugcaggccgccggcgccgacagcgccggccccaagaccgugcccagccacguguucagcgagcugugggaccccagcgaggccuggaugcaggccaacuacgaccugcugagcgccuucgaggccaugaccagccaggccaaccccgaggcccugagcgcccccgcccugcaggaggaggccgccuuccccggcagaagagugaacgccaagaugcccguguacagcggcagcagacccgccugccagcugcaggugcccacccugagacagcagugccugagagugcccagaaacaaccccgacgcccugggcgacguggagggcgugcccuacagcgugcuggagcccgugcuggagggcuggacccccgaccagcuguacagaaccgagaaggacaacgccgcccuggccagagagaccgacgagcuguggagaauccacugccugcaggacuucaaggaggagaagccccaggagcacgagagcuggagagagcuguaccugagacugagagacgccagagagcagagacugagaguggugaccaccaagaucagaagcgccagagagaacaagcccagcggcagacagaccaagaugaucugcuucaacagcguggccaagacccccuacgacgccagcagaagacaggagaagagcgccggcgccgccgaccccggcaacggcgagauggagcccgcccccaagcccgccggcagcagccaggcccccagcggccugggcgacggcgacggcggcagcgugagcggcggcggcagcagcaacagacacgccgcccccgccgacaagaccagaaagcaggccgccaagaagguggccccccugauggccaaggccaucagagacuacaagggcagauucagcagaagauaa

SEQ ID NO: 24446 - RNA, 3234 nt, Artificial Sequence
  TCERG1__Homo_sapiens__NP_001035095
auggccgagagaggcggcgacggcggcgagagcgagagauucaaccccggcgagcugagaauggcccagcagcaggcccugagauucagaggccccgcccccccccccaacgccgugaugagaggcccccccccccugaugagaccccccccccccuucggcaugaugagaggccccccccccccccccagaccccccuucggcagaccccccuucgaccccaacaugccccccaugcccccccccggcggcauccccccccccaugggccccccccaccugcagagaccccccuucaugcccccccccaugagcagcaugccccccccccccggcaugauguucccccccggcaugccccccgugaccgcccccggcacccccgcccugccccccaccgaggagaucuggguggagaacaagacccccgacggcaagguguacuacuacaacgccagaaccagagagagcgccuggaccaagcccgacggcgugaaggugauccagcagagcgagcugacccccaugcuggccgcccaggcccaggugcaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggugcaggcccaggugcaggcccaggugcaggcccaggccgugggcgccagcacccccaccaccagcagccccgcccccgccgugagcaccagcaccagcagcagcacccccagcagcaccaccagcaccaccaccaccgccaccagcguggcccagaccgugagcacccccaccacccaggaccagacccccagcagcgccgugagcguggccacccccaccgugagcgugagcacccccgcccccaccgccacccccgugcagaccgugccccagccccacccccagacccugccccccgccgugccccacagcgugccccagcccaccaccgccauccccgccuucccccccgugauggugccccccuucagagugccccugcccggcaugcccaucccccugcccggcgugcugcccggcauggccccccccaucgugcccaugauccacccccagguggccaucgccgccagccccgccacccuggccggcgccaccgccgugagcgaguggaccgaguacaagaccgccgacggcaagaccuacuacuacaacaacagaacccuggagagcaccugggagaagccccaggagcugaaggagaaggagaagcuggaggagaagaucaaggagcccaucaaggagcccagcgaggagccccugcccauggagaccgaggaggaggaccccaaggaggagcccaucaaggagaucaaggaggagcccaaggaggaggagaugaccgaggaggagaaggccgcccagaaggccaagcccguggccaccgcccccauccccggcacccccuggugcgugguguggaccggcgacgagagaguguucuucuacaaccccaccaccagacugagcaugugggacagacccgacgaccugaucggcagagccgacguggacaagaucauccaggagcccccccacaagaagggcauggaggagcugaagaagcugagacaccccacccccaccaugcugagcauccagaaguggcaguucagcaugagcgccaucaaggaggagcaggagcugauggaggagaucaacgaggacgagcccgugaaggccaagaagagaaagagagacgacaacaaggacaucgacagcgagaaggaggccgccauggaggccgagaucaaggccgccagagagagagccaucgugccccuggaggccagaaugaagcaguucaaggacaugcugcuggagagaggcgugagcgccuucagcaccugggagaaggagcugcacaagaucguguucgaccccagauaccugcugcugaaccccaaggagagaaagcagguguucgaccaguacgugaagaccagagccgaggaggagagaagagagaagaagaacaagaucaugcaggccaaggaggacuucaagaagaugauggaggaggccaaguucaaccccagagccaccuucagcgaguucgccgccaagcacgccaaggacagcagauucaaggccaucgagaagaugaaggacagagaggcccuguucaacgaguucguggccgccgccagaaagaaggagaaggaggacagcaagaccagaggcgagaagaucaagagcgacuucuucgagcugcugagcaaccaccaccuggacagccagagcagauggagcaaggugaaggacaagguggagagcgaccccagauacaaggccguggacagcagcagcaugagagaggaccuguucaagcaguacaucgagaagaucgccaagaaccuggacagcgagaaggagaaggagcuggagagacaggccagaaucgaggccagccugagagagagagagagagaggugcagaaggccagaagcgagcagaccaaggagaucgacagagagagagagcagcacaagagagaggaggccauccagaacuucaaggcccugcugagcgacauggugagaagcagcgacgugagcuggagcgacaccagaagaacccugagaaaggaccacagaugggagagcggcagccugcuggagagagaggagaaggagaagcuguucaacgagcacaucgaggcccugaccaagaagaagagagagcacuucagacagcugcuggacgagaccagcgccaucacccugaccagcaccuggaaggaggugaagaagaucaucaaggaggaccccagaugcaucaaguucagcagcagcgacagaaagaagcagagagaguucgaggaguacaucagagacaaguacaucaccgccaaggccgacuucagaacccugcugaaggagaccaaguucaucaccuacagaagcaagaagcugauccaggagagcgaccagcaccugaaggacguggagaagauccugcagaacgacaagagauaccuggugcuggacugcgugcccgaggagagaagaaagcugaucguggccuacguggacgaccuggacagaagaggccccccccccccccccaccgccagcgagcccaccagaagaagcaccaaguaa

SEQ ID NO: 24447 - RNA, 1761 nt, Artificial Sequence
  TCERG1L__Homo_sapiens__NP_777597
augcaggccggcgccagauuccagagaagaagaagacagcugcagcagcagcagcccagaagaagacagccccugcuguggcccauggacgccgagccccccccccccccccccuggguguggauggugcccggcagcgccggccugcugagacugagcgccggcgugguggugccccccgugcugcuggccagcgcccccccccccgccgccccccugcugcccggccugcccggcuggcccgcccccagcgagcccgugcugccccugcugccccugcccagcgcccccgacagcgccgccgccgccgccgcccaccccuuccccgcccugcacggccaguggcuguucggcggccacagccccagccugggccugccccccagcagcaccguggagcuggugcccguguucccccaccugugccccagcgcccuggccacccccaucggcaagagcuggaucgacaagagaauccccaacugcaagaucuucuucaacaacagcuucgcccuggacagcaccuggauccaccccgaggagagcagauucuuccacggccacgagaagcccagacugcuggccaaccagguggccgugagccugagcagacccgcccccgccagcagaccccugcccaccguggugcuggccccccagcccauccccggcggcugccacaacagccugaaggugaccagcagccccgccaucgccaucgccaccgccgccgccgccgccauggugagcguggaccccgagaaccugagaggccccagccccagcagcgugcagcccagacacuuccugacccuggcccccaucaagaucccccugagaaccagccccgugagcgacaccagaaccgagagaggcagaguggccagaccccccgcccugaugcugagagcccagaagagcagagacggcgacaaggaggacaaggagcccccccccaugcugggcggcggcgaggacagcaccgccagaggcaacagacccguggccagcacccccgugcccggcagccccuggugcgugguguggaccggcgacgacagaguguucuucuucaaccccaccaugcaccugagcgugugggagaagcccauggaccugaaggacagaggcgaccugaacagaaucaucgaggaccccccccacaagagaaagcuggaggcccccgccaccgacaacagcgacggcagcagcagcgaggacaacagagaggaccaggacgugaagaccaagagaaacagaaccgagggcugcggcagccccaagcccgaggaggccaagagagaggacaagggcaccagaaccccccccccccagauccugcugccccuggaggagagagugacccacuucagagacaugcugcuggagagaggcgugagcgccuucagcaccugggagaaggagcugcacaagaucguguucgaccccagauaccugcugcugaacagcgaggagagaaagcagaucuucgagcaguucgugaagaccagaaucaaggaggaguacaaggagaagaagagcaagcugcugcuggccaaggaggaguucaagaagcugcuggaggagagcaaggugagccccagaaccaccuucaaggaguucgccgagaaguacggcagagaccagagauucagacuggugcagaagagaaaggaccaggagcacuucuucaaccaguucauccugauccugaagaagagagacaaggagaacagacugagacugagaaagaugagauaa

SEQ ID NO: 24448 - RNA, 2049 nt, Artificial Sequence
  TCF12__Homo_sapiens__NP_003196
augaacccccagcagcagagaauggccgccaucggcaccgacaaggagcugagcgaccugcuggacuucagcgccauguucagcccccccgugaacagcggcaagaccagacccaccacccugggcagcagccaguucagcggcagcggcaucgacgagagaggcggcaccaccagcuggggcaccagcggccagcccagccccagcuacgacagcagcagaggcuucaccgacagcccccacuacagcgaccaccugaacgacagcagacugggcgcccacgagggccugagccccacccccuucaugaacagcaaccugaugggcaagaccagcgagagaggcagcuucagccuguacagcagagacaccggccugcccggcugccagagcagccugcugagacaggaccugggccugggcagccccgcccagcugagcagcagcggcaagcccggcaccgccuacuacagcuucagcgccaccagcagcagaagaagaccccugcacgacagcgccgcccuggacccccugcaggccaagaaggugagaaaggugccccccggccugcccagcagcguguacgcccccagccccaacagcgacgacuucaacagagagagccccagcuaccccagccccaagccccccaccagcauguucgccagcaccuucuucaugcaggacggcacccacaacagcagcgaccuguggagcagcagcaacggcaugagccagcccggcuucggcggcauccugggcaccagcaccagccacaugagccagagcagcagcuacggcaaccugcacagccacgacagacugagcuaccccccccacagcgugagccccaccgacaucaacaccagccugccccccaugagcagcuuccacagaggcagcaccagcagcagccccuacguggccgccagccacaccccccccaucaacggcagcgacagcauccugggcaccagaggcaacgccgccggcagcagccagaccggcgacgcccugggcaaggcccuggccagcaucuacagccccgaccacaccagcagcagcuuccccagcaaccccagcacccccgugggcagccccagcccccugaccggcaccagccaguggcccagacccggcggccaggcccccagcagccccagcuacgagaacagccugcacagccugcagagcagaauggaggacagacuggacagacuggacgacgccauccacgugcugagaaaccacgccgugggccccagcaccagccugcccgccggccacagcgacauccacagccugcugggccccagccacaacgcccccaucggcagccugaacagcaacuacggcggcagcagccugguggccagcagcagaagcgccagcauggugggcacccacagagaggacagcgugagccugaacggcaaccacagcgugcugagcagcaccgugaccaccagcagcaccgaccugaaccacaagacccaggagaacuacagaggcggccugcagagccagagcggcaccguggugaccaccgagaucaagaccgagaacaaggagaaggacgagaaccugcacgagccccccagcagcgacgacaugaagagcgacgacgagagcagccagaaggacaucaaggugagcagcagaggcagaaccagcagcaccaacgaggacgaggaccugaaccccgagcagaagaucgagagagagaaggagagaagaauggccaacaacgccagagagagacugagagugagagacaucaacgaggccuucaaggagcugggcagaaugugccagcugcaccugaagagcgagaagccccagaccaagcugcugauccugcaccaggccguggccgugauccugagccuggagcagcaggugagagagagaaaccugaaccccaaggccgccugccugaagagaagagaggaggagaaggugagcgccgugagcgccgagccccccaccacccugcccggcacccaccccggccugagcgagaccaccaaccccaugggccacauguaa

SEQ ID NO: 24449 - RNA, 600 nt, Artificial Sequence
  TCF15__Homo_sapiens__NP_004600
auggccuucgcccugcugagacccgugggcgcccacgugcuguaccccgacgugagacugcugagcgaggacgaggagaacagaagcgagagcgacgccagcgaccagagcuucggcugcugcgagggccccgaggccgccagaagaggccccggccccggcggcggcagaagagccggcggcggcggcggcgccggccccguggugguggugagacagagacaggccgccaacgccagagagagagacagaacccagagcgugaacaccgccuucaccgcccugagaacccugauccccaccgagcccguggacagaaagcugagcaagaucgagacccugagacuggccagcagcuacaucgcccaccuggccaacgugcugcugcugggcgacagcgccgacgacggccagcccugcuucagagccgccggcagcgccaagggcgccgugcccgccgccgccgacggcggcagacagcccagaagcaucugcaccuucugccugagcaaccagagaaagggcggcggcagaagagaccugggcggcagcugccugaaggugagaggcguggccccccugagaggccccagaagauaa

SEQ ID NO: 24450 - RNA, 1038 nt, Artificial Sequence
  TCF19__Homo_sapiens__XP_005249391
augcugcccugcuuccagcugcugagaaucggcggcggcagaggcggcgaccuguacaccuuccacccccccgccggcgccggcugcaccuacagacugggccacagagccgaccugugcgacguggcccugagaccccagcaggagcccggccugaucagcggcauccacgccgagcugcacgccgagcccagaggcgacgacuggagagugagccuggaggaccacagcagccagggcacccuggugaacaacgugagacugcccagaggccacagacuggagcugagcgacggcgaccugcugaccuucggccccgagggcccccccggcaccagccccagcgaguucuacuucauguuccagcaggugagagugaagccccaggacuucgccgccaucaccauccccagaagcagaggcgaggccagagugggcgccggcuucagacccaugcugcccagccagggcgccccccagagaccccugagcaccuucagccccgcccccaaggccacccugauccugaacagcaucggcagccugagcaagcugagaccccagccccugaccuucagccccagcuggggcggccccaagagccugcccgugcccgccccccccggcgagaugggcaccacccccagcgcccccccccagagaaacagaagaaagagcgugcacagagugcuggccgagcuggacgacgagagcgagccccccgagaaccccccccccgugcugauggagcccagaaagaagcugagaguggacaaggccccccugacccccaccggcaacagaagaggcagacccagaaaguaccccgugagcgcccccauggccccccccgccgugggcggcggcgagcccugcgccgcccccugcugcugccugccccaggaggagaccguggccugggugcagugcgacggcugcgacgugugguuccacguggccugcgugggcugcagcauccaggccgccagagaggccgacuucagaugccccggcugcagagccggcauccagaccuaa

SEQ ID NO: 24451 - RNA, 5883 nt, Artificial Sequence
  TCF20__Homo_sapiens__NP_005641
augcagagcuucagagagcagagcagcuaccacggcaaccagcagagcuacccccaggaggugcacggcagcagcagacuggaggaguucagccccagacaggcccagauguuccagaacuucggcggcaccggcggcagcagcggcagcagcggcagcggcagcggcggcggcagaagaggcgccgccgccgccgccgccgccauggccagcgagaccagcggccaccagggcuaccagggcuucagaaaggaggccggcgacuucuacuacauggccggcaacaaggaccccgugaccaccggcaccccccagcccccccagagaagacccagcggccccgugcagagcuacggccccccccagggcagcagcuucggcaaccaguacggcagcgagggccacgugggccaguuccaggcccagcacagcggccugggcggcgugagccacuaccagcaggacuacaccggccccuucagccccggcagcgcccaguaccagcagcaggccagcagccagcagcagcagcagcaggugcagcagcugagacagcagcuguaccagagccaccagccccugccccaggccaccggccagcccgccagcagcagcagccaccugcagcccaugcagagacccagcacccugcccagcagcgccgccggcuaccagcugagagugggccaguucggccagcacuaccagagcagcgccagcagcagcagcagcagcagcuuccccagcccccagagauucagccagagcggccagagcuacgacggcagcuacaacgugaacgccggcagccaguacgagggccacaacgugggcagcaacgcccaggccuacggcacccagagcaacuacagcuaccagccccagagcaugaagaacuucgagcaggccaagaucccccagggcacccagcagggccagcagcagcagcagccccagcagcagcagcaccccagccagcacgugaugcaguacaccaacgccgccaccaagcugccccugcagagccaggugggccaguacaaccagcccgaggugcccgugagaagccccaugcaguuccaccagaacuucagccccaucagcaaccccagccccgccgccagcguggugcagagccccagcugcagcagcacccccagcccccugaugcagaccggcgagaaccugcagugcggccagggcagcgugcccaugggcagcagaaacagaauccugcagcugaugccccagcugagccccacccccagcaugaugcccagccccaacagccacgccgccggcuucaagggcuucggccuggagggcgugcccgagaagagacugaccgaccccggccugagcagccugagcgcccugagcacccagguggccaaccugcccaacaccgugcagcacaugcugcugagcgacgcccugaccccccagaagaagaccagcaagagacccagcagcagcaagaaggccgacagcugcaccaacagcgagggcagcagccagcccgaggagcagcugaagagccccauggccgagagccuggacggcggcugcagcagcagcagcgaggaccagggcgagagagugagacagcugagcggccagagcaccagcagcgacaccaccuacaagggcggcgccagcgagaaggccggcagcagccccgcccagggcgcccagaacgagccccccagacugaacgccagccccgccgccagagaggaggccaccagccccggcgccaaggacaugccccugagcagcgacggcaaccccaaggugaacgagaagaccgugggcgugaucgugagcagagaggccaugaccggcagaguggagaagcccggcggccaggacaagggcagccaggaggacgaccccgccgccacccagagaccccccagcaacggcggcgccaaggagaccagccacgccagccugccccagcccgagccccccggcggcggcggcagcaagggcaacaagaacggcgacaacaacagcaaccacaacggcgagggcaacggccagagcggccacagcgccgccggccccggcuucaccagcagaaccgagcccagcaagagccccggcagccugagauacagcuacaaggacagcuucggcagcgccgugcccagaaacgugagcggcuucccccaguaccccaccggccaggagaagggcgacuucaccggccacggcgagagaaagggcagaaacgagaaguuccccagccugcugcaggaggugcugcagggcuaccaccaccaccccgacagaagauacagcagaagcacccaggagcaccagggcauggccggcagccuggagggcaccaccagacccaacgugcuggugagccagaccaacgagcuggccagcagaggccugcugaacaagagcaucggcagccugcuggagaacccccacuggggccccugggagagaaagagcagcagcaccgcccccgagaugaagcagaucaaccugaccgacuaccccauccccagaaaguucgagaucgagccccagagcagcgcccacgagcccggcggcagccugagcgagagaagaagcgugaucugcgacaucagcccccugagacagaucgugagagaccccggcgcccacagccugggccacaugagcgccgacaccagaaucggcagaaacgacagacugaaccccacccugagccagagcgugauccugcccggcggccuggugagcauggagaccaagcugaagagccagagcggccagaucaaggaggaggacuucgagcagagcaagagccaggccagcuucaacaacaagaagagcggcgaccacugccacccccccagcaucaagcacgagagcuacagaggcaacgccagccccggcgccgccacccacgacagccugagcgacuacggcccccaggacagcagacccacccccaugagaagagugcccggcagagugggcggcagagagggcaugagaggcagaagccccagccaguaccacgacuucgccgagaagcugaagaugagccccggcagaagcagaggccccggcggcgacccccaccacaugaacccccacaugaccuucagcgagagagccaacagaagcagccugcacacccccuucagccccaacagcgagacccuggccagcgccuaccacgccaacaccagagcccacgccuacggcgaccccaacgccggccugaacagccagcugcacuacaagagacagauguaccagcagcagcccgaggaguacaaggacuggagcagcggcagcgcccagggcgugaucgccgccgcccagcacagacaggagggccccagaaagagccccagacagcagcaguuccuggacagagugagaagcccccugaagaacgacaaggacggcaugauguacggcccccccgugggcaccuaccacgaccccagcgcccaggaggccggcagaugccugaugagcagcgacggccugcccaacaagggcauggagcugaagcacggcagccagaagcugcaggagagcugcugggaccugagcagacagaccagccccgccaagagcagcggcccccccggcaugagcagccagaagagauacggccccccccacgagaccgacggccacggccuggccgaggccacccagagcagcaagcccggcagcgugaugcugagacugcccggccaggaggaccacagcagccagaacccccugaucaugagaagaagagugagaagcuucaucagccccauccccagcaagagacagagccaggacgugaagaacagcagcaccgaggacaagggcagacugcugcacagcagcaaggagggcgccgacaaggccuucaacagcuacgcccaccugagccacagccaggacaucaagagcauccccaagagagacagcagcaaggaccugcccagccccgacagcagaaacugccccgccgugacccugaccagccccgccaagaccaagauccugccccccagaaagggcagaggccugaagcuggaggccaucgugcagaagaucaccagccccaacaucagaagaagcgccagcagcaacagcgccgaggccggcggcgacaccgugacccuggacgacauccugagccugaagagcggcccccccgagggcggcagcguggccgugcaggacgccgacaucgagaagagaaagggcgagguggccagcgaccuggugagccccgccaaccaggagcugcacguggagaagccccugcccagaagcagcgaggaguggagaggcagcguggacgacaaggugaagaccgagacccacgccgagaccgugaccgccggcaaggagccccccggcgccaugaccagcaccaccagccagaagcccggcagcaaccagggcagacccgacggcagccugggcggcaccgccccccugaucuuccccgacagcaagaacgugccccccgugggcauccuggcccccgaggccaaccccaaggccgaggagaaggagaacgacaccgugaccaucagccccaagcaggagggcuucccccccaagggcuacuuccccagcggcaagaagaagggcagacccaucggcagcgugaacaagcagaagaagcagcagcagcccccccccccccccccccagcccccccagauccccgagggcagcgccgacggcgagcccaagcccaagaagcagagacagagaagagagagaagaaagcccggcgcccagcccagaaagagaaagaccaagcaggccgugcccaucguggagccccaggagcccgagaucaagcugaaguacgccacccagccccuggacaagaccgacgccaagaacaagagcuucuaccccuacauccacguggugaacaagugcgagcugggcgccgugugcaccaucaucaacgccgaggaggaggagcagaccaagcuggugagaggcagaaagggccagagaagccugacccccccccccagcagcaccgagagcaaggcccugcccgccagcagcuucaugcugcagggccccguggugaccgagagcagcgugaugggccaccuggugugcugccugugcggcaagugggccagcuacagaaacaugggcgaccuguucggccccuucuacccccaggacuacgccgccacccugcccaagaaccccccccccaagagagccaccgagaugcagagcaaggugaaggugagacacaagagcgccagcaacggcagcaagaccgacaccgaggaggaggaggagcagcagcagcagcagaaggagcagagaagccuggccgcccaccccagauucaagagaagacacagaagcgaggacugcggcggcggccccagaagccugagcagaggccugcccugcaagaaggccgccaccgagggcagcagcgagaagaccgugcuggacagcaagcccagcgugcccaccaccagcgagggcggccccgagcuggagcugcagauccccgagcugccccuggacagcaacgaguucugggugcacgagggcugcauccugugggccaacggcaucuaccuggugugcggcagacuguacggccugcaggaggcccuggagaucgccagagagaugaagugcagccacugccaggaggccggcgccacccugggcugcuacaacaagggcugcagcuucagauaccacuaccccugcgccaucgacgccgacugccugcugcacgaggagaacuucagcgugagaugccccaagcacaagcccccccugcccugcccccugcccccccugcagaacaagaccgccaagggcagccugagcaccgagcagagcgagagaggcuaa

SEQ ID NO: 24452 - RNA, 540 nt, Artificial Sequence
  TCF21__Homo_sapiens__NP_003197
augagcaccggcagccugagcgacguggaggaccugcaggagguggagaugcuggagugcgacggccugaagauggacagcaacaaggaguucgugaccagcaacgagagcaccgaggagagcagcaacugcgagaacggcagcccccagaagggcagaggcggccugggcaagagaagaaaggcccccaccaagaagagcccccugagcggcgugagccaggagggcaagcaggugcagagaaacgccgccaacgccagagagagagccagaaugagagugcugagcaaggccuucagcagacugaagaccacccugcccugggugccccccgacaccaagcugagcaagcuggacacccugagacuggccagcagcuacaucgcccaccugagacagauccuggccaacgacaaguacgagaacggcuacauccaccccgugaaccugaccuggcccuucaugguggccggcaagcccgagagcgaccugaaggagguggugaccgccagcagacugugcggcaccaccgccagcuaa

SEQ ID NO: 24453 - RNA, 2031 nt, Artificial Sequence
  TCF25__Homo_sapiens__NP_055787
augagcagaagagcccugagaagacugagaggcgagcagagaggccaggagccccugggccccggcgcccugcacuucgaccugagagacgacgacgacgccgaggaggagggccccaagagagagcugggcgugagaagacccggcggcgccggcaaggagggcgugagagugaacaacagauucgagcugaucaacaucgacgaccuggaggacgaccccguggugaacggcgagagaagcggcugcgcccugaccgacgccguggcccccggcaacaagggcagaggccagagaggcaacaccgagagcaagaccgacggcgacgacaccgagaccgugcccagcgagcagagccacgccagcggcaagcugagaaagaagaagaagaagcagaagaacaagaagagcagcaccggcgaggccagcgagaacggccuggaggacaucgacagaauccuggagagaaucgaggacagcaccggccugaacagacccggccccgccccccugagcagcagaaagcacgugcuguacguggagcacagacaccugaaccccgacaccgagcugaagagauacuucggcgccagagccauccugggcgagcagagacccagacagagacagagaguguaccccaagugcaccuggcugaccacccccaagagcaccuggcccagauacagcaagcccggccugagcaugagacugcuggagagcaagaagggccugagcuucuucgccuucgagcacagcgaggaguaccagcaggcccagcacaaguuccugguggccguggagagcauggagcccaacaacaucguggugcugcugcagaccagccccuaccacguggacagccugcugcagcugagcgacgccugcagauuccaggaggaccaggagauggccagagaccugguggagagagcccuguacagcauggagugcgccuuccacccccuguucagccugaccagcggcgccugcagacuggacuacagaagacccgagaacagaagcuucuaccuggcccuguacaagcagaugagcuuccuggagaagagaggcugccccagaaccgcccuggaguacugcaagcugauccugagccuggagcccgacgaggacccccugugcaugcugcugcugaucgaccaccuggcccugagagccagaaacuacgaguaccugaucagacuguuccaggagugggaggcccacagaaaccugagccagcugcccaacuucgccuucagcgugccccuggccuacuuccugcugagccagcagaccgaccugcccgagugcgagcagagcagcgccagacagaaggccagccugcugauccagcaggcccugaccauguuccccggcgugcugcugccccugcuggagagcugcagcgugagacccgacgccagcgugagcagccacagauucuucggccccaacgccgagaucagccagccccccgcccugagccagcuggugaaccuguaccugggcagaagccacuuccuguggaaggagcccgccaccaugagcuggcuggaggagaacgugcacgaggugcugcaggccguggacgccggcgaccccgccguggaggccugcgagaacagaagaaaggugcuguaccagagagcccccagaaacauccacagacacgugauccugagcgagaucaaggaggccguggccgcccugccccccgacgugaccacccagagcgugaugggcuucgacccccugccccccagcgacaccaucuacagcuacgugagacccgagagacugagccccaucagccacggcaacaccaucgcccuguucuucagaagccugcugcccaacuacaccauggagggcgagagacccgaggagggcguggccggcggccugaacagaaaccagggccugaacagacugaugcuggccgugagagacaugauggccaacuuccaccugaacgaccuggaggccccccacgaggacgacgccgagggcgagggcgagugggacuaa

SEQ ID NO: 24454 - RNA, 1956 nt, Artificial Sequence
  TCF3__Homo_sapiens__NP_001129611
augaaccagccccagagaauggcccccgugggcaccgacaaggagcugagcgaccugcuggacuucagcaugauguucccccugcccgugaccaacggcaagggcagacccgccagccuggccggcgcccaguucggcggcagcggccuggaggacagacccagcagcggcagcuggggcagcggcgaccagagcagcagcagcuucgaccccagcagaaccuucagcgagggcacccacuucaccgagagccacagcagccugagcagcagcaccuuccugggccccggccugggcggcaagagcggcgagagaggcgccuacgccagcuucggcagagacgccggcgugggcggccugacccaggccggcuuccugagcggcgagcuggcccugaacagccccggcccccugagccccagcggcaugaagggcaccagccaguacuaccccagcuacagcggcagcagcagaagaagagccgccgacggcagccuggacacccagcccaagaaggugagaaaggugccccccggccugcccagcagcguguacccccccagcagcggcgaggacuacggcagagacgccaccgccuaccccagcgccaagacccccagcagcaccuaccccgcccccuucuacguggccgacggcagccugcaccccagcgccgagcuguggagcccccccggccaggccggcuucggccccaugcugggcggcggcagcagcccccugccccugccccccggcagcggccccgugggcagcagcggcagcagcagcaccuucggcggccugcaccagcacgagagaaugggcuaccagcugcacggcgccgaggugaacggcggccugcccagcgccagcagcuucagcagcgcccccggcgccaccuacggcggcgugagcagccacaccccccccgugagcggcgccgacagccugcugggcagcagaggcaccaccgccggcagcagcggcgacgcccugggcaaggcccuggccagcaucuacagccccgaccacagcagcaacaacuucagcagcagccccagcacccccgugggcagcccccagggccuggccggcaccagccaguggcccagagccggcgcccccggcgcccugagccccagcuacgacggcggccugcacggccugcagagcaagaucgaggaccaccuggacgaggccauccacgugcugagaagccacgccgugggcaccgccggcgacaugcacacccugcugcccggccacggcgcccuggccagcggcuucaccggccccaugagccugggcggcagacacgccggccuggugggcggcagccaccccgaggacggccuggccggcagcaccagccugaugcacaaccacgccgcccugcccagccagcccggcacccugcccgaccugagcagaccccccgacagcuacagcggccugggcagagccggcgccaccgccgccgccagcgagaucaagagagaggagaaggaggacgaggagaacaccagcgccgccgaccacagcgaggaggagaagaaggagcugaaggcccccagagccagaaccagcagcaccgacgaggugcugagccuggaggagaaggaccugagagacagagagagaagaauggccaacaacgccagagagagagugagagugagagacaucaacgaggccuucagagagcugggcagaaugugccagaugcaccugaagagcgacaaggcccagaccaagcugcugauccugcagcaggccgugcaggugauccugggccuggagcagcaggugagagagagaaaccugaaccccaaggccgccugccugaagagaagagaggaggagaaggugagcggcguggugggcgacccccagauggugcugagcgccccccaccccggccugagcgaggcccacaaccccgccggccacauguaa

SEQ ID NO: 24455 - RNA, 2322 nt, Artificial Sequence
  TCF4__Homo_sapiens__NP_001230155
auguucagcaagagacuggagaagaucccccaggugccccugcuguuccccuucaucuucaucauccugaccaacuacagcaagauggagggcgccguggagagccagcccagcuucuucaagaccagccaggacaucgugaccugcaccuggguggagaacugcuacagcagcuucagcagaagaccccuggagcagauguucugcaagcaccagagcaagaacaucaucagcuggaccggcaugguggcccacaccugcaaccccagcacccugggcggccagggccugugcgacuucgccaagaugcaccaccagcagagaauggccgcccugggcaccgacaaggagcugagcgaccugcuggacuucagcgccauguucagcccccccgugagcagcggcaagaacggccccaccagccuggccagcggccacuucaccggcagcaacguggaggacagaagcagcagcggcagcuggggcaacggcggccaccccagccccagcagaaacuacggcgacggcacccccuacgaccacaugaccagcagagaccugggcagccacgacaaccugagcccccccuucgugaacagcagaauccagagcaagaccgagagaggcagcuacagcagcuacggcagagagagcaaccugcagggcugccaccagcagagccugcugggcggcgacauggacaugggcaaccccggcacccugagccccaccaagcccggcagccaguacuaccaguacagcagcaacaaccccagaagaagaccccugcacagcagcgccauggaggugcagaccaagaaggugagaaaggugccccccggccugcccagcagcguguacgcccccagcgccagcaccgccgacuacaacagagacagccccggcuaccccagcagcaagcccgccaccagcaccuuccccagcagcuucuucaugcaggacggccaccacagcagcgaccccuggagcagcagcagcggcaugaaccagcccggcuacgccggcaugcugggcaacagcagccacaucccccagagcagcagcuacugcagccugcacccccacgagagacugagcuaccccagccacagcagcgccgacaucaacagcagccugccccccaugagcaccuuccacagaagcggcaccaaccacuacagcaccagcagcugcaccccccccgccaacggcaccgacagcaucauggccaacagaggcagcggcgccgccggcagcagccagaccggcgacgcccugggcaaggcccuggccagcaucuacagccccgaccacaccaacaacagcuucagcagcaaccccagcacccccgugggcagcccccccagccugagcgccggcaccgccguguggagcagaaacggcggccaggccagcagcagccccaacuacgagggcccccugcacagccugcagagcagaaucgaggacagacuggagagacuggacgacgccauccacgugcugagaaaccacgccgugggccccagcaccgccaugcccggcggccacggcgacaugcacggcaucaucggccccagccacaacggcgccaugggcggccugggcagcggcuacggcaccggccugcugagcgccaacagacacagccugauggugggcacccacagagaggacggcguggcccugagaggcagccacagccugcugcccaaccaggugcccgugccccagcugcccgugcagagcgccaccagccccgaccugaaccccccccaggaccccuacagaggcaugccccccggccugcagggccagagcgugagcagcggcagcagcgagaucaagagcgacgacgagggcgacgagaaccugcaggacaccaagagcagcgaggacaagaagcuggacgacgacaagaaggacaucaagagcaucaccagaagcagaagcagcaacaacgacgacgaggaccugacccccgagcagaaggccgagagagagaaggagagaagaauggccaacaacgccagagagagacugagagugagagacaucaacgaggccuucaaggagcugggcagaauggugcagcugcaccugaagagcgacaagccccagaccaagcugcugauccugcaccaggccguggccgugauccugagccuggagcagcaggugagagagagaaaccugaaccccaaggccgccugccugaagagaagagaggaggagaaggugagcagcgagccccccccccugagccuggccggcccccaccccggcaugggcgacgccagcaaccacaugggccagauguaa

SEQ ID NO: 24456 - RNA, 810 nt, Artificial Sequence
  TCF7__Homo_sapiens__NP_001128323
auguacaaggagaccguguacagcgccuucaaccugcugaugcacuaccccccccccagcggcgccggccagcacccccagccccagcccccccugcacaaggccaaccagcccccccacggcgugccccagcugagccuguacgagcacuucaacagcccccaccccacccccgcccccgccgacaucagccagaagcaggugcacagaccccugcagacccccgaccugagcggcuucuacagccugaccagcggcagcaugggccagcugccccacaccgugagcugguucacccaccccagccugaugcugggcagcggcgugcccggccaccccgccgccaucccccaccccgccaucgugccccccagcggcaagcaggagcugcagcccuucgacagaaaccugaagacccaggccgagagcaaggccgagaaggaggccaagaagcccaccaucaagaagccccugaacgccuucaugcuguacaugaaggagaugagagccaaggugaucgccgagugcacccugaaggagagcgccgccaucaaccagauccugggcagaagauggcacgcccugagcagagaggagcaggccaaguacuacgagcuggccagaaaggagagacagcugcacaugcagcuguaccccggcuggagcgccagagacaacuacggcaagaagaagagaagaagcagagagaagcaccaggagagcaccaccgagaccaacuggcccagagagcugaaggacggcaacggccaggagagccugagcaugagcagcagcagcagccccgccuaa

SEQ ID NO: 24457 - RNA, 1767 nt, Artificial Sequence
  TCF7L1__Homo_sapiens__NP_112573
augccccagcugggcggcggcggcggcggcggcggcggcggcagcggcggcggcggcggcagcagcgccggcgccgccggcggcggcgacgaccugggcgccaacgacgagcugauccccuuccaggacgagggcggcgaggagcaggagcccagcagcgacagcgccagcgcccagagagaccuggacgaggugaagagcagccuggugaacgagagcgagaaccagagcagcagcagcgacagcgaggccgagagaagaccccagcccgugagagacaccuuccagaagcccagagacuacuucgccgaggugagaagaccccaggacagcgccuucuucaagggcccccccuaccccggcuaccccuuccugaugauccccgaccugagcagccccuaccugagcaacggcccccugagccccggcggcgccagaaccuaccugcagaugaaguggccccugcuggacgugcccagcagcgccaccgugaaggacaccagaagccccagccccgcccaccugagcaacaaggugcccguggugcagcacccccaccacaugcacccccugaccccccugaucaccuacagcaacgaccacuucagccccggcagcccccccacccaccugagccccgagaucgaccccaagaccggcauccccagacccccccaccccagcgagcugagccccuacuacccccugagccccggcgccgugggccagaucccccacccccugggcuggcuggugccccagcagggccagcccauguacagccugccccccggcggcuucagacaccccuaccccgcccuggccaugaacgccagcaugagcagccuggugagcagcagauucagcccccacaugguggcccccgcccaccccggccugcccaccagcggcaucccccaccccgccaucgugagccccaucgugaagcaggagcccgccccccccagccugagccccgccgugagcgugaagagccccgugaccgugaagaaggaggaggagaagaagccccacgugaagaagccccugaacgccuucaugcuguacaugaaggagaugagagccaaggugguggccgagugcacccugaaggagagcgccgccaucaaccagauccugggcagaaaguggcacaaccugagcagagaggagcaggccaaguacuacgagcuggccagaaaggagagacagcugcacagccagcuguaccccaccuggagcgccagagacaacuacggcaagaagaagaagagaaagagagagaagcagcugagccagacccagagccagcagcaggugcaggaggccgagggcgcccuggccagcaagagcaagaagcccugcgugcaguaccugccccccgagaagcccugcgacagccccgccagcagccacggcagcaugcuggacagccccgccacccccagcgccgcccuggccagccccgccgcccccgccgccacccacagcgagcaggcccagccccugagccugaccaccaagcccgagaccagagcccagcuggcccugcacagcgccgccuuccugagcgccaaggccgccgccagcagcagcggccagaugggcagccagcccccccugcugagcagaccccugccccugggcagcaugcccaccgcccugcuggccagcccccccagcuuccccgccacccugcacgcccaccaggcccugcccgugcugcaggcccagccccugagccuggugaccaagagcgcccacuaa

SEQ ID NO: 24458 - RNA, 1809 nt, Artificial Sequence
  TCF7L2__Homo_sapiens__NP_001139746
augccccagcugaacggcggcggcggcgacgaccugggcgccaacgacgagcugaucagcuucaaggacgagggcgagcaggaggagaagagcagcgagaacagcagcgccgagagagaccuggccgacgugaagagcagccuggugaacgagagcgagaccaaccagaacagcagcagcgacagcgaggccgagagaagacccccccccagaagcgagagcuucagagacaagagcagagagagccuggaggaggccgccaagagacaggacggcggccuguucaagggcccccccuaccccggcuaccccuucaucaugauccccgaccugaccagccccuaccugcccaacggcagccugagccccaccgccagaacccugcacuuccagagcggcagcacccacuacagcgccuacaagaccaucgagcaccagaucgccgugcaguaccugcagaugaaguggccccugcuggacgugcaggccggcagccugcagagcagacaggcccugaaggacgccagaagccccagccccgcccacaucgugagcaacaaggugcccguggugcagcacccccaccacgugcacccccugaccccccugaucaccuacagcaacgagcacuucacccccggcaacccccccccccaccugcccgccgacguggaccccaagaccggcauccccagacccccccacccccccgacaucagccccuacuacccccugagccccggcaccgugggccagaucccccacccccugggcuggcuggugccccagcagggccagcccguguaccccaucaccaccggcggcuucagacaccccuaccccaccgcccugaccgugaacgccagcaugagcagauuccccccccacauggugcccccccaccacacccugcacaccaccggcaucccccaccccgccaucgugacccccaccgugaagcaggagagcagccagagcgacgugggcagccugcacagcagcaagcaccaggacagcaagaaggaggaggagaagaagaagccccacaucaagaagccccugaacgccuucaugcuguacaugaaggagaugagagccaaggugguggccgagugcacccugaaggagagcgccgccaucaaccagauccugggcagaagauggcacgcccugagcagagaggagcaggccaaguacuacgagcuggccagaaaggagagacagcugcacaugcagcuguaccccggcuggagcgccagagacaacuacggcaagaagaagaagagaaagagagacaagcagcccggcgagaccaacgacgccaacacccccaagaagugcagagcccuguucggccuggacagacagacccuguggugcaagcccugcagaagaaagaagaagugcgugagauacauccagggcgagggcagcugccugagcccccccagcagcgacggcagccugcuggacagccccccccccagccccaaccugcugggcagcccccccagagacgccaagagccagaccgagcagacccagccccugagccugagccugaagcccgacccccuggcccaccugagcaugaugccccccccccccgcccugcugcuggccgaggccacccacaaggccagcgcccugugccccaacggcgcccuggaccugccccccgccgcccugcagcccgccgcccccagcagcagcaucgcccagcccagcaccagcagccugcacagccacagcagccuggccggcacccagccccagccccugagccuggugaccaagagccuggaguaa

SEQ ID NO: 24459 - RNA, 1503 nt, Artificial Sequence
  TCFL5__Homo_sapiens__NP_006593
augagcggccccggccccagagagcccccccccgaggccggcgccgccggcggcgaggccgccguggagggcgccggcggcggcgacgccgcccugggcgagcccggccugagcuucaccaccaccgaccugagccugguggagaugaccgagguggaguacacccagcugcagcacauccugugcagccacauggaggccgccgccgacggcgagcuggagaccagacugaacagcgcccugcuggccgccgccggccccggcgccggcgccggcggcuucgccgccggcggccagggcggcgccgcccccguguaccccgugcugugccccagcgcccuggccgccgacgcccccugccugggccacaucgacuuccaggagcugagaaugaugcugcugagcgaggccggcgccgccgagaagaccagcggcggcggcgacggcgccagagccagagccgacggcgccgccaaggagggcgccggcgccgccgccgccgccgccggccccgacggcgcccccgaggccagagccaagcccgccgugagagugagacuggaggacagauucaacagcauccccgccgagcccccccccgcccccagaggccccgagccccccgagcccggcggcgcccugaacaaccuggugacccugaucagacaccccagcgagcugaugaacgugccccugcagcagcagaacaagugcaccgcccuggugaagaacaagaccgccgccaccaccaccgcccugcaguucaccuacccccuguucaccaccaacgccugcagcaccagcggcaacagcaaccugagccagacccagagcagcagcaacagcugcagcgugcuggaggccgccaagcaccaggacaucggccugcccagagccuucagcuucugcuaccagcaggagaucgagagcaccaagcagacccugggcagcagaaacaaggugcugcccgagcagguguggaucaaggugggcgaggccgcccugugcaagcaggcccugaagagaaacagaagcagaaugagacagcuggacaccaacguggagagaagagcccugggcgagauccagaacgugggcgagggcgccaccgccacccagggcgccuggcagagcagcgagagcagccaggccaaccugggcgagcaggcccagagcggcccccagggcggcagaagccagagaagagagagacacaacagaauggagagagacagaagaagaagaaucagaaucugcugcgacgagcugaaccugcuggugcccuucugcaacgccgagaccgacaaggccaccacccugcaguggaccaccgccuuccugaaguacauccaggagagacacggcgacagccugaagaaggaguucgagagcguguucugcggcaagaccggcagaagacugaagcugaccagacccgacagccuggugaccugccccgcccagggcagccugcagagcagccccagcauggagaucaaguaa

SEQ ID NO: 24460 - RNA, 5832 nt, Artificial Sequence
  TCHH__Homo_sapiens__NP_009044
augagcccccugcugagaagcaucugcgacaucaccgagaucuucaaccaguacgugagccacgacugcgacggcgccgcccugaccaagaaggaccugaagaaccugcuggagagagaguucggcgccgugcugagaagaccccacgaccccaagaccguggaccugauccuggagcugcuggaccuggacagcaacggcagaguggacuucaacgaguuccugcuguucaucuucaagguggcccaggccugcuacuacgcccugggccaggccaccggccuggacgaggagaagagagccagaugcgacggcaaggagagccugcugcaggacagaagacaggaggaggaccagagaagauucgagcccagagacagacagcuggaggaggagcccggccagagaagaagacagaagagacaggagcaggagagagagcuggccgagggcgaggagcagagcgagaagcaggagagacuggagcagagagacagacagagaagagacgaggagcuguggagacagagacaggaguggcaggagagagaggagagaagagccgaggaggagcagcugcagagcugcaagggccacgagaccgaggaguuccccgacgaggagcagcugagaagaagagagcugcuggagcugagaagaaagggcagagaggagaagcagcagcagagaagagagagacaggacagaguguuccaggaggaggaggagaaggaguggagaaagagagagaccgugcugagaaaggaggaggagaagcugcaggaggaggagccccagagacagagagagcugcaggaggaggaggagcagcugagaaagcuggagagacaggagcugagaagagagagacaggaggaggagcagcagcagcagagacugagaagagagcagcagcugagaagaaagcaggaggaggagagaagagagcagcaggaggagagaagagagcagcaggagagaagagagcagcaggaggagagaagagagcagcagcugagaagagagcaggaggagagaagagagcagcagcugagaagagagcaggaggaggagagaagagagcagcagcugagaagagagcaggaggaggagagaagagagcagcagcugagaagagagcagcagcugagaagagagcagcagcugagaagagagcagcagcugagaagagagcagcagcugagaagagagcagcagcugagaagagagcagcagcugagaagagagcagcagcugagaagagagcagcagcugagaagagagcaggaggaggagagacacgagcagaagcacgagcaggagagaagagagcagagacugaagagagagcaggaggagagaagagacuggcugaagagagaggaggagaccgagagacacgagcaggagagaagaaagcagcagcugaagagagaccaggaggaggagagaagagagagauggcugaagcuggaggaggaggagagaagagagcagcaggagagaagagagcagcagcugagaagagagcaggaggagagaagagagcagagacugaagagacaggaggaggaggagagacugcagcagagacugagaagcgagcagcagcugagaagagagcaggaggagagaagagagcagcugcugaagagagaggaggagaagagacuggagcaggagagaagagagcagagacugaagagagagcaggaggagagaagagaccagcugcugaagagagaggaggagagaagacagcagagacugaagagagagcaggaggagagacuggagcagagacugaagagagaggagguggagagacuggagcaggaggagagaagagagcagagacugaagagagaggagcccgaggaggagagaagacagcagcugcugaagagcgaggagcaggaggagagaagacagcagcagcugagaagagagcagcaggagagaagagagcagagacugaagagagaggaggaggaggagagacuggagcagagacugaagagagagcacgaggaggagagaagagagcaggagcuggccgaggaggagcaggagcaggccagagagagaaucaagagcagaauccccaaguggcaguggcagcuggagagcgaggccgacgccagacagagcaagguguacagcagacccagaaagcaggagggccagagaagaagacaggagcaggaggagaagagaagaagaagagagagcgagcugcaguggcaggaggaggagagagcccacagacagcagcaggaggaggagcagagaagagacuucaccuggcaguggcaggccgaggagaagagcgagagaggcagacagagacugagcgccagacccccccugagagagcagagagagagacagcugagagccgaggagagacagcagagagagcagagauuccugcccgaggaggaggagaaggagcagagaagaagacagagaagagagagagagaaggagcugcaguuccuggaggaggaggagcagcugcagagaagagagagagcccagcagcugcaggaggaggaggacggccugcaggaggaccaggagagaagaagaagccaggagcagagaagagaccagaaguggagauggcagcuggaggaggagagaaagagaagaagacacacccuguacgccaagcccgcccugcaggagcagcugagaaaggagcagcagcugcugcaggaggaggaggaggagcugcagagagaggagagagagaagagaagaagacaggagcaggagagacaguacagagaggaggagcagcugcagcaggaggaggagcagcugcugagagaggagagagagaagagaagaagacaggagagagagagacaguacagaaaggacaagaagcugcagcagaaggaggagcagcugcugggcgaggagcccgagaagagaagaagacaggagagagagaagaaguacagagaggaggaggagcugcagcaggaggaggagcagcugcugagagaggagagagagaagagaagaagacaggagugggagagacaguacagaaagaaggacgagcugcagcaggaggaggagcagcugcugagagaggagagagagaagagaagacugcaggagagagagagacaguacagagaggaggaggagcugcagcaggaggaggagcagcugcugggcgaggagagagagaccagaagaagacaggagcuggagagacaguacagaaaggaggaggagcugcagcaggaggaggagcagcugcugagagaggagcccgagaagagaagaagacaggagagagagagacagugcagagaggaggaggagcugcagcaggaggaggagcagcugcugagagaggagagagagaagagaagaagacaggagcuggagagacaguacagagaggaggaggaggugcagcaggaggaggagcagcugcugagagaggagcccgagaagagaagaagacaggagcuggagagacaguacagagaggaggaggagcugcagcaggaggaggagcagcugcugagagaggagcaggagaagagaagacaggagagagagagacaguacagagaggaggaggagcugcagagacagaagagaaagcagagauacagagacgaggaccagagaagcgaccugaaguggcagugggagcccgagaaggagaacgccgugagagacaacaagguguacugcaagggcagagagaacgagcaguucagacagcuggaggacagccagcugagagacagacagagccagcaggaccugcagcaccugcugggcgagcagcaggagagagacagagagcaggagagaagaagauggcagcagagagacagacacuuccccgaggaggagcagcuggagagagaggagcagaaggaggccaagagaagagacagaaagagccaggaggagaagcagcugcugagagaggagagagaggagaagagaagaagacaggagaccgacagaaaguucagagaggaggagcagcugcugcaggagagagaggagcagccccugagaagacaggagagagacagaaaguucagagaggaggagcugagacaccaggagcagggcagaaaguuccuggaggaggagcagagacugagaagacaggagagagagagaaaguuccugaaggaggagcagcagcugagaugccaggagagagagcagcagcugagacaggacagagacagaaaguucagagaggaggagcagcagcugagcagacaggagagagacagaaaguucagagaggaggagcagcaggugagaagacaggagagagagagaaaguuccuggaggaggagcagcagcugagacaggagagacacagaaaguucagagaggaggagcagcugcugcaggagagagaggagcagcagcugcacagacaggagagagacagaaaguuccuggaggaggagcagcagcugagaagacaggagagagacagaaaguucagagagcaggagcugagaagccaggagcccgagagaaaguuccuggaggaggagcagcagcugcacagacagcagagacagagaaaguuccugcaggaggagcagcagcugagaagacaggagagaggccagcagagaagacaggacagagacagaaaguucagagaggaggagcagcugagacaggagagagaggagcagcagcugagcagacaggagagagacagaaaguucagacuggaggagcagaaggugagaagacaggagcaggagagaaaguucauggaggacgagcagcagcugagaagacaggagggccagcagcagcugagacaggagagagacagaaaguucagagaggacgagcagcugcugcaggagagagaggagcagcagcugcacagacaggagagagacagaaaguuccuggaggaggagccccagcugagaagacaggagagagagcagcagcugagacacgacagagacagaaaguucagagaggaggagcagcugcugcaggagggcgaggagcagcagcugagaagacaggagagagacagaaaguucagagaggaggagcagcagcugagaagacaggagagagagagaaaguuccugcaggaggagcagcagcugagaagacaggagcuggagagaaaguucagagaggaggagcagcugagacaggagaccgagcaggagcagcugagaagacaggagagauacagaaagauccuggaggaggagcagcugagacccgagagagaggagcagcagcugagaagacaggagagagacagaaaguucagagaggaggagcagcugagacaggagagagaggagcagcagcugagaagccaggagagcgacagaaaguucagagaggaggagcagcugagacaggagagagaggagcagcagcugagaccccagcagagagacggcaaguacagaugggaggaggagcagcugcagcuggaggagcaggagcagagacugagacaggagagagacagacaguacagagccgaggagcaguucgccacccaggagaagagcagaagagaggagcaggagcuguggcaggaggaggagcagaagagaagacaggagagagagagaaagcugagagaggagcacaucagaagacagcagaaggaggagcagagacacagacaggugggcgagaucaagagccaggagggcaagggccacggcagacugcuggagcccggcacccaccaguucgccagcgugcccgugagaagcagcccccuguacgaguacauccaggagcagagaagccaguacagacccuaa

SEQ ID NO: 24461 - RNA, 1497 nt, Artificial Sequence
  TCHP__Homo_sapiens__XP_011537139
auggcccugcccacccugcccagcuacuggugcagccagcagagacugaaccagcagcuggccagacagagagagcaggaggccagacugagacagcagugggagcagaacagcagauacuucagaaugagcgacaucugcagcagcaagcaggccgaguggagcagcaagaccagcuaccagagaagcaugcacgccuaccagagagagaagaugaaggaggagaagagaagaagccuggaggccagaagagagaagcugagacagcugaugcaggaggagcaggaccugcuggccagagagcuggaggagcugagacugagcaugaaccugcaggagagaagaaucagagagcagcacggcaagcugaagagcgccaaggaggagcagagaaagcugaucgccgagcagcugcuguacgagcacuggaagaagaacaaccccaagcugagagagauggagcuggaccugcaccagaagcacguggugaacagcugggagaugcagaaggaggagaagaagcagcaggaggccaccgccgagcaggagaacaagagauacgagaacgaguacgagagagccagaagagaggcccuggagagaaugaaggccgaggaggagagaagacagcuggaggacaagcugcaggccgaggcccugcugcagcagauggaggagcugaagcugaaggagguggaggccaccaagcugaagaaggagcaggagaaccugcugaagcagagaugggagcuggagagacuggaggaggagagaaagcagauggaggccuucagacagaaggccgagcugggcagauuccugagacaccaguacaacgcccagcugagcagaagaacccagcagauccaggaggagcuggaggccgacagaagaauccugcaggcccugcuggagaaggaggacgagagccagagacugcaccuggccagaagagagcaggugauggccgacguggccuggaugaagcaggccaucgaggagcagcugcagcuggagagagccagagaggccgagcugcagaugcugcugagagaggaggccaaggagaugugggagaagagagaggccgagugggccagagagagaagcgccagagacagacugaugagcgaggugcugaccggcagacagcagcagauccaggagaagaucgagcagaacagaagagcccaggaggagagccugaagcacagagagcagcugaucagaaaccuggaggaggugagagagcuggccagaagagagaaggaggagagcgagaagcugaagagcgccagaaagcaggagcuggaggcccagguggccgagagaagacugcaggccugggaggccgaccagcaggaggaggaggaggaggaggaggccagaagaguggagcagcugagcgacgcccugcugcagcaggaggccgagaccauggccgagcagggcuacagacccaagcccuacggccaccccaagaucgccuggaacuaa

SEQ ID NO: 24462 - RNA, 1845 nt, Artificial Sequence
  TCIRG1__Homo_sapiens__NP_006044
augaccuuccugaucagcuacuggggcgagcagaucggccagaagaucagaaagaucaccgacugcuuccacugccacguguuccccuuccugcagcaggaggaggccagacugggcgcccugcagcagcugcagcagcagagccaggagcugcaggaggugcugggcgagaccgagagauuccugagccaggugcugggcagagugcugcagcugcugccccccggccaggugcaggugcacaagaugaaggccguguaccuggcccugaaccagugcagcgugagcaccacccacaagugccugaucgccgaggccuggugcagcgugagagaccugcccgcccugcaggaggcccugagagacagcagcauggaggagggcgugagcgccguggcccacagaauccccugcagagacaugccccccacccugaucagaaccaacagauucaccgccagcuuccagggcaucguggacgccuacggcgugggcagauaccaggaggugaaccccgcccccuacaccaucaucaccuuccccuuccuguucgccgugauguucggcgacgugggccacggccugcugauguuccuguucgcccuggccauggugcuggccgagaacagacccgccgugaaggccgcccagaacgagaucuggcagaccuucuucagaggcagauaccugcugcugcugaugggccuguucagcaucuacaccggcuucaucuacaacgagugcuucagcagagccaccagcaucuuccccagcggcuggagcguggccgccauggccaaccagagcggcuggagcgacgccuuccuggcccagcacaccaugcugacccuggaccccaacgugaccggcguguuccugggccccuaccccuucggcaucgaccccaucuggagccuggccgccaaccaccugagcuuccugaacagcuucaagaugaagaugagcgugauccugggcguggugcacauggccuucggcguggugcugggcguguucaaccacgugcacuucggccagagacacagacugcugcuggagacccugcccgagcugaccuuccugcugggccuguucggcuaccugguguuccuggugaucuacaaguggcugugcgugugggccgccagagccgccagcgcccccagcauccugauccacuucaucaacauguuccuguucagccacagccccagcaacagacugcuguaccccagacaggagguggugcaggccacccugguggugcuggcccuggccauggugcccauccugcugcugggcaccccccugcaccugcugcacagacacagaagaagacugagaagaagacccgccgacagacaggaggagaacaaggccggccugcuggaccugcccgacgccagcgugaacggcuggagcagcgacgaggagaaggccggcggccuggacgacgaggaggaggccgagcuggugcccagcgaggugcugaugcaccaggccauccacaccaucgaguucugccugggcugcgugagcaacaccgccagcuaccugagacugugggcccugagccuggcccacgcccagcugagcgaggugcugugggccauggugaugagaaucggccugggccugggcagagaggugggcguggccgccguggugcuggugcccaucuucgccgccuucgccgugaugaccguggccauccugcuggugauggagggccugagcgccuuccugcacgcccugagacugcacuggguggaguuccagaacaaguucuacagcggcaccggcuacaagcugagccccuucaccuucgccgccaccgacgacuaa

SEQ ID NO: 24463 - RNA, 345 nt, Artificial Sequence
  TCL1A__Homo_sapiens__NP_001092195
auggccgagugccccacccugggcgaggccgugaccgaccaccccgacagacugugggccugggagaaguucguguaccuggacgagaagcagcacgccuggcugccccugaccaucgagaucaaggacagacugcagcugagagugcugcugagaagagaggacguggugcugggcagacccaugacccccacccagaucggccccagccugcugcccaucauguggcagcuguaccccgacggcagauacagaagcagcgacagcagcuucuggagacugguguaccacaucaagaucgacggcguggaggacaugcugcuggagcugcugcccgacgacuaa

SEQ ID NO: 24464 - RNA, 387 nt, Artificial Sequence
  TCL1B__Homo_sapiens__NP_004909
auggccagcgaggccagcgugagacugggcgugccccccggcagacuguggauccagagacccggcaucuacgaggacgaggagggcagaaccugggugaccgugguggugagauucaaccccagcagaagagagugggccagagccagccagggcagcagauacgagcccagcaucaccgugcaccuguggcagauggccgugcacaccagagagcugcugagcagcggccagaugcccuucagccagcugcccgccguguggcagcuguaccccggcagaaaguacagagccgccgacagcagcuucugggagaucgccgaccacggccagaucgacagcauggagcagcuggugcugaccuaccagcccgagagaaaggacuaa

SEQ ID NO: 24465 - RNA, 1302 nt, Artificial Sequence
  TCN1__Homo_sapiens__NP_001053
augagacagagccaccagcugccccuggugggccugcugcuguucagcuucauccccagccagcugugcgagaucugcgaggugagcgaggagaacuacaucagacugaagccccugcugaacaccaugauccagagcaacuacaacagaggcaccagcgccgugaacguggugcugagccugaagcuggugggcauccagauccagacccugaugcagaagaugauccagcagaucaaguacaacgugaagagcagacugagcgacgugagcagcggcgagcuggcccugaucauccuggcccugggcgugugcagaaacgccgaggagaaccugaucuacgacuaccaccugaucgacaagcuggagaacaaguuccaggccgagaucgagaacauggaggcccacaacggcaccccccugaccaacuacuaccagcugagccuggacgugcuggcccugugccuguucaacggcaacuacagcaccgccgagguggugaaccacuucacccccgagaacaagaacuacuacuucggcagccaguucagcguggacaccggcgccauggccgugcuggcccugaccugcgugaagaagagccugaucaacggccagaucaaggccgacgagggcagccugaagaacaucagcaucuacaccaagagccugguggagaagauccugagcgagaagaaggagaacggccugaucggcaacaccuucagcaccggcgaggccaugcaggcccuguucgugagcagcgacuacuacaacgagaacgacuggaacugccagcagacccugaacaccgugcugaccgagaucagccagggcgccuucagcaaccccaacgccgccgcccaggugcugcccgcccugaugggcaagaccuuccuggacaucaacaaggacagcagcugcgugagcgccagcggcaacuucaacaucagcgccgacgagcccaucaccgugaccccccccgacagccagagcuacaucagcgugaacuacagcgugagaaucaacgagaccuacuucaccaacgugaccgugcugaacggcagcguguuccugagcgugauggagaaggcccagaagaugaacgacaccaucuucggcuucaccauggaggagagaagcuggggccccuacaucaccugcauccagggccugugcgccaacaacaacgacagaaccuacugggagcugcugagcggcggcgagccccugagccagggcgccggcagcuacguggugagaaacggcgagaaccuggaggugagauggagcaaguacuaa

SEQ ID NO: 24466 - RNA, 1284 nt, Artificial Sequence
  TCN2__Homo_sapiens__NP_000346
augagacaccugggcgccuuccuguuccugcugggcgugcugggcgcccugaccgagaugugcgagauccccgagauggacagccaccugguggagaagcugggccagcaccugcugcccuggauggacagacugagccuggagcaccugaaccccagcaucuacgugggccugagacugagcagccugcaggccggcaccaaggaggaccuguaccugcacagccugaagcugggcuaccagcagugccugcugggcagcgccuucagcgaggacgacggcgacugccagggcaagcccagcaugggccagcuggcccuguaccugcuggcccugagagccaacugcgaguucgugagaggccacaagggcgacagacuggugagccagcugaagugguuccuggaggacgagaagagagccaucggccacgaccacaagggccacccccacaccagcuacuaccaguacggccugggcauccuggcccugugccugcaccagaagagagugcacgacagcgugguggacaagcugcuguacgccguggagcccuuccaccagggccaccacagcguggacaccgccgccauggccggccuggccuucaccugccugaagagaagcaacuucaaccccggcagaagacagagaaucaccauggccaucagaaccgugagagaggagauccugaaggcccagacccccgagggccacuucggcaacguguacagcaccccccuggcccugcaguuccugaugaccagccccaugagaggcgccgagcugggcaccgccugccugaaggccagaguggcccugcuggccagccugcaggacggcgccuuccagaacgcccugaugaucagccagcugcugcccgugcugaaccacaagaccuacaucgaccugaucuuccccgacugccuggcccccagagugaugcuggagcccgccgccgagaccaucccccagacccaggagaucaucagcgugacccugcaggugcugagccugcugccccccuacagacagagcaucagcgugcuggccggcagcaccguggaggacgugcugaagaaggcccacgagcugggcggcuucaccuacgagacccaggccagccugagcggccccuaccugaccagcgugaugggcaaggccgccggcgagagagaguucuggcagcugcugagagaccccaacaccccccugcugcagggcaucgccgacuacagacccaaggacggcgagaccaucgagcugagacuggugagcugguaa

SEQ ID NO: 24467 - RNA, 4236 nt, Artificial Sequence
  TCOF1__Homo_sapiens__NP_000347
auggccgaggccagaaagagaagagagcugcugccccugaucuaccaccaccugcugagagccggcuacgugagagccgccagagaggugaaggagcagagcggccagaagugcuuccuggcccagcccgugacccugcuggacaucuacacccacuggcagcagaccagcgagcugggcagaaagagaaaggccgaggaggacgccgcccugcaggccaagaagaccagagugagcgaccccaucagcaccagcgagagcagcgaggaggaggaggaggccgaggccgagaccgccaaggccacccccagacuggccagcaccaacagcagcgugcugggcgccgaccugcccagcagcaugaaggagaaggccaaggccgagaccgagaaggccggcaagaccggcaacagcaugccccaccccgccaccggcaagaccguggccaaccugcugagcggcaagagccccagaaagagcgccgagcccagcgccaacaccacccuggugagcgagaccgaggaggagggcagcgugcccgccuucggcgccgccgccaagcccggcauggugagcgccggccaggccgacagcagcagcgaggacaccagcagcagcagcgacgagaccgacguggaggugaaggccagcgagaagauccugcaggugagagccgccagcgcccccgccaagggcacccccggcaagggcgccacccccgccccccccggcaaggccggcgccguggccagccagaccaaggccggcaagcccgaggaggacagcgagagcagcagcgaggagagcagcgacagcgaggaggagacccccgccgccaaggcccugcugcaggccaaggccagcggcaagaccagccaggugggcgccgccagcgcccccgccaaggagagccccagaaagggcgccgcccccgccccccccggcaagaccggccccgccguggccaaggcccaggccggcaagagagaggaggacagccagagcagcagcgaggagagcgacagcgaggaggaggcccccgcccaggccaagcccagcggcaaggccccccaggugagagccgccagcgcccccgccaaggagagccccagaaagggcgccgcccccgccccccccagaaagaccggccccgccgccgcccaggugcaggugggcaagcaggaggaggacagcagaagcagcagcgaggagagcgacagcgacagagaggcccuggccgccaugaacgccgcccaggugaagccccugggcaagagcccccaggugaagcccgccagcaccaugggcaugggcccccugggcaagggcgccggccccgugccccccggcaaggugggccccgccacccccagcgcccaggugggcaagugggaggaggacagcgagagcagcagcgaggagagcagcgacagcagcgacggcgaggugcccaccgccguggcccccgcccaggagaagagccugggcaacauccugcaggccaagcccaccagcagccccgccaagggccccccccagaaggccggccccguggccgugcaggugaaggccgagaagcccauggacaacagcgagagcagcgaggagagcagcgacagcgccgacagcgaggaggcccccgccgccaugaccgccgcccaggccaagcccgcccugaagaucccccagaccaaggccugccccaagaagaccaacaccaccgccagcgccaagguggcccccgugagagugggcacccaggcccccagaaaggccggcaccgccaccagccccgccggcagcagccccgccguggccggcggcacccagagacccgccgaggacagcagcagcagcgaggagagcgacagcgaggaggagaagaccggccuggccgugaccgugggccaggccaagagcgugggcaagggccugcaggugaaggccgccagcgugcccgugaagggcagccugggccagggcaccgcccccgugcugcccggcaagaccggccccaccgugacccaggugaaggccgagaagcaggaggacagcgagagcagcgaggaggagagcgacagcgaggaggccgccgccagccccgcccaggugaagaccagcgugaagaagacccaggccaaggccaaccccgccgccgccagagcccccagcgccaagggcaccaucagcgcccccggcaagguggugaccgccgccgcccaggccaagcagagaagccccagcaaggugaagccccccgugagaaacccccagaacagcaccgugcuggccagaggccccgccagcgugcccagcgugggcaaggccguggccaccgccgcccaggcccagaccggccccgaggaggacagcggcagcagcgaggaggagagcgacagcgaggaggaggccgagacccuggcccaggugaagcccagcggcaagacccaccagaucagagccgcccuggcccccgccaaggagagccccagaaagggcgccgcccccaccccccccggcaagaccggccccagcgccgcccaggccggcaagcaggacgacagcggcagcagcagcgaggagagcgacagcgacggcgaggcccccgccgccgugaccagcgcccaggugaucaagcccccccugaucuucguggaccccaacagaagccccgccggccccgccgccacccccgcccaggcccaggccgccagcacccccagaaaggccagagccagcgagagcaccgccagaagcagcagcagcgagagcgaggacgaggacgugauccccgccacccagugccugacccccggcaucagaaccaacguggugaccaugcccaccgcccaccccagaaucgcccccaaggccagcauggccggcgccagcagcagcaaggagagcagcagaaucagcgacggcaagaagcaggagggccccgccacccaggugagcaagaagaaccccgccagccugccccugacccaggccgcccugaaggugcuggcccagaaggccagcgaggcccagccccccguggccagaacccagcccagcagcggcguggacagcgccgugggcacccugcccgccaccagcccccagagcaccagcgugcaggccaagggcaccaacaagcugagaaagcccaagcugcccgaggugcagcaggccaccaaggcccccgagagcagcgacgacagcgaggacagcagcgacagcagcagcggcagcgaggaggacggcgagggcccccagggcgccaagagcgcccacacccugggccccacccccagcagaaccgagacccugguggaggagaccgccgccgagagcagcgaggacgacgugguggcccccagccagagccugcugagcggcuacaugacccccggccugacccccgccaacagccaggccagcaaggccacccccaagcuggacagcagccccagcgugagcagcacccuggccgccaaggacgaccccgacggcaagcaggaggccaagccccagcaggccgccggcaugcugagccccaagaccggcggcaaggaggccgccagcggcaccaccccccagaagagcagaaagcccaagaagggcgccggcaacccccaggccagcacccuggcccugcagagcaacaucacccagugccugcugggccagcccuggccccugaacgaggcccaggugcaggccagcguggugaaggugcugaccgagcugcuggagcaggagagaaagaaggugguggacaccaccaaggagagcagcagaaagggcugggagagcagaaagagaaagcugagcggcgaccagcccgccgccagaacccccagaagcaagaagaagaagaagcugggcgccggcgagggcggcgaggccagcgugagccccgagaagaccagcaccaccagcaagggcaaggccaagagagacaaggccagcggcgacgugaaggagaagaagggcaagggcagccugggcagccagggcgccaaggacgagcccgaggaggagcugcagaagggcaugggcaccguggagggcggcgaccagagcaaccccaagagcaagaaggagaagaagaagagcgacaagagaaagaaggacaaggagaagaaggagaagaagaagaaggccaagaaggccagcaccaaggacagcgagagccccagccagaagaagaagaagaagaagaagaagaccgccgagcagaccguguaa

SEQ ID NO: 24468 - RNA, 981 nt, Artificial Sequence
  TCP10__Homo_sapiens__NP_004601
auggagaagacccccgccgccgccgaggugcccagagaggacagcaacgccggcgagaugcccagccugcagcagcagaucaccagccugcaccaggagcugggcagacagcagagccugugggccgacauccacagaaagcugcagagccacauggacgcccugagaaagcagaacagagagcugagagaggagcugagaggccugcagagacagcagugggaggccggcaagaagcccgccgccagcccccacgccggcagagagagccacacccuggcccuggagcccgccuucggcaagaucagccaccugagcgccgacgaggacaccacccccaaguacgccggcagaaagagccagagcgccacccugcugggccagagauggagcagcaaccaccuggccccccccaagcccaugagccugaagaccgagagaaucaacagcggcaagacccccccccaggaggacagagagaagagcccccccggcagaagacaggacagaagccccgcccccaccggcagacccacccccggcgccgagagaagaggcgugagcgaggacggcaagaucaugcaccccagcagcagaagcccccagaacagcggcggcagaaagagccccgugcaggccagccaggccaccacccugcaggagcagaccgccgccgccagaggcgccgacagaagcagcagcgugcugggcagcagcgagggcggcuuccugagcagagugcaggccgacgaguucgccagcagcgcccccgacagcgccgagagacagaaccugcccgugaacccccccagcagccuggagaucgcccaggccauggacaccaagaugaagaaggaggaggugcaggaggagaagagacaccccaagggcaaggccgacgacugcagaagaagcggcuuccccagcgaguuccccggcgcccugcacgccgcccccagcagacaggacaugggccccuaa

SEQ ID NO: 24469 - RNA, 1062 nt, Artificial Sequence
  TCP10L2__Homo_sapiens__NP_001138593
augcuggagggccagcuggaggccagagagcccaaggagggcacccaccccgaggaccccugccccggcgccggcgccgccauggagaagacccccgccgccgccgaggugcccagagaggacagcaacgccggcgagaugcccagccugcagcagcagaucaccagccugcaccaggagcugggcagacagcagagccugugggccgacauccacagaaagcugcagagccacauggacgcccugagaaagcagaacagagagcugagagaggagcugagaggccugcagagacagcagugggaggccggcaagaagcccgccgccagcccccacgccggcagagagagccacacccuggcccuggagcccgccuucggcaagaucagcccccugagcgccgacgaggagaccacccccaaguacgccggcagaaagagccagagcgccacccugcugggccagagauggagcagcaaccaccuggccccccccaagcccaugagccugaagaccgagagaaucaacagcggcaagacccccccccaggaggacagagagaagagcccccccggcagaagacaggacagaagccccgcccccaccggcagacccacccccggcgccgagagaagagaggugagcgaggacggcaagaucaugcaccccagcagcagaagccugcagaacagcggcggcagaaagagccccgugcaggccagccaggccgccacccugcaggagcagaccgccgccgccggcguggccgacagaagcagcagcgugcugggcagcagcgagggcggcuuccugagcagagugcaggccgaggaguucgccagcagcagccccgacagcgccgagagacagaaccugcccgugaacccccccagcagccuggagaucgcccaggccauggacaccaagaugaagaaggaggaggugcaggaggagaagagacaccccaacggcaaggccgacgacugcagaagaagcggcuuccccagcgaguuccccggcgcccugcacgccgcccccagcagacaggacaugggccccuaa

SEQ ID NO: 24470 - RNA, 1530 nt, Artificial Sequence
  TCP11L1__Homo_sapiens__NP_060863
augagcgagaaccuggacaagagcaacgugaacgaggccggcaagagcaagagcaacgacagcgaggagggccuggaggacgccguggagggcgccgacgaggcccugcagaaggccaucaagagcgacagcagcagcccccagagagugcagagaccccacagcagcccccccagauucgugaccguggaggagcugcuggagaccgccagaggcgugaccaacauggcccuggcccacgagaucguggugaacggcgacuuccagaucaagcccguggagcugcccgagaacagccugaagaagagagugaaggagaucgugcacaaggccuucugggacugccugagcgugcagcugagcgaggacccccccgccuacgaccacgccaucaagcuggugggcgagaucaaggagacccugcugagcuuccugcugcccggccacaccagacugagaaaccagaucaccgaggugcuggaccuggaccugaucaagcaggaggccgagaacggcgcccuggacaucagcaagcuggccgaguucaucaucggcaugaugggcacccugugcgcccccgccagagacgaggaggugaagaagcugaaggacaucaaggagaucgugccccuguucagagagaucuucagcgugcuggaccugaugaagguggacauggccaacuucgccaucagcagcaucagaccccaccugaugcagcagagcguggaguacgagagaaagaaguuccaggagauccuggagagacagcccaacagccuggacuucgugacccaguggcuggaggaggccagcgaggaccugaugacccagaaguacaagcacgcccugcccgugggcggcauggccgccggcagcggcgacaugcccagacugagccccguggccgugcagaacuacgccuaccugaagcugcugaagugggaccaccugcagagacccuuccccgagaccgugcugauggaccagagcagauuccacgagcugcagcugcagcuggagcagcugaccauccugggcgccgugcugcuggugaccuucagcauggccgcccccggcaucagcagccaggccgacuucgccgagaagcugaagaugaucgugaagauccugcugaccgacaugcaccugcccagcuuccaccugaaggacgugcugaccaccaucggcgagaaggugugccuggaggugagcagcugccugagccugugcggcagcagccccuucaccaccgacaaggagaccgugcugaagggccagauccaggccguggccagccccgacgaccccaucagaagaaucauggagagcagaauccugaccuuccuggagaccuaccuggccagcggccaccagaagccccugcccaccgugcccggcggccugagccccgugcagagagagcuggaggagguggccaucaaguucgccagacuggugaacuacaacaagaugguguucugccccuacuacgacgccauccugagcaagauccuggugagaagcuaa

SEQ ID NO: 24471 - RNA, 1206 nt, Artificial Sequence
  TCP1__Homo_sapiens__NP_001008897
augagcagcaagaucaucggcaucaacggcgacuucuucgccaacauggugguggacgccgugcuggccaucaaguacaccgacaucagaggccagcccagauaccccgugaacagcgugaacauccugaaggcccacggcagaagccagauggagagcaugcugaucagcggcuacgcccugaacugcguggugggcagccagggcaugcccaagagaaucgugaacgccaagaucgccugccuggacuucagccugcagaagaccaagaugaagcugggcgugcagguggugaucaccgaccccgagaagcuggaccagaucagacagagagagagcgacaucaccaaggagagaauccagaagauccuggccaccggcgccaacgugauccugaccaccggcggcaucgacgacaugugccugaaguacuucguggaggccggcgccauggccgugagaagagugcugaagagagaccugaagagaaucgccaaggccagcggcgccaccauccugagcacccuggccaaccuggagggcgaggagaccuucgaggccgccaugcugggccaggccgaggagguggugcaggagagaaucugcgacgacgagcugauccugaucaagaacaccaaggccagaaccagcgccagcaucauccugagaggcgccaacgacuucaugugcgacgagauggagagaagccugcacgacgcccugugcguggugaagagagugcuggagagcaagagcguggugcccggcggcggcgccguggaggccgcccugagcaucuaccuggagaacuacgccaccagcaugggcagcagagagcagcuggccaucgccgaguucgccagaagccugcuggugauccccaacacccuggccgugaacgccgcccaggacagcaccgaccugguggccaagcugagagccuuccacaacgaggcccaggugaaccccgagagaaagaaccugaaguggaucggccuggaccugagcaacggcaagcccagagacaacaagcaggccggcguguucgagcccaccaucgugaaggugaagagccugaaguucgccaccgaggccgccaucaccauccugagaaucgacgaccugaucaagcugcaccccgagagcaaggacgacaagcacggcagcuacgaggacgccgugcacagcggcgcccugaacgacuaa

SEQ ID NO: 24472 - RNA, 312 nt, Artificial Sequence
  TCTA__Homo_sapiens__NP_071503
auggccgagagcuggagcggccaggcccugcaggcccugcccgccaccgugcugggcgcccugggcagcgaguuccugagagagugggaggcccaggacaugagagugacccuguucaagcugcugcugcuguggcuggugcugagccugcugggcauccagcuggccuggggcuucuacggcaacaccgugaccggccuguaccacagacccggccugggcggccagaacggcagcacccccgacggcagcacccacuuccccagcugggagauggccgccaacgagccccugaagacccacagagaguaa

SEQ ID NO: 24473 - RNA, 1506 nt, Artificial Sequence
  TCTE1__Homo_sapiens__XP_011512640
augcaggacaccgugaccaccagcgcccugcuggaccccagccacagcagcgugagcacccaggacaacagcagcaccggcggccacaccagcagcaccagcccccagcugagcaagcccagcaucacccccgugcccgccaagagcagaaacccccaccccagagccaacaucagaagaaugagaagaaucaucgccgaggaccccgaguggagccuggccaucgugccccugcugaccgagcugugcauccagcacaucaucagaaacuuccagaagaaccccauccugaagcagaugcugcccgagcaccagcagaaggugcugaaccaccugagccccgaccugccccuggccgugaccgccaaccugaucgacagcgagaacuacuggcugagaugcugcaugcacagauggcccgugugccacguggcccaccacggcggcagcuggaagagaauguucuucgagagacaccuggagaaccugcugaagcacuucauccccggcaccaccgaccccgccgugauccuggaccugcugccccugugcagaaacuacgugagaagagugcacguggaccaguuccugccccccgugcagcugcccgcccagcugagacccggcgaccagagcgacagcggcagcgagggcgagauggaggagcccaccguggaccacuaccagcugggcgaccugguggccggccugagccaccuggaggagcuggaccugguguacgacgugaaggacugcggcaugaacuucgaguggaaccuguuccuguucaccuacagagacugccugagccuggccgccgccaucaaggccugccacacccugaagaucuucaagcugaccagaagcaagguggacgacgacaaggccagaaucaucaucagaagccugcuggaccaccccgugcuggaggagcuggaccugagccagaaccugaucggcgacagaggcgccagaggcgccgccaagcugcugagccacagcagacugagagugcugaaccuggccaacaaccaggugagagcccccggcgcccagagccuggcccacgcccuggcccacaacaccaaccugaucagccugaaccugagacugaacugcaucgaggacgagggcggccaggcccuggcccacgcccugcagaccaacaagugccugaccacccugcaccugggcggcaacgagcugagcgagcccaccgccacccugcugagccaggugcuggccaucaacaccacccugaccagcaucaaccugagcugcaaccacaucggccuggacggcggcaagcagcugcuggagggcaugagcgacaacaagacccugcuggaguucgaccugagacugagcgacguggcccaggagagcgaguaccugaucggccaggcccuguacgccaacagagaggccgccagacagagagcccugaaccccagccacuucaugagcaccaucaccgccaacggccccgagaacagcgugggcuaa

SEQ ID NO: 24474 - RNA, 1764 nt, Artificial Sequence
  TCTN1__Homo_sapiens__NP_001076006
augagacccagaggccugcccccccugcugguggugcugcugggcugcugggccagcgugagcgcccagaccgacgccacccccgccgugaccaccgagggccugaacagcaccgaggccgcccuggccaccuucggcaccuuccccagcaccagaccccccggcacccccagagcccccggccccagcagcggccccagacccacccccgugaccgacguggccgugcugugcgugugcgaccugagccccgcccagugcgacaucaacugcugcugcgaccccgacugcagcagcguggacuucagcguguucagcgccugcagcgugcccguggugaccggcgacagccaguucugcagccagaaggccgugaucuacagccugaacuucaccgccaaccccccccagagaguguucgagcugguggaccagaucaaccccagcaucuucugcauccacaucaccaacuacaagcccgcccugagcuucaucaaccccgaggugcccgacgagaacaacuucgacacccugaugaagaccagcgacggcuucacccugaacgccgagagcuacgugagcuucaccaccaagcuggacauccccaccgccgccaaguacgaguacggcgugccccugcagaccagcgacagcuuccugagauuccccagcagccugaccagcagccugugcaccgacaacaaccccgccgccuuccuggugaaccaggccgugaagugcaccagaaagaucaaccuggagcagugcgaggagaucgaggcccugagcauggccuucuacagcagccccgagauccugagagugcccgacagcagaaagaaggugcccaucaccgugcagagcaucgugauccagagccugaacaagacccugaccagaagagaggacaccgacgugcugcagcccacccuggugaacgccggccacuucagccugugcgugaacguggugcuggaggugaaguacagccugaccuacaccgacgccggcgaggugaccaaggccgaccugagcuucgugcugggcaccgugagcagcgugguggugccccugcagcagaaguucgagauccacuuccugcaggagaacacccagcccgugccccugagcggcaaccccggcuacguggugggccugccccuggccgccggcuuccagccccacaagggcagcggcaucauccagaccaccaacagauacggccagcugaccauccugcacagcaccaccgagcaggacugccuggcccuggagggcgugagaacccccgugcuguucggcuacaccaugcagagcggcugcaagcugagacugaccggcgcccugcccugccagcugguggcccagaaggugaagagccugcuguggggccagggcuuccccgacuacguggcccccuucggcaacagccaggcccaggacaugcuggacugggugcccauccacuucaucacccagagcuucaacagaaaggacagcugccagcugcccggcgcccuggugaucgaggugaaguggaccaaguacggcagccugcugaacccccaggccaagaucgugaacgugaccgccaaccugaucagcagcagcuuccccgaggccaacagcggcaacgagagaaccauccugaucagcaccgccgugaccuucguggacgugagcgcccccgccgaggccggcuucagagccccccccgccaucaacgccagacugcccuucaacuucuucuuccccuucguguaa

SEQ ID NO: 24475 - RNA, 2091 nt, Artificial Sequence
  TCTN2__Homo_sapiens__NP_001137322
augggcuuccagccccccgccgcccugcugcugagacuguuccugcugcagggcauccugagacugcuguggggcgaccuggccuucaucccccccuucaucagaaugagcggccccgccgugagcgccagccuggugggcgacaccgagggcgugaccgugagccuggccgugcugcaggacgaggccggcauccugcccauccccaccugcggcgugcugaacaacgagaccgaggacuggagcgugaccgugauccccggcgccgugcuggaggugaccgugagauggaagagaggccuggacuggugcagcagcaacgagaccgacagcuucagcgagagccccugcauccugcagacccugcuggugagcgccagccacaacagcagcugcagcgcccaccugcugauccagguggagaucuacgccaacagcagccugacccacaacgccagcgagaacgugaccgugauccccaaccagguguaccagccccugggccccugccccugcaaccugaccgccggcgccugcgacgugagaugcugcugcgaccaggagugcagcagcaaccugaccacccuguucagaagaagcugcuucaccggcguguucggcggcgacgugaacccccccuucgaccagcugugcagcgccggcaccaccaccagaggcgugcccgacugguuccccuuccugugcgugcagagcccccuggccaacacccccuuccugggcuacuucuaccacggcgccgugagccccaagcaggacagcagcuucgagguguacguggacaccgacgccaaggacuucgccgacuucggcuacaagcagggcgaccccaucaugaccgugaagaaggccuacuucaccaucccccaggugagccuggccggccagugcaugcagaacgcccccguggccuuccugcacaacuucgacgugaagugcgugaccaaccuggagcuguaccaggagagagacggcaucaucaacgccaagaucaagaacguggcccugggcggcaucgugacccccaaggugaucuacgaggaggccaccgaccuggacaaguucaucaccaacaccgagaccccccugaacaacggcagcacccccagaaucgugaacguggaggagcacuacaucuucaaguggaacaacaacaccaucagcgagaucaacgugaagaucuucagagccgagaucaacgcccaccagaagggcaucaugacccagagauucguggugaaguuccugagcuacaacagcggcaacgaggaggagcugagcggcaaccccggcuaccagcugggcaagcccgugagagcccugaacaucaacagaaugaacaacgugaccacccugcaccuguggcagagcgccggcagaggccugugcaccagcgccaccuucaagcccauccuguucggcgagaacgugcugagcggcugccugcuggaggugggcaucaacgagaacugcacccagcugagagagaacgccguggagagacuggacagccugauccaggccacccacguggccaugagaggcaacagcgacuacgccgaccugagcgacggcuggcuggagaucaucagaguggacgcccccgaccccggcgccgacccccuggccagcagcgugaacggcaugugccuggacauccccgcccaccugagcaucagaauccugaucagcgacgccggcgccguggagggcaucacccagcaggagauccugggcguggagaccagauucagcagcgugaacuggcaguaccagugcggccugaccugcgagcacaaggccgaccugcugcccaucagcgccagcgugcaguucaucaagauccccgcccagcugccccacccccugaccagauuccagaucaacuacaccgaguacgacugcaacagaaacgaggugugcuggccccagcugcuguaccccuggacccaguacuaccagggcgagcugcacagccagugcguggccaagggccugcugcugcugcuguuccugacccuggcccuguuccugagcaaccccuggaccagaaucugcaaggccuacagcuaa

SEQ ID NO: 24476 - RNA, 1380 nt, Artificial Sequence
  TCTN3__Homo_sapiens__NP_001137445
augagaaccccccagcuggcccugcugcagguguucuuccugguguuccccgacggcgugagaccccagcccagcagcagccccagcggcgccgugcccaccagccuggagcugcagagaggcaccgacggcggcacccugcagagccccagcgaggccaccgccaccagacccgccgugcccggccugcccaccguggugcccacccuggugacccccagcgcccccggcaacagaaccguggaccuguuccccgugcugcccaucugcgugugcgaccugacccccggcgccugcgacaucaacugcugcugcgacagagacugcuaccugcugcaccccagaaccguguucagcuucugccugcccggcagcgugagaagcagcagcugggugugcguggacaacagcgugaucuucagaagcaacagccccuuccccagcagaguguucauggacagcaacggcaucagacaguucugcgugcacgugaacaacugcuuccuggagagcaagagcaccaccugcaccagauucuucaagaaccuggccagcagcugcacccuggacagcgcccugaacgccgccagcuacuacaacuucaccgugcugaaggugcccagaagcaugaccgacccccagaacauggaggccuuccagcagagcaccgccgccagccugaccagccccagaagcggcaaccccggcuacaucgugggcaagccccugcuggcccugaccgacgacaucagcuacagcaugacccugcugcagagccagggcaacggcagcugcagcgugaagagacacgaggugcaguucggcgugaacgccaucagcggcugcaagcugagacugaagaaggccgacugcagccaccugcagcaggagaucuaccagacccugcacggcagacccagacccgaguacguggccaucuucggcaacgccgaccccgcccagaagggcggcuggaccagaauccugaacagacacugcagcaucagcgccaucaacugcaccagcugcugccugauccccgugagccuggagauccaggugcugugggccuacgugggccugcugagcaacccccaggcccacgugagcggcgugagauuccuguaccagugccagagcauccaggacagccagcaggugaccgaggugagccugaccacccuggugaacuucguggacaucacccagaagccccagccccccagaggccagcccaagauggacuggaaguggcccuucgacuucuuccccuucaagguggccuucagcagaggcguguucagccagaagugcagcgugagccccauccugauccugugccugcugcugcugggcgugcugaaccuggagaccauguaa

SEQ ID NO: 24477 - RNA, 519 nt, Artificial Sequence
  TDGF1__Homo_sapiens__NP_001167607
auggccaucagcaagguguucgagcugggccugguggccggccugggccaccaggaguucgccagacccagcagaggcuaccuggccuucagagacgacagcaucuggccccaggaggagcccgccaucagacccagaagcagccagagagugccccccaugggcauccagcacagcaaggagcugaacagaaccugcugccugaacggcggcaccugcaugcugggcagcuucugcgccugcccccccagcuucuacggcagaaacugcgagcacgacgugagaaaggagaacugcggcagcgugccccacgacaccuggcugcccaagaagugcagccugugcaagugcuggcacggccagcugagaugcuucccccaggccuuccugcccggcugcgacggccuggugauggacgagcaccugguggccagcagaacccccgagcugccccccagcgccagaaccaccaccuucaugcuggugggcaucugccugagcauccagagcuacuacuaa

SEQ ID NO: 24478 - RNA, 1233 nt, Artificial Sequence
  TDG__Homo_sapiens__NP_003202
auggaggccgagaacgccggcagcuacagccugcagcaggcccaggccuucuacaccuuccccuuccagcagcugauggccgaggcccccaacauggccguggugaacgagcagcagaugcccgaggaggugcccgcccccgcccccgcccaggagcccgugcaggaggcccccaagggcagaaagagaaagcccagaaccaccgagcccaagcagcccguggagcccaagaagcccguggagagcaagaagagcggcaagagcgccaagagcaaggagaagcaggagaagaucaccgacaccuucaaggugaagagaaagguggacagauucaacggcgugagcgaggccgagcugcugaccaagacccugcccgacauccugaccuucaaccuggacaucgugaucaucggcaucaaccccggccugauggccgccuacaagggccaccacuaccccggccccggcaaccacuucuggaagugccuguucaugagcggccugagcgaggugcagcugaaccacauggacgaccacacccugcccggcaaguacggcaucggcuucaccaacaugguggagagaaccacccccggcagcaaggaccugagcagcaaggaguucagagagggcggcagaauccuggugcagaagcugcagaaguaccagcccagaaucgccguguucaacggcaagugcaucuacgagaucuucagcaaggagguguucggcgugaaggugaagaaccuggaguucggccugcagccccacaagauccccgacaccgagacccugugcuacgugaugcccagcagcagcgccagaugcgcccaguuccccagagcccaggacaaggugcacuacuacaucaagcugaaggaccugagagaccagcugaagggcaucgagagaaacauggacgugcaggaggugcaguacaccuucgaccugcagcuggcccaggaggacgccaagaagauggccgugaaggaggagaaguacgaccccggcuacgaggccgccuacggcggcgccuacggcgagaaccccugcagcagcgagcccugcggcuucagcagcaacggccugaucgagagcguggagcugagaggcgagagcgccuucagcggcauccccaacggccaguggaugacccagagcuucaccgaccagauccccagcuucagcaaccacugcggcacccaggagcaggaggaggagagccacgccuaa

SEQ ID NO: 24479 - RNA, 1221 nt, Artificial Sequence
  TDO2__Homo_sapiens__NP_005642
augagcggcugccccuuccugggcaacaacuucggcuacaccuucaagaagcugcccguggagggcagcgaggaggacaagagccagaccggcgugaacagagccagcaagggcggccugaucuacggcaacuaccugcaccuggagaaggugcugaacgcccaggagcugcagagcgagaccaagggcaacaagauccacgacgagcaccuguucaucaucacccaccaggccuacgagcugugguucaagcagauccugugggagcuggacagcgugagagagaucuuccagaacggccacgugagagacgagagaaacaugcugaagguggugagcagaaugcacagagugagcgugauccugaagcugcuggugcagcaguucagcauccuggagaccaugaccgcccuggacuucaacgacuucagagaguaccugagccccgccagcggcuuccagagccugcaguucagacugcuggagaacaagaucggcgugcugcagaacaugagagugcccuacaacagaagacacuacagagacaacuucaagggcgaggagaacgagcugcugcugaagagcgagcaggagaagacccugcuggagcugguggaggccuggcuggagagaacccccggccuggagccccacggcuucaacuucuggggcaagcuggagaagaacaucaccagaggccuggaggaggaguucaucagaauccaggccaaggaggagagcgaggagaaggaggagcagguggccgaguuccagaagcagaaggaggugcugcugagccuguucgacgagaagagacacgagcaccugcugagcaagggcgagagaagacugagcuacagagcccugcagggcgcccugaugaucuacuucuacagagaggagcccagauuccaggugcccuuccagcugcugaccagccugauggacaucgacagccugaugaccaaguggagauacaaccacgugugcauggugcacagaaugcugggcagcaaggccggcaccggcggcagcagcggcuaccacuaccugagaagcaccgugagcgacagauacaagguguucguggaccuguucaaccugagcaccuaccugauccccagacacuggauccccaagaugaaccccaccauccacaaguuccuguacaccgccgaguacugcgacagcagcuacuucagcagcgacgagagcgacuaa

SEQ ID NO: 24480 - RNA, 1032 nt, Artificial Sequence
  TDP1__Homo_sapiens__XP_006720263
augaugcugcugcuguacgaggagggccugagaguggugauccacaccagcaaccugauccacgccgacuggcaccagaagacccagggcaucuggcugagcccccuguaccccagaaucgccgacggcacccacaagagcggcgagagccccacccacuucaaggccgaccugaucagcuaccugauggccuacaacgcccccagccugaaggaguggaucgacgugauccacaagcacgaccugagcgagaccaacguguaccugaucggcagcacccccggcagauuccagggcagccagaaggacaacuggggccacuucagacugaagaagcugcugaaggaccacgccagcagcaugcccaacgccgagagcuggcccguggugggccaguucagcagcgugggcagccugggcgccgacgagagcaaguggcugugcagcgaguucaaggagagcaugcugacccugggcaaggagagcaagacccccggcaagagcagcgugccccuguaccugaucuaccccagcguggagaacgugagaaccagccuggagggcuaccccgccggcggcagccugcccuacagcauccagaccgccgagaagcagaacuggcugcacagcuacuuccacaaguggagcgccgagaccagcggcagaagcaacgccaugccccacaucaagaccuacaugagacccagccccgacuucagcaagaucgccugguuccuggugaccagcgccaaccugagcaaggccgccuggggcgcccuggagaagaacggcacccagcugaugaucagaagcuacgagcugggcgugcuguuccugcccagcgccuucggccuggacagcuucaaggugaagcagaaguucuucgccggcagccaggagcccauggccaccuuccccgugcccuacgaccugccccccgagcuguacggcagcaaggacagacccuggaucuggaacauccccuacgugaaggcccccgacacccacggcaacaugugggugcccagcuaa

SEQ ID NO: 24481 - RNA, 1089 nt, Artificial Sequence
  TDP2__Homo_sapiens__NP_057698
auggagcugggcagcugccuggagggcggcagagaggccgccgaggaggagggcgagcccgaggugaagaagagaagacugcugugcguggaguucgccagcguggccagcugcgacgccgccguggcccagugcuuccuggccgagaacgacugggagauggagagagcccugaacagcuacuucgagccccccguggaggagagcgcccuggagagaagacccgagaccaucagcgagcccaagaccuacguggaccugaccaacgaggagaccaccgacagcaccaccagcaagaucagccccagcgaggacacccagcaggagaacggcagcauguucagccugaucaccuggaacaucgacggccuggaccugaacaaccugagcgagagagccagaggcgugugcagcuaccuggcccuguacagccccgacgugaucuuccugcaggaggugaucccccccuacuacagcuaccugaagaagagaagcagcaacuacgagaucaucaccggccacgaggagggcuacuucaccgccaucaugcugaagaagagcagagugaagcugaagagccaggagaucauccccuuccccagcaccaagaugaugagaaaccugcugugcgugcacgugaacgugagcggcaacgagcugugccugaugaccagccaccuggagagcaccagaggccacgccgccgagagaaugaaccagcugaagauggugcugaagaagaugcaggaggcccccgagagcgccaccgugaucuucgccggcgacaccaaccugagagacagagaggugaccagaugcggcggccugcccaacaacaucguggacgugugggaguuccugggcaagcccaagcacugccaguacaccugggacacccagaugaacagcaaccugggcaucaccgccgccugcaagcugagauucgacagaaucuucuucagagccgccgccgaggagggccacaucauccccagaagccuggaccugcugggccuggagaagcuggacugcggcagauuccccagcgaccacuggggccugcugugcaaccuggacaucauccuguaa

SEQ ID NO: 24482 - RNA, 3570 nt, Artificial Sequence
  TDRD1__Homo_sapiens__NP_942090
augagcgugaagagccccuucaacgugaugagcagaaacaaccuggaggccccccccugcaagaugaccgagcccuucaacuucgagaagaacgagaacaagcugcccccccacgagagccugagaagccccggcacccugcccaaccaccccaacuucagacugaagagcagcgagaacggcaacaagaagaacaacuuccugcugugcgagcagaccaagcaguaccuggccagccaggaggacaacagcgugagcagcaaccccaacggcaucaacggcgagguggugggcagcaagggcgacagaaagaagcugcccgccggcaacagcgugagcccccccagcgccgagagcaacagcccccccaaggaggugaacaucaagcccggcaacaacgugagacccgccaagagcaagaagcugaacaagcugguggagaacagccugagcaucagcaaccccggccuguucaccagccugggccccccccugagaagcaccaccugccacagaugcggccuguucggcagccugagaugcagccagugcaagcagaccuacuacugcagcaccgccugccagagaagagacuggagcgcccacagcaucgugugcagacccgugcagcccaacuuccacaagcuggagaacaagagcagcaucgagaccaaggacguggaggugaacaacaagagcgacugcccccugggcgugaccaaggagaucgccaucugggccgagagaaucauguucagcgaccugagaagccugcagcugaagaagaccauggagaucaagggcaccgugaccgaguucaagcaccccggcgacuucuacgugcagcuguacagcagcgaggugcuggaguacaugaaccagcugagcgccagccugaaggagaccuacgccaacgugcacgagaaggacuacauccccgugaagggcgaggugugcaucgccaaguacaccguggaccagaccuggaacagagccaucauccagaacguggacgugcagcagaagaaggcccacgugcuguacaucgacuacggcaacgaggagaucaucccccugaacagaaucuaccaccugaacagaaacaucgaccuguucccccccugcgccaucaagugcuucguggccaacgugauccccgccgagggcaacuggagcagcgacugcaucaaggccaccaagccccugcugauggagcaguacugcagcaucaagaucguggacauccuggaggaggagguggugaccuucgccguggagguggagcugcccaacagcggcaagcugcuggaccacgugcugaucgagaugggcuacggccugaagcccagcggccaggacagcaagaaggagaacgccgaccagagcgaccccgaggacgugggcaagaugaccaccgagaacaacaucgugguggacaagagcgaccugauccccaaggugcugacccugaacgugggcgacgaguucugcggcgugguggcccacauccagacccccgaggacuucuucugccagcagcugcagagcggcagaaagcuggccgagcugcaggccagccugagcaaguacugcgaccagcugccccccagaagcgacuucuaccccgccaucggcgacaucugcugcgcccaguucagcgaggacgaccagugguacagagccagcgugcuggccuacgccagcgaggagagcgugcuggugggcuacguggacuacggcaacuucgagauccugagccugaugagacugugccccaucauccccaagcugcuggagcugcccaugcaggccaucaagugcgugcuggccggcgugaagcccagccugggcaucuggacccccgaggccaucugccugaugaagaagcuggugcagaacaagaucaucaccgugaaggugguggacaagcuggagaacagcagccugguggagcugaucgacaagagcgagaccccccacgugagcgugagcaaggugcugcuggacgccggcuucgccgugggcgagcagagcauggugaccgacaagcccagcgacgugaaggagaccagcgugccccugggcguggagggcaaggugaacccccuggaguggaccuggguggagcugggcguggaccagaccguggacgugguggugugcgugaucuacagccccggcgaguucuacugccacgugcugaaggaggacgcccugaagaagcugaacgaccugaacaagagccuggccgagcacugccagcagaagcugcccaacggcuucaaggccgagaucggccagcccugcugcgccuucuucgccggcgacggcagcugguacagagcccuggugaaggagauccugcccaacggccacgugaaggugcacuucguggacuacggcaacaucgaggaggugaccgccgacgagcugagaaugaucagcagcaccuuccugaaccugcccuuccagggcaucagaugccagcuggccgacauccagagcagaaacaagcacuggagcgaggaggccaucaccagauuccagaugugcguggccggcaucaagcugcaggccagagugguggaggugaccgagaacggcaucggcguggagcugaccgaccugagcaccugcuaccccagaaucaucagcgacgugcugaucgacgagcaccuggugcugaagagcgccagcccccacaaggaccugcccaacgacagacuggugaacaagcacgagcugcaggugcacgugcagggccugcaggccaccagcagcgccgagcaguggaagaccaucgagcugcccguggacaagaccauccaggccaacgugcuggagaucaucagccccaaccuguucuacgcccugcccaagggcaugcccgagaaccaggagaagcugugcaugcugaccgccgagcugcuggaguacugcaacgcccccaagagcagaccccccuacagacccagaaucggcgacgccugcugcgccaaguacaccagcgacgacuucugguacagagccguggugcugggcaccagcgacaccgacguggaggugcuguacgccgacuacggcaacaucgagacccugccccugugcagagugcagcccaucaccagcagccaccuggcccugcccuuccagaucaucagaugcagccuggagggccugauggagcugaacggcagcagcagccagcugaucaucaugcugcugaagaacuucaugcugaaccagaacgugaugcugagcgugaagggcaucaccaagaacgugcacaccgugagcguggagaagugcagcgagaacggcaccguggacguggccgacaagcuggugaccuucggccuggccaagaacaucaccccccagagacagagcgcccugaacaccgagaagauguacagaaugaacugcugcugcaccgagcugcagaagcagguggagaagcacgagcacauccugcuguuccugcugaacaacagcaccaaccagaacaaguucaucgagaugaagaagcugcugaagaagaccgccagccugggcggcaagccccuguaa

SEQ ID NO: 24483 - RNA, 2235 nt, Artificial Sequence
  TDRD3__Homo_sapiens__NP_001139542
auggcccagguggccggcgccgcccugagccaggccggcugguaccugagcgacgagggcaucgaggccugcaccagcagccccgacaaggugaacgugaacgacaucauccugaucgcccugaacaccgaccugagaaccaucggcaagaaguuccugcccagcgacaucaacagcggcaagguggagaagcuggagggccccugcgugcugcagauccagaagaucagaaacguggccgcccccaaggacaacgaggagagccaggccgcccccagaaugcugagacugcagaugaccgacggccacaucagcugcaccgccguggaguucagcuacaugagcaagaucagccugaacaccccccccggcaccaaggugaagcugagcggcaucguggacaucaagaacggcuuccugcugcugaacgacagcaacaccaccgugcugggcggcgagguggagcaccugaucgagaagugggagcugcagagaagccugagcaagcacaacagaagcaacaucggcaccgagggcggccccccccccuucgugcccuucggccagaagugcgugagccacgugcagguggacagcagagagcuggacagaagaaagacccugcaggugaccaugcccgugaagcccaccaacgacaacgacgaguucgagaagcagagaaccgccgccaucgccgagguggccaagagcaaggagaccaagaccuucggcggcggcggcggcggcgccagaagcaaccugaacaugaacgccgccggcaacagaaacagagaggugcugcagaaggagaagagcaccaagagcgagggcaagcacgagggcguguacagagagcugguggacgagaaggcccugaagcacaucaccgagaugggcuucagcaaggaggccagcagacaggcccugauggacaacggcaacaaccuggaggccgcccugaacgugcugcugaccagcaacaagcagaagcccgugaugggccccccccugagaggcagaggcaagggcagaggcagaaucagaagcgaggacgaggaggaccugggcaacgccagacccagcgcccccagcacccuguucgacuuccuggagagcaagaugggcacccugaacguggaggagcccaagagccagccccagcagcugcaccagggccaguacagaagcagcaacaccgagcagaacggcgugaaggacaacaaccaccugagacacccccccagaaacgacaccagacagcccagaaacgagaagccccccagauuccagagagacagccagaacagcaagagcgugcuggagggcagcggccugcccagaaacagaggcagcgagagacccagcaccagcagcgugagcgaggugugggccgaggacagaaucaagugcgacagacccuacagcagauacgacagaaccaaggacaccagcuacccccugggcagccagcacagcgacggcgccuucaagaagagagacaacagcaugcagagcagaagcggcaagggccccagcuucgccgaggccaaggagaacccccugccccagggcagcguggacuacaacaaccagaagagaggcaagagagagagccagaccagcauccccgacuacuucuacgacagaaagagccagaccaucaacaacgaggccuucagcggcaucaagaucgagaagcacuucaacgugaacaccgacuaccagaaccccgugagaagcaacagcuucaucggcgugcccaacggcgagguggagaugccccugaagggcagaagaaucggccccaucaagcccgccggccccgugaccgccgugcccugcgacgacaagaucuucuacaacagcggccccaagagaagaagcggccccaucaagcccgagaagauccuggagagcagcauccccauggaguacgccaagauguggaagcccggcgacgagugcuucgcccuguacugggaggacaacaaguucuacagagccgagguggaggcccugcacagcagcggcaugaccgccguggugaaguucaucgacuacggcaacuacgaggaggugcugcugagcaacaucaagcccauccagaccgaggccugggaggaggagggcaccuacgaccagacccuggaguucagaagaggcggcgacggccagcccagaagaagcaccagacccacccagcaguucuaccagccccccagagccagaaacuaa

SEQ ID NO: 24484 - RNA, 2946 nt, Artificial Sequence
  TDRD5__Homo_sapiens__NP_001186020
augagcgagcaggagagaauccaggagugccugagaaaggagaucagaagccugcugaucagcaccaaggacggccugagcccccaggagcuggagaaggaguaccugcugauggugggcaaccaccugccccugagaauccugggcuacagaagcaccauggagcuggugcuggacaugcccgacguggugagagugugccccggcgccggcggcaccgugauccugaaggccauccccgacgagagcaccaagggcaucgccagccugguggccaagcagagaagcagccacaagcugagaaacagcaugcacaagggcagacccagcaucuacagcggccccagaagccacagaagagugcccuacagaggcagaguggcccccauccugcccgccguggugaagagcgagcugaaggaccugcuggcccugagccccgugcugcugagcgacuucgagaaggccuucgccaagagauucggcagaagcuuccaguacaugcaguacggcuuccugagcauguucgaggugcugaacgccgccagcgacgugaucagcguggagcagaccagagccggcagccugcugaugcugaagaagagcgugaccgaggagaagcccagaggcugccccgccggcaagaucuucacccagcccuucagaaugaagcagggcagcuacagcaccggcuuccccguggccaagcccugcuucagccagcccaccagcaacauggagccccccaagcagaucaugagcauggagaagaccagcaagcugaacgugguggagaccagcagacugaaccacaccgagaagcugaaccagcuggagaacaccuucaagagcgugaucgcccagaucggccccggcggcaccaucagcagcgagcugaagcacaagaucaaguucguggugagcaaguuccccgagggccuguucaucagcaagcugcugggcgaguacgaggugaucuucaaggagcagcugagccccaagaagcugggcuuccugaacgugaccgagcuggugggcgcccugagcgacauccugcacguggaguucagaaagggccaccaggaccugcugguguucgacgccgacaagaagccccugccccccgugcagagcgacaagaagaucgaggccaaggccugcgugagcagcccccccagaaacagccugagcaccgccgccgugaaggagaccguguggaacugccccagcaagaagcagaaggagccccagcagaagaucugcaagaagcccaaccugguggugaagccccugcagcugcagguggagaccaacaagagcgagcugaaccuggccauggccaaccacgacaucccccccgacgccgugcccaacaagaagcugugcagacugcccccccuggacaccagcagccugaucggcguguucguggaguacaucaucagccccagccaguucuacaucagaaucuacagcagagacagcagcgagcugcuggaggacaugaugaucgagaugagaagaugcuacagcaaccagcuggugagcgacagauacgugaugcccgagugcuucauccagcccggccaccugugcugcgugagaaucagcgaggacaaguggugguacagagugaucauccacagagugcuggagaagcaggagguggagguguucuaccccgacuucggcaacaucggcaucgugcagaagagcagccugagauuccugaagugcugcuacaccaagcugcccgcccaggccauccccugcagccuggccugggugagacccguggaggagcacuggaccagcaaggccauccugcaguuccagaagcugugcggccugaagccccuggugggcgugguggacgaguacguggacggcauccugaacaucuuccugugcgacaccagcagcaacgaggacguguacuuccaccacgugcugagaaccgagggccacgccaucgugugcagagagaacaucagcagcaagggcuucagcgagcugaacccccuggcccuguacaccaccagcagcggcggccccgaggacaucgugcugaccgagcugggcuaccccagccagcagcacuacuucaacgaggacagaaagaucagcccccagagcaaggagagcgagcugagaauccuggacgagauccccaccggcaugcccugccuggagagcgugaccaucggcgacgacaucugggacgagaacuggcugccccugcaggccaagaugggcaagggcggcgacgccgccagccaccuguucaccgccagccugggcggcaagaaccaguacagcagcugcaaggagaugccccagaaggacuggugcuucagcacccccaaggacaccugggacgacagcuggcagcccagcggccuggugaacggcaccaagguggaggugcacaagcccgaggugcugggcgcccaggagaagaacaccggcaccaacagaacccagaagcagcuggacaucaacggcagcagcgacagcagcacccugcccaagcuggaggaguucugcaccagccugacccagagcgagcagagcgccgacggcagccagagcgagcccaacaacagccagacccagcccaagcagauccagcugagcaccgccgcccccugcagcaccaccgccguggacgacagcgccgagaagcccagcggcagcguggagagcagccccgagauccugaagaacgaggacuucagcagcagcagagccaucacccuguacaaggacaagagacaggagagcguggaccagcugagccugauccugagcuacgagugccagaucagccagaagcuguacauccccagaagcaccgccaccgccgcccugggcgccgccgccagacuggccaccagcagaagccugcugcacugguaccccagcgugaagagaauggaggccuaa

SEQ ID NO: 24485 - RNA, 6291 nt, Artificial Sequence
  TDRD6__Homo_sapiens__NP_001010870
augugcagcacccccggcaugcccgcccccggcgccagccuggcccugagagugagcuucguggacgugcaccccgacgugauccccgugcagcuguggggccuggugggcgagagaagaggcgaguaccugagacugagcagagagauccaggaggccgccgccaccagaggccagugggcccugggcagcgccagcgccagccccggcgagcugugccuggugcaggugggccugcuguggcacagaugcagaguggugagcagacaggcccaggagagcagaguguuccugcuggacgagggcagaaccaucaccgccggcgccggcagccuggcccccggcagaagagaguucuucaaccugcccagcgaggugcugggcugcgugcuggccggccuggugcccgccggcugcggcgccggcagcggcgagcccccccagcacuggcccgccgacgccguggacuuccugagcaaccugcagggcaaggaggugcacggcugcgugcuggacgugcugcugcugcacagacuggugcugcuggaggugcccgacguguuccagcagaugagagagcugggccuggccagaagagugcccgacagccuguucagaagccugcuggagagauaccugaccgccgccaccgccagcgugggcagcggcgugcccgugcugagcagagugccccugaagcagaagcagcccggccuggacuacuucuacccccagcugcagcugggcgugaccgaggccguggugaucacccaggugugccacccccacagaauccacugccagcugagaagcgugagccaggagauccacagacugagcgagagcauggcccagguguacagaggcagcaccggcaccggcgacgagaacagcaccagcgccaccugggaggagagagaggagagccccgacaagcccggcagccccugcgccagcugcggccuggacggccacugguacagagcccugcugcuggagaccuucagaccccagagaugcgcccaggugcugcacguggacuacggcagaaaggagcuggugagcugcagcagccugagauaccugcugcccgaguacuucagaaugcccguggugaccuaccccugcgcccuguacggccugugggacggcggcagaggcuggagcagaagccaggugggcgaccugaagacccugauccugggcaaggccgugaacgccaagaucgaguucuacugcagcuucgagcacguguacuacgugagccuguacggcgaggacggcaucaaccugaacagaguguucggcgugcagagcugcugccuggccgacagagugcugcagagccaggccaccgaggaggaggagcccgagaccagccagagccagagccccgccgaggagguggacgaggagaucagccugcccgcccugagaagcaucagacugaagaugaacgccuucuacgacgcccagguggaguucgugaagaaccccagcgaguucuggaucagacugagaaagcacaacgugaccuucagcaagcugaugagaagaaugugcggcuucuacagcagcgccagcaagcuggacggcguggugcugaagcccgagcccgacgaccugugcugcgugaaguggaaggagaacggcuacuacagagccaucgugaccaagcuggacgacaagagcguggacguguuccugguggacagaggcaacagcgagaacguggacugguacgacgugagaaugcugcugccccaguucagacagcugcccauccuggccgugaagugcacccuggccgacaucuggccccugggcaagaccuggagccaggaggccgugagcuucuucaagaagaccgugcugcacaaggagcuggugauccacauccuggacaagcaggaccaccaguacgugaucgagauccuggacgagagcagaaccggcgaggagaacaucagcaaggugaucgcccaggccggcuacgccaaguaccaggaguucgagaccaaggagaacauccuggugaacgcccacagccccggccacgugagcaaccacuucaccaccgagagcaacaagauccccuucgccaagaccggcgagggcgagcagaaggccaagagagagaacaagaccaccagcgugagcaaggcccugagcgacaccaccguggugaccaacggcagcaccgagcugguggugcaggagaaggugaagagagccagcguguacuucccccugaugcagaacugccuggagaucaagcccggcagcagcagcaagggcgagcuggaggugggcagcaccguggaggugagagugagcuacguggagaaccccggcuacuucuggugccagcugaccagaaacauccagggccugaagacccugaugagcgacauccaguacuacugcaagaacaccgccgccccccaccagagaaacacccuggccugccuggccaagagaaccgugaacagacaguggagcagagcccugaucagcggcauccagagcguggagcacgugaacgugaccuucguggacuacggcgacagagagauggugagcgugaagaacaucuacagcaucagcgaggaguuccugaaggugaaggcccaggccuucagaugcagccuguacaaccugauccagcccgugggccagaaccccuucgugugggacgugaaggccauccaggccuucaacgaguucaucgacaacgccuggcagaagaaccuggagcugaagugcaccaucuucgcccuggccagcaucaacgaggagcuguucaacaucguggaccugcugacccccuuccagagcgccugccacuuccugguggagaagagacuggccagacccgugaagcugcagaagccccuggagagcagcgugcagcugcacagcuacuucuacagcacccacgacaugaagaucggcagcgaggagcugguguacaucacccacaucgacgaccccuggaccuucuacugccagcuggccagaaacgccaacauccuggagcagcugagcugcagcaucacccagcugagcaaggugcugcugaaccugaagaccagcccccugaaccccggcacccugugccuggccaaguacaccgacggcaacugguacagaggcaucgugaucgagaaggagcccaagaagguguucuucguggacuucggcaacaucuacguggugaccagcgacgaccugcugcccauccccagcgacgccuacgacgugcugcugcugcccaugcaggccgugagaugcagccugagcgacauccccgaccacauccccgaggaggugguggugugguuccaggagaccauccuggacaagagccugaaggcccuggugguggccaaggaccccgacggcacccugaucaucgagcuguacggcgacaacauccagaucagcgccagcaucaacaagaagcugggccugcugagcuacaaggacagaaucagaaagaaggagagcgaggugcugugcagcaccaccgagacccuggaggagaagaacgagaacaugaagcugcccugcaccgaguaccugagcaagagcgugggcuacaagcugcccaacaaggagauccuggaggagagcuacaagccccagaucaacagcagcuacaaggagcugaagcugcugcagagccugaccaagaccaaccuggugacccaguaccaggacagcgugggcaacaagaacagccagguguucccccugaccaccgagaagaaggaggagaucagcgccgagaccccccugaagaccgccagaguggaggccacccugagcgagagaaagaucggcgacagcugcgacaaggaccugccccugaaguucugcgaguucccccagaagaccaucaugcccggcuucaagaccaccguguacgugagccacaucaacgaccugagcgacuucuacgugcagcugaucgaggacgaggccgagaucagccaccugagcgagagacugaacagcgugaagaccagacccgaguacuacgugggccccccccugcagagaggcgacaugaucugcgccguguuccccgaggacaaccugugguacagagccgugaucaaggagcagcagcccaacgaccugcugagcgugcaguucaucgacuacggcaacgugagcguggugcacaccaacaagaucggcagacuggaccuggugaacgccauccugcccggccugugcauccacugcagccugcagggcuucgaggugcccgacaacaagaacagcaagaagaugaugcacuacuucagccagagaaccagcgaggccgccaucagaugcgaguucgugaaguuccaggacagaugggaggugauccuggccgacgagcacggcaucaucgccgacgacaugaucagcagauacgcccugagcgagaagagccagguggagcugagcacccaggugaucaagagcgccagcagcaagagcgugaacaagagcgacaucgacaccagcguguuccugaacugguacaaccccgagaagaagaugaucagagccuacgccaccgugaucgacggccccgaguacuucuggugccaguucgccgacaccgagaagcugcagugccuggagguggaggugcagaccgccggcgagcagguggccgacagaagaaacugcauccccugccccuacaucggcgaccccugcaucgugagauacagagaggacggccacuacuacagagcccugaucaccaacaucugcgaggacuaccuggugagcgugagacugguggacuucggcaacaucgaggacugcguggaccccaaggcccugugggccauccccagcgagcugcugagcgugcccaugcaggccuuccccugcugccugagcggcuucaacaucagcgagggccugugcagccaggagggcaacgacuacuucuacgagaucaucaccgaggacgugcuggagaucaccauccuggagaucagaagagacgugugcgacaucccccuggccaucguggaccugaagagcaagggcaagagcaucaacgagaagauggagaaguacagcaagaccggcaucaagagcgcccugcccuacgagaacaucgacagcgagaucaagcagacccugggcagcuacaaccuggacgugggccugaagaagcugagcaacaaggccgugcagaacaagaucuacauggagcagcagaccgacgagcuggccgagaucaccgagaaggacgugaacaucaucggcaccaagcccagcaacuucagagaccccaagaccgacaacaucugcgagggcuucgagaaccccugcaaggacaagaucgacaccgaggagcuggagggcgagcuggagugccaccugguggacaaggccgaguucgacgacaaguaccugaucaccggcuucaacacccugcugccccacgccaacgagaccaaggagauccuggagcugaacagccuggaggugccccugagccccgacgacgagagcaaggaguuccuggagcuggagagcaucgagcugcagaacagccuggugguggacgaggagaagggcgagcugagccccgugccccccaacgugccccugagccaggagugcgugaccaagggcgccauggagcuguucacccugcagcugccccugagcugcgaggccgagaagcagcccgagcuggagcugcccaccgcccagcugccccuggacgacaagauggacccccugagccugggcgugagccagaaggcccaggagagcaugugcaccgaggacaugagaaagagcagcugcguggagagcuucgacgaccagagaagaaugagccugcaccugcacggcgccgacugcgaccccaagacccagaacgagaugaacaucugcgaggaggaguucguggaguacaagaacagagacgccaucagcgcccugaugccccuguucagcgaggaggagagcagcgacggcagcaagcacaacaacggccugcccgaccacaucagcgcccagcugcagaacaccuacacccugaaggccuucaccgugggcagcaagugcgugguguggagcagccugagaaacaccuggagcaagugcgagauccuggagaccgccgaggagggcaccagagugcugaaccugagcaacggcauggaggagaucgugaaccccgagaacguguggaacggcauccccaagcuggacaagagcccccccgagaagagaggccuggaggugauggagaucuaa

SEQ ID NO: 24486 - RNA, 3075 nt, Artificial Sequence
  TDRD7__Homo_sapiens__NP_001289813
auggccugcaccgagaccgccagaaucgcccagcugguggccagacagagaagcagcaagagaaagaccggcagacaggugaacugccagaugagagugaagaagaccaugcccuucuuccuggagggcaagcccaaggccacccugagacagcccggcuucgccagcaacuucagcgugggcaagaagcccaaccccgccccccugagagacaagggcaacagcgugggcgugaagcccgacgccgagaugagccccuacaugcugcacaccacccugggcaacgaggccuucaaggacauccccgugcagagacacgugaccaugagcaccaacaacagauucagccccaaggccagccugcagcccccccugcagaugcaccugagcagaaccagcaccaaggagaugagcgacaaccugaaccagaccguggagaagcccaacgugaagccccccgccagcuacaccuacaagauggacgaggugcagaacagaaucaaggagauccugaacaagcacaacaacggcaucuggaucagcaagcugccccacuucuacaaggagcuguacaaggaggaccugaaccagggcauccugcagcaguucgagcacuggccccacaucugcaccguggagaagcccugcagcggcggccaggaccugcugcuguaccccgccaagagaaagcagcugcugagaagcgagcuggacaccgagaaggugccccugagcccccugcccggccccaagcagacccccccccugaagggcugccccaccgugauggccggcgacuucaaggagaagguggccgaccugcuggugaaguacaccagcggccugugggccagcgcccugcccaaggccuucgaggagauguacaaggugaaguuccccgaggacgcccugaagaaccuggccagccugagcgacgugugcagcaucgacuacaucagcggcaacccccagaaggccauccuguacgccaagcugccccugcccaccgacaagauccagaaggacgccggccaggcccacggcgacaacgacaucaaggccaugguggagcaggaguaccugcagguggaggagagcaucgccgagagcgccaacaccuucauggaggacaucaccgugcccccccugaugauccccaccgaggccagccccagcgugcuggugguggagcugagcaacaccaacgagguggugaucagauacgugggcaaggacuacagcgccgcccaggagcugauggaggacgagaugaaggaguacuacagcaagaaccccaagaucacccccgugcaggccgugaacgugggccagcugcuggccgugaacgccgaggaggacgccuggcugagagcccaggugaucagcaccgaggagaacaagaucaaggugugcuacguggacuacggcuucagcgagaacguggagaagagcaaggccuacaagcugaaccccaaguucugcagccugagcuuccaggccaccaagugcaagcuggccggccuggaggugcugagcgacgaccccgaccuggugaaggugguggagagccugaccugcggcaagaucuucgccguggagauccuggacaaggccgacaucccccugguggugcuguacgacaccagcggcgaggacgacaucaacaucaacgccaccugccugaaggccaucugcgacaagagccuggaggugcaccugcagguggacgccauguacaccaacgugaaggugaccaacaucugcagcgacggcacccuguacugccaggugcccugcaagggccugaacaagcugagcgaccugcugagaaagaucgaggacuacuuccacugcaagcacaugaccagcgagugcuucgugagccugcccuucugcggcaagaucugccuguuccacugcaagggcaaguggcugagaguggagaucaccaacgugcacagcagcagagcccuggacgugcaguuccuggacagcggcaccgugaccagcgugaaggugagcgagcugagagagaucccccccagauuccugcaggagaugaucgccauccccccccaggccaucaagugcugccuggccgaccugccccagagcaucggcauguggacccccgacgccgugcuguggcugagagacagcgugcugaacugcagcgacugcagcaucaaggugaccaagguggacgagaccagaggcaucgcccacguguaccuguucacccccaagaacuuccccgacccccacagaagcaucaacagacagaucaccaacgccgaccuguggaagcaccagaaggacguguuccugagcgccaucagcagcggcgccgacagccccaacagcaagaacggcaacaugcccaugagcggcaacaccggcgagaacuucagaaagaaccugaccgacgugaucaagaagagcaugguggaccacaccagcgccuucagcaccgaggagcugcccccccccgugcaccugagcaagcccggcgagcacauggacguguacgugcccguggccugccaccccggcuacuucgugauccagcccuggcaggagauccacaagcuggaggugcugauggaggagaugauccuguacuacagcgugagcgaggagagacacaucgccguggagaaggaccagguguacgccgccaagguggagaacaaguggcacagagugcugcugaagggcauccugaccaacggccuggugagcguguacgagcuggacuacggcaagcacgagcuggugaacaucagaaaggugcagccccugguggacauguucagaaagcugcccuuccaggccgugaccgcccagcuggccggcgugaagugcaaccaguggagcgaggaggccagcaugguguucagaaaccacguggagaagaagccccugguggcccuggugcagaccgugaucgagaacgccaaccccugggacagaaagguggugguguaccugguggacaccagccugcccgacaccgacaccuggauccacgacuucaugagcgaguaccugaucgagcugagcaaggugaacuaa

SEQ ID NO: 24487 - RNA, 4149 nt, Artificial Sequence
  TDRD9__Homo_sapiens__NP_694591
augcugagaaagcugaccaucgagcagaucaacgacugguucaccaucggcaagaccgugaccaacguggagcugcugggcgccccccccgccuuccccgccggcgccgccagagaggaggugcagagacaggacguggcccccggcgccggccccgccgcccaggcccccgcccuggcccaggcccccgccagacccgccgccgccuucgagagaagccugagccagagaagcagcgagguggaguacaucaacaaguacagacagcuggaggcccaggagcuggacgugugcagaagcgugcagcccaccagcggccccggccccagacccagccuggccaagcugagcagcgugaccugcauccccggcaccaccuacaaguaccccgaccugcccaucagcagauacaaggaggagguggugagccugaucgagagcaacagcguggugaucauccacggcgccaccggcagcggcaagagcacccagcugccccaguacauccuggaccacuacgugcagagaagcgccuacugcagcaucguggugacccagcccagaaagaucggcgccagcagcaucgccagauggaucagcaaggagagagccuggacccugggcggcguggugggcuaccaggugggccuggagaagaucgccaccgaggacaccagacugaucuacaugaccaccggcgugcugcugcagaagaucgugagcgccaagagccugauggaguucacccacaucaucaucgacgaggugcacgagagaaccgaggagauggacuuccugcugcugguggugagaaagcugcugagaaccaacagcagauucgugaagguggugcugaugagcgccaccaucagcugcaaggaguucgccgacuacuucgccgugcccgugcagaacaagaugaaccccgccuacaucuucgagguggagggcaagccccacagcguggaggaguacuaccugaacgaccuggagcacauccaccacagcaagcugagcccccaccugcuggaggagcccgugaucaccaaggacaucuacgagguggccgugagccugauccagauguucgacgaccuggacaugaaggagagcggcaacaaggccuggagcggcgcccaguucgugcuggagagaagcagcgugcugguguuccugcccggccugggcgagaucaacuacaugcacgagcugcugaccagccuggugcacaagagacugcagguguacccccugcacagcagcguggcccuggaggagcagaacaacguguuccugagccccgugcccggcuacagaaagaucauccugagcaccaacaucgccgagagcagcgugaccgugcccgacgugaaguacgugaucgacuucugccugaccagaacccuggugugcgacgaggacaccaacuaccagagccugagacugagcugggccagcaagaccagcugcaaccagagaaagggcagagccggcagagugagcagaggcuacugcuacagacuggugcacaaggacuucugggacaacagcauccccgaccacguggugcccgagaugcugagaugcccccugggcagcaccauccugaaggugaagcugcuggacaugggcgagcccagagcccugcuggccaccgcccugagcccccccggccugagcgacaucgagagaaccauccugcugcugaaggaggugggcgcccuggccgugagcggccagagagaggacgagaacccccacgacggcgagcugaccuuccugggcagagugcuggcccagcugcccgugaaccagcagcugggcaagcugaucgugcugggccacguguucggcugccuggacgagugccugaucaucgccgccgcccugagccugaagaacuucuucgccaugcccuucagacagcaccuggacggcuacagaaacaaggugaacuucagcggcagcagcaagagcgacugcaucgcccugguggaggccuucaagaccuggaaggccugcagacagaccggcgagcugagauaccccaaggacgagcugaacuggggcagacugaacuacauccagaucaagagaaucagagagguggccgagcuguacgaggagcugaagaccagaaucagccaguucaacaugcacguggacagcagaagacccgugauggaccaggaguacaucuacaagcagagauucauccugcagguggugcuggccggcgccuucuaccccaacuacuucaccuucggccagcccgacgaggagauggccgugagagagcuggccggcaaggaccccaagaccaccguggugcugaagcacaucccccccuacggcuuccuguacuacaagcagcugcagagccuguucagacagugcggccaggugaagagcaucguguucgacggcgccaaggccuucguggaguucagcagaaaccccaccgagagauucaagacccugcccgccguguacauggccaucaagaugagccagcugaaggugagccuggagcugagcgugcacagcgccgaggagaucgagggcaaggugcagggcaugaacgugagcaagcugagaaacaccagagugaacguggacuuccagaagcagaccguggaccccaugcaggugagcuucaacaccagcgacagaagccagaccgugaccgaccugcugcugaccaucgacgugaccgaggugguggaggugggccacuucuggggcuacagaaucgacgagaacaacagcgagauccugaagaagcugaccgccgagaucaaccagcugacccuggugccccugcccacccacccccaccccgaccuggugugccuggcccccuucgccgacuucgacaagcagagauacuucagagcccaggugcuguacgugagcggcaacagcgccgagguguucuucguggacuacggcaacaagagccacguggaccugcaccugcugauggagauccccugccaguuccuggagcugcccuuccaggcccuggaguucaagaucugcaagaugagacccagcgccaagagccuggugugcggcaagcacuggagcgacggcgccagccagugguucgccagccuggugagcggcugcacccugcuggugaagguguucagcguggugcacagcgugcugcacguggacguguaccaguacagcggcgugcaggacgccaucaacaucagagacgugcugauccagcagggcuacgccgagcugaccgaggagagcuacgagagcaagcagagccacgaggugcugaagggccuguucagcaagagcguggagaacaugaccgacggcagcgugcccuuccccaugaaggacgacgagaaguaccugaucagaauccugcuggagagcuucagcaccaacaagcugggcacccccaacugcaaggccgagcugcacggccccuucaaccccuacgagcugaagugccacagccugaccagaaucagcaaguucagaugcguguggaucgagaaggagagcaucaacagcgugaucaucagcgacgcccccgaggaccugcaccagagaaugcugguggccgccagccugagcaucaacgccaccggcagcaccaugcugcugagagagaccagccugaugccccacauccccggccugcccgcccugcugagcaugcuguucgcccccgugaucgagcugagaaucgaccagaacggcaaguacuacaccggcgugcugugcggccugggcuggaaccccgccaccggcgccagcauccugcccgagcacgacauggagcuggccuucgacgugcaguucagcguggaggacgugguggaggugaacauccugagagccgccaucaacaagcuggugugcgacggccccaacggcugcaagugccugggccccgagagaguggcccagcugcaggacaucgccagacagaagcugcugggccuguucugccagagcaagcccagagagaagaucgugcccaaguggcacgagaagcccuacgaguggaaccagguggaccccaagcuggugauggagcaggccgacagagagagcagcagaggcaagaacaccuuccuguaccagcugcacaagcugguggugcugggcaccuaa

SEQ ID NO: 24488 - RNA, 1551 nt, Artificial Sequence
  TDRKH__Homo_sapiens__NP_001077433
augagcaccgagagaaccagcuggaccagccugagcaccauccagaagaucgcccugggccugggcauccccgccagcgccaccguggccuacauccuguacagaagauacagagagagcagagaggagagacugaccuucgugggcgaggacgacaucgagaucgagaugagagugccccaggaggccgugaagcugaucaucggcagacagggcgccaacaucaagcagcugagaaagcagaccggcgccagaaucgacguggacaccgaggacgugggcgacgagagagugcugcugaucagcggcuuccccgugcaggccagcggcgccaagaucaccugcgacaaggagagcgagggcacccugcugcugagcagacugaucaagaucagcggcacccagaaggagguggccgccgccaagcaccugauccuggagaaggugagcgaggacgaggagcugagaaagagaaucgcccacagcgccgagaccagagugcccagaaagcagcccaucagcgugagaagagaggacaugaccgagcccggcggcgccggcgagcccgcccuguggaagaacaccagcagcagcauggagcccaccgccccccuggugacccccccccccaagggcggcggcgacauggccgugguggugagcaaggagggcagcugggagaagcccagcgacgacagcuuccagaagagcgaggcccaggccauccccgagaugcccauguucgagauccccagccccgacuucagcuuccacgccgacgaguaccuggagguguacgugagcgccagcgagcaccccaaccacuucuggauccagaucgugggcagcagaagccugcagcuggacaagcuggugaacgagaugacccagcacuacgagaacagcgugcccgaggaccugaccgugcacgugggcgacaucguggccgccccccugcccaccaacggcagcugguacagagccagagugcugggcacccuggagaacggcaaccuggaccuguacuucguggacuucggcgacaacggcgacugcccccugaaggaccugagagcccugagaagcgacuuccugagccugcccuuccaggccaucgagugcagccuggccagaaucgcccccagcggcgaccagugggaggaggaggcccuggacgaguucgacagacugacccacugcgccgacuggaagccccugguggccaagaucagcagcuacgugcagaccggcaucagcaccuggcccaagaucuaccuguacgacaccagcaacggcaagaagcuggacaucggccuggagcuggugcacaagggcuacgccaucgagcugcccgaggacaucgaggagaacagagccgugcccgacaugcugaaggacauggccaccgagaccgacgccagccugagcacccugcugaccgagaccaagaagagcagcggcgagaucacccacacccugagcugccugagccugagcgaggccgccagcaugagcggcgacgacaaccuggaggacgacuaccugcuguaa

SEQ ID NO: 24489 - RNA, 597 nt, Artificial Sequence
  TDRP__Homo_sapiens__NP_001243042
auguggaagcugggcagaggcagagugcugcuggacgagccccccgaggaggaggacggccugagaggcggccccccccccgccgccgccgccgccgcccaggcccaggugcagggcgccagcuucagaggcuggaaggaggugaccagccuguucaacaaggacgacgagcagcaccugcuggagagaugcaagagccccaagagcaagggcaccaaccugagacugaaggaggagcugaaggccgagaagaagagcggcuucugggacaaccuggugcugaagcagaacauccagagcaagaagcccgacgagaucgagggcugggagccccccaagcuggcccuggaggacaucagcgccgaccccgaggacaccgugggcggccaccccagcuggagcggcugggaggacgacgccaagggcagcaccaaguacaccagccuggccagcagcgccaacagcagcagauggagccugagagccgccggcagacugaucaaggagguguggaucaacuucagccagcugaucaucagcuucagaaagcacugccuggcccacuacagagagcugagacugugcaucaaguacuaa

SEQ ID NO: 24490 - RNA, 1281 nt, Artificial Sequence
  TEAD1__Homo_sapiens__NP_068780
auggagcccagcagcuggagcggcagcgagagccccgccgagaacauggagagaaugagcgacagcgccgacaagcccaucgacaacgacgccgagggcguguggagccccgacaucgagcagagcuuccaggaggcccuggccaucuacccccccugcggcagaagaaagaucauccugagcgacgagggcaagauguacggcagaaacgagcugaucgccagauacaucaagcugagaaccggcaagaccagaaccagaaagcaggugagcagccacauccaggugcuggccagaagaaagagcagagacuuccacagcaagcugaaggaccagaccgccaaggacaaggcccugcagcacauggccgccaugagcagcgcccagaucgugagcgccaccgccauccacaacaagcugggccugcccggcauccccagacccaccuuccccggcgcccccggcuucuggcccggcaugauccagaccggccagcccggcagcagccaggacgugaagcccuucgugcagcaggccuaccccauccagcccgccgugaccgcccccauccccggcuucgagcccgccagcgcccccgcccccagcgugcccgccuggcagggcagaagcaucggcaccaccaagcugagacugguggaguucagcgccuuccuggagcagcagagagaccccgacagcuacaacaagcaccuguucgugcacaucggccacgccaaccacagcuacagcgacccccugcuggagagcguggacaucagacagaucuacgacaaguuccccgagaagaagggcggccugaaggagcuguucggcaagggcccccagaacgccuucuuccuggugaaguucugggccgaccugaacugcaacauccaggacgacgccggcgccuucuacggcgugaccagccaguacgagagcagcgagaacaugaccgugaccugcagcaccaaggugugcagcuucggcaagcaggugguggagaagguggagaccgaguacgccagauucgagaacggcagauucguguacagaaucaacagaagccccaugugcgaguacaugaucaacuucauccacaagcugaagcaccugcccgagaaguacaugaugaacagcgugcuggagaacuucaccauccugcugguggugaccaacagagacacccaggagacccugcugugcauggccugcguguucgaggugagcaacagcgagcacggcgcccagcaccacaucuacagacuggugaaggacuaa

SEQ ID NO: 24491 - RNA, 1353 nt, Artificial Sequence
  TEAD2__Homo_sapiens__NP_001243587
augggcgagcccagagccggcgccgcccuggacgacggcagcggcuggaccggcagcgaggagggcagcgaggagggcaccggcggcagcgagggcgccggcggcgacggcggccccgacgccgagggcguguggagccccgacaucgagcagagcuuccaggaggcccuggccaucuacccccccugcggcagaagaaagaucauccugagcgacgagggcaagauguacggcagaaacgagcugaucgccagauacaucaagcugagaaccggcaagaccagaaccagaaagcaggugagcagccacauccaggugcuggccagaagaaagagcagagagauccagagcaagcugaaggaccaggugagcaaggacaaggccuuccagaccauggccaccaugagcagcgcccagcugaucagcgcccccagccugcaggccaagcugggccccaccggcccccagguggugcaggccagcgagcuguuccaguucuggagcggcggcagcggcccccccuggaacgugcccgacgugaagcccuucagccagacccccuucacccugagccugaccccccccagcaccgaccugcccggcuacgagcccccccaggcccugagcccccugcccccccccacccccagcccccccgccuggcaggccagaggccugggcaccgccagacugcagcugguggaguucagcgccuucguggagccccccgacgccguggacagcuaccagagacaccuguucgugcacaucagccagcacugccccagccccggcgcccccccccuggagagcguggacgugagacagaucuacgacaaguuccccgagaagaagggcggccugagagagcuguacgacagaggccccccccacgccuucuuccuggugaaguucugggccgaccugaacuggggccccagcggcgaggaggccggcgccggcggcagcaucagcagcggcggcuucuacggcgugagcagccaguacgagagccuggagcacaugacccugaccugcagcagcaaggugugcagcuucggcaagcaggugguggagaagguggagaccgagagagcccagcuggaggacggcagauucguguacagacugcugagaagccccaugugcgaguaccuggugaacuuccugcacaagcugagacagcugcccgagagauacaugaugaacagcgugcuggagaacuucaccauccugcagguggugaccaacagagacacccaggagcugcugcugugcaccgccuacguguucgaggugagcaccagcgagagaggcgcccagcaccacaucuacagacuggugagagacuaa

SEQ ID NO: 24492 - RNA, 1308 nt, Artificial Sequence
  TEAD3__Homo_sapiens__NP_003205
auggccagcaacagcuggaacgccagcagcagccccggcgaggccagagaggacggccccgagggccuggacaagggccuggacaacgacgccgagggcguguggagccccgacaucgagcagagcuuccaggaggcccuggccaucuacccccccugcggcagaagaaagaucauccugagcgacgagggcaagauguacggcagaaacgagcugaucgccagauacaucaagcugagaaccggcaagaccagaaccagaaagcaggugagcagccacauccaggugcuggccagaaagaaggugagagaguaccaggugggcaucaaggccaugaaccuggaccaggugagcaaggacaaggcccugcagagcauggccagcaugagcagcgcccagaucgugagcgccagcgugcugcagaacaaguucagcccccccagcccccugccccaggccguguucagcaccagcagcagauucuggagcagccccccccugcugggccagcagcccggccccagccaggacaucaagcccuucgcccagcccgccuaccccauccagcccccccugccccccacccugagcagcuacgagccccuggccccccugcccagcgccgccgccagcgugcccguguggcaggacagaaccaucgccagcagcagacugagacugcuggaguacagcgccuucauggaggugcagagagaccccgacaccuacagcaagcaccuguucgugcacaucggccagaccaaccccgccuucagcgaccccccccuggaggccguggacgugagacagaucuacgacaaguuccccgagaagaagggcggccugaaggagcuguacgagaagggcccccccaacgccuucuuccuggugaaguucugggccgaccugaacagcaccauccaggagggccccggcgccuucuacggcgugagcagccaguacagcagcgccgacagcaugaccaucagcgugagcaccaaggugugcagcuucggcaagcaggugguggagaagguggagaccgaguacgccagacuggagaacggcagauucguguacagaauccacagaagccccaugugcgaguacaugaucaacuucauccacaagcugaagcaccugcccgagaaguacaugaugaacagcgugcuggagaacuucaccauccugcagguggugaccagcagagacagccaggagacccugcuggugaucgccuucguguucgaggugagcaccagcgagcacggcgcccagcaccacguguacaagcuggugaaggacuaa

SEQ ID NO: 24493 - RNA, 1305 nt, Artificial Sequence
  TEAD4__Homo_sapiens__NP_003204
auggagggcaccgccggcaccaucaccagcaacgaguggagcagccccaccagccccgagggcagcaccgccagcggcggcagccaggcccuggacaagcccaucgacaacgacgccgagggcguguggagccccgacaucgagcagagcuuccaggaggcccuggccaucuacccccccugcggcagaagaaagaucauccugagcgacgagggcaagauguacggcagaaacgagcugaucgccagauacaucaagcugagaaccggcaagaccagaaccagaaagcaggugagcagccacauccaggugcuggccagaagaaaggccagagagauccaggccaagcugaaggaccaggccgccaaggacaaggcccugcagagcauggccgccaugagcagcgcccagaucaucagcgccaccgccuuccacagcagcauggcccuggccagaggccccggcagacccgccgugagcggcuucuggcagggcgcccugcccggccaggccggcaccagccacgacgugaagcccuucagccagcagaccuacgccgugcagcccccccugccccugcccggcuucgagagccccgccggccccgcccccagccccagcgccccccccgccccccccuggcagggcagaagcguggccagcagcaagcuguggaugcuggaguucagcgccuuccuggagcagcagcaggaccccgacaccuacaacaagcaccuguucgugcacaucggccagagcagccccagcuacagcgaccccuaccuggaggccguggacaucagacagaucuacgacaaguuccccgagaagaagggcggccugaaggaccuguucgagagaggccccagcaacgccuucuuccuggugaaguucugggccgaccugaacaccaacaucgaggacgagggcagcagcuucuacggcgugagcagccaguacgagagccccgagaacaugaucaucaccugcagcaccaaggugugcagcuucggcaagcaggugguggagaagguggagaccgaguacgccagauacgagaacggccacuacagcuacagaauccacagaagcccccugugcgaguacaugaucaacuucauccacaagcugaagcaccugcccgagaaguacaugaugaacagcgugcuggagaacuucaccauccugcagguggugaccaacagagacacccaggagacccugcugugcaucgccuacguguucgaggugagcgccagcgagcacggcgcccagcaccacaucuacagacuggugaaggaguaa

SEQ ID NO: 24494 - RNA, 1896 nt, Artificial Sequence
  TEC__Homo_sapiens__XP_011512038
augaacuucaacaccauccuggaggagauccugaucaagagaagccagcagaagaagaagaccagcccccugaacuacaaggagagacuguucgugcugaccaagagcaugcugaccuacuacgagggcagagccgagaagaaguacagaaagggcuucaucgacgugagcaagaucaagugcguggagaucgugaagaacgacgacggcgugauccccugccagaacaaguaccccuuccagguggugcacgacgccaacacccuguacaucuucgcccccagcccccagagcagagaccugugggugaagaagcugaaggaggagaucaagaacaacaacaacaucaugaucaaguaccaccccaaguucuggaccgacggcagcuaccagugcugcagacagaccgagaagcuggcccccggcugcgagaaguacaaccuguucgagagcagcaucagaaaggcccugccccccgcccccgagaccaagaagagaagaccccccccccccaucccccuggaggaggaggacaacagcgaggagaucgugguggccauguacgacuuccaggccgccgagggccacgaccugagacuggagagaggccaggaguaccugauccuggagaagaacgacgugcacugguggagagccagagacaaguacggcaacgagggcuacauccccagcaacuacgugaccggcaagaagagcaacaaccuggaccaguacgagugguacugcagaaacaugaacagaagcaaggccgagcagcugcugagaagcgaggacaaggagggcggcuucauggugagagacagcagccagcccggccuguacaccgugagccuguacaccaaguucggcggcgagggcagcagcggcuucagacacuaccacaucaaggagaccaccaccagccccaagaaguacuaccuggccgagaagcacgccuucggcagcauccccgagaucaucgaguaccacaagcacaacgccgccggccuggugaccagacugagauaccccgugagcgugaagggcaagaacgcccccaccaccgccggcuucagcuacgagaagugggagaucaaccccagcgagcugaccuucaugagagagcugggcagcggccuguucggcguggugagacugggcaaguggagagcccaguacaagguggccaucaaggccaucagagagggcgccaugugcgaggaggacuucaucgaggaggccaaggugaugaugaagcugacccaccccaagcuggugcagcuguacggcgugugcacccagcagaagcccaucuacaucgugaccgaguucauggagagaggcugccugcugaacuuccugagacagagacagggccacuucagcagagacgugcugcugagcaugugccaggacgugugcgagggcauggaguaccuggagagaaacagcuucauccacagagaccuggccgccagaaacugccuggugagcgaggccggcguggugaaggugagcgacuucggcauggccagauacgugcuggacgaccaguacaccagcagcagcggcgccaaguuccccgugaaguggugcccccccgagguguucaacuacagcagauucagcagcaagagcgacguguggagcuucggcgugcugaugugggagguguucaccgagggcagaaugcccuucgagaaguacaccaacuacgagguggugaccauggugaccagaggccacagacuguaccagcccaagcuggccagcaacuacguguacgaggugaugcugagaugcuggcaggagaagcccgagggcagacccagcuucgaggaccugcugagaaccaucgacgagcugguggagugcgaggagaccuucggcagauaa

SEQ ID NO: 24495 - RNA, 3804 nt, Artificial Sequence
  TECPR2__Homo_sapiens__NP_001166102
auggccagcaucagcgagcccgugaccuucagagaguucugcccccuguacuaccugcugaacgccauccccaccaagauccagaagggcuucagaagcaucgugguguaccugaccgcccuggacaccaacggcgacuacaucgccgugggcagcagcaucggcaugcuguaccuguacugcagacaccugaaccagaugagaaaguacaacuucgagggcaagaccgagagcaucaccguggugaagcugcugagcugcuucgacgaccugguggccgccggcaccgccagcggcagaguggccguguuccagcuggugagcagccugcccggcagaaacaagcagcugagaagauucgacgugaccggcauccacaagaacagcaucaccgcccuggccuggagccccaacggcaugaagcuguucagcggcgacgacaagggcaagaucguguacagcagccuggaccuggaccagggccugugcaacagccagcuggugcuggaggagcccagcagcaucgugcagcuggacuacagccagaaggugcugcuggugagcacccugcagagaagccugcuguucuacaccgaggagaagagcgugagacagaucggcacccagcccagaaagagcaccggcaaguucggcgccugcuucauccccggccugugcaagcagagcgaccugacccuguacgccagcagacccggccugagacuguggaaggccgacgugcacggcaccgugcaggccaccuucauccugaaggacgccuucgccggcggcgugaagcccuucgagcugcaccccagacuggagagccccaacagcggcagcugcagccugcccgagagacaccugggccuggugagcugcuucuuccaggagggcugggugcugagcuggaacgaguacagcaucuaccugcuggacaccgugaaccaggccaccguggccggccuggagggcagcggcgacaucgugagcgugagcugcaccgagaacgagaucuucuuccugaagggcgacagaaacaucaucagaaucagcagcagacccgagggccugaccagcaccgugagagacggccuggagaugagcggcugcagcgagagagugcacgugcagcaggccgagaagcugcccggcgccaccgugagcgagaccagacugagaggcagcagcauggccagcagcguggccagcgagcccagaagcagaagcagcagccugaacagcaccgacagcggcagcggccugcugccccccggccugcaggccacccccgagcugggcaagggcagccagccccugagccagagauucaacgccaucagcagcgaggacuucgaccaggagcugguggugaagcccaucaaggugaagagaaagaagaagaagaagaagaccgagggcggcagcagaagcaccugccacagcagccuggagagcacccccugcagcgaguuccccggcgacagcccccagagccugaacaccgaccugcugagcaugaccagcagcgugcugggcagcagcguggaccagcugagcgccgagagccccgaccaggagagcagcuucaacggcgaggugaacggcgugccccaggagaacaccgaccccgagaccuucaacgugcuggaggugagcggcagcaugcccgacagccuggccgaggaggacgacaucagaaccgagaugccccacugccaccacgcccacggcagagagcugcugaacggcgccagagaggacgugggcggcagcgacgugaccggccugggcgacgagcccugccccgccgacgacggccccaacagcacccagcugcccuuccaggagcaggacagcagccccggcgcccacgacggcgaggacauccagcccaucggcccccagagcaccuucugcgaggugccccugcugaacagccugaccgugcccagcagccugagcugggcccccagcgccgagcaguggcugcccggcaccagagccgacgagggcagccccguggagcccagccaggagcaggacauccugaccagcauggaggccagcggccaccugagcaccaaccuguggcacgccgugaccgacgacgacaccggccagaaggagauccccaucagcgagagagugcugggcagcgugggcggccagcugacccccgugagcgcccuggccgccagcacccacaagcccuggcuggagcagccccccagagaccagacccugaccagcagcgacgaggaggacaucuacgcccacggccugcccagcagcagcagcgagaccagcgugaccgagcugggccccagcugcagccagcaggaccugagcagacugggcgccgaggacgccggccugcugaagcccgaccaguucgccgagagcuggaugggcuacagcggccccggcuacggcauccugagccugguggugagcgagaaguacaucuggugccuggacuacaagggcggccuguucugcagcgcccugcccggcgccggccugagauggcagaaguucgaggacgccgugcagcagguggccgugagccccagcggcgcccugcuguggaagaucgagcagaagagcaacagagccuucgccugcggcaaggugaccaucaagggcaagagacacugguacgaggcccugccccaggccguguucguggcccugagcgacgacaccgccuggaucaucagaaccagcggcgaccuguaccugcagaccggccugagcguggacagacccugcgccagagccgugaagguggacugccccuacccccugagccagaucaccgccagaaacaacguggugugggcccugaccgagcagagagcccugcuguacagagagggcgugagcagcuucugccccgagggcgagcaguggaagugcgacaucgugagcgagagacaggcccuggagcccgugugcaucacccugggcgaccagcagacccugugggcccuggacauccacggcaaccugugguucagaaccggcaucaucagcaagaagccccagggcgacgacgaccacugguggcaggugagcaucaccgacuacgugguguucgaccagugcagccuguuccagaccaucauccacgccacccacagcguggccaccgccgcccaggcccccguggagaagguggccgacaagcugagaauggccuucuggagccagcagcugcagugccagcccagccugcugggcgugaacaacagcggcguguggaucagcagcggcaagaacgaguuccacguggccaagggcagccugaucggcaccuacuggaaccacguggugcccagaggcaccgccagcgccaccaagugggccuucgugcuggccagcgccgcccccaccaaggagggcagcuuccuguggcugugccagagcagcaaggaccugugcagcgugagcgcccagagcgcccagagcagacccagcaccgugcagcugccccccgaggccgagaugagagccuacgccgccugccaggacgcccugugggcccuggacagccugggccagguguucaucagaacccugagcaagagcugccccaccggcaugcacuggaccagacuggaccugagccagcugggcgccgugaagcugaccagccuggccugcggcaaccagcacaucugggccugcgacagcagaggcggcguguacuucagagugggcacccagccccugaaccccagccugaugcugcccgccuggaucaugaucgagccccccgugcaggugagcagaagcuaa

SEQ ID NO: 24496 - RNA, 927 nt, Artificial Sequence
  TECR__Homo_sapiens__NP_612510
augaagcacuacgagguggagauccuggacgccaagaccagagagaagcugugcuuccuggacaagguggagccccacgccaccaucgccgagaucaagaaccuguucaccaagacccacccccagugguaccccgccagacagagccugagacuggaccccaagggcaagagccugaaggacgaggacgugcugcagaagcugcccgugggcaccaccgccacccuguacuucagagaccugggcgcccagaucagcugggugaccguguuccugaccgaguacgccggcccccuguucaucuaccugcuguucuacuucagagugcccuucaucuacggccacaaguacgacuucaccagcagcagacacaccguggugcaccuggccugcaucugccacagcuuccacuacaucaagagacugcuggagacccuguucgugcacagauucagccacggcaccaugccccugagaaacaucuucaagaacugcaccuacuacuggggcuucgccgccuggauggccuacuacaucaaccacccccuguacaccccccccaccuacggcgcccagcaggugaagcuggcccuggccaucuucgugaucugccagcugggcaacuucagcauccacauggcccugagagaccugagacccgccggcagcaagaccagaaagauccccuaccccaccaagaaccccuucaccuggcuguuccugcuggugagcugccccaacuacaccuacgaggugggcagcuggaucggcuucgccaucaugacccagugccugcccguggcccuguucagccuggugggcuucacccagaugaccaucugggccaagggcaagcacagaagcuaccugaaggaguucagagacuaccccccccugagaaugcccaucauccccuuccugcuguaa

SEQ ID NO: 24497 - RNA, 1092 nt, Artificial Sequence
  TECRL__Homo_sapiens__NP_001010874
auguucaagagacacaagagccuggccagcgagagaaagagagcccugcugagccagagagccaccagauucauccugaaggacgacaugagaaacuuccacuuccugagcaagcuggugcugagcgccggcccccugagacccacccccgccgugaagcacagcaagaccacccacuucgagaucgagaucuucgacgcccagaccagaaagcagaucugcauccuggacaaggugacccagagcagcaccauccacgacgugaagcagaaguuccacaaggccugccccaagugguaccccagcagagugggccugcagcuggagugcggcggccccuuccugaaggacuacaucaccauccagagcaucgccgccagcagcaucgugacccuguacgccaccgaccugggccagcaggugagcuggaccaccguguuccuggccgaguacaccggcccccugcugaucuaccugcuguucuaccugagaauccccugcaucuacgacggcaaggagagcgccagaagacugagacaccccguggugcaccuggccugcuucugccacugcauccacuacaucagauaccugcuggagacccuguucgugcacaaggugagcgccggccacaccccccugaagaaccugaucaugagcugcgccuucuacuggggcuucaccagcuggaucgccuacuacaucaaccacccccuguacaccccccccagcuucggcaacagacagaucaccgugagcgccaucaacuuccugaucugcgaggccggcaaccacuucaucaacgugaugcugagccaccccaaccacaccggcaacaacgccugcuuccccagccccaacuacaaccccuucaccuggauguucuuccuggugagcugccccaacuacaccuacgagaucggcagcuggaucagcuucaccgugaugacccagacccugcccgugggcaucuucacccugcugaugagcauccagaugagccugugggcccagaagaagcacaagaucuaccugagaaaguucaacagcuacauccacagaaagagcgccaugauccccuucauccuguaa

SEQ ID NO: 24498 - RNA, 6468 nt, Artificial Sequence
  TECTA__Homo_sapiens__NP_005413
augaacuacagcagcuuccugagaaucugggugagcuucaucuucgcccuggugcagcaccaggcccagcccagagagcugauguaccccuucuggcagaacgacaccaagacccccaagguggacgacggcagcagcagcgagaucaagcuggccauccccguguucuucuucggcgugcccuacagaaccguguacgugaacaacaacggcguggugagcuucaacgugcuggugagccaguucacccccgagagcuucccccugaccgacggcagagccuucguggcccccuucugggccgacgugcacaacggcaucagaggcgagaucuacuacagagagaccauggagcccgccauccugaagagagccaccaaggacaucagaaaguacuucaaggacauggccaccuucagcgccaccuggguguucaucgugaccugggaggaggugaccuucuacggcggcagcagcaccacccccgugaacaccuuccaggccgugcuggugagcgacggcagcuacaccuucacccuguucaacuacuacgagaucaacuggaccaccggcaccgccagcggcggcgacccccugaccggccugggcggcgugauggcccaggccggcuucaacggcggcaaccugaccaacuucuucagccugcccggcagcagaacccccgagaucgugaacauccaggagaccaccaacgugaacgugcccggcagaugggccuucaagguggacggcaaggagaucgaccccgccaacggcugcaccagcagaggccaguuccugagaagaggcgagguguucugggacgaccugaacugcaccgugaagugcagaugccuggacuucaacaacgagaucuacugccaggaggccagcugcagccccuacgaggugugcgagcccaagggcaaguucuucuacugcagcgccguggagaccagcaccugcgugguguucggcgagccccacuaccacaccuucgacggcuuccuguuccacuuccagggcagcugcgccuaccugcuggccagacagugccugcagaccagcagccugcccuucuucagcguggaggccaagaacgagcacagaagaggcagcgccgugagcugggugaaggagcugagcguggaggugaacggcuacaagauccugauccccaagggcagcuacggcagagugaaggugaacgaccuggugaccagccugcccgugacccuggaccugggcaccgugaagaucuaccagagcggcaucagcaccgccguggagaccgacuucggccugcuggugaccuucgacggccagcacuacgccagcaucagcgugcccggcagcuacaucaacagcaccugcggccugugcggcaacuacaacaagaacccccuggacgacuuccugagacccgacggcagacccgccaugagcgugcuggaccugggcgagagcuggagaguguaccacgccgacuggaagugcgacagcggcugcguggacaacugcacccagugcgacgccgccaccgaggcccuguacuucggcagcgacuacugcggcuuccugaacaagaccgacggcccccugugggagugcggcaccgugguggaccccaccgccuucgugcacagcugcguguacgaccugugcagcgugagagacaacggcacccugcugugccaggccauccaggccuacgcccuggugugccaggcccugggcauccccaucggcgacuggagaacccagaccggcugcgugagcaccgugcagugccccagcuucagccacuacagcgugugcaccagcagcugccccgacaccugcagcgaccugaccgccagcagaaacugcgccacccccugcaccgagggcugcgagugcaaccagggcuucgugcugagcaccagccagugcgugccccugcacaagugcggcugcgacuucgacggccacuacuacaccaugggcgaguucuucugggccaccgccaacugcaccgugcagugccugugcgaggagggcggcgacguguacugcuucaacaagaccugcggcagcggcgaggugugcgccguggaggacggcuaccagggcugcuuccccaagagagagaccgugugccugcugagccagaaccaggugcugcacaccuucgacggcgccagcuacgccuuccccagcgaguucagcuacacccugcugaagaccugccccgagagacccgaguaccuggagaucgacaucaacaagaagaagcccgacgccggccccgccuggcugagaggccugagaauccugguggccgaccaggaggugaagaucggcggcaucggcgccagcgaggugaagcugaacggccaggagguggagcugcccuucuuccaccccagcggcaagcuggagaucuacagaaacaagaacagcaccaccguggagagcaagggcguggugaccgugcaguacagcgacaucggccugcuguacaucagacugagcaccaccuacuucaacugcaccggcggccugugcggcuucuacaacgccaacgccagcgacgaguucugccugcccaacggcaagugcaccgacaaccuggccguguuccuggagagcuggaccaccuucgaggagaucugcaacggcgagugcggcgaccugcugaaggccugcaacaacgacagcgagcugcugaaguucuacagaagcagaagcagaugcggcaucaucaacgaccccagcaacagcagcuuccuggagugccacggcguggugaacgugaccgccuacuacagaaccugccuguucagacugugccagagcggcggcaacgagagcgagcugugcgacagcguggccagauacgccagcgccugcaagaacgccgacguggaggugggccccuggagaaccuacgacuucugcccccuggagugccccgagaacagccacuucgaggagugcaucaccugcaccgagaccugcgagacccugacccugggccccaucugcguggacagcugcagcgagggcugccagugcgacgagggcuacgcccugcugggcagccagugcgugaccagaagcgagugcggcugcaacuucgagggccaccagcuggccaccaacgagaccuucuggguggaccuggacugccagaucuucugcuacugcagcggcaccgacaacagagugcacugcgagaccauccccugcaaggacgacgaguacugcauggaggagggcggccuguacuacugccaggccagaaccgacgccagcugcaucgugagcggcuacggccacuaccugaccuucgacggcuuccccuucgacuuccagaccagcugcccccugauccugugcaccaccggcagcagacccagcagcgacagcuuccccaaguucguggugaccgccaagaacgaggacagagaccccagccuggcccugugggugaagcagguggacgugaccguguucggcuacagcaucgugauccacagagccuacaagcacaccgugcuggugaacagcgagagacuguaccugccccugaagcugggccagggcaagaucaacaucuucagcuucggcuuccacguggugguggagaccgacuucggccugaaggugguguacgacuggaagaccuuccugagcaucaccgugcccagaagcaugcagaacagcaccuacggccugugcggcagauacaacggcaaccccgacgacgaccuggagaugcccaugggccugcuggccagcagcgugaacgaguucggccagagcugggugaagagagacaccuucugccaggugggcugcggcgacagaugccccagcugcgccaagguggagggcuucagcaaggugcagcagcugugcagccugauccccaaccagaacgccgccuucagcaagugccacagcaaggugaaccccaccuucuucuacaagaacugccuguucgacagcugcaucgacggcggcgccgugcagaccgccugcagcuggcugcagaacuacgccagcaccugccagacccagggcaucaccgugaccggcuggagaaacuacaccagcugcaccgugaccugcccccccaacagccacuacgagagcugcgugagcgugugccagcccagaugcgccgccaucagacugaagagcgacugcagccacuacugcguggagggcugccacugcgacgccggcuacgugcugaacggcaagagcugcauccugccccacagcugcggcugcuacagcgacggcaaguacuacgagcccaagcagcuguucuggaacagcgacugcaccagaagaugcagaugcuucagaagaaacgugauccagugcgaccccagacagugcaagagcgacgaggagugcgcccugagaaacggcgugagaggcugcuucagcaccaagaccagcuacugccuggccgccggcggcggcguguucagaaccuucgacggcgccuuccugagauuccccgccaacugcgccuucgugcugagcaccaucugccagaagcugcccgacaucagcuuccagcugaucaucaacuucgacaaguggagcgcccccaaccugaccaucaucagccccguguacuucuacaucaacgaggagcagauccugaucaacgacagaaacaccgugaaggugaacggcacccaggugaacgugcccuucaucaccggccuggccaccaagaucuacagcagcgagggcuuccuggugaucgacaccagccccgacauccagaucuacuacaacggcuucaacgugaucaagaucagcaucagcgagagacugcagaacaaggugugcggccugugcggcaacuucaacggcgaccugaccgacgacuacgugacccugagaggcaagcccguggugagcagcguggugcuggcccagagcuggaagaccaacggcaugcagaagagaccccuggcccccagcugcaacgagcugcaguucagccaguacgccgccaugugcgacaacgugcacauccagaagaugcagggcgacggcuacugccugaagcugaccgacaugaagggcuucuuccagcccugcuacggccugcuggacccccugcccuucuacgagagcugcuaccuggacggcugcuacagccacaagaaguuccagcugugcggcagccuggccgccuacggcgaggccugcagaagcuucggcauccugagcaccgaguggaucgagaaggagaacugcagcggcgugguggaggaccccugcgugggcgccgacugccccaacagaaccugcgagcugggcaacggcagagagcugugcggcugcaucgagcccccccccuacggcaacaacagccacgacaucaucgacgccgaggugaccugcaaggccgcccagauggaggugagcaucagcaagugcaagcuguuccagcugggcuucgagagagagggcgugagaaucaacgacagacagugcaccggcaucgagggcgaggacuucaucagcuuccagaucaacaacaccaagggcaacugcggcaacaucgugcagagcaacggcacccacaucauguacaagaacacccuguggaucgagagcgccaacaacaccggcaacaucaucaccagagacagaaccaucaacguggaguucagcugcgccuacgagcuggacaucaagaucagccuggacagcguggugaagcccaugcugagcgugaucaaccugaccgugcccacccaggagggcagcuucaucaccaagauggcccuguacaagaacgccagcuacaagcaccccuacagacagggcgagguggugcugaccaccagagacgugcuguacgugggcguguucguggugggcgccgacgccacccaccugauccugacccugaacaagugcuacgccacccccaccagagacagcaacgacaagcugagauacuucaucaucgagggcggcugccagaaccugaaggacaacaccaucggcaucgaggagaacgccgugagccugaccugcagauuccacgugaccguguucaaguucaucggcgacuacgacgaggugcaccugcacugcgccgugagccugugcgacagcgagaaguacagcugcaagaucaccugcccccacaacagcagaaucgccaccgacuacaccaaggagcccaaggagcagaucaucagcgugggccccaucagaagaaagagacuggacuggugcgaggacaacggcggcugcgagcagaucugcaccagcagaguggacggcccccugugcagcugcgugaccggcacccugcaggaggacggcaagagcugcagagccagcaacagcagcauggagcugcagguguggacccugcugcugaucaugauccagaucagccuguggcacuucguguacaagagcggcaccaccagcuaa

SEQ ID NO: 24499 - RNA, 822 nt, Artificial Sequence
  TEF__Homo_sapiens__NP_001138870
auggacaugcccgaggugcugaagagccugcuggagcacagccugcccuggcccgagaagagaaccgacaaggagaagggcaaggagaagcuggaggaggacgaggccgccgccgccagcaccauggccgugagcgccagccugaugccccccaucugggacaagaccauccccuacgacggcgagagcuuccaccuggaguacauggaccuggacgaguuccugcuggagaacggcauccccgccagccccacccaccuggcccacaaccugcugcugcccguggccgagcuggagggcaaggagagcgccagcagcagcaccgccagcccccccagcagcagcaccgccaucuuccagcccagcgagaccgugagcagcaccgagagcagccuggagaaggagagagagacccccagccccaucgaccccaacugcguggagguggacgugaacuucaaccccgaccccgccgaccuggugcugagcagcgugcccggcggcgagcuguucaaccccagaaagcacaaguucgccgaggaggaccugaagccccagcccaugaucaagaaggccaagaagguguucgugcccgacgagcagaaggacgagaaguacuggaccagaagaaagaagaacaacguggccgccaagagaagcagagacgccagaagacugaaggagaaccagaucaccaucagagccgccuuccuggagaaggagaacaccgcccugagaaccgagguggccgagcugagaaaggaggugggcaagugcaagaccaucgugagcaaguacgagaccaaguacggcccccuguaa

SEQ ID NO: 24500 - RNA, 1083 nt, Artificial Sequence
  TEFM__Homo_sapiens__NP_078959
augagcggcagcgugcuguucaccgccggcgagagauggagaugcuuccugacccccagcagaagcagccuguacugggcccugcacaacuucugcugcagaaagaagagcaccacccccaagaagaucacccccaacgugaccuucugcgacgagaacgccaaggagcccgagaacgcccuggacaagcuguucagcagcgagcagcaggccagcauccugcacgugcugaacaccgccagcaccaaggagcuggaggccuucagacugcugagaggcagaagaagcaucaacaucguggagcacagagagaacuucggccccuuccagaaccuggagagccugaugaacgugccccuguucaaguacaagagcaccgugcaggugugcaacagcauccugugccccaagaccggcagagagaagagaaagagccccgagaacagauuccugagaaagcugcugaagcccgacaucgagagagagagacugaaggccgugaacagcaucaucagcaucguguucggcaccagaagaaucgccugggcccaccuggacagaaagcugaccgugcuggacuggcagcagagcgacagauggagccugaugagaggcaucuacagcagcagcguguaccuggaggagaucagcagcaucaucagcaagaugcccaaggccgacuucuacgugcuggagaagaccggccugagcauccagaacagcagccuguuccccauccugcugcacuuccacaucauggaggccaugcuguacgcccugcugaacaagaccuucgcccaggacggccagcaccaggugcugagcaugaacagaaacgccgugggcaagcacuucgagcugaugaucggcgacagcagaaccagcggcaaggagcuggugaagcaguuccuguucgacagcauccugaaggccgaccccagaguguucuuccccagcgacaagaucgugcacuacagacagauguuccugagcaccgagcugcagagaguggaggagcuguacgacagccugcugcaggccaucgccuucuacgagcuggccguguucgacagccagcccuaa

SEQ ID NO: 24501 - RNA, 3375 nt, Artificial Sequence
  TEK__Homo_sapiens__NP_000450
auggacagccuggccagccuggugcugugcggcgugagccugcugcugagcggcaccguggagggcgccauggaccugauccugaucaacagccugccccuggugagcgacgccgagaccagccugaccugcaucgccagcggcuggagaccccacgagcccaucaccaucggcagagacuucgaggcccugaugaaccagcaccaggacccccuggaggugacccaggacgugaccagagagugggccaagaaggugguguggaagagagagaaggccagcaagaucaacggcgccuacuucugcgagggcagagugagaggcgaggccaucagaaucagaaccaugaagaugagacagcaggccagcuuccugcccgccacccugaccaugaccguggacaagggcgacaacgugaacaucagcuucaagaaggugcugaucaaggaggaggacgccgugaucuacaagaacggcagcuucauccacagcgugcccagacacgaggugcccgacauccuggaggugcaccugccccacgcccagccccaggacgccggcguguacagcgccagauacaucggcggcaaccuguucaccagcgccuucaccagacugaucgugagaagaugcgaggcccagaaguggggccccgagugcaaccaccugugcaccgccugcaugaacaacggcgugugccacgaggacaccggcgagugcaucugcccccccggcuucaugggcagaaccugcgagaaggccugcgagcugcacaccuucggcagaaccugcaaggagagaugcagcggccaggagggcugcaagagcuacguguucugccugcccgaccccuacggcugcagcugcgccaccggcuggaagggccugcagugcaacgaggccugccaccccggcuucuacggccccgacugcaagcugagaugcagcugcaacaacggcgagaugugcgacagauuccagggcugccugugcagccccggcuggcagggccugcagugcgagagagagggcauccccagaaugacccccaagaucguggaccugcccgaccacaucgaggugaacagcggcaaguucaaccccaucugcaaggccagcggcuggccccugcccaccaacgaggagaugacccuggugaagcccgacggcaccgugcugcaccccaaggacuucaaccacaccgaccacuucagcguggccaucuucaccauccacagaauccugccccccgacagcggcgugugggugugcagcgugaacaccguggccggcaugguggagaagcccuucaacaucagcgugaaggugcugcccaagccccugaacgcccccaacgugaucgacaccggccacaacuucgccgugaucaacaucagcagcgagcccuacuucggcgacggccccaucaagagcaagaagcugcuguacaagcccgugaaccacuacgaggccuggcagcacauccaggugaccaacgagaucgugacccugaacuaccuggagcccagaaccgaguacgagcugugcgugcagcuggugagaagaggcgagggcggcgagggccaccccggccccgugagaagauucaccaccgccagcaucggccugcccccccccagaggccugaaccugcugcccaagagccagaccacccugaaccugaccuggcagcccaucuuccccagcagcgaggacgacuucuacguggagguggagagaagaagcgugcagaagagcgaccagcagaacaucaaggugcccggcaaccugaccagcgugcugcugaacaaccugcaccccagagagcaguacguggugagagccagagugaacaccaaggcccagggcgaguggagcgaggaccugaccgccuggacccugagcgacauccugcccccccagcccgagaacaucaagaucagcaacaucacccacagcagcgccgugaucagcuggaccauccuggacggcuacagcaucagcagcaucaccaucagauacaaggugcagggcaagaacgaggaccagcacguggacgugaagaucaagaacgccaccaucacccaguaccagcugaagggccuggagcccgagaccgccuaccagguggacaucuucgccgagaacaacaucggcagcagcaaccccgccuucagccacgagcuggugacccugcccgagagccaggcccccgccgaccugggcggcggcaagaugcugcugaucgccauccugggcagcgccggcaugaccugccugaccgugcugcuggccuuccugaucauccugcagcugaagagagccaacgugcagagaagaauggcccaggccuuccagaacgugagagaggagcccgccgugcaguucaacagcggcacccuggcccugaacagaaaggugaagaacaaccccgaccccaccaucuaccccgugcuggacuggaacgacaucaaguuccaggacgugaucggcgagggcaacuucggccaggugcugaaggccagaaucaagaaggacggccugagaauggacgccgccaucaagagaaugaaggaguacgccagcaaggacgaccacagagacuucgccggcgagcuggaggugcugugcaagcugggccaccaccccaacaucaucaaccugcugggcgccugcgagcacagaggcuaccuguaccuggccaucgaguacgccccccacggcaaccugcuggacuuccugagaaagagcagagugcuggagaccgaccccgccuucgccaucgccaacagcaccgccagcacccugagcagccagcagcugcugcacuucgccgccgacguggccagaggcauggacuaccugagccagaagcaguucauccacagagaccuggccgccagaaacauccuggugggcgagaacuacguggccaagaucgccgacuucggccugagcagaggccaggagguguacgugaagaagaccaugggcagacugcccgugagauggauggccaucgagagccugaacuacagcguguacaccaccaacagcgacguguggagcuacggcgugcugcugugggagaucgugagccugggcggcacccccuacugcggcaugaccugcgccgagcuguacgagaagcugccccagggcuacagacuggagaagccccugaacugcgacgacgagguguacgaccugaugagacagugcuggagagagaagcccuacgagagacccagcuucgcccagauccuggugagccugaacagaaugcuggaggagagaaagaccuacgugaacaccacccuguacgagaaguucaccuacgccggcaucgacugcagcgccgaggaggccgccuaa

SEQ ID NO: 24502 - RNA, 1257 nt, Artificial Sequence
  TEKT1__Homo_sapiens__NP_444515
auggccaagcugcugcagcccccccccaaguuccugcccagcgaguggcacaucgccaacaagaaccaguaccacagagccgacgcccagagaagcagaagcgagagacugguggccgagagccagagacugguggacgagaucgagaagaccaccagaaagagccagagcgacgugaacaagaagcuggagcagagacuggaggaggugcaguucuggaagaaggagcuggacgacaagcuggagcagcuggugaacgugaccgacgaccugcugaucuacaagaucagacuggagaaggcccuggagacccugaaggagccccugcacaucaccgagaccugccuggccuacagagagaagagaaucggcaucgaccuggugcacgacaccguggagcacgagcugaucaaggaggccgagaucauccagggcaucauggcccugcugaccagaacccuggaggaggccagcgagcagaucagaaugaacagaagcgccaaguacaaccuggagaaggaccugaaggacaaguucguggcccugaccaucgacgacaucugcuucagccugaacaacaacagccccaacaucagauacagcgagaacgccgugagaaucgagcccaacagcgugagccuggaggacuggcuggacuucagcagcaccaacguggagaaggccgacaagcagagaaacaacagccugaugcugaaggcccugguggacagaauccugagccagaccgccaacgaccugagaaagcagugcgacgugguggacaccgccuucaagaacggccugaaggacaccaaggacgccagagacaagcuggccgaccaccuggccaaggugauggaggagaucgccagccaggagaagaacaucaccgcccuggagaaggccauccuggaccaggagggccccgccaagguggcccacaccagacuggagaccagaacccacagacccaacguggagcugugcagagacguggcccaguacagacugaugaaggaggugcaggagaucacccacaacguggccagacugaaggagacccuggcccaggcccaggccgagcugaagggccugcacagaagacagcuggcccugcaggaggagauccaggugaaggagaacaccaucuacaucgacgaggugcugugcaugcagaugagaaagagcaucccccugagagacggcgaggaccacggcgugugggccggcggccugagacccgacgccgugugcuaa

SEQ ID NO: 24503 - RNA, 1458 nt, Artificial Sequence
  TEKT5__Homo_sapiens__NP_653275
auggaguuccugggcaccacccagaccgccagcuacugcggccccaagaagugcugcggccugaccagccugcccgccgugcaggcccccgugauccaggagugcuaccagcccuacuaccugcccggcuacagauaccugaacagcuggagacccagccuguucuacaagaucgccaacgugcagaccugccccgacgagagcaccagcacccugagaccccccaccauccugcccacccugagaagcgcccuguucagcagauacagcccccacgacugggaccagagcaaccagcugcaggugagaggcgccgaggccagcagacugugggccagcagacugaccgacgacagcaugagacugcugcaggacaaggaccagcugacccaccagaugcaggagggcaccugcagaaaccugggccagagacugagcgacaucggcuucuggaagagcgagcugagcuacgagcuggacagacugcugaccgagaaccagaaccuggagaccgugaagagaagacuggagugcgccgccaacgaggugaacugcccccugcagguggcccuggagugccuguaccacagagagaagagaaucggcaucgaccuggugcacgacaacguggagaagaaccugaucagagagguggaccugcugaagugcugccaggagcagaugagaaagcuggcccagagaaucgacauccagaugagagacaacagagacgcccagcacgugcuggagagagaccuggaggacaagagcagcgcccagugcaucgacgagaagugcuucaaccugagaaacaccagcgacugcaucagcuucuuccacggcauggagaagaucgacggcaccaucagcgugcccgagaccugggccaaguucagcaacgacaacaucaagcacagccagaacaugagagccaacagcauccagcugagagaggaggccgagcaccuguucgagacccugagcgaccagauguggagacaguucaccgacaccaaccuggccuucaacgccagaaucagcgaggugaccgacgugaagaacaagcugcagacccagcuggccaagacccugcaggagaucuuccaggccgagaacaccaucaugcugcuggagagaagcaucauggccaaggagggcccccugaagguggcccagaccagacuggagugcagaaccagaagacccaacauggagcugugcagagacaucccccagcugaagcuggugaacgagguguucaccaucgacgacacccugcagacccugaagcugagacugagagagacccaggacacccugcagcugcuggugaugaccaagugcagacuggagcacgagcuggccaucaaggccaacacccugugcaucgacaaggagaagugcaugggcaugagaaagaccuuccccugcacccccagacuggugggccacaccuaa

SEQ ID NO: 24504 - RNA, 2514 nt, Artificial Sequence
  TELO2__Homo_sapiens__NP_057195
auggagcccgcccccagcgaggugagacuggccgugagagaggccauccacgcccugagcagcagcgaggacggcggccacaucuucugcacccuggagagccugaagagauaccugggcgagauggagccccccgcccugcccagagagaaggaggaguucgccagcgcccacuucagccccgugcugagaugccuggccagcagacugagccccgccuggcuggagcugcugccccacggcagacuggaggagcugugggccagcuucuuccuggagggccccgccgaccaggccuuccuggugcugauggagaccaucgagggcgccgccggccccagcuucagacugaugaagauggccagacugcuggccagauuccugagagagggcagacuggccgugcugauggaggcccagugcagacagcagacccagcccggcuucauccugcugagagagacccugcugggcaaggugguggcccugcccgaccaccugggcaacagacugcagcaggagaaccuggccgaguucuucccccagaacuacuucagacugcugggcgaggagguggugagagugcugcaggccgugguggacagccugcagggcggccuggacagcagcgugagcuucgugagccaggugcugggcaaggccugcgugcacggcagacagcaggagauccugggcgugcuggugcccagacuggccgcccugacccagggcagcuaccugcaccagagagugugcuggagacugguggagcaggugcccgacagagccauggaggccgugcugaccggccugguggaggccgcccugggccccgaggugcugagcagacugcugggcaaccugguggugaagaacaagaaggcccaguucgugaugacccagaagcugcuguuccugcagagcagacugaccacccccaugcugcagagccugcugggccaccuggccauggacagccagagaagaccccugcugcugcaggugcugaaggagcugcuggagaccuggggcagcagcagcgccaucagacacaccccccugccccagcagagacacgugagcaaggccgugcugaucugccuggcccagcugggcgagcccgagcugagagacagcagagacgagcugcuggccagcaugauggccggcgugaagugcagacuggacagcagccugccccccgugagaagacugggcaugaucguggccgagguggugagcgccagaauccaccccgagggccccccccugaaguuccaguacgaggaggacgagcugagccuggagcugcuggcccuggccagcccccagcccgccggcgacggcgccagcgaggccggcaccagccuggugcccgccaccgccgagccccccgccgagacccccgccgagaucguggacggcggcgugccccaggcccagcuggccggcagcgacagcgaccuggacagcgacgacgaguucgugcccuacgacaugagcggcgacagagagcugaagagcagcaaggcccccgccuacgugagagacugcguggaggcccugaccaccagcgaggacaucgagagaugggaggccgcccugagagcccuggagggccugguguacagaagccccaccgccaccagagaggugagcguggagcuggccaaggugcugcugcaccuggaggagaagaccugcguggugggcuucgccggccugagacagagagcccugguggccgugaccgugaccgaccccgcccccguggccgacuaccugaccagccaguucuacgcccugaacuacagccugagacagagaauggacauccuggacgugcugacccuggccgcccaggagcugagcagacccggcugccugggcagaaccccccagcccggcagccccagccccaacacccccugccugcccgaggccgccgugagccagcccggcagcgccguggccagcgacuggagaguggugguggaggagagaaucagaagcaagacccagagacugagcaagggcggccccagacagggccccgccggcagccccagcagauucaacagcguggccggccacuucuucuucccccugcugcagagauucgacagaccccuggugaccuucgaccugcugggcgaggaccagcuggugcugggcagacuggcccacacccugggcgcccugaugugccuggccgugaacaccaccguggccguggccaugggcaaggcccugcuggaguucgugugggcccugagauuccacaucgacgccuacgugagacagggccugcugagcgccgugagcagcgugcugcugagccugcccgccgccagacugcuggaggaccugauggacgagcugcuggaggccagaagcuggcuggccgacguggccgagaaggaccccgacgaggacugcagaacccuggcccugagagcccugcugcugcugcagagacugaagaacagacugcugccccccgccagccccuaa

SEQ ID NO: 24505 - RNA, 8178 nt, Artificial Sequence
  TENM1__Homo_sapiens__NP_055068
auggagcagaccgacugcaagcccuaccagccccugcccaaggugaagcacgagauggaccuggccuacaccagcagcagcgacgagagcgaggacggcagaaagcccagacagagcuacaacagcagagagacccugcacgaguacaaccaggagcugagaaugaacuacaacagccagagcagaaagagaaaggagguggagaagagcacccaggagauggaguucugcgagaccagccacacccugugcagcggcuaccagaccgacaugcacagcgugagcagacacggcuaccagcuggagaugggcagcgacguggacaccgagaccgagggcgccgccagccccgaccacgcccugagaauguggaucagaggcaugaagagcgagcacagcagcugccugagcagcagagccaacagcgcccugagccugaccgacaccgaccacgagagaaagagcgacggcgagaacggcuucaaguucagccccgugugcugcgacauggaggcccaggccggcagcacccaggacgugcagagcagcccccacaaccaguucaccuucagaccccugccccccccccccccccccccccacgccugcaccugcgccagaaagcccccccccgccgccgacagccugcagagaagaagcaugaccaccagaagccagcccagccccgccgcccccgccccccccaccagcacccaggacagcgugcaccugcacaacagcugggugcugaacagcaacaucccccuggagaccagacacuuccuguucaagcacggcagcggcagcagcgccaucuucagcgccgccagccagaacuacccccugaccagcaacaccguguacagccccccccccagaccccugcccagaagcaccuucagcagacccgccuucaccuucaacaagcccuacagaugcugcaacuggaagugcaccgcccugagcgccaccgccaucaccgugacccuggcccugcugcuggccuacgugaucgccgugcaccuguucggccugaccuggcagcugcagcccguggagggcgagcuguacgccaacggcgugagcaagggcaacagaggcaccgagagcauggacaccaccuacagccccaucggcggcaaggugagcgacaagagcgagaagaagguguuccagaagggcagagccaucgacaccggcgagguggacaucggcgcccaggugaugcagaccaucccccccggccuguucuggagauuccagaucaccauccaccaccccaucuaccugaaguucaacaucagccuggccaaggacagccugcugggcaucuacggcagaagaaacaucccccccacccacacccaguucgacuucgugaagcugauggacggcaagcagcuggugaagcaggacagcaagggcagcgacgacacccagcacagccccagaaaccugauccugaccagccugcaggagaccggcuucaucgaguacauggaccagggccccugguaccuggccuucuacaacgacggcaagaagauggagcagguguucgugcugaccaccgccaucgagaucauggacgacugcagcaccaacugcaacggcaacggcgagugcaucagcggccacugccacugcuuccccggcuuccugggccccgacugcgccagagacagcugccccgugcugugcggcggcaacggcgaguacgagaagggccacugcgugugcagacacggcuggaagggccccgagugcgacgugcccgaggagcagugcaucgaccccaccugcuucggccacggcaccugcaucaugggcgugugcaucugcgugcccggcuacaagggcgagaucugcgaggaggaggacugccuggaccccaugugcagcaaccacggcaucugcgugaagggcgagugccacugcagcaccggcuggggcggcgugaacugcgagaccccccugcccgugugccaggagcagugcagcggccacggcaccuuccugcuggacgccggcgugugcagcugcgaccccaaguggaccggcagcgacugcagcaccgagcugugcaccauggagugcggcagccacggcgugugcagcagaggcaucugccagugcgaggagggcugggugggccccaccugcgaggagagaagcugccacagccacugcaccgagcacggccagugcaaggacggcaagugcgagugcagccccggcugggagggcgaccacugcaccaucgcccacuaccuggacgccgugagagacggcugccccggccugugcuucggcaacggcagaugcacccuggaccagaacggcuggcacugcgugugccaggugggcuggagcggcaccggcugcaacguggugauggagaugcugugcggcgacaaccuggacaacgacggcgacggccugaccgacugcguggaccccgacugcugccagcagagcaacugcuacaucagcccccugugccagggcagccccgacccccuggaccugauccagcagagccagacccuguucagccagcacaccagcagacuguucuacgacagaaucaaguuccugaucggcaaggacagcacccacgugaucccccccgaggugagcuucgacagcagaagagccugcgugaucagaggccaggugguggccaucgacggcaccccccuggugggcgugaacgugagcuuccugcaccacagcgacuacggcuucaccaucagcagacaggacggcagcuucgaccugguggccaucggcggcaucagcgugauccugaucuucgacagaagccccuuccugcccgagaagagaacccuguggcugcccuggaaccaguucaucgugguggagaaggugaccaugcagagaguggugagcgacccccccagcugcgacaucagcaacuucaucagccccaaccccaucgugcugcccagcccccugaccagcuucggcggcagcugccccgagagaggcaccaucgugcccgagcugcagguggugcaggaggagauccccauccccagcagcuucgugagacugagcuaccugagcagcagaacccccggcuacaagacccugcugagaauccugcugacccacagcaccauccccgugggcaugaucaaggugcaccugaccguggccguggagggcagacugacccagaagugguuccccgccgccaucaaccugguguacaccuucgccuggaacaagaccgacaucuacggccagaagguguggggccuggccgaggcccuggugagcgugggcuacgaguacgagaccugccccgacuucauccugugggagcagagaaccguggugcugcagggcuucgagauggacgccagcaaccugggcggcuggagccugaacaagcaccacauccugaacccccagagcggcaucauccacaagggcaacggcgagaacauguucaucagccagcagccccccgugaucagcaccaucaugggcaacggccaccagagaagcguggccugcaccaacugcaacggccccgcccacaacaacaagcuguucgcccccguggcccuggccagcggccccgacggcagcguguacgugggcgacuucaacuucgugagaagaaucuuccccagcggcaacagcgugagcauccuggagcugagcaccagccccgcccacaaguacuaccuggccauggaccccgugagcgagagccuguaccugagcgacaccaacaccagaaagguguacaagcugaagagccugguggagaccaaggaccugagcaagaacuucgaggugguggccggcaccggcgaccagugccugcccuucgaccagagccacugcggcgacggcggcagagccagcgaggccagccugaacagccccagaggcaucaccguggacagacacggcuucaucuacuucguggacggcaccaugaucagaaagaucgacgagaacgccgugaucaccaccgugaucggcagcaacggccugaccagcacccagccccugagcugcgacagcggcauggacaucacccaggugagacuggaguggcccaccgaccuggccgugaaccccauggacaacagccuguacgugcuggacaacaacaucgugcugcagaucagcgagaacagaagagugagaaucaucgccggcagacccauccacugccaggugcccggcaucgaccacuuccuggugagcaagguggccauccacagcacccuggagagcgccagagccaucagcgugagccacagcggccugcuguucaucgccgagaccgacgagagaaaggugaacagaauccagcaggugaccaccaacggcgagaucuacaucaucgccggcgcccccaccgacugcgacugcaagaucgaccccaacugcgacugcuucagcggcgacggcggcuacgccaaggacgccaagaugaaggcccccagcagccuggccgugagccccgacggcacccuguacguggccgaccugggcaacgugagaaucagaaccaucagcagaaaccaggcccaccugaacgacaugaacaucuacgagaucgccagccccgccgaccaggagcuguaccaguucaccgugaacggcacccaccugcacacccugaaccugaucaccagagacuacguguacaacuucaccuacaacagcgagggcgaccugggcgccaucaccagcagcaacggcaacagcgugcacaucagaagagacgccggcggcaugccccuguggcugguggugcccggcggccagguguacuggcugaccaucagcagcaacggcgugcugaagagagugagcgcccagggcuacaaccuggcccugaugaccuaccccggcaacaccggccugcuggccaccaagagcaacgagaacggcuggaccaccguguacgaguacgaccccgagggccaccugaccaacgccaccuuccccaccggcgaggugagcagcuuccacagcgaccuggagaagcugaccaagguggagcuggacaccagcaacagagagaacgugcugaugagcaccaaccugaccgccaccagcaccaucuacauccugaagcaggagaacacccagagcaccuacagagugaaccccgacggcagccugagagugaccuucgccagcggcauggagaucggccugagcagcgagccccacauccuggccggcgccgugaaccccacccugggcaagugcaacaucagccugcccggcgagcacaacgccaaccugaucgaguggagacagagaaaggagcagaacaagggcaacgugagcgccuucgagagaagacugagagcccacaacagaaaccugcugagcaucgacuucgaccacaucaccagaaccggcaagaucuacgacgaccacagaaaguucacccugagaauccuguacgaccagaccggcagacccauccuguggagccccgugagcagauacaacgaggugaacaucaccuacagccccagcggccuggugaccuucauccagagaggcaccuggaacgagaagauggaguacgaccagagcggcaagaucaucagcagaaccugggccgacggcaagaucuggagcuacaccuaccuggagaagagcgugaugcugcugcugcacagccagagaagauacaucuucgaguacgaccagcccgacugccugcugagcgugaccaugcccagcauggugagacacagccugcagaccaugcugagcgugggcuacuacagaaacaucuacaccccccccgacagcagcaccagcuucauccaggacuacagcagagacggcagacugcugcagacccugcaccugggcaccggcagaagagugcuguacaaguacaccaagcaggccagacugagcgaggugcuguacgacaccacccaggugacccugaccuacgaggagagcagcggcgugaucaagaccauccaccugaugcacgacggcuucaucugcaccaucagauacagacagaccggcccccugaucggcagacagaucuucagauucagcgaggagggccuggugaacgccagauucgacuacagcuacaacaacuucagagugaccagcaugcaggccgugaucaacgagaccccccugcccaucgaccuguacagauacguggacgugagcggcagaaccgagcaguucggcaaguucagcgugaucaacuacgaccugaaccaggugaucaccaccaccgugaugaagcacaccaagaucuucagcgccaacggccaggugaucgaggugcaguacgagauccugaaggccaucgccuacuggaugaccauccaguacgacaacgugggcagaauggugaucugcgacaucagagugggcguggacgccaacaucaccagauacuucuacgaguacgacgccgacggccagcugcagaccgugagcgugaacgacaagacccaguggagauacagcuacgaccugaacggcaacaucaaccugcugagccacggcaagagcgccagacugaccccccugagauacgaccugagagacagaaucaccagacugggcgagauccaguacaagauggacgaggacggcuuccugagacagagaggcaacgacaucuucgaguacaacagcaacggccugcugcagaaggccuacaacaaggccagcggcuggaccgugcaguacuacuacgacggccugggcagaagaguggccagcaagagcagccugggccagcaccugcaguucuucuacgccgaccugaccaaccccaucagagugacccaccuguacaaccacaccagcagcgagaucaccagccuguacuacgaccugcagggccaccugaucgccauggagcugagcagcggcgaggaguacuacguggccugcgacaacaccggcaccccccuggccguguucagcagcagaggccaggugaucaaggagauccuguacacccccuacggcgacaucuaccacgacaccuaccccgacuuccaggugaucaucggcuuccacggcggccuguacgacuuccugaccaagcuggugcaccugggccagagagacuacgacgugguggccggcagauggaccacccccaaccaccacaucuggaagcagcugaaccugcugcccaagcccuucaaccuguacagcuucgagaacaacuaccccgugggcaagauccaggacguggccaaguacaccaccgacaucagaagcuggcuggagcuguucggcuuccagcugcacaacgugcugcccggcuuccccaagcccgagcuggagaaccuggagcugaccuacgagcugcugagacugcagaccaagacccaggagugggaccccggcaagaccauccugggcauccagugcgagcugcagaagcagcugagaaacuucaucagccuggaccagcugcccaugacccccagauacaacgacggcagaugccuggagggcggcaagcagcccagauucgccgccgugcccagcguguucggcaagggcaucaaguucgccaucaaggacggcaucgugaccgccgacaucaucggcguggccaacgaggacagcagaagacuggccgccauccugaacaacgcccacuaccuggagaaccugcacuucaccaucgagggcagagacacccacuacuucaucaagcugggcagccuggaggaggaccuggugcugaucggcaacaccggcggcagaagaauccuggagaacggcgugaacgugaccgugagccagaugaccagcgugcugaacggcagaaccagaagauucgccgacauccagcugcagcacggcgcccugugcuucaacaucagauacggcaccaccguggaggaggagaagaaccacgugcuggagaucgccagacagagagccguggcccaggccuggaccaaggagcagagaagacugcaggagggcgaggagggcaucagagccuggaccgagggcgagaagcagcagcugcugagcaccggcagagugcagggcuacgacggcuacuucgugcugagcguggagcaguaccuggagcugagcgacagcgccaacaacauccacuucaugagacagagcgagaucggcagaagauaa

SEQ ID NO: 24506 - RNA, 8298 nt, Artificial Sequence
  TENM2__Homo_sapiens__NP_001116151
auggacgugaaggacagaagacacagaagccugaccagaggcagaugcggcaaggagugcagauacaccagcagcagccuggacagcgaggacugcagagugcccacccagaagagcuacagcagcagcgagacccugaaggccuacgaccacgacagcagaaugcacuacggcaacagagugaccgaccugauccacagagagagcgacgaguuccccagacagggcaccaacuucacccuggccgagcugggcaucugcgagcccagcccccacagaagcggcuacugcagcgacaugggcauccugcaccagggcuacagccugagcaccggcagcgacgccgacagcgacaccgagggcggcaugagccccgagcacgccaucagacuguggggcagaggcaucaagagcagaagaagcagcggccugagcagcagagagaacagcgcccugacccugaccgacagcgacaacgagaacaagagcgacgacgagaacggcagacccaucccccccaccagcagccccagccugcugcccagcgcccagcugcccagcagccacaaccccccccccgugagcugccagaugccccugcuggacagcaacaccagccaccagaucauggacaccaaccccgacgaggaguucagccccaacagcuaccugcugagagccugcagcggcccccagcaggccagcagcagcggcccccccaaccaccacagccagagcacccugagacccccccugccccccccccacaaccacacccugagccaccaccacagcagcgccaacagccugaacagaaacagccugaccaacagaagaagccagauccacgcccccgcccccgcccccaacgaccuggccaccacccccgagagcgugcagcugcaggacagcugggugcugaacagcaacgugccccuggagaccagacacuuccuguucaagaccagcagcggcagcaccccccuguucagcagcagcagccccggcuacccccugaccagcggcaccguguacacccccccccccagacugcugcccagaaacaccuucagcagaaaggccuucaagcugaagaagcccagcaaguacugcagcuggaagugcgccgcccugagcgccaucgccgccgcccugcugcuggccauccugcuggccuacuucaucgccaugcaccugcugggccugaacuggcagcugcagcccgccgacggccacaccuucaacaacggcaucagaaccggccugcccggcaacgacgacguggccaccaugcccagcggcggcaaggugcccuggagccugaagaacagcagcaucgacagcggcgaggccgaggugggcagaagagugacccaggaggugccccccggcguguucuggagaagccagauccacaucagccagccccaguuccugaaguucaacaucagccugggcaaggacgcccuguucggcguguacaucagaagaggccugccccccagccacgcccaguacgacuucauggagagacuggacggcaaggagaaguggagcgugguggagagccccagagagagaagaagcauccagacccuggugcagaacgaggccguguucgugcaguaccuggacgugggccuguggcaccuggccuucuacaacgacggcaaggacaaggagauggugagcuucaacaccguggugcuggacagcgugcaggacugccccagaaacugccacggcaacggcgagugcgugagcggcgugugccacugcuuccccggcuuccugggcgccgacugcgccaaggccgccugccccgugcugugcagcggcaacggccaguacagcaagggcaccugccagugcuacagcggcuggaagggcgccgagugcgacgugcccaugaaccagugcaucgaccccagcugcggcggccacggcagcugcaucgacggcaacugcgugugcagcgccggcuacaagggcgagcacugcgaggagguggacugccuggaccccaccugcagcagccacggcgugugcgugaacggcgagugccugugcagccccggcuggggcggccugaacugcgagcuggccagagugcagugccccgaccagugcagcggccacggcaccuaccugcccgacaccggccugugcagcugcgaccccaacuggaugggccccgacugcagcguggaggugugcagcguggacugcggcacccacggcgugugcaucggcggcgccugcagaugcgaggagggcuggaccggcgccgccugcgaccagagagugugccaccccagaugcaucgagcacggcaccugcaaggacggcaagugcgagugcagagagggcuggaacggcgagcacugcaccaucgacggcugccccgaccugugcaacggcaacggcagaugcacccugggccagaacagcuggcagugcgugugccagaccggcuggagaggccccggcugcaacguggccauggagaccagcugcgccgacaacaaggacaacgagggcgacggccugguggacugccuggaccccgacugcugccugcagagcgccugccagaacagccugcugugcagaggcagcagagacccccuggacaucauccagcagggccagaccgacuggcccgccgugaagagcuucuacgacagaaucaagcugcuggccggcaaggacagcacccacaucauccccggcgagaaccccuucaacagcagccuggugagccugaucagaggccagguggugaccaccgacggcaccccccuggugggcgugaacgugagcuucgugaaguaccccaaguacggcuacaccaucaccagacaggacggcaccuucgaccugaucgccaacggcggcgccagccugacccugcacuucgagagagcccccuucaugagccaggagagaaccguguggcugcccuggaacagcuucuacgccauggacacccuggugaugaagaccgaggagaacagcauccccagcugcgaccugagcggcuucgugagacccgaccccaucaucaucagcagcccccugagcaccuucuucagcgccgcccccggccagaaccccaucgugcccgagacccaggugcugcacgaggagaucgagcugcccggcagcaacgugaagcugagauaccugagcagcagaaccgccggcuacaagagccugcugaagaucaccaugacccagagcaccgugccccugaaccugaucagagugcaccugaugguggccguggagggccaccuguuccagaagagcuuccaggccagccccaaccuggccuacaccuucaucugggacaagaccgacgccuacggccagagaguguacggccugagcgacgccguggugagcgugggcuucgaguacgagaccugccccagccugauccugugggagaagagaaccgcccugcugcagggcuucgagcuggaccccagcaaccugggcggcuggagccuggacaagcaccacauccugaacgugaagagcggcauccugcacaagggcaccggcgagaaccaguuccugacccagcagcccgccaucaucaccagcaucaugggcaacggcagaagaagaagcaucagcugccccagcugcaacggccuggccgagggcaacaagcugcuggcccccguggcccuggccgugggcaucgacggcagccuguacgugggcgacuucaacuacaucagaagaaucuuccccagcagaaacgugaccagcauccuggagcugagaaacaaggaguucaagcacagcaacaaccccgcccacaaguacuaccuggccguggaccccgugagcggcagccuguacgugagcgacaccaacagcagaagaaucuacagagugaagagccugagcggcaccaaggaccuggccggcaacagcgaggugguggccggcaccggcgagcagugccugcccuucgacgaggccagaugcggcgacggcggcaaggccaucgacgccacccugaugagccccagaggcaucgccguggacaagaacggccugauguacuucguggacgccaccaugaucagaaagguggaccagaacggcaucaucagcacccugcugggcagcaacgaccugaccgccgugagaccccugagcugcgacagcagcauggacguggcccaggugagacuggaguggcccaccgaccuggccgugaaccccauggacaacagccuguacgugcuggagaacaacgugauccugagaaucaccgagaaccaccaggugagcaucaucgccggcagacccaugcacugccaggugcccggcaucgacuacagccugagcaagcuggccauccacagcgcccuggagagcgccagcgccaucgccaucagccacaccggcgugcuguacaucaccgagaccgacgagaagaagaucaacagacugagacaggugaccaccaacggcgagaucugccugcuggccggcgccgccagcgacugcgacugcaagaacgacgugaacugcaacugcuacagcggcgacgacgccuacgccaccgacgccauccugaacagccccagcagccuggccguggcccccgacggcaccaucuacaucgccgaccugggcaacaucagaaucagagccgugagcaagaacaagcccgugcugaacgccuucaaccaguacgaggccgccagccccggcgagcaggagcuguacguguucaacgccgacggcauccaccaguacaccgugagccuggugaccggcgaguaccuguacaacuucaccuacagcaccgacaacgacgugaccgagcugaucgacaacaacggcaacagccugaagaucagaagagacagcagcggcaugcccagacaccugcugaugcccgacaaccagaucaucacccugaccgugggcaccaacggcggccugaagguggugagcacccagaaccuggagcugggccugaugaccuacgacggcaacaccggccugcuggccaccaagagcgacgagaccggcuggaccaccuucuacgacuacgaccacgagggcagacugaccaacgugaccagacccaccggcguggugaccagccugcacagagagauggagaagagcaucaccaucgacaucgagaacagcaacagagacgacgacgugaccgugaucaccaaccugagcagcguggaggccagcuacaccguggugcaggaccaggugagaaacagcuaccagcugugcaacaacggcacccugagagugauguacgccaacggcaugggcaucagcuuccacagcgagccccacgugcuggccggcaccaucacccccaccaucggcagaugcaacaucagccugcccauggagaacggccugaacagcaucgaguggagacugagaaaggagcagaucaagggcaaggugaccaucuucggcagaaagcugagagugcacggcagaaaccugcugagcaucgacuacgacagaaacaucagaaccgagaagaucuacgacgaccacagaaaguucacccugagaaucaucuacgaccaggugggcagacccuuccuguggcugcccagcagcggccuggccgccgugaacgugagcuacuucuucaacggcagacuggccggccugcagagaggcgccaugagcgagagaaccgacaucgacaagcagggcagaaucgugagcagaauguucgccgacggcaagguguggagcuacagcuaccuggacaagagcauggugcugcugcugcagagccagagacaguacaucuucgaguacgacagcagcgacagacugcuggccgugaccaugcccagcguggccagacacagcaugagcacccacaccagcaucggcuacaucagaaacaucuacaacccccccgagagcaacgccagcgugaucuucgacuacagcgacgacggcagaauccugaagaccagcuuccugggcaccggcagacagguguucuacaaguacggcaagcugagcaagcugagcgagaucguguacgacagcaccgccgugaccuucggcuacgacgagaccaccggcgugcugaagauggugaaccugcagagcggcggcuucagcugcaccaucagauacagaaagaucggcccccugguggacaagcagaucuacagauucagcgaggagggcauggugaacgccagauucgacuacaccuaccacgacaacagcuucagaaucgccagcaucaagcccgugaucagcgagaccccccugcccguggaccuguacagauacgacgagaucagcggcaagguggagcacuucggcaaguucggcgugaucuacuacgacaucaaccagaucaucaccaccgccgugaugacccugagcaagcacuucgacacccacggcagaaucaaggaggugcaguacgagauguucagaagccugauguacuggaugaccgugcaguacgacagcaugggcagagugaucaagagagagcugaagcugggccccuacgccaacaccaccaaguacaccuacgacuacgacggcgacggccagcugcagagcguggccgugaacgacagacccaccuggagauacagcuacgaccugaacggcaaccugcaccugcugaaccccggcaacagcgugagacugaugccccugagauacgaccugagagacagaaucaccagacugggcgacgugcaguacaagaucgacgacgacggcuaccugugccagagaggcagcgacaucuucgaguacaacagcaagggccugcugaccagagccuacaacaaggccagcggcuggagcgugcaguacagauacgacggcgugggcagaagagccagcuacaagaccaaccugggccaccaccugcaguacuucuacagcgaccugcacaaccccaccagaaucacccacguguacaaccacagcaacagcgagaucaccagccuguacuacgaccugcagggccaccuguucgccauggagagcagcagcggcgaggaguacuacguggccagcgacaacaccggcaccccccuggccguguucagcaucaacggccugaugaucaagcagcugcaguacaccgccuacggcgagaucuacuacgacagcaaccccgacuuccagauggugaucggcuuccacggcggccuguacgacccccugaccaagcuggugcacuucacccagagagacuacgacgugcuggccggcagauggaccagccccgacuacaccauguggaagaacgugggcaaggagcccgcccccuucaaccuguacauguucaagagcaacaacccccugagcagcgagcuggaccugaagaacuacgugaccgacgugaagagcuggcuggugauguucggcuuccagcugagcaacaucauccccggcuuccccagagccaagauguacuucgugcccccccccuacgagcugagcgagagccaggccagcgagaacggccagcugaucaccggcgugcagcagaccaccgagagacacaaccaggccuucauggcccuggagggccaggugaucaccaagaagcugcacgccagcaucagagagaaggccggccacugguucgccaccaccacccccaucaucggcaagggcaucauguucgccaucaaggagggcagagugaccaccggcgugagcagcaucgccagcgaggacagcagaaagguggccagcgugcugaacaacgccuacuaccuggacaagaugcacuacagcaucgagggcaaggacacccacuacuucgugaagaucggcagcgccgacggcgaccuggugacccugggcaccaccaucggcagaaaggugcuggagagcggcgugaacgugaccgugagccagcccacccugcuggugaacggcagaaccagaagauucaccaacaucgaguuccaguacagcacccugcugcugagcaucagauacggccugacccccgacacccuggacgaggagaaggccagagugcuggaccaggccagacagagagcccugggcaccgccugggccaaggagcagcagaaggccagagacggcagagagggcagcagacuguggaccgagggcgagaagcagcagcugcugagcaccggcagagugcagggcuacgagggcuacuacgugcugcccguggagcaguaccccgagcuggccgacagcagcagcaacauccaguuccugagacagaacgagaugggcaagagauaa

SEQ ID NO: 24507 - RNA, 8100 nt, Artificial Sequence
  TENM3__Homo_sapiens__NP_001073946
auggacgugaaggagagaagacccuacugcagccugaccaagagcagaagagagaaggagagaagauacaccaacagcagcgccgacaacgaggagugcagagugcccacccagaagagcuacagcagcagcgagacccugaaggccuucgaccacgacagcagcagacugcuguacggcaacagagugaaggaccuggugcacagagaggccgacgaguucaccagacagggccagaacuucacccugagacagcugggcgugugcgagcccgccaccagaagaggccuggccuucugcgccgagaugggccugccccacagaggcuacagcaucagcgccggcagcgacgccgacaccgagaacgaggccgugaugagccccgagcacgccaugagacuguggggcagaggcgugaagagcggcagaagcagcugccugagcagcagaagcaacagcgcccugacccugaccgacaccgagcacgagaacaagagcgacagcgagaacgagcagcccgccagcaaccagggccagagcacccugcagccccugccccccagccacaagcagcacagcgcccagcaccaccccagcaucaccagccugaacagaaacagccugaccaacagaagaaaccagagccccgccccccccgccgcccugcccgccgagcugcagaccacccccgagagcgugcagcugcaggacagcugggugcugggcagcaacgugccccuggagagcagacacuuccuguucaagaccggcaccggcaccaccccccuguucagcaccgccacccccggcuacaccauggccagcggcagcguguacagcccccccaccagaccccugcccagaaacacccugagcagaagcgccuucaaguucaagaagagcagcaaguacugcagcuggaagugcaccgcccugugcgccgugggcgugagcgugcugcuggccauccugcugagcuacuucaucgccaugcaccuguucggccugaacuggcagcugcagcagaccgagaacgacaccuucgagaacggcaaggugaacagcgacaccaugcccaccaacaccgugagccugcccagcggcgacaacggcaagcugggcggcuucacccaggagaacaacaccaucgacagcggcgagcuggacaucggcagaagagccauccaggagaucccccccggcaucuucuggagaagccagcuguucaucgaccagccccaguuccugaaguucaacaucagccugcagaaggacgcccugaucggcguguacggcagaaagggccugccccccagccacacccaguacgacuucguggagcugcuggacggcagcagacugaucgccagagagcagagaagccugcuggagaccgagagagccggcagacaggccagaagcgugagccugcacgaggccggcuucauccaguaccuggacagcggcaucuggcaccuggccuucuacaacgacggcaagaacgccgagcaggugagcuucaacaccaucgugaucgagagcgugguggagugccccagaaacugccacggcaacggcgagugcgugagcggcaccugccacugcuuccccggcuuccugggccccgacugcagcagagccgccugccccgugcugugcagcggcaacggccaguacagcaagggcagaugccugugcuucagcggcuggaagggcaccgagugcgacgugcccaccacccagugcaucgacccccagugcggcggcagaggcaucugcaucaugggcagcugcgccugcaacagcggcuacaagggcgagagcugcgaggaggccgacugcaucgaccccggcugcagcaaccacggcgugugcauccacggcgagugccacugcagccccggcuggggcggcagcaacugcgagauccugaagaccaugugccccgaccagugcagcggccacggcaccuaccugcaggagagcggcagcugcaccugcgaccccaacuggaccggccccgacugcagcaacgagaucugcagcguggacugcggcagccacggcgugugcaugggcggcaccugcagaugcgaggagggcuggaccggccccgccugcaaccagagagccugccaccccagaugcgccgagcacggcaccugcaaggacggcaagugcgagugcagccagggcuggaacggcgagcacugcaccaucgagggcugccccggccugugcaacagcaacggcagaugcacccuggaccagaacggcuggcacugcgugugccagcccggcuggagaggcgccggcugcgacguggccauggagacccugugcaccgacagcaaggacaacgagggcgacggccugaucgacugcauggaccccgacugcugccugcagagcagcugccagaaccagcccuacugcagaggccugcccgacccccaggacaucaucagccagagccugcagagccccagccagcaggccgccaagagcuucuacgacagaaucagcuuccugaucggcagcgacagcacccacgugauccccggcgagagccccuucaacaagagccuggccagcgugaucagaggccaggugcugaccgccgacggcaccccccugaucggcgugaacgugagcuucuuccacuaccccgaguacggcuacaccaucaccagacaggacggcauguucgaccugguggccaacggcggcgccagccugacccugguguucgagagaagccccuuccugacccaguaccacaccguguggauccccuggaacguguucuacgugauggacacccuggugaugaagaaggaggagaacgacauccccagcugcgaccugagcggcuucgugagacccaaccccaucaucgugagcagcccccugagcaccuucuucagaagcagccccgaggacagccccaucauccccgagacccaggugcugcacgaggagaccaccauccccggcaccgaccugaagcugagcuaccugagcagcagagccgccggcuacaagagcgugcugaagaucaccaugacccagagcaucauccccuucaaccugaugaaggugcaccugaugguggccguggugggcagacuguuccagaagugguuccccgccagccccaaccuggccuacaccuucaucugggacaagaccgacgccuacaaccagaagguguacggccugagcgaggccguggugagcgugggcuacgaguacgagagcugccuggaccugacccugugggagaagagaaccgccauccugcagggcuacgagcuggacgccagcaacaugggcggcuggacccuggacaagcaccacgugcuggacgugcagaacggcauccuguacaagggcaacggcgagaaccaguucaucagccagcagccccccguggugagcagcaucaugggcaacggcagaagaagaagcaucagcugccccagcugcaacggccaggccgacggcaacaagcugcuggcccccguggcccuggccugcggcaucgacggcagccuguacgugggcgacuucaacuacgugagaagaaucuuccccagcggcaacgugaccagcgugcuggagcugagcagcaaccccgcccacagauacuaccuggccaccgaccccgugaccggcgaccuguacgugagcgacaccaacaccagaagaaucuacagacccaagagccugaccggcgccaaggaccugaccaagaacgccgaggugguggccggcaccggcgagcagugccugcccuucgacgaggccagaugcggcgacggcggcaaggccguggaggccacccugaugagccccaagggcauggccguggacaagaacggccugaucuacuucguggacggcaccaugaucagaaagguggaccagaacggcaucaucagcacccugcugggcagcaacgaccugaccagcgccagaccccugaccugcgacaccagcaugcacaucagccaggugagacuggaguggcccaccgaccuggccaucaaccccauggacaacagcaucuacgugcuggacaacaacguggugcugcagaucaccgagaacagacaggugagaaucgccgccggcagacccaugcacugccaggugcccggcguggaguaccccgugggcaagcacgccgugcagaccacccuggagagcgccaccgccaucgccgugagcuacagcggcgugcuguacaucaccgagaccgacgagaagaagaucaacagaaucagacaggugaccaccgacggcgagaucagccugguggccggcauccccagcgagugcgacugcaagaacgacgccaacugcgacugcuaccagagcggcgacggcuacgccaaggacgccaagcugagcgcccccagcagccuggccgccagccccgacggcacccuguacaucgccgaccugggcaacaucagaaucagagccgugagcaagaacaagccccugcugaacagcaugaacuucuacgagguggccagccccaccgaccaggagcuguacaucuucgacaucaacggcacccaccaguacaccgugagccuggugaccggcgacuaccuguacaacuucagcuacagcaacgacaacgacaucaccgccgugaccgacagcaacggcaacacccugagaaucagaagagaccccaacagaaugcccgugagaguggugagccccgacaaccaggugaucuggcugaccaucggcaccaacggcugccugaagagcaugaccgcccagggccuggagcuggugcuguucaccuaccacggcaacagcggccugcuggccaccaagagcgacgagaccggcuggaccaccuucuucgacuacgacagcgagggcagacugaccaacgugaccuuccccaccggcguggugaccaaccugcacggcgacauggacaaggccaucaccguggacaucgagagcagcagcagagaggaggacgugagcaucaccagcaaccugagcagcaucgacagcuucuacaccauggugcaggaccagcugagaaacagcuaccagaucggcuacgacggcagccugagaaucaucuacgccagcggccuggacagccacuaccagaccgagccccacgugcuggccggcaccgccaaccccaccguggccaagagaaacaugacccugcccggcgagaacggccagaaccugguggaguggagauucagaaaggagcaggcccagggcaaggugaacguguucggcagaaagcugagagugaacggcagaaaccugcugagcguggacuucgacagaaccaccaagaccgagaagaucuacgacgaccacagaaaguuccugcugagaaucgccuacgacaccagcggccaccccacccuguggcugcccagcagcaagcugauggccgugaacgugaccuacagcagcaccggccagaucgccagcauccagagaggcaccaccagcgagaagguggacuacgacggccagggcagaaucgugagcagaguguucgccgacggcaagaccuggagcuacaccuaccuggagaagagcauggugcugcugcugcacagccagagacaguacaucuucgaguacgacaugugggacagacugagcgccaucaccaugcccagcguggccagacacaccaugcagaccaucagaagcaucggcuacuacagaaacaucuacaacccccccgagagcaacgccagcaucaucaccgacuacaacgaggagggccugcugcugcagaccgccuuccugggcaccagcagaagagugcuguucaaguacagaagacagaccagacugagcgagauccuguacgacagcaccagagugagcuucaccuacgacgagaccgccggcgugcugaagaccgugaaccugcagagcgacggcuucaucugcaccaucagauacagacagaucggcccccugaucgacagacagaucuucagauucagcgaggacggcauggugaacgccagauucgacuacagcuacgacaacagcuucagagugaccagcaugcagggcgugaucaacgagaccccccugcccaucgaccuguaccaguucgacgacaucagcggcaagguggagcaguucggcaaguucggcgugaucuacuacgacaucaaccagaucaucagcaccgccgugaugaccuacaccaagcacuucgacgcccacggcagaaucaaggagauccaguacgagaucuucagaagccugauguacuggaucaccauccaguacgacaacaugggcagagugaccaagagagagaucaagaucggccccuucgccaacaccaccaaguacgccuacgaguacgacguggacggccagcugcagaccguguaccugaacgagaagaucauguggagauacaacuacgaccugaacggcaaccugcaccugcugaaccccagcaacagcgccagacugaccccccugagauacgaccugagagacagaaucaccagacugggcgacgugcaguacagacuggacgaggacggcuuccugagacagagaggcaccgagaucuucgaguacagcagcaagggccugcugaccagaguguacagcaagggcagcggcuggaccgugaucuacagauacgacggccugggcagaagagugagcagcaagaccagccugggccagcaccugcaguucuucuacgccgaccugaccuaccccaccagaaucacccacguguacaaccacagcagcagcgagaucaccagccuguacuacgaccugcagggccaccuguucgccauggagaucagcagcggcgacgaguucuacaucgccagcgacaacaccggcaccccccuggccguguucagcagcaacggccugaugcugaagcagauccaguacaccgccuacggcgagaucuacuucgacagcaacaucgacuuccagcuggugaucggcuuccacggcggccuguacgacccccugaccaagcugauccacuucggcgagagagacuacgacauccuggccggcagauggaccacccccgacaucgagaucuggaagagaaucggcaaggaccccgcccccuucaaccuguacauguucagaaacaacaaccccgccagcaagauccacgacgugaaggacuacaucaccgacgugaacagcuggcuggugaccuucggcuuccaccugcacaacgccauccccggcuuccccgugcccaaguucgaccugaccgagcccagcuacgagcuggugaagagccagcagugggacgacaucccccccaucuucggcgugcagcagcagguggccagacaggccaaggccuuccugagccugggcaagauggccgaggugcaggugagcagaagaagagccggcggcgcccagagcuggcugugguucgccaccgugaagagccugaucggcaagggcgugaugcuggccgugagccagggcagagugcagaccaacgugcugaacaucgccaacgaggacugcaucaagguggccgccgugcugaacaacgccuucuaccuggagaaccugcacuucaccaucgagggcaaggacacccacuacuucaucaagaccaccacccccgagagcgaccugggcacccugagacugaccagcggcagaaaggcccuggagaacggcaucaacgugaccgugagccagagcaccaccguggugaacggcagaaccagaagauucgccgacguggagaugcaguucggcgcccuggcccugcacgugagauacggcaugacccuggacgaggagaaggccagaauccuggagcaggccagacagagagcccuggccagagccugggccagagagcagcagagagugagagacggcgaggagggcgccagacuguggaccgagggcgagaagagacagcugcugagcgccggcaaggugcagggcuacgacggcuacuacgugcugagcguggagcaguaccccgagcuggccgacagcgccaacaacauccaguuccugagacagagcgagaucggcagaagauaa

SEQ ID NO: 24508 - RNA, 8310 nt, Artificial Sequence
  TENM4__Homo_sapiens__NP_001092286
auggacgugaaggagagaaagcccuacagaagccugaccagaagaagagacgccgagagaagauacaccagcagcagcgccgacagcgaggagggcaaggccccccagaagagcuacagcagcagcgagacccugaaggccuacgaccaggacgccagacuggccuacggcagcagagugaaggacaucgugccccaggaggccgaggaguucugcagaaccggcgccaacuucacccugagagagcugggccuggaggaggugacccccccccacggcacccuguacagaaccgacaucggccugccccacugcggcuacagcaugggcgccggcagcgacgccgacauggaggccgacaccgugcugagccccgagcaccccgugagacuguggggcagaagcaccagaagcggcagaagcagcugccugagcagcagagccaacagcaaccugacccugaccgacaccgagcacgagaacaccgagaccgaccaccccggcggccugcagaaccacgccagacugagaacccccccccccccccugagccacgcccacacccccaaccagcaccacgccgccagcaucaacagccugaacagaggcaacuucacccccagaagcaaccccagccccgcccccaccgaccacagccugagcggcgagccccccgccggcggcgcccaggagcccgcccacgcccaggagaacuggcugcugaacagcaacaucccccuggagaccagaaaccugggcaagcagcccuuccugggcacccugcaggacaaccugaucgagauggacauccugggcgccagcagacacgacggcgccuacagcgacggccacuuccuguucaagcccggcggcaccagcccccuguucugcaccaccagccccggcuacccccugaccagcagcaccguguacagccccccccccagaccccugcccagaagcaccuucgccagacccgccuucaaccugaagaagcccagcaaguacugcaacuggaagugcgccgcccugagcgccaucgugaucagcgccacccuggugauccugcuggccuacuucguggccaugcaccuguucggccugaacuggcaccugcagcccauggagggccagauguacgagaucaccgaggacaccgccagcagcuggcccgugcccaccgacgugagccuguaccccagcggcggcaccggccuggagacccccgacagaaagggcaagggcaccaccgagggcaagcccagcagcuucuuccccgaggacagcuucaucgacagcggcgagaucgacgugggcagaagagccagccagaagaucccccccggcaccuucuggagaagccagguguucaucgaccaccccgugcaccugaaguucaacgugagccugggcaaggccgcccuggugggcaucuacggcagaaagggccugccccccagccacacccaguucgacuucguggagcugcuggacggcagaagacugcugacccaggaggccagaagccuggagggcacccccagacagagcagaggcaccgugccccccagcagccacgagaccggcuucauccaguaccuggacagcggcaucuggcaccuggccuucuacaacgacggcaaggagagcgagguggugagcuuccugaccaccgccaucgagagcguggacaacugccccagcaacugcuacggcaacggcgacugcaucagcggcaccugccacugcuuccugggcuuccugggccccgacugcggcagagccagcugccccgugcugugcagcggcaacggccaguacaugaagggcagaugccugugccacagcggcuggaagggcgccgagugcgacgugcccaccaaccagugcaucgacguggccugcagcaaccacggcaccugcaucaccggcaccugcaucugcaaccccggcuacaagggcgagagcugcgaggagguggacugcauggaccccaccugcagcggcagaggcgugugcgugagaggcgagugccacugcagcgugggcuggggcggcaccaacugcgagacccccagagccaccugccuggaccagugcagcggccacggcaccuuccugcccgacaccggccugugcagcugcgaccccagcuggaccggccacgacugcagcaucgagaucugcgccgccgacugcggcggccacggcgugugcgugggcggcaccugcagaugcgaggacggcuggaugggcgccgccugcgaccagagagccugccaccccagaugcgccgagcacggcaccugcagagacggcaagugcgagugcagccccggcuggaacggcgagcacugcaccaucgcccacuaccuggacagaguggugaaggagggcugccccggccugugcaacggcaacggcagaugcacccuggaccugaacggcuggcacugcgugugccagcugggcuggagaggcgccggcugcgacaccagcauggagaccgccugcggcgacagcaaggacaacgacggcgacggccugguggacugcauggaccccgacugcugccugcagccccugugccacaucaacccccugugccugggcagccccaacccccuggacaucauccaggagacccaggugcccgugagccagcagaaccugcacagcuucuacgacagaaucaaguuccuggugggcagagacagcacccacaucauccccggcgagaaccccuucgacggcggccacgccugcgugaucagaggccaggugaugaccagcgacggcaccccccuggugggcgugaacaucagcuucgugaacaacccccuguucggcuacaccaucagcagacaggacggcagcuucgaccuggugaccaacggcggcaucagcaucauccugagauucgagagagcccccuucaucacccaggagcacacccuguggcugcccugggacagauucuucgugauggagaccaucaucaugagacacgaggagaacgagauccccagcugcgaccugagcaacuucgccagacccaaccccguggugagccccagcccccugaccagcuucgccagcagcugcgccgagaagggccccaucgugcccgagauccaggcccugcaggaggagaucagcaucagcggcugcaagaugagacugagcuaccugagcagcagaacccccggcuacaagagcgugcugagaaucagccugacccaccccaccauccccuucaaccugaugaaggugcaccugaugguggccguggagggcagacuguucagaaagugguucgccgccgcccccgaccugagcuacuacuucaucugggacaagaccgacguguacaaccagaagguguucggccugagcgaggccuucgugagcgugggcuacgaguacgagagcugccccgaccugauccugugggagaagagaaccaccgugcugcagggcuacgagaucgacgccagcaagcugggcggcuggagccuggacaagcaccacgcccugaacauccagagcggcauccugcacaagggcaacggcgagaaccaguucgugagccagcagccccccgugaucggcagcaucaugggcaacggcagaagaagaagcaucagcugccccagcugcaacggccuggccgacggcaacaagcugcuggcccccguggcccugaccugcggcagcgacggcagccuguacgugggcgacuucaacuacaucagaagaaucuuccccagcggcaacgugaccaacauccuggagcugagaaacaaggacuucagacacagccacagccccgcccacaaguacuaccuggccaccgaccccaugagcggcgccguguuccugagcgacagcaacagcagaagaguguucaagaucaagagcaccgugguggugaaggaccuggugaagaacagcgaggugguggccggcaccggcgaccagugccugcccuucgacgacaccagaugcggcgacggcggcaaggccaccgaggccacccugaccaaccccagaggcaucaccguggacaaguucggccugaucuacuucguggacggcaccaugaucagaagaaucgaccagaacggcaucaucagcacccugcugggcagcaacgaccugaccagcgccagaccccugagcugcgacagcgugauggacaucagccaggugcaccuggaguggcccaccgaccuggccaucaaccccauggacaacagccuguacgugcuggacaacaacguggugcugcagaucagcgagaaccaccaggugagaaucguggccggcagacccaugcacugccaggugcccggcaucgaccacuuccugcugagcaagguggccauccacgccacccuggagagcgccaccgcccuggccgugagccacaacggcgugcuguacaucgccgagaccgacgagaagaagaucaacagaaucagacaggugaccaccagcggcgagaucagccugguggccggcgcccccagcggcugcgacugcaagaacgacgccaacugcgacugcuucagcggcgacgacggcuacgccaaggacgccaagcugaacacccccagcagccuggccgugugcgccgacggcgagcuguacguggccgaccugggcaacaucagaaucagauucaucagaaagaacaagcccuuccugaacacccagaacauguacgagcugagcagccccaucgaccaggagcuguaccuguucgacaccaccggcaagcaccuguacacccagagccugcccaccggcgacuaccuguacaacuucaccuacaccggcgacggcgacaucacccugaucaccgacaacaacggcaacauggugaacgugagaagagacagcaccggcaugccccuguggcugguggugcccgacggccagguguacugggugaccaugggcaccaacagcgcccugaagagcgugaccacccagggccacgagcuggccaugaugaccuaccacggcaacagcggccugcuggccaccaagagcaacgagaacggcuggaccaccuucuacgaguacgacagcuucggcagacugaccaacgugaccuuccccaccggccaggugagcagcuucagaagcgacaccgacagcagcgugcacgugcagguggagaccagcagcaaggacgacgugaccaucaccaccaaccugagcgccagcggcgccuucuacacccugcugcaggaccaggugagaaacagcuacuacaucggcgccgacggcagccugagacugcugcuggccaacggcauggagguggcccugcagaccgagccccaccugcuggccggcaccgugaaccccaccgugggcaagagaaacgugacccugcccaucgacaacggccugaaccugguggaguggagacagagaaaggagcaggccagaggccaggugaccguguucggcagaagacugagagugcacaacagaaaccugcugagccuggacuucgacagagugaccagaaccgagaagaucuacgacgaccacagaaaguucacccugagaauccuguacgaccaggccggcagacccagccuguggagccccagcagcagacugaacggcgugaacgugaccuacagccccggcggcuacaucgccggcauccagagaggcaucaugagcgagagaauggaguacgaccaggccggcagaaucaccagcagaaucuucgccgacggcaagaccuggagcuacaccuaccuggagaagagcauggugcugcugcugcacagccagagacaguacaucuucgaguucgacaagaacgacagacugagcagcgugaccaugcccaacguggccagacagacccuggagaccaucagaagcgugggcuacuacagaaacaucuaccagccccccgagggcaacgccagcgugauccaggacuucaccgaggacggccaccugcugcacaccuucuaccugggcaccggcagaagagugaucuacaaguacggcaagcugagcaagcuggccgagacccuguacgacaccaccaaggugagcuucaccuacgacgagaccgccggcaugcugaagaccaucaaccugcagaacgagggcuucaccugcaccaucagauacagacagaucggcccccugaucgacagacagaucuucagauucaccgaggagggcauggugaacgccagauucgacuacaacuacgacaacagcuucagagugaccagcaugcaggccgugaucaacgagaccccccugcccaucgaccuguacagauacgacgacgugagcggcaagaccgagcaguucggcaaguucggcgugaucuacuacgacaucaaccagaucaucaccaccgccgugaugacccacaccaagcacuucgacgccuacggcagaaugaaggaggugcaguacgagaucuucagaagccugauguacuggaugaccgugcaguacgacaacaugggcagaguggugaagaaggagcugaaggugggccccuacgccaacaccaccagauacagcuacgaguacgacgccgacggccagcugcagaccgugagcaucaacgacaagccccuguggagauacagcuacgaccugaacggcaaccugcaccugcugagccccggcaacagcgccagacugaccccccugagauacgacaucagagacagaaucaccagacugggcgacgugcaguacaagauggacgaggacggcuuccugagacagagaggcggcgacaucuucgaguacaacagcgccggccugcugaucaaggccuacaacagagccggcagcuggagcgugagauacagauacgacggccugggcagaagagugagcagcaagagcagccacagccaccaccugcaguucuucuacgccgaccugaccaaccccaccaaggugacccaccuguacaaccacagcagcagcgagaucaccagccuguacuacgaccugcagggccaccuguucgccauggagcugagcagcggcgacgaguucuacaucgccugcgacaacaucggcaccccccuggccguguucagcggcaccggccugaugaucaagcagauccuguacaccgccuacggcgagaucuacauggacaccaaccccaacuuccagaucaucaucggcuaccacggcggccuguacgacccccugaccaagcuggugcacaugggcagaagagacuacgacgugcuggccggcagauggaccagccccgaccacgagcuguggaagcaccugagcagcagcaacgugaugcccuucaaccuguacauguucaagaacaacaaccccaucagcaacagccaggacaucaagugcuucaugaccgacgugaacagcuggcugcugaccuucggcuuccagcugcacaacgugauccccggcuaccccaagcccgacauggacgccauggagcccagcuacgagcugauccacacccagaugaagacccaggagugggacaacagcaagagcauccugggcgugcagugcgaggugcagaagcagcugaaggccuucgugacccuggagagauucgaccagcuguacggcagcaccaucaccagcugccagcaggcccccaagaccaagaaguucgccagcagcggcagcguguucggcaagggcgugaaguucgcccugaaggacggcagagugaccaccgacaucaucagcguggccaacgaggacggcagaagaguggccgccauccugaaccacgcccacuaccuggagaaccugcacuucaccaucgacggcguggacacccacuacuucgugaagcccggccccagcgagggcgaccuggccauccugggccugagcggcggcagaagaacccuggagaacggcgugaacgugaccgugagccagaucaacaccgugcugaacggcagaaccagaagauacaccgacauccagcugcaguacggcgcccugugccugaacaccagauacggcaccacccuggacgaggagaaggccagagugcuggagcuggccagacagagagccgugagacaggccugggccagagagcagcagagacugagagagggcgaggagggccugagagccuggaccgagggcgagaagcagcaggugcugagcaccggcagagugcagggcuacgacggcuucuucgugaucagcguggagcaguaccccgagcugagcgacagcgccaacaacauccacuucaugagacagagcgagaugggcagaagauaa

SEQ ID NO: 24509 - RNA, 7884 nt, Artificial Sequence
  TEP1__Homo_sapiens__XP_005268084
auggagaagcugcacggccacgugagcgcccaccccgacauccugagccuggagaacagaugccuggccaugcugcccgaccugcagccccuggagaagcugcaccagcacgugagcacccacagcgacauccugagccugaagaaccagugccuggccacccugcccgaccugaagaccauggagaagccccacggcuacgugagcgcccaccccgacauccugagccuggagaaccagugccuggccacccugagcgaccugaagaccauggagaagccccacggccacgugagcgcccaccccgacauccugagccuggagaacagaugccuggccacccugagcagccugaagagcaccgugagcgccagcccccuguuccagagccugcagaucagccacaugacccaggccgaccuguacagagugaacaacagcaacugccugcugagcgagccccccagcuggagagcccagcacuucagcaagggccuggaccugagcaccugccccaucgcccugaagagcaucagcgccaccgagaccgcccaggaggccacccugggcagaugguucgacagcgaggagaagaagggcgccgagacccagaugcccagcuacagccugagccugggcgaggaggaggagguggaggaccuggccgugaagcugaccagcggcgacagcgagagccaccccgagcccaccgaccacgugcugcaggagaagaagauggcccugcugagccugcugugcagcacccuggugagcgaggugaacaugaacaacaccagcgaccccacccuggccgccaucuucgagaucugcagagagcuggcccugcuggagcccgaguucauccugaaggccagccuguacgccagacagcagcugaacgugagaaacguggccaacaacauccuggccaucgccgccuuccugcccgccugcagaccccaccugagaagauacuucugcgccaucgugcagcugcccagcgacuggauccagguggccgagcuguaccagagccuggccgagggcgacaagaacaagcuggugccccugcccgccugccugagaaccgccaugaccgacaaguucgcccaguucgacgaguaccagcuggccaaguacaaccccagaaagcacagagccaagagacaccccagaagaccccccagaagccccggcauggagccccccuucagccacagaugcuuccccagauacaucggcuuccugagagaggagcagagaaaguucgagaaggccggcgacaccgugagcgagaagaagaacccccccagauucacccugaagaagcuggugcagagacugcacauccacaagcccgcccagcacgugcaggcccugcugggcuacagauaccccagcaaccugcagcuguucagcagaagcagacugcccggccccugggacagcagcagagccggcaagagaaugaagcugagcagacccgagaccugggagagagagcugagccugagaggcaacaaggccagcgugugggaggagcugaucgagaacggcaagcugcccuucauggccaugcugagaaaccugugcaaccugcugagagugggcaucagcagcagacaccacgagcugauccugcagagacugcagcacgccaagagcgugauccacagcagacaguuccccuucagauuccugaacgcccacgacgccaucgacgcccuggaggcccagcugagaaaccaggcccugcccuuccccagcaacaucacccugaugagaagaauccugaccagaaacgagaagaacagacccagaagaagauuccugugccaccugagcagacagcagcugagaauggccaugagaauccccgugcuguacgagcagcugaagagagagaagcugagagugcacaaggccagacaguggaaguacgacggcgagaugcugaacagauacagacaggcccuggagaccgccgugaaccugagcgugaagcacagccugccccugcugcccggcagaaccgugcugguguaccugaccgacgccaacgccgacagacugugccccaagagcaacccccagggccccccccugaacuacgcccugcugcugaucggcaugaugaucaccagagccgagcagguggacguggugcugugcggcggcgacacccugaagaccgccgugcugaaggccgaggagggcauccugaagaccgccaucaagcugcaggcccaggugcaggaguucgacgagaacgacggcuggagccugaacaccuucggcaaguaccugcugagccuggccggccagagagugcccguggacagagugauccugcugggccagagcauggacgacggcaugaucaacguggccaagcagcuguacuggcagagagugaacagcaagugccuguucgugggcauccugcugagaagagugcaguaccugagcaccgaccugaaccccaacgacgugacccugagcggcugcaccgacgccauccugaaguucaucgccgagcacggcgccagccaccugcuggagcacgugggccagauggacaagaucuucaagaucccccccccccccggcaagaccggcgugcagagccugagaccccuggaggaggacacccccagcccccuggcccccgugagccagcagggcuggagaagcaucagacuguucaucagcagcaccuucagagacaugcacggcgagagagaccugcugcugagaagcgugcugcccgcccugcaggccagagccgccccccacagaaucagccugcacggcaucgaccugagauggggcgugaccgaggaggagaccagaagaaacagacagcuggaggugugccugggcgagguggagaacgcccagcuguucgugggcauccugggcagcagauacggcuacaucccccccagcuacaaccugcccgaccacccccacuuccacugggcccagcaguaccccagcggcagaagcgugaccgagauggaggugaugcaguuccugaacagaaaccagagacugcagcccagcgcccaggcccugaucuacuucagagacagcagcuuccugagcagcgugcccgacgccuggaagagcgacuucgugagcgagagcgaggaggccgccagaagaaucagcgagcugaagagcuaccugagcagacagaagggcaucaccugcagaagauaccccugcgaguggggcggcguggccgccggcagacccuacgugggcggccuggaggaguucggccagcuggugcugcaggacguguggaacaugauccagaagcuguaccugcagcccggcgcccugcuggagcagcccgugagcauccccgacgacgaccuggugcaggccaccuuccagcagcugcagaagccccccagccccgccagacccagacugcugcaggacaccgugcagagacugaugcugccccacggcagacugagccuggugaccggccagagcggccagggcaagaccgccuuccuggccagccuggugagcgcccugcaggcccccgacggcgccaagguggccagccugguguucuuccacuucagcggcgccagacccgaccagggccuggcccugacccugcugagaagacugugcaccuaccugagaggccagcugaaggagcccggcgcccugcccagcaccuacagaagccuggugugggagcugcagcagagacugcugcccaagagcgccgagagccugcaccccggccagacccaggugcugaucaucgacggcgccgacagacugguggaccagaacggccagcugaucagcgacuggauccccaagaagcugcccagaugcgugcaccuggugcugagcgugagcagcgacgccggccugggcgagacccuggagcagagccagggcgcccacgugcuggcccugggcccccuggaggccagcgccagagccagacuggugagagaggagcuggcccuguacggcaagagacuggaggagagccccuucaacaaccagaugagacugcugcuggugaagagagagagcggcagaccccuguaccugagacuggugaccgaccaccugagacuguucacccuguacgagcaggugagcgagagacugagaacccugcccgccaccgugccccugcugcugcagcacauccugagcacccuggagaaggagcacggccccgacgugcugccccaggcccugaccgcccuggaggugaccagaagcggccugaccguggaccagcugcacggcgugcugagcguguggagaacccugcccaagggcaccaagagcugggaggaggccguggccgccggcaacagcggcgaccccuaccccaugggccccuucgccugccuggugcagagccugagaagccugcugggcgagggcccccuggagagacccggcgccagacugugccugcccgacggcccccugagaaccgccgccaagagaugcuacggcaagagacccggccuggaggacaccgcccacauccugaucgccgcccagcuguggaagaccugcgacgccgacgccagcggcaccuucagaagcugcccccccgaggcccugggcgaccugcccuaccaccugcugcagagcggcaacagaggccugcugagcaaguuccugaccaaccugcacgugguggccgcccaccuggagcugggccuggugagcagacugcuggaggcccacgcccuguacgccagcagcgugcccaaggaggagcagaagcugcccgaggccgacguggccguguucagaaccuuccugagacagcaggccagcauccugagccaguaccccagacugcugccccagcaggccgccaaccagccccuggacagcccccugugccaccaggccagccugcugagcagaagauggcaccugcagcacacccugagauggcugaacaagcccagaaccaugaagaaccagcagagcagcagccugagccuggccgugagcagcagccccaccgccguggccuucagcaccaacggccagagagccgccgugggcaccgccaacggcaccguguaccugcuggaccugagaaccuggcaggaggagaagagcguggugagcggcugcgacggcaucagcgccugccuguuccugagcgacgacacccuguuccugaccgccuucgacggccugcuggagcugugggaccugcagcacggcugcagagugcugcagaccaaggcccaccaguaccagaucaccggcugcugccugagccccgacugcagacugcuggccaccgugugccugggcggcugccugaagcugugggacaccgugagaggccagcuggccuuccagcacaccuaccccaagagccugaacugcguggccuuccaccccgagggccaggugaucgccaccggcagcugggccggcagcaucagcuucuuccagguggacggccugaaggugaccaaggaccugggcgcccccggcgccagcaucagaacccuggccuucaacgugcccggcggcgugguggccgugggcagacuggacagcaugguggagcugugggccuggagagagggcgccagacuggccgccuuccccgcccaccacggcuucguggccgccgcccuguuccugcacgccggcugccagcugcugaccgccggcgaggacggcaaggugcagguguggagcggcagccugggcagacccagaggccaccugggcagccugagccugagccccgcccugagcguggcccugagccccgacggcgacagaguggccgugggcuacagagccgacggcaucagaaucuacaagaucagcagcggcagccagggcgcccagggccaggcccuggacguggccgugagcgcccuggccuggcugagccccaaggugcuggugagcggcgccgaggacggcagccugcagggcugggcccugaaggagugcagccugcagagccuguggcugcugagcagauuccagaagcccgugcugggccuggccaccagccaggagcugcuggccagcgccagcgaggacuucaccgugcagcuguggcccagacagcugcugaccagaccccacaaggccgaggacuuccccugcggcaccgagcugagaggccacgagggccccgugagcugcugcagcuucagcaccgacggcggcagccuggccaccggcggcagagacagaagccugcugugcugggacgugagaacccccaagacccccgugcugauccacagcuuccccgccugccacagagacugggugaccggcugcgccuggaccaaggacaaccugcugaucagcugcagcagcgacggcagcgugggccugugggaccccgagagcggccagagacugggccaguuccugggccaccagagcgccgugagcgccguggccgccguggaggagcacguggugagcgugagcagagacggcacccugaaggugugggaccaccagggcguggagcugaccagcauccccgcccacagcggccccaucagccacugcgccgccgccauggagcccagagccgccggccagcccggcagcgagcugcugguggugaccgugggccuggacggcgccaccagacuguggcacccccugcuggugugccagacccacacccugcugggccacagcggccccgugagagccgccgccgugagcgagaccagcggccugaugcugaccgccagcgaggacggcagcgugagacuguggcaggugcccaaggaggccgacgacaccugcauccccagaagcagcgccgccgugaccgccguggccugggcccccgacggcagcauggccgugagcggcaaccaggccggcgagcugauccuguggcaggaggccaaggccguggccaccgcccaggcccccggccacaucggcgcccugaucuggagcagcgcccacaccuucuucgugcugagcgccgacgagaagaucagcgaguggcaggugaagcugagaaagggcagcgcccccggcaaccugagccugcaccugaacagaauccugcaggaggaccugggcgugcugaccagccuggacugggcccccgacggccacuuccugauccuggccaaggccgaccugaagcugcugugcaugaagcccggcgacgcccccagcgagaucuggagcagcuacaccgagaaccccaugauccugagcacccacaaggaguacggcaucuucgugcugcagcccaaggaccccggcgugcugagcuuccugagacagaaggagagcggcgaguucgaggagagacugaacuucgacaucaaccuggagaaccccagcagaacccugaucagcaucacccaggccaagcccgagagcgagagcagcuuccugugcgccagcagcgacggcauccuguggaaccuggccaagugcagccccgagggcgaguggaccaccggcaacauguggcagaagaaggccaacacccccgagacccagacccccggcaccgaccccagcaccugcagagagagcgacgccagcauggacagcgacgccagcauggacagcgagcccaccccccaccugaagaccagacagagaagaaagauccacagcggcagcgugaccgcccugcacgugcugcccgagcugcuggugaccgccagcaaggacagagacgugaagcugugggagagacccagcaugcagcugcugggccuguucagaugcgagggcagcgugagcugccuggagcccuggcugggcgccaacagcacccugcagcuggccgugggcgacgugcagggcaacguguacuuccugaacugggaguaa

SEQ ID NO: 24510 - RNA, 897 nt, Artificial Sequence
  TEPP__Homo_sapiens__NP_950247
augggcaucgugugcgcccagugcagcuucauccugcugcugagcaucaucagagccagacccccccccuuccuguucugcccccugagcagccagagaaccgagagccccuacaagcccgugcaccugggccugggccccaccgacaagguggccgccaucgccauggccagaaucaucgaccuggugcccugggacgacggcagcacccacguguacgccagccccgccauccugcugcccauggagagacagagaaaccagcuggccggcgugaagcagcagcuguaccaccccgcccugcccacccugagacacauggacagagacaccgugaaggccugccugcccgacgagcacugccagagcaccaccuacugcagaaaggacgaguucgacaacgcccacuucacccugcugggcgugcccaacaagccccugcagugccuggacaucaccgccaccggccagaagcugagaaacagauaccacgagggcaagcuggcccccaucgcccccggcaucaacagaguggacuggcccugcuucaccagagccaucgaggacuggagccacuucgugagcagcgccggcgaguucaagcugcccugccugagaaagagagccgagggccugagcggcuacgccgugagauaccugaagcccgacgugacccagaccuggagacaggaggcccugugcggcgccugggccggcagacccugcagccccgacagccccagacccuaccccugcugccccccccaguacugccugagccagaaccccagccuggacagauacggccagaagccccugcccuucgacagccugaacaccuucagaagcuucggcagcagcuacagcagagugaacuaccugacccccuggcacuaa

SEQ ID NO: 24511 - RNA, 1260 nt, Artificial Sequence
  TERF1__Homo_sapiens__NP_003209
auggccgaggacgugagcagcgccgcccccagccccagaggcugcgccgacggcagagacgccgaccccaccgaggagcagauggccgagaccgagagaaacgacgaggagcaguucgagugccaggagcugcuggagugccaggugcaggugggcgcccccgaggaggaggaggaggaggaggaggacgccggccugguggccgaggccgaggccguggccgccggcuggaugcuggacuuccugugccugagccugugcagagccuucagagacggcagaagcgaggacuucagaagaaccagaaacagcgccgaggccaucauccacggccugagcagccugaccgccugccagcugagaaccaucuacaucugccaguuccugaccagaaucgccgccggcaagacccuggacgcccaguucgagaacgacgagagaaucaccccccuggagagcgcccugaugaucuggggcagcaucgagaaggagcacgacaagcugcacgaggagauccagaaccugaucaagauccaggccaucgccgugugcauggagaacggcaacuucaaggaggccgaggagguguucgagagaaucuucggcgaccccaacagccacaugcccuucaagagcaagcugcugaugaucaucagccagaaggacaccuuccacagcuucuuccagcacuucagcuacaaccacaugauggagaagaucaagagcuacgugaacuacgugcugagcgagaagagcagcaccuuccugaugaaggccgccgccaaggugguggagagcaagagaaccagaaccaucaccagccaggacaagcccagcggcaacgacguggagauggagaccgaggccaaccuggacaccagaaagagaagccacaagaaccuguuccugagcaagcugcagcacggcacccagcagcaggaccugaacaagaaggagagaagagugggcaccccccagagcaccaagaagaagaaggagagcagaagagccaccgagagcagaauccccgugagcaagagccagcccgugacccccgagaagcacagagccagaaagagacaggccuggcugugggaggaggacaagaaccugagaagcggcgugagaaaguacggcgagggcaacuggagcaagauccugcugcacuacaaguucaacaacagaaccagcgugaugcugaaggacagauggagaaccaugaagaagcugaagcugaucagcagcgacagcgaggacuaa

SEQ ID NO: 24512 - RNA, 1629 nt, Artificial Sequence
  TERF2__Homo_sapiens__NP_005643
auggccgccggcgccggcaccgccggccccgccagcggccccggcguggugagagaccccgccgccagccagcccagaaagagacccggcagagagggcggcgagggcgccagaagaagcgacaccauggccggcggcggcggcagcagcgacggcagcggcagagccgccggcagaagagccagcagaagcagcggcagagccagaagaggcagacacgagcccggccugggcggccccgccgagagaggcgccggcgaggccagacuggaggaggccgugaacagaugggugcugaaguucuacuuccacgaggcccugagagccuucagaggcagcagauacggcgacuucagacagaucagagacaucaugcaggcccugcuggugagaccccugggcaaggagcacaccgugagcagacugcugagagugaugcagugccugagcagaaucgaggagggcgagaaccuggacugcagcuucgacauggaggccgagcugaccccccuggagagcgccaucaacgugcuggagaugaucaagaccgaguucacccugaccgaggccgugguggagagcagcagaaagcuggugaaggaggccgccgugaucaucugcaucaagaacaaggaguucgagaaggccagcaagauccugaagaagcacaugagcaaggaccccaccacccagaagcugagaaacgaccugcugaacaucaucagagagaagaaccuggcccaccccgugauccagaacuucagcuacgagaccuuccagcagaagaugcugagauuccuggagagccaccuggacgacgccgagcccuaccugcugaccauggccaagaaggcccugaagagcgagagcgccgccagcagcaccggcaaggaggacaagcagcccgcccccggccccguggagaagccccccagagagcccgccagacagcugagaaacccccccaccaccaucggcaugaugacccugaaggccgccuucaagacccugagcggcgcccaggacagcgaggccgccuucgccaagcuggaccagaaggaccuggugcugcccacccaggcccugcccgccagccccgcccugaagaacaagagacccagaaaggacgagaacgagagcagcgcccccgccgacggcgagggcggcagcgagcugcagcccaagaacaagagaaugaccaucagcagacuggugcuggaggaggacagccagagcaccgagcccagcgccggccugaacagcagccaggaggccgccagcgccccccccagcaagcccaccgugcugaaccagccccugcccggcgagaagaaccccaaggugcccaagggcaaguggaacagcagcaacggcguggaggagaaggagaccuggguggaggaggacgagcuguuccaggugcaggccgcccccgacgaggacagcaccaccaacaucaccaagaagcagaaguggaccguggaggagagcgagugggugaaggccggcgugcagaaguacggcgagggcaacugggccgccaucagcaagaacuaccccuucgugaacagaaccgccgugaugaucaaggacagauggagaaccaugaagagacugggcaugaacuaa

SEQ ID NO: 24513 - RNA, 1200 nt, Artificial Sequence
  TERF2IP__Homo_sapiens__NP_061848
auggccgaggccauggaccugggcaaggaccccaacggccccacccacagcagcacccuguucgugagagacgacggcagcagcaugagcuucuacgugagacccagccccgccaagagaagacugagcacccugauccugcacggcggcggcaccgugugcagagugcaggagcccggcgccgugcugcuggcccagcccggcgaggcccuggccgaggccagcggcgacuucaucagcacccaguacauccuggacugcguggagagaaacgagagacuggagcuggaggccuacagacugggccccgccagcgccgccgacaccggcagcgaggccaagcccggcgcccuggccgagggcgccgccgagcccgagccccagagacacgccggcagaaucgccuucaccgacgccgacgacguggccauccugaccuacgugaaggagaacgccagaagccccagcagcgugaccggcaacgcccuguggaaggccauggagaagagcagccugacccagcacagcuggcagagccugaaggacagauaccugaagcaccugagaggccaggagcacaaguaccugcugggcgacgcccccgugagccccagcagccagaagcugaagagaaaggccgaggaggaccccgaggccgccgacagcggcgagccccagaacaagagaacccccgaccugcccgaggaggaguacgugaaggaggagauccaggagaacgaggaggccgugaagaagaugcugguggaggccaccagagaguucgaggagguggugguggacgagagcccccccgacuucgagauccacaucaccaugugcgacgacgacccccccacccccgaggaggacagcgagacccagcccgacgaggaggaggaggaggaggaggagaaggugagccagcccgaggugggcgccgccaucaagaucaucagacagcugauggagaaguucaaccuggaccugagcaccgugacccaggccuuccugaagaacagcggcgagcuggaggccaccagcgccuuccuggccagcggccagagagccgacggcuaccccaucuggagcagacaggacgacaucgaccugcagaaggacgacgaggacaccagagaggcccuggugaagaaguucggcgcccagaacguggccagaagaaucgaguucagaaagaaguaa

SEQ ID NO: 24514 - RNA, 3210 nt, Artificial Sequence
  TERT__Homo_sapiens__NP_001180305
augcccagagcccccagaugcagagccgugagaagccugcugagaagccacuacagagaggugcugccccuggccaccuucgugagaagacugggcccccagggcuggagacuggugcagagaggcgaccccgccgccuucagagcccugguggcccagugccuggugugcgugcccugggacgccagacccccccccgccgcccccagcuucagacaggugagcugccugaaggagcugguggccagagugcugcagagacugugcgagagaggcgccaagaacgugcuggccuucggcuucgcccugcuggacggcgccagaggcggcccccccgaggccuucaccaccagcgugagaagcuaccugcccaacaccgugaccgacgcccugagaggcagcggcgccuggggccugcugcugagaagagugggcgacgacgugcuggugcaccugcuggccagaugcgcccuguucgugcugguggcccccagcugcgccuaccaggugugcggccccccccuguaccagcugggcgccgccacccaggccagaccccccccccacgccagcggccccagaagaagacugggcugcgagagagccuggaaccacagcgugagagaggccggcgugccccugggccugcccgcccccggcgccagaagaagaggcggcagcgccagcagaagccugccccugcccaagagacccagaagaggcgccgcccccgagcccgagagaacccccgugggccagggcagcugggcccaccccggcagaaccagaggccccagcgacagaggcuucugcguggugagccccgccagacccgccgaggaggccaccagccuggagggcgcccugagcggcaccagacacagccaccccagcgugggcagacagcaccacgccggcccccccagcaccagcagaccccccagacccugggacacccccugcccccccguguacgccgagaccaagcacuuccuguacagcagcggcgacaaggagcagcugagacccagcuuccugcugagcagccugagacccagccugaccggcgccagaagacugguggagaccaucuuccugggcagcagacccuggaugcccggcacccccagaagacugcccagacugccccagagauacuggcagaugagaccccuguuccuggagcugcugggcaaccacgcccagugccccuacggcgugcugcugaagacccacugcccccugagagccgccgugacccccgccgccggcgugugcgccagagagaagccccagggcagcguggccgcccccgaggaggaggacaccgaccccagaagacuggugcagcugcugagacagcacagcagccccuggcagguguacggcuucgugagagccugccugagaagacuggugccccccggccuguggggcagcagacacaacgagagaagauuccugagaaacaccaagaaguucaucagccugggcaagcacgccaagcugagccugcaggagcugaccuggaagaugagcgugagagacugcgccuggcugagaagaagccccggcgugggcugcgugcccgccgccgagcacagacugagagaggagauccuggccaaguuccugcacuggcugaugagcguguacgugguggagcugcugagaagcuucuucuacgugaccgagaccaccuuccagaagaacagacuguucuucuacagaaagagcguguggagcaagcugcagagcaucggcaucagacagcaccugaagagagugcagcugagagagcugagcgaggccgaggugagacagcacagagaggccagacccgcccugcugaccagcagacugagauucauccccaagcccgacggccugagacccaucgugaacauggacuacguggugggcgccagaaccuucagaagagagaagagagccgagagacugaccagcagagugaaggcccuguucagcgugcugaacuacgagagagccagaagacccggccugcugggcgccagcgugcugggccuggacgacauccacagagccuggagaaccuucgugcugagagugagagcccaggaccccccccccgagcuguacuucgugaagguggacgugaccggcgccuacgacaccaucccccaggacagacugaccgaggugaucgccagcaucaucaagccccagaacaccuacugcgugagaagauacgccguggugcagaaggccgcccacggccacgugagaaaggccuucaagagccacgugagcacccugaccgaccugcagcccuacaugagacaguucguggcccaccugcaggagaccagcccccugagagacgccguggugaucgagcagagcagcagccugaacgaggccagcagcggccuguucgacguguuccugagauucaugugccaccacgccgugagaaucagaggcaagagcuacgugcagugccagggcaucccccagggcagcauccugagcacccugcugugcagccugugcuacggcgacauggagaacaagcuguucgccggcaucagaagagacggccugcugcugagacugguggacgacuuccugcuggugaccccccaccugacccacgccaagaccuuccugagcuacgccagaaccagcaucagagccagccugaccuucaacagaggcuucaaggccggcagaaacaugagaagaaagcuguucggcgugcugagacugaagugccacagccuguuccuggaccugcaggugaacagccugcagaccgugugcaccaacaucuacaagauccugcugcugcaggccuacagauuccacgccugcgugcugcagcugcccuuccaccagcagguguggaagaaccccaccuucuuccugagagugaucagcgacaccgccagccugugcuacagcauccugaaggccaagaacgccggcaugagccugggcgccaagggcgccgccggcccccugcccagcgaggccgugcaguggcugugccaccaggccuuccugcugaagcugaccagacacagagugaccuacgugccccugcugggcagccugagaaccgcccagacccagcugagcagaaagcugcccggcaccacccugaccgcccuggaggccgccgccaaccccgcccugcccagcgacuucaagaccauccuggacuaa

SEQ ID NO: 24515 - RNA, 564 nt, Artificial Sequence
  TESC__Homo_sapiens__NP_001161797
augggcgccgcccacagcgccagcgaggaggugagagagcuggagggcaagaccggcuucagcagcgaccagaucgagcagcugcacagaagauucaagcagcugagcggcgaccagcccaccaucagaaaccugagaaagggccccagcggccuggccgacgagaucaacuucgaggacuuccugaccaucaugagcuacuucagacccaucgacaccaccauggacgaggagcagguggagcugagcagaaaggagaagcugagauuccuguuccacauguacgacagcgacagcgacggcagaaucacccuggaggaguacagaaacgugguggaggagcugcugagcggcaacccccacaucgagaaggagagcgccagaagcaucgccgacggcgccaugauggaggccgccagcgugugcaugggccagauggagcccgaccagguguacgagggcaucaccuucgaggacuuccugaagaucuggcagggcaucgacaucgagaccaagaugcacgugagauuccugaacauggagaccauggcccugugccacuaa

SEQ ID NO: 24516 - RNA, 1266 nt, Artificial Sequence
  TES__Homo_sapiens__NP_056456
auggaccuggagaacaaggugaagaagaugggccugggccacgagcagggcuucggcgcccccugccugaagugcaaggagaagugcgagggcuucgagcugcacuucuggagaaagaucugcagaaacugcaagugcggccaggaggagcacgacgugcugcugagcaacgaggaggacagaaaggugggcaagcuguucgaggacaccaaguacaccacccugaucgccaagcugaagagcgacggcauccccauguacaagagaaacgugaugauccugaccaaccccguggccgccaagaagaacgugagcaucaacaccgugaccuacgagugggccccccccgugcagaaccaggcccuggccagacaguacaugcagaugcugcccaaggagaagcagcccguggccggcagcgagggcgcccaguacagaaagaagcagcuggccaagcagcugcccgcccacgaccaggaccccagcaagugccacgagcugagccccagagaggugaaggagauggagcaguucgugaagaaguacaagagcgaggcccugggcgugggcgacgugaagcugcccugcgagauggacgcccagggccccaagcagaugaacauccccggcggcgacagaagcacccccgccgccgugggcgccauggaggacaagagcgccgagcacaagagaacccaguacagcugcuacugcugcaagcugagcaugaaggagggcgaccccgccaucuacgccgagagagccggcuacgacaagcuguggcaccccgccugcuucgugugcagcaccugccacgagcugcugguggacaugaucuacuucuggaagaacgagaagcuguacugcggcagacacuacugcgacagcgagaagcccagaugcgccggcugcgacgagcugaucuucagcaacgaguacacccaggccgagaaccagaacuggcaccugaagcacuucugcugcuucgacugcgacagcauccuggccggcgagaucuacgugauggugaacgacaagcccgugugcaagcccugcuacgugaagaaccacgccguggugugccagggcugccacaacgccaucgaccccgaggugcagagagugaccuacaacaacuucagcuggcacgccagcaccgagugcuuccugugcagcugcugcagcaagugccugaucggccagaaguucaugcccguggagggcaugguguucugcagcguggagugcaagaagagaaugagcuaa

SEQ ID NO: 24517 - RNA, 1566 nt, Artificial Sequence
  TESPA1__Homo_sapiens__NP_001129502
auggaggccagcgugcugagccccaccagcugggagaagagaagagccuggcugagacagagcagaaacuggcagacccaggugcuggaggaggaggccgccgccgcccugcaggacgugcccgaccccgagcccagcagccuggacgacguguuccaggagggcaaccccaucaacaagaucgaggacuggcugcaggacugcggcuacagcgaggagggcuucagcgaggaggccggccaguucaucuacaacggcuucugcagccacggcaccagcuucgaggacgaccugacccugggcgccgaggccacccugcuggccgccaacggcaagcuguucagcagaagcuuccuggagaccgccagacccugccagcugcuggaccugggcugcagccuggccagcagcagcaugaccggcggcaccaacaagaccagcagcagcaucagcgagauccuggacaaggugcaggaggacgccgaggacgugcuguucagccugggcuucggccaggaggaccacaaggacaccagcagaauccccgccagauucuucaccacccccagccaggccaagggcaucgacuuccagcuguuccugaagagccaggugagaagaaucgagauggaggaccccugccugaugcuggccagcagauucaagcaggugcagacccuggccgugaccgccgacgccuucuucugccuguacagcuacgugagcaagacccccgugcagaaguucacccccagccacauguucuggaacugcaaccaccccaccgacgugcccagcaucagaauccugagcagagagcccgagccccagagccccagagacagacugagaaaggccaucagcaagaugugccuguacaccugccccagagacagacccccccccccccacaacacccccaagagaaacagccuggaccagguggugcuggaggugauggacaaggugaaggaggagaagcaguuccugcagcaggacagcgaccugggccaguucagccaggaggaccccgugccccccgccgagggcaagaagcugcccaccagccccuaccccugcguguucugcugcgaggaggagacccagcagagaaugagcaccgugcuggcccccagccagacccuggacagcaaccccaaggugcccugcugcacccacagccugcccaucgaggacccccaguggagcaccgaccccgcccagaucagaagagagcugugcagccugcccgccaccaacaccgagacccaccccgccaaggacgagaccuucuggaagagaaagagcagagccagaaagagccuguuccagaagaaccugaugggcagaaaggugaagagccuggaccugagcaucacccagcagaaguggaagcagagcguggacagacccgagcugagaagaagccugagccagcagccccaggacaccuucgaccuggaggaggugcagagcaacagcgaggaggagcagagccagagcagauggcccagcagacccagacacccccaccaccaccagaccuucgccggcaaggacagcuaa

SEQ ID NO: 24518 - RNA, 6411 nt, Artificial Sequence
  TET1__Homo_sapiens__NP_085128
augagcagaagcagacacgccagacccagcagacuggugagaaaggaggacgugaacaagaagaagaagaacagccagcugagaaagaccaccaagggcgccaacaagaacguggccagcgugaagacccugagccccggcaagcugaagcagcugauccaggagagagacgugaagaagaagaccgagcccaagccccccgugcccgugagaagccugcugaccagagccggcgccgccagaaugaaccuggacagaaccgaggugcuguuccagaaccccgagagccugaccugcaacggcuucaccauggcccugagaagcaccagccugagcagaagacugagccagcccccccuggugguggccaagagcaagaaggugccccugagcaagggccuggagaagcagcacgacugcgacuacaagauccugcccgcccugggcgugaagcacagcgagaacgacagcgugcccaugcaggacacccaggugcugcccgacaucgagacccugaucggcgugcagaaccccagccugcugaagggcaagagccaggagaccacccaguucuggagccagagaguggaggacagcaagaucaacauccccacccacagcggccccgccgccgagauccugcccggcccccuggagggcaccagaugcggcgagggccuguucagcgaggagacccugaacgacaccagcggcagccccaagauguucgcccaggacaccgugugcgcccccuucccccagagagccacccccaaggugaccagccagggcaaccccagcauccagcuggaggagcugggcagcagaguggagagccugaagcugagcgacagcuaccuggaccccaucaagagcgagcacgacugcuaccccaccagcagccugaacaaggugauccccgaccugaaccugagaaacugccuggcccugggcggcagcaccagccccaccagcgugaucaaguuccugcuggccggcagcaagcaggccacccugggcgccaagcccgaccaccaggaggccuucgaggccaccgccaaccagcaggaggugagcgacaccaccagcuuccugggccaggccuucggcgccaucccccaccagugggagcugcccggcgccgaccccgugcacggcgaggcccugggcgagacccccgaccugcccgagauccccggcgccauccccgugcagggcgagguguucggcaccauccuggaccagcaggagacccugggcaugagcggcagcguggugcccgaccugcccguguuccugcccgugccccccaaccccaucgccaccuucaacgcccccagcaaguggcccgagccccagagcaccgugagcuacggccuggccgugcagggcgccauccagauccugccccugggcagcggccacaccccccagagcagcagcaacagcgagaagaacagccugccccccgugauggccaucagcaacguggagaacgagaagcaggugcacaucagcuuccugcccgccaacacccagggcuucccccuggcccccgagagaggccuguuccacgccagccugggcaucgcccagcugagccaggccggccccagcaagagcgacagaggcagcagccaggugagcgugaccagcaccgugcacguggugaacaccaccguggugaccaugcccgugcccauggugagcaccagcagcagcagcuacaccacccugcugcccacccuggagaagaagaagagaaagagaugcggcgugugcgagcccugccagcagaagaccaacugcggcgagugcaccuacugcaagaacagaaagaacagccaccagaucugcaagaagagaaagugcgaggagcugaagaagaagcccagcgugguggugccccuggaggugaucaaggagaacaagagaccccagagagagaagaagcccaaggugcugaaggccgacuucgacaacaagcccgugaacggccccaagagcgagagcauggacuacagcagaugcggccacggcgaggagcagaagcuggagcugaacccccacaccguggagaacgugaccaagaacgaggacagcaugaccggcaucgagguggagaaguggacccagaacaagaagagccagcugaccgaccacgugaagggcgacuucagcgccaacgugcccgaggccgagaagagcaagaacagcgagguggacaagaagagaaccaagagccccaagcuguucgugcagaccgugagaaacggcaucaagcacgugcacugccugcccgccgagaccaacgugagcuucaagaaguucaacaucgaggaguucggcaagacccuggagaacaacagcuacaaguuccugaaggacaccgccaaccacaagaacgccaugagcagcguggccaccgacaugagcugcgaccaccugaagggcagaagcaacgugcugguguuccagcagcccggcuucaacugcagcagcaucccccacagcagccacagcaucaucaaccaccacgccagcauccacaacgagggcgaccagcccaagacccccgagaacauccccagcaaggagcccaaggacggcagccccgugcagcccagccugcugagccugaugaaggacagaagacugacccuggagcaggugguggccaucgaggcccugacccagcugagcgaggcccccagcgagaacagcagccccagcaagagcgagaaggacgaggagagcgagcagagaaccgccagccugcugaacagcugcaaggccauccuguacaccgugagaaaggaccugcaggaccccaaccugcagggcgagccccccaagcugaaccacugccccagccuggagaagcagagcagcugcaacaccgugguguucaacggccagaccaccacccugagcaacagccacaucaacagcgccaccaaccaggccagcaccaagagccacgaguacagcaaggugaccaacagccugagccuguucauccccaagagcaacagcagcaagaucgacaccaacaagagcaucgcccagggcaucaucacccuggacaacugcagcaacgaccugcaccagcugccccccagaaacaacgagguggaguacugcaaccagcugcuggacagcagcaagaagcuggacagcgacgaccugagcugccaggacgccacccacacccagaucgaggaggacguggccacccagcugacccagcuggccagcaucaucaagaucaacuacaucaagcccgaggacaagaagguggagagcacccccaccagccuggugaccugcaacgugcagcagaaguacaaccaggagaagggcaccauccagcagaagccccccagcagcgugcacaacaaccacggcagcagccugaccaagcagaagaaccccacccagaagaagaccaagagcacccccagcagagacagaagaaagaagaagcccaccguggugagcuaccaggagaacgacagacagaagugggagaagcugagcuacauguacggcaccaucugcgacaucuggaucgccagcaaguuccagaacuucggccaguucugcccccacgacuuccccaccguguucggcaagaucagcagcagcaccaagaucuggaagccccuggcccagaccagaagcaucaugcagcccaagaccguguuccccccccugacccagaucaagcugcagagauaccccgagagcgccgaggagaaggugaagguggagccccuggacagccugagccuguuccaccugaagaccgagagcaacggcaaggccuucaccgacaaggccuacaacagccaggugcagcugaccgugaacgccaaccagaaggcccacccccugacccagcccagcagcccccccaaccagugcgccaacgugauggccggcgacgaccagaucagauuccagcagguggugaaggagcagcugaugcaccagagacugcccacccugcccggcaucagccacgagaccccccugcccgagagcgcccugacccugagaaacgugaacguggugugcagcggcggcaucaccguggugagcaccaagagcgaggaggaggugugcagcagcagcuucggcaccagcgaguucagcaccguggacagcgcccagaagaacuucaacgacuacgccaugaacuucuucaccaaccccaccaagaaccuggugagcaucaccaaggacagcgagcugcccaccugcagcugccuggacagagugauccagaaggacaagggccccuacuacacccaccugggcgccggccccagcguggccgccgugagagagaucauggagaacagauacggccagaagggcaacgccaucagaaucgagaucgugguguacaccggcaaggagggcaagagcagccacggcugccccaucgccaagugggugcugagaagaagcagcgacgaggagaaggugcugugccuggugagacagagaaccggccaccacugccccaccgccgugaugguggugcugaucauggugugggacggcaucccccugcccauggccgacagacuguacaccgagcugaccgagaaccugaagagcuacaacggccaccccaccgacagaagaugcacccugaacgagaacagaaccugcaccugccagggcaucgaccccgagaccugcggcgccagcuucagcuucggcugcagcuggagcauguacuucaacggcugcaaguucggcagaagccccagccccagaagauucagaaucgaccccagcagcccccugcacgagaagaaccuggaggacaaccugcagagccuggccaccagacuggcccccaucuacaagcaguacgcccccguggccuaccagaaccagguggaguacgagaacguggccagagagugcagacugggcagcaaggagggcagacccuucagcggcgugaccgccugccuggacuucugcgcccacccccacagagacauccacaacaugaacaacggcagcaccguggugugcacccugaccagagaggacaacagaagccugggcgugaucccccaggacgagcagcugcacgugcugccccuguacaagcugagcgacaccgacgaguucggcagcaaggagggcauggaggccaagaucaagagcggcgccaucgaggugcuggcccccagaagaaagaagagaaccugcuucacccagcccgugcccagaagcggcaagaagagagccgccaugaugaccgaggugcuggcccacaagaucagagccguggagaagaagcccauccccagaaucaagagaaagaacaacagcaccaccaccaacaacagcaagcccagcagccugcccacccugggcagcaacaccgagaccgugcagcccgaggugaagagcgagaccgagccccacuucauccugaagagcagcgacaacaccaagaccuacagccugaugcccagcgccccccaccccgugaaggaggccagccccggcuucagcuggagccccaagaccgccagcgccacccccgccccccugaagaacgacgccaccgccagcugcggcuucagcgagagaagcagcaccccccacugcaccaugcccagcggcagacugagcggcgccaacgccgccgccgccgacggccccggcaucagccagcugggcgagguggccccccugcccacccugagcgcccccgugauggagccccugaucaacagcgagcccagcaccggcgugaccgagccccugaccccccaccagcccaaccaccagcccagcuuccugaccagcccccaggaccuggccagcagccccauggaggaggacgagcagcacagcgaggccgacgagccccccagcgacgagccccugagcgacgacccccugagccccgccgaggagaagcugccccacaucgacgaguacuggagcgacagcgagcacaucuuccuggacgccaacaucggcggcguggccaucgcccccgcccacggcagcgugcugaucgagugcgccagaagagagcugcacgccaccacccccguggagcaccccaacagaaaccaccccaccagacugagccugguguucuaccagcacaagaaccugaacaagccccagcacggcuucgagcugaacaagaucaaguucgaggccaaggaggccaagaacaagaagaugaaggccagcgagcagaaggaccaggccgccaacgagggccccgagcagagcagcgaggugaacgagcugaaccagauccccagccacaaggcccugacccugacccacgacaacguggugaccgugagccccuacgcccugacccacguggccggccccuacaaccacuggguguaa

SEQ ID NO: 24519 - RNA, 6009 nt, Artificial Sequence
  TET2__Homo_sapiens__NP_001120680
auggagcaggacagaaccaaccacguggagggcaacagacugagccccuuccugauccccagcccccccaucugccagaccgagccccuggccaccaagcugcagaacggcagcccccugcccgagagagcccaccccgaggugaacggcgacaccaaguggcacagcuucaagagcuacuacggcauccccugcaugaagggcagccagaacagcagagugagccccgacuucacccaggagagcagaggcuacagcaagugccugcagaacggcggcaucaagagaaccgugagcgagcccagccugagcggccugcugcagaucaagaagcugaagcaggaccagaaggccaacggcgagagaagaaacuucggcgugagccaggagagaaaccccggcgagagcagccagcccaacgugagcgaccugagcgacaagaaggagagcgugagcagcguggcccaggagaacgccgugaaggacuucaccagcuucagcacccacaacugcagcggccccgagaaccccgagcugcagauccugaacgagcaggagggcaagagcgccaacuaccacgacaagaacaucgugcugcugaagaacaaggccgugcugaugcccaacggcgccaccgugagcgccagcagcguggagcacacccacggcgagcugcuggagaagacccugagccaguacuaccccgacugcgugagcaucgccgugcagaagaccaccagccacaucaacgccaucaacagccaggccaccaacgagcugagcugcgagaucacccaccccagccacaccagcggccagaucaacagcgcccagaccagcaacagcgagcugccccccaagcccgccgccguggugagcgaggccugcgacgccgacgacgccgacaacgccagcaagcuggccgccaugcugaacaccugcagcuuccagaagcccgagcagcugcagcagcagaagagcguguucgagaucugccccagccccgccgagaacaacauccagggcaccaccaagcuggccagcggcgaggaguucugcagcggcagcagcagcaaccugcaggcccccggcggcagcagcgagagauaccugaagcagaacgagaugaacggcgccuacuucaagcagagcagcguguucaccaaggacagcuucagcgccaccaccaccccccccccccccagccagcugcugcugagccccccccccccccugccccaggugccccagcugcccagcgagggcaagagcacccugaacggcggcgugcuggaggagcaccaccacuaccccaaccagagcaacaccacccugcugagagaggugaagaucgagggcaagcccgaggccccccccagccagagccccaaccccagcacccacgugugcagccccagccccaugcugagcgagagaccccagaacaacugcgugaacagaaacgacauccagaccgccggcaccaugaccgugccccugugcagcgagaagaccagacccaugagcgagcaccugaagcacaacccccccaucuucggcagcagcggcgagcugcaggacaacugccagcagcugaugagaaacaaggagcaggagauccugaagggcagagacaaggagcagaccagagaccuggugccccccacccagcacuaccugaagcccggcuggaucgagcugaaggcccccagauuccaccaggccgagagccaccugaagagaaacgaggccagccugcccagcauccugcaguaccagcccaaccugagcaaccagaugaccagcaagcaguacaccggcaacagcaacaugcccggcggccugcccagacaggccuacacccagaagaccacccagcuggagcacaagagccagauguaccagguggagaugaaccagggccagagccagggcaccguggaccagcaccugcaguuccagaagcccagccaccaggugcacuucagcaagaccgaccaccugcccaaggcccacgugcagagccugugcggcaccagauuccacuuccagcagagagccgacagccagaccgagaagcugaugagccccgugcugaagcagcaccugaaccagcaggccagcgagaccgagcccuucagcaacagccaccugcugcagcacaagccccacaagcaggccgcccagacccagcccagccagagcagccaccugccccagaaccagcagcagcagcagaagcugcagaucaagaacaaggaggagauccugcagaccuucccccacccccagagcaacaacgaccagcagagagagggcagcuucuucggccagaccaagguggaggagugcuuccacggcgagaaccaguacagcaagagcagcgaguucgagacccacaacgugcagaugggccuggaggaggugcagaacaucaacagaagaaacagccccuacagccagaccaugaagagcagcgccugcaagauccaggugagcugcagcaacaacacccaccuggugagcgagaacaaggagcagaccacccaccccgagcuguucgccggcaacaagacccagaaccugcaccacaugcaguacuuccccaacaacgugauccccaagcaggaccugcugcacagaugcuuccaggagcaggagcagaagagccagcaggccagcgugcugcagggcuacaagaacagaaaccaggacaugagcggccagcaggccgcccagcuggcccagcagagauaccugauccacaaccacgccaacguguuccccgugcccgaccagggcggcagccacacccagacccccccccagaaggacacccagaagcacgccgcccugagauggcaccugcugcagaagcaggagcagcagcagacccagcagccccagaccgagagcugccacagccagaugcacagacccaucaagguggagcccggcugcaagccccacgccugcaugcacaccgccccccccgagaacaagaccuggaagaaggugaccaagcaggagaacccccccgccagcugcgacaacgugcagcagaagagcaucaucgagaccauggagcagcaccugaagcaguuccacgccaagagccuguucgaccacaaggcccugacccugaagagccagaagcaggugaagguggagaugagcggccccgugaccgugcugaccagacagaccaccgccgccgagcuggacagccacacccccgcccuggagcagcagaccaccagcagcgagaagacccccaccaagagaaccgccgccagcgugcugaacaacuucaucgagagccccagcaagcugcuggacacccccaucaagaaccugcuggacacccccgugaagacccaguacgacuuccccagcugcagaugcguggagcagaucaucgagaaggacgagggccccuucuacacccaccugggcgccggccccaacguggccgccaucagagagaucauggaggagagauucggccagaagggcaaggccaucagaaucgagagagugaucuacaccggcaaggagggcaagagcagccagggcugccccaucgccaaguggguggugagaagaagcagcagcgaggagaagcugcugugccuggugagagagagagccggccacaccugcgaggccgccgugaucgugauccugauccuggugugggagggcaucccccugagccuggccgacaagcuguacagcgagcugaccgagacccugagaaaguacggcacccugaccaacagaagaugcgcccugaacgaggagagaaccugcgccugccagggccuggaccccgagaccugcggcgccagcuucagcuucggcugcagcuggagcauguacuacaacggcugcaaguucgccagaagcaagauccccagaaaguucaagcugcugggcgacgaccccaaggaggaggagaagcuggagagccaccugcagaaccugagcacccugauggcccccaccuacaagaagcuggcccccgacgccuacaacaaccagaucgaguacgagcacagagcccccgagugcagacugggccugaaggagggcagacccuucagcggcgugaccgccugccuggacuucugcgcccacgcccacagagaccugcacaacaugcagaacggcagcacccuggugugcacccugaccagagaggacaacagagaguucggcggcaagcccgaggacgagcagcugcacgugcugccccuguacaaggugagcgacguggacgaguucggcagcguggaggcccaggaggagaagaagagaagcggcgccauccaggugcugagcagcuucagaagaaaggugagaaugcuggccgagcccgugaagaccugcagacagagaaagcuggaggccaagaaggccgccgccgagaagcugagcagccuggagaacagcagcaacaagaacgagaaggagaagagcgcccccagcagaaccaagcagaccgagaacgccagccaggccaagcagcuggccgagcugcugagacugagcggccccgugaugcagcagagccagcagccccagccccugcagaagcagcccccccagccccagcagcagcagagaccccagcagcagcagccccaccacccccagaccgagagcgugaacagcuacagcgccagcggcagcaccaaccccuacaugagaagacccaaccccgugagccccuaccccaacagcagccacaccagcgacaucuacggcagcaccagccccaugaacuucuacagcaccagcagccaggccgccggcagcuaccugaacagcagcaaccccaugaaccccuaccccggccugcugaaccagaacacccaguaccccagcuaccagugcaacggcaaccugagcguggacaacugcagccccuaccugggcagcuacagcccccagagccagcccauggaccuguacagauaccccagccaggacccccugagcaagcugagccugccccccauccacacccuguaccagcccagauucggcaacagccagagcuucaccagcaaguaccugggcuacggcaaccagaacaugcagggcgacggcuucagcagcugcaccaucagacccaacgugcaccacgugggcaagcugccccccuaccccacccacgagauggacggccacuucaugggcgccaccagcagacugccccccaaccugagcaaccccaacauggacuacaagaacggcgagcaccacagccccagccacaucauccacaacuacagcgccgcccccggcauguucaacagcagccugcacgcccugcaccugcagaacaaggagaacgacaugcugagccacaccgccaacggccugagcaagaugcugcccgcccugaaccacgacagaaccgccugcgugcagggcggccugcacaagcugagcgacgccaacggccaggagaagcagccccuggcccuggugcagggcguggccagcggcgccgaggacaacgacgagguguggagcgacagcgagcagagcuuccuggaccccgacaucggcggcguggccguggcccccacccacggcagcauccugaucgagugcgccaagagagagcugcacgccaccaccccccugaagaaccccaacagaaaccaccccaccagaaucagccugguguucuaccagcacaagagcaugaacgagcccaagcacggccuggcccugugggaggccaagauggccgagaaggccagagagaaggaggaggagugcgagaaguacggccccgacuacgugccccagaagagccacggcaagaaggugaagagagagcccgccgagccccacgagaccagcgagcccaccuaccugagauucaucaagagccuggccgagagaaccaugagcgugaccaccgacagcaccgugaccaccagccccuacgccuucaccagagugaccggccccuacaacagauacaucuaa

SEQ ID NO: 24520 - RNA, 5388 nt, Artificial Sequence
  TET3__Homo_sapiens__XP_005264244
augagccaguuccaggugccccuggccgugcagcccgaccugcccggccuguacgacuucccccagagacaggugauggugggcagcuuccccggcagcggccugagcauggccggcagcgagagccagcugagaggcggcggcgacggcagaaagaagagaaagagaugcggcaccugcgagcccugcagaagacuggagaacugcggcgccugcaccagcugcaccaacagaagaacccaccagaucugcaagcugagaaagugcgaggugcugaagaagaaggugggccugcugaaggagguggagaucaaggccggcgagggcgccggccccuggggccagggcgccgccgugaagaccggcagcgagcugagccccguggacggccccgugcccggccagauggacagcggccccguguaccacggcgacagcagacagcugagcgccagcggcgugcccgugaacggcgccagagagcccgccggccccagccugcugggcaccggcggccccuggagaguggaccagaagcccgacugggaggccgcccccggccccgcccacaccgccagacuggaggacgcccacgaccugguggccuucagcgccguggccgaggccgugagcagcuacggcgcccugagcaccagacuguacgagaccuucaacagagagaugagcagagaggccggcaacaacagcagaggccccagacccggccccgagggcugcagcgccggcagcgaggaccuggacacccugcagaccgcccuggcccuggccagacacggcaugaagccccccaacugcaacugcgacggccccgagugccccgacuaccuggaguggcuggagggcaagaucaagagcguggugauggagggcggcgaggagagacccagacugcccggcccccugccccccggcgaggccggccugcccgcccccagcaccagaccccugcugagcagcgaggugccccagaucagcccccaggagggccugccccugagccagagcgcccugagcaucgccaaggagaagaacaucagccugcagaccgccaucgccaucgaggcccugacccagcugagcagcgcccugccccagcccagccacagcaccccccaggccagcugcccccugcccgaggcccugagcccccccgcccccuucagaagcccccagagcuaccugagagcccccagcuggcccguggugccccccgaggagcacagcagcuucgcccccgacagcagcgccuucccccccgccacccccagaaccgaguuccccgaggccuggggcaccgacaccccccccgccacccccagaagcagcuggcccaugcccagacccagccccgaccccauggccgagcuggagcagcugcugggcagcgccagcgacuacauccagagcguguucaagagacccgaggcccugcccaccaagcccaaggugaagguggaggcccccagcagcagccccgcccccgcccccagccccgugcugcagagagaggcccccacccccagcagcgagcccgacacccaccagaaggcccagaccgcccugcagcagcaccugcaccacaagagaagccuguuccuggagcaggugcacgacaccagcuuccccgcccccagcgagcccagcgcccccggcugguggcccccccccagcagccccgugcccagacugcccgacagaccccccaaggagaagaagaagaagcugcccacccccgccggcggccccgugggcaccgagaaggccgcccccggcaucaagcccagcgugagaaagcccauccagaucaagaagagcagacccagagaggcccagccccuguucccccccgugagacagaucgugcuggagggccugagaagccccgccagccaggaggugcaggcccacccccccgccccccugcccgccagccagggcagcgccgugccccugccccccgagcccagccuggcccuguucgcccccagccccagcagagacagccugcugccccccacccaggagaugagaagccccagccccaugaccgcccugcagcccggcagcaccggcccccugccccccgccgacgacaagcuggaggagcugaucagacaguucgaggccgaguucggcgacagcuucggccugcccggcccccccagcgugcccauccaggaccccgagaaccagcagaccugccugcccgcccccgagagccccuucgccaccagaagccccaagcagaucaagaucgagagcagcggcgccgugaccgugcugagcaccaccugcuuccacagcgaggagggcggccaggaggccacccccaccaaggccgagaacccccugacccccacccugagcggcuuccuggagagcccccugaaguaccuggacacccccaccaagagccugcuggacacccccgccaagagagcccaggccgaguuccccaccugcgacugcguggagcagaucguggagaaggacgagggccccuacuacacccaccugggcagcggccccaccguggccagcaucagagagcugauggaggagagauacggcgagaagggcaaggccaucagaaucgagaaggugaucuacaccggcaaggagggcaagagcagcagaggcugccccaucgccaagugggugaucagaagacacacccuggaggagaagcugcugugccuggugagacacagagccggccaccacugccagaacgccgugaucgugauccugauccuggccugggagggcauccccagaagccugggcgacacccuguaccaggagcugaccgacacccugagaaaguacggcaaccccaccagcagaagaugcggccugaacgacgacagaaccugcgccugccagggcaaggaccccaacaccugcggcgccagcuucagcuucggcugcagcuggagcauguacuucaacggcugcaaguacgccagaagcaagacccccagaaaguucagacuggccggcgacaaccccaaggaggaggaggugcugagaaagagcuuccaggaccuggccaccgagguggccccccuguacaagagacuggccccccaggccuaccagaaccaggugaccaacgaggagaucgccaucgacugcagacugggccugaaggagggcagacccuucgccggcgugaccgccugcauggacuucugcgcccacgcccacaaggaccagcacaaccuguacaacggcugcaccguggugugcacccugaccaaggaggacaacagaugcgugggcaagauccccgaggacgagcagcugcacgugcugccccuguacaagauggccaacaccgacgaguucggcagcgaggagaaccagaacgccaaggugggcagcggcgccauccaggugcugaccgccuuccccagagaggugagaagacugcccgagcccgccaagagcugcagacagagacagcuggaggccagaaaggccgccgccgagaagaagaagauccagaaggagaagcugagcacccccgagaagaucaagcaggaggcccuggagcuggccggcaucaccagcgaccccggccugagccugaagggcggccugagccagcagggccugaagcccagccugaagguggagccccagaaccacuucagcagcuucaaguacagcggcaacgccgugguggagagcuacagcgugcugggcaacugcagacccagcgaccccuacagcaugaacagcguguacagcuaccacagcuacuacgcccagcccagccugaccagcgugaacggcuuccacagcaaguacgcccugcccagcuucagcuacuacggcuuccccagcagcaaccccguguuccccagccaguuccugggccccggcgccuggggccacagcggcagcagcggcagcuucgagaagaagcccgaccugcacgcccugcacaacagccugagccccgccuacggcggcgccgaguucgccgagcugcccagccaggccgugcccaccgacgcccaccaccccaccccccaccaccagcagcccgccuaccccggccccaaggaguaccugcugcccaaggccccccugcugcacagcgugagcagagaccccagccccuucgcccagagcagcaacugcuacaacagaagcaucaagcaggagcccguggacccccugacccaggccgagcccgugcccagagacgccggcaagaugggcaagaccccccugagcgaggugagccagaacggcggccccagccaccuguggggccaguacagcggcggccccagcaugagccccaagagaaccaacggcgugggcggcagcuggggcguguucagcagcggcgagagccccgccaucgugcccgacaagcugagcagcuucggcgccagcugccuggcccccagccacuucaccgacggccaguggggccuguuccccggcgagggccagcaggccgccagccacagcggcggcagacugagaggcaagcccuggagccccugcaaguucggcaacagcaccagcgcccuggccggccccagccugaccgagaagcccugggcccugggcgccggcgacuucaacagcgcccugaagggcagccccggcuuccaggacaagcuguggaaccccaugaagggcgaggagggcagaauccccgccgccggcgccagccagcuggacagagccuggcagagcuucggccugccccugggcagcagcgagaagcuguucggcgcccugaagagcgaggagaagcugugggaccccuucagccuggaggagggccccgccgaggagccccccagcaagggcgccgugaaggaggagaagggcggcggcggcgccgaggaggaggaggaggagcuguggagcgacagcgagcacaacuuccuggacgagaacaucggcggcguggccguggcccccgcccacggcagcauccugaucgagugcgccagaagagagcugcacgccaccaccccccugaagaagcccaacagaugccaccccaccagaaucagccugguguucuaccagcacaagaaccugaaccagcccaaccacggccuggcccugugggaggccaagaugaagcagcuggccgagagagccagagccagacaggaggaggccgccagacugggccugggccagcaggaggccaagcuguacggcaagaagagaaaguggggcggcaccgugguggccgagccccagcagaaggagaagaagggcguggugcccaccagacaggcccuggccgugcccaccgacagcgccgugaccgugagcagcuacgccuacaccaaggugaccggccccuacagcagauggaucuaa

SEQ ID NO: 24521 - RNA, 750 nt, Artificial Sequence
  TEX101__Homo_sapiens__NP_001123483
augggcacccccagaauccagcaccugcugauccugcuggugcugggcgccagccugcugaccagcggccuggagcuguacugccagaagggccugagcaugaccguggaggccgaccccgccaacauguucaacuggaccaccgaggagguggagaccugcgacaagggcgcccugugccaggagaccauccugaucaucaaggccggcaccgagaccgccauccuggccaccaagggcugcauccccgagggcgaggaggccaucaccaucgugcagcacagcagcccccccggccugaucgugaccagcuacagcaacuacugcgaggacagcuucugcaacgacaaggacagccugagccaguucugggaguucagcgagaccaccgccagcaccgugagcaccacccugcacugccccaccugcguggcccugggcaccugcuucagcgcccccagccugcccugccccaacggcaccaccagaugcuaccagggcaagcuggagaucaccggcggcggcaucgagagcagcguggaggugaagggcugcaccgccaugaucggcugcagacugaugagcggcauccuggccgugggccccauguucgugagagaggccugcccccaccagcugcugacccagcccagaaagaccgagaacggcgccaccugccugcccauccccguguggggccugcagcugcugcugccccugcugcugcccagcuucauccacuucagcuaa

SEQ ID NO: 24522 - RNA, 2823 nt, Artificial Sequence
  TEX11__Homo_sapiens__NP_001003811
augaucagcgcccacugcaaccugagacugcugugcagcagcgacagcagcgccagcgccagccagguggccggcaccaccgaggugguggagaaccuggugaccaacgacaacagccccaacauccccgaggccaucgacagacuguucagcgacaucgccaacaucaacagagagagcauggccgagaucaccgacauccagaucgaggagauggccgugaaccuguggaacugggcccugaccaucggcggcggcuggcuggugaacgaggagcagaagaucagacugcacuacguggccugcaagcugcugagcaugugcgaggccagcuucgccagcgagcagagcauccagagacugaucaugaugaacaugagaaucggcaaggaguggcuggacgccggcaacuuccugaucgccgacgagugcuuccaggccgccguggccagccuggagcagcuguacgugaagcugauccagagaagcagccccgaggccgaccugaccauggagaagaucaccguggagagcgaccacuucagagugcugagcuaccaggccgagagcgccguggcccagggcgacuuccagagagccagcaugugcgugcugcagugcaaggacaugcugaugagacugccccagaugaccagcagccugcaccaccugugcuacaacuucggcguggagacccagaagaacaacaaguacgaggagagcagcuucuggcugagccagagcuacgacaucggcaagauggacaagaagagcaccggccccgagaugcuggccaaggugcugagacugcuggccaccaacuaccuggacugggacgacaccaaguacuacgacaaggcccugaacgccgugaaccuggccaacaaggagcaccugagcagccccggccuguuccugaagaugaagauccugcugaagggcgagaccagcaacgaggagcugcuggaggccgugauggagauccugcaccuggacaugccccuggacuucugccugaacaucgccaagcugcugauggaccacgagagagagagcgugggcuuccacuuccugaccaucauccacgagagauucaagagcagcgagaacaucggcaaggugcugauccugcacaccgacaugcugcugcagagaaaggaggagcugcuggccaaggagaagaucgaggagaucuuccuggcccaccagaccggcagacagcugaccgccgagagcaugaacuggcugcacaacauccuguggagacaggccgccagcagcuucgaggugcagaacuacaccgacgcccugcagugguacuacuacagccugagauucuacagcaccgacgagauggaccuggacuucaccaagcugcagagaaacauggccugcugcuaccugaaccugcagcagcuggacaaggccaaggaggccguggccgaggccgagagacacgaccccagaaacguguucacccaguucuacaucuucaagaucgccgugaucgagggcaacagcgagagagcccugcaggccaucaucacccuggagaacauccugaccgacgaggagagcgaggacaacgaccugguggccgagagaggcagccccaccaugcugcugagccuggccgcccaguucgcccuggagaacggccagcagaucguggccgagaaggcccuggaguaccuggcccagcacagcgaggaccaggagcaggugcugaccgccgugaagugccugcugagauuccugcugcccaagaucgccgagaugcccgagagcgaggacaagaagaaggagauggacagacugcugaccugccugaacagagccuucgugaagcugagccagcccuucggcgaggaggcccugagccuggagagcagagccaacgaggcccagugguucagaaagaccgccuggaaccuggccgugcagugcgacaaggaccccgugaugaugagagaguucuucauccugagcuacaagaugagccaguucugccccagcgaccaggugauccugaucgccagaaagaccugccugcugauggccguggccguggaccuggagcagggcagaaaggccagcaccgccuucgagcagaccauguuccugagcagagcccuggaggagauccagaccugcaacgacauccacaacuuccugaagcagaccggcaccuucagcaacgacagcugcgagaagcugcugcugcuguacgaguucgaggugagagccaagcugaacgacccccugcuggagagcuuccuggagagcgugugggagcugccccaccuggagaccaagaccuucgagaccaucgccaucaucgccauggagaagcccgcccacuacccccugaucgcccugaaggcccugaagaaggcccugcugcuguacaagaaggaggagcccaucgacaucagccaguacagcaagugcaugcacaaccuggugaaccugagcgugcccgacggcgccagcaacguggagcugugcccccuggaggagguguggggcuacuucgaggacgcccugagccacaucagcagaaccaaggacuaccccgagauggagauccuguggcugauggugaagagcuggaacaccggcgugcugauguucagcagaagcaaguacgccagcgccgagaaguggugcggccuggcccugagauuccugaaccaccugaccagcuucaaggagagcuacgagacccagaugaacaugcuguacagccagcugguggaggcccugagcaacaacaagggccccguguuccacgagcacggcuacuggagcaagagcgacuaa

SEQ ID NO: 24523 - RNA, 4494 nt, Artificial Sequence
  TEX14__Homo_sapiens__NP_001188386
augagcagagccgugagacugcccgugcccugccccgugcagcugggcacccugagaaacgacagccuggaggcccagcugcacgaguacgugaagcagggcaacuacgugaaggugaagaagauccugaagaagggcaucuacguggacgccgugaacagccugggccagaccgcccuguucguggccgcccugcugggccugagaaaguucguggacgugcugguggacuacggcagcgaccccaaccacagaugcuucgacggcagcacccccgugcacgccgccgccuucagcggcaaccaguggauccugagcaagcugcuggacgccggcggcgaccugagacugcacgacgagagaggccagaaccccaagaccugggcccugaccgccggcaaggagagaagcacccagaucguggaguucaugcagagaugcgccagccacaugcaggccaucauccagggcuucagcuacgaccugcugaagaagaucgacagcccccagagacugguguacagccccagcuggugcggcggccuggugcagggcaaccccaacggcagccccaacagacugcugaaggccggcgugaucagcgcccagaacaucuacagcuucggcuucggcaaggccaugcccugguuccaguucuaccugaccggcgccacccagauggccuaccugggcagccugcccgugaucggcgagaaggaggugauccaggccgacgacgagcccaccuucagcuucuucagcggccccuacauggugaugaccaaccugguguggaacggcagcagagugaccgugaaggagcugaaccugcccacccacccccacugcagcagacugagacuggccgaccugcugaucgccgagcaggagcacagcagcaagcugagacaccccuaccugcugcagcugauggccgugugccugagccaggaccuggagaagaccagacugguguacgagagaaucaccaucggcacccuguucagcgugcugcacgagagaagaagccaguuccccgugcugcacauggaggugaucgugcaccugcugcugcagaucagcgacgcccugagauaccugcacuuccagggcuucauccacagaagccugagcagcuacgccgugcacaucaucagccccggcgaggccagacugaccaaccuggaguacaugcuggagagcgaggacagaggcgugcagagagaccugaccagagugccccugcccacccagcuguacaacugggccgcccccgaggugauccugcagaaggccgccaccgugaagagcgacaucuacagcuucagcaugaucaugcaggagauccugaccgacgacauccccuggaagggccuggacggcagcguggugaagaaggccguggugagcggcaacuaccuggaggccgacgugagacugcccaagcccuacuacgacaucgugaagagcggcauccacgugaagcagaaggacagaaccaugaaccugcaggacaucagauacauccugaagaacgaccugaaggacuucaccggcgcccagagaacccagcccaccgagagccccagagugcagagauacggccugcaccccgacgugaacguguaccugggccugaccagcgagcaccccagagagacccccgacauggagaucaucgagcugaaggagaugggcagccagccccacagccccagagugcacagccuguucaccgagggcacccuggacccccaggcccccgaccccugccugauggccagagagacccagaaccaggacgcccccugccccgcccccuucauggccgaggaggccagcagccccagcaccggccagcccagccugugcagcuucgagaucaacgagaucuacagcggcugccugauccuggaggacgacaucgaggagccccccggcgccgccagcagccuggaggccgacggccccaaccagguggacgagcugaagagcauggaggaggagcuggacaagauggagagagaggccugcugcuucggcagcgaggacgagagcagcagcaaggccgagaccgaguacagcuucgacgacugggacuggcagaacggcagccugagcagccugagccugcccgagagcaccagagaggccaagagcaaccugaacaacaugagcaccaccgaggaguaccugaucagcaagugcgugcuggaccugaagaucaugcagaccaucaugcacgagaacgacgacagacugagaaacaucgagcagauccuggacgagguggagaugaagcagaaggagcaggaggagagaaugagccugugggccaccagcagagaguucaccaacgccuacaagcugccccuggccgugggcccccccagccugaacuacaucccccccgugcugcagcugagcggcggccagaagcccgacaccagcggcaacuaccccacccugcccagauuccccagaaugcugcccacccugugcgaccccggcaagcagaacaccgacgagcaguuccagugcacccagggcgccaaggacagccuggagaccagcagaauccagaacaccagcagccagggcagacccagagagagcaccgcccaggccaaggccacccaguucaacagcgcccuguucacccugagcagccacagacagggccccagcgccagccccagcugccacugggacagcaccagaaugagcguggagcccgugagcagcgagaucuacaacgccgagagcagaaacaaggacgacggcaaggugcaccugaaguggaagauggaggugaaggagauggccaagaaggccgccaccggccagcugaccgugccccccuggcacccccagagcagccugacccuggagagcgaggccgagaacgagcccgacgcccugcugcagccccccaucagaagccccgagaacaccgacuggcagagagugaucgaguaccacagagagaacgacgagcccagaggcaacggcaaguucgacaagaccggcaacaacgacugcgacagcgaccagcacggcagacagcccagacugggcagcuucaccagcaucagacaccccagccccagacagaaggagcagcccgagcacagcgaggccuuccaggccagcagcgacacccugguggccguggagaagagcuacagccaccagagcaugcagagcaccugcagccccgagagcagcgaggacaucaccgacgaguuccugacccccgacggcgaguacuucuacagcagcaccgcccaggagaaccuggcccuggagaccagcagccccaucgaggaggacuucgagggcauccagggcgccuucgcccagccccaggugagcggcgaggagaaguuccagaugagaaagauccugggcaagaacgccgagauccugcccagaagccaguuccagcccgugagaagcaccgaggacgagcaggaggagaccagcaaggagagccccaaggagcugaaggagaaggacaucagccugaccgacauccaggaccugagcagcaucagcuacgagcccgacagcagcuucaaggaggccagcugcaagacccccaagaucaaccacgcccccaccagcgugagcaccccccugagccccggcagcgugagcagcgccgccagccaguacaaggacugccuggagagcaucaccuuccaggugaagaccgaguucgccagcugcuggaacagccaggaguucauccagacccugagcgacgacuucaucagcgugagagagagagccaagaagcuggacagccugcugaccagcagcgagaccccccccagcagacugaccggccugaagagacugagcagcuucaucggcgccggcagccccagccuggugaaggccugcgacagcagccccccccacgccacccagagaagaagccugcccaagguggaggccuucagccagcaccacaucgacgagcugcccccccccagccaggagcugcuggacgacaucgagcugcugaagcagcagcagggcagcagcaccgugcugcacgagaacaccgccagcgacggcggcggcaccgccaacgaccagagacaccuggaggagcaggagaccgacagcaagaaggaggacagcagcaugcugcugagcaaggagaccgaggaccugggcgaggacaccgagagagcccacagcacccuggacgaggaccuggagagauggcugcagccccccgaggagagcguggagcugcaggaccugcccaagggcagcgagagagagaccaacaucaaggaccagaaggugggcgaggagaagagaaagagagaggacagcaucacccccgagagaagaaagagcgagggcgugcugggcaccagcgaggaggacgagcugaagagcugcuucuggaagagacugggcuggagcgagagcagcagaaucaucgugcuggaccagagcgaccugagcgacuaa

SEQ ID NO: 24524 - RNA, 8370 nt, Artificial Sequence
  TEX15__Homo_sapiens__NP_112561
augcccagcgacgccaaggacagcgugaacggcgaccugcugcugaacuggaccagccugaagaacauccugagcggccugaacgccagcuucccccugcacaacaacaccggcagcagcaccgugaccaccagcaagagcaucaaggaccccagacugaugagaagagaggagagcaugggcgagcagagcagcaccgccggccugaacgaggugcugcaguucgagaagagcagcgacaacgugaacagcgagaucaagagcacccccagcaacagcgccagcagcagcgagguggugcccggcgacugcgccgugcugaccaacggccuggacacccccugcuucaagaccagcgugaacgacagccagagcugggcccacaacaugggcagcgaggacuacgacugcaucccccccaacaaggugaccauggccggccagugcaaggaccagggcaacuucagcuuccccaucagcgugagcaacguggugagcgagguggagaaccagaaccacagcgaggagaaggcccagagagcccagcaggagagcggcaacgccuacaccaaggaguacagcagccacaucuuccaggacagccagagcagcgaccugaagaccaucuaccagaccggcugccagaccagcaccguguucccccugaagaagaaggugagcaucgacgaguaccugcagaacaccggcaagaugaagaacuucgccgaccuggaggacagcagcaagcacgaggagaagcagaccagcuggaaggagaucgacaacgacuucaccaacgagaccaagaucagccccaucgacaacuacaucgugcugcaccaggaguacaaggagagcgagagccacaacagcuucggcaagagcugcgacaagauccugaucacccaggagcuggagaucaccaagagcagcaccagcaccaucaaggacaaggacgagcuggaccaccuggcccuggaguggcagaucacccccagcuucgagagccugagccagaagcacccccagcacagcguggaguacgagggcaacauccacaccagccuggccaucgcccagaagcugauggagcugaagcugggcaagaucaaccagaacuacgccagcaucaucaccgaggccuuccccaagcccaaggacaucccccaggccaaggagauguucaucgacaccgugaucagcagcuacaacaucgagaccgcccacgacagcagcaacugcagcaucaccagagagcacaucugcgugcacagaaagaacgagaacgagcccgugagccuggagaacauccagagagacuacaaggagaccgccuacguggaggacagaggccaggaccacaaccuguucugcaacagccagcugagcaacgacaucuggcugaacgugaacuucaagaagcagaccgacagagagaaccagaacgaggccaaggagaacagcgccagcugcguggagaacaacaucgagaacaucuacggcgacaagaagcaggacagccacaccaacgagaacuucagcaacaucgacgagaaggaggacaagaacuaccacaacaucgagauccugagcagcgaggaguucagcaccaaguucaaccugaucugcagagaggacaacgccgugagcgccgccaccgcccugcuggagagcgaggaggacaccaucagcgccgugaagcagaaggacaccgagaacaccggcagaagcguggagcaccuggccagcaccaccuuccccaagaccgccagcagcagcgugugcguggccagcaacgccgccauccagaucgccagcgccaccaugcccgcccugagccugaacaacgacgaccaccagaucuaccaguucaaggagaccugcagcagcgagagccccgacuucggccugcuggugaagcacagagugagcgacugcgagaucgacaccgacaagaacaagagccaggagagcuuccaccagagcaucaacgagaaccuggugcugcagagcaucgagcuggagagcgagaucgagaucgagcuggaggacugcgacgacgccuucaucuuccagcaggacacccacagccacgagaacaugcugugcgaggaguucgugaccagcuacaaggcccugaagagcagaaucagcugggagggccugcuggcccuggacaacggcgagauggaggugcuggagagcaccaccggcagagagaacagcgaccagcacuacagcaaggagagcaacuacuucuacagcagcacccagaacaacgagaccgagcugaccagccccauccugcugcccgaccugcagaucaagaucaccaacaucuucagacccggcuucagccccaccgccgacagccuggcccugaaggacagcuucugcacccacgugaccgaggccaccaagcccgagaucaacaaggaggacggcgagauccugggcuucgacaucuacagccagcccuucggcgagaacgccgacuaccccugcgaggacaagguggacaacaucagacaggagagcggccccgugagcaacagcgagaucagccugagcuucgaccugagcagaaacaccgacgugaaccacaccagcgagaaccagaacagcgagagccuguucaccgagcccagcaacgugaccaccaucgacgacggcagcagaugcuucuucaccaagagcaagaccgacuacaacgacaccaagaacaagaaggagguggagagcagaaucagcaagagaaagcugcacaucagcagcagagaccagaacaucccccacaaggaccugagaagacacaagaucuacggcagaaagagaagacugaccagccaggacagcagcgagugcuucagcagccugagccagggcagaaucaagaccuucagccagagcgagaagcacaucaagagcgugcugaacauccugagcgacgaggccagccugugcaagagcaagugccugagcagaaagcuggacaaggccguggugcaccugaagaaggcccacagaagagugcacaccagccugcagcugaucaccaaggugggcgaggagagaaagggcccccugcccaagagcuacgccaucaucugcaacaacuucugggagagcugcgaccugcagggcuacagcagcgugagccagagaaaguacuacagcaccaagcacuucagcagcaagagaaaguacgacaagagaagaaagaagagagcccccaaggccgacaucagcaagagccugacccacgugagcaagcacaagagcuacaagaccagcggcgagaagaagugccugagcagaaagagcauggccagcagcgugagcaagagccaccccaccaccagccacaugggcgaguucugcaaccaggagcaccccgagagccagcugcccgugagcagcaccagccagagcaccagccagagcguguacuacaacagcagcgugagcaaccccagccugagcgaggagcaccagcccuucagcggcaagaccgccuaccuguucagccccgaccacagcgacgagaagcugaucgagaaggagaaccagaucgacaccgccuuccugagcagcaccagcaaguacgagaagcuggagaagcacagcgccaaccacaacgugaaggacgccaccaaggagaacagcugcgacgccaacgaggugaucaacgagagcaacagcgugagccugagcugcaucaaggagaacaucaacagcagcaccggcaacgacugcgacgccaccugcaucggccacaccaaggccaagaccgacgugcugaucagcgugcuggacagcaacgugaagcacuuccugaacgaccuguaccagcagggcaaccugauccugagcgacugcaagagaaaccuggaggugaaguggaccgaccccaucgagagacccaagcagaacaucaucaccggcaacuuccugaugggcccccugaaccugacccugaucgccagcaagaaguacagcaucccccagcugagcgccgccgccgugaccgacagcgagggcgagagcagcaagagcuaccuggacaagcagagaauccugaccguggacagcuucgccgccagcagcaccgugccccacugcgagcagagcugcagagagaaggagcugcugaagaccgagcagugcagcagcggcaacugccugcacaccgacggcaacgagaccaacgugaccgagaacuacgagcuggacguggccagcggcaccgaggaggacaagagcuacggcgagaacaucguggagcugagcagcagcgacagcagccugcugcugaaggacaacgugaagggcagcagcagcgagaccugcaucgugaagaaggacaccgaggacagaaucaccuggaaggugaagcaggccgagaaggccaaggacagcguguacaagagaagcaugaccgagggcagcaccgugaacaccgaguacaagaaccagaagaaccagaucagcgaggagagcugccugaacgagaagaucaucaccaccaaccugaucgacagccaccugagcaccaagaacaccaccaccgagagcgugccccugaagaacaccgugagcaacccccugaacaagagagagaagaagggcgagaucaaggugagcaaggacagccagagcgaccugacccugcacagcgagaucgccuacaucagcaagcccggcauccugggcgugaaccacacccccauccugcccgcccacagcgagaccugcaaggugcccacccugcugaagaagcccgccagcuacgugagcgacuucaaggagaagcacugcagcgccaaccacaccgcccugaucgccaaccugagccagauccugcagagagccgacgaggccagcagccugcagauccugcaggaggagaccaaggugugccugaacauccugccccuguucguggaggccuucgagagaaagcaggagugcagcguggagcagauccugaucagcagagagcugcugguggaccagaaccuguggaacaacugcaagcacacccugaagcccugcgccguggacacccugguggagcugcagaugaugauggagaccauccaguucaucgagaacaagaagagacaccuggagggcgagcccacccugagaagccugcugugguacgacgagacccuguacgccgagcugcugggcaagcccagaggcuuccagcagcagagcaacuucuaccccggcuuccagggcagacugaaguacaacgccuucugcgagcugcagaccuaccacgaccagcugguggagcugcuggaggagaccaagagagagaagaacagcuacuacguguuccugaaguacaagagacaggugaacgagugcgaggccaucauggagcacugcagcgacugcuucgacuucagccugagcgugcccuucaccugcggcgugaacuucggcgacagccuggaggaccuggagauccugagaaagagcacccugaagcugaucaacgugugcggcgacagccccaaggugcacagcuaccccggcaagcaggaccaccuguggaucaucaucgagaugaucagcagcaaggugaacuucaucaagaacaacgaggccgugagagugaagaucagccuguacggccuggagcacaucuucuucgacgccgccaagaaccugguguggaaggagagaacccagagcuucagcaagaaguacagccagaagaaggacgaggagagacugcugagagugaacaagugcgccuucagcaagcugcagaagaucuacgacacccugagcaaggaccugaacaacgagcccaucagccccaucggccuggaggaggacaccaucaucgccagcagaaagagcgaccaccccaucaacgaggccaccaucagcaucgagaacagcaaguucaacagcaaccugcuggcccaccccgacaucugcugcaucagcgagauccuggaccaggccgaguucgccgaccugaagaagcugcaggaccugacccugagaugcaccgaccaccuggagauccugaagaaguacuuccagaugcugcaggacaacaacauggacaacaucuucaucaccgaggagaacgugcuggacguggugaucaaccacagccacgaggccaucauccugaagcccgaggccaucgagauguacaucgagaucgugauggugagcgagaccauccacuuccugaagaacagcaucgccaagaagcuggacaagcagagauucagaggcaugcugugguucgaccugagccugcugcccgagcuggugcagugccaggagaagauggccagcuucagcuuccugaaggacaacagcaccgacgugugccuguggaaggugaucgagaccgccgugagcgagcugaagaaggaccuggacaucaucugcaaguacaacgaggccgugaacugcagcuacgccauccaccugcugagcagagagcugcaggagcugagcgagaucaagaagcugcugaagaagagcaaguacuucaucagcaccuacaucgacuucgugcccuacaucgccagcaucaacuacggcagcaccgugaccgagcuggaguacaacuacaaccaguucagcacccugcugaagaacgugaugagcgcccccagaaaggaccugggcaagauggcccacaucagaaaggugaugaagaccaucgagcacaugaagaugaucugcaccaagaacgccgagcugaccaucagcuucuuccugugccagaugcuguacaacagaagaaagauccugcagcugaagagaaaggagaagaugaacauccacaucgugaagcccggcgagaacaacaacaaguucagcaucagcaccaugcugccccccgugagcgagugcaucaacaagaacaucagcaacagcagcaagaagagacccagcaccguggacaagugcgaggacagccaggagcagcagcaggacaccaccgugagcagcugcaagaagcugaagguggacaugaaggacgugaccaagaucaacagagagaaggccaccuucaagcaccccagaaccaccggcagccaccccaagagcgagaacaagaucgugcccagcagcugcgacagccugaagagaaaccaccugacccccaagaagguggagaugcagagaagccugcccggcagccugcugccccuggagaaccccaaggacaccugcgccagcaagagcgagagcaagaucgaccugaccgugagcagcgaccacuucagcggccagcaggagaaccugaacagcaugaagaagagaaacgugaacuucagcgccgccgagaccaagagcgacaagaaggacugcgccgccuucgccaucugcgaccagaagagcgugcacggcaccuucagccccgaccacggcacccugcugcagaaguuccugaagaacagccccgaccccacccagaagagcugccugagcgacaucaaccccgagaccgacgugagccuggugcccgacgccagcgugcugagcaagcccaucuucugcuucgugaaggacgugcaccccgaccuggagaugaacgacaccguguucgagcugcaggacaacgacaucgugaacagcagcaucaagaacagcagcugcaugaccagccccgagcccaucugcauccagaacaagauccccacccugcagaucaacaagcugcagcccaccgagaccgagagcgaggacaaguacaugaaggacacccugaaccccaacaccgugcacaccuucggcgccagcggccacaucacccugaacgugaaccagggcgccgaguacagccugagcgagcagcagaacgacaagaacagcaaggugcugaugcagaacgccgccaccuacuggaacgagcugccccagagcgccugcaaccccaccuacaacagcagcgagcaccuguucggcaccagcuaccccuacagcgccuggugcguguaccaguacagcaacagcaacggcaacgccaucacccagaccuaccagggcaucaccagcuacgaggugcagcccagccccagcggccugcugaccaccguggccagcaccgcccagggcacccacagcaaccugcuguacagccaguacuucaccuacuucgccggcgagccccaggccaacggcuucgugcccgugaacggcuacuuccagagccagauccccgccagcaacuucagacagcccaucuucagccaguacgccagccaccagccccugccccaggccaccuaccccuaccugcccaacagauucgugccccccgaggugcccuggguguacgcccccuggcaccaggagagcuuccaccccggccacuaa

SEQ ID NO: 24525 - RNA, 942 nt, Artificial Sequence
  TEX264__Homo_sapiens__NP_001230655
augagcgaccugcugcugcugggccugaucggcggccugacccugcugcugcugcugacccugcuggccuucgccggcuacagcggccugcuggccggcguggaggugagcgccggcagcccccccaucagaaacgugaccguggccuacaaguuccacaugggccuguacggcgagaccggcagacuguucaccgagagcugcagcaucagccccaagcugagaagcaucgccguguacuacgacaacccccacauggugccccccgacaagugcagaugcgccgugggcagcauccugagcgagggcgaggagagccccagccccgagcugaucgaccuguaccagaaguucggcuucaagguguucagcuuccccgcccccagccacguggugaccgccaccuuccccuacaccaccauccugagcaucuggcuggccaccagaagagugcaccccgcccuggacaccuacaucaaggagagaaagcugugcgccuaccccagacuggagaucuaccaggaggaccagauccacuucaugugcccccuggccagacagggcgacuucuacgugcccgagaugaaggagaccgaguggaaguggagaggccugguggaggccaucgacacccagguggacggcaccggcgccgacaccaugagcgacaccagcagcgugagccuggaggugagccccggcagcagagagaccagcgccgccacccugagccccggcgccagcagcagaggcugggacgacggcgacaccagaagcgagcacagcuacagcgagagcggcgccagcggcagcagcuucgaggagcuggaccuggagggcgagggcccccugggcgagagcagacuggaccccggcaccgagccccugggcaccaccaaguggcugugggagcccaccgcccccgagaagggcaaggaguaa

SEQ ID NO: 24526 - RNA, 456 nt, Artificial Sequence
  TEX29__Homo_sapiens__NP_689537
auggaguacgugcuggaggugaagaacagccccagacaccugcugaagcaguucaccgugugcgacgugccccuguacgacaucugcgacuacaacgugagcagagacagaugccaggagcugggcugcugcuucuacgagggcgugugcuacaagaaggccgugcccaucuacauccacguguucagcgcccugaucgugaucaucgccggcgccuucgugaucaccaucaucuacagagugauccaggagagcagaaaggagaaggccauccccguggacguggcccugccccagaagagcagcgagaaggccgagcuggccagcagcagcagcaagcugggccugaagcccgccagccccggcccccccagcgccggccccagcaugaagagcgacgaggacaaggacgacgugaccggcaccaucaccgaggccgaggagaccgaggacuaa

SEQ ID NO: 24527 - RNA, 561 nt, Artificial Sequence
  TEX30__Homo_sapiens__NP_001273705
augaaccugccccaccugaugagccuggccagccaccuggccagccacggcuucuucugccugagauucaccugcaagggccugaacaucgugcacagaaucaaggccuacaagagcgugcugaacuaccugaagaccagcggcgaguacaagcuggccggcguguuccugggcggcagaagcaugggcagcagagccgccgccagcgugaugugccacaucgagcccgacgacggcgacgacuucgugagaggccugaucugcaucagcuacccccugcaccaccccaagcagcagcacaagcugagagacgaggaccuguucagacugaaggagcccgugcuguucgugagcggcagcgccgacgagaugugcgagaagaaccugcuggagaagguggcccagaagaugcaggccccccacaagauccacuggaucgagaaggccaaccacagcauggccgugaagggcagaagcaccaacgacguguucaaggagaucaacacccagauccuguucuggauccaggagaucaccgagauggacaagaagugccacuaa

SEQ ID NO: 24528 - RNA, 648 nt, Artificial Sequence
  TEX35__Homo_sapiens__NP_001164193
augagcgccaagagagccgagcugaagaagacccaccuggugaaggagagacacugcuggaccagcaagaacuacaaggccgugugccuggagcugaagcccgagcccaccaagaccuucgacuacaaggccgugaagcaggagggcagauucaccaaggccggcgugacccaggaccugaagaacgagcugagagaggugagagaggagcugaaggagaagauggaggagaucaagcagaucaaggaccugauggacaaggacuucgacaagcugcacgaguucguggagaucaugaaggagaugcagaaggacauggacgagaagauggacauccugaucaacacccagaagaacuacaagcugccccugagaagagcccccaaggagcagcaggagcugagacugaugggcaagacccacagagagccccagcugagacccaagaagauggacggcgccagcggcgugaacggcgcccccugcgcccugcacaagaagaccauggccccccagaagaccaagcagggcagccuggacccccugcaccacugcggcaccugcugcgagaagugccugcugugcgcccugaagaacaacuacaacagaggcaucuacgccgccgugggccugcuggaccugugguaa

SEQ ID NO: 24529 - RNA, 603 nt, Artificial Sequence
  TEX40__Homo_sapiens__NP_001034585
auggaggagaagcccagcaaggugagccugaagagcagcgacagacagggcagcgacgaggagagcgugcacagcgacaccagagaccuguggaccaccaccacccugagccaggcccagcugaacaugccccugagcgaggugugcgagggcuucgacgaggagggcagaaacaucagcaagaccagaggcuggcacagccccggcagaggcagccuggacgagggcuacaaggccagccacaagcccgaggagcuggacgagcacgcccugguggagcuggagcugcacagaggcagcagcauggagaucaaccugggcgagaaggacaccgccagccagaucgaggccgagaagagcagcagcaugagcagccugaacaucgccaagcacaugccccacagagccuacugggccgagcagcagagcagacugccccugccccugauggagcugauggagaacgaggcccuggagauccugaccaaggcccugagaagcuaccagcugggcaucggcagagaccacuuccugaccaaggagcugcagagauacaucgagggccugaagaagagaagaagcaagagacuguacgugaacuaa

SEQ ID NO: 24530 - RNA, 645 nt, Artificial Sequence
  TFAM__Homo_sapiens__NP_001257711
auggccuuccugagaagcauguggggcgugcugagcgcccugggcagaagcggcgccgagcugugcaccggcugcggcagcagacugagaagccccuucagcuucguguaccugcccagaugguucagcagcgugcuggccagcugccccaagaagcccgugagcagcuaccugagauucagcaaggagcagcugcccaucuucaaggcccagaaccccgacgccaagaccaccgagcugaucagaagaaucgcccagagauggagagagcugcccgacagcaagaagaagaucuaccaggacgccuacagagccgaguggcagguguacaaggaggagaucagcagauucaaggagcagcugacccccagccagaucaugagccuggagaaggagaucauggacaagcaccugaagagaaaggccaugaccaagaagaaggagaagcugaagaccgugaaggagaacuggaagaaccugagcgacagcgagaaggagcuguacauccagcacgccaaggaggacgagaccagauaccacaacgagaugaagagcugggaggagcagaugaucgaggugggcagaaaggaccugcugagaagaaccaucaagaagcagagaaaguacggcgccgaggagugcuaa

SEQ ID NO: 24531 - RNA, 1296 nt, Artificial Sequence
  TFAP2A__Homo_sapiens__NP_001027451
augcuggugcacagcuucagcgccauggacagacacgacggcaccagcaacggcaccgccagacugccccagcugggcaccgugggccagagccccuacaccagcgcccccccccugagccacacccccaacgccgacuuccagccccccuacuuccccccccccuaccagcccaucuacccccagagccaggaccccuacagccacgugaacgaccccuacagccugaacccccugcacgcccagccccagccccagcaccccggcuggcccggccagagacagagccaggagagcggccugcugcacacccacagaggccugccccaccagcugagcggccuggaccccagaagagacuacagaagacacgaggaccugcugcacggcccccacgcccugagcagcggccugggcgaccugagcauccacagccugccccacgccaucgaggaggugccccacguggaggaccccggcaucaacauccccgaccagaccgugaucaagaagggccccgugagccugagcaagagcaacagcaacgccgugagcgccauccccaucaacaaggacaaccuguucggcggcguggugaaccccaacgagguguucugcagcgugcccggcagacugagccugcugagcagcaccagcaaguacaaggugaccguggccgaggugcagagaagacugagcccccccgagugccugaacgccagccugcugggcggcgugcugagaagagccaagagcaagaacggcggcagaagccugagagagaagcuggacaagaucggccugaaccugcccgccggcagaagaaaggccgccaacgugacccugcugaccagccugguggagggcgaggccgugcaccuggccagagacuucggcuacgugugcgagaccgaguuccccgccaaggccguggccgaguuccugaacagacagcacagcgaccccaacgagcaggugaccagaaagaacaugcugcuggccaccaagcagaucugcaaggaguucaccgaccugcuggcccaggacagaagcccccugggcaacagcagacccaaccccauccuggagcccggcauccagagcugccugacccacuucaaccugaucagccacggcuucggcagccccgccgugugcgccgccgugaccgcccugcagaacuaccugaccgaggcccugaaggccauggacaagauguaccugagcaacaaccccaacagccacaccgacaacaacgccaagagcagcgacaaggaggagaagcacagaaaguaa

SEQ ID NO: 24532 - RNA, 1383 nt, Artificial Sequence
  TFAP2B__Homo_sapiens__NP_003212
augcacagcccccccagagaccaggccgccaucaugcuguggaagcugguggagaacgugaaguacgaggacaucuacgaggacagacacgacggcgugcccagccacagcagcagacugagccagcugggcagcgugagccagggccccuacagcagcgcccccccccugagccacacccccagcagcgacuuccagccccccuacuuccccccccccuaccagccccugcccuaccaccagagccaggaccccuacagccacgugaacgaccccuacagccugaacccccugcaccagccccagcagcaccccuggggccagagacagagacaggaggugggcagcgaggccggcagccugcugccccagcccagagccgcccugccccagcugagcggccuggaccccagaagagacuaccacagcgugagaagacccgacgugcugcugcacagcgcccaccacggccuggacgccggcaugggcgacagccugagccugcacggccugggccaccccggcauggaggacgugcagagcguggaggacgccaacaacagcggcaugaaccugcuggaccagagcgugaucaagaaggugcccgugccccccaagagcgugaccagccugaugaugaacaaggacggcuuccugggcggcaugagcgugaacaccggcgagguguucugcagcgugcccggcagacugagccugcugagcagcaccagcaaguacaaggugaccgugggcgaggugcagagaagacugagcccccccgagugccugaacgccagccugcugggcggcgugcugagaagagccaagagcaagaacggcggcagaagccugagagagagacuggagaagaucggccugaaccugcccgccggcagaagaaaggccgccaacgugacccugcugaccagccugguggagggcgaggccgugcaccuggccagagacuucggcuacaucugcgagaccgaguuccccgccaaggccgugagcgaguaccugaacagacagcacaccgaccccagcgaccugcacagcagaaagaacaugcugcuggccaccaagcagcugugcaaggaguucaccgaccugcuggcccaggacagaacccccaucggcaacagcagacccagccccauccuggagcccggcauccagagcugccugacccacuucagccugaucacccacggcuucggcgcccccgccaucugcgccgcccugaccgcccugcagaacuaccugaccgaggcccugaagggcauggacaagauguuccugaacaacaccaccaccaacagacacaccagcggcgagggccccggcagcaagaccggcgacaaggaggagaagcacagaaaguaa

SEQ ID NO: 24533 - RNA, 1353 nt, Artificial Sequence
  TFAP2C__Homo_sapiens__NP_003213
augcuguggaagaucaccgacaacgugaaguacgaggaggacugcgaggacagacacgacggcagcagcaacggcaaccccagagugccccaccugagcagcgccggccagcaccuguacagccccgcccccccccugagccacaccggcguggccgaguaccagcccccccccuacuuccccccccccuaccagcagcuggccuacagccagagcgccgaccccuacagccaccugggcgaggccuacgccgccgccaucaacccccugcaccagcccgcccccaccggcagccagcagcaggccuggcccggcagacagagccaggagggcgccggccugcccagccaccacggcagacccgccggccugcugccccaccugagcggccuggaggccggcgccgugagcgccagaagagacgccuacagaagaagcgaccugcugcugccccacgcccacgcccuggacgccgccggccuggccgagaaccugggccugcacgacaugccccaccagauggacgaggugcagaacguggacgaccagcaccugcugcugcacgaccagaccgugaucagaaagggccccaucagcaugaccaagaacccccugaaccugcccugccagaaggagcuggugggcgccgugaugaaccccaccgagguguucugcagcgugcccggcagacugagccugcugagcagcaccagcaaguacaaggugaccguggccgaggugcagagaagacugagcccccccgagugccugaacgccagccugcugggcggcgugcugagaagagccaagagcaagaacggcggcagaagccugagagagaagcuggacaagaucggccugaaccugcccgccggcagaagaaaggccgcccacgugacccugcugaccagccugguggagggcgaggccgugcaccuggccagagacuucgccuacgugugcgaggccgaguuccccagcaagcccguggccgaguaccugaccagaccccaccugggcggcagaaacgagauggccgccagaaagaacaugcugcuggccgcccagcagcugugcaaggaguucaccgagcugcugagccaggacagaaccccccacggcaccagcagacuggcccccgugcuggagaccaacauccagaacugccugagccacuucagccugaucacccacggcuucggcagccaggccaucugcgccgccgugagcgcccugcagaacuacaucaaggaggcccugaucgugaucgacaagagcuacaugaaccccggcgaccagagccccgccgacagcaacaagacccuggagaagauggagaagcacagaaaguaa

SEQ ID NO: 24534 - RNA, 1017 nt, Artificial Sequence
  TFAP4__Homo_sapiens__NP_003214
auggaguacuucauggugcccacccagaaggugcccagccugcagcacuucagaaagaccgagaaggaggugaucggcggccugugcagccuggccaacaucccccugacccccgagacccagagagaccaggagagaagaaucagaagagagaucgccaacagcaacgagagaagaagaaugcagagcaucaacgccggcuuccagagccugaagacccugaucccccacaccgacggcgagaagcugagcaaggccgccauccugcagcagaccgccgaguacaucuucagccuggagcaggagaagaccagacugcugcagcagaacacccagcugaagagauucauccaggagcugagcggcagcagccccaagagaagaagagccgaggacaaggacgagggcaucggcagccccgacaucugggaggacgagaaggccgaggaccugagaagagagaugaucgagcugagacagcagcuggacaaggagagaagcgugagaaugaugcuggaggagcaggugagaagccuggaggcccacauguaccccgagaagcugaaggugaucgcccagcaggugcagcugcagcagcagcaggagcaggugagacugcugcaccaggagaagcuggagagagagcagcagcagcugagaacccagcugcugcccccccccgcccccacccaccaccccaccgugaucgugcccgcccccccccccccccccagccaccacaucaacguggugaccaugggccccagcagcgugaucaacagcgugagcaccagcagacagaaccuggacaccaucgugcaggccauccagcacaucgagggcacccaggagaagcaggagcuggaggaggagcagagaagagccgugaucgugaagcccgugagaagcugccccgaggcccccaccagcgacaccgccagcgacagcgaggccagcgacagcgacgccauggaccagagcagagaggagcccagcggcgacggcgagcugcccuaa

SEQ ID NO: 24535 - RNA, 1041 nt, Artificial Sequence
  TFB1M__Homo_sapiens__NP_057104
auggccgccagcggcaagcugagcaccugcagacugcccccccugcccaccaucagagagaucaucaagcugcugagacugcaggccgccaagcagcugagccagaacuuccugcuggaccugagacugaccgacaagaucgugagaaaggccggcaaccugaccaacgccuacguguacgaggugggccccggccccggcggcaucaccagaagcauccugaacgccgacguggccgagcugcuggugguggagaaggacaccagauucauccccggccugcagaugcugagcgacgccgcccccggcaagcugagaaucgugcacggcgacgugcugaccuucaagguggagaaggccuucagcgagagccugaagagacccugggaggacgacccccccaacgugcacaucaucggcaaccugcccuucagcgugagcaccccccugaucaucaaguggcuggagaacaucagcugcagagacggccccuucguguacggcagaacccagaugacccugaccuuccagaaggagguggccgagagacuggccgccaacaccggcagcaagcagagaagcagacugagcgugauggcccaguaccugugcaacgugagacacaucuucaccauccccggccaggccuucgugcccaagcccgagguggacgugggcguggugcacuucaccccccugauccagcccaagaucgagcagcccuucaagcugguggagaagguggugcagaacguguuccaguucagaagaaaguacugccacagaggccugagaaugcuguuccccgaggcccagagacuggagagcaccggcagacugcuggagcuggccgacaucgaccccacccugagacccagacagcugagcaucagccacuucaagagccugugcgacguguacagaaagaugugcgacgaggacccccagcuguucgccuacaacuucagagaggagcugaagagaagaaagagcaagaacgaggagaaggaggaggacgacgccgagaacuacagacuguaa

SEQ ID NO: 24536 - RNA, 1191 nt, Artificial Sequence
  TFB2M__Homo_sapiens__NP_071761
auguggauccccguggugggccugcccagaagacugagacugagcgcccuggccggcgccggcagauucugcauccugggcagcgaggccgccaccagaaagcaccugcccgccagaaaccacugcggccugagcgacagcagcccccagcuguggcccgagcccgacuucagaaacccccccagaaaggccagcaaggccagccuggacuucaagagauacgugaccgacagaagacuggccgagacccuggcccagaucuaccugggcaagcccagcagacccccccaccugcugcuggagugcaaccccggccccggcauccugacccaggcccugcuggaggccggcgccaaggugguggcccuggagagcgacaagaccuucaucccccaccuggagagccugggcaagaaccuggacggcaagcugagagugauccacugcgacuucuucaagcuggaccccagaagcggcggcgugaucaagccccccgccaugagcagcagaggccuguucaagaaccugggcaucgaggccgugcccuggaccgccgacaucccccugaagguggugggcauguuccccagcagaggcgagaagagagcccuguggaagcuggccuacgaccuguacagcugcaccagcaucuacaaguucggcagaaucgaggugaacauguucaucggcgagaaggaguuccagaagcugauggccgaccccggcaaccccgaccuguaccacgugcugagcgugaucuggcagcuggccugcgagaucaaggugcugcacauggagcccuggagcagcuucgacaucuacaccagaaagggcccccuggagaaccccaagagaagagagcugcuggaccagcugcagcagaagcuguaccugauccagaugauccccagacagaaccuguucaccaagaaccugacccccaugaacuacaacaucuucuuccaccugcugaagcacugcuucggcagaagaagcgccaccgugaucgaccaccugagaagccugaccccccuggacgccagagacauccugaugcagaucggcaagcaggaggacgagaagguggugaacaugcacccccaggacuucaagacccuguucgagaccaucgagagaagcaaggacugcgccuacaaguggcuguacgacgagacccuggaggacagauaa

SEQ ID NO: 24537 - RNA, 1353 nt, Artificial Sequence
  TFCP2__Homo_sapiens__NP_001166924
auggccugggcccugaagcugccccuggccgacgaggugaucgagagcggccuggugcaggacuucgacgccagccugagcggcaucggccaggagcugggcgccggcgccuacagcaugagcgacgugcuggcccugcccaucuucaagcaggaggagagcagccugccccccgacaacgagaacaagauccugcccuuccaguacgugcugugcgccgccaccagccccgccgugaagcugcacgacgagacccugaccuaccugaaccagggccagagcuacgagaucagaaugcuggacaacagaaagcugggcgagcugcccgagaucaacggcaagcuggugaagagcaucuucagagugguguuccacgacagaagacugcaguacaccgagcaccagcagcuggagggcuggagauggaacagacccggcgacagaauccuggacaucgacauccccaugagcgugggcaucaucgaccccagagccaaccccacccagcugaacaccguggaguuccugugggaccccgccaagagaaccagcguguucauccagcccaagggcgccgacagaaagcagaagaccgacagagagaagauggagaagagaaccccccacgagaaggagaaguaccagcccagcuacgagaccaccauccugaccgagugcagccccuggcccgagaucaccuacgugaacaacagccccagccccggcuucaacagcagccacagcagcuucagccugggcgagggcaacggcagccccaaccaccagcccgagccccccccccccgugaccgacaaccugcugcccaccaccaccccccaggaggcccagcaguggcugcacagaaacagauucagcaccuucaccagacuguucaccaacuucagcggcgccgaccugcugaagcugaccagagacgacgugauccagaucugcggccccgccgacggcaucagacuguucaacgcccugaagggcagaauggugagacccagacugaccaucuacgugugccaggagagccugcagcugagagagcagcagcagcagcagcagcagcagcagcagaagcacgaggacggcgacagcaacggcaccuucuucguguaccacgccaucuaccuggaggagcugaccgccguggagcugaccgagaagaucgcccagcuguucagcaucagccccugccagaucagccagaucuacaagcagggccccaccggcauccacgugcugaucagcgacgagaugauccagaacuuccaggaggaggccugcuucauccuggacaccaugaaggagaccaacgacagcuaccacaucauccugaaguaa

SEQ ID NO: 24538 - RNA, 1233 nt, Artificial Sequence
  TFDP1__Homo_sapiens__XP_005268384
auggccaaggacgccggccugaucgaggccaacggcgagcugaagguguucaucgaccagaaccugagccccggcaagggcguggugagccugguggccgugcaccccagcaccgugaacccccugggcaagcagcugcugcccaagaccuucggccagagcaacgugaacaucgcccagcagguggugaucggcaccccccagagacccgccgccagcaacacccugguggugggcagcccccacacccccagcacccacuucgccagccagaaccagcccagcgacagcagccccuggagcgccggcaagagaaacagaaagggcgagaagaacggcaagggccugagacacuucagcaugaaggugugcgagaaggugcagagaaagggcaccaccagcuacaacgagguggccgacgagcugguggccgaguucagcgccgccgacaaccacauccugcccaacgagagcgccuacgaccagaagaacaucagaagaagaguguacgacgcccugaacgugcugauggccaugaacaucaucagcaaggagaagaaggagaucaaguggaucggccugcccaccaacagcgcccaggagugccagaaccuggagguggagagacagagaagacuggagagaaucaagcagaagcagagccagcugcaggagcugauccugcagcagaucgccuucaagaaccuggugcagagaaacagacacgccgagcagcaggccagcagaccccccccccccaacagcgugauccaccugcccuucaucaucgugaacaccagcaagaagaccgugaucgacugcagcaucagcaacgacaaguucgaguaccuguucaacuucgacaacaccuucgagauccacgacgacaucgaggugcugaagagaaugggcauggccugcggccuggagagcggcagcugcagcgccgaggaccugaagauggccagaagccuggugcccaaggcccuggagcccuacgugaccgagauggcccagggcaccgugggcggcguguucaucaccaccgccggcagcaccagcaacggcaccagauucagcgccagcgaccugaccaacggcgccgacggcaugcuggccaccagcagcaacggcagccaguacagcggcagcagaguggagacccccgugagcuacgugggcgaggacgacgaggaggacgacgacuucaacgagaacgacgaggacgacuaa

SEQ ID NO: 24539 - RNA, 1161 nt, Artificial Sequence
  TFDP2__Homo_sapiens__NP_001171609
augaucaucagcaccccccagagacugaccagcagcggcagcgugcugaucggcagccccuacacccccgcccccgccauggugacccagacccacaucgccgaggccaccggcugggugcccggcgacagaaagagagccagaaaguucaucgacagcgacuucagcgagagcaagagaagcaagaagggcgacaagaacggcaagggccugagacacuucagcaugaaggugugcgagaaggugcagagaaagggcaccaccagcuacaacgagguggccgacgagcuggugagcgaguucaccaacagcaacaaccaccuggccgccgacagccaggccuacgaccagaagaacaucagaagaagaguguacgacgcccugaacgugcugauggccaugaacaucaucagcaaggagaagaaggagaucaaguggaucggccugcccaccaacagcgcccaggagugccagaaccuggagaucgagaagcagagaagaaucgagagaaucaagcagaagagagcccagcugcaggagcugcugcugcagcagaucgccuucaagaaccuggugcagagaaacagacagaacgagcagcagaaccagggcccccccgcccugaacagcaccauccagcugcccuucaucaucaucaacaccagcagaaagaccgugaucgacugcagcaucagcagcgacaaguucgaguaccuguucaacuucgacaacaccuucgagauccacgacgacaucgaggugcugaagagaaugggcaugagcuucggccuggagagcggcaagugcagccuggaggaccugaagcuggccaagagccuggugcccaaggcccuggagggcuacaucaccgacaucagcaccggccccagcuggcugaaccagggccugcugcugaacagcacccagagcgugagcaaccuggaccugaccaccggcgccacccugccccagagcagcgugaaccagggccugugccuggacgccgagguggcccuggccaccggccaguuccuggcccccaacagccaccagagcagcagcgccgccagccacugcagcgagagcagaggcgagacccccugcagcuucaacgacgaggacgaggaggacgacgaggaggacagcagcagccccgaguaa

SEQ ID NO: 24540 - RNA, 1218 nt, Artificial Sequence
  TFDP3__Homo_sapiens__NP_057605
auggccaaguacgugagccugaccgaggccaacgaggagcugaaggugcugauggacgagaaccagaccagcagacccguggccgugcacaccagcaccgugaacccccugggcaagcagcugcugcccaagaccuucggccagagcagcgugaacaucgaccagcagguggugaucggcaugccccagagacccgccgccagcaacauccccguggugggcagccccaacccccccagcacccacuucgccagccagaaccagcacagcuacagcagcccccccugggccggccagcacaacagaaagggcgagaagaacggcaugggccugugcagacugagcaugaaggugugggagaccgugcagagaaagggcaccaccagcugccaggagguggugggcgagcugguggccaaguucagagccgccagcaaccacgccagccccaacgagagcgccuacgacgugaagaacaucaagagaagaaccuacgacgcccugaacgugcugauggccaugaacaucaucagcagagagaagaagaagaucaaguggaucggccugaccaccaacagcgcccagaacugccagaaccugagaguggagagacagaagagacuggagagaaucaagcagaagcagagcgagcugcagcagcugauccugcagcagaucgccuucaagaaccuggugcugagaaaccaguacguggaggagcaggugagccagagaccccugcccaacagcgugauccacgugcccuucaucaucaucagcagcagcaagaagaccgugaucaacugcagcaucagcgacgacaagagcgaguaccuguucaaguucaacagcagcuucgagauccacgacgacaccgaggugcugauguggaugggcaugaccuucggccuggagagcggcagcugcagcgccgaggaccugaagauggccagaaaccuggugcccaaggcccuggagcccuacgugaccgagauggcccagggcaccuucggcggcguguucaccaccgccggcagcagaagcaacggcaccuggcugagcgccagcgaccugaccaacaucgccaucggcaugcuggccaccagcagcggcggcagccaguacagcggcagcagaguggagacccccgccguggaggaggaggaggaggaggacaacaacgacgacgaccugagcgagaacgacgaggacgacuaa

SEQ ID NO: 24541 - RNA, 1728 nt, Artificial Sequence
  TFE3__Homo_sapiens__NP_006512
augagccacgccgccgagcccgccagagacggcguggaggccagcgccgagggccccagagccguguucgugcugcuggaggagagaagacccgccgacagcgcccagcugcugagccugaacagccugcugcccgagagcggcaucguggccgacaucgagcuggagaacgugcuggaccccgacagcuucuacgagcugaagagccagccccugccccugagaagcagccugcccaucagccugcaggccacccccgccacccccgccacccugagcgccagcagcagcgccggcggcagcagaacccccgccaugagcagcagcagcagcagcagagugcugcugagacagcagcugaugagagcccaggcccaggagcaggagagaagagagagaagagagcaggccgccgccgcccccuuccccagccccgcccccgccagccccgccaucagcguggugggcgugagcgccggcggccacacccugagcagacccccccccgcccaggugcccagagaggugcugaaggugcagacccaccuggagaaccccaccagauaccaccugcagcaggccagaagacagcaggugaagcaguaccugagcaccacccugggccccaagcuggccagccaggcccugacccccccccccggccccgccagcgcccagccccugcccgcccccgaggccgcccacaccaccggccccaccggcagcgcccccaacagccccauggcccugcugaccaucggcagcagcagcgagaaggagaucgacgacgugaucgacgagaucaucagccuggagagcagcuacaacgacgagaugcugagcuaccugcccggcggcaccaccggccugcagcugcccagcacccugcccgugagcggcaaccugcuggacguguacagcagccagggcguggccacccccgccaucaccgugagcaacagcugccccgccgagcugcccaacaucaagagagagaucagcgagaccgaggccaaggcccugcugaaggagagacagaagaaggacaaccacaaccugaucgagagaagaagaagauucaacaucaacgacagaaucaaggagcugggcacccugauccccaagagcagcgaccccgagaugagauggaacaagggcaccauccugaaggccagcguggacuacaucagaaagcugcagaaggagcagcagagaagcaaggaccuggagagcagacagagaagccuggagcaggccaacagaagccugcagcugagaauccaggagcuggagcugcaggcccagauccacggccugcccgugccccccacccccggccugcugagccuggccaccaccagcgccagcgacagccugaagcccgagcagcuggacaucgaggaggagggcagacccggcgccgccaccuuccacgugggcggcggccccgcccagaacgccccccaccagcagccccccgccccccccagcgacgcccugcuggaccugcacuuccccagcgaccaccugggcgaccugggcgaccccuuccaccugggccuggaggacauccugauggaggaggaggagggcguggugggcggccugagcggcggcgcccugagcccccugagagccgccagcgacccccugcugagcagcgugagccccgccgugagcaaggccagcagcagaagaagcagcuucagcauggaggaggagagcuaa

SEQ ID NO: 24542 - RNA, 1473 nt, Artificial Sequence
  TFEB__Homo_sapiens__NP_001161299
augaccgccagcagcggcugggagcccgcccccgccgccaccauggccagcagaaucggccugagaaugcagcugaugagagagcaggcccagcaggaggagcagagagagagaaugcagcagcaggccgugaugcacuacaugcagcagcagcagcagcagcagcagcagcagcugggcggcccccccacccccgccaucaacacccccgugcacuuccagagccccccccccgugcccggcgaggugcugaaggugcagagcuaccuggagaaccccaccagcuaccaccugcagcagagccagcaccagaaggugagagaguaccugagcgagaccuacggcaacaaguucgccgcccacaucagccccgcccagggcagccccaagcccccccccgccgccagccccggcgugagagccggccacgugcugagcagcagcgccggcaacagcgcccccaacagccccauggccaugcugcacaucggcagcaaccccgagagagagcuggacgacgugaucgacaacaucaugagacuggacgacgugcugggcuacaucaaccccgagaugcagaugcccaacacccugccccugagcagcagccaccugaacguguacagcagcgacccccaggugaccgccagccuggugggcgugaccagcagcagcugccccgccgaccugacccagaagagagagcugaccgacgccgagagcagagcccuggccaaggagagacagaagaaggacaaccacaaccugaucgagagaagaagaagauucaacaucaacgacagaaucaaggagcugggcaugcugauccccaaggccaacgaccuggacgugagauggaacaagggcaccauccugaaggccagcguggacuacaucagaagaaugcagaaggaccugcagaagagcagagagcuggagaaccacagcagaagacuggagaugaccaacaagcagcuguggcugagaauccaggagcuggagaugcaggccagagugcacggccugcccaccaccagccccagcggcaugaacauggccgagcuggcccagcagguggugaagcaggagcugcccagcgaggagggccccggcgaggcccugaugcugggcgccgaggugcccgaccccgagccccugcccgcccugcccccccaggccccccugccccugcccacccagccccccagccccuuccaccaccuggacuucagccacagccugagcuucggcggcagagaggacgagggcccccccggcuaccccgagccccuggcccccggccacggcagccccuuccccagccugagcaagaaggaccuggaccugaugcugcuggacgacagccugcugccccuggccagcgacccccugcugagcaccaugagccccgaggccagcaaggccagcagcagaagaagcagcuucagcauggaggagggcgacgugcuguaa

SEQ ID NO: 24543 - RNA, 957 nt, Artificial Sequence
  TFEC__Homo_sapiens__NP_001018068
augacccuggaccaccagaucaucaaccccacccugaaguggagccagcccgccgugcccagcggcggcccccuggugcagcacgcccacaccacccuggacagcgacgccggccugaccgagaacccccugaccaagcugcuggccaucggcaaggaggacgacaacgcccaguggcaccugagcggcagcauccuggacguguacagcggcgagcagggcaucagccccaucaacaugggccugaccagcgccagcugccccagcagccugcccaugaagagagagaucaccgagaccgacaccagagcccuggccaaggagagacagaagaaggacaaccacaaccugaucgagagaagaagaagauacaacaucaacuacagaaucaaggagcugggcacccugauccccaagagcaacgaccccgacaugagauggaacaagggcaccauccugaaggccagcguggaguacaucaaguggcugcagaaggagcagcagagagccagagagcuggagcacagacagaagaagcuggagcaggccaacagaagacugcugcugagaauccaggagcuggagauccaggccagaacccacggccugcccacccuggccagccugggcaccguggaccugggcgcccacgugaccaagcagcagagccaccccgagcagaacagcguggacuacugccagcagcugaccgugagccagggccccagccccgagcugugcgaccaggccaucgccuucagcgacccccugagcuacuucaccgaccugagcuucagcgccgcccugaaggaggagcagagacuggacggcaugcugcuggacgacaccaucagccccuucggcaccgacccccugcugagcgccaccagccccgccgugagcaaggagagcagcagaagaagcagcuucagcagcgacgacggcgacgagcuguaa

SEQ ID NO: 24544 - RNA, 255 nt, Artificial Sequence
  TFF1__Homo_sapiens__NP_003216
auggccaccauggagaacaaggugaucugcgcccuggugcuggugagcaugcuggcccugggcacccuggccgaggcccagaccgagaccugcaccguggcccccagagagagacagaacugcggcuuccccggcgugacccccagccagugcgccaacaagggcugcugcuucgacgacaccgugagaggcgugcccuggugcuucuaccccaacaccaucgacgugccccccgaggaggagugcgaguucuaa

SEQ ID NO: 24545 - RNA, 390 nt, Artificial Sequence
  TFF2__Homo_sapiens__NP_005414
augggcagaagagacgcccagcugcuggccgcccugcuggugcugggccugugcgcccuggccggcagcgagaagcccagccccugccagugcagcagacugagcccccacaacagaaccaacugcggcuuccccggcaucaccagcgaccagugcuucgacaacggcugcugcuucgacagcagcgugaccggcgugcccuggugcuuccacccccugcccaagcaggagagcgaccagugcgugauggaggugagcgacagaagaaacugcggcuaccccggcaucagccccgaggagugcgccagcagaaagugcugcuucagcaacuucaucuucgaggugcccuggugcuucuuccccaagagcguggaggacugccacuacuaa

SEQ ID NO: 24546 - RNA, 285 nt, Artificial Sequence
  TFF3__Homo_sapiens__NP_003217
augaagagagugcugagcugcgugcccgagcccaccguggugauggccgccagagcccugugcaugcugggccuggugcuggcccugcugagcagcagcagcgccgaggaguacgugggccugagcgccaaccagugcgccgugcccgccaaggacagaguggacugcggcuacccccacgugacccccaaggagugcaacaacagaggcugcugcuucgacagcagaauccccggcgugcccuggugcuucaagccccugcaggaggccgagugcaccuucuaa

SEQ ID NO: 24547 - RNA, 1203 nt, Artificial Sequence
  TFG__Homo_sapiens__NP_001007566
augaacggccagcuggaccugagcggcaagcugaucaucaaggcccagcugggcgaggacaucagaagaauccccauccacaacgaggacaucaccuacgacgagcuggugcugaugaugcagagaguguucagaggcaagcugcugagcaacgacgaggugaccaucaaguacaaggacgaggacggcgaccugaucaccaucuucgacagcagcgaccugagcuucgccauccagugcagcagaauccugaagcugacccuguucgugaacggccagcccagaccccuggagagcagccaggugaaguaccugagaagagagcugaucgagcugagaaacaaggugaacagacugcuggacagccuggagccccccggcgagcccggccccagcaccaacauccccgagaacgacaccguggacggcagagaggagaagagcgccagcgacagcagcggcaagcagagcacccaggugauggccgccagcaugagcgccuucgacccccugaagaaccaggacgagaucaacaagaacgugaugagcgccuucggccugaccgacgaccaggugagcggcccccccagcgcccccgccgaggacagaagcggcacccccgacagcaucgccagcagcagcagcgccgcccacccccccggcgugcagccccagcagccccccuacaccggcgcccagacccaggccggccagaucgagggccagauguaccagcaguaccagcagcaggccggcuacggcgcccagcagccccaggcccccccccagcagccccagcaguacggcauccaguacagcgccagcuacagccagcagaccggcccccagcagccccagcaguuccagggcuacggccagcagcccaccagccaggcccccgcccccgccuucagcggccagccccagcagcugcccgcccagcccccccagcaguaccaggccagcaacuaccccgcccagaccuacaccgcccagaccagccagcccaccaacuacaccguggcccccgccagccagcccggcauggcccccagccagcccggcgccuaccagcccagacccggcuucaccagccugcccggcagcaccaugacccccccccccagcggccccaaccccuacgccagaaacagaccccccuucggccagggcuacacccagcccggccccggcuacagauaa

SEQ ID NO: 24548 - RNA, 2097 nt, Artificial Sequence
  TF__Homo_sapiens__XP_011511402
augagacuggccgugggcgcccugcuggugugcgccgugcugggccugugccuggccgugcccgacaagaccgugagauggugcgccgugagcgagcacgaggccaccaagugccagagcuucagagaccacaugaagagcgugauccccagcgacggccccagcguggccugcgugaagaaggccagcuaccuggacugcaucagagccaucgccgccaacgaggccgacgccgugacccuggacgccggccugguguacgacgccuaccuggcccccaacaaccugaagcccgugguggccgaguucuacggcagcaaggaggacccccagaccuucuacuacgccguggccguggugaagaaggacagcggcuuccagaugaaccagcugagaggcaagaagagcugccacaccggccugggcagaagcgccggcuggaacauccccaucggccugcuguacugcgaccugcccgagcccagaaagccccuggagaaggccguggccaacuucuucagcggcagcugcgcccccugcgccgacggcaccgacuucccccagcugugccagcugugccccggcugcggcugcagcacccugaaccaguacuucggcuacagcggcgccuucaagugccugaaggacggcgccggcgacguggccuucgugaagcacagcaccaucuucgagaaccuggccaacaaggccgacagagaccaguacgagcugcugugccuggacaacaccagaaagcccguggacgaguacaaggacugccaccuggcccaggugcccagccacaccgugguggccagaagcaugggcggcaaggaggaccugaucugggagcugcugaaccaggcccaggagcacuucggcaaggacaagagcaaggaguuccagcuguucagcagcccccacggcaaggaccugcuguucaaggacagcgcccacggcuuccugaaggugccccccagaauggacgccaagauguaccugggcuacgaguacgugaccgccaucagaaaccugagagagggcaccugccccgaggcccccaccgacgagugcaagcccgugaaguggugcgcccugagccaccacgagagacugaagugcgacgaguggagcgugaacagcgugggcaagaucgagugcgugagcgccgagaccaccgaggacugcaucgccaagaucaugaacggcgaggccgacgccaugagccuggacggcggcuucguguacaucgccggcaagugcggccuggugcccgugcuggccgagaacuacaacaagagcgacaacugcgaggacacccccgaggccggcuacuucgccaucgccguggugaagaagagcgccagcgaccugaccugggacaaccugaagggcaagaagagcugccacaccgccgugggcagaaccgccggcuggaacauccccaugggccugcuguacaacaagaucaaccacugcagauucgacgaguucuucagcgagggcugcgcccccggcagcaagaaggacagcagccugugcaagcugugcaugggcagcggccugaaccugugcgagcccaacaacaaggagggcuacuacggcuacaccggcgccuucagaugccugguggagaagggcgacguggccuucgugaagcaccagaccgugccccagaacaccggcggcaagaaccccgaccccugggccaagaaccugaacgagaaggacuacgagcugcugugccuggacggcaccagaaagcccguggaggaguacgccaacugccaccuggccagagcccccaaccacgccguggugaccagaaaggacaaggaggccugcgugcacaagauccugagacagcagcagcaccuguucggcagcaacgugaccgacugcagcggcaacuucugccuguucagaagcgagaccaaggaccugcuguucagagacgacaccgugugccuggccaagcugcacgacagaaacaccuacgagaaguaccugggcgaggaguacgugaaggccgugggcaaccugagaaagugcagcaccagcagccugcuggaggccugcaccuucagaagacccuaa

SEQ ID NO: 24549 - RNA, 2514 nt, Artificial Sequence
  TFIP11__Homo_sapiens__XP_011528381
augagccugagccaccuguacagagacggcgagggcagaaucgacgacgacgacgacgagagagagaacuucgagaucaccgacugggaccugcagaacgaguucaaccccaacagacagagacacuggcagaccaaggaggaggccaccuacggcgugugggccgagagagacagcgacgacgagagacccagcuucggcggcaagagagccagagacuacagcgcccccgugaacuucaucagcgccggccugaagaagggcgccgccgaggaggccgagcuggaggacagcgacgacgaggagaagcccgugaagcaggacgacuuccccaaggacuucggccccagaaagcugaagaccggcggcaacuucaagcccagccagaagggcuucgccggcggcaccaagagcuucauggacuucggcagcugggagagacacaccaagggcaucggccagaagcugcugcagaagaugggcuacgugcccggcagaggccugggcaagaacgcccagggcaucaucaaccccaucgaggccaagcagagaaagggcaagggcgccgugggcgccuacggcagcgagagaaccacccagagcaugcaggacuuccccgugguggacagcgaggaggaggccgaggaggaguuccagaaggagcugagccaguggagaaaggaccccagcggcagcaagaagaagcccaaguacagcuacaagaccguggaggagcugaaggccaagggcagaaucagcaagaagcugaccgccccccagaaggagcugagccaggugaaggugaucgacaugaccggcagagagcagaagguguacuacagcuacagccagaucagccacaagcacaacgugcccgacgacggccugccccugcagagccagcagcugccccagagcggcaaggaggccaaggcccccggcuucgcccugcccgagcuggagcacaaccugcagcugcugaucgaccugaccgagcaggagaucauccagaacgacagacagcugcaguacgagagagacaugguggugaaccuguuccacgagcuggagaagaugaccgaggugcuggaccacgaggagagagugaucagcaaccugagcaaggugcuggagaugguggaggagugcgagagaagaaugcagcccgacugcagcaacccccugacccuggacgagugcgccagaaucuucgagacccugcaggacaaguacuacgaggaguacagaaugagcgacagaguggaccuggccguggccaucguguacccccugaugaaggaguacuucaaggagugggacccccugaaggacugcaccuacggcaccgagaucaucagcaaguggaagagccugcuggagaacgaccagcugcugagccacggcggccaggaccugagcgccgacgccuuccacagacugaucugggagguguggaugcccuucgugagaaacaucgugacccaguggcagcccagaaacugcgaccccaugguggacuuccuggacagcugggugcacaucauccccguguggauccuggacaacauccuggaccagcugaucuuccccaagcugcagaaggagguggagaacuggaacccccugaccgacaccgugcccauccacagcuggauccaccccuggcugccccugaugcaggccagacuggagccccuguacagccccaucagaagcaagcugagcagcgcccugcagaaguggcaccccagcgacagcagcgccaagcugauccugcagcccuggaaggacguguucacccccggcagcugggaggccuucauggugaagaacaucgugcccaagcugggcaugugccugggcgagcuggugaucaacccccaccagcagcacauggacgccuucuacugggugaucgacugggagggcaugaucagcgugagcagccuggugggccugcuggagaagcacuucuuccccaaguggcugcaggugcugugcagcuggcugagcaacagccccaacuacgaggagaucaccaagugguaccugggcuggaagagcauguucagcgaccaggugcuggcccaccccagcgugaaggacaaguucaacgaggcccuggacaucaugaacagagccgugagcagcaacgugggcgccuacaugcagcccggcgccagagagaacaucgccuaccugacccacaccgagagaagaaaggacuuccaguacgaggccaugcaggagagaagagaggccgagaacauggcccagagaggcaucggcguggccgccagcagcgugcccaugaacuucaaggaccugaucgagaccaaggccgaggagcacaacaucguguucaugcccgugaucggcaagagacacgagggcaagcagcuguacaccuucggcagaaucgugaucuacaucgacagaggcgugguguucgugcagggcgagaagaccugggugcccaccagccugcagagccugaucgacauggccaaguaa

SEQ ID NO: 24550 - RNA, 561 nt, Artificial Sequence
  TFPI2__Homo_sapiens__NP_001257933
auggaccccgccagaccccugggccugagcauccugcugcuguuccugaccgaggccgcccugggcgacgccgcccaggagcccaccggcaacaacgccgagaucugccugcugccccuggacuacggccccugcagagcccugcugcugagauacuacuacgacagauacacccagagcugcagacaguuccuguacggcggcugcgagggcaacgccaacaacuucuacaccugggaggccugcgacgacgccugcuggagaaucgagaaggugcccaaggugugcagacugcaggugagcguggacgaccagugcgagggcagcaccgagaaguacuucuucaaccugagcagcaugaccugcgagaaguucuucagcggcggcugccacagaaacagaaucgagaacagauuccccgacgaggccaccugcaugggcuucugcgcccccaagaagaacaccgagcccgugaugcugagccccauccuggccguggagggcaugaccaucacccugcuggccggcagaaucgccaacgugcacgugcagaagcuguaa

SEQ ID NO: 24551 - RNA, 756 nt, Artificial Sequence
  TFPI__Homo_sapiens__NP_001027452
augaucuacaccaugaagaaggugcacgcccugugggccagcgugugccugcugcugaaccuggcccccgccccccugaacgccgacagcgaggaggacgaggagcacaccaucaucaccgacaccgagcugcccccccugaagcugaugcacagcuucugcgccuucaaggccgacgacggccccugcaaggccaucaugaagagauucuucuucaacaucuucaccagacagugcgaggaguucaucuacggcggcugcgagggcaaccagaacagauucgagagccuggaggagugcaagaagaugugcaccagagacaacgccaacagaaucaucaagaccacccugcagcaggagaagcccgacuucugcuuccuggaggaggaccccggcaucugcagaggcuacaucaccagauacuucuacaacaaccagaccaagcagugcgagagauucaaguacggcggcugccugggcaacaugaacaacuucgagacccuggaggagugcaagaacaucugcgaggacggccccaacggcuuccagguggacaacuacggcacccagcugaacgccgugaacaacagccugaccccccagagcaccaaggugcccagccuguucgugaccaaggagggcaccaacgacggcuggaagaacgccgcccacaucuaccagguguuccugaacgccuucugcauccacgccagcauguucuuccugggccuggacagcaucagcugccugugcuaa

SEQ ID NO: 24552 - RNA, 762 nt, Artificial Sequence
  TFPT__Homo_sapiens__NP_037474
auggagcuggagcagagagagggcaccauggccgccgugggcuucgaggaguucagcgccccccccggcagcgagcuggcccugcccccccuguucggcggccacauccuggagagcgagcuggagaccgagguggaguucgugagcggcggccugggcggcagcggccugagagagagagacgaggaggaggaggccgccagaggcagaagaagaagacagagagagcugaacagaagaaaguaccaggcccugggcagaagaugcagagagaucgagcaggugaacgagagagugcugaacagacugcaccaggugcagagaaucaccagaagacugcagcaggagagaagauuccugaugagagugcuggacagcuacggcgacgacuacagagccagccaguucaccaucgugcuggaggacgagggcagccagggcaccgacgcccccacccccggcaacgccgagaacgagccccccgagaaggagacccugagcccccccagaagaacccccgccccccccgagcccggcagccccgcccccggcgagggccccagcggcagaaagagaagaagagugcccagagacggcagaagagccggcaacgcccugacccccgagcuggcccccgugcagaucaagguggaggaggacuucggcuucgaggccgacgaggcccuggacagcagcugggugagcagaggccccgacaagcugcugcccuaccccacccuggccagccccgccagcgacuaa

SEQ ID NO: 24553 - RNA, 1893 nt, Artificial Sequence
  TFR2__Homo_sapiens__NP_001193784
auggccgcccugacccaggacaucagagccgcccugagcagacagaagcuggaccacguguggaccgacacccacuacgugggccugcaguuccccgaccccgcccaccccaacacccugcacuggguggacgaggccggcaaggugggcgagcagcugccccuggaggaccccgacguguacugccccuacagcgccaucggcaacgugaccggcgagcugguguacgcccacuacggcagacccgaggaccugcaggaccugagagccagaggcguggaccccgugggcagacugcugcuggugagagugggcgugaucagcuucgcccagaaggugaccaacgcccaggacuucggcgcccagggcgugcugaucuaccccgagcccgccgacuucagccaggacccccccaagcccagccugagcagccagcaggccguguacggccacgugcaccugggcaccggcgaccccuacacccccggcuuccccagcuucaaccagacccaguucccccccguggccagcagcggccugcccagcauccccgcccagcccaucagcgccgacaucgccagcagacugcugagaaagcugaagggccccguggccccccaggaguggcagggcagccugcugggcagccccuaccaccugggccccggccccagacugagacugguggugaacaaccacagaaccagcacccccaucaacaacaucuucggcugcaucgagggcagaagcgagcccgaccacuacguggugaucggcgcccagagagacgccuggggccccggcgccgccaagagcgccgugggcaccgccauccugcuggagcuggugagaaccuucagcagcauggugagcaacggcuucagacccagaagaagccugcuguucaucagcugggacggcggcgacuucggcagcgugggcagcaccgaguggcuggagggcuaccugagcgugcugcaccugaaggccgugguguacgugagccuggacaacgccgugcugggcgacgacaaguuccacgccaagaccagcccccugcugaccagccugaucgagagcgugcugaagcagguggacagccccaaccacagcggccagacccuguacgagcaggugguguucaccaaccccagcugggacgccgaggugaucagaccccugcccauggacagcagcgccuacagcuucaccgccuucgugggcgugcccgccguggaguucagcuucauggaggacgaccaggccuaccccuuccugcacaccaaggaggacaccuacgagaaccugcacaaggugcugcagggcagacugcccgccguggcccaggccguggcccagcuggccggccagcugcugaucagacugagccacgacagacugcugccccuggacuucggcagauacggcgacguggugcugagacacaucggcaaccugaacgaguucagcggcgaccugaaggccagaggccugacccugcaguggguguacagcgccagaggcgacuacaucagagccgccgagaagcugagacaggagaucuacagcagcgaggagagagacgagagacugaccagaauguacaacgugagaaucaugagaguggaguucuacuuccugagccaguacgugagccccgccgacagccccuucagacacaucuucaugggcagaggcgaccacacccugggcgcccugcuggaccaccugagacugcugagaagcaacagcagcggcacccccggcgccaccagcagcaccggcuuccaggagagcagauucagaagacagcuggcccugcugaccuggacccugcagggcgccgccaacgcccugagcggcgacguguggaacaucgacaacaacuucuaa

SEQ ID NO: 24554 - RNA, 2283 nt, Artificial Sequence
  TFRC__Homo_sapiens__NP_003225
augauggaccaggccagaagcgccuucagcaaccuguucggcggcgagccccugagcuacaccagauucagccuggccagacagguggacggcgacaacagccacguggagaugaagcuggccguggacgaggaggagaacgccgacaacaacaccaaggccaacgugaccaagcccaagagaugcagcggcagcaucugcuacggcaccaucgccgugaucguguucuuccugaucggcuucaugaucggcuaccugggcuacugcaagggcguggagcccaagaccgagugcgagagacuggccggcaccgagagccccgugagagaggagcccggcgaggacuuccccgccgccagaagacuguacugggacgaccugaagagaaagcugagcgagaagcuggacagcaccgacuucaccggcaccaucaagcugcugaacgagaacagcuacgugcccagagaggccggcagccagaaggacgagaaccuggcccuguacguggagaaccaguucagagaguucaagcugagcaagguguggagagaccagcacuucgugaagauccaggugaaggacagcgcccagaacagcgugaucaucguggacaagaacggcagacugguguaccugguggagaaccccggcggcuacguggccuacagcaaggccgccaccgugaccggcaagcuggugcacgccaacuucggcaccaagaaggacuucgaggaccuguacacccccgugaacggcagcaucgugaucgugagagccggcaagaucaccuucgccgagaagguggccaacgccgagagccugaacgccaucggcgugcugaucuacauggaccagaccaaguuccccaucgugaacgccgagcugagcuucuucggccacgcccaccugggcaccggcgaccccuacacccccggcuuccccagcuucaaccacacccaguucccccccagcagaagcagcggccugcccaacauccccgugcagaccaucagcagagccgccgccgagaagcuguucggcaacauggagggcgacugccccagcgacuggaagaccgacagcaccugcagaauggugaccagcgagagcaagaacgugaagcugaccgugagcaacgugcugaaggagaucaagauccugaacaucuucggcgugaucaagggcuucguggagcccgaccacuacgugguggugggcgcccagagagacgccuggggccccggcgccgccaagagcggcgugggcaccgcccugcugcugaagcuggcccagauguucagcgacauggugcugaaggacggcuuccagcccagcagaagcaucaucuucgccagcuggagcgccggcgacuucggcagcgugggcgccaccgaguggcuggagggcuaccugagcagccugcaccugaaggccuucaccuacaucaaccuggacaaggccgugcugggcaccagcaacuucaaggugagcgccagcccccugcuguacacccugaucgagaagaccaugcagaacgugaagcaccccgugaccggccaguuccuguaccaggacagcaacugggccagcaagguggagaagcugacccuggacaacgccgccuuccccuuccuggccuacagcggcauccccgccgugagcuucugcuucugcgaggacaccgacuaccccuaccugggcaccaccauggacaccuacaaggagcugaucgagagaauccccgagcugaacaagguggccagagccgccgccgagguggccggccaguucgugaucaagcugacccacgacguggagcugaaccuggacuacgagagauacaacagccagcugcugagcuucgugagagaccugaaccaguacagagccgacaucaaggagaugggccugagccugcaguggcuguacagcgccagaggcgacuucuucagagccaccagcagacugaccaccgacuucggcaacgccgagaagaccgacagauucgugaugaagaagcugaacgacagagugaugagaguggaguaccacuuccugagccccuacgugagccccaaggagagccccuucagacacguguucuggggcagcggcagccacacccugcccgcccugcuggagaaccugaagcugagaaagcagaacaacggcgccuucaacgagacccuguucagaaaccagcuggcccuggccaccuggaccauccagggcgccgccaacgcccugagcggcgacgugugggacaucgacaacgaguucuaa

SEQ ID NO: 24555 - RNA, 480 nt, Artificial Sequence
  TGFA__Homo_sapiens__NP_001093161
auggugcccagcgccggccagcuggcccuguucgcccugggcaucgugcuggccgccugccaggcccuggagaacagcaccagcccccugagcgacccccccguggccgccgccguggugagccacuucaacgacugccccgacagccacacccaguucugcuuccacggcaccugcagauuccuggugcaggaggacaagcccgccugcgugugccacagcggcuacgugggcgccagaugcgagcacgccgaccugcuggccgugguggccgccagccagaagaagcaggccaucaccgcccuggugguggugagcaucguggcccuggccgugcugaucaucaccugcgugcugauccacugcugccaggugagaaagcacugcgaguggugcagagcccugaucugcagacacgagaagcccagcgcccugcugaagggcagaaccgccugcugccacagcgagaccgugguguaa

SEQ ID NO: 24556 - RNA, 1173 nt, Artificial Sequence
  TGFB1__Homo_sapiens__NP_000651
augccccccagcggccugagacugcugccccugcugcugccccugcuguggcugcuggugcugacccccggcagacccgccgccggccugagcaccugcaagaccaucgacauggagcuggugaagagaaagagaaucgaggccaucagaggccagauccugagcaagcugagacuggccagcccccccagccagggcgaggugccccccggcccccugcccgaggccgugcuggcccuguacaacagcaccagagacagaguggccggcgagagcgccgagcccgagcccgagcccgaggccgacuacuacgccaaggaggugaccagagugcugaugguggagacccacaacgagaucuacgacaaguucaagcagagcacccacagcaucuacauguucuucaacaccagcgagcugagagaggccgugcccgagcccgugcugcugagcagagccgagcugagacugcugagacugaagcugaagguggagcagcacguggagcuguaccagaaguacagcaacaacagcuggagauaccugagcaacagacugcuggcccccagcgacagccccgaguggcugagcuucgacgugaccggcguggugagacaguggcugagcagaggcggcgagaucgagggcuucagacugagcgcccacugcagcugcgacagcagagacaacacccugcagguggacaucaacggcuucaccaccggcagaagaggcgaccuggccaccauccacggcaugaacagacccuuccugcugcugauggccaccccccuggagagagcccagcaccugcagagcagcagacacagaagagcccuggacaccaacuacugcuucagcagcaccgagaagaacugcugcgugagacagcuguacaucgacuucagaaaggaccugggcuggaaguggauccacgagcccaagggcuaccacgccaacuucugccugggccccugccccuacaucuggagccuggacacccaguacagcaaggugcuggcccuguacaaccagcacaaccccggcgccagcgccgcccccugcugcgugccccaggcccuggagccccugcccaucguguacuacgugggcagaaagcccaagguggagcagcugagcaacaugaucgugagaagcugcaagugcagcuaa

SEQ ID NO: 24557 - RNA, 1386 nt, Artificial Sequence
  TGFB1I1__Homo_sapiens__NP_001035919
auggaggaccuggacgcccugcugagcgaccuggagaccaccaccagccacaugcccagaagcggcgcccccaaggagagacccgccgagccccugacccccccccccagcuacggccaccagccccagaccggcagcggcgagagcagcggcgccagcggcgacaaggaccaccuguacagcaccgugugcaagcccagaagccccaagcccgccgcccccgccgccccccccuucagcagcagcagcggcgugcugggcaccggccugugcgagcuggacagacugcugcaggagcugaacgccacccaguucaacaucaccgacgagaucaugagccaguuccccagcagcaagguggccagcggcgagcagaaggaggaccagagcgaggacaagaagagacccagccugcccagcagccccagccccggccugcccaaggccagcgccaccagcgccacccuggagcuggacagacugauggccagccugagcgacuucagagugcagaaccaccugcccgccagcggccccacccagccccccguggugagcagcaccaacgagggcagccccagcccccccgagcccaccggcaagggcagccuggacaccaugcugggccugcugcagagcgaccugagcagaagaggcgugcccacccaggccaagggccugugcggcagcugcaacaagcccaucgccggccagguggugaccgcccugggcagagccuggcaccccgagcacuucgugugcggcggcugcagcaccgcccugggcggcagcagcuucuucgagaaggacggcgcccccuucugccccgagugcuacuucgagagauucagccccagaugcggcuucugcaaccagcccaucagacacaagauggugaccgcccugggcacccacuggcaccccgagcacuucugcugcgugagcugcggcgagcccuucggcgacgagggcuuccacgagagagagggcagacccuacugcagaagagacuuccugcagcuguucgcccccagaugccagggcugccagggccccauccuggacaacuacaucagcgcccugagcgcccuguggcaccccgacugcuucgugugcagagagugcuucgcccccuucagcggcggcagcuucuucgagcacgagggcagaccccugugcgagaaccacuuccacgccagaagaggcagccugugcgccaccugcggccugcccgugaccggcagaugcgugagcgcccugggcagaagauuccaccccgaccacuucaccugcaccuucugccugagaccccugaccaagggcagcuuccaggagagagccggcaagcccuacugccagcccugcuuccugaagcuguucggcuaa

SEQ ID NO: 24558 - RNA, 1329 nt, Artificial Sequence
  TGFB2__Homo_sapiens__NP_001129071
augcacuacugcgugcugagcgccuuccugauccugcaccuggugaccguggcccugagccugagcaccugcagcacccuggacauggaccaguucaugagaaagagaaucgaggccaucagaggccagauccugagcaagcugaagcugaccagcccccccgaggacuaccccgagcccgaggaggugccccccgaggugaucagcaucuacaacagcaccagagaccugcugcaggagaaggccagcagaagagccgccgccugcgagagagagagaagcgacgaggaguacuacgccaaggagguguacaagaucgacaugccccccuucuuccccagcgagaccgugugccccguggugaccacccccagcggcagcgugggcagccugugcagcagacagagccaggugcugugcggcuaccuggacgccaucccccccaccuucuacagacccuacuucagaaucgugagauucgacgugagcgccauggagaagaacgccagcaaccuggugaaggccgaguucagaguguucagacugcagaaccccaaggccagagugcccgagcagagaaucgagcuguaccagauccugaagagcaaggaccugaccagccccacccagagauacaucgacagcaagguggugaagaccagagccgagggcgaguggcugagcuucgacgugaccgacgccgugcacgaguggcugcaccacaaggacagaaaccugggcuucaagaucagccugcacugccccugcugcaccuucgugcccagcaacaacuacaucauccccaacaagagcgaggagcuggaggccagauucgccggcaucgacggcaccagcaccuacaccagcggcgaccagaagaccaucaagagcaccagaaagaagaacagcggcaagaccccccaccugcugcugaugcugcugcccagcuacagacuggagagccagcagaccaacagaagaaagaagagagcccuggacgccgccuacugcuucagaaacgugcaggacaacugcugccugagaccccuguacaucgacuucaagagagaccugggcuggaaguggauccacgagcccaagggcuacaacgccaacuucugcgccggcgccugccccuaccuguggagcagcgacacccagcacagcagagugcugagccuguacaacaccaucaaccccgaggccagcgccagccccugcugcgugagccaggaccuggagccccugaccauccuguacuacaucggcaagacccccaagaucgagcagcugagcaacaugaucgugaagagcugcaagugcagcuaa

SEQ ID NO: 24559 - RNA, 1239 nt, Artificial Sequence
  TGFB3__Homo_sapiens__NP_003230
augaagaugcaccugcagagagcccugguggugcuggcccugcugaacuucgccaccgugagccugagccugagcaccugcaccacccuggacuucggccacaucaagaagaagagaguggaggccaucagaggccagauccugagcaagcugagacugaccagcccccccgagcccaccgugaugacccacgugcccuaccaggugcuggcccuguacaacagcaccagagagcugcuggaggagaugcacggcgagagagaggagggcugcacccaggagaacaccgagagcgaguacuacgccaaggagauccacaaguucgacaugauccagggccuggccgagcacaacgagcuggccgugugccccaagggcaucaccagcaagguguucagauucaacgugagcagcguggagaagaacagaaccaaccuguucagagccgaguucagagugcugagagugcccaaccccagcagcaagagaaacgagcagagaaucgagcuguuccagauccugagacccgacgagcacaucgccaagcagagauacaucggcggcaagaaccugcccaccagaggcaccgccgaguggcugagcuucgacgugaccgacaccgugagagaguggcugcugagaagagagagcaaccugggccuggagaucagcauccacugccccugccacaccuuccagcccaacggcgacauccuggagaacauccacgaggugauggagaucaaguucaagggcguggacaacgaggacgaccacggcagaggcgaccugggcagacugaagaagcagaaggaccaccacaacccccaccugauccugaugaugauccccccccacagacuggacaaccccggccagggcggccagagaaagaagagagcccuggacaccaacuacugcuucagaaaccuggaggagaacugcugcgugagaccccuguacaucgacuucagacaggaccugggcuggaagugggugcacgagcccaagggcuacuacgccaacuucugcagcggccccugccccuaccugagaagcgccgacaccacccacagcaccgugcugggccuguacaacacccugaaccccgaggccagcgccagccccugcugcgugccccaggaccuggagccccugaccauccuguacuacgugggcagaacccccaagguggagcagcugagcaacaugguggugaagagcugcaagugcagcuaa

SEQ ID NO: 24560 - RNA, 2052 nt, Artificial Sequence
  TGFBI__Homo_sapiens__NP_000349
auggcccuguucgugagacugcuggcccuggcccuggcccuggcccugggccccgccgccacccuggccggccccgccaagagccccuaccagcuggugcugcagcacagcagacugagaggcagacagcacggccccaacgugugcgccgugcagaaggugaucggcaccaacagaaaguacuucaccaacugcaagcagugguaccagagaaagaucugcggcaagagcaccgugaucagcuacgagugcugccccggcuacgagaaggugcccggcgagaagggcugccccgccgcccugccccugagcaaccuguacgagacccugggcguggugggcagcaccaccacccagcuguacaccgacagaaccgagaagcugagacccgagauggagggccccggcagcuucaccaucuucgcccccagcaacgaggccugggccagccugcccgccgaggugcuggacagccuggugagcaacgugaacaucgagcugcugaacgcccugagauaccacauggugggcagaagagugcugaccgacgagcugaagcacggcaugacccugaccagcauguaccagaacagcaacauccagauccaccacuaccccaacggcaucgugaccgugaacugcgccagacugcugaaggccgaccaccacgccaccaacggcguggugcaccugaucgacaaggugaucagcaccaucaccaacaacauccagcagaucaucgagaucgaggacaccuucgagacccugagagccgccguggccgccagcggccugaacaccaugcuggagggcaacggccaguacacccugcuggcccccaccaacgaggccuucgagaagauccccagcgagacccugaacagaauccugggcgaccccgaggcccugagagaccugcugaacaaccacauccugaagagcgccaugugcgccgaggccaucguggccggccugagcguggagacccuggagggcaccacccuggaggugggcugcagcggcgacaugcugaccaucaacggcaaggccaucaucagcaacaaggacauccuggccaccaacggcgugauccacuacaucgacgagcugcugauccccgacagcgccaagacccuguucgagcuggccgccgagagcgacgugagcaccgccaucgaccuguucagacaggccggccugggcaaccaccugagcggcagcgagagacugacccugcuggccccccugaacagcguguucaaggacggcaccccccccaucgacgcccacaccagaaaccugcugagaaaccacaucaucaaggaccagcuggccagcaaguaccuguaccacggccagacccuggagacccugggcggcaagaagcugagaguguucguguacagaaacagccugugcaucgagaacagcugcaucgccgcccacgacaagagaggcagauacggcacccuguucaccauggacagagugcugaccccccccaugggcaccgugauggacgugcugaagggcgacaacagauucagcaugcugguggccgccauccagagcgccggccugaccgagacccugaacagagagggcguguacaccguguucgcccccaccaacgaggccuucagagcccugccccccagagagagaagcagacugcugggcgacgccaaggagcuggccaacauccugaaguaccacaucggcgacgagauccuggugagcggcggcaucggcgcccuggugagacugaagagccugcagggcgacaagcuggaggugagccugaagaacaacguggugagcgugaacaaggagcccguggccgagcccgacaucauggccaccaacggcguggugcacgugaucaccaacgugcugcagccccccgccaacagaccccaggagagaggcgacgagcuggccgacagcgcccuggagaucuucaagcaggccagcgccuucagcagagccagccagagaagcgugagacuggcccccguguaccagaagcugcuggagagaaugaagcacuaa

SEQ ID NO: 24561 - RNA, 1281 nt, Artificial Sequence
  TGFBR1__Homo_sapiens__NP_001124388
auggaggccgccguggccgcccccagacccagacugcugcugcuggugcuggccgccgccgccgccgccgccgccgcccugcugcccggcgccaccgcccugcagugcuucugccaccugugcaccaaggacaacuucaccugcgugaccgacggccugugcuucgugagcgugaccgagaccaccgacaaggugauccacaacagcaugugcaucgccgagaucgaccugauccccagagacagacccuucgugugcgcccccagcagcaagaccggcagcgugaccaccaccuacugcugcaaccaggaccacugcaacaagaucgagcugcccaccaccggccugccccugcuggugcagagaaccaucgccagaaccaucgugcugcaggagagcaucggcaagggcagauucggcgagguguggagaggcaaguggagaggcgaggagguggccgugaagaucuucagcagcagagaggagagaagcugguucagagaggccgagaucuaccagaccgugaugcugagacacgagaacauccugggcuucaucgccgccgacaacaaggacaacggcaccuggacccagcuguggcuggugagcgacuaccacgagcacggcagccuguucgacuaccugaacagauacaccgugaccguggagggcaugaucaagcuggcccugagcaccgccagcggccuggcccaccugcacauggagaucgugggcacccagggcaagcccgccaucgcccacagagaccugaagagcaagaacauccuggugaagaagaacggcaccugcugcaucgccgaccugggccuggccgugagacacgacagcgccaccgacaccaucgacaucgcccccaaccacagagugggcaccaagagauacauggcccccgaggugcuggacgacagcaucaacaugaagcacuucgagagcuucaagagagccgacaucuacgccaugggccugguguucugggagaucgccagaagaugcagcaucggcggcauccacgaggacuaccagcugcccuacuacgaccuggugcccagcgaccccagcguggaggagaugagaaagguggugugcgagcagaagcugagacccaacauccccaacagauggcagagcugcgaggcccugagagugauggccaagaucaugagagagugcugguacgccaacggcgccgccagacugaccgcccugagaaucaagaagacccugagccagcugagccagcaggagggcaucaagauguaa

SEQ ID NO: 24562 - RNA, 1779 nt, Artificial Sequence
  TGFBR2__Homo_sapiens__NP_001020018
augggcagaggccugcugagaggccuguggccccugcacaucgugcuguggaccagaaucgccagcaccauccccccccacgugcagaagagcgacguggagauggaggcccagaaggacgagaucaucugccccagcugcaacagaaccgcccacccccugagacacaucaacaacgacaugaucgugaccgacaacaacggcgccgugaaguucccccagcugugcaaguucugcgacgugagauucagcaccugcgacaaccagaagagcugcaugagcaacugcagcaucaccagcaucugcgagaagccccaggaggugugcguggccguguggagaaagaacgacgagaacaucacccuggagaccgugugccacgaccccaagcugcccuaccacgacuucauccuggaggacgccgccagccccaagugcaucaugaaggagaagaagaagcccggcgagaccuucuucaugugcagcugcagcagcgacgagugcaacgacaacaucaucuucagcgaggaguacaacaccagcaaccccgaccugcugcuggugaucuuccaggugaccggcaucagccugcugcccccccugggcguggccaucagcgugaucaucaucuucuacugcuacagagugaacagacagcagaagcugagcagcaccugggagaccggcaagaccagaaagcugauggaguucagcgagcacugcgccaucauccuggaggacgacagaagcgacaucagcagcaccugcgccaacaacaucaaccacaacaccgagcugcugcccaucgagcuggacacccuggugggcaagggcagauucgccgagguguacaaggccaagcugaagcagaacaccagcgagcaguucgagaccguggccgugaagaucuuccccuacgaggaguacgccagcuggaagaccgagaaggacaucuucagcgacaucaaccugaagcacgagaacauccugcaguuccugaccgccgaggagagaaagaccgagcugggcaagcaguacuggcugaucaccgccuuccacgccaagggcaaccugcaggaguaccugaccagacacgugaucagcugggaggaccugagaaagcugggcagcagccuggccagaggcaucgcccaccugcacagcgaccacacccccugcggcagacccaagaugcccaucgugcacagagaccugaagagcagcaacauccuggugaagaacgaccugaccugcugccugugcgacuucggccugagccugagacuggaccccacccugagcguggacgaccuggccaacagcggccaggugggcaccgccagauacauggcccccgaggugcuggagagcagaaugaaccuggagaacguggagagcuucaagcagaccgacguguacagcauggcccuggugcugugggagaugaccagcagaugcaacgccgugggcgaggugaaggacuacgagccccccuucggcagcaaggugagagagcaccccugcguggagagcaugaaggacaacgugcugagagacagaggcagacccgagauccccagcuucuggcugaaccaccagggcauccagauggugugcgagacccugaccgagugcugggaccacgaccccgaggccagacugaccgcccagugcguggccgagagauucagcgagcuggagcaccuggacagacugagcggcagaagcugcagcgaggagaagauccccgaggacggcagccugaacaccaccaaguaa

SEQ ID NO: 24563 - RNA, 2583 nt, Artificial Sequence
  TGFBRAP1__Homo_sapiens__NP_001136093
augaugagcaucaaggccuucacccuggugagcgccguggagagagagcugcugaugggcgacaaggagagagugaacaucgagugcguggagugcugcggcagagaccuguacgugggcaccaacgacugcuucguguaccacuuccugcuggaggagagacccgugcccgccggccccgccaccuucaccgccaccaagcagcugcagagacaccugggcuucaagaagcccgugaacgagcugagagccgccagcgcccugaacagacugcuggugcugugcgacaacagcaucagccuggugaacaugcugaaccuggagcccgugcccagcggcgccagaaucaagggcgccgccaccuucgcccugaacgagaaccccgugagcggcgaccccuucugcguggaggugugcaucaucagcgugaagagaagaaccauccagauguuccugguguacgaggacagagugcagaucgugaaggaggugagcaccgccgagcagccccuggccguggccguggacggccacuuccugugccuggcccugaccacccaguacaucauccacaacuacagcaccggcgugagccaggaccuguuccccuacugcagcgaggagagaccccccaucgugaagagaaucggcagacaggaguuccugcuggccggccccggcggccugggcauguucgccaccguggccggcaucagccagagagcccccgugcacuggagcgagaacgugaucggcgccgccgugagcuuccccuacgugaucgcccuggacgacgaguucaucaccgugcacagcaugcuggaccagcagcagaagcagacccugcccuucaaggagggccacauccugcaggacuucgagggcagagugaucguggccaccagcaagggcguguacauccuggugccccugccccuggagaagcagauccaggaccugcuggccagcagaagaguggaggaggcccuggugcuggccaagggcgccagaagaaacauccccaaggagaaguuccaggugauguacagaagaauccugcagcaggccggcuucauccaguucgcccagcugcaguuccuggaggccaaggagcuguucagaagcggccagcuggacgugagagagcugaucagccuguaccccuuccugcugcccaccagcagcagcuucaccagaagccaccccccccugcacgaguacgccgaccugaaccagcugacccagggcgaccaggagaagauggccaagugcaagagauuccugaugagcuaccugaacgaggugagaagcaccgagguggccaacggcuacaaggaggacaucgacaccgcccugcugaagcuguacgccgaggccgaccacgacagccugcuggaccugcuggugaccgagaacuucugccugcugaccgacagcgccgccuggcuggagaagcacaagaaguacuucgcccugggccugcuguaccacuacaacaaccaggacgccgccgccgugcagcugugggugaacaucgugaacggcgacgugcaggacagcaccagaagcgaccuguacgaguacaucguggacuuccugaccuacugccuggacgaggagcuggugugggccuacgccgacugggugcugcagaagagcgaggaggugggcgugcagguguucaccaagagaccccuggacgagcagcagaagaacagcuucaaccccgacgacaucaucaacugccugaagaaguaccccaaggcccuggugaaguaccuggagcaccuggugaucgacaagagacugcagaaggaggaguaccacacccaccuggccgugcuguaccuggaggaggugcugcugcagagagccagcgccagcggcaagggcgccgaggccaccgagacccaggccaagcugagaagacugcugcagaagagcgaccuguacagagugcacuuccugcuggagagacugcagggcgccggccugcccauggagagcgccauccugcacggcaagcugggcgagcacgagaaggcccugcacauccuggugcacgagcugcaggacuucgccgccgccgaggacuacugccuguggugcagcgagggcagagaccccccccacagacagcagcuguuccacacccugcuggccaucuaccugcacgccggccccaccgcccacgagcuggccguggccgccguggaccugcugaacagacacgccaccgaguucgacgccgcccaggugcugcagaugcugcccgacaccuggagcgugcagcugcugugccccuuccugaugggcgccaugagagacagcauccacgccagaagaaccaugcagguggcccugggccuggccagaagcgagaaccugaucuacaccuacgacaagaugaagcugaagggcagcagcauccagcugagcgacaagaagcugugccagaucugccagaaccccuucugcgagcccguguucgugagauaccccaacggcggccuggugcacacccacugcgccgccagcagacacaccaaccccagcagcagcagccccggcaccagaaccuaa

SEQ ID NO: 24564 - RNA, 8307 nt, Artificial Sequence
  TG__Homo_sapiens__NP_003226
auggcccuggugcuggagaucuucacccugcuggccagcaucugcugggugagcgccaacaucuucgaguaccagguggacgcccagccccugagacccugcgagcugcagagagagaccgccuuccugaagcaggccgacuacgugccccagugcgccgaggacggcagcuuccagaccgugcagugccagaacgacggcagaagcugcuggugcgugggcgccaacggcagcgaggugcugggcagcagacagcccggcagacccguggccugccugagcuucugccagcugcagaagcagcagauccugcugagcggcuacaucaacagcaccgacaccagcuaccugccccagugccaggacagcggcgacuacgcccccgugcagugcgacgugcagcaggugcagugcuggugcguggacgccgagggcauggagguguacggcaccagacagcugggcagacccaagagaugccccagaagcugcgagaucagaaacagaagacugcugcacggcgugggcgacaagagccccccccagugcagcgccgagggcgaguucaugcccgugcagugcaaguucgugaacaccaccgacaugaugaucuucgaccuggugcacagcuacaacagauuccccgacgccuucgugaccuucagcagcuuccagagaagauuccccgaggugagcggcuacugccacugcgccgacagccagggcagagagcuggccgagaccggccuggagcugcugcuggacgagaucuacgacaccaucuucgccggccuggaccugcccagcaccuucaccgagaccacccuguacagaauccugcagagaagauuccuggccgugcagagcgugaucagcggcagauucagaugccccaccaagugcgagguggagagauucaccgccaccagcuucggccaccccuacgugcccagcugcagaagaaacggcgacuaccaggccgugcagugccagaccgagggccccugcuggugcguggacgcccagggcaaggagaugcacggcaccagacagcagggcgagccccccagcugcgccgagggccagagcugcgccagcgagagacagcaggcccugagcagacuguacuucggcaccagcggcuacuucagccagcacgaccuguucagcagccccgagaagagaugggccagccccagaguggccagauucgccaccagcugcccccccaccaucaaggagcuguucguggacagcggccugcugagacccaugguggagggccagagccagcaguucagcgugagcgagaaccugcugaaggaggccaucagagccaucuuccccagcagaggccuggccagacuggcccugcaguucaccaccaaccccaagagacugcagcagaaccuguucggcggcaaguuccuggugaacgugggccaguucaaccugagcggcgcccugggcaccagaggcaccuucaacuucagccaguucuuccagcagcugggccuggccagcuuccugaacggcggcagacaggaggaccuggccaagccccugagcgugggccuggacagcaacagcagcaccggcacccccgaggccgccaagaaggacggcaccaugaacaagcccaccgugggcagcuucggcuucgagaucaaccugcaggagaaccagaacgcccugaaguuccuggccagccugcuggagcugcccgaguuccugcuguuccugcagcacgccaucagcgugcccgaggacguggccagagaccugggcgacgugauggagaccgugcugagcagccagaccugcgagcagacccccgagagacuguucgugcccagcugcaccaccgagggcagcuacgaggacgugcagugcuucagcggcgagugcuggugcgugaacagcuggggcaaggagcugcccggcagcagagugagaggcggccagcccagaugccccaccgacugcgagaagcagagagccagaaugcagagccugaugggcagccagcccgccggcagcacccuguucgugcccgccugcaccagcgagggccacuuccugcccgugcagugcuucaacagcgagugcuacugcguggacgccgagggccaggccauccccggcaccagaagcgccaucggcaagcccaagaagugccccacccccugccagcugcagagcgagcaggccuuccugagaaccgugcaggcccugcugagcaacagcagcaugcugcccacccugagcgacaccuacaucccccagugcagcaccgacggccaguggagacaggugcagugcaacggcccccccgagcagguguucgagcuguaccagagaugggaggcccagaacaagggccaggaccugacccccgccaagcugcuggugaagaucaugagcuacagagaggccgccagcggcaacuucagccuguucauccagagccuguacgaggccggccagcaggacguguuccccgugcugagccaguaccccagccugcaggacgugccccuggccgcccuggagggcaagagaccccagcccagagagaacauccugcuggagcccuaccuguucuggcagauccugaacggccagcugagccaguaccccggcagcuacagcgacuucagcaccccccuggcccacuucgaccugagaaacugcuggugcguggacgaggccggccaggagcuggagggcaugagaagcgagcccagcaagcugcccaccugccccggcagcugcgaggaggccaagcugagagugcugcaguucaucagagagaccgaggagaucgugagcgccagcaacagcagcagauucccccugggcgagagcuuccugguggccaagggcaucagacugagaaacgaggaccugggccugcccccccuguucccccccagagaggccuucgccgagcaguuccugagaggcagcgacuacgccaucagacuggccgcccagagcacccugagcuucuaccagagaagaagauucagccccgacgacagcgccggcgccagcgcccugcugagaagcggccccuacaugccccagugcgacgccuucggcagcugggagcccgugcagugccacgccggcaccggccacugcuggugcguggacgagaagggcggcuucauccccggcagccugaccgccagaagccugcagaucccccagugccccaccaccugcgagaagagcagaaccagcggccugcugagcagcuggaagcaggccagaagccaggagaaccccagccccaaggaccuguucgugcccgccugccuggagaccggcgaguacgccagacugcaggccagcggcgccggcaccuggugcguggaccccgccagcggcgaggagcugagacccggcagcagcagcagcgcccagugccccagccugugcaacgugcugaagagcggcgugcugagcagaagagugagccccggcuacgugcccgccugcagagccgaggacggcggcuucagccccgugcagugcgaccaggcccagggcagcugcuggugcgugauggacagcggcgaggaggugcccggcaccagagugaccggcggccagcccgccugcgagagccccagaugcccccugcccuucaacgccagcgagguggugggcggcaccauccugugcgagaccaucagcggccccaccggcagcgccaugcagcagugccagcugcugugcagacagggcagcuggagcguguucccccccggcccccugaucugcagccuggagagcggcagaugggagagccagcugccccagcccagagccugccagagaccccagcuguggcagaccauccagacccagggccacuuccagcugcagcugccccccggcaagaugugcagcgccgacuacgccgaccugcugcagaccuuccagguguucauccuggacgagcugaccgccagaggcuucugccagauccaggugaagaccuucggcacccuggugagcauccccgugugcaacaacagcagcgugcaggugggcugccugaccagagagagacugggcgugaacgugaccuggaagagcagacuggaggacauccccguggccagccugcccgaccugcacgacaucgagagagcccuggugggcaaggaccugcugggcagauucaccgaccugauccagagcggcagcuuccagcugcaccuggacagcaagaccuuccccgccgagaccaucagauuccugcagggcgaccacuucggcaccagccccagaaccugguucggcugcagcgagggcuucuaccaggugcugaccagcgaggccagccaggacggccugggcugcgugaagugccccgagggcagcuacagccaggacgaggagugcauccccugccccgugggcuucuaccaggagcaggccggcagccuggccugcgugcccugccccgugggcagaaccaccaucagcgccggcgccuucagccagacccacugcgugaccgacugccagagaaacgaggccggccugcagugcgaccagaacggccaguacagagccagccagaaggacagaggcagcggcaaggccuucugcguggacggcgagggcagaagacugcccuggugggagaccgaggccccccuggaggacagccagugccugaugaugcagaaguucgagaaggugcccgagagcaaggugaucuucgacgccaacgcccccguggccgugagaagcaaggugcccgacagcgaguuccccgugaugcagugccugaccgacugcaccgaggacgaggccugcagcuucuucaccgugagcaccaccgagcccgagaucagcugcgacuucuacgccuggaccagcgacaacguggccugcaugaccagcgaccagaagagagacgcccugggcaacagcaaggccaccagcuucggcagccugagaugccaggugaaggugagaagccacggccaggacagccccgccguguaccugaagaagggccagggcagcaccaccacccugcagaagagauucgagcccaccggcuuccagaacaugcugagcggccuguacaaccccaucguguucagcgccagcggcgccaaccugaccgacgcccaccuguucugccugcuggccugcgacagagaccugugcugcgacggcuucgugcugacccaggugcagggcggcgccaucaucugcggccugcugagcagccccagcgugcugcugugcaacgugaaggacuggauggaccccagcgaggccugggccaacgccaccugccccggcgugaccuacgaccaggagagccaccaggugauccugagacugggcgaccaggaguucaucaagagccugaccccccuggagggcacccaggacaccuucaccaacuuccagcagguguaccuguggaaggacagcgacaugggcagcagacccgagagcaugggcugcagaaaggacaccgugcccagacccgccagccccaccgaggccggccugaccaccgagcuguucagccccguggaccugaaccaggugaucgugaacggcaaccagagccugagcagccagaagcacuggcuguucaagcaccuguucagcgcccagcaggccaaccuguggugccugagcagaugcgugcaggagcacagcuucugccagcuggccgagaucaccgagagcgccagccuguacuucaccugcacccuguaccccgaggcccaggugugcgacgacaucauggagagcaacgcccagggcugcagacugauccugccccagaugcccaaggcccuguucagaaagaaggugauccuggaggacaaggugaagaacuucuacaccagacugcccuuccagaagcugaugggcaucagcaucagaaacaaggugcccaugagcgagaagagcaucagcaacggcuucuucgagugcgagagaagaugcgacgccgaccccugcugcaccggcuucggcuuccugaacgugagccagcugaagggcggcgaggugaccugccugacccugaacagccugggcauccagaugugcagcgaggagaacggcggcgccuggagaauccuggacugcggcagccccgacaucgaggugcacaccuaccccuucggcugguaccagaagcccaucgcccagaacaacgcccccagcuucugcccccugguggugcugcccagccugaccgagaaggugagccuggacagcuggcagagccuggcccugagcagcguggugguggaccccagcaucagacacuucgacguggcccacgugagcaccgccgccaccagcaacuucagcgccgugagagaccugugccugagcgagugcagccagcacgaggccugccugaucaccacccugcagacccagcccggcgccgugagaugcauguucuacgccgacacccagagcugcacccacagccugcagggccagaacugcagacugcugcugagagaggaggccacccacaucuacagaaagcccggcaucagccugcugagcuacgaggccagcgugcccagcgugcccaucagcacccacggcagacugcugggcagaagccaggccauccaggugggcaccagcuggaagcagguggaccaguuccugggcgugcccuacgccgcccccccccuggccgagagaagauuccaggcccccgagccccugaacuggaccggcagcugggacgccagcaagcccagagccagcugcuggcagcccggcaccagaaccagcaccagccccggcgugagcgaggacugccuguaccugaacguguucaucccccagaacguggcccccaacgccagcgugcugguguucuuccacaacaccauggacagagaggagagcgagggcuggcccgccaucgacggcagcuuccuggccgccgugggcaaccugaucguggugaccgccagcuacagagugggcguguucggcuuccugagcagcggcagcggcgaggugagcggcaacuggggccugcuggaccagguggccgcccugaccugggugcagacccacaucagaggcuucggcggcgaccccagaagagugagccuggccgccgacagaggcggcgccgacguggccagcauccaccugcugaccgccagagccaccaacagccagcuguucagaagagccgugcugaugggcggcagcgcccugagccccgccgccgugaucagccacgagagagcccagcagcaggccaucgcccuggccaaggaggugagcugccccaugagcagcagccaggagguggugagcugccugagacagaagcccgccaacgugcugaacgacgcccagaccaagcugcuggccgugagcggccccuuccacuacuggggccccgugaucgacggccacuuccugagagagccccccgccagagcccugaagagaagccuguggguggagguggaccugcugaucggcagcagccaggacgacggccugaucaacagagccaaggccgugaagcaguucgaggagagcagaggcagaaccagcagcaagaccgccuucuaccaggcccugcagaacagccugggcggcgaggacagcgacgccagaguggaggccgccgccaccugguacuacagccuggagcacagcaccgacgacuacgccagcuucagcagagcccuggagaacgccaccagagacuacuucaucaucugccccaucaucgacauggccagcgccugggccaagagagccagaggcaacguguucauguaccacgcccccgagaacuacggccacggcagccuggagcugcuggccgacgugcaguucgcccugggccugcccuucuaccccgccuacgagggccaguucagccuggaggagaagagccugagccugaagaucaugcaguacuucagccacuucaucagaagcggcaaccccaacuaccccuacgaguucagcagaaaggugcccaccuucgccacccccuggcccgacuucgugcccagagccggcggcgagaacuacaaggaguucagcgagcugcugcccaacagacagggccugaagaaggccgacugcagcuucuggagcaaguacaucagcagccugaagaccagcgccgacggcgccaagggcggccagagcgccgagagcgaggaggaggagcugaccgccggcagcggccugagagaggaccugcugagccugcaggagcccggcagcaagaccuacagcaaguaa

SEQ ID NO: 24565 - RNA, 828 nt, Artificial Sequence
  TGIF1__Homo_sapiens__NP_001265611
auggccgccgcccacagcggcagaagcaucguggccgccagcggcagcgagaccgaggacgaggacagcauggacaucccccuggaccugagcagcagcgccggcagcggcaagagaagaagaagaggcaaccugcccaaggagagcgugcagauccugagagacuggcuguacgagcacagauacaacgccuaccccagcgagcaggagaaggcccugcugagccagcagacccaccugagcacccugcaggugugcaacugguucaucaacgccagaagaagacugcugcccgacaugcugagaaaggacggcaaggaccccaaccaguucaccaucagcagaagaggcgccaagaucagcgagaccagcagcguggagagcgugaugggcaucaagaacuucaugcccgcccuggaggagacccccuuccacagcugcaccgccggccccaaccccacccugggcagaccccugagccccaagcccagcagccccggcagcgugcuggccagacccagcgugaucugccacaccaccgugaccgcccugaaggacgugcccuucagccugugccagagcgugggcgugggccagaacaccgacauccagcagaucgccgccaagaacuucaccgacaccagccugauguaccccgaggacaccugcaagagcggccccagcaccaacacccagagcggccuguucaacacccccccccccaccccccccgaccugaaccaggacuucagcggcuuccagcugcugguggacguggcccugaagagagccgccgagauggagcugcaggccaagcugaccgccuaa

SEQ ID NO: 24566 - RNA, 468 nt, Artificial Sequence
  TGIF2-C20orf24__Homo_sapiens__NP_001186464
augagcgacagcgaccugggcgaggacgagggccugcugagccuggccggcaagagaaagagaagaggcaaccugcccaaggagagcgugaagauccugagagacuggcuguaccugcacagauacaacgccuaccccagcgagcaggagaagcugagccugagcggccagaccaaccugagcgugcugcaggacgaguuccuggacgugaucuacugguucagacagaucaucgccguggugcugggcgugaucuggggcgugcugccccugagaggcuuccugggcaucgccggcuucugccugaucaacgccggcgugcuguaccuguacuucagcaacuaccugcagaucgacgaggaggaguacggcggcaccugggagcugaccaaggagggcuucaugaccagcuucgcccuguucauggugaucuggaucaucuucuacaccgccauccacuacgacuaa

SEQ ID NO: 24567 - RNA, 714 nt, Artificial Sequence
  TGIF2__Homo_sapiens__NP_001186444
augagcgacagcgaccugggcgaggacgagggccugcugagccuggccggcaagagaaagagaagaggcaaccugcccaaggagagcgugaagauccugagagacuggcuguaccugcacagauacaacgccuaccccagcgagcaggagaagcugagccugagcggccagaccaaccugagcgugcugcagaucugcaacugguucaucaacgccagaagaagacugcugcccgacaugcugagaaaggacggcaaggaccccaaccaguucaccaucagcagaagaggcggcaaggccagcgacguggcccugcccagaggcagcagccccagcgugcuggccgugagcgugcccgcccccaccaacgugcugagccugagcgugugcagcaugccccugcacagcggccagggcgagaagcccgccgcccccuuccccagaggcgagcuggagagccccaagccccuggugacccccggcagcacccugacccugcugaccagagccgaggccggcagccccaccggcggccuguucaacacccccccccccaccccccccgagcaggacaaggaggacuucagcagcuuccagcugcugguggagguggcccugcagagagccgccgagauggagcugcagaagcagcaggaccccagccugccccugcugcacacccccaucccccuggugagcgagaacccccaguaa

SEQ ID NO: 24568 - RNA, 726 nt, Artificial Sequence
  TGIF2LX__Homo_sapiens__NP_620410
auggaggccgccgccgacggccccgccgagacccagagccccguggagaaggacagccccgccaagacccagagccccgcccaggacaccagcaucaugagcagaaacaacgccgacaccggcagagugcuggcccugcccgagcacaagaagaagagaaagggcaaccugcccgccgagagcgugaagauccugagagacuggauguacaagcacagauucaaggccuaccccagcgaggaggagaagcagaugcugagcgagaagaccaaccugagccugcugcagaucagcaacugguucaucaacgccagaagaagaauccugcccgacaugcugcagcagagaagaaacgaccccaucaucggccacaagaccggcaaggacgcccacgccacccaccugcagagcaccgaggccagcgugcccgccaagagcggccccagcggccccgacaacgugcagagccugccccuguggccccugcccaagggccagaugagcagagagaagcagcccgaccccgagagcgcccccagccagaagcugaccggcaucgcccagcccaagaagaaggugaaggugagcgugaccagccccagcagccccgagcuggugagccccgaggagcacgccgacuucagcagcuuccugcugcugguggacgccgccgugcagagagccgccgagcuggagcuggagaagaagcaggagcccaaccccuaa

SEQ ID NO: 24569 - RNA, 2454 nt, Artificial Sequence
  TGM1__Homo_sapiens__NP_000350
augauggacggccccagaagcgacgugggcagauggggcggcaacccccugcagccccccaccacccccagccccgagcccgagcccgagcccgacggcagaagcagaagaggcggcggcagaagcuucugggccagaugcugcggcugcugcagcugcagaaacgccgccgacgacgacuggggccccgagcccagcgacagcagaggcagaggcagcagcagcggcaccagaagacccggcagcagaggcagcgacagcagaagacccgugagcagaggcagcggcgugaacgccgccggcgacggcaccaucagagagggcaugcugguggugaacggcguggaccugcugagcagcagaagcgaccagaacagaagagagcaccacaccgacgaguacgaguacgacgagcugaucgugagaagaggccagcccuuccacaugcugcugcugcugagcagaaccuacgagagcagcgacagaaucacccuggagcugcugaucggcaacaaccccgaggugggcaagggcacccacgugaucauccccgugggcaagggcggcagcggcggcuggaaggcccagguggugaaggccagcggccagaaccugaaccugagagugcacaccagccccaacgccaucaucggcaaguuccaguucaccgugagaacccagagcgacgccggcgaguuccagcugcccuucgaccccagaaacgagaucuacauccuguucaaccccuggugccccgaggacaucguguacguggaccacgaggacuggagacaggaguacgugcugaacgagagcggcagaaucuacuacggcaccgaggcccagaucggcgagagaaccuggaacuacggccaguucgaccacggcgugcuggacgccugccuguacauccuggacagaagaggcaugcccuacggcggcagaggcgaccccgugaacgugagcagagugaucagcgccauggugaacagccuggacgacaacggcgugcugaucggcaacuggagcggcgacuacagcagaggcaccaaccccagcgccugggugggcagcguggagauccugcugagcuaccugagaaccggcuacagcgugcccuacggccagugcuggguguucgccggcgugaccaccaccgugcugagaugccugggccuggccaccagaaccgugaccaacuucaacagcgcccacgacaccgacaccagccugaccauggacaucuacuucgacgagaacaugaagccccuggagcaccugaaccacgacagcguguggaacuuccacguguggaacgacugcuggaugaagagacccgaccugcccagcggcuucgacggcuggcaggugguggacgccaccccccaggagaccagcagcggcaucuucugcugcggccccugcagcguggagagcaucaagaacggccugguguacaugaaguacgacacccccuucaucuucgccgaggugaacagcgacaagguguacuggcagagacaggacgacggcagcuucaagaucguguacguggaggagaaggccaucggcacccugaucgugaccaaggccaucagcagcaacaugagagaggacaucaccuaccuguacaagcaccccgagggcagcgacgccgagagaaaggccguggagaccgccgccgcccacggcagcaagcccaacguguacgccaacagaggcagcgccgaggacguggccaugcagguggaggcccaggacgccgugaugggccaggaccugauggugagcgugaugcugaucaaccacagcagcagcagaagaaccgugaagcugcaccuguaccugagcgugaccuucuacaccggcgugagcggcaccaucuucaaggagaccaagaaggagguggagcuggcccccggcgccagcgacagagugaccaugcccguggccuacaaggaguacagaccccaccugguggaccagggcgccaugcugcugaacgugagcggccacgugaaggagagcggccaggugcuggccaagcagcacaccuucagacugagaacccccgaccugagccugacccugcugggcgccgccguggugggccaggagugcgaggugcagaucguguucaagaacccccugcccgugacccugaccaacgugguguucagacuggagggcagcggccugcagagacccaagauccugaacgugggcgacaucggcggcaacgagaccgugacccugagacagagcuucgugcccgugagacccggccccagacagcugaucgccagccuggacagcccccagcugagccaggugcacggcgugauccagguggacguggcccccgcccccggcgacggcggcuucuucagcgacgccggcggcgacagccaccugggcgagaccauccccauggccagcagaggcggcgccuaa

SEQ ID NO: 24570 - RNA, 1647 nt, Artificial Sequence
  TGM2__Homo_sapiens__NP_945189
auggccgaggagcuggugcuggagagaugcgaccuggagcuggagaccaacggcagagaccaccacaccgccgaccugugcagagagaagcugguggugagaagaggccagcccuucuggcugacccugcacuucgagggcagaaacuacgaggccagcguggacagccugaccuucagcguggugaccggccccgcccccagccaggaggccggcaccaaggccagauucccccugagagacgccguggaggagggcgacuggaccgccaccgugguggaccagcaggacugcacccugagccugcagcugaccacccccgccaacgcccccaucggccuguacagacugagccuggaggccagcaccggcuaccagggcagcagcuucgugcugggccacuucauccugcuguucaacgccuggugccccgccgacgccguguaccuggacagcgaggaggagagacaggaguacgugcugacccagcagggcuucaucuaccagggcagcgccaaguucaucaagaacauccccuggaacuucggccaguucgaggacggcauccuggacaucugccugauccugcuggacgugaaccccaaguuccugaagaacgccggcagagacugcagcagaagaagcagccccguguacgugggcagaguggugagcggcauggugaacugcaacgacgaccagggcgugcugcugggcagaugggacaacaacuacggcgacggcgugagccccaugagcuggaucggcagcguggacauccugagaagauggaagaaccacggcugccagagagugaaguacggccagugcuggguguucgccgccguggccugcaccgugcugagaugccugggcauccccaccagaguggugaccaacuacaacagcgcccacgaccagaacagcaaccugcugaucgaguacuucagaaacgaguucggcgagauccagggcgacaagagcgagaugaucuggaacuuccacugcuggguggagagcuggaugaccagacccgaccugcagcccggcuacgagggcuggcaggcccuggaccccaccccccaggagaagagcgagggcaccuacugcugcggccccgugcccgugagagccaucaaggagggcgaccugagcaccaaguacgacgcccccuucguguucgccgaggugaacgccgacgugguggacuggauccagcaggacgacggcagcgugcacaagagcaucaacagaagccugaucgugggccugaagaucagcaccaagagcgugggcagagacgagagagaggacaucacccacaccuacaaguaccccgagggcagcagcgaggagagagaggccuucaccagagccaaccaccugaacaagcuggccgagaaggaggagaccggcauggccaugagaaucagagugggccagagcaugaacaugggcagcgacuucgacguguucgcccacaucaccaacaacaccgccgaggaguacgugugcagacugcugcugugcgccagaaccgugagcuacaacggcauccugggccccgagugcggcaccaaguaccugcugaaccugaaccuggagcccuucagcggcaaggcccugugcagcuggagcaucugcuaa

SEQ ID NO: 24571 - RNA, 2082 nt, Artificial Sequence
  TGM3__Homo_sapiens__NP_003236
auggccgcccugggcgugcagagcaucaacuggcagaccgccuucaacagacaggcccaccacaccgacaaguucagcagccaggagcugauccugagaagaggccagaacuuccaggugcugaugaucaugaacaagggccugggcagcaacgagagacuggaguucaucgugagcaccggccccuaccccagcgagagcgccaugaccaaggccguguucccccugagcaacggcagcagcggcggcuggagcgccgugcugcaggccagcaacggcaacacccugaccaucagcaucagcagccccgccagcgcccccaucggcagauacaccauggcccugcagaucuucagccagggcggcaucagcagcgugaagcugggcaccuucauccugcuguucaaccccuggcugaacguggacagcguguucaugggcaaccacgccgagagagaggaguacgugcaggaggacgccggcaucaucuucgugggcagcaccaacagaaucggcaugaucggcuggaacuucggccaguucgaggaggacauccugagcaucugccugagcauccuggacagaagccugaacuucagaagagacgccgccaccgacguggccagcagaaacgaccccaaguacgugggcagagugcugagcgccaugaucaacagcaacgacgacaacggcgugcuggccggcaacuggagcggcaccuacaccggcggcagagaccccagaagcuggaacggcagcguggagauccugaagaacuggaagaagagcggcuucagccccgugagauacggccagugcuggguguucgccggcacccugaacaccgcccugagaagccugggcauccccagcagagugaucaccaacuucaacagcgcccacgacaccgacagaaaccugagcguggacguguacuacgaccccaugggcaacccccuggacaagggcagcgacagcguguggaacuuccacguguggaacgagggcugguucgugagaagcgaccugggccccagcuacggcggcuggcaggugcuggacgccaccccccaggagagaagccagggcguguuccagugcggccccgccagcgugaucggcgugagagagggcgacgugcagcugaacuucgacaugcccuucaucuucgccgaggugaacgccgacagaaucaccuggcuguacgacaacaccaccggcaagcaguggaagaacagcgugaacagccacaccaucggcagauacaucagcaccaaggccgugggcagcaacgccagaauggacgugaccgacaaguacaaguaccccgagggcagcgaccaggagagacagguguuccagaaggcccugggcaagcugaagcccaacacccccuucgccgccaccagcagcaugggccuggagaccgaggagcaggagcccagcaucaucggcaagcugaagguggccggcaugcuggccgugggcaaggaggugaaccuggugcugcugcugaagaaccugagcagagacaccaagaccgugaccgugaacaugaccgccuggaccaucaucuacaacggcacccuggugcacgagguguggaaggacagcgccaccaugagccuggaccccgaggaggaggccgagcaccccaucaagaucagcuacgcccaguacgagaaguaccugaagagcgacaacaugaucagaaucaccgccgugugcaaggugcccgacgagagcgagguggugguggagagagacaucauccuggacaaccccacccugacccuggaggugcugaacgaggccagagugagaaagcccgugaacgugcagaugcuguucagcaacccccuggacgagcccgugagagacugcgugcugaugguggagggcagcggccugcugcugggcaaccugaagaucgacgugcccacccugggccccaaggagggcagcagagugagauucgacauccugcccagcagaagcggcaccaagcagcugcuggccgacuucagcugcaacaaguuccccgccaucaaggccaugcugagcaucgacguggccgaguaa

SEQ ID NO: 24572 - RNA, 2055 nt, Artificial Sequence
  TGM4__Homo_sapiens__NP_003232
augauggacgccagcaaggagcugcaggugcugcacaucgacuuccugaaccaggacaacgccgugagccaccacaccugggaguuccagaccagcagccccguguucagaagaggccagguguuccaccugagacuggugcugaaccagccccugcagagcuaccaccagcugaagcuggaguucagcaccggccccaaccccagcaucgccaagcacacccugguggugcuggaccccagaacccccagcgaccacuacaacuggcaggccacccugcagaacgagagcggcaaggaggugaccguggccgugaccagcagccccaacgccauccugggcaaguaccagcugaacgugaagaccggcaaccacauccugaagagcgaggagaacauccuguaccugcuguucaaccccuggugcaaggaggacaugguguucaugcccgacgaggacgagagaaaggaguacauccugaacgacaccggcugccacuacgugggcgccgccagaagcaucaagugcaagcccuggaacuucggccaguucgagaagaacgugcuggacugcugcaucagccugcugaccgagagcagccugaagcccaccgacagaagagaccccgugcuggugugcagagccaugugcgccaugaugagcuucgagaagggccagggcgugcugaucggcaacuggaccggcgacuacgagggcggcaccgcccccuacaaguggaccggcagcgcccccauccugcagcaguacuacaacaccaagcaggccgugugcuucggccagugcuggguguucgccggcauccugaccaccgugcugagagcccugggcauccccgccagaagcgugaccggcuucgacagcgcccacgacaccgagagaaaccugaccguggacaccuacgugaacgagaacggcgagaagaucaccagcaugacccacgacagcguguggaacuuccacguguggaccgacgccuggaugaagagacccgaccugcccaagggcuacgacggcuggcaggccguggacgccaccccccaggagagaagccagggcguguucugcugcggccccagcccccugaccgccaucagaaagggcgacaucuucaucguguacgacaccagauucguguucagcgaggugaacggcgacagacugaucuggcuggugaagauggugaacggccaggaggagcugcacgugaucagcauggagaccaccagcaucggcaagaacaucagcaccaaggccgugggccaggacagaagaagagacaucaccuacgaguacaaguaccccgagggcagcagcgaggagagacaggugauggaccacgccuuccugcugcugagcagcgagagagagcacagaagacccgugaaggagaacuuccugcacaugagcgugcagagcgacgacgugcugcugggcaacagcgugaacuucaccgugauccugaagagaaagaccgccgcccugcagaacgugaacauccugggcagcuucgagcugcagcuguacaccggcaagaagauggccaagcugugcgaccugaacaagaccagccagauccagggccaggugagcgaggugacccugacccuggacagcaagaccuacaucaacagccuggccauccuggacgacgagcccgugaucagaggcuucaucaucgccgagaucguggagagcaaggagaucauggccagcgagguguucaccagcuuccaguaccccgaguucagcaucgagcugcccaacaccggcagaaucggccagcugcuggugugcaacugcaucuucaagaacacccuggccaucccccugaccgacgugaaguucagccuggagagccugggcaucagcagccugcagaccagcgaccacggcaccgugcagcccggcgagaccauccagagccagaucaagugcacccccaucaagaccggccccaagaaguucaucgugaagcugagcagcaagcaggugaaggagaucaacgcccagaagaucgugcugaucaccaaguaa

SEQ ID NO: 24573 - RNA, 1917 nt, Artificial Sequence
  TGM5__Homo_sapiens__NP_004236
auggcccagggccuggagguggcccugaccgaccugcagagcagcagaaacaacgugagacaccacaccgaggagaucaccguggaccaccugcuggugagaagaggccaggccuucaaccugacccuguacuucagaaacagaagcuuccagcccggccuggacaacaucaucuucgugguggagaccgaggacgccguguaccuggacagcgagccccagagacaggaguacgugaugaacgacuacggcuucaucuaccagggcagcaagaacuggaucagacccugccccuggaacuacggccaguucgaggacaagaucaucgacaucugccugaagcugcuggacaagagccugcacuuccagaccgaccccgccaccgacugcgcccugagaggcagccccguguacgugagcagaguggugugcgccaugaucaacagcaacgacgacaacggcgugcugaacggcaacuggagcgagaacuacaccgacggcgccaaccccgccgaguggaccggcagcguggccauccugaagcaguggaacgccaccggcugccagcccgugagauacggccagugcuggguguucgccgccgugaugugcaccgugaugagaugccugggcauccccaccagagugaucaccaacuucgacagcggccacgacaccgacggcaaccugaucaucgacgaguacuacgacaacaccggcagaauccugggcaacaagaagaaggacaccaucuggaacuuccacguguggaacgagugcuggauggccagaaaggaccugccccccgccuacggcggcuggcaggugcuggacgccaccccccaggagaugagcaacggcguguacugcugcggccccgccagcgugagagccaucaaggagggcgagguggaccugaacuacgacacccccuucguguucagcauggugaacgccgacugcaugagcuggcuggugcagggcggcaaggagcagaagcugcaccaggacaccagcagcgugggcaacuucaucagcaccaagagcauccagagcgacgagagagacgacaucaccgagaacuacaaguacgaggagggcagccugcaggagagacagguguuccugaaggcccugcagaagcugaaggccagaagcuuccacggcagccagagaggcgccgagcugcagcccagcagacccaccagccugagccaggacagccccagaagccugcacacccccagccugagacccagcgacguggugcaggugagccugaaguucaagcugcuggacccccccaacaugggccaggacaucugcuucgugcugcuggcccugaacaugagcagccaguucaaggaccugaaggugaaccugagcgcccagagccugcugcacgacggcagcccccugagccccuucuggcaggacaccgccuucaucacccugagccccaaggaggccaagaccuaccccugcaagaucagcuacagccaguacagccaguaccugagcaccgacaagcugaucagaaucagcgcccugggcgaggagaagagcagccccgagaagauccuggugaacaagaucaucacccugagcuaccccagcaucaccaucaacgugcugggcgccgccguggugaaccagccccugagcauccaggugaucuucagcaacccccugagcgagcagguggaggacugcgugcugaccguggagggcagcggccuguucaagaagcagcagaagguguuccugggcgugcugaagccccagcaccaggccagcaucauccuggagaccgugcccuucaagagcggccagagacagauccaggccaacaugagaagcaacaaguucaaggacaucaagggcuacagaaacguguacguggacuucgcccuguaa

SEQ ID NO: 24574 - RNA, 1878 nt, Artificial Sequence
  TGM6__Homo_sapiens__NP_001241663
auggccggcaucagagugaccaagguggacuggcagagaagcagaaacggcgccgcccaccacacccaggaguaccccugccccgagcugguggugagaagaggccagagcuucagccugacccuggagcugagcagagcccuggacugcgaggagauccugaucuucaccauggagaccggccccagagccagcgaggcccugcacaccaaggccguguuccagaccagcgagcuggagagaggcgagggcuggaccgccgccagagaggcccagauggagaagacccugaccgugagccuggccagcccccccagcgccgugaucggcagauaccugcugagcaucagacugagcagccacagaaagcacagcaacagaagacugggcgaguucgugcugcuguucaaccccuggugcgccgaggacgacguguuccuggccagcgaggaggagagacaggaguacgugcugagcgacagcggcaucaucuucagaggcguggagaagcacaucagagcccagggcuggaacuacggccaguucgaggaggacauccugaacaucugccugagcauccuggacagaagccccggccaccagaacaaccccgccaccgacgugagcugcagacacaaccccaucuacgugaccagagugaucagcgccauggugaacagcaacaacgacagaggcguggugcagggccaguggcagggcaaguacggcggcggcaccagcccccugcacuggagaggcagcguggccauccugcagaaguggcugaagggcagauacaagcccgugaaguacggccagugcuggguguucgccggcgugcugugcaccgugcugagaugccugggcaucgccaccagaguggugagcaacuucaacagcgcccacgacaccgaccagaaccugagcguggacaaguacguggacagcuucggcagaacccuggaggaccugaccgaggacagcauguggaacuuccacguguggaacgagagcugguucgccagacaggaccugggccccagcuacaacggcuggcaggugcuggacgccaccccccaggaggagagcgagggcguguucagaugcggccccgccagcgugaccgccaucagagagggcgacgugcaccuggcccacgacggccccuucguguucgccgaggugaacgccgacuacaucaccuggcuguggcacgaggacgagagcagagagagaguguacagcaacaccaagaagaucggcagaugcaucagcaccaaggccgugggcagcgacagcagaguggacaucaccgaccuguacaaguaccccgagggcagcagaaaggagagacagguguacagcaaggccgugaacagacuguucggcguggaggccagcggcagaagaaucuggaucagaagagccggcggcagaugccuguggagagacgaccugcuggagcccgccaccaagcccagcaucgccggcaaguucaaggugcuggagccccccaugcugggccacgaccugagacuggcccugugccuggccaaccugaccagcagagcccagagagugagagugaaccugagcggcgccaccauccuguacaccagaaagcccguggccgagauccugcacgagagccacgccgugagacugggcccccaggaggagaagagaauccccaucaccaucagcuacagcaaguacaaggaggaccugaccgaggacaagaagauccugcuggccgccaugugccuggugaccaagggcgagaagcugcugguggagaaggacaucacccuggaggacuucaucaccaucaagagagccuaccccggcgccagcggcgagggccugagccccguguaa

SEQ ID NO: 24575 - RNA, 2133 nt, Artificial Sequence
  TGM7__Homo_sapiens__NP_443187
auggaccagguggccacccugagacuggagagcguggaccugcagagcagcagaaacaacaaggagcaccacacccaggagaugggcgugaagagacugaccgugagaagaggccagcccuucuaccugagacugagcuucagcagacccuuccagagccagaacgaccacaucaccuucguggccgagaccggccccaagcccagcgagcugcugggcaccagagccaccuucuuccugaccagagugcagcccggcaacguguggagcgccagcgacuucaccaucgacagcaacagccugcaggugagccuguucacccccgccaacgccgugaucggccacuacacccugaagaucgagaucagccagggccagggccacagcgugaccuacccccugggcaccuucauccugcuguucaaccccuggagccccgaggacgacguguaccugcccagcgagauccugcugcaggaguacaucaugagagacuacggcuucguguacaagggccacgagagauucaucaccagcuggcccuggaacuacggccaguucgaggaggacaucaucgacaucugcuucgagauccugaacaagagccuguaccaccugaagaaccccgccaaggacugcagccagagaaacgacgugguguacgugugcagaguggugagcgccaugaucaacagcaacgacgacaacggcgugcugcagggcaacuggggcgaggacuacagcaagggcgugagcccccuggaguggaagggcagcguggccauccugcagcaguggagcgccagaggcggccagcccgugaaguacggccagugcuggguguucgccagcgugaugugcaccgugaugagaugccugggcgugcccaccagaguggugagcaacuucagaagcgcccacaacguggacagaaaccugaccaucgacaccuacuacgacagaaacgccgagaugcugagcacccagaagagagacaagaucuggaacuuccacguguggaacgagugcuggaugaucagaaaggaccugccccccggcuacaacggcuggcaggugcuggaccccaccccccagcagaccagcagcggccuguucugcugcggccccgccagcgugaaggccaucagagagggcgacgugcaccuggccuacgacacccccuucguguacgccgaggugaacgccgacgaggugaucuggcugcugggcgacggccaggcccaggagauccuggcccacaacaccagcagcaucggcaaggagaucagcaccaagauggugggcagcgaccagagacagagcaucaccagcagcuacaaguaccccgagggcagccccgaggagagagccguguucaugaaggccagcagaaagaugcugggcccccagagagccagccugcccuuccuggaccugcuggagagcggcggccugagagaccagcccgcccagcugcagcugcaccuggccagaauccccgaguggggccaggaccugcagcugcugcugagaauccagagagugcccgacagcacccaccccagaggccccaucggccugguggugagauucugcgcccaggcccugcugcacggcggcggcacccagaagcccuucuggagacacaccgugagaaugaaccuggacuucggcaaggagacccaguggccccugcugcugcccuacagcaacuacagaaacaagcugaccgacgagaagcugaucagagugagcggcaucgccgagguggaggagaccggcagaagcaugcuggugcugaaggacaucugccuggagcccccccaccugagcaucgaggugagcgagagagccgaggugggcaaggcccugagagugcacgugacccugaccaacacccugaugguggcccugagcagcugcaccauggugcuggagggcagcggccugaucaacggccagaucgccaaggaccugggcacccugguggccggccacacccugcagauccagcuggaccuguaccccaccaaggccggccccagacagcugcaggugcugaucagcagcaacgaggugaaggagaucaagggcuacaaggacaucuucgugaccguggccggcgcccccuaa

SEQ ID NO: 24576 - RNA, 1362 nt, Artificial Sequence
  TGOLN2__Homo_sapiens__NP_001193770
augagauucgugguggcccuggugcugcugaacguggccgccgccggcgccgugccccugcuggccaccgagagcgugaagcaggaggaggccggcgugagacccagcgccggcaacgugagcacccaccccagccugagccagagacccggcggcagcaccaagagccaccccgagccccagacccccaaggacagccccagcaagagcagcgccgaggcccagacccccgaggacacccccaacaagagcggcgccgaggccaagacccagaaggacagcagcaacaagagcggcgccgaggccaagacccagaagggcagcaccagcaagagcggcagcgaggcccagaccaccaaggacagcaccagcaagagccaccccgagcugcagacccccaaggacagcaccggcaagagcggcgccgaggcccagacccccgaggacagccccaacagaagcggcgccgaggccaagacccagaaggacagccccagcaagagcggcagcgaggcccagaccaccaaggacgugcccaacaagagcggcgccgacggccagacccccaaggacggcagcagcaagagcggcgccgaggaccagacccccaaggacgugcccaacaagagcggcgccgagaagcagacccccaaggacggcagcaacaagagcggcgccgaggagcagggccccaucgacggccccagcaagagcggcgccgaggagcagaccagcaaggacagccccaacaagguggugcccgagcagcccagcagaaaggaccacagcaagcccaucagcaaccccagcgacaacaaggagcugcccaaggccgacaccaaccagcuggccgacaagggcaagcugagcccccacgccuucaagaccgagagcggcgaggagaccgaccugaucagccccccccaggaggaggugaagagcagcgagcccaccgaggacguggagcccaaggaggccgaggacgacgacaccggccccgaggagggcagcccccccaaggaggagaaggagaagaugagcggcagcgccagcagcgagaacagagagggcacccugagcgacagcaccggcagcgagaaggacgaccuguaccccaacggcagcggcaacggcagcgccgagagcagccacuucuucgccuaccuggugaccgccgccauccugguggccgugcuguacaucgcccaccacaacaagagaaagaucaucgccuucgugcuggagggcaagagaagcaaggugaccagaagacccaaggccagcgacuaccagagacuggaccagaagaucuucuucccccccagccccaacagaaugguguacagcagcggcaagagauaa

SEQ ID NO: 24577 - RNA, 2562 nt, Artificial Sequence
  TGS1__Homo_sapiens__NP_079107
augugcugcgagaaguggagcagaguggccgagauguuccuguucaucgaggagagagaggacugcaagauccugugccugugcagcagagccuucguggaggacagaaagcuguacaaccugggccugaagggcuacuacaucagagacagcggcaacaacagcggcgaccaggccaccgaggaggaggagggcggcuacagcugcggcaccgccgagagccacgacagcaagggcaucggccuggacgagagcgagcuggacagcgaggccgagcugaugagaagcaugggccugccccugcaguucggcagaaucaccgcccacaaggacuucgaggugagcaugaacaccagaaacaaggugaagaucaagaagaagaagcaccagaagaaguaccuggacgagaucgugcaggagagcuggagaaaggaguacgaggaggacgacauccuggccagcgacgaccccagcagcaucgagcaguacgagaacaccagaaccuacgagcugcagagcaagaaggacaccgagaccgagaacccccccguggagaacacccugagccccaagcuggagaucaccgagaagugggagaaguacuggaacgaguacggcggcggccugcuguggcagagcuggcaggagaagcaccccggccaggcccugagcagcgagcccuggaacuuccccgacaccaaggaggagugggagcagcacuacagccagcuguacugguacuaccuggagcaguuccaguacugggaggcccagggcuggaccuucgacgccagccagagcugcgacaccgacaccuacaccagcaagaccgaggccgacgacaagaacgacgagaagugcaugaagguggaccuggugagcuuccccagcagccccaucaugguggacaacgacagcagcggcaccagcgacaaggaccacagcgagauccuggacggcaucagcaacaucaagcugaacagcgaggaggugacccagagccagcuggacagcugcaccagccacgacggccaccagcagcugagcgaggugagcagcaagagagagugccccgccagcggccagagcgagcccagaaacggcggcaccaacgaggagagcaacagcagcggcaacaccaacaccgacccccccgccgaggacagccagaagagcagcggcgccaacaccagcaaggacagaccccacgccagcggcaccgacggcgacgagagcgaggaggacccccccgagcacaagcccagcaagcugaagagaagccacgagcuggacaucgacgagaaccccgccagcgacuucgacgacagcggcagccugcugggcuucaaguacggcagcggccagaaguacggcggcauccccaacuucagccacagacaggugagauaccuggagaagaacgugaagcugaagagcaaguaccuggacaugagaagacagaucaagaugaagaacaagcacaucuucuucaccaaggagagcgagaagcccuucuucaagaagagcaagauccugagcaagguggagaaguuccugaccugggugaacaagcccauggacgaggaggccagccaggagagcagcagccacgacaacgugcacgacgccagcaccagcagcgacagcgaggagcaggacaugagcgugaagaagggcgacgaccugcuggagaccaacaaccccgagcccgagaagugccagagcgugagcagcgccggcgagcuggagaccgagaacuacgagagagacagccugcuggccaccgugcccgacgagcaggacugcgugacccaggaggugcccgacagcagacaggccgagaccgaggccgaggugaagaagaagaagaacaagaagaagaacaagaaggugaacggccugccccccgagaucgccgccgugcccgagcuggccaaguacugggcccagagauacagacuguucagcagauucgacgacggcaucaagcuggacagagagggcugguucagcgugacccccgagaagaucgccgagcacaucgccggcagagugagccagagcuucaagugcgacguggugguggacgccuucugcggcgugggcggcaacaccauccaguucgcccugaccggcaugagagugaucgccaucgacaucgaccccgugaagaucgcccuggccagaaacaacgccgagguguacggcaucgccgacaagaucgaguucaucugcggcgacuuccugcugcuggccagcuuccugaaggccgacgugguguuccugagcccccccuggggcggccccgacuacgccaccgccgagaccuucgacaucagaaccaugaugagccccgacggcuucgagaucuucagacugagcaagaagaucaccaacaacaucguguacuuccugcccagaaacgccgacaucgaccagguggccagccuggccggccccggcggccagguggagaucgagcagaacuuccugaacaacaagcugaagaccaucaccgccuacuucggcgaccugaucagaagacccgccagcgagaccuaa

SEQ ID NO: 24578 - RNA, 5862 nt, Artificial Sequence
  THADA__Homo_sapiens__NP_001077422
augggcgugaagaagaagaaggagaugcagguggccgcccugaccaucugccaccaggaccuggagacccugaagagcuucgccgacguggagggcaagaaccuggccagccugcugcugcacugcgugcagcugaccgacggcgugagccagauccacuacaucaagcagaucgugccccugcuggagaaggccgacaagaacggcaugugcgaccccaccauccagagcugccuggacauccuggccggcaucuaccugagccugagccugaagaacccccugaagaaggugcuggccagcagccugaacagccugcccgacuucuuccugcccgaggccaugcacagauucaccagcagacugcaggaggagcugaacaccaccgaccuguacagcuacagaaaggugaccgacaacaucagcagcugcauggagaacuucaaccugggcagagccagcgugaacaaccugcugaagaacgugcugcacuuccugcagaagagccugaucgagauccuggaggagaacagaaagugcgccggcaaccacaucauccagacccagcugaugaacgaccugcuggugggcaucagagugagcaugaugcuggugcagaaggugcaggacuuccagggcaaccuguggaagaccagcgacagccccaucuggcagaacaugugcggccugcugagcaucuucaccaaggugcugagcgacgacgaccugcugcagaccgugcagagcaccagcggccuggccaucauccuguucaucaagaccauguuccaccccagcgagaagaucccccaccugaucagcagcgugcugcugagaagcguggacugcaccagcgugcccgagugguucaugagcagcugcagaagccugugcugcggcgacaucagccagagcgccgugcuguuccugugccagggcacccuggccaugcuggacuggcagaacggcagcaugggcagaagcggcgaggcccugcugcuggacaccgcccacgugcuguucacccugagcagccagaucaaggagcccacccuggagauguuccugagcagaauccuggccagcuggaccaacagcgccauccaggugcuggagagcagcagccccagccugaccgacagccugaacggcaacagcagcaucgugggcagacugcuggaguacguguacacccacugggagcacccccuggacgcccugagacaccagaccaagaucauguucaagaaccugcugcagaugcacagacugaccguggagggcgccgacuucgugcccgaccccuucuucguggagcugaccgagagccugcugagacuggaguggcacaucaagggcaaguacaccugccugggcugccugguggagugcaucggcguggagcacauccuggccaucgacaagaccauccccagccagauccuggaggugaugggcgaccagagccuggugcccuacgccagcgaccugcuggagaccauguucagaaaccacaagagccaccugaagagccagaccgccgagagcagcuggaucgaccaguggcacgagaccugggugagcccccugcuguucauccugugcgagggcaaccuggaccagaagagcuacgugaucgacuacuaccugcccaagcugcugagcuacagccccgagagccugcaguacauggugaagauccugcagaccagcaucgacgccaagaccggccaggagcagagcuuccccagccugggcagcugcaacagcagaggcgcccugggcgcccugauggccugccugagaaucgccagagcccacggccaccugcagagcgccaccgacaccugggagaaccuggugagcgacgccagaaucaagcagggccugauccaccagcacugccaggugagaaucgacacccugggccugcugugcgagagcaacagaagcaccgagaucgugagcauggaggagaugcaguggauccaguucuucaucaccuacaaccugaacagccagagccccggcgugagacagcagaucugcagccugcugaagaagcuguucugcagaauccaggagagcagccaggugcuguacaagcuggagcagagcaagagcaagagagagcccgagaacgagcugaccaagcagcaccccagcgugagccugcagcaguacaagaacuucaugagcagcaucugcaacagccuguucgaggcccuguuccccggcagcagcuacagcaccagauucagcgcccugaccauccugggcagcaucgccgagguguuccacgugcccgagggcagaaucuacaccguguaccagcugagccacgacaucgacgugggcagauuccagacccugauggagugcuucaccagcaccuucgaggacgugaagauccuggccuucgaccugcugaugaagcugagcaagaccgccgugcacuuccaggacagcggcaagcugcagggccuguuccaggccgcccuggagcugagcaccagcaccaagcccuacgacugcgugaccgccagcuaccugcugaacuuccugaucuggcaggacgcccugcccagcagccugagcgccuaccugacccagcagguggccugcgacaacggcgacagacccgccgccgugguggagagaaacacccugauggugaucaagugccugauggagaaccuggaggaggaggugagccaggccgagaacagccugcugcaggccgccgccgccuuccccauguacggcagagugcacugcaucaccggcgcccugcagaagcugagccugaacagccugcagcuggugagcgaguggagacccgugguggagaagcugcugcugaugagcuacagacugagcaccguggugagccccgugauccagagcagcagccccgagggccugauccccauggacaccgacagcgagagcgccagcagacugcagaugauccugaacgagauccagcccagagacaccaacgacuacuucaaccaggccaagauccugaaggagcacgacagcuucgacaugaaggaccugaacgccagcguggugaacaucgacaccagcaccgagaucaagggcaaggaggugaagaccugcgacgugaccgcccagauggugcuggugugcugcuggagaagcaugaaggagguggcccugcugcugggcaugcugugccagcugcugcccaugcagcccgugcccgagagcagcgacggccugcugaccguggagcaggugaaggagaucggcgacuacuucaagcagcaccugcugcagagcagacacagaggcgccuucgagcuggccuacaccggcuucgugaagcugaccgaggugcugaacagaugccccaacgugagccugcagaagcugcccgagcaguggcuguggagcgugcuggaggagaucaagugcagcgaccccagcagcaagcugugcgccaccagaagaagcgccggcauccccuucuacauccaggcccugcuggccagcgagcccaagaagggcagaauggaccugcugaagaucaccaugaaggagcugaucagccuggccggccccaccgacgacauccagagcaccgugccccaggugcacgcccugaacauccugagagcccuguucagagacaccagacugggcgagaacaucauccccuacguggccgacggcgccaaggccgccauccugggcuucaccagccccgugugggccgugagaaacagcagcacccugcuguucagcgcccugaucaccagaaucuucggcgugaagagagccaaggacgagcacagcaagaccaacagaaugaccggcagagaguucuucagcagauuccccgagcuguaccccuuccugcugaagcagcuggagaccguggccaacaccguggacagcgacaugggcgagcccaacagacaccccagcauguuccugcugcugcuggugcuggagagacuguacgccagccccauggacggcaccagcagcgcccugagcaugggccccuucgugcccuucaucaugagaugcggccacagccccguguaccacagcagagagauggccgccagagcccuggugcccuucgugaugaucgaccacauccccaacaccaucagaacccugcugagcacccugcccagcugcaccgaccagugcuucagacagaaccacauccacggcacccugcugcagguguuccaccugcugcaggccuacagcgacagcaagcacggcaccaacagcgacuuccagcacgagcugaccgacaucaccgugugcaccaaggccaagcuguggcuggccaagagacagaaccccugccuggugaccagagccguguacaucgacauccuguuccugcugaccugcugccugaacagaagcgccaaggacaaccagcccgugcuggagagccugggcuucugggaggaggugagaggcaucaucagcggcagcgagcugaucaccggcuuccccugggccuucaaggugcccggccugccccaguaccugcagagccugaccagacuggccaucgccgccgugugggccgccgccgccaagagcggcgagagagagaccaacgugcccaucagcuucagccagcugcuggagagcgccuuccccgaggugagaagccugacccuggaggcccugcuggagaaguuccuggccgccgccagcggccugggcgagaagggcgugcccccccugcugugcaacaugggcgagaaguuccugcugcuggccaugaaggagaaccaccccgagugcuucugcaagauccugaagauccugcacugcauggaccccggcgaguggcugccccagaccgagcacugcgugcaccugacccccaaggaguuccugaucuggaccauggacaucgccagcaacgagagaagcgagauccagagcguggcccugagacuggccagcaaggugaucagccaccacaugcagaccugcguggagaacagagagcugaucgccgccgagcugaagcagugggugcagcuggugauccugagcugcgaggaccaccugcccaccgagagcagacuggccgugguggaggugcugaccagcaccaccccccuguuccugaccaacccccaccccauccuggagcugcaggacacccuggcccuguggaagugcgugcugacccugcugcagagcgaggagcaggccgugagagacgccgccaccgagaccgugaccaccgccaugagccaggagaacaccugccagagcaccgaguucgccuucugccagguggacgccagcaucgcccuggcccuggcccuggccgugcugugcgaccugcugcagcagugggaccagcuggcccccggccugcccauccugcugggcuggcugcugggcgagagcgacgaccugguggccugcguggagagcaugcaccagguggaggaggacuaccuguucgagaaggccgaggugaacuucugggccgagacccugaucuucgugaaguaccugugcaagcaccuguucugccugcugagcaagagcggcuggagaccccccagccccgagaugcugugccaccugcagagaauggugagcgagcagugccaccugcugagccaguucuucagagagcugccccccgccgccgaguucgugaagaccguggaguucaccagacugagaauccaggaggagagaacccuggccugccugagacugcuggccuuccuggagggcaaggagggcgaggacacccuggugcugagcgugugggacagcuacgccgagagcagacagcugacccugcccagaaccgaggccgccugcuaa

SEQ ID NO: 24579 - RNA, 774 nt, Artificial Sequence
  THAP10__Homo_sapiens__NP_064532
augcccgccagaugcguggccgcccacugcggcaacaccaccaagagcggcaagagccuguucagauuccccaaggacagagccgugagacugcugugggacagauucgugagaggcugcagagccgacugguacggcggcaacgacagaagcgugaucugcagcgaccacuucgcccccgccugcuucgacgugagcagcgugauccagaagaaccugagauucagccagagacugagacugguggccggcgccgugcccacccugcacagagugcccgcccccgcccccaagagaggcgaggagggcgaccaggccggcagacuggacaccagaggcgagcugcaggccgccagacacagcgaggccgcccccggccccgugagcugcaccagacccagagccggcaagcaggccgccgccagccagaucaccugcgagaacgagcuggugcagacccagccccacgccgacaaccccagcaacaccgugaccagcgugcccacccacugcgaggagggccccgugcacaagagcacccagaucagccugaagagacccagacacagaagcgugggcauccaggccaaggugaaggccuucggcaagagacugugcaacgccaccacccagaccgaggagcuguggagcagaaccagcagccuguucgacaucuacagcagcgacagcgagaccgacaccgacugggacaucaagagcgagcagagcgaccugagcuacauggccgugcaggugaaggaggagaccugcuaa

SEQ ID NO: 24580 - RNA, 945 nt, Artificial Sequence
  THAP11__Homo_sapiens__NP_065190
augcccggcuucaccugcugcgugcccggcugcuacaacaacagccacagagacaaggcccugcacuucuacaccuuccccaaggacgccgagcugagaagacuguggcugaagaacgugagcagagccggcgugagcggcugcuucagcaccuuccagcccaccaccggccacagacugugcagcgugcacuuccagggcggcagaaagaccuacaccgugagagugcccaccaucuucccccugagaggcgugaacgagagaaagguggccagaagacccgccggcgccgccgccgccagaagaagacagcagcagcagcagcagcagcagcagcagcagcagcagcagcagcagcagcagcagcagcagcagcagcagcagcagcagcagcagagcagccccagcgccagcaccgcccagaccgcccagcugcagcccaaccuggugagcgccagcgccgccgugcugcugacccugcaggccaccguggacagcagccaggcccccggcagcgugcagcccgcccccaucacccccaccggcgaggacgugaagcccaucgaccugaccgugcagguggaguucgccgccgccgagggcgccgccgccgccgccgccgccagcgagcugcaggccgccaccgccggccuggaggccgccgagugccccaugggcccccagcuggugguggugggcgaggagggcuuccccgacaccggcagcgaccacagcuacagccugagcagcggcaccaccgaggaggagcugcugagaaagcugaacgagcagagagacauccuggcccugauggaggugaagaugaaggagaugaagggcagcaucagacaccugagacugaccgaggccaagcugagagaggagcugagagagaaggacagacugcuggccauggccgugaucagaaagaagcacggcauguaa

SEQ ID NO: 24581 - RNA, 642 nt, Artificial Sequence
  THAP1__Homo_sapiens__NP_060575
auggugcagagcugcagcgccuacggcugcaagaacagauacgacaaggacaagcccgugagcuuccacaaguucccccugaccagacccagccugugcaaggagugggaggccgccgugagaagaaagaacuucaagcccaccaaguacagcagcaucugcagcgagcacuucacccccgacugcuucaagagagagugcaacaacaagcugcugaaggagaacgccgugcccaccaucuuccugugcaccgagccccacgacaagaaggaggaccugcuggagccccaggagcagcugcccccccccccccugcccccccccgugagccagguggacgccgccaucggccugcugaugcccccccugcagacccccgugaaccugagcguguucugcgaccacaacuacaccguggaggacaccaugcaccagagaaagagaauccaccagcuggagcagcagguggagaagcugagaaagaagcugaagaccgcccagcagagaugcagaagacaggagagacagcuggagaagcugaaggagguggugcacuuccagaaggagaaggacgacgugagcgagagaggcuacgugauccugcccaacgacuacuucgagaucguggaggugcccgccuaa

SEQ ID NO: 24582 - RNA, 687 nt, Artificial Sequence
  THAP2__Homo_sapiens__NP_113623
augcccaccaacugcgccgccgccggcugcgccaccaccuacaacaagcacaucaacaucagcuuccacagauucccccuggaccccaagagaagaaaggagugggugagacuggugagaagaaagaacuucgugcccggcaagcacaccuuccugugcagcaagcacuucgaggccagcugcuucgaccugaccggccagaccagaagacugaagauggacgccgugcccaccaucuucgacuucugcacccacaucaagagcaugaagcugaagagcagaaaccugcugaagaagaacaacagcugcagccccgccggccccagcaaccugaagagcaacaucagcagccagcaggugcugcuggagcacagcuacgccuucagaaaccccauggaggccaagaagagaaucaucaagcuggagaaggagaucgccagccugagaagaaagaugaagaccugccugcagaaggagagaagagccaccagaagauggaucaaggccaccugccuggugaagaaccuggaggccaacagcgugcugcccaagggcaccagcgagcacaugcugcccaccgcccugagcagccugccccuggaggacuucaagauccuggagcaggaccagcaggacaagacccugcugagccugaaccugaagcagaccaagagcaccuucaucuaa

SEQ ID NO: 24583 - RNA, 669 nt, Artificial Sequence
  THAP6__Homo_sapiens__NP_653322
auggugaagugcugcagcgccaucggcugcgccagcagaugccugcccaacagcaagcugaagggccugaccuuccacguguuccccaccgacgagaacaucaagagaaagugggugcuggccaugaagagacuggacgugaacgccgccggcaucugggagcccaagaagggcgacgugcugugcagcagacacuucaagaagaccgacuucgacagaagcgcccccaacaucaagcugaagcccggcgugauccccagcaucuucgacagccccuaccaccugcagggcaagagagagaagcugcacugcagaaagaacuucacccugaagaccgugcccgccaccaacuacaaccaccaccuggugggcgccagcagcugcaucgaggaguuccagagccaguucaucuucgagcacagcuacagcgugauggacagccccaagaagcugaagcacaagcuggaccacgugaucggcgagcuggaggacaccaaggagagccugagaaacgugcuggacagagagaagagauuccagaagagccugagaaagaccaucagagagcugaaggacgagugccugaucagccaggagaccgccaacagacuggacaccuucugcugggacugcugccaggagagcaucgagcaggacuacaucagcuaa

SEQ ID NO: 24584 - RNA, 1728 nt, Artificial Sequence
  THBD__Homo_sapiens__NP_000352
augcugggcgugcuggugcugggcgcccuggcccuggccggccugggcuuccccgcccccgccgagccccagcccggcggcagccagugcguggagcacgacugcuucgcccuguaccccggccccgccaccuuccugaacgccagccagaucugcgacggccugagaggccaccugaugaccgugagaagcagcguggccgccgacgugaucagccugcugcugaacggcgacggcggcgugggcagaagaagacuguggaucggccugcagcugccccccggcugcggcgaccccaagagacugggcccccugagaggcuuccagugggugaccggcgacaacaacaccagcuacagcagaugggccagacuggaccugaacggcgccccccugugcggcccccugugcguggccgugagcgccgccgaggccaccgugcccagcgagcccaucugggaggagcagcagugcgaggugaaggccgacggcuuccugugcgaguuccacuuccccgccaccugcagaccccuggccguggagcccggcgccgccgccgccgccgugagcaucaccuacggcacccccuucgccgccagaggcgccgacuuccaggcccugcccgugggcagcagcgccgccguggccccccugggccugcagcugaugugcaccgccccccccggcgccgugcagggccacugggccagagaggcccccggcgccugggacugcagcguggagaacggcggcugcgagcacgccugcaacgccauccccggcgcccccagaugccagugccccgccggcgccgcccugcaggccgacggcagaagcugcaccgccagcgccacccagagcugcaacgaccugugcgagcacuucugcgugcccaaccccgaccagcccggcagcuacagcugcaugugcgagaccggcuacagacuggccgccgaccagcacagaugcgaggacguggacgacugcauccuggagcccagccccugcccccagagaugcgugaacacccagggcggcuucgagugccacugcuaccccaacuacgaccugguggacggcgagugcguggagcccguggaccccugcuucagagccaacugcgaguaccagugccagccccugaaccagaccagcuaccugugcgugugcgccgagggcuucgcccccaucccccacgagccccacagaugccagauguucugcaaccagaccgccugccccgccgacugcgaccccaacacccaggccagcugcgagugccccgagggcuacauccuggacgacggcuucaucugcaccgacaucgacgagugcgagaacggcggcuucugcagcggcgugugccacaaccugcccggcaccuucgagugcaucugcggccccgacagcgcccuggccagacacaucggcaccgacugcgacagcggcaagguggacggcggcgacagcggcagcggcgagcccccccccagccccacccccggcagcacccugaccccccccgccgugggccuggugcacagcggccugcugaucggcaucagcaucgccagccugugccuggugguggcccugcuggcccugcugugccaccugagaaagaagcagggcgccgccagagccaagauggaguacaagugcgccgcccccagcaaggagguggugcugcagcacgugagaaccgagagaaccccccagagacuguaa

SEQ ID NO: 24585 - RNA, 3513 nt, Artificial Sequence
  THBS1__Homo_sapiens__NP_003237
augggccuggccuggggccugggcgugcuguuccugaugcacgugugcggcaccaacagaauccccgagagcggcggcgacaacagcguguucgacaucuucgagcugaccggcgccgccagaaagggcagcggcagaagacuggugaagggccccgaccccagcagccccgccuucagaaucgaggacgccaaccugaucccccccgugcccgacgacaaguuccaggaccugguggacgccgugagagccgagaagggcuuccugcugcuggccagccugagacagaugaagaagaccagaggcacccugcuggcccuggagagaaaggaccacagcggccagguguucagcguggugagcaacggcaaggccggcacccuggaccugagccugaccgugcagggcaagcagcacguggugagcguggaggaggcccugcuggccaccggccaguggaagagcaucacccuguucgugcaggaggacagagcccagcuguacaucgacugcgagaagauggagaacgccgagcuggacgugcccauccagagcguguucaccagagaccuggccagcaucgccagacugagaaucgccaagggcggcgugaacgacaacuuccagggcgugcugcagaacgugagauucguguucggcaccacccccgaggacauccugagaaacaagggcugcagcagcagcaccagcgugcugcugacccuggacaacaacguggugaacggcagcagccccgccaucagaaccaacuacaucggccacaagaccaaggaccugcaggccaucugcggcaucagcugcgacgagcugagcagcauggugcuggagcugagaggccugagaaccaucgugaccacccugcaggacagcaucagaaaggugaccgaggagaacaaggagcuggccaacgagcugagaagacccccccugugcuaccacaacggcgugcaguacagaaacaacgaggaguggaccguggacagcugcaccgagugccacugccagaacagcgugaccaucugcaagaaggugagcugccccaucaugcccugcagcaacgccaccgugcccgacggcgagugcugccccagaugcuggcccagcgacagcgccgacgacggcuggagccccuggagcgaguggaccagcugcagcaccagcugcggcaacggcauccagcagagaggcagaagcugcgacagccugaacaacagaugcgagggcagcagcgugcagaccagaaccugccacauccaggagugcgacaagagauucaagcaggacggcggcuggagccacuggagccccuggagcagcugcagcgugaccugcggcgacggcgugaucaccagaaucagacugugcaacagccccagcccccagaugaacggcaagcccugcgagggcgaggccagagagaccaaggccugcaagaaggacgccugccccaucaacggcggcuggggccccuggagccccugggacaucugcagcgugaccugcggcggcggcgugcagaagagaagcagacugugcaacaaccccaccccccaguucggcggcaaggacugcgugggcgacgugaccgagaaccagaucugcaacaagcaggacugccccaucgacggcugccugagcaaccccugcuucgccggcgugaagugcaccagcuaccccgacggcagcuggaagugcggcgccugcccccccggcuacagcggcaacggcauccagugcaccgacguggacgagugcaaggaggugcccgacgccugcuucaaccacaacggcgagcacagaugcgagaacaccgaccccggcuacaacugccugcccugcccccccagauucaccggcagccagcccuucggccagggcguggagcacgccaccgccaacaagcaggugugcaagcccagaaaccccugcaccgacggcacccacgacugcaacaagaacgccaagugcaacuaccugggccacuacagcgaccccauguacagaugcgagugcaagcccggcuacgccggcaacggcaucaucugcggcgaggacaccgaccuggacggcuggcccaacgagaaccuggugugcguggccaacgccaccuaccacugcaagaaggacaacugccccaaccugcccaacagcggccaggaggacuacgacaaggacggcaucggcgacgccugcgacgacgacgacgacaacgacaagauccccgacgacagagacaacugccccuuccacuacaaccccgcccaguacgacuacgacagagacgacgugggcgacagaugcgacaacugccccuacaaccacaaccccgaccaggccgacaccgacaacaacggcgagggcgacgccugcgccgccgacaucgacggcgacggcauccugaacgagagagacaacugccaguacguguacaacguggaccagagagacaccgacauggacggcgugggcgaccagugcgacaacugcccccuggagcacaaccccgaccagcuggacagcgacagcgacagaaucggcgacaccugcgacaacaaccaggacaucgacgaggacggccaccagaacaaccuggacaacugccccuacgugcccaacgccaaccaggccgaccacgacaaggacggcaagggcgacgccugcgaccacgacgacgacaacgacggcauccccgacgacaaggacaacugcagacuggugcccaaccccgaccagaaggacagcgacggcgacggcagaggcgacgccugcaaggacgacuucgaccacgacagcgugcccgacaucgacgacaucugccccgagaacguggacaucagcgagaccgacuucagaagauuccagaugaucccccuggaccccaagggcaccagccagaacgaccccaacuggguggugagacaccagggcaaggagcuggugcagaccgugaacugcgaccccggccuggccgugggcuacgacgaguucaacgccguggacuucagcggcaccuucuucaucaacaccgagagagacgacgacuacgccggcuucguguucggcuaccagagcagcagcagauucuacguggugauguggaagcaggugacccagagcuacugggacaccaaccccaccagagcccagggcuacagcggccugagcgugaagguggugaacagcaccaccggccccggcgagcaccugagaaacgcccuguggcacaccggcaacacccccggccaggugagaacccuguggcacgaccccagacacaucggcuggaaggacuucaccgccuacagauggagacugagccacagacccaagaccggcuucaucagaguggugauguacgagggcaagaagaucauggccgacagcggccccaucuacgacaagaccuacgccggcggcagacugggccuguucguguucagccaggagaugguguucuucagcgaccugaaguacgagugcagagaccccuaa

SEQ ID NO: 24586 - RNA, 3519 nt, Artificial Sequence
  THBS2__Homo_sapiens__NP_003238
augguguggagacuggugcugcuggcccuguggguguggcccagcacccaggccggccaccaggacaaggacaccaccuucgaccuguucagcaucagcaacaucaacagaaagaccaucggcgccaagcaguucagaggccccgaccccggcgugcccgccuacagauucgugagauucgacuacaucccccccgugaacgccgacgaccugagcaagaucaccaagaucaugagacagaaggagggcuucuuccugaccgcccagcugaagcaggacggcaagagcagaggcacccugcuggcccuggagggccccggccugagccagagacaguucgagaucgugagcaacggccccgccgacacccuggaccugaccuacuggaucgacggcaccagacacguggugagccuggaggacgugggccuggccgacagccaguggaagaacgugaccgugcagguggccggcgagaccuacagccugcacgugggcugcgaccugaucgacagcuucgcccuggacgagcccuucuacgagcaccugcaggccgagaagagcagaauguacguggccaagggcagcgccagagagagccacuucagaggccugcugcagaacgugcaccugguguucgagaacagcguggaggacauccugagcaagaagggcugccagcagggccagggcgccgagaucaacgccaucagcgagaacaccgagacccugagacugggcccccacgugaccaccgaguacgugggccccagcagcgagagaagacccgaggugugcgagagaagcugcgaggagcugggcaacauggugcaggagcugagcggccugcacgugcuggugaaccagcugagcgagaaccugaagagagugagcaacgacaaccaguuccugugggagcugaucggcggcccccccaagaccagaaacaugagcgccugcuggcaggacggcagauucuucgccgagaacgagaccugggugguggacagcugcaccaccugcaccugcaagaaguucaagaccaucugccaccagaucaccugcccccccgccaccugcgccagccccagcuucguggagggcgagugcugccccagcugccugcacagcguggacggcgaggagggcuggagccccugggccgaguggacccagugcagcgugaccugcggcagcggcacccagcagagaggcagaagcugcgacgugaccagcaacaccugccugggccccagcauccagaccagagccugcagccugagcaagugcgacaccagaaucagacaggacggcggcuggagccacuggagccccuggagcagcugcagcgugaccugcggcgugggcaacaucaccagaaucagacugugcaacagccccgugccccagaugggcggcaagaacugcaagggcagcggcagagagaccaaggccugccagggcgcccccugccccaucgacggcagauggagccccuggagccccuggagcgccugcaccgugaccugcgccggcggcaucagagagagaaccagagugugcaacagccccgagccccaguacggcggcaaggccugcgugggcgacgugcaggagagacagaugugcaacaagagaagcugccccguggacggcugccugagcaaccccugcuuccccggcgcccagugcagcagcuuccccgacggcagcuggagcugcggcagcugccccgugggcuuccugggcaacggcacccacugcgaggaccuggacgagugcgcccuggugcccgacaucugcuucagcaccagcaaggugcccagaugcgugaacacccagcccggcuuccacugccugcccugcccccccagauacagaggcaaccagcccgugggcgugggccuggaggccgccaagaccgagaagcaggugugcgagcccgagaaccccugcaaggacaagacccacaacugccacaagcacgccgagugcaucuaccugggccacuucagcgaccccauguacaagugcgagugccagaccggcuacgccggcgacggccugaucugcggcgaggacagcgaccuggacggcuggcccaaccugaaccuggugugcgccaccaacgccaccuaccacugcaucaaggacaacugcccccaccugcccaacagcggccaggaggacuucgacaaggacggcaucggcgacgccugcgacgacgacgacgacaacgacggcgugaccgacgagaaggacaacugccagcugcuguucaaccccagacaggccgacuacgacaaggacgaggugggcgacagaugcgacaacugccccuacgugcacaaccccgcccagaucgacaccgacaacaacggcgagggcgacgccugcagcguggacaucgacggcgacgacguguucaacgagagagacaacugccccuacguguacaacaccgaccagagagacaccgacggcgacggcgugggcgaccacugcgacaacugcccccuggugcacaaccccgaccagaccgacguggacaacgaccuggugggcgaccagugcgacaacaacgaggacaucgacgacgacggccaccagaacaaccaggacaacugccccuacaucagcaacgccaaccaggccgaccacgacagagacggccagggcgacgccugcgaccccgacgacgacaacgacggcgugcccgacgacagagacaacugcagacugguguucaaccccgaccaggaggaccuggacggcgacggcagaggcgacaucugcaaggacgacuucgacaacgacaacauccccgacaucgacgacgugugccccgagaacaacgccaucagcgagaccgacuucagaaacuuccagauggugccccuggaccccaagggcaccacccagaucgaccccaacugggugaucagacaccagggcaaggagcuggugcagaccgccaacagcgaccccggcaucgccgugggcuucgacgaguucggcagcguggacuucagcggcaccuucuacgugaacaccgacagagacgacgacuacgccggcuucguguucggcuaccagagcagcagcagauucuacguggugauguggaagcaggugacccagaccuacugggaggaccagcccaccagagccuacggcuacagcggcgugagccugaagguggugaacagcaccaccggcaccggcgagcaccugagaaacgcccuguggcacaccggcaacacccccggccaggugagaacccuguggcacgaccccagaaacaucggcuggaaggacuacaccgccuacagauggcaccugacccacagacccaagaccggcuacaucagagugcuggugcacgagggcaagcaggugauggccgacagcggccccaucuacgaccagaccuacgccggcggcagacugggccuguucguguucagccaggagaugguguacuucagcgaccugaaguacgagugcagagacaucuaa

SEQ ID NO: 24587 - RNA, 2511 nt, Artificial Sequence
  THBS3__Homo_sapiens__NP_001239537
auggagacccaggagcugagaggcgcccuggcccugcugcugcugugcuucuucaccagcgccagccaggaccugcaggugaucgaccugcugaccgugggcgagagcagacagaugguggccguggccgagaagaucagaaccgcccugcugaccgccggcgacaucuaccugcugagcaccuucagacugccccccaagcagggcggcgugcuguucggccuguacagcagacaggacaacaccagauggcuggaggccagcguggugggcaagaucaacaaggugaccaacgcccugcacagcauccugggcgagcagaccaaggcccuggugacccagcugacccuguucaaccagauccugguggagcugagagacgacaucagagaccaggugaaggagaugagccugaucagaaacaccaucauggagugccaggugugcggcuuccacgagcagagaagccacugcagccccaaccccugcuucagaggcguggacugcauggagguguacgaguaccccggcuacagaugcggccccugcccccccggccugcagggcaacggcacccacugcagcgacaucaacgagugcgcccacgccgaccccugcuuccccggcagcagcugcaucaacaccaugcccggcuuccacugcgaggccugccccagaggcuacaagggcacccaggugagcggcgugggcaucgacuacgccagagccagcaagcaggugugcaacgacaucgacgagugcaacgacggcaacaacggcggcugcgaccccaacagcaucugcaccaacaccgugggcagcuucaagugcggccccugcagacugggcuuccugggcaaccagagccagggcugccugcccgccagaaccugccacagccccgcccacagccccugccacauccacgcccacugccuguucgagagaaacggcgccgugagcugccagugcaacgugggcugggccggcaacggcaacgugugcggcaccgacaccgacaucgacggcuaccccgaccaggcccugcccugcauggacaacaacaagcacugcaagcaggacaacugccugcugacccccaacagcggccaggaggacgccgacaacgacggcgugggcgaccagugcgacgacgacgccgacggcgacggcaucaagaacguggaggacaacugcagacuguuccccaacaaggaccagcagaacagcgacaccgacagcuucggcgacgccugcgacaacugccccaacgugcccaacaacgaccagaaggacaccgacggcaacggcgagggcgacgccugcgacaacgacguggacggcgacggcauccccaacggccuggacaacugccccaaggugcccaacccccugcagaccgacagagacgaggacggcgugggcgacgccugcgacagcugccccgagaugagcaaccccacccagaccgacgccgacagcgaccuggugggcgacgugugcgacaccaacgaggacagcgacggcgacggccaccaggacaccaaggacaacugcccccagcugcccaacagcagccagcuggacagcgacaacgacggccugggcgacgagugcgacggcgacgacgacaacgacggcauccccgacuacgugccccccggccccgacaacugcagacuggugcccaaccccaaccagaaggacagcgacggcaacggcgugggcgacgugugcgaggacgacuucgacaacgacgccgugguggacccccuggacgugugccccgagagcgccgaggugacccugaccgacuucagagccuaccagaccguggugcuggaccccgagggcgacgcccagaucgaccccaacuggguggugcugaaccagggcauggagaucgugcagaccaugaacagcgaccccggccuggccgugggcuacaccgccuucaacggcguggacuucgagggcaccuuccacgugaacaccgugaccgacgacgacuacgccggcuuccuguucagcuaccaggacagcggcagauucuacguggugauguggaagcagaccgagcagaccuacuggcaggccacccccuucagagccguggcccagcccggccugcagcugaaggccgugaccagcgugagcggccccggcgagcaccugagaaacgcccuguggcacaccggccacacccccgaccaggugagacugcuguggaccgaccccagaaacgugggcuggagagacaagaccagcuacagauggcagcugcugcacagaccccaggugggcuacaucagagugaagcuguacgagggcccccagcugguggccgacagcggcgugaucaucgacaccagcaugagaggcggcagacugggcguguucugcuucagccaggagaacaucaucuggagcaaccugcaguacagaugcaacgacaccgugcccgaggacuucgagcccuucagaagacagcugcugcagggcagaguguaa

SEQ ID NO: 24588 - RNA, 2886 nt, Artificial Sequence
  THBS4__Homo_sapiens__NP_003239
augcuggcccccagaggcgccgccgugcugcugcugcaccuggugcugcagagauggcuggccgccggcgcccaggccaccccccagguguucgaccugcugcccagcagcagccagagacugaaccccggcgcccugcugcccgugcugaccgaccccgcccugaacgaccuguacgugaucagcaccuucaagcugcagaccaagagcagcgccaccaucuucggccuguacagcagcaccgacaacagcaaguacuucgaguucaccgugaugggcagacugaacaaggccauccugagauaccugaagaacgacggcaaggugcaccuggugguguucaacaaccugcagcuggccgacggcagaagacacagaauccugcugagacugagcaaccugcagagaggcgccggcagccuggagcuguaccuggacugcauccagguggacagcgugcacaaccugcccagagccuucgccggccccagccagaagcccgagaccaucgagcugagaaccuuccagagaaagccccaggacuuccuggaggagcugaagcugguggugagaggcagccuguuccagguggccagccugcaggacugcuuccugcagcagagcgagccccuggccgccaccggcaccggcgacuucaacagacaguuccugggccagaugacccagcugaaccagcugcugggcgaggugaaggaccugcugagacagcaggugaaggagaccagcuuccugagaaacaccaucgccgagugccaggccugcggcccccugaaguuccagagccccacccccagcaccguggugccccccgccccccccgccccccccaccagaccccccagaagaugcgacagcaaccccugcuucagaggcgugcagugcaccgacagcagagacggcuuccagugcggccccugccccgagggcuacaccggcaacggcaucaccugcaucgacguggacgagugcaaguaccaccccugcuaccccggcgugcacugcaucaaccugagccccggcuucagaugcgacgccugccccgugggcuucaccggccccauggugcagggcgugggcaucagcuucgccaagagcaacaagcaggugugcaccgacaucgacgagugcagaaacggcgccugcgugcccaacagcaucugcgugaacacccugggcagcuacagaugcggccccugcaagcccggcuacaccggcgaccagaucagaggcugcaaggccgagagaaacugcagaaaccccgagcugaaccccugcagcgugaacgcccagugcaucgaggagagacagggcgacgugaccugcgugugcggcgugggcugggccggcgacggcuacaucugcggcaaggacguggacaucgacagcuaccccgacgaggagcugcccugcagcgccagaaacugcaagaaggacaacugcaaguacgugcccaacagcggccaggaggacgccgacagagacggcaucggcgacgccugcgacgaggacgccgacggcgacggcauccugaacgagcaggacaacugcgugcugauccacaacguggaccagagaaacagcgacaaggacaucuucggcgacgccugcgacaacugccugagcgugcugaacaacgaccagaaggacaccgacggcgacggcagaggcgacgccugcgacgacgacauggacggcgacggcaucaagaacauccuggacaacugccccaaguuccccaacagagaccagagagacaaggacggcgacggcgugggcgacgccugcgacagcugccccgacgugagcaaccccaaccagagcgacguggacaacgaccuggugggcgacagcugcgacaccaaccaggacagcgacggcgacggccaccaggacagcaccgacaacugccccaccgugaucaacagcgcccagcuggacaccgacaaggacggcaucggcgacgagugcgacgacgacgacgacaacgacggcauccccgaccuggugccccccggccccgacaacugcagacuggugcccaaccccgcccaggaggacagcaacagcgacggcgugggcgacaucugcgagagcgacuucgaccaggaccaggugaucgacagaaucgacgugugccccgagaacgccgaggugacccugaccgacuucagagccuaccagaccguggugcuggaccccgagggcgacgcccagaucgaccccaacuggguggugcugaaccagggcauggagaucgugcagaccaugaacagcgaccccggccuggccgugggcuacaccgccuucaacggcguggacuucgagggcaccuuccacgugaacacccagaccgacgacgacuacgccggcuucaucuucggcuaccaggacagcagcagcuucuacguggugauguggaagcagaccgagcagaccuacuggcaggccacccccuucagagccguggccgagcccggcauccagcugaaggccgugaagagcaagaccggccccggcgagcaccugagaaacagccuguggcacaccggcgacaccagcgaccaggugagacugcuguggaaggacagcagaaacgugggcuggaaggacaaggugagcuacagaugguuccugcagcacagaccccaggugggcuacaucagagugagauucuacgagggcagcgagcugguggccgacagcggcgugaccaucgacaccaccaugagaggcggcagacugggcguguucugcuucagccaggagaacaucaucuggagcaaccugaaguacagaugcaacgacaccauccccgaggacuuccaggaguuccagacccagaacuucgacagauucgacaacuaa

SEQ ID NO: 24589 - RNA, 1140 nt, Artificial Sequence
  THEG__Homo_sapiens__NP_057669
augggcgacagcagaagaagaagccugggcaaccagcccagcagcgaggccgccggcagaagcgagagagagcaggacggcgaccccagaggccugcagagcagcguguacgagagcagaagagugaccgaccccgagagacaggaccuggacaacgccgagcugggccccgaggaccccgaggaggagcugccccccgaggagguggccggcgaggaguuccccgagacccuggaccccaaggaggcccugagcgagcuggagagagugcuggacaaggaccuggaggaggacauccccgagaucagcagacugagcaucagccagaagcugcccagcaccaccaugaccaaggccagaaagagaagaagaagaagaagacugauggagcuggccgagcccaagaucaacuggcaggugcugaaggacagaaagggcagaugcggcaagggcuacgccuggaucagccccugcaagaugagccugcacuucugccugugcuggcccagcguguacuggaccgagagauuccuggaggacaccacccugaccaucaccgugcccgccgugagcagaagaguggaggagcugagcagacccaagagauucuaccuggaguacuacaacaacaacagaaccacccccguguggcccauccccagaagcagccuggaguacagagccagcagcagacugaaggagcuggccgcccccaagaucagagacaacuucuggagcaugcccaugagcgaggugagccaggugagcagagccgcccagauggccgugcccagcagcagaauccugcagcugagcaagcccaaggcccccgccacccugcuggaggagugggaccccgugcccaagcccaagccccacgugagcgaccacaacagacugcugcaccuggccagacccaaggcccagagcgacaagugcgugcccgacagagaccccagaugggaggugcuggacgugaccaagaaggugguggccagccccagaaucaucagccuggccaagcccaaggugagaaagggccugaacgagggcuacgacagaagaccccuggccagcaugagccugcccccccccaaggccagccccgagaagugcgaccagcccagacccggccuguaa

SEQ ID NO: 24590 - RNA, 723 nt, Artificial Sequence
  THEM4__Homo_sapiens__NP_444283
augcugagaagcugcgccgccagacugagaacccugggcgcccugugccugccccccgugggcagaagacugcccggcagcgagcccagacccgagcugagaagcuucagcagcgaggaggugauccugaaggacugcagcgugcccaaccccagcuggaacaaggaccugagacugcuguucgaccaguucaugaagaagugcgaggacggcagcuggaagagacugcccagcuacaagagaacccccaccgaguggauccaggacuucaagacccacuuccuggaccccaagcugaugaaggaggagcagaugagccaggcccagcuguucaccagaagcuucgacgacggccugggcuucgaguacgugauguucuacaacgacaucgagaagagaauggugugccuguuccagggcggccccuaccuggagggcccccccggcuucauccacggcggcgccaucgccaccaugaucgacgccaccgugggcaugugcgccaugauggccggcggcaucgugaugaccgccaaccugaacaucaacuacaagagacccaucccccugugcagcguggugaugaucaacagccagcuggacaagguggagggcagaaaguucuucgugagcugcaacgugcagagcguggacgagaagacccuguacagcgaggccaccagccuguucaucaagcugaaccccgccaagagccugaccuaa

SEQ ID NO: 24591 - RNA, 744 nt, Artificial Sequence
  THEM5__Homo_sapiens__NP_872384
augaucagaagaugcuuccagguggccgccagacugggccaccacagaggccugcuggaggcccccagaauccugcccagacugaaccccgccagcgccuucggcagcagcaccgacagcauguucagcagauuccugcccgagaagaccgaccugaaggacuacgcccugcccaacgccagcuggugcagcgacaugcugagccuguaccaggaguuccuggagaagaccaagagcagcggcuggaucaagcugcccagcuucaagagcaacagagaccacaucagaggccugaagcugcccagcggccuggccgugagcagcgacaagggcgacugcagaaucuucaccagaugcauccagguggagggccagggcuucgaguacgugaucuucuuccagcccacccagaagaagagcgugugccuguuccagcccggcagcuaccuggagggcccccccggcuucgcccacggcggcagccuggccgccaugauggacgagaccuucagcaagaccgccuuccuggccggcgagggccuguucacccugagccugaacaucagauucaagaaccugauccccguggacagccugguggugauggacguggagguggacaagaucgaggaccagaagcuguacaugagcugcaucgcccacagcagagaccagcagaccguguacgccaagagcagcggcguguuccugcagcugcagcuggaggaggagagcccccaguaa

SEQ ID NO: 24592 - RNA, 627 nt, Artificial Sequence
  THEM6__Homo_sapiens__NP_057731
augcugggccugcugguggcccugcuggcccugggccuggccguguucgcccugcuggacgugugguaccuggugagacugcccugcgccgugcugagagccagacugcugcagcccagagugagagaccugcuggccgagcagagauuccccggcagagugcugcccagcgaccuggaccugcugcugcacaugaacaacgccagauaccugagagaggccgacuucgccagaguggcccaccugaccagaugcggcgugcugggcgcccugagagagcugagagcccacaccgugcuggccgccagcugcgccagacacagaagaagccugagacugcuggagcccuucgaggugagaaccagacugcugggcugggacgacagagccuucuaccuggaggccagauucgugagccugagagacggcuucgugugcgcccugcugagauucagacagcaccugcugggcaccagccccgagagaguggugcagcaccugugccagagaagaguggagccccccgagcugcccgccgaccugcagcacuggaucagcuacaacgaggccagcagccagcugcugagaauggagagcggccugagcgacgugaccaaggaccaguaa

SEQ ID NO: 24593 - RNA, 1791 nt, Artificial Sequence
  THEMIS2__Homo_sapiens__XP_011540747
auggagcccgugccccugcaggacuucgugagagcccuggaccccgccagccugcccagagugcugagagugugcagcggcguguacuucgagggcuacuucaccccccugaacaccccccagagcuacgagacccuggaggagcuggugagcgccaccacccagagcagcaagcagcugcccaccugcuucaugagcacccacagaaucgugaccgagggcagaguggugaccgaggaccagcugcugaugcuggaggccguggugaugcaccugggcaucagaagcgccagaugcgugcugggcauggagggccagcaggugauccugcaccugccccugagccagaagggccccuucuggaccugggagcccagcgcccccagaacccugcugcaggugcugcaggaccccgcccugaaggaccuggugcugaccugccccacccugcccuggcacagccugauccugagaccccaguacgagauccaggccaucaugcacaugagaagaaccaucgugaagauccccagcacccuggagguggacguggaggacgugaccgccagcagcagacacgugcacuucaucaagccccugcugcugagcgaggugcuggccugggagggccccuucccccugagcauggagauccuggaggugcccgagggcagacccaucuuccugagccccugggugggcagccugcagaagggccagagacugugcguguacggccuggccagcccccccuggagagugcuggccagcagcaagggcagaaaggugcccagacacuuccuggugagcggcggcuaccagggcaagcugagaagaagacccagagaguuccccaccgccuacgaccugcugggcgccuuccagcccggcagaccccugagagugguggccaccaaggacugcgagggcgagagagaggagaaccccgaguucaccagccuggccgugggcgacagacuggaggugcugggccccggccaggcccacggcgcccagggcagcgacguggacgugcuggugugccagagacugagcgaccaggccggcgaggacgaggaggaggagugcaaggaggaggccgagagccccgagagagugcugcugcccuuccacuuccccggcagcuucguggaggagaugagcgacagcagaagauacagccuggccgaccugaccgcccaguucagccugcccugcgaggugaaggugguggccaaggacaccagccaccccaccgacccccugaccagcuuccugggccugagacuggaggagaagaucaccgagcccuuccugguggugagccuggacagcgagcccggcaugugcuucgagaucccccccagauggcuggaccugaccguggugaaggccaagggccagcccgaccugcccgagggcagccugcccaucgccaccguggaggagcugaccgacaccuucuacuacagacugagaaagcugcccgccugcgagauccaggcccccccccccagaccccccaagaaccagggccugagcaagcagagaagacacagcagcgagggcggcgugaagagcagccaggugcugggccugcagcagcacgccagacugcccaagcccaaggccaagacccugcccgaguucaucaaggacggcagcagcaccuacagcaagauccccgcccacagaaagggccacagacccgccaagccccagagacaggaccuggacgacgacgagcacgacuacgaggagauccuggagcaguuccagaagaccaucuaa

SEQ ID NO: 24594 - RNA, 1926 nt, Artificial Sequence
  THEMIS__Homo_sapiens__NP_001010923
auggcccugagccuggaggaguucgugcacagccuggaccugagaacccugcccagagugcuggagauccaggccggcaucuaccuggagggcagcaucuacgagauguucggcaacgagugcugcuucagcaccggcgaggugaucaagaucaccggccugaaggugaagaagaucaucgccgagaucugcgagcagaucgagggcugcgagagccugcagcccuucgagcugcccaugaacuuccccggccuguucaagaucguggccgacaagacccccuaccugaccauggaggagaucaccagaaccauccacaucggccccagcagacugggccaccccugcuucuaccaccagaaggacaucaagcuggagaaccugaucaucaagcagggcgagcagaucaugcugaacagcguggaggagaucgacggcgagaucauggugagcugcgccguggccagaaaccaccagacccacagcuucaaccugccccugagccaggagggcgaguucuacgagugcgaggacgagagaaucuacacccugaaggagaucguggaguggaagauccccaagaacagaaccagaaccgugaaccugaccgacuucagcaacaagugggacagcaccaaccccuuccccaaggacuucuacggcacccugauccugaagcccguguacgagauccagggcgugaugaaguucagaaaggacaucaucagaauccugcccagccuggacguggaggugaaggacaucaccgacagcuacgacgccaacugguuccugcagcugcugagcaccgaggaccuguucgagaugaccagcaaggaguuccccaucgugaccgaggugaucgaggcccccgagggcaaccaccugccccagagcauccugcagcccggcaagaccaucgugauccacaagaaguaccaggccagcagaauccuggccagcgagaucagaagcaacuuccccaagagacacuuccugauccccaccagcuacaagggcaaguucaagagaagacccagagaguuccccaccgccuacgaccuggagaucgccaagagcgagaaggagccccugcacgugguggccaccaaggccuuccacagcccccacgacaagcugagcagcgugagcgugggcgaccaguuccuggugcaccagagcgagaccaccgaggugcugugcgagggcaucaagaagguggugaacgugcuggccugcgagaagauccugaagaagagcuacgaggccgcccugcugccccuguacauggagggcggcuucguggaggugauccacgacaagaagcaguaccccaucagcgagcugugcaagcaguucagacugcccuucaacgugaaggugagcgugagagaccugagcaucgaggaggacgugcuggccgccacccccggccugcagcuggaggaggacaucaccgacagcuaccugcugaucagcgacuucgccaaccccaccgagugcugggagauccccgugggcagacugaacaugaccgugcagcuggugagcaacuucagcagagacgccgagcccuuccuggugagaacccugguggaggagaucaccgaggagcaguacuacaugaugagaagauacgagagcagcgccagccaccccccccccagaccccccaagcaccccagcguggaggagaccaagcugacccugcugacccuggccgaggagagaaccguggaccugcccaagagccccaagagacaccacguggacaucaccaagaagcugcaccccaaccaggccggccuggacagcaaggugcugaucggcagccagaacgaccugguggacgaggagaaggagagaagcaacagaggcgccaccgccaucgccgagaccuucaagaacgagaagcaccagaaguaa

SEQ ID NO: 24595 - RNA, 897 nt, Artificial Sequence
  THG1L__Homo_sapiens__NP_060342
auguggggcgccugcaaggugaaggugcacgacagccuggccaccaucagcaucacccugagaagauaccugagacugggcgccaccauggccaagagcaaguucgaguacgugagagacuucgaggccgacgacaccugccuggcccacugcugggugguggugagacuggacggcagaaacuuccacagauucgccgagaagcacaacuucgccaagcccaacgacagcagagcccugcagcugaugaccaagugcgcccagaccgugauggaggagcuggaggacaucgugaucgccuacggccagagcgacgaguacagcuucguguucaagagaaagaccaacugguucaagagaagagccagcaaguucaugacccacguggccagccaguucgccagcagcuacguguucuacuggagagacuacuucgaggaccagccccugcuguacccccccggcuucgacggcagaguggugguguaccccagcaaccagacccugaaggacuaccugagcuggagacaggccgacugccacaucaacaaccuguacaacaccguguucugggcccugauccagcagagcggccugacccccgugcaggcccagggcagacugcagggcacccuggccgccgacaagaacgagauccuguucagcgaguucaacaucaacuacaacaacgagcugcccauguacagaaagggcaccgugcugaucuggcagaagguggacgaggugaugaccaaggagaucaagcugcccaccgagauggagggcaagaagauggccgugaccagaaccagaaccaagcccgugccccugcacugcgacaucaucggcgacgccuucuggaaggagcaccccgagauccuggacgaggacagcuaa

SEQ ID NO: 24596 - RNA, 1494 nt, Artificial Sequence
  TH__Homo_sapiens__NP_000351
augcccacccccgacgccaccaccccccaggccaagggcuucagaagagccgugagcgagcuggacgccaagcaggccgaggccaucaugagccccagauucaucggcagaagacagagccugaucgaggacgccagaaaggagagagaggccgccguggccgccgccgccgccgccgugcccagcgagcccggcgacccccuggaggccguggccuucgaggagaaggagggcaaggccgugcugaaccugcuguucagccccagagccaccaagcccagcgcccugagcagagccgugaagguguucgagaccuucgaggccaagauccaccaccuggagaccagacccgcccagagacccagagccggcggcccccaccuggaguacuucgugagacuggaggugagaagaggcgaccuggccgcccugcugagcggcgugagacaggugagcgaggacgugagaagccccgccggccccaaggugcccugguuccccagaaaggugagcgagcuggacaagugccaccaccuggugaccaaguucgaccccgaccuggaccuggaccaccccggcuucagcgaccagguguacagacagagaagaaagcugaucgccgagaucgccuuccaguacagacacggcgaccccauccccagaguggaguacaccgccgaggagaucgccaccuggaaggagguguacaccacccugaagggccuguacgccacccacgccugcggcgagcaccuggaggccuucgcccugcuggagagauucagcggcuacagagaggacaacaucccccagcuggaggacgugagcagauuccugaaggagagaaccggcuuccagcugagacccguggccggccugcugagcgccagagacuuccuggccagccuggccuucagaguguuccagugcacccaguacaucagacacgccagcagccccaugcacagccccgagcccgacugcugccacgagcugcugggccacgugcccaugcuggccgacagaaccuucgcccaguucagccaggacaucggccuggccagccugggcgccagcgacgaggagaucgagaagcugagcacccuguacugguucaccguggaguucggccugugcaagcagaacggcgaggugaaggccuacggcgccggccugcugagcagcuacggcgagcugcugcacugccugagcgaggagcccgagaucagagccuucgaccccgaggccgccgccgugcagcccuaccaggaccagaccuaccagagcguguacuucgugagcgagagcuucagcgacgccaaggacaagcugagaagcuacgccagcagaauccagagacccuucagcgugaaguucgaccccuacacccuggccaucgacgugcuggacagcccccaggccgugagaagaagccuggagggcgugcaggacgagcuggacacccuggcccacgcccugagcgccaucggcuaa

SEQ ID NO: 24597 - RNA, 2232 nt, Artificial Sequence
  THNSL1__Homo_sapiens__NP_079114
augcugcacuucaacagaugccaccaccugaagaagaucacccagaagugcuucagcagcauccacgugaagaccgacaagcacgcccagagauuccugagcagaaccuucgcccuggccgagcugagaaagagcugguacagcacccacagccuggugggcgacaagaacaucauccugaugggcccccccggcgccggcaagaccaccgugggcagaaucaucggccagaagcugggcugcugcgugaucgacguggacgacgacauccuggagaagaccuggaacaugagcgugagcgagaagcugcaggacgugggcaacgagcaguuccuggaggaggagggcaaggccgugcugaacuucagcgccagcggcagcgugaucagccugaccggcagcaaccccaugcacgacgccagcauguggcaccugaagaagaacggcaucaucguguaccuggacgugccccugcuggaccugaucugcagacugaagcugaugaagaccgacagaaucgugggccagaacagcggcaccagcaugaaggaccugcugaaguucagaagacaguacuacaagaagugguacgacgccagaguguucugcgagagcggcgccagccccgaggagguggccgacaaggugcugaacgccaucaagagauaccaggacguggacagcgagaccuucaucagcaccagacacguguggcccgaggacugcgagcagaaggugagcgccaaguucuucagcgaggccgugaucgagggccuggccagcgacggcggccuguucgugcccgccaaggaguuccccaagcugagcugcggcgaguggaagagccuggugggcgccaccuacguggagagagcccagauccugcuggagagaugcauccaccccgccgacauccccgccgccagacugggcgagaugaucgagaccgccuacggcgagaacuucgccugcagcaagaucgcccccgugagacaccugagcggcaaccaguucauccuggagcuguuccacggccccaccggcagcuucaaggaccugagccugcagcugaugccccacaucuucgcccacugcaucccccccagcugcaacuacaugauccugguggccaccagcggcgacaccggcagcgccgugcugaacggcuucagcagacugaacaagaacgacaagcagagaaucgccgugguggccuucuuccccgagaacggcgugagcgacuuccagaaggcccagaucaucggcagccagagagagaacggcugggccgugggcguggagagcgacuucgacuucugccagaccgccaucaagagaaucuucaacgacagcgacuucaccggcuuccugaccguggaguacggcaccauccugagcagcgccaacagcaucaacuggggcagacugcugccccaggugguguaccacgccagcgccuaccuggaccuggugagccagggcuucaucagcuucggcagccccguggacgugugcauccccaccggcaacuucggcaacauccuggccgccguguacgccaagaugaugggcauccccaucagaaaguucaucugcgccagcaaccagaaccacgugcugaccgacuucaucaagaccggccacuacgaccugagagagagaaagcuggcccagaccuucagccccagcaucgacauccugaagagcagcaaccuggagagacaccugcaccugauggccaacaaggacggccagcugaugaccgagcuguucaacagacuggagagccagcaccacuuccagaucgagaaggcccugguggagaagcugcagcaggacuucguggccgacuggugcagcgagggcgagugccuggccgccaucaacagcaccuacaacaccagcggcuacauccuggacccccacaccgccguggccaaggugguggccgacagagugcaggacaagaccugccccgugaucaucagcagcaccgcccacuacagcaaguucgcccccgccaucaugcaggcccugaagaucaaggagaucaacgagaccagcagcagccagcuguaccugcugggcagcuacaacgcccugcccccccugcacgaggcccugcuggagagaaccaagcagcaggagaagauggaguaccaggugugcgccgccgacaugaacgugcugaagagccacguggagcagcuggugcagaaccaguucaucuaa

SEQ ID NO: 24598 - RNA, 1218 nt, Artificial Sequence
  THNSL2__Homo_sapiens__NP_001231605
augugguacgugagcaccagaggcguggcccccagagugaacuucgagggcgcccuguucagcggcuacgcccccgacggcggccuguucaugcccgaggagcugccccagcuggacagaggcacccugugccaguggagcacccugagcuaccccggccuggugaaggagcugugcgcccuguucaucggcagcgagcugcugcccaaggacgagcugaacgaccugaucgacagagccuucagcagauucagacacagagagguggugcaccugagcagacugagaaacggccugaacgugcuggagcuguggcacggcgugaccuacgccuucaaggaccugagccugagcugcaccacccaguuccugcaguacuuccuggagaagagagagaagcacgugaccgugguggugggcaccagcggcgacaccggcagcgccgccaucgagagcgugcagggcgccaagaacauggacaucaucgugcugcugcccaagggccacugcaccaagauccaggagcugcagaugaccaccgugcugaagcagaacgugcacguguucggcguggagggcaacagcgacgagcuggacgagcccaucaagaccguguucgccgacguggccuucgugaagaagcacaaccugaugagccugaacagcaucaacuggagcagagugcuggugcagauggcccaccacuucuucgccuacuuccagugcacccccagccuggacacccacccccugccccugguggaggugguggugcccaccggcgccgccggcaaccuggccgccggcuacaucgcccagaagaucggccugcccaucagacuggugguggccgugaacagaaacgacaucauccacagaaccgugcagcagggcgacuucagccugagcgaggccgugaagagcacccuggccagcgccauggacauccaggugcccuacaacauggagagaguguucuggcugcugagcggcagcgacagccaggugaccagagcccugauggagcaguucgagagaacccagagcgugaaccugcccaaggagcugcacagcaagugggagagacaggacuacgagaagauggccgugauggagugcgacggcugcugcguggagcugugccugggcaacugcggccccagaagaggcagcgugaccgacauccccggcaccgccauggugagaggcggcggcuaa

SEQ ID NO: 24599 - RNA, 1974 nt, Artificial Sequence
  THOC1__Homo_sapiens__NP_005122
augagccccacccccccccuguucagccugcccgaggccagaaccagauucaccaagagcaccagagaggcccugaacaacaagaacaucaagccccugcugagcaccuucagccaggugcccggcagcgagaacgagaagaagugcacccuggaccaggccuucagaggcauccuggaggaggagaucaucaaccacagcagcugcgagaacgugcuggccaucaucagccuggccaucggcggcgugaccgagggcaucugcaccgccagcacccccuucgugcugcugggcgacgugcuggacugccugccccuggaccagugcgacaccaucuucaccuucguggagaagaacguggccaccuggaagagcaacaccuucuacagcgccggcaagaacuaccugcugagaaugugcaacgaccugcugagaagacugagcaagagccagaacaccguguucugcggcagaauccagcuguuccuggccagacuguucccccugagcgagaagagcggccugaaccugcagagccaguucaaccuggagaacgugaccguguucaacaccaacgagcaggagagcacccugggccagaagcacaccgaggacagagaggagggcauggacguggaggagggcgagaugggcgacgaggaggcccccaccaccugcagcauccccaucgacuacaaccuguacagaaaguucuggagccugcaggacuacuucagaaaccccgugcagugcuacgagaagaucagcuggaagaccuuccugaaguacagcgaggaggugcuggccguguucaagagcuacaagcuggacgacacccaggccagcagaaagaagauggaggagcugaagaccggcggcgagcacguguacuucgccaaguuccugaccagcgagaagcugauggaccugcagcugagcgacagcaacuucagaagacacauccugcugcaguaccugauccuguuccaguaccugaagggccaggugaaguucaagagcagcaacuacgugcugaccgacgagcagagccuguggaucgaggacaccaccaagagcguguaccagcugcugagcgagaacccccccgacggcgagagauucagcaagaugguggagcacauccugaacaccgaggagaacuggaacagcuggaagaacgagggcugccccagcuucgugaaggagagaaccagcgacaccaagcccaccagaaucaucagaaagagaaccgcccccgaggacuuccugggcaagggccccaccaagaagauccugaugggcaacgaggagcugaccagacuguggaaccugugccccgacaacauggaggccugcaagagcgagaccagagagcacaugcccacccuggaggaguucuucgaggaggccaucgagcaggccgaccccgagaacaugguggagaacgaguacaaggccgugaacaacagcaacuacggcuggagagcccugagacugcuggccagaagaagcccccacuucuuccagcccaccaaccagcaguucaagagccugcccgaguaccuggagaacauggugaucaagcuggccaaggagcugcccccccccagcgaggagaucaagaccggcgaggacgaggacgaggaggacaacgacgcccugcugaaggagaacgagagccccgacgugagaagagacaagcccgugaccggcgagcagaucgagguguucgccaacaagcugggcgagcaguggaagauccuggcccccuaccuggagaugaaggacagcgagaucagacagaucgagugcgacagcgaggacaugaagaugagagccaagcagcugcugguggccuggcaggaccaggagggcgugcacgccacccccgagaaccugaucaacgcccugaacaagagcggccugagcgaccuggccgagagccugaccaacgacaacgagaccaacagcuaa

SEQ ID NO: 24600 - RNA, 4782 nt, Artificial Sequence
  THOC2__Homo_sapiens__NP_001075019
auggccgccgccgccgugguggugcccgccgaguggaucaagaacugggagaagagcggcagaggcgaguuccugcaccugugcagaauccugagcgagaacaagagccacgacagcagcaccuacagagacuuccagcaggcccuguacgagcugagcuaccacgugaucaagggcaaccugaagcacgagcaggccagcaacgugcugagcgacaucagcgaguucagagaggacaugcccagcauccuggccgacguguucugcauccuggacaucgagaccaacugccuggaggagaagagcaagagagacuacuucacccagcuggugcuggccugccuguaccuggugagcgacaccgugcugaaggagagacuggaccccgagacccuggagagccugggccugaucaagcagagccagcaguucaaccagaagagcgugaagaucaagaccaagcuguucuacaagcagcagaaguucaaccugcugagagaggagaacgagggcuacgccaagcugaucgccgagcugggccaggaccugagcggcagcaucaccagcgaccugauccuggagaacaucaagagccugaucggcugcuucaaccuggaccccaacagagugcuggacgugauccuggagguguucgagugcagacccgagcacgacgacuucuucaucagccugcuggagagcuacaugagcaugugcgagccccagacccugugccacauccugggcuucaaguucaaguucuaccaggagcccaacggcgagacccccagcagccuguacagaguggccgccgugcugcugcaguucaaccugaucgaccuggacgaccuguacgugcaccugcugcccgccgacaacugcaucauggacgagcacaagagagagaucgccgaggccaagcagaucgugagaaagcugaccaugguggugcugagcagcgagaagauggacgagagagagaaggagaaggagaaggaggaggagaagguggagaagccccccgacaaccagaagcugggccugcuggaggcccugcugaagaucggcgacuggcagcacgcccagaacaucauggaccagaugccccccuacuacgccgccagccacaagcugaucgcccuggccaucugcaagcugauccacaucaccaucgagccccuguacagaagagugggcgugcccaagggcgccaagggcagccccgugaacgcccugcagaacaagagagcccccaagcaggccgagagcuucgaggaccugagaagagacguguucaacauguucugcuaccugggcccccaccugagccacgaccccauccuguucgccaagguggugagaaucggcaagagcuucaugaaggaguuccagagcgacggcagcaagcaggaggacaaggagaagaccgaggugauccugagcugccugcugagcaucaccgaccaggugcugcugcccagccugagccugauggacugcaacgccugcaugagcgaggagcuguggggcauguucaagaccuuccccuaccagcacagauacagacuguacggccaguggaagaacgagaccuacaacagccacccccugcuggugaaggugaaggcccagaccaucgacagagccaaguacaucaugaagagacugaccaaggagaacgugaagcccagcggcagacagaucggcaagcugagccacagcaaccccaccauccuguucgacuacauccugagccagauccagaaguacgacaaccugaucacccccgugguggacagccugaaguaccugaccagccugaacuacgacgugcuggccuacugcaucaucgaggcccuggccaaccccgagaaggagagaaugaagcacgacgacaccaccaucagcagcuggcugcagagccuggccagcuucugcggcgccguguucagaaaguaccccaucgaccuggccggccugcugcaguacguggccaaccagcugaaggccggcaagagcuucgaccugcugauccugaaggagguggugcagaagauggccggcaucgagaucaccgaggagaugaccauggagcagcuggaggccaugaccggcggcgagcagcugaaggccgagggcggcuacuucggccagaucagaaacaccaagaagagcagccagagacugaaggacgcccugcuggaccacgaccuggcccugccccugugccugcugauggcccagcagagaaacggcgugaucuuccaggagggcggcgagaagcaccugaagcuggugggcaagcuguacgaccagugccacgacacccuggugcaguucggcggcuuccuggccagcaaccugagcaccgaggacuacaucaagagagugcccagcaucgacgugcugugcaacgaguuccacaccccccacgacgccgccuucuuccugagcagacccauguacgcccaccacaucagcagcaaguacgacgagcugaagaagagcgagaagggcagcaagcagcagcacaaggugcacaaguacaucaccagcugcgagauggugauggcccccgugcacgaggccguggugagccugcacgugagcaaggugugggacgacaucagcccccaguucuacgccaccuucuggagccugaccauguacgaccuggccgugccccacaccagcuacgagagagaggugaacaagcugaaggugcagaugaaggccaucgacgacaaccaggagaugccccccaacaagaagaagaaggagaaggagagaugcaccgcccugcaggacaagcugcuggaggaggagaagaagcagauggagcacgugcagagagugcugcagagacugaagcuggagaaggacaacuggcugcuggccaagagcaccaagaacgagaccaucaccaaguuccugcagcugugcaucuuccccagaugcaucuucagcgccaucgacgccguguacugcgccagauucguggagcuggugcaccagcagaagacccccaacuucagcacccugcugugcuacgacagaguguucagcgacaucaucuacaccguggccagcugcaccgagaacgaggccagcagauacggcagauuccugugcugcaugcuggagaccgugaccagauggcacagcgacagagccaccuacgagaaggagugcggcaacuaccccggcuuccugaccauccugagagccaccggcuucgacggcggcaacaaggccgaccagcuggacuacgagaacuucagacacguggugcacaaguggcacuacaagcugaccaaggccagcgugcacugccuggagaccggcgaguacacccacaucagaaacauccugaucgugcugaccaagauccugcccugguaccccaaggugcugaaccugggccaggcccuggagagaagagugcacaagaucugccaggaggagaaggagaagagacccgaccuguacgcccuggccaugggcuacagcggccagcugaagagcagaaagagcuacaugauccccgagaacgaguuccaccacaaggaccccccccccagaaacgccguggccagcgugcagaacggccccggcggcggccccagcagcagcagcaucggcagcgccagcaagagcgacgagagcagcaccgaggagaccgacaagagcagagagagaagccagugcggcgugaaggccgugaacaaggccagcagcaccacccccaagggcaacagcagcaacggcaacagcggcagcaacagcaacaaggccgugaaggagaacgacaaggagaagggcaaggagaaggagaaggagaagaaggagaagacccccgccaccacccccgaggccagagugcugggcaaggacggcaaggagaagcccaaggaggagagacccaacaaggacgagaaggccagagagaccaaggagagaacccccaagagcgacaaggagaaggagaaguucaagaaggaggagaaggccaaggacgagaaguucaagaccaccgugcccaacgccgagagcaagagcacccaggagagagagagagagaaggagcccagcagagagagagacaucgccaaggagaugaagagcaaggagaacgugaagggcggcgagaagacccccgugagcggcagccugaagagccccgugcccagaagcgacauccccgagcccgagagagagcagaagagaagaaagaucgacacccaccccagccccagccacagcagcaccgugaaggacagccugaucgagcugaaggagagcagcgccaagcuguacaucaaccacaccccccccccccugagcaagagcaaggagagagagauggacaagaaggaccuggacaagagcagagagagaagcagagagagagagaagaaggacgagaaggacagaaaggagagaaagagagaccacagcaacaacgacagagaggugccccccgaccugaccaagagaagaaaggaggagaacggcaccaugggcgugagcaagcacaagagcgagagccccugcgagagccccuaccccaacgagaaggacaaggagaagaacaagagcaagagcagcggcaaggagaagggcagcgacagcuucaagagcgagaagauggacaagaucagcagcggcggcaagaaggagagcagacacgacaaggagaagaucgagaagaaggagaagagagacagcagcggcggcaaggaggagaagaagcaccacaagagcagcgacaagcacagauaa

SEQ ID NO: 24601 - RNA, 2052 nt, Artificial Sequence
  THOC5__Homo_sapiens__NP_001002878
augagcagcgagagcagcaagaagagaaagcccaaggugaucagaagcgacggcgcccccgccgagggcaagagaaacagaagcgacaccgagcaggagggcaaguacuacagcgaggaggccgagguggaccugagagaccccggcagagacuacgagcuguacaaguacaccugccaggagcugcagagacugauggccgagauccaggaccugaagagcagaggcggcaaggacguggccaucgagaucgaggagagaagaauccagagcugcgugcacuucaugacccugaagaagcugaacagacuggcccacaucagacugaagaagggcagagaccagacccacgaggccaagcagaagguggacgccuaccaccugcagcugcagaaccugcuguacgaggugaugcaccugcagaaggagaucaccaagugccuggaguucaagagcaagcacgaggagaucgaccuggugagccuggaggaguucuacaaggaggccccccccgacaucagcaaggccgaggugaccaugggcgacccccaccagcagacccuggccagacuggacugggagcuggagcagagaaagagacuggccgagaaguacagagagugccugagcaacaaggagaagauccugaaggagaucgaggugaagaaggaguaccugagcagccugcagcccagacugaacagcaucaugcaggccagccugcccgugcaggaguaccuguucaugcccuucgaccaggcccacaagcaguacgagaccgccagacaccugccccccccccuguacgugcuguucgugcaggccaccgccuacggccaggccugcgacaagacccugagcguggccaucgagggcagcguggacgaggccaaggcccuguucaagccccccgaggacagccaggacgacgagagcgacagcgacgccgaggaggagcagaccaccaagagaagaagacccacccugggcgugcagcuggacgacaagagaaaggagaugcugaagagacacccccugagcgugaugcuggaccugaagugcaaggacgacagcgugcugcaccugaccuucuacuaccugaugaaccugaacaucaugaccgugaaggccaaggugaccaccgccauggagcugaucacccccaucagcgccggcgaccugcugagccccgacagcgugcugagcugccuguaccccggcgaccacggcaagaagacccccaaccccgccaaccaguaccaguucgacaaggugggcauccugacccugagcgacuacgugcuggagcugggccaccccuaccugugggugcagaagcugggcggccugcacuuccccaaggagcagccccagcagaccgugaucgccgaccacagccugagcgccagccacauggagaccaccaugaagcugcugaagaccagagugcagagcagacuggcccugcacaagcaguucgccagccuggagcacggcaucgugcccgugaccagcgacugccaguaccuguuccccgccaagguggugagcagacuggugaagugggugaccguggcccacgaggacuacauggagcugcacuucaccaaggacaucguggacgccggccuggccggcgacaccaaccuguacuacauggcccugaucgagagaggcaccgccaagcugcaggccgccguggugcugaaccccggcuacagcagcaucccccccguguuccagcugugccugaacuggaagggcgagaagaccaacagcaacgacgacaacaucagagccauggagggcgaggugaacgugugcuacaaggagcugugcggccccuggcccagccaccagcugcugaccaaccagcugcagagacugugcgugcugcuggacguguaccuggagaccgagagccacgacgacagcguggagggccccaaggaguucccccaggagaagaugugccugagacuguucagaggccccagcagaaugaagcccuucaaguacaaccacccccagggcuucuucagccacagauaa

SEQ ID NO: 24602 - RNA, 891 nt, Artificial Sequence
  THOC6__Homo_sapiens__NP_001135822
auggagagagccgugccccuggccgugccccugggccagaccgagguguuccaggcccugcagagacugcacaugaccaucuucagccagagcgugagccccugcggcaaguuccuggccgccggcaacaacuacggccagaucgccaucuucagccugagcagcgcccugagcagcgaggccaaggaggagagcaagaagcccguggugaccuuccaggcccacgacggccccguguacagcauggugagcaccgacagacaccugcugagcgccggcgacggcgaggugaaggccuggcugugggccgagaugcugaagaagggcugcaaggagcuguggagaagacagccccccuacagaaccagccuggaggugcccgagaucaacgcccugcugcuggugcccaaggagaacagccugauccuggccggcggcgacugccagcugcacaccauggaccuggagaccggcaccuucaccagagugcugagaggccacaccgacuacauccacugccuggcccugagagagagaagccccgaggugcugagcggcggcgaggacggcgccgugagacugugggaccugagaaccgccaaggaggugcagaccaucgagguguacaagcacgaggagugcagcagaccccacaacggcagauggaucggcugccuggccaccgacagcgacuggauggugugcggcggcggccccgcccugacccuguggcaccugagaagcagcacccccaccaccaucuuccccaucagagccccccagaagcacgugaccuucuaccaggaccuggugcugaccgccgccggcaacagcugcagaguggacguguucaccaaccugggcuacagagccuucagccugagcuucuaa

SEQ ID NO: 24603 - RNA, 1134 nt, Artificial Sequence
  T__Homo_sapiens__NP_001257413
augagcagccccggcaccgagagcgccggcaagagccugcaguacagaguggaccaccugcugagcgccguggagaacgagcugcaggccggcagcgagaagggcgaccccaccgagagagagcugagagugggccuggaggagagcgagcuguggcugagauucaaggagcugaccaacgagaugaucgugaccaagaacggcagaagaauguuccccgugcugaaggugaacgugagcggccuggaccccaacgccauguacagcuuccugcuggacuucguggccgccgacaaccacagauggaaguacgugaacggcgagugggugcccggcggcaagcccgagccccaggcccccagcugcguguacauccaccccgacagccccaacuucggcgcccacuggaugaaggcccccgugagcuucagcaaggugaagcugaccaacaagcugaacggcggcggccagaucaugcugaacagccugcacaaguacgagcccagaauccacaucgugagagugggcggcccccagagaaugaucaccagccacugcuuccccgagacccaguucaucgccgugaccgccuaccagaacgaggagaucaccgcccugaagaucaaguacaaccccuucgccaaggccuuccuggacgccaaggagagaagcgaccacaaggagaugauggaggagcccggcgacagccagcagcccggcuacagccagagcuacagcgacaacagccccgccugccugagcaugcugcagagccacgacaacuggagcagccugggcaugcccgcccaccccagcaugcugcccgugagccacaacgccagcccccccaccagcagcagccaguaccccagccuguggagcgugagcaacggcgccgugacccccggcagccaggccgccgccgugagcaacggccugggcgcccaguucuucagaggcagccccgcccacuacaccccccugacccaccccgugagcgcccccagcagcagcggcagcccccuguacgagggcgccgccgccgccaccgacaucguggacagccaguacgacgccgccgcccagggcagacugaucgccagcuggacccccgugagcccccccagcauguaa

SEQ ID NO: 24604 - RNA, 2070 nt, Artificial Sequence
  THOP1__Homo_sapiens__NP_003240
augaagccccccgccgccugcgccggcgacauggccgacgccgccagccccugcagcguggugaacgaccugagaugggaccugagcgcccagcagaucgaggagagaaccagagagcugaucgagcagaccaagagaguguacgaccaggugggcacccaggaguucgaggacgugagcuacgagagcacccugaaggcccuggccgacguggaggugaccuacaccgugcagagaaacauccuggacuucccccagcacgugagccccagcaaggacaucagaaccgccagcaccgaggccgacaagaagcugagcgaguucgacguggagaugagcaugagagaggacguguaccagagaaucguguggcugcaggagaaggugcagaaggacagccugagacccgaggccgccagauaccuggagagacugaucaagcugggcagaagaaacggccugcaccugcccagagagacccaggagaacaucaagagaaucaagaagaagcugagccugcugugcaucgacuucaacaagaaccugaacgaggacaccaccuuccugcccuucacccugcaggagcugggcggccugcccgaggacuuccugaacagccuggagaagauggaggacggcaagcugaaggugacccugaaguacccccacuacuucccccugcugaagaagugccacgugcccgagaccagaagaaagguggaggaggccuucaacugcagaugcaaggaggagaacugcgccauccugaaggagcuggugacccugagagcccagaagagcagacugcugggcuuccacacccacgccgacuacgugcuggagaugaacauggccaagaccagccagaccguggccaccuuccuggacgagcuggcccagaagcugaagccccugggcgagcaggagagagccgugauccuggagcugaagagagccgagugcgagagaagaggccugcccuucgacggcagaaucagagccugggacaugagauacuacaugaaccagguggaggagaccagauacugcguggaccagaaccugcugaaggaguacuuccccgugcagguggugacccacggccugcugggcaucuaccaggagcugcugggccuggccuuccaccacgaggagggcgccagcgccuggcacgaggacgugagacuguacaccgccagagacgccgccagcggcgagguggugggcaaguucuaccuggaccuguaccccagagagggcaaguacggccacgccgccugcuucggccugcagcccggcugccugagacaggacggcagcagacagaucgccaucgccgccaugguggccaacuucaccaagcccaccgccgacgcccccagccugcugcagcacgacgagguggagaccuacuuccacgaguucggccacgugaugcaccagcugugcagccaggccgaguucgccauguucagcggcacccacguggagagagacuucguggaggcccccagccagaugcuggagaacugggugugggagcaggagccccugcugagaaugagcagacacuacagaaccggcagcgccgugcccagagagcugcuggagaagcugaucgagagcagacaggccaacaccggccuguucaaccugagacagaucgugcuggccaagguggaccaggcccugcacacccagaccgacgccgaccccgccgaggaguacgccagacugugccaggagauccugggcgugcccgccacccccggcaccaacaugcccgccaccuucggccaccuggccggcggcuacgacgcccaguacuacggcuaccuguggagcgagguguacagcauggacauguuccacaccagauucaagcaggagggcgugcugaacagcaaggugggcauggacuacagaagcugcauccugagacccggcggcagcgaggacgccagcgccaugcugagaagauuccugggcagagaccccaagcaggacgccuuccugcugagcaagggccugcaggugggcggcugcgagcccgagccccaggugugcuaa

SEQ ID NO: 24605 - RNA, 1482 nt, Artificial Sequence
  THPO__Homo_sapiens__NP_001276932
auggacccccccauccagaucuucagcguggugugcgugggcggcggcguggaccccggccccggcagaggcagcagagaggagaaggccagccugcccggcgccuucaccagcgugugguggcugcccagccugaucggccagaaguggcccagacaggccuacgaccugcugcuguggagaggcugcgccccccccccccacguguuccugcccaucugcagccccgagggcugccugcugugcaccugggugcuggagcccuucagcaccagaaucgacagcagcccccuggccagacugugccccacccugcugugccccgaggugcaggagcccaagcccccccccuggccccaggagggcuucagaggcgaggcccccaacagagagcccagacagcccgacacccccgccagaauggagcugaccgagcugcugcugguggugaugcugcugcugaccgccagacugacccugagcagccccgccccccccgccugcgaccugagagugcugagcaagcugcugagagacagccacgugcugcacagcagacugagccagugccccgaggugcacccccugcccacccccgugcugcugcccgccguggacuucagccugggcgaguggaagacccagauggaggagaccaaggcccaggacauccugggcgccgugacccugcugcuggagggcgugauggccgccagaggccagcugggccccaccugccugagcagccugcugggccagcugagcggccaggugagacugcugcugggcgcccugcagagccugcugggcacccagcugcccccccagggcagaaccaccgcccacaaggaccccaacgccaucuuccugagcuuccagcaccugcugagaggcaaggugagauuccugaugcuggugggcggcagcacccugugcgugagaagagccccccccaccaccgccgugcccagcagaaccagccuggugcugacccugaacgagcugcccaacagaaccagcggccugcuggagaccaacuucaccgccagcgccagaaccaccggcagcggccugcugaaguggcagcagggcuucagagccaagauccccggccugcugaaccagaccagcagaagccuggaccagauccccggcuaccugaacagaauccacgagcugcugaacggcaccagaggccuguuccccggccccagcagaagaacccugggcgcccccgacaucagcagcggcaccagcgacaccggcagccugccccccaaccugcagcccggcuacagccccagccccacccacccccccaccggccaguacacccuguucccccugccccccacccugcccacccccguggugcagcugcacccccugcugcccgaccccagcgcccccacccccacccccaccagcccccugcugaacaccagcuacacccacagccagaaccugagccaggagggcuaa

SEQ ID NO: 24606 - RNA, 1356 nt, Artificial Sequence
  THRA__Homo_sapiens__NP_001177847
auggagcagaagcccagcaagguggagugcggcagcgaccccgaggagaacagcgccagaagccccgacggcaagagaaagagaaagaacggccagugcagccugaagaccagcaugagcggcuacauccccagcuaccuggacaaggacgagcagugcguggugugcggcgacaaggccaccggcuaccacuacagaugcaucaccugcgagggcugcaagggcuucuucagaagaaccauccagaagaaccugcaccccaccuacagcugcaaguacgacagcugcugcgugaucgacaagaucaccagaaaccagugccagcugugcagauucaagaagugcaucgccgugggcauggccauggaccuggugcuggacgacagcaagagaguggccaagagaaagcugaucgagcagaacagagagagaagaagaaaggaggagaugaucagaagccugcagcagagacccgagcccacccccgaggagugggaccugauccacaucgccaccgaggcccacagaagcaccaacgcccagggcagccacuggaagcagagaagaaaguuccugcccgacgacaucggccagagccccaucgugagcaugcccgacggcgacaagguggaccuggaggccuucagcgaguucaccaagaucaucacccccgccaucaccagagugguggacuucgccaagaagcugcccauguucagcgagcugcccugcgaggaccagaucauccugcugaagggcugcugcauggagaucaugagccugagagccgccgugagauacgaccccgagagcgacacccugacccugagcggcgagauggccgugaagagagagcagcugaagaacggcggccugggcguggugagcgacgccaucuucgagcugggcaagagccugagcgccuucaaccuggacgacaccgagguggcccugcugcaggccgugcugcugaugagcaccgacagaagcggccugcugugcguggacaagaucgagaagagccaggaggccuaccugcuggccuucgagcacuacgugaaccacagaaagcacaacaucccccacuucuggcccaagcugcugaugaagggcccccaggugagacagcuggagcagcagcugggcgaggccggcagccugcagggccccgugcugcagcaccagagccccaagagcccccagcagagacugcuggagcugcugcacagaagcggcauccugcacgccagagccgugugcggcgaggacgacagcagcgaggccgacagccccagcagcagcgaggaggagcccgaggugugcgaggaccuggccggcaacgccgccagccccuaa

SEQ ID NO: 24607 - RNA, 1386 nt, Artificial Sequence
  THRB__Homo_sapiens__NP_001239563
augacccccaacagcaugaccgagaacggccugaccgccugggacaagcccaagcacugccccgacagagagcacgacuggaagcuggugggcaugagcgaggccugccugcacagaaagagccacagcgagagaagaagcacccugaagaacgagcagagcagcccccaccugauccagaccaccuggaccagcagcaucuuccaccuggaccacgacgacgugaacgaccagagcgugagcagcgcccagaccuuccagaccgaggagaagaagugcaagggcuacauccccagcuaccuggacaaggacgagcugugcguggugugcggcgacaaggccaccggcuaccacuacagaugcaucaccugcgagggcugcaagggcuucuucagaagaaccauccagaagaaccugcaccccagcuacagcugcaaguacgagggcaagugcgugaucgacaaggugaccagaaaccagugccaggagugcagauucaagaagugcaucuacgugggcauggccaccgaccuggugcuggacgacagcaagagacuggccaagagaaagcugaucgaggagaacagagagaagagaagaagagaggagcugcagaagagcaucggccacaagcccgagcccaccgacgaggagugggagcugaucaagaccgugaccgaggcccacguggccaccaacgcccagggcagccacuggaagcagaagagaaaguuccugcccgaggacaucggccaggcccccaucgugaacgcccccgagggcggcaagguggaccuggaggccuucagccacuucaccaagaucaucacccccgccaucaccagagugguggacuucgccaagaagcugcccauguucugcgagcugcccugcgaggaccagaucauccugcugaagggcugcugcauggagaucaugagccugagagccgccgugagauacgaccccgagagcgagacccugacccugaacggcgagauggccgugaccagaggccagcugaagaacggcggccugggcguggugagcgacgccaucuucgaccugggcaugagccugagcagcuucaaccuggacgacaccgagguggcccugcugcaggccgugcugcugaugagcagcgacagacccggccuggccugcguggagagaaucgagaaguaccaggacagcuuccugcuggccuucgagcacuacaucaacuacagaaagcaccacgugacccacuucuggcccaagcugcugaugaaggugaccgaccugagaaugaucggcgccugccacgccagcagauuccugcacaugaagguggagugccccaccgagcuguuccccccccuguuccuggagguguucgaggacuaa

SEQ ID NO: 24608 - RNA, 441 nt, Artificial Sequence
  THRSP__Homo_sapiens__NP_003242
augcaggugcugaccaagagauaccccaagaacugccugcugaccgugauggacagauacgccgccgaggugcacaacauggagcagguggugaugauccccagccugcugagagacgugcagcugagcggccccggcggccaggcccaggccgaggcccccgaccuguacaccuacuucaccaugcugaaggccaucugcguggacguggaccacggccugcugcccagagaggaguggcaggccaagguggccggcagcgaggagaacggcaccgccgagaccgaggagguggaggacgagagcgccagcggcgagcuggaccuggaggcccaguuccaccugcacuucagcagccugcaccacauccugaugcaccugaccgagaaggcccaggaggugaccagaaaguaccaggagaugaccggccaggugugguaa

SEQ ID NO: 24609 - RNA, 2559 nt, Artificial Sequence
  THSD1__Homo_sapiens__NP_061146
augaagcccaugcugaaggacuucagcaaccugcugcugguggugcugugcgacuacgugcugggcgaggccgaguaccugcugcugagagagcccggccacguggcccugagcaacgacaccguguacguggacuuccaguacuucgacggcgccaacggcacccugagaaacgugagcgugcugcugcuggaggccaacaccaaccagaccgugaccaccaaguaccugcugaccaaccagagccagggcacccugaaguucgagugcuucuacuucaaggaggccggcgacuacugguucaccaugacccccgaggccaccgacaacagcacccccuuccccuggugggagaagagcgccuuccugaagguggaguggcccguguuccacguggaccugaacagaagcgccaaggccgccgagggcaccuuccaggugggccuguucaccagccagccccugugccccuuccccguggacaagcccaacaucgugguggacgugaucuucaccaacagccugcccgaggccagaagaaacagcagacagccccuggagaucagaaccagcaagagaaccgagcuggcccagggccaguggguggaguucggcugcgccccccugggccccgaggccuacgugaccguggugcugaagcugcugggcagagacagcgugaucaccagcaccggccccaucgaccuggcccagaaguucggcuacaagcuggugauggugcccgagcugaccugcgagagcggcguggaggugaccgugcugcccccccccugcaccuucgugcagggcguggugaccguguucaaggaggcccccagauaccccggcaagagaaccauccaccuggccgagaacagccugccccugggcgagagaagaaccaucuucaacugcacccuguucgacaugggcaagaacaaguacugcuucgacuucggcaucagcagcagaagccacuucagcgccaaggaggagugcaugcugauccagagaaacaccgagaccuggggccuguggcagcccuggagccagugcagcgccaccugcggcgacggcgugagagagagaagaagagugugccugaccagcuuccccagcagccccgugugccccggcaugagccuggaggccagccugugcagccuggaggagugcgccgccuuccagcccagcagccccagcccccugcagccccagggccccgugaagagcaacaacaucgugaccgugaccggcaucagccugugccuguucaucaucaucgccaccgugcugaucacccuguggagaagauucggcagacccgccaagugcagcacccccgccagacacaacagcauccacagccccagcuucagaaagaacagcgacgaggagaacaucugcgagcugagcgagcagagaggcagcuucagcgacggcggcgacggccccaccggcagccccggcgacaccggcaucccccugaccuacagaagaagcggccccgugccccccgaggacgacgccagcggcagcgagagcuuccagagcaacgcccagaagaucauccccccccuguucagcuacagacuggcccagcagcagcugaaggagaugaagaagaagggccugaccgagaccaccaagguguaccacgugagccagagcccccugaccgacaccgccaucgacgccgcccccagcgccccccuggaccuggagagccccgaggaggccgccgccaacaaguucagaaucaagagccccuuccccgagcagcccgccgugagcgccggcgagagaccccccagcagacuggaccugaacgugacccaggccagcugcgccaucagccccagccagacccugaucagaaagagccaggccagacacgugggcagcagaggcggccccagcgagagaagccacgccagaaacgcccacuucagaagaaccgccagcuuccacgaggccagacaggccagacccuucagagagagaagcaugagcacccugacccccagacaggcccccgccuacagcagcagaaccagaaccugcgagcaggccgaggacagauucagaccccagagcagaggcgcccaccuguuccccgagaagcuggagcacuuccaggaggccagcggcaccagaggcccccugaacccccugcccaagagcuacacccugggccagccccugagaaagcccgaccugggcgaccaccaggccggccugguggccggcaucgagagaaccgagccccacagagccagaagaggccccagccccagccacaagagcgugagcagaaagcagagcagccccaucagccccaaggacaacuaccagagagugagcagccugagccccagccagugcagaaaggacaagugccagagcuuccccacccaccccgaguucgccuucuacgacaacaccagcuucggccugaccgaggccgagcagagaaugcuggaccugcccggcuacuucggcagcaacgaggaggacgagaccaccagcacccugagcguggagaagcuggugaucuaa

SEQ ID NO: 24610 - RNA, 1977 nt, Artificial Sequence
  THSD4__Homo_sapiens__NP_001273358
auguucgugagcuaccugauccugacccugcugcacgugcagaccgccgugcuggccagacccggcggcgagagcaucggcugcgacgacuaccugggcagcgacaaggugguggacaagugcggcgugugcggcggcgacaacaccggcugccagguggugagcggcguguucaagcacgcccugaccagccugggcuaccacagagugguggagauccccgagggcgccaccaagaucaacaucaccgagauguacaagagcaacaacuaccuggcccugagaagcagaagcggcagaagcaucaucaacggcaacugggccaucgacagacccggcaaguacgagggcggcggcaccauguucaccuacaagagacccaacgagaucagcagcaccgccggcgagagcuuccuggccgagggccccaccaacgagauccuggacguguacaugauccaccagcagcccaaccccggcgugcacuacgaguacgugaucaugggcaccaacgccaucagcccccaggugcccccccacagaagacccggcgagcccuucaacggccagauggugaccgagggcagaagccaggaggagggcgagcagaagggcagaaacgaggagaaggaggaccugagaggcgaggcccccgagauguucaccagcgagagcgcccagaccuuccccgugagacaccccgacagauucagcccccacagacccgacaaccuggugccccccgccccccagccccccagaagaagcagagaccacaacuggaagcagcugggcaccaccgagugcagcaccaccugcggcaagggcagccaguaccccaucuucagaugcgugcacagaagcacccacgaggaggcccccgagagcuacugcgacagcagcaugaagcccacccccgaggaggagcccugcaacaucuuccccugccccgccuucugggacaucggcgaguggagcgagugcagcaagaccugcggccugggcaugcagcacagacaggugcugugcagacagguguacgccaacagaagccugaccgugcagcccuacagaugccagcaccuggagaagcccgagaccaccagcaccugccagcugaagaucugcagcgaguggcagaucagaaccgacuggaccagcugcagcgugcccugcggcgugggccagagaaccagagacgugaagugcgugagcaacaucggcgacgugguggacgacgaggagugcaacaugaagcugagacccaacgacaucgagaacugcgacaugggccccugcgccaagagcugguuccugaccgaguggagcgagagaugcagcgccgagugcggcgccggcgugagaaccagaagcguggugugcaugaccaaccacgugagcagccugccccuggagggcugcggcaacaacagacccgccgaggccacccccugcgacaacggccccugcaccggcaagguggagugguucgccggcagcuggagccagugcagcaucgagugcggcagcggcacccagcagagagaggugaucugcgugagaaagaacgccgacaccuucgaggugcuggaccccagcgagugcagcuuccuggagaagccccccagccagcagagcugccaccugaagcccugcggcgccaagugguucagcaccgaguggagcaugugcagcaagagcugccagggcggcuucagagugagagaggugagaugccugagcgacgacaugacccugagcaaccugugcgacccccagcugaagcccgaggagagagagagcugcaacccccaggacugcgugcccgagguggacgagaacugcaaggacaaguacuacaacugcaacgugguggugcaggccagacugugcguguacaacuacuacaagaccgccugcugcgccagcugcaccagaguggccaacagacagaccggcuuccugggcagcagauaa

SEQ ID NO: 24611 - RNA, 4974 nt, Artificial Sequence
  THSD7A__Homo_sapiens__NP_056019
augggccugcaggccagaagaugggccagcggcagcagaggcgccgccggccccagaagaggcgugcugcagcugcugccccugccccugccccugccccugcugcugcugcugcugcugagacccggcgccggcagagccgccgcccagggcgaggccgaggcccccacccuguaccuguggaagaccggccccuggggcagaugcaugggcgacgagugcggccccggcggcauccagaccagagccguguggugcgcccacguggagggcuggaccacccugcacaccaacugcaagcaggccgagagacccaacaaccagcagaacugcuucaaggugugcgacuggcacaaggagcuguacgacuggagacugggccccuggaaccagugccagcccgugaucagcaagagccuggagaagccccuggagugcaucaagggcgaggagggcauccaggugagagagaucgccugcauccagaaggacaaggacauccccgccgaggacaucaucugcgaguacuucgagcccaagccccugcuggagcaggccugccugauccccugccagcaggacugcaucgugagcgaguucagcgccuggagcgagugcagcaagaccugcggcagcggccugcagcacagaaccagacacgugguggcccccccccaguucggcggcagcggcugccccaaccugaccgaguuccaggugugccagagcagccccugcgaggccgaggagcugagauacagccugcacgugggccccuggagcaccugcagcaugccccacagcagacaggugagacaggccagaagaagaggcaagaacaaggagagagagaaggacagaagcaagggcgugaaggaccccgaggccagagagcugaucaagaagaagagaaacagaaacagacagaacagacaggagaacaaguacugggacauccagaucggcuaccagaccagagaggugaugugcaucaacaagaccggcaaggccgccgaccugagcuucugccagcaggagaagcugcccaugaccuuccagagcugcgugaucaccaaggagugccaggugagcgaguggagcgaguggagccccugcagcaagaccugccacgacauggugagccccgccggcaccagagugagaaccagaaccaucagacaguuccccaucggcagcgagaaggagugccccgaguucgaggagaaggagcccugccugagccagggcgacggcguggugcccugcgccaccuacggcuggagaaccaccgaguggaccgagugcagaguggacccccugcugagccagcaggacaagagaagaggcaaccagaccgcccugugcggcggcggcauccagaccagagagguguacugcgugcaggccaacgagaaccugcugagccagcugagcacccacaagaacaaggaggccagcaagcccauggaccugaagcugugcaccggccccauccccaacaccacccagcugugccacauccccugccccaccgagugcgaggugagccccuggagcgccuggggccccugcaccuacgagaacugcaacgaccagcagggcaagaagggcuucaagcugagaaagagaagaaucaccaacgagcccaccggcggcagcggcgugaccggcaacugcccccaccugcuggaggccauccccugcgaggagcccgccugcuacgacuggaaggccgugagacugggcaacugcgagcccgacaacggcaaggagugcggccccggcacccaggugcaggagguggugugcaucaacagcgacggcgaggagguggacagacagcugugcagagacgccaucuuccccauccccguggccugcgacgcccccugccccaaggacugcgugcugagcaccuggagcaccuggagcagcugcagccacaccugcagcggcaagaccaccgagggcaagcagaucagagccagaagcauccuggccuacgccggcgaggagggcggcaucagaugccccaacagcagcgcccugcaggaggugagaagcugcaacgagcaccccugcaccguguaccacuggcagaccggccccuggggccagugcaucgaggacaccagcgugagcagcuucaacaccaccaccaccuggaacggcgaggccagcugcagcgugggcaugcagaccagaaaggugaucugcgugagagugaacgugggccaggugggccccaagaagugccccgagagccugagacccgagaccgugagacccugccugcugcccugcaagaaggacugcaucgugacccccuacagcgacuggaccagcugccccagcagcugcaaggagggcgacagcagcaucagaaagcagagcagacacagagugaucauccagcugcccgccaacggcggcagagacugcaccgacccccuguacgaggagaaggccugcgaggccccccaggccugccagagcuacagauggaagacccacaaguggagaagaugccagcuggugcccuggagcgugcagcaggacagccccggcgcccaggagggcugcggccccggcagacaggccagagccaucaccugcagaaagcaggacggcggccaggccggcauccacgagugccugcaguacgccggccccgugcccgcccugacccaggccugccagauccccugccaggacgacugccagcugaccagcuggagcaaguucagcagcugcaacggcgacugcggcgccgugagaaccagaaagagaacccuggugggcaagagcaagaagaaggagaagugcaagaacagccaccuguacccccugaucgagacccaguacugccccugcgacaaguacaacgcccagcccgugggcaacuggagcgacugcauccugcccgagggcaagguggaggugcugcugggcaugaaggugcagggcgacaucaaggagugcggccagggcuacagauaccaggccauggccugcuacgaccagaacggcagacugguggagaccagcagaugcaacagccacggcuacaucgaggaggccugcaucauccccugccccagcgacugcaagcugagcgaguggagcaacuggagcagaugcagcaagagcugcggcagcggcgugaaggugagaagcaaguggcugagagagaagcccuacaacggcggcagacccugccccaagcuggaccacgugaaccaggcccagguguacgagguggugcccugccacagcgacugcaaccaguaccugugggugaccgagcccuggagcaucugcaaggugaccuucgugaacaugagagagaacugcggcgagggcgugcagaccagaaaggugagaugcaugcagaacaccgccgacggccccagcgagcacguggaggacuaccugugcgaccccgaggagaugccccugggcagcagagugugcaagcugcccugccccgaggacugcgugaucagcgaguggggccccuggacccagugcgugcugcccugcaaccagagcagcuucagacagagaagcgccgaccccaucagacagcccgccgacgagggcagaagcugccccaacgccguggagaaggagcccugcaaccugaacaagaacugcuaccacuacgacuacaacgugaccgacuggagcaccugccagcugagcgagaaggccgugugcggcaacggcaucaagaccagaaugcuggacugcgugagaagcgacggcaagagcguggaccugaaguacugcgaggcccugggccuggagaagaacuggcagaugaacaccagcugcaugguggagugccccgugaacugccagcugagcgacuggagccccuggagcgagugcagccagaccugcggccugaccggcaagaugaucagaagaagaaccgugacccagcccuuccagggcgacggcagacccugccccagccugauggaccagagcaagcccugccccgugaagcccugcuacagauggcaguacggccaguggagccccugccaggugcaggaggcccagugcggcgagggcaccagaaccagaaacaucagcugcguggugagcgacggcagcgccgacgacuucagcaaggugguggacgaggaguucugcgccgacaucgagcugaucaucgacggcaacaagaacauggugcuggaggagagcugcagccagcccugccccggcgacugcuaccugaaggacuggagcagcuggagccugugccagcugaccugcgugaacggcgaggaccugggcuucggcggcauccaggugagaagcagacccgugaucauccaggagcuggagaaccagcaccugugccccgagcagaugcuggagaccaagagcugcuacgacggccagugcuacgaguacaaguggauggccagcgccuggaagggcagcagcagaaccguguggugccagagaagcgacggcaucaacgugaccggcggcugccuggugaugagccagcccgacgccgacagaagcugcaacccccccugcagccagccccacagcuacugcagcgagaccaagaccugccacugcgaggagggcuacaccgaggugaugagcagcaacagcacccuggagcagugcacccugauccccgugguggugcugcccaccauggaggacaagagaggcgacgugaagaccagcagagccgugcaccccacccagcccagcagcaaccccgccggcagaggcagaaccugguuccugcagcccuucggccccgacggcagacugaagaccuggguguacggcguggccgccggcgccuucgugcugcugaucuucaucgugagcaugaucuaccuggccugcaagaagcccaagaagccccagagaagacagaacaacagacugaagccccugacccuggccuacgacggcgacgccgacauguaa

SEQ ID NO: 24612 - RNA, 501 nt, Artificial Sequence
  THYN1__Homo_sapiens__NP_001032381
augagcagacccagaaagagacuggccggcaccagcggcagcgacaagggccugagcggcaagagaaccaagaccgagaacagcggcgaggcccuggccaagguggaggacagcaacccccagaagaccagcgccaccaagaacugccugaagaaccugagcagccacuggcugaugaagagcgagcccgagagcagacuggagaagggcguggacgugaaguucagcaucgaggaccugaaggcccagcccaagcagaccaccugcugggacggcgugagaaacuaccaggccagaaacuuccugagagccaugaagcugggcgaggaggccuucuucuaccacagcaacugcaaggagcccggcaucgccggccugaugaagaucgugaaggaggccuaccccgaccacacccaguucgagaagaacaacccccacuacgaccccagcagcaaggaggacaaccccaaguggagcaugaagagccugauccuguucuaa

SEQ ID NO: 24613 - RNA, 1128 nt, Artificial Sequence
  TIA1__Homo_sapiens__NP_071320
auggaggacgagaugcccaagacccuguacgugggcaaccugagcagagacgugaccgaggcccugauccugcagcuguucagccagaucggccccugcaagaacugcaagaugaucauggacaccgccggcaacgaccccuacugcuucguggaguuccacgagcacagacacgccgccgccgcccuggccgccaugaacggcagaaagaucaugggcaaggaggugaaggugaacugggccaccacccccagcagccagaagaaggacaccagcaaccacuuccacguguucgugggcgaccugagccccgagaucaccaccgaggacaucaaggccgccuucgcccccuucggcagaaucagcgacgccagaguggugaaggacauggccaccggcaagagcaagggcuacggcuucgugagcuucuucaacaagugggacgccgagaacgccauccagcagaugggcggccaguggcugggcggcagacagaucagaaccaacugggccaccagaaagccccccgcccccaagagcaccuacgagagcaacaccaagcagcugagcuacgacgagguggugaaccagagcagccccagcaacugcaccguguacugcggcggcgugaccagcggccugaccgagcagcugaugagacagaccuucagccccuucggccagaucauggagaucagaguguuccccgacaagggcuacagcuucgugagauucaacagccacgagagcgccgcccacgccaucgugagcgugaacggcaccaccaucgagggccacguggugaagugcuacuggggcaaggagacccuggacaugaucaaccccgugcagcagcagaaccagaucggcuacccccagcccuacggccaguggggccagugguacggcaacgcccagcagaucggccaguacaugcccaacggcuggcaggugcccgccuacggcauguacggccaggccuggaaccagcagggcuucaaccagacccagagcagcgcccccuggaugggccccaacuacggcgugcagcccccccagggccagaacggcagcaugcugcccaaccagcccagcggcuacagaguggccggcuacgagacccaguaa

SEQ ID NO: 24614 - RNA, 348 nt, Artificial Sequence
  TIAF1__Homo_sapiens__NP_004731
augagcagccccagcagccccuucagagagcagagcuuccugugcgccgccggcgacgccggcgaggagagcagagugcaggugcugaagaacgaggugagaagaggcagccccgugcugcugggcuggguggagcaggccuacgccgacaagugcgugugcggccccagcgccccccccgcccccaccccccccagccugagccagagagugaugugcaacgaccuguucaaggugaaccccuuccagcugcagcaguucagagccgaccccagcaccgccagccugcugcugugccccggcggccuggaccacaagcugaaccugagaggcaaggccuggggcuaa

SEQ ID NO: 24615 - RNA, 1179 nt, Artificial Sequence
  TIAL1__Homo_sapiens__NP_001029097
augauggaggacgacggccagcccagaacccuguacgugggcaaccugagcagagacgugaccgaggugcugauccugcagcuguucagccagaucggccccugcaagagcugcaagaugaucaccgagcagcccgacagcagaagagugaacagcagcgugggcuucagcgugcugcagcacaccagcaacgaccccuacugcuucguggaguucuacgagcacagagacgccgccgccgcccuggccgccaugaacggcagaaagauccugggcaaggaggugaaggugaacugggccaccacccccagcagccagaagaaggacaccagcaaccacuuccacguguucgugggcgaccugagccccgagaucaccaccgaggacaucaagagcgccuucgcccccuucggcaagaucagcgacgccagaguggugaaggacauggccaccggcaagagcaagggcuacggcuucgugagcuucuacaacaagcuggacgccgagaacgccaucgugcacaugggcggccaguggcugggcggcagacagaucagaaccaacugggccaccagaaagccccccgcccccaagagcacccaggagaacaacaccaagcagcugagauucgaggacguggugaaccagagcagccccaagaacugcaccguguacugcggcggcaucgccagcggccugaccgaccagcugaugagacagaccuucagccccuucggccagaucauggagaucagaguguuccccgagaagggcuacagcuucgugagauucagcacccacgagagcgccgcccacgccaucgugagcgugaacggcaccaccaucgagggccacguggugaagugcuacuggggcaaggagagccccgacaugaccaagaacuuccagcagguggacuacagccaguggggccaguggagccagguguacggcaacccccagcaguacggccaguacauggccaacggcuggcaggugccccccuacggcguguacggccagcccuggaaccagcagggcuucggcguggaccagagccccagcgccgccuggaugggcggcuucggcgcccagcccccccagggccaggcccccccccccgugauccccccccccaaccaggccggcuacggcauggccagcuaccagacccaguaa

SEQ ID NO: 24616 - RNA, 4776 nt, Artificial Sequence
  TIAM1__Homo_sapiens__XP_005261095
augggcaacgccgagagccagcacguggagcacgaguucuacggcgagaagcacgccagccugggcagaaagcacaccagcagaagccugagacugagccacaagaccagaagaaccagacacgccagcagcggcaaggugauccacagaaacagcgaggugagcaccagaagcagcagcacccccagcaucccccagagccuggccgagaacggccuggagcccuucagccaggacggcacccuggaggacuucggcagccccaucuggguggacagaguggacaugggccugagacccgugagcuacaccgacagcagcgugacccccagcguggacagcagcaucgugcugaccgccgccagcgugcagagcaugcccgacaccgaggagagcagacuguacggcgacgacgccaccuaccuggccgagggcggcagaagacagcacagcuacaccagcaacggccccaccuucauggagaccgccagcuucaagaagaagagaagcaagagcgccgacaucuggagagaggacagccuggaguucagccugagcgaccugagccaggagcaccugaccagcaacgaggagauccugggcagcgccgaggagaaggacugcgaggaggccagaggcauggagaccagagccagccccagacagcugagcaccugccagagagccaacagccugggcgaccuguacgcccagaagaacagcggcgugaccgccaacggcggccccggcagcaaguucgccggcuacugcagaaaccuggugagcgacauccccaaccuggccaaccacaagaugccccccgccgccgccgaggagaccccccccuacagcaacuacaacacccugcccugcagaaagagccacugccugagcgagggcgccaccaacccccagaucagccacagcaacagcaugcagggcagaagagccaagaccacccaggacgugaacgccggcgagggcagcgaguucgccgacagcggcaucgagggcgccaccaccgacaccgaccugcugagcagaagaagcaacgccaccaacagcagcuacagccccaccaccggcagagccuucgugggcagcgacagcggcagcagcagcaccggcgacgccgccagacagggcguguacgagaacuucagaagagagcuggagaugagcaccaccaacagcgagagccuggaggaggccggcagcgcccacagcgacgagcagagcagcggcacccugagcagccccggccagagcgacauccugcugaccgccgcccagggcaccgugagaaaggccggcgcccuggccgugaagaacuuccuggugcacaagaagaacaagaagguggagagcgccaccagaagaaaguggaagcacuacugggugagccugaagggcugcacccuguucuucuacgagagcgacggcagaagcggcaucgaccacaacagcauccccaagcacgccguguggguggagaacagcaucgugcaggccgugcccgagcaccccaagaaggacuucguguucugccugagcaacagccugggcgacgccuuccuguuccagaccaccagccagaccgagcuggagaacuggaucaccgccauccacagcgccugcgccaccgccguggccagacaccaccacaaggaggacacccugagacugcugaagagcgagaucaagaagcuggagcagaagaucgacauggacgagaagaugaagaagaugggcgagaugcagcugagcagcgugaccgacagcaagaagaagaagaccauccuggaccagaucuucgugugggagcagaaccuggagcaguuccagauggaccuguucagauucagaugcuaccuggccagccugcagggcggcgagcugcccaaccccaagagacugcuggccuucgccagcagacccaccaagguggccaugggcagacugggcaucuucagcgugagcagcuuccacgcccugguggccgccagaaccggcgagaccggcgugagaagaagaacccaggccaugagcagaagcgccagcaagagaagaagcagauucagcagccuguggggccuggacaccaccagcaagaagaagcagggcagacccagcaucaaccagguguucggcgagggcaccgaggccgugaagaagagccuggagggcaucuucgacgacaucgugcccgacggcaagagagagaaggagguggugcugcccaacgugcaccagcacaaccccgacugcgacaucugggugcacgaguacuucacccccagcugguucugccugcccaacaaccagcccgcccugaccguggugagacccggcgacaccgccagagacacccuggagcugaucugcaagacccaccagcuggaccacagcgcccacuaccugagacugaaguuccugaucgagaacaagaugcagcuguacgugccccagcccgaggaggacaucuacgagcugcuguacaaggagaucgagaucugccccaaggugacccagagcauccacaucgagaagagcgacaccgccgccgacaccuacggcuucagccugagcagcguggaggaggacggcaucagaagacuguacgugaacagcgugaaggagaccggccuggccagcaagaagggccugaaggccggcgacgagauccuggagaucaacaacagagccgccgacgcccugaacagcagcaugcugaaggacuuccugagccagcccagccugggccugcuggugagaaccuaccccgagcuggaggagggcguggagcugcuggagagccccccccacagaguggacggccccgccgaccugggcgagagcccccuggccuuccugaccagcaaccccggccacagccugugcagcgagcagggcagcagcgccgagaccgcccccgaggagaccgagggccccgaccuggagagcagcgacgagaccgaccacagcagcaagagcaccgagcagguggccgccuucugcagaagccugcacgagaugaaccccagcgaccagagccccagcccccaggacagcaccggcccccagcuggccaccaugagacagcugagcgacgccgacaagcugagaaaggugaucugcgagcugcuggagaccgagagaaccuacgugaaggaccugaacugccugauggagagauaccugaagccccugcagaaggagaccuuccugacccaggacgagcuggacgugcuguucggcaaccugaccgagaugguggaguuccagguggaguuccugaagacccuggaggacggcgugagacuggugcccgaccuggagaagcuggagaagguggaccaguucaagaaggugcuguucagccugggcggcagcuuccuguacuacgccgacagauucaagcuguacagcgccuucugcgccagccacaccaaggugcccaaggugcuggugaaggccaagaccgacaccgccuucaaggccuuccuggacgcccagaaccccaagcagcagcacagcagcacccuggagagcuaccugaucaagcccauccagagaauccugaaguacccccugcugcugagagagcuguucgcccugaccgacgccgagagcgaggagcacuaccaccuggacguggccaucaagaccaugaacaagguggccagccacaucaacgagaugcagaagauccacgaggaguucggcgccguguucgaccagcugaucgccgagcagaccggcgagaagaaggagguggccgaccugagcaugggcgaccugcugcugcacaccaccgugaucuggcugaacccccccgccagccugggcaaguggaagaaggagcccgagcuggccgccuucguguucaagaccgccguggugcugguguacaaggacggcagcaagcagaagaagaagcuggugggcagccacagacugagcaucuacgaggacugggaccccuucagauucagacacaugauccccaccgaggcccugcaggugagagcccuggccagcgccgacgccgaggccaacgccgugugcgagaucgugcacgugaagagcgagagcgagggcagacccgagagaguguuccaccugugcugcagcagccccgagagcagaaaggacuuccugaaggccgugcacagcauccugagagacaagcacagaagacagcugcugaagaccgagagccugcccagcagccagcaguacgugcccuucggcggcaagagacugugcgcccugaagggcgccagacccgccaugagcagagccgugagcgcccccagcaagagccugggcagaagaagaagaagacuggccagaaacagauucaccaucgacagcgacgccgugagcgccagcagccccgagaaggagagccagcagccccccggcggcggcgacaccgacagauggguggaggagcaguucgaccuggcccaguacgaggagcaggacgacaucaaggagaccgacauccugagcgacgacgacgaguucugcgagagcgugaagggcgccagcguggacagagaccugcaggagagacugcaggccaccagcaucagccagagagagagaggcagaaagacccuggacagccacgccagcagaauggcccagcugaagaagcaggccgcccugagcggcaucaacggcggccuggagagcgccagcgaggaggugaucugggugagaagagaggacuucgcccccagcagaaagcugaacaccgagaucuaa

SEQ ID NO: 24617 - RNA, 5106 nt, Artificial Sequence
  TIAM2__Homo_sapiens__NP_036586
augggcaacagcgacagccaguacacccugcagggcagcaagaaccacagcaacaccaucaccggcgccaagcagauccccugcagccugaagaucagaggcauccacgccaaggaggagaagagccugcacggcuggggccacggcagcaacggcgccggcuacaagagcagaagccuggccagaagcugccugagccacuucaagagcaaccagcccuacgccagcagacugggcggccccaccugcaaggugagcagaggcguggccuacagcacccacagaaccaacgcccccggcaaggacuuccagggcaucagcgccgccuucagcaccgagaacggcuuccacagcgugggccacgagcuggccgacaaccacaucaccagcagagacugcaacggccaccugcugaacugcuacggcagaaacgagagcaucgccagcaccccccccggcgaggacagaaagagccccagagugcugaucaagacccugggcaagcuggacggcugccugagaguggaguuccacaacggcggcaaccccagcaaggugcccgccgaggacugcagcgagcccgugcagcugcugagauacagccccacccuggccagcgagaccagccccgugcccgaggccagaagaggcagcagcgccgacagccugcccagccacagacccagccccaccgacagcagacugagaagcagcaagggcagcagccugagcagcgagagcagcugguacgacagccccuggggcaacgccggcgagcugagcgaggccgagggcagcuuccuggcccccggcaugcccgaccccagccugcacgccagcuucccccccggcgacgccaagaagcccuucaaccagagcagcagccugagcagccugagagagcuguacaaggacgccaaccugggcagccugagccccagcggcaucagacugagcgacgaguacaugggcacccacgccagccugagcaacagagugagcuucgccagcgacaucgacgugcccagcagaguggcccacggcgaccccauccaguacagcagcuucacccugcccugcagaaagcccaaggccuucguggaggacaccgccaagaaggacagccugaaggccagaaugagaagaaucagcgacuggaccggcagccugagcagaaagaagagaaagcugcaggagcccagaagcaaggagggcagcgacuacuucgacagcagaagcgacggccugaacaccgacgugcagggcagcagccaggccagcgccuuccuguggagcggcggcagcacccagauccugagccagagaagcgagagcacccacgccaucggcagcgacccccugagacagaacaucuacgagaacuucaugagagagcuggagaugagcagaaccaacaccgagaacaucgagaccagcaccgagaccgccgagagcagcagcgagagccugagcagccuggagcagcuggaccugcuguucgagaaggagcagggcguggugagaaaggccggcuggcuguucuucaagccccuggugaccgugcagaaggagagaaagcuggagcugguggccagaagaaaguggaagcaguacugggugacccugaagggcugcacccugcuguucuacgagaccuacggcaagaacagcauggaccagagcagcgcccccagaugcgcccuguucgccgaggacagcaucgugcagagcgugcccgagcaccccaagaaggagaacguguucugccugagcaacagcuucggcgacguguaccuguuccaggccaccagccagaccgaccuggagaacugggugaccgccgugcacagcgccugcgccagccuguucgccaagaagcacggcaaggaggacacccugagacugcugaagaaccagaccaagaaccugcugcagaagaucgacauggacagcaagaugaagaagauggccgagcugcagcugagcguggugagcgaccccaagaacagaaaggccaucgagaaccagauccagcagugggagcagaaccuggagaaguuccacauggaccuguucagaaugagaugcuaccuggccagccugcagggcggcgagcugcccaaccccaagagccugcuggccgccgccagcagacccagcaagcuggcccugggcagacugggcauccugagcgugagcagcuuccacgcccuggugugcagcagagacgacagcgcccugagaaagagaacccugagccugacccagagaggcagaaacaagaagggcaucuucagcagccugaagggccuggacacccuggccagaaagggcaaggagaagagacccagcaucacccagguggacgagcugcugcacaucuacggcagcaccguggacggcgugcccagagacaacgccugggagauccagaccuacgugcacuuccaggacaaccacggcgugaccgugggcaucaagcccgagcacagaguggaggacauccugacccuggccugcaagaugagacagcuggagcccagccacuacggccugcagcugagaaagcugguggacgacaacguggaguacugcauccccgcccccuacgaguacaugcagcagcagguguacgacgagaucgagguguucccccugaacguguacgacgugcagcugaccaagaccggcagcgugugcgacuucggcuucgccgugaccgcccagguggacgagagacagcaccugagcagaaucuucaucagcgacgugcugcccgacggccuggccuacggcgagggccugagaaagggcaacgagaucaugacccugaacggcgaggccgugagcgaccuggaccugaagcagauggaggcccuguucagcgagaagagcgugggccugacccugaucgccagaccccccgacaccaaggccacccugugcaccagcuggagcgacagcgaccuguucagcagagaccagaagagccugcugcccccccccaaccagagccagcugcuggaggaguuccuggacaacuucaagaagaacaccgccaacgacuucagcaacgugcccgacaucaccaccggccugaagagaagccagaccgacggcacccuggaccaggugagccacagagagaagauggagcagaccuucagaagcgccgagcagaucaccgcccugugcagaagcuucaacgacagccaggccaacggcauggagggccccagagagaaccaggaccccccccccagaccccuggccagacaccugagcgacgccgacagacugagaaaggugauccaggagcugguggacaccgagaagagcuacgugaaggaccugagcugccuguucgagcuguaccuggagccccugcagaacgagaccuuccugacccaggacgagauggagagccuguucggcagccugcccgagaugcuggaguuccagaagguguuccuggagacccuggaggacggcaucagcgccagcagcgacuucaacacccuggagacccccagccaguucagaaagcugcuguucagccugggcggcagcuuccuguacuacgccgaccacuucaagcuguacagcggcuucugcgccaaccacaucaaggugcagaaggugcuggagagagccaagaccgacaaggccuucaaggccuuccuggacgccagaaaccccaccaagcagcacagcagcacccuggagagcuaccugaucaagcccgugcagagagugcugaaguacccccugcugcugaaggagcuggugagccugaccgaccaggagagcgaggagcacuaccaccugaccgaggcccugaaggccauggagaagguggccagccacaucaacgagaugcagaagaucuacgaggacuacggcaccguguucgaccagcugguggccgagcagagcggcaccgagaaggaggugaccgagcugagcaugggcgagcugcugaugcacagcaccgugagcuggcugaaccccuuccugagccugggcaaggccagaaaggaccuggagcugaccguguucguguucaagagagccgugauccugguguacaaggagaacugcaagcugaagaagaagcugcccagcaacagcagacccgcccacaacagcaccgaccuggaccccuucaaguucagauggcugauccccaucagcgcccugcaggugagacugggcaaccccgccggcaccgagaacaacagcaucugggagcugauccacaccaagagcgagaucgagggcagacccgagaccaucuuccagcugugcugcagcgacagcgagagcaagaccaacaucgugaaggugaucagaagcauccugagagagaacuucagaagacacaucaagugcgagcugccccuggagaagaccugcaaggacagacuggugccccugaagaacagagugcccgugagcgccaagcuggccagcagcagaagccugaaggugcugaagaacagcagcagcaacgaguggaccggcgagaccggcaagggcacccugcuggacagcgacgagggcagccugagcagcggcacccagagcagcggcugccccaccgccgagggcagacaggacagcaagagcaccagccccggcaaguacccccaccccggccuggccgacuucgccgacaaccugaucaaggagagcgacauccugagcgacgaggacgacgaccacagacagaccgugaagcagggcagccccaccaaggacaucgagauccaguuccagagacugagaaucagcgaggaccccgacgugcaccccgaggccgagcagcagcccggccccgagagcggcgagggccagaagggcggcgagcagcccaagcuggugagaggccacuucugccccaucaagagaaaggccaacagcaccaagagagacagaggcacccugcugaaggcccagaucagacaccagagccuggacagccagagcgagaacgccaccaucgaccugaacagcgugcuggagagagaguucagcgugcagagccugaccagcguggugagcgaggagugcuucuacgagaccgagagccacggcaagagcuaa

SEQ ID NO: 24618 - RNA, 2139 nt, Artificial Sequence
  TICAM1__Homo_sapiens__NP_891549
auggccugcaccggccccagccugcccagcgccuucgacauccugggcgccgccggccaggacaagcugcuguaccugaagcacaagcugaagacccccagacccggcugccagggccaggaccugcugcacgccauggugcugcugaagcugggccaggagaccgaggccagaaucagccuggaggcccugaaggccgacgccguggccagacugguggccagacagugggccggcguggacagcaccgaggaccccgaggagccccccgacgugagcugggccguggccagacuguaccaccugcuggccgaggagaagcugugccccgccagccugagagacguggccuaccaggaggccgugagaacccugagcagcagagacgaccacagacugggcgagcugcaggacgaggccagaaacagaugcggcugggacaucgccggcgaccccggcagcaucagaacccugcagagcaaccugggcugccugccccccagcagcgcccugcccagcggcaccagaagccugcccagacccaucgacggcgugagcgacuggagccagggcugcagccugagaagcaccggcagccccgccagccuggccagcaaccuggagaucagccagagccccaccaugcccuuccugagccugcacagaagcccccacggccccagcaagcugugcgacgacccccaggccagccuggugcccgagcccgugcccggcggcugccaggagcccgaggagaugagcuggccccccagcggcgagaucgccagcccccccgagcugcccagcagccccccccccggccugcccgagguggcccccgacgccaccagcaccggccugcccgacacccccgccgcccccgagaccagcaccaacuaccccguggagugcaccgagggcagcgccggcccccagagccugccccugcccauccuggagcccgugaagaaccccugcagcgugaaggaccagaccccccugcagcugagcguggaggacaccaccagccccaacaccaagcccugcccccccacccccaccacccccgagaccagcccccccccccccccccccccccccagcagcacccccugcagcgcccaccugacccccagcagccuguuccccagcagccuggagagcagcagcgagcagaaguucuacaacuucgugauccugcacgccagagccgacgagcacaucgcccugagagugagagagaagcuggaggcccugggcgugcccgacggcgccaccuucugcgaggacuuccaggugcccggcagaggcgagcugagcugccugcaggacgccaucgaccacagcgccuucaucauccugcugcugaccagcaacuucgacugcagacugagccugcaccaggugaaccaggccaugaugagcaaccugaccagacagggcagccccgacugcgugauccccuuccugccccuggagagcagccccgcccagcugagcagcgacaccgccagccugcugagcggccuggugagacuggacgagcacagccagaucuucgccagaaagguggccaacaccuucaagccccacagacugcaggccagaaaggccauguggagaaaggagcaggacaccagagcccugagagagcagagccagcaccuggacggcgagagaaugcaggccgccgcccugaacgccgccuacagcgccuaccugcagagcuaccugagcuaccaggcccagauggagcagcugcagguggccuucggcagccacaugagcuucggcaccggcgcccccuacggcgccagaaugcccuucggcggccaggugccccugggcgcccccccccccuuccccaccuggcccggcugcccccagccccccccccugcacgccuggcaggccggcaccccccccccccccagcccccagcccgccgccuucccccagagccugcccuucccccagagccccgccuuccccaccgccagccccgcccccccccagagccccggccugcagccccugaucauccaccacgcccagauggugcagcugggccugaacaaccacauguggaaccagagaggcagccaggcccccgaggacaagacccaggaggccgaguaa

SEQ ID NO: 24619 - RNA, 708 nt, Artificial Sequence
  TICAM2__Homo_sapiens__NP_067681
augggcaucggcaagagcaagaucaacagcugcccccugagccugagcuggggcaagagacacagcguggacaccagccccggcuaccacgagagcgacagcaagaagagcgaggaccugagccugugcaacguggccgagcacagcaacaccaccgagggccccaccggcaagcaggagggcgcccagagcguggaggagauguucgaggaggaggccgaggaggagguguuccugaaguucgugauccugcacgccgaggacgacaccgacgaggcccugagagugcagaaccugcugcaggacgacuucggcaucaagcccggcaucaucuucgccgagaugcccugcggcagacagcaccugcagaaccuggacgacgccgugaacggcagcgccuggaccauccugcugcugaccgagaacuuccugagagacaccuggugcaacuuccaguucuacaccagccugaugaacagcgugaacagacagcacaaguacaacagcgugauccccaugagaccccugaacaacccccugcccagagagagaacccccuucgcccugcagaccaucaacgcccuggaggaggagagcagaggcuuccccacccagguggagagaaucuuccaggagagcguguacaagacccagcagaccaucuggaaggagaccagaaacauggugcagagacaguucaucgccuaa

SEQ ID NO: 24620 - RNA, 5733 nt, Artificial Sequence
  TICRR__Homo_sapiens__NP_689472
auggccugcugccacaaggugaugcugcugcuggacaccgccggcggcgccgccagacacagcagagugagaagagccgcccugagacugcugaccuaccugagcugcagauucggccuggccagagugcacugggccuucaaguucuucgacagccagggcgccagaagcagacccagcagagugagcgacuucagagagcugggcagcagaagcugggaggacuucgaggaggagcuggaggccagacuggaggacagagcccaccugcccggccccgcccccagagccacccacacccacggcgcccugauggagacccugcuggacuaccagugggacagacccgagaucaccagccccaccaagcccauccugagaagcagcggcagaagacugcuggacguggagagcgaggccaaggaggccgaggccgcccugggcggccuggugaacgccguguuccugcuggcccccugcccccacagccagagagagcugcugcaguucgugagcggcugcgaggcccaggcccagagacugccccccacccccaagcaggugauggagaagcugcugcccaagagagugagagaggugaugguggccagaaagaucaccuucuacuggguggacaccaccgaguggagcaagcugugggagagccccgaccaccugggcuacuggaccgugugcgagcugcugcaccacggcggcggcaccgugcugcccagcgagagcuucagcugggacuucgcccaggccggcgagaugcugcugagaagcggcaucaagcugagcagcgagccccaccugagccccuggaucagcaugcugcccaccgacgccacccugaacagacugcuguacaacagccccgaguacgaggccagcuuccccagaauggagggcaugcuguuccugcccguggaggccggcaaggagauccaggagaccuggaccgugacccuggagccccuggccaugcaccagagacacuuccagaagcccgugagaaucuuccugaagggcagcguggcccaguggagccugcccaccagcagcacccugggcaccgacagcuggaugcugggcagccccgaggagagcaccgccacccagagacugcuguuccagcagcuggugagcagacugaccgccgaggagcugcaccugguggccgacguggaccccggcgagggcagaccccccaucaccggcgugaucagcccccugagcgccagcgccaugauccugaccgugugcagaaccaaggaggccgaguuccagagacacgugcugcagaccgccguggccgacagccccagagacaccgccagccuguucagcgacgugguggacagcauccugaaccagacccacgacagccuggccgacaccgccagcgccgccagccccgugcccgagugggcccagcaggagcugggccacaccacccccuggagccccgccgugguggagaagugguuccccuucugcaacaucagcggcgccagcagcgaccugauggagagcuucggccugcugcaggccgccagcgccaacaaggaggagagcagcaagaccgagggcgagcugauccacugccuggccgagcuguaccagagaaagagcagagaggagagcaccaucgcccaccaggaggacagcaagaagaagagaggcgugcccagaacccccgugagacagaagaugaacaccaugugcagaagccugaagaugcugaacguggccagacugaacgugaaggcccagaagcugcaccccgacggcagccccgacguggccggcgagaagggcauccagaagauccccagcggcagaaccguggacaagcuggaggacagaggcagaacccugagaagcagcaagcccaaggacuucaagaccgaggaggagcugcugagcuacaucagagagaacuaccagaagaccguggccaccggcgagaucaugcuguacgccugcgccagaaacaugaucagcaccgugaagauguuccugaagagcaagggcaccaaggagcuggaggugaacugccugaaccaggugaagagcagccugcugaagaccagcaagagccugagacagaaccugggcaagaagcuggacaaggaggacaaggugagagagugccagcugcagguguuccugagacuggagaugugccugcagugccccagcaucaacgagagcaccgacgacauggagcaggugguggaggaggugaccgaccugcugagaauggugugccugaccgaggacagcgccuaccuggccgaguuccuggaggagauccugagacuguacaucgacagcauccccaagacccugggcaaccuguacaacagccugggcuucgugaucccccagaagcuggccggcgugcugcccaccgacuucuucagcgacgacagcaugacccaggagaacaagagcccccugcugagcgugcccuuccugagcagcgccagaagaagcgugagcggcagccccgagagcgacgagcugcaggagcugagaaccagaagcgccaagaagagaagaaagaacgcccugaucagacacaagagcaucgccgaggugagccagaaccugagacagaucgagauccccaaggugagcaagagagccaccaagaaggagaacagccaccccgccccccagcagcccagccagcccgugaaggacaccgugcaggaggugaccaaggugagaagaaaccuguucaaccaggagcugcugagccccagcaagagaagccugaagagaggccugcccagaagccacagcgugagcgccguggacggccuggaggacaagcuggacaacuucaagaagaacaagggcuaccacaagcugcugaccaagagcguggccgagacccccgugcacaagcagaucagcaagagacugcugcacagacagaucaagggcagaagcagcgaccccggccccgacaucggcgugguggaggagagccccgagaagggcgacgagaucagccugagaagaagccccagaaucaagcagcugagcuucagcagaacccacagcgccagcuucuacagcgugagccagcccaagagcagaagcgugcagagagugcacagcuuccagcaggacaagagcgaccagagagagaacagccccgugcagagcaucagaagccccaagagccugcuguucggcgccaugagcgagaugaucagccccagcgagaagggcagcgccagaaugaagaagagaagcagaaacacccuggacagcgaggugcccgccgccuaccagacccccaagaagagccaccagaagagccugagcuucagcaagaccacccccagaagaaucagccacaccccccagaccccccuguacacccccgagagacugcagaagagccccgccaagaugacccccaccaagcaggccgccuucaaggagagccugaaggacagcagcagccccggccacgacagcccccuggacagcaagaucaccccccagaagagacacacccaggccggcgagggcaccagccuggagaccaagacccccagaacccccaagagacagggcacccagccccccggcuuccugcccaacugcaccuggccccacagcgugaacagcagccccgagagccccagcugccccgccccccccaccagcagcaccgcccagcccagaagagagugccugacccccaucagagacccccugagaaccccccccagagccgccgccuucaugggcaccccccagaaccagacccaccagcagccccacgugcugagagccgccagagccgaggagcccgcccagaagcugaaggacaaggccaucaagacccccaagagacccggcaacagcaccgugaccagcagcccccccgugacccccaagaagcuguucaccagcccccugugcgacgugagcaagaagagccccuucagaaagagcaagaucgagugccccagccccggcgagcuggaccagaaggagccccagaugagccccagcguggccgccagccugagcugccccgugcccagcaccccccccgagcugagccagagagccacccuggacaccgugcccccccccccccccagcaaggugggcaagagaugcagaaagaccagcgaccccagaagaagcaucguggagugccagcccgacgccagcgccacccccggcgugggcaccgccgacagccccgccgcccccaccgacagcagagacgaccagaagggccugagccugagcccccagagcccccccgagagaagaggcuaccccggccccggccugagaagcgacuggcacgccagcagcccccugcugaucaccagcgacaccgagcacgugacccugcugagcgaggccgagcaccacggcaucggcgaccugaagagcaacgugcugagcguggaggagggcgagggccugagaaccgccgacgccgagaagagcagccugagccaccccggcaucccccccagcccccccagcugcggccccggcagcccccugaugcccagcagagacgugcacugcaccaccgacggcagacagugccaggccagcgcccagcuggacaaccugcccgccagcgccuggcacagcaccgacagcgccagcccccagaccuacgagguggagcuggagaugcaggccagcggccugcccaagcugagaaucaagaagaucgaccccagcagcagccuggaggccgagccccugagcaaggaggagagcagccugggcgaggagagcuuccugcccgcccugagcaugcccagagccagcagaagccugagcaagcccgagcccaccuacgugagcccccccugccccagacugagccacagcacccccggcaagagcagaggccagaccuacaucugccaggccugcacccccacccacggccccagcagcacccccagccccuuccagaccgacggcgugcccuggacccccagccccaagcacagcggcaagaccacccccgacaucaucaaggacuggcccagaagaaagagagccgugggcugcggcgccggcagcagcagcggcagaggcgaggugggcgccgaccugcccggcagccugagccugcuggagagcgagggcaaggaccacggccuggagcugagcauccacagaacccccauccuggaggacuucgagcuggagggcgugugccagcugcccgaccagagcccccccagaaacagcaugcccaaggccgaggaggccagcagcuggggccaguucggccugagcagcagaaagagagugcugcuggccaaggaggaggccgacagaggcgccaagagaaucugcgaccugagagaggacagcgaggugagcaagagcaaggagggcagccccagcuggagcgccuggcagcugcccagcaccggcgacgaggagguguucgugagcggcagcacccccccccccagcugcgccgugagaagcugccugagcgccagcgcccugcaggcccugacccagagcccccugcuguuccagggcaagacccccagcagccagagcaaggaccccagagacgaggacguggacgugcugcccagcaccguggaggacagccccuucagcagagccuucagcagaagaagacccaucagcagaaccuacaccagaaagaagcugaugggcaccuggcuggaggaccuguaa

SEQ ID NO: 24621 - RNA, 555 nt, Artificial Sequence
  TIFA__Homo_sapiens__NP_443096
augaccagcuucgaggacgccgacaccgaggagaccgugaccugccugcagaugaccguguaccaccccggccagcugcagugcggcaucuuccagagcaucagcuucaacagagagaagcugcccagcagcgagguggugaaguucggcagaaacagcaacaucugccacuacaccuuccaggacaagcaggugagcagagugcaguucagccugcagcuguucaagaaguucaacagcagcgugcugagcuucgagaucaagaacaugagcaagaagaccaaccugaucguggacagcagagagcugggcuaccugaacaagauggaccugcccuacagaugcauggugagauucggcgaguaccaguuccugauggagaaggaggacggcgagagccuggaguucuucgagacccaguucauccugagccccagaagccugcugcaggagaacaacuggcccccccacagacccauccccgaguacggcaccuacagccugugcagcagccagagcagcagccccaccgagauggacgagaacgagagcuaa

SEQ ID NO: 24622 - RNA, 1578 nt, Artificial Sequence
  TIGD2__Homo_sapiens__NP_663761
augcugggcaagagaaagagaguggugcugaccaucaaggacaagcuggacaucaucaagaagcuggaggagggcaucagcuucaagaagcugagcgugguguacggcaucggcgagagcaccgugagagacaucaagaagaacaaggagagaaucaucaacuacgccaacagcagcgaccccaccagcggcgugagcaagagaaagagcaugaagagcagcaccuacgaggagcuggacagagugaugaucgagugguucaaccagcagaagaccgacggcauccccgugagcggcaccaucugcgccaagcaggccaaguucuucuucgacgcccugggcauggagggcgacuucaacgccagcagcggcuggcugaccagauucaagcagagacacggcauccccaaggccgccggcaagggcaccaagcugaagggcgacgagaccgccgccagagaguucugcggcagcuuccaggaguucguggagaaggagaaccugcagcccgagcagaucuacggcgccgaccagaccggccuguucuggaagugccugcccagcagaacccugacccuggagaccgaccagagcaccagcggcugcagaagcagcagagagagaaucaucaucaugugcugcgccaacgccaccggccugcacaagcugaaccugugcguggugggcaaggccaagaagcccagagccuucaagggcaccgaccugagcaaccugcccgugaccuacuacagccagaagggcgccuggaucgagcagagcguguucagacagugguucgagaaguacuucgugccccaggugcagaagcaccugaagagcaagggccugcuggagaaggccgugcugcugcuggacuucccccccgccagacccaacgaggagaugcugagcagcgacgacggcagaaucaucgugaaguaccugccccccaacgugaccagccugauccagcccaugagccagggcgugcuggccaccgugaagagauacuacagagccggccugcugcagaaguacauggacgagggcaacgaccccaagaucuucuggaagaaccugaccgugcuggacgccaucuacgaggugagcagagccuggaacauggugaagagcagcaccaucaccaaggccuggaagaagcuguuccccggcaacgaggagaacagcggcaugaacaucgacgagggcgccauccuggccgccaaccuggccaccgugcugcagaacaccgaggagugcgagcacguggacaucgagaacaucgaccagugguucgacagcagaagcagcgacagcagcugccaggugcugaccgacagcgagagcgccgaggaccagaccaaggccgccgagcagaagcccagcagcaagagcagaaagaccgagcugaaccccgagaagcacaucagccacaaggccgcccuggaguggaccgagaaccugcuggacuaccuggagcagcaggacgacaugcugcugagcgacaagcuggugcugagaagacugagaaccaucaucagaaagaagcagaagauccagaacaacaagaaccacuaa

SEQ ID NO: 24623 - RNA, 735 nt, Artificial Sequence
  TIGIT__Homo_sapiens__NP_776160
augagauggugccugcugcugaucugggcccagggccugagacaggccccccuggccagcggcaugaugaccggcaccaucgagaccaccggcaacaucagcgccgagaagggcggcagcaucauccugcagugccaccugagcagcaccaccgcccaggugacccaggugaacugggagcagcaggaccagcugcuggccaucugcaacgccgaccugggcuggcacaucagccccagcuucaaggacagaguggcccccggccccggccugggccugacccugcagagccugaccgugaacgacaccggcgaguacuucugcaucuaccacaccuaccccgacggcaccuacaccggcagaaucuuccuggaggugcuggagagcagcguggccgagcacggcgccagauuccagaucccccugcugggcgccauggccgccacccugguggugaucugcaccgccgugaucguggugguggcccugaccagaaagaagaaggcccugagaauccacagcguggagggcgaccugagaagaaagagcgccggccaggaggaguggagccccagcgcccccagcccccccggcagcugcgugcaggccgaggccgcccccgccggccugugcggcgagcagagaggcgaggacugcgccgagcugcacgacuacuucaacgugcugagcuacagaagccugggcaacugcagcuucuucaccgagaccggcuaa

SEQ ID NO: 24624 - RNA, 1053 nt, Artificial Sequence
  TIMD4__Homo_sapiens__NP_001140198
augagcaaggagccccugauccuguggcugaugaucgaguucugguggcuguaccugacccccgugaccagcgagaccguggugaccgaggugcugggccacagagugacccugcccugccuguacagcagcuggagccacaacagcaacagcaugugcuggggcaaggaccagugccccuacagcggcugcaaggaggcccugaucagaaccgacggcaugagagugaccagcagaaagagcgccaaguacagacugcagggcaccauccccagaggcgacgugagccugaccauccugaaccccagcgagagcgacagcggcguguacugcugcagaaucgaggugcccggcugguucaacgacgugaagaucaacgugagacugaaccugcagagagccagcaccaccacccacagaaccgccaccaccaccaccagaagaaccaccaccaccagccccaccaccaccagacagaugaccaccacccccgccgcccugcccaccaccguggugaccacccccgaccugaccaccggcaccccccugcagaugaccaccaucgccguguucaccaccgccaacaccugccugagccugacccccagcacccugcccgaggaggccaccggccugcugacccccgagcccagcaaggagggccccauccugaccgccgagagcgagaccgugcugcccagcgacagcuggagcagcguggagagcaccagcgccgacaccgugcugcugaccagcaaggccagcgacaccgccgugcccgagcagaacaagaccaccaagaccggccagauggacggcauccccaugagcaugaagaacgagaugcccaucagccagcugcugaugaucaucgcccccagccugggcuucgugcuguucgcccuguucguggccuuccugcugagaggcaagcugauggagaccuacugcagccagaagcacaccagacuggacuacaucggcgacagcaagaacgugcugaacgacgugcagcacggcagagaggacgaggacggccuguucacccuguaa

SEQ ID NO: 24625 - RNA, 3627 nt, Artificial Sequence
  TIMELESS__Homo_sapiens__NP_003911
auggaccugcacaugaugaacugcgagcugcuggccaccugcagcgcccugggcuaccuggagggcgacaccuaccacaaggagcccgacugccuggagagcgugaaggaccugaucagauaccugagacacgaggacgagaccagagacgugagacagcagcugggcgccgcccagauccugcagagcgaccugcugcccauccugacccagcaccaccaggacaagccccuguucgacgccgugaucagacugauggugaaccugacccagcccgcccugcugugcuucggcaaccugcccaaggagcccagcuucagacaccacuuccugcaggugcugaccuaccugcaggccuacaaggaggccuucgccagcgagaaggccuucggcgugcugagcgagacccuguacgagcugcugcagcugggcugggaggagagacaggaggaggacaaccugcugaucgagagaauccugcugcuggugagaaacauccugcacgugcccgccgaccuggaccaggagaagaagaucgacgacgacgccagcgcccacgaccagcugcugugggccauccaccugagcggccuggacgaccugcugcuguuccuggccagcagcagcgccgaggagcaguggagccugcacgugcuggagaucgugagccugauguucagagaccagaaccccgagcagcuggccggcgugggccagggcagacuggcccaggagagaagcgccgacuucgccgagcuggaggugcugagacagagagagauggccgagaagaagaccagagcccugcagagaggcaacagacacagcagauucggcggcagcuacaucgugcagggccugaagagcaucggcgagagagaccugaucuuccacaagggccugcacaaccugagaaacuacagcagcgaccugggcaagcagcccaagaaggugcccaagagaagacaggccgccagagagcugagcauccagagaagaagcgcccugaacgugagacuguuccugagagacuucugcagcgaguuccuggagaacugcuacaacagacugaugggcagcgugaaggaccaccugcugagagagaaggcccagcagcacgacgagaccuacuacaugugggcccuggccuucuucauggccuucaacagagccgccagcuucagacccggccuggugagcgagacccugagcgugagaaccuuccacuucaucgagcagaaccugaccaacuacuacgagaugaugcugaccgacagaaaggaggccgccagcugggccagaagaaugcaccuggcccugaaggccuaccaggagcugcuggccaccgugaacgagauggacaucagccccgacgaggccgugagagagagcagcagaaucaucaagaacaacaucuucuacgugauggaguacagagagcuguuccuggcccuguucagaaaguucgacgagagaugccagcccagaagcuuccugagagaccugguggagaccacccaccuguuccugaagaugcuggagagauucugcagaagcagaggcaaccugguggugcagaacaagcagaagaagagaagaaagaagaagaagaaggugcuggaccaggccaucgugagcggcaacgugcccagcagccccgaggagguggaggccguguggcccgcccuggccgagcagcugcagugcugcgcccagaacagcgagcugagcauggacagcguggugcccuucgacgccgccagcgaggugcccguggaggagcagagagccgaggccauggugagaauccaggacugccugcuggccggccaggccccccaggcccugacccugcugagaagcgccagagagguguggcccgagggcgacguguucggcagccaggacaucagccccgaggaggagauccagcugcugaagcagauccugagcgccccccugcccagacagcagggccccgaggagagaggcgccgaggaggaggaggaggaggaggaggaggaggaggaggagcugcagguggugcaggugagcgagaaggaguucaacuuccuggacuaccugaagagauucgccugcagcaccguggugagagccuacgugcugcugcugagaagcuaccagcagaacagcgcccacaccaaccacugcaucgugaagaugcugcacagacuggcccacgaccugaagauggaggcccugcuguuccagcugagcguguucugccuguucaacagacugcugagcgaccccgccgccggcgccuacaaggagcuggugaccuucgccaaguacauccugggcaaguucuucgcccuggccgccgugaaccagaaggccuucguggagcugcuguucuggaagaacaccgccguggugagagagaugaccgagggcuacggcagccuggacgacagaagcagcagcagaagagcccccaccuggagccccgaggaggaggcccaccugagagagcuguaccuggccaacaaggacguggagggccaggacgugguggaggccauccuggcccaccugaacaccgugcccagaaccagaaagcagaucauccaccaccuggugcagaugggccuggccgacagcgugaaggacuuccagagaaagggcacccacaucgugcuguggaccggcgaccaggagcuggagcugcagagacuguucgaggaguucagagacagcgacgacgugcugggccacaucaugaagaacaucaccgccaagagaagcagagccagaaucguggacaagcugcuggcccugggccugguggccgagagaagagagcuguacaagaagagacagaagaagcuggccagcagcauccugcccaacggcgccgagagccugaaggacuucugccaggaggaccuggaggaggaggagaaccugcccgaggaggacagcgaggaggaggaggagggcggcagcgaggccgagcaggugcagggcagccuggugcugagcaacgagaaccugggccagagccugcaccaggagggcuucagcaucccccugcuguggcugcagaacugccugaucagagccgccgacgacagagaggaggacggcugcagccaggccgugccccuggugccccugaccgaggagaacgaggaggccauggagaacgagcaguuccagcagcugcugagaaagcugggcgugagaccccccgccagcggccaggagaccuucuggagaauccccgccaagcugagccccacccagcugagaagagccgccgccagccugagccagcccgaggaggagcagaagcugcagcccgagcugcagcccaaggugcccggcgagcagggcagcgacgaggagcacugcaaggagcacagagcccaggcccugagagcccugcugcuggcccacaagaagaaggccggccuggccagccccgaggaggaggacgccgugggcaaggagccccugaaggccgcccccaagaagagacagcugcuggacagcgacgaggagcaggaggaggacgagggcagaaacagagcccccgagcugggcgcccccggcauccagaagaagaagagauaccagaucgaggacgacgaggacgacuaa

SEQ ID NO: 24626 - RNA, 273 nt, Artificial Sequence
  TIMM10__Homo_sapiens__NP_036588
auggacccccugagagcccagcagcuggccgccgagcuggagguggagaugauggccgacauguacaacagaaugaccagcgccugccacagaaagugcgugcccccccacuacaaggaggccgagcugagcaagggcgagagcgugugccuggacagaugcgugagcaaguaccuggacauccacgagagaaugggcaagaagcugaccgagcugagcaugcaggacgaggagcugaugaagagagugcagcagagcagcggccccgccuaa

SEQ ID NO: 24627 - RNA, 516 nt, Artificial Sequence
  TIMM17A__Homo_sapiens__NP_006326
auggaggaguacgccagagagcccugccccuggagaaucguggacgacugcggcggcgccuucaccaugggcaccaucggcggcggcaucuuccaggccaucaagggcuucagaaacagccccgugggcgugaaccacagacugagaggcagccugaccgccaucaagaccagagccccccagcugggcggcagcuucgccguguggggcggccuguucagcaugaucgacugcagcauggugcaggugagaggcaaggaggaccccuggaacagcaucaccagcggcgcccugaccggcgccauccuggccgccagaaacggccccguggccauggugggcagcgccgccaugggcggcauccugcuggcccugaucgagggcgccggcauccugcugaccagauucgccagcgcccaguuccccaacggcccccaguucgccgaggaccccagccagcugcccagcacccagcugcccagcagccccuucggcgacuacagacaguaccaguaa
